United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 28

SEQ ID NO: 1024586 - RNA, 18 nt, Mycobacterium avium subsp. paratuberculosis
ccagcugcaccggggccg

SEQ ID NO: 1024587 - RNA, 21 nt, Mycobacterium avium subsp. paratuberculosis
ccagcugcaccggggccggcg

SEQ ID NO: 1024588 - RNA, 15 nt, Mycobacterium avium subsp. paratuberculosis
ccagcugcuggaauc

SEQ ID NO: 1024589 - RNA, 21 nt, Mycobacterium avium subsp. paratuberculosis
ccagcuggauggcgcccagcc

SEQ ID NO: 1024590 - RNA, 22 nt, Mycobacterium avium subsp. paratuberculosis
ccagcuggauggcgcccagccc

SEQ ID NO: 1024591 - RNA, 22 nt, Mycobacterium avium subsp. paratuberculosis
ccagcuuagguucguccaccuc

SEQ ID NO: 1024592 - RNA, 14 nt, Mycobacterium avium subsp. paratuberculosis
ccagcugcccacca

SEQ ID NO: 1024593 - RNA, 22 nt, Mycobacterium avium subsp. paratuberculosis
ccagcuguugacgggccgcggc

SEQ ID NO: 1024594 - RNA, 14 nt, Mycobacterium avium subsp. paratuberculosis
ccagcugucccagu

SEQ ID NO: 1024595 - RNA, 18 nt, Mycobacterium avium subsp. paratuberculosis
ccagcuggugaagcugcc

SEQ ID NO: 1024596 - RNA, 15 nt, Mycobacterium avium subsp. paratuberculosis
ccagcugggcagcca

SEQ ID NO: 1024597 - RNA, 16 nt, Mycobacterium avium subsp. paratuberculosis
ccagcugggcagccag

SEQ ID NO: 1024598 - RNA, 17 nt, Mycobacterium avium subsp. paratuberculosis
ccagcugggcagccaga

SEQ ID NO: 1024599 - RNA, 14 nt, Mycobacterium avium subsp. paratuberculosis
ccagcugggccgcc

SEQ ID NO: 1024600 - RNA, 24 nt, Mycobacterium avium subsp. paratuberculosis
ccagcucuucauagcugaucacau

SEQ ID NO: 1024601 - RNA, 21 nt, Mycobacterium avium subsp. paratuberculosis
ccagcugauagccgcccugcc

SEQ ID NO: 1024602 - RNA, 14 nt, Mycobacterium avium subsp. paratuberculosis
ccagcucgucgccg

SEQ ID NO: 1024603 - RNA, 17 nt, Mycobacterium avium subsp. paratuberculosis
ccagcucgucgccgacc

SEQ ID NO: 1024604 - RNA, 20 nt, Mycobacterium avium subsp. paratuberculosis
ccagcucgucgcggaacagc

SEQ ID NO: 1024605 - RNA, 18 nt, Mycobacterium avium subsp. paratuberculosis
ccagcucguugccggcgg

SEQ ID NO: 1024606 - RNA, 19 nt, Mycobacterium avium subsp. paratuberculosis
ccagcucguugccggcggc

SEQ ID NO: 1024607 - RNA, 13 nt, Mycobacterium avium subsp. paratuberculosis
ccagcucggcccg

SEQ ID NO: 1024608 - RNA, 15 nt, Mycobacterium avium subsp. paratuberculosis
ccagcucggcggcca

SEQ ID NO: 1024609 - RNA, 19 nt, Mycobacterium avium subsp. paratuberculosis
ccagcucgcguucgggccc

SEQ ID NO: 1024610 - RNA, 18 nt, Mycobacterium avium subsp. paratuberculosis
ccagggcucgugcagccg

SEQ ID NO: 1024611 - RNA, 17 nt, Mycobacterium avium subsp. paratuberculosis
ccagggcgaucaccgcg

SEQ ID NO: 1024612 - RNA, 23 nt, Mycobacterium avium subsp. paratuberculosis
ccagguauucgcgggaggacagc

SEQ ID NO: 1024613 - RNA, 23 nt, Mycobacterium avium subsp. paratuberculosis
ccagguauucguugcccugccug

SEQ ID NO: 1024614 - RNA, 13 nt, Mycobacterium avium subsp. paratuberculosis
ccagguccuugag

SEQ ID NO: 1024615 - RNA, 12 nt, Mycobacterium avium subsp. paratuberculosis
ccagguccggga

SEQ ID NO: 1024616 - RNA, 18 nt, Mycobacterium avium subsp. paratuberculosis
ccagguccgggcacucga

SEQ ID NO: 1024617 - RNA, 15 nt, Mycobacterium avium subsp. paratuberculosis
ccagguccucgcugg

SEQ ID NO: 1024618 - RNA, 17 nt, Mycobacterium avium subsp. paratuberculosis
ccagguccaccccgcca

SEQ ID NO: 1024619 - RNA, 14 nt, Mycobacterium avium subsp. paratuberculosis
ccagggcggcgccg

SEQ ID NO: 1024620 - RNA, 17 nt, Mycobacterium avium subsp. paratuberculosis
ccagggccgcgagcgcu

SEQ ID NO: 1024621 - RNA, 17 nt, Mycobacterium avium subsp. paratuberculosis
ccagggccgggcgugcc

SEQ ID NO: 1024622 - RNA, 17 nt, Mycobacterium avium subsp. paratuberculosis
ccagggcagccagcccg

SEQ ID NO: 1024623 - RNA, 13 nt, Mycobacterium avium subsp. paratuberculosis
ccagggcagcgcc

SEQ ID NO: 1024624 - RNA, 17 nt, Mycobacterium avium subsp. paratuberculosis
ccaggcguuugguguga

SEQ ID NO: 1024625 - RNA, 14 nt, Mycobacterium avium subsp. paratuberculosis
ccaggcucgcuccc

SEQ ID NO: 1024626 - RNA, 18 nt, Mycobacterium avium subsp. paratuberculosis
ccaggcucgcucccgcgc

SEQ ID NO: 1024627 - RNA, 21 nt, Mycobacterium avium subsp. paratuberculosis
ccaggcggaucacaucggaca

SEQ ID NO: 1024628 - RNA, 19 nt, Mycobacterium avium subsp. paratuberculosis
ccaggcugcucggcgggcu

SEQ ID NO: 1024629 - RNA, 22 nt, Mycobacterium avium subsp. paratuberculosis
ccaggcugaacaccaccaggcc

SEQ ID NO: 1024630 - RNA, 14 nt, Mycobacterium avium subsp. paratuberculosis
ccaggcuggccagg

SEQ ID NO: 1024631 - RNA, 15 nt, Mycobacterium avium subsp. paratuberculosis
ccaggcuggccaggc

SEQ ID NO: 1024632 - RNA, 13 nt, Mycobacterium avium subsp. paratuberculosis
ccaggcuugcccc

SEQ ID NO: 1024633 - RNA, 17 nt, Mycobacterium avium subsp. paratuberculosis
ccaggcuugccccguac

SEQ ID NO: 1024634 - RNA, 14 nt, Mycobacterium avium subsp. paratuberculosis
ccaggcuuggcccg

SEQ ID NO: 1024635 - RNA, 16 nt, Mycobacterium avium subsp. paratuberculosis
ccaggcuuggcccgcc

SEQ ID NO: 1024636 - RNA, 18 nt, Mycobacterium avium subsp. paratuberculosis
ccaggcuuggcccgccgc

SEQ ID NO: 1024637 - RNA, 22 nt, Mycobacterium avium subsp. paratuberculosis
ccagggacaugccgagcagcac

SEQ ID NO: 1024638 - RNA, 20 nt, Mycobacterium avium subsp. paratuberculosis
ccaggccgugaucggccuuc

SEQ ID NO: 1024639 - RNA, 20 nt, Mycobacterium avium subsp. paratuberculosis
ccaggccgucggcgcggccg

SEQ ID NO: 1024640 - RNA, 19 nt, Mycobacterium avium subsp. paratuberculosis
ccaggccggcgagcucgcg

SEQ ID NO: 1024641 - RNA, 21 nt, Mycobacterium avium subsp. paratuberculosis
ccaggccgaguauccgcgcag

SEQ ID NO: 1024642 - RNA, 17 nt, Mycobacterium avium subsp. paratuberculosis
ccaggccgcggucgccc

SEQ ID NO: 1024643 - RNA, 16 nt, Mycobacterium avium subsp. paratuberculosis
ccaggccgcgagcacg

SEQ ID NO: 1024644 - RNA, 13 nt, Mycobacterium avium subsp. paratuberculosis
ccaggccgcgccg

SEQ ID NO: 1024645 - RNA, 19 nt, Mycobacterium avium subsp. paratuberculosis
ccaggccgccagcucgucc

SEQ ID NO: 1024646 - RNA, 19 nt, Mycobacterium avium subsp. paratuberculosis
ccaggcccugccagcgccc

SEQ ID NO: 1024647 - RNA, 17 nt, Mycobacterium avium subsp. paratuberculosis
ccaggcccucgccgcgg

SEQ ID NO: 1024648 - RNA, 12 nt, Mycobacterium avium subsp. paratuberculosis
ccaggcccggca

SEQ ID NO: 1024649 - RNA, 14 nt, Mycobacterium avium subsp. paratuberculosis
ccaggcccaggccg

SEQ ID NO: 1024650 - RNA, 14 nt, Mycobacterium avium subsp. paratuberculosis
ccaggcccaccguc

SEQ ID NO: 1024651 - RNA, 15 nt, Mycobacterium avium subsp. paratuberculosis
ccaggcccagcagca

SEQ ID NO: 1024652 - RNA, 17 nt, Mycobacterium avium subsp. paratuberculosis
ccaggcccagcccaccg

SEQ ID NO: 1024653 - RNA, 17 nt, Mycobacterium avium subsp. paratuberculosis
ccaggcccagcccggcc

SEQ ID NO: 1024654 - RNA, 22 nt, Mycobacterium avium subsp. paratuberculosis
ccaggcccagcccggccccacc

SEQ ID NO: 1024655 - RNA, 16 nt, Mycobacterium avium subsp. paratuberculosis
ccaggccuugucgucc

SEQ ID NO: 1024656 - RNA, 22 nt, Mycobacterium avium subsp. paratuberculosis
ccaggcgaaguuggucaccacc

SEQ ID NO: 1024657 - RNA, 15 nt, Mycobacterium avium subsp. paratuberculosis
ccaggcgaccggccc

SEQ ID NO: 1024658 - RNA, 15 nt, Mycobacterium avium subsp. paratuberculosis
ccaggcgcaccagcu

SEQ ID NO: 1024659 - RNA, 16 nt, Mycobacterium avium subsp. paratuberculosis
ccaggcgaugaagccg

SEQ ID NO: 1024660 - RNA, 19 nt, Mycobacterium avium subsp. paratuberculosis
ccaggcgccacagcagcac

SEQ ID NO: 1024661 - RNA, 13 nt, Mycobacterium avium subsp. paratuberculosis
ccaggcgccgucg

SEQ ID NO: 1024662 - RNA, 13 nt, Mycobacterium avium subsp. paratuberculosis
ccaggcgcgcgcu

SEQ ID NO: 1024663 - RNA, 17 nt, Mycobacterium avium subsp. paratuberculosis
ccaggcgccggccagca

SEQ ID NO: 1024664 - RNA, 14 nt, Mycobacterium avium subsp. paratuberculosis
ccaggcgggccagc

SEQ ID NO: 1024665 - RNA, 23 nt, Mycobacterium avium subsp. paratuberculosis
cgaguuccaccucgggccgggcg

SEQ ID NO: 1024666 - RNA, 20 nt, Mycobacterium avium subsp. paratuberculosis
cgaguugauaggucacgccg

SEQ ID NO: 1024667 - RNA, 17 nt, Mycobacterium avium subsp. paratuberculosis
cgaguuguugggccgaa

SEQ ID NO: 1024668 - RNA, 20 nt, Mycobacterium avium subsp. paratuberculosis
cgaguuuggccugaaccagc

SEQ ID NO: 1024669 - RNA, 14 nt, Mycobacterium avium subsp. paratuberculosis
cgauaccagccgcg

SEQ ID NO: 1024670 - RNA, 15 nt, Mycobacterium avium subsp. paratuberculosis
cgagucaccggcucg

SEQ ID NO: 1024671 - RNA, 20 nt, Mycobacterium avium subsp. paratuberculosis
cgagucaucgccacccgcac

SEQ ID NO: 1024672 - RNA, 17 nt, Mycobacterium avium subsp. paratuberculosis
cgaguccagccagccgc

SEQ ID NO: 1024673 - RNA, 20 nt, Mycobacterium avium subsp. paratuberculosis
cgaguccagccagccgcgcc

SEQ ID NO: 1024674 - RNA, 20 nt, Mycobacterium avium subsp. paratuberculosis
cgaguccugguaccccagca

SEQ ID NO: 1024675 - RNA, 18 nt, Mycobacterium avium subsp. paratuberculosis
cgaguccgggccgccggc

SEQ ID NO: 1024676 - RNA, 16 nt, Mycobacterium avium subsp. paratuberculosis
cgaguacccgccgcac

SEQ ID NO: 1024677 - RNA, 17 nt, Mycobacterium avium subsp. paratuberculosis
cgagugcucgauggcca

SEQ ID NO: 1024678 - RNA, 20 nt, Mycobacterium avium subsp. paratuberculosis
cgagugcucgauggccagcg

SEQ ID NO: 1024679 - RNA, 20 nt, Mycobacterium avium subsp. paratuberculosis
cgagucgaaggcgcgggcgu

SEQ ID NO: 1024680 - RNA, 21 nt, Mycobacterium avium subsp. paratuberculosis
cgagucgagaaacgcgcgcag

SEQ ID NO: 1024681 - RNA, 19 nt, Mycobacterium avium subsp. paratuberculosis
cgagucgaucgccagcgcg

SEQ ID NO: 1024682 - RNA, 20 nt, Mycobacterium avium subsp. paratuberculosis
cgagucgaucgccagcgcgc

SEQ ID NO: 1024683 - RNA, 17 nt, Mycobacterium avium subsp. paratuberculosis
cgagggugacccgggcg

SEQ ID NO: 1024684 - RNA, 20 nt, Mycobacterium avium subsp. paratuberculosis
cgagggugacccgggcgaug

SEQ ID NO: 1024685 - RNA, 15 nt, Mycobacterium avium subsp. paratuberculosis
cgagggugccggcca

SEQ ID NO: 1024686 - RNA, 19 nt, Mycobacterium avium subsp. paratuberculosis
cgaggggcuuggcgacgaa

SEQ ID NO: 1024687 - RNA, 17 nt, Mycobacterium avium subsp. paratuberculosis
cgaggggcagcagcgcc

SEQ ID NO: 1024688 - RNA, 15 nt, Mycobacterium avium subsp. paratuberculosis
cgagguacugcagca

SEQ ID NO: 1024689 - RNA, 16 nt, Mycobacterium avium subsp. paratuberculosis
cgagguagaccgccga

SEQ ID NO: 1024690 - RNA, 20 nt, Mycobacterium avium subsp. paratuberculosis
cgagguagguuucguugucc

SEQ ID NO: 1024691 - RNA, 20 nt, Mycobacterium avium subsp. paratuberculosis
cgaggucgcgcagcaccucc

SEQ ID NO: 1024692 - RNA, 17 nt, Mycobacterium avium subsp. paratuberculosis
cgaggucaccaacgcga

SEQ ID NO: 1024693 - RNA, 17 nt, Mycobacterium avium subsp. paratuberculosis
cgagguugucccgggcg

SEQ ID NO: 1024694 - RNA, 22 nt, Mycobacterium avium subsp. paratuberculosis
cgagguucauguggaagccgcg

SEQ ID NO: 1024695 - RNA, 22 nt, Mycobacterium avium subsp. paratuberculosis
cgagguguugucgugccgggug

SEQ ID NO: 1024696 - RNA, 16 nt, Mycobacterium avium subsp. paratuberculosis
cgaggugaagucgucc

SEQ ID NO: 1024697 - RNA, 22 nt, Mycobacterium avium subsp. paratuberculosis
cgaggucuuucaucgccccggc

SEQ ID NO: 1024698 - RNA, 14 nt, Mycobacterium avium subsp. paratuberculosis
cgaggucggccagc

SEQ ID NO: 1024699 - RNA, 15 nt, Mycobacterium avium subsp. paratuberculosis
cgaggucggccagca

SEQ ID NO: 1024700 - RNA, 23 nt, Mycobacterium avium subsp. paratuberculosis
cgaggucggucgcggcaucccug

SEQ ID NO: 1024701 - RNA, 19 nt, Mycobacterium avium subsp. paratuberculosis
cgaggucggugaggcuggg

SEQ ID NO: 1024702 - RNA, 22 nt, Mycobacterium avium subsp. paratuberculosis
cgaggucgucgagggccaccgg

SEQ ID NO: 1024703 - RNA, 15 nt, Mycobacterium avium subsp. paratuberculosis
cgaggucgucgggcg

SEQ ID NO: 1024704 - RNA, 20 nt, Mycobacterium avium subsp. paratuberculosis
cgaggucgucgggcgccggu

SEQ ID NO: 1024705 - RNA, 14 nt, Mycobacterium avium subsp. paratuberculosis
cgagguggcccagc

SEQ ID NO: 1024706 - RNA, 19 nt, Mycobacterium avium subsp. paratuberculosis
cgagcgcgcucaaccgccc

SEQ ID NO: 1024707 - RNA, 20 nt, Mycobacterium avium subsp. paratuberculosis
cgagcgcgcucaaccgccca

SEQ ID NO: 1024708 - RNA, 17 nt, Mycobacterium avium subsp. paratuberculosis
cgagcgcggcccgccga

SEQ ID NO: 1024709 - RNA, 17 nt, Mycobacterium avium subsp. paratuberculosis
cgagcgcgccgaggugg

SEQ ID NO: 1024710 - RNA, 17 nt, Mycobacterium avium subsp. paratuberculosis
cgagcggcgcugcagca

SEQ ID NO: 1024711 - RNA, 14 nt, Mycobacterium avium subsp. paratuberculosis
cgagcggcugcugg

SEQ ID NO: 1024712 - RNA, 18 nt, Mycobacterium avium subsp. paratuberculosis
cgagcggcuugccgccgc

SEQ ID NO: 1024713 - RNA, 13 nt, Mycobacterium avium subsp. paratuberculosis
cgagcgggcacgc

SEQ ID NO: 1024714 - RNA, 22 nt, Mycobacterium avium subsp. paratuberculosis
cgagcgguccaacgggcucagc

SEQ ID NO: 1024715 - RNA, 16 nt, Mycobacterium avium subsp. paratuberculosis
cgagcgguuggcgacg

SEQ ID NO: 1024716 - RNA, 19 nt, Mycobacterium avium subsp. paratuberculosis
cgagcgcguucuccaccgc

SEQ ID NO: 1024717 - RNA, 21 nt, Mycobacterium avium subsp. paratuberculosis
cgagcgcguucuccaccgcgc

SEQ ID NO: 1024718 - RNA, 20 nt, Mycobacterium avium subsp. paratuberculosis
cgagcgcuaccgcgcucacc

SEQ ID NO: 1024719 - RNA, 13 nt, Mycobacterium avium subsp. paratuberculosis
cgagcugggcccg

SEQ ID NO: 1024720 - RNA, 21 nt, Mycobacterium avium subsp. paratuberculosis
cgagcugcuucgucgccgggc

SEQ ID NO: 1024721 - RNA, 22 nt, Mycobacterium avium subsp. paratuberculosis
cgagcuugggccggugcagcac

SEQ ID NO: 1024722 - RNA, 13 nt, Mycobacterium avium subsp. paratuberculosis
cgagcgucauucc

SEQ ID NO: 1024723 - RNA, 14 nt, Mycobacterium avium subsp. paratuberculosis
cgagcgucauuccg

SEQ ID NO: 1024724 - RNA, 18 nt, Mycobacterium avium subsp. paratuberculosis
cgagcgucauuccgccgc

SEQ ID NO: 1024725 - RNA, 21 nt, Mycobacterium avium subsp. paratuberculosis
cgagcgucauuccgccgcgcc

SEQ ID NO: 1024726 - RNA, 22 nt, Mycobacterium avium subsp. paratuberculosis
cgagcgucauuccgccgcgccc

SEQ ID NO: 1024727 - RNA, 16 nt, Mycobacterium avium subsp. paratuberculosis
cgagcgucacgccagc

SEQ ID NO: 1024728 - RNA, 15 nt, Mycobacterium avium subsp. paratuberculosis
cgagcgucacgccgc

SEQ ID NO: 1024729 - RNA, 18 nt, Mycobacterium avium subsp. paratuberculosis
cgagcgucacgccgcgcc

SEQ ID NO: 1024730 - RNA, 15 nt, Mycobacterium avium subsp. paratuberculosis
cgagcgugcccgcgc

SEQ ID NO: 1024731 - RNA, 23 nt, Mycobacterium avium subsp. paratuberculosis
cgagcucggccuugagccggucg

SEQ ID NO: 1024732 - RNA, 15 nt, Mycobacterium avium subsp. paratuberculosis
cgagcugaccggcca

SEQ ID NO: 1024733 - RNA, 17 nt, Mycobacterium avium subsp. paratuberculosis
cgagcugaccggccacc

SEQ ID NO: 1024734 - RNA, 19 nt, Mycobacterium avium subsp. paratuberculosis
cgagcugaccggccaccuc

SEQ ID NO: 1024735 - RNA, 20 nt, Mycobacterium avium subsp. paratuberculosis
cgagcugacgaacgcgccgc

SEQ ID NO: 1024736 - RNA, 22 nt, Mycobacterium avium subsp. paratuberculosis
cgagcugacgaacgcgccgccc

SEQ ID NO: 1024737 - RNA, 16 nt, Mycobacterium avium subsp. paratuberculosis
cgagcucaggccggcc

SEQ ID NO: 1024738 - RNA, 23 nt, Mycobacterium avium subsp. paratuberculosis
cgagcucaugguguuccaccagc

SEQ ID NO: 1024739 - RNA, 14 nt, Mycobacterium avium subsp. paratuberculosis
cgagcuccagcuag

SEQ ID NO: 1024740 - RNA, 14 nt, Mycobacterium avium subsp. paratuberculosis
cgagcuccuccggg

SEQ ID NO: 1024741 - RNA, 17 nt, Mycobacterium avium subsp. paratuberculosis
cgagcuccucggccagc

SEQ ID NO: 1024742 - RNA, 19 nt, Mycobacterium avium subsp. paratuberculosis
cgaggagacgucggccggg

SEQ ID NO: 1024743 - RNA, 21 nt, Mycobacterium avium subsp. paratuberculosis
cgaggacgucgucgacgucca

SEQ ID NO: 1024744 - RNA, 22 nt, Mycobacterium avium subsp. paratuberculosis
cgaggaaguccggcgcgcccgg

SEQ ID NO: 1024745 - RNA, 21 nt, Mycobacterium avium subsp. paratuberculosis
cgaggaacucagcgcccagga

SEQ ID NO: 1024746 - RNA, 13 nt, Mycobacterium avium subsp. paratuberculosis
cgaggccaucauc

SEQ ID NO: 1024747 - RNA, 21 nt, Mycobacterium avium subsp. paratuberculosis
cgaggccagcagauacuccuc

SEQ ID NO: 1024748 - RNA, 14 nt, Mycobacterium avium subsp. paratuberculosis
cgaggccaacucgc

SEQ ID NO: 1024749 - RNA, 18 nt, Mycobacterium avium subsp. paratuberculosis
cgaggccaacucgcgaag

SEQ ID NO: 1024750 - RNA, 23 nt, Mycobacterium avium subsp. paratuberculosis
cgaggcacggcccgcucgggcca

SEQ ID NO: 1024751 - RNA, 13 nt, Mycobacterium avium subsp. paratuberculosis
cgaggaggccgcg

SEQ ID NO: 1024752 - RNA, 19 nt, Mycobacterium avium subsp. paratuberculosis
cgaggaugccgcccaccac

SEQ ID NO: 1024753 - RNA, 14 nt, Mycobacterium avium subsp. paratuberculosis
cgaggcugacgauc

SEQ ID NO: 1024754 - RNA, 22 nt, Mycobacterium avium subsp. paratuberculosis
cgagggcuaaccaccggugacg

SEQ ID NO: 1024755 - RNA, 18 nt, Mycobacterium avium subsp. paratuberculosis
cgagggccguugcggcca

SEQ ID NO: 1024756 - RNA, 15 nt, Mycobacterium avium subsp. paratuberculosis
cgagggccuccacca

SEQ ID NO: 1024757 - RNA, 15 nt, Mycobacterium avium subsp. paratuberculosis
cgagggccagcagcc

SEQ ID NO: 1024758 - RNA, 18 nt, Mycobacterium avium subsp. paratuberculosis
cgagggcccgggcaggca

SEQ ID NO: 1024759 - RNA, 23 nt, Mycobacterium avium subsp. paratuberculosis
cgaggcggguaggcgucgcgcag

SEQ ID NO: 1024760 - RNA, 19 nt, Mycobacterium avium subsp. paratuberculosis
cgaggcgggugaggacgcc

SEQ ID NO: 1024761 - RNA, 14 nt, Mycobacterium avium subsp. paratuberculosis
cgaggcgggcacac

SEQ ID NO: 1024762 - RNA, 15 nt, Mycobacterium avium subsp. paratuberculosis
cgaggcguccuccuc

SEQ ID NO: 1024763 - RNA, 18 nt, Mycobacterium avium subsp. paratuberculosis
cgaggcgugcagcccgca

SEQ ID NO: 1024764 - RNA, 21 nt, Mycobacterium avium subsp. paratuberculosis
cgaggcguucggcgauccggg

SEQ ID NO: 1024765 - RNA, 22 nt, Mycobacterium avium subsp. paratuberculosis
cgaggcggaucuucucgcugcu

SEQ ID NO: 1024766 - RNA, 15 nt, Mycobacterium avium subsp. paratuberculosis
cgaggcgagugagga

SEQ ID NO: 1024767 - RNA, 16 nt, Mycobacterium avium subsp. paratuberculosis
cgaggcgagugaggac

SEQ ID NO: 1024768 - RNA, 21 nt, Mycobacterium avium subsp. paratuberculosis
cgaggccguaucccaccacga

SEQ ID NO: 1024769 - RNA, 15 nt, Mycobacterium avium subsp. paratuberculosis
cgaggccggccagcg

SEQ ID NO: 1024770 - RNA, 14 nt, Mycobacterium avium subsp. paratuberculosis
cgaggccgcgggcg

SEQ ID NO: 1024771 - RNA, 17 nt, Mycobacterium avium subsp. paratuberculosis
cgaggccgcgggcguuc

SEQ ID NO: 1024772 - RNA, 12 nt, Mycobacterium avium subsp. paratuberculosis
cgaggccgggcu

SEQ ID NO: 1024773 - RNA, 20 nt, Mycobacterium avium subsp. paratuberculosis
cgacguuggccagcaccgcg

SEQ ID NO: 1024774 - RNA, 15 nt, Mycobacterium avium subsp. paratuberculosis
cgacguugcgggcca

SEQ ID NO: 1024775 - RNA, 18 nt, Mycobacterium avium subsp. paratuberculosis
cgacgugggcggccacca

SEQ ID NO: 1024776 - RNA, 15 nt, Mycobacterium avium subsp. paratuberculosis
cgacguggugcaccg

SEQ ID NO: 1024777 - RNA, 16 nt, Mycobacterium avium subsp. paratuberculosis
cgacguggugcaccgc

SEQ ID NO: 1024778 - RNA, 20 nt, Mycobacterium avium subsp. paratuberculosis
cgacgugguggaugaugccg

SEQ ID NO: 1024779 - RNA, 18 nt, Mycobacterium avium subsp. paratuberculosis
cgacguucggcgggcagg

SEQ ID NO: 1024780 - RNA, 16 nt, Mycobacterium avium subsp. paratuberculosis
cgacgugcccuucccc

SEQ ID NO: 1024781 - RNA, 22 nt, Mycobacterium avium subsp. paratuberculosis
cgacgugaucuggucggccagc

SEQ ID NO: 1024782 - RNA, 23 nt, Mycobacterium avium subsp. paratuberculosis
cgacgugaucuggucggccagcg

SEQ ID NO: 1024783 - RNA, 18 nt, Mycobacterium avium subsp. paratuberculosis
cgacgugcagcgccagca

SEQ ID NO: 1024784 - RNA, 21 nt, Mycobacterium avium subsp. paratuberculosis
cgaauacaccguccagcucag

SEQ ID NO: 1024785 - RNA, 23 nt, Mycobacterium avium subsp. paratuberculosis
cgacgucggugaaauagcgcagc

SEQ ID NO: 1024786 - RNA, 17 nt, Mycobacterium avium subsp. paratuberculosis
cgacuccagcaccggcg

SEQ ID NO: 1024787 - RNA, 14 nt, Mycobacterium avium subsp. paratuberculosis
cgacuccagcagcg

SEQ ID NO: 1024788 - RNA, 16 nt, Mycobacterium avium subsp. paratuberculosis
cgacuccagcagcgcc

SEQ ID NO: 1024789 - RNA, 19 nt, Mycobacterium avium subsp. paratuberculosis
cgacuccagcagcgccagc

SEQ ID NO: 1024790 - RNA, 16 nt, Mycobacterium avium subsp. paratuberculosis
cgacucggccuccgcg

SEQ ID NO: 1024791 - RNA, 13 nt, Mycobacterium avium subsp. paratuberculosis
cgacucgaccccg

SEQ ID NO: 1024792 - RNA, 19 nt, Mycobacterium avium subsp. paratuberculosis
cgacucgaccccgcccagc

SEQ ID NO: 1024793 - RNA, 14 nt, Mycobacterium avium subsp. paratuberculosis
cgacuccucacacc

SEQ ID NO: 1024794 - RNA, 16 nt, Mycobacterium avium subsp. paratuberculosis
cgacuccuccggcccg

SEQ ID NO: 1024795 - RNA, 17 nt, Mycobacterium avium subsp. paratuberculosis
cgacugcgcggccggcg

SEQ ID NO: 1024796 - RNA, 16 nt, Mycobacterium avium subsp. paratuberculosis
cgacuggaccaccaug

SEQ ID NO: 1024797 - RNA, 14 nt, Mycobacterium avium subsp. paratuberculosis
cgacuggaucaucg

SEQ ID NO: 1024798 - RNA, 12 nt, Mycobacterium avium subsp. paratuberculosis
cgacugccccgc

SEQ ID NO: 1024799 - RNA, 14 nt, Mycobacterium avium subsp. paratuberculosis
cgacugcaggaaca

SEQ ID NO: 1024800 - RNA, 23 nt, Mycobacterium avium subsp. paratuberculosis
cgacugcaggaacaaccgcagcg

SEQ ID NO: 1024801 - RNA, 14 nt, Mycobacterium avium subsp. paratuberculosis
cgacucuuccagga

SEQ ID NO: 1024802 - RNA, 18 nt, Mycobacterium avium subsp. paratuberculosis
cgacucguuggccggcuc

SEQ ID NO: 1024803 - RNA, 20 nt, Mycobacterium avium subsp. paratuberculosis
cgacuucuacggcgggccgg

SEQ ID NO: 1024804 - RNA, 18 nt, Mycobacterium avium subsp. paratuberculosis
cgacuuggucagcccgcg

SEQ ID NO: 1024805 - RNA, 17 nt, Mycobacterium avium subsp. paratuberculosis
cgacuugguggccagca

SEQ ID NO: 1024806 - RNA, 16 nt, Mycobacterium avium subsp. paratuberculosis
cgagacacgcgccggc

SEQ ID NO: 1024807 - RNA, 17 nt, Mycobacterium avium subsp. paratuberculosis
cgagaccaugucggcca

SEQ ID NO: 1024808 - RNA, 15 nt, Mycobacterium avium subsp. paratuberculosis
cgagacgaccaggau

SEQ ID NO: 1024809 - RNA, 19 nt, Mycobacterium avium subsp. paratuberculosis
cgagagcucuugcgcccca

SEQ ID NO: 1024810 - RNA, 21 nt, Mycobacterium avium subsp. paratuberculosis
cgagagcugcugccgccgcag

SEQ ID NO: 1024811 - RNA, 23 nt, Mycobacterium avium subsp. paratuberculosis
cgagacugcacagugcgucgccc

SEQ ID NO: 1024812 - RNA, 17 nt, Mycobacterium avium subsp. paratuberculosis
cgagaucuucuccccgc

SEQ ID NO: 1024813 - RNA, 16 nt, Mycobacterium avium subsp. paratuberculosis
cgagaugcccacccgc

SEQ ID NO: 1024814 - RNA, 22 nt, Mycobacterium avium subsp. paratuberculosis
cgagaugcguucggccgcagcg

SEQ ID NO: 1024815 - RNA, 17 nt, Mycobacterium avium subsp. paratuberculosis
cgagaucccgguucccg

SEQ ID NO: 1024816 - RNA, 20 nt, Mycobacterium avium subsp. paratuberculosis
cgagaucccgguucccggca

SEQ ID NO: 1024817 - RNA, 20 nt, Mycobacterium avium subsp. paratuberculosis
cgagauccaccgcgcggcca

SEQ ID NO: 1024818 - RNA, 17 nt, Mycobacterium avium subsp. paratuberculosis
cgagaucucgucgaugg

SEQ ID NO: 1024819 - RNA, 20 nt, Mycobacterium avium subsp. paratuberculosis
cgagagccgguagggccggu

SEQ ID NO: 1024820 - RNA, 17 nt, Mycobacterium avium subsp. paratuberculosis
cgagaucagggcgcgca

SEQ ID NO: 1024821 - RNA, 15 nt, Mycobacterium avium subsp. paratuberculosis
cgagaucagcaccag

SEQ ID NO: 1024822 - RNA, 15 nt, Mycobacterium avium subsp. paratuberculosis
cgagauucugcagcc

SEQ ID NO: 1024823 - RNA, 15 nt, Mycobacterium avium subsp. paratuberculosis
cgagcaacaccaccu

SEQ ID NO: 1024824 - RNA, 16 nt, Mycobacterium avium subsp. paratuberculosis
cgagaugaucagccgc

SEQ ID NO: 1024825 - RNA, 14 nt, Mycobacterium avium subsp. paratuberculosis
cgagauggacagca

SEQ ID NO: 1024826 - RNA, 15 nt, Mycobacterium avium subsp. paratuberculosis
cgagauggacagcac

SEQ ID NO: 1024827 - RNA, 14 nt, Mycobacterium avium subsp. paratuberculosis
cgagauggccacca

SEQ ID NO: 1024828 - RNA, 18 nt, Mycobacterium avium subsp. paratuberculosis
cgagcaacggccgcagcg

SEQ ID NO: 1024829 - RNA, 18 nt, Mycobacterium avium subsp. paratuberculosis
cgagcaacugggugagca

SEQ ID NO: 1024830 - RNA, 14 nt, Mycobacterium avium subsp. paratuberculosis
cgagcacaucggcg

SEQ ID NO: 1024831 - RNA, 16 nt, Mycobacterium avium subsp. paratuberculosis
cgagcaggccgaggcc

SEQ ID NO: 1024832 - RNA, 15 nt, Mycobacterium avium subsp. paratuberculosis
cgagcagccgcaaca

SEQ ID NO: 1024833 - RNA, 18 nt, Mycobacterium avium subsp. paratuberculosis
cgagcagccgguccaugu

SEQ ID NO: 1024834 - RNA, 15 nt, Mycobacterium avium subsp. paratuberculosis
cgagcagcgcgcgcu

SEQ ID NO: 1024835 - RNA, 16 nt, Mycobacterium avium subsp. paratuberculosis
cgagcagcgcgcgcuu

SEQ ID NO: 1024836 - RNA, 22 nt, Mycobacterium avium subsp. paratuberculosis
cgagcagcgcgcgcuugcgcuc

SEQ ID NO: 1024837 - RNA, 16 nt, Mycobacterium avium subsp. paratuberculosis
cgagcagcgggucguc

SEQ ID NO: 1024838 - RNA, 15 nt, Mycobacterium avium subsp. paratuberculosis
cgagcagcaccaccc

SEQ ID NO: 1024839 - RNA, 17 nt, Mycobacterium avium subsp. paratuberculosis
cgagcagaucggguccc

SEQ ID NO: 1024840 - RNA, 20 nt, Mycobacterium avium subsp. paratuberculosis
cgagcagaucgggucccaga

SEQ ID NO: 1024841 - RNA, 15 nt, Mycobacterium avium subsp. paratuberculosis
cgagcagcaagagca

SEQ ID NO: 1024842 - RNA, 21 nt, Mycobacterium avium subsp. paratuberculosis
cgagcagacacaaaagcaccc

SEQ ID NO: 1024843 - RNA, 21 nt, Mycobacterium avium subsp. paratuberculosis
cgagcagacgcaaaagccccg

SEQ ID NO: 1024844 - RNA, 19 nt, Mycobacterium avium subsp. paratuberculosis
cgagcaccgcgaucaccga

SEQ ID NO: 1024845 - RNA, 17 nt, Mycobacterium avium subsp. paratuberculosis
cgagcaccggcggcagc

SEQ ID NO: 1024846 - RNA, 21 nt, Mycobacterium avium subsp. paratuberculosis
cgagcaccggcuggugcagca

SEQ ID NO: 1024847 - RNA, 15 nt, Mycobacterium avium subsp. paratuberculosis
cgagcaccgggccga

SEQ ID NO: 1024848 - RNA, 14 nt, Mycobacterium avium subsp. paratuberculosis
cgagcaccgugccg

SEQ ID NO: 1024849 - RNA, 20 nt, Mycobacterium avium subsp. paratuberculosis
cgagcaccugaacggccgcg

SEQ ID NO: 1024850 - RNA, 23 nt, Mycobacterium avium subsp. paratuberculosis
cgagcacgaacgcggccgccauc

SEQ ID NO: 1024851 - RNA, 15 nt, Mycobacterium avium subsp. paratuberculosis
cgagcacggcacgcc

SEQ ID NO: 1024852 - RNA, 18 nt, Mycobacterium avium subsp. paratuberculosis
cgagcacccagaaacacc

SEQ ID NO: 1024853 - RNA, 20 nt, Mycobacterium avium subsp. paratuberculosis
cgagcaccccgucgagcagc

SEQ ID NO: 1024854 - RNA, 16 nt, Mycobacterium avium subsp. paratuberculosis
cgagcaccacccgggu

SEQ ID NO: 1024855 - RNA, 12 nt, Mycobacterium avium subsp. paratuberculosis
cgagcaccagcg

SEQ ID NO: 1024856 - RNA, 17 nt, Mycobacterium avium subsp. paratuberculosis
cgagcacaggaacgcga

SEQ ID NO: 1024857 - RNA, 12 nt, Mycobacterium avium subsp. paratuberculosis
cgagcaccaccc

SEQ ID NO: 1024858 - RNA, 22 nt, Mycobacterium avium subsp. paratuberculosis
cgagcaucagcugccguccggg

SEQ ID NO: 1024859 - RNA, 20 nt, Mycobacterium avium subsp. paratuberculosis
cgagcauccggugccgagcg

SEQ ID NO: 1024860 - RNA, 13 nt, Mycobacterium avium subsp. paratuberculosis
cgagcaucuccag

SEQ ID NO: 1024861 - RNA, 16 nt, Mycobacterium avium subsp. paratuberculosis
cgagcccaccgcgccc

SEQ ID NO: 1024862 - RNA, 19 nt, Mycobacterium avium subsp. paratuberculosis
cgagcccaccgcgcccagc

SEQ ID NO: 1024863 - RNA, 14 nt, Mycobacterium avium subsp. paratuberculosis
cgagccgccgcggg

SEQ ID NO: 1024864 - RNA, 18 nt, Mycobacterium avium subsp. paratuberculosis
cgagccgccugcgcgccg

SEQ ID NO: 1024865 - RNA, 19 nt, Mycobacterium avium subsp. paratuberculosis
cgagccgcgccacgcgcag

SEQ ID NO: 1024866 - RNA, 13 nt, Mycobacterium avium subsp. paratuberculosis
cgagccgcgcgcc

SEQ ID NO: 1024867 - RNA, 19 nt, Mycobacterium avium subsp. paratuberculosis
cgagccgcggauggccucg

SEQ ID NO: 1024868 - RNA, 14 nt, Mycobacterium avium subsp. paratuberculosis
cgagccgagcaccg

SEQ ID NO: 1024869 - RNA, 19 nt, Mycobacterium avium subsp. paratuberculosis
cgagccgagcaccggcagc

SEQ ID NO: 1024870 - RNA, 17 nt, Mycobacterium avium subsp. paratuberculosis
cgagccgagcacgcagc

SEQ ID NO: 1024871 - RNA, 24 nt, Mycobacterium avium subsp. paratuberculosis
cgagccgagcacgcagccgcgccc

SEQ ID NO: 1024872 - RNA, 14 nt, Mycobacterium avium subsp. paratuberculosis
cgagccgagccgac

SEQ ID NO: 1024873 - RNA, 15 nt, Mycobacterium avium subsp. paratuberculosis
cgagccgagccgacc

SEQ ID NO: 1024874 - RNA, 16 nt, Mycobacterium avium subsp. paratuberculosis
cgagccgagccgaccc

SEQ ID NO: 1024875 - RNA, 16 nt, Mycobacterium avium subsp. paratuberculosis
cgagccgagccggucc

SEQ ID NO: 1024876 - RNA, 22 nt, Mycobacterium avium subsp. paratuberculosis
cgagccgaggccgauggcgccc

SEQ ID NO: 1024877 - RNA, 18 nt, Mycobacterium avium subsp. paratuberculosis
cgagcccuuugcgcugcc

SEQ ID NO: 1024878 - RNA, 19 nt, Mycobacterium avium subsp. paratuberculosis
cgagcccuuugcgcugccc

SEQ ID NO: 1024879 - RNA, 23 nt, Mycobacterium avium subsp. paratuberculosis
cgagcccuucgcggugugcggca

SEQ ID NO: 1024880 - RNA, 16 nt, Mycobacterium avium subsp. paratuberculosis
cgagccgaugcccagc

SEQ ID NO: 1024881 - RNA, 20 nt, Mycobacterium avium subsp. paratuberculosis
cgagccgaugcccagcagcg

SEQ ID NO: 1024882 - RNA, 20 nt, Mycobacterium avium subsp. paratuberculosis
cgagcccugcgccagcagca

SEQ ID NO: 1024883 - RNA, 15 nt, Mycobacterium avium subsp. paratuberculosis
cgagcccgccggcgg

SEQ ID NO: 1024884 - RNA, 20 nt, Mycobacterium avium subsp. paratuberculosis
cgagcccagcugcgcggagc

SEQ ID NO: 1024885 - RNA, 13 nt, Mycobacterium avium subsp. paratuberculosis
cgagcccagcugc

SEQ ID NO: 1024886 - RNA, 14 nt, Mycobacterium avium subsp. paratuberculosis
cgagcccagcugcg

SEQ ID NO: 1024887 - RNA, 16 nt, Mycobacterium avium subsp. paratuberculosis
cgagcccgacggcagc

SEQ ID NO: 1024888 - RNA, 17 nt, Mycobacterium avium subsp. paratuberculosis
cgagcccgacggcagca

SEQ ID NO: 1024889 - RNA, 19 nt, Mycobacterium avium subsp. paratuberculosis
cgagcccgacggcagcacc

SEQ ID NO: 1024890 - RNA, 20 nt, Mycobacterium avium subsp. paratuberculosis
cgagcccgacggcagcaccg

SEQ ID NO: 1024891 - RNA, 23 nt, Mycobacterium avium subsp. paratuberculosis
cgagcccgcaaaucagccgagcc

SEQ ID NO: 1024892 - RNA, 19 nt, Mycobacterium avium subsp. paratuberculosis
cgagcgaacacgugcagcu

SEQ ID NO: 1024893 - RNA, 14 nt, Mycobacterium avium subsp. paratuberculosis
cgagccuggcgcgc

SEQ ID NO: 1024894 - RNA, 21 nt, Mycobacterium avium subsp. paratuberculosis
cgagccugggauugccgggca

SEQ ID NO: 1024895 - RNA, 22 nt, Mycobacterium avium subsp. paratuberculosis
cgagccgguugacccucagcag

SEQ ID NO: 1024896 - RNA, 23 nt, Mycobacterium avium subsp. paratuberculosis
cgagccggcccggggugugcccg

SEQ ID NO: 1024897 - RNA, 15 nt, Mycobacterium avium subsp. paratuberculosis
cgagccgggcccggg

SEQ ID NO: 1024898 - RNA, 13 nt, Mycobacterium avium subsp. paratuberculosis
cgagccgcggccc

SEQ ID NO: 1024899 - RNA, 16 nt, Mycobacterium avium subsp. paratuberculosis
cgagccgcuccaccgc

SEQ ID NO: 1024900 - RNA, 23 nt, Mycobacterium avium subsp. paratuberculosis
cgagccgcucccgcagcggggcg

SEQ ID NO: 1024901 - RNA, 16 nt, Mycobacterium avium subsp. paratuberculosis
cgagccgcucgcgcac

SEQ ID NO: 1024902 - RNA, 12 nt, Mycobacterium avium subsp. paratuberculosis
cgagcgcagcag

SEQ ID NO: 1024903 - RNA, 13 nt, Mycobacterium avium subsp. paratuberculosis
cgagcgcaccgcc

SEQ ID NO: 1024904 - RNA, 12 nt, Mycobacterium avium subsp. paratuberculosis
cgagcgcccggg

SEQ ID NO: 1024905 - RNA, 11 nt, Mycobacterium avium subsp. paratuberculosis
cgccaccacca

SEQ ID NO: 1024906 - RNA, 13 nt, Mycobacterium avium subsp. paratuberculosis
cgccaccaccagc

SEQ ID NO: 1024907 - RNA, 15 nt, Mycobacterium avium subsp. paratuberculosis
cgccaccacccggcg

SEQ ID NO: 1024908 - RNA, 15 nt, Mycobacterium avium subsp. paratuberculosis
cgccacccgcaccuc

SEQ ID NO: 1024909 - RNA, 12 nt, Mycobacterium avium subsp. paratuberculosis
cgccacccgcau

SEQ ID NO: 1024910 - RNA, 15 nt, Mycobacterium avium subsp. paratuberculosis
cgccaccccgcgcca

SEQ ID NO: 1024911 - RNA, 20 nt, Mycobacterium avium subsp. paratuberculosis
cgccaccccgcgccacgccg

SEQ ID NO: 1024912 - RNA, 16 nt, Mycobacterium avium subsp. paratuberculosis
cgccaccaccgcgccg

SEQ ID NO: 1024913 - RNA, 15 nt, Mycobacterium avium subsp. paratuberculosis
cgccaccaccuccuc

SEQ ID NO: 1024914 - RNA, 16 nt, Mycobacterium avium subsp. paratuberculosis
cgccaccggccggucc

SEQ ID NO: 1024915 - RNA, 21 nt, Mycobacterium avium subsp. paratuberculosis
cgccaccggccgguccgccca

SEQ ID NO: 1024916 - RNA, 16 nt, Mycobacterium avium subsp. paratuberculosis
cgccaccgaggccagc

SEQ ID NO: 1024917 - RNA, 22 nt, Mycobacterium avium subsp. paratuberculosis
cgccaccgagucgcgcgaccag

SEQ ID NO: 1024918 - RNA, 17 nt, Mycobacterium avium subsp. paratuberculosis
cgccaccgacaccaccg

SEQ ID NO: 1024919 - RNA, 14 nt, Mycobacterium avium subsp. paratuberculosis
cgccaccgcccgcu

SEQ ID NO: 1024920 - RNA, 21 nt, Mycobacterium avium subsp. paratuberculosis
cgccaccgcgaaagcgucggc

SEQ ID NO: 1024921 - RNA, 15 nt, Mycobacterium avium subsp. paratuberculosis
cgccaccgcgcaacc

SEQ ID NO: 1024922 - RNA, 22 nt, Mycobacterium avium subsp. paratuberculosis
cgccaccgcgcaaccgggccgc

SEQ ID NO: 1024923 - RNA, 15 nt, Mycobacterium avium subsp. paratuberculosis
cgccaauccggcggg

SEQ ID NO: 1024924 - RNA, 23 nt, Mycobacterium avium subsp. paratuberculosis
cgccaauaaagcgggcccgccuu

SEQ ID NO: 1024925 - RNA, 16 nt, Mycobacterium avium subsp. paratuberculosis
cgccacaaacagcgcg

SEQ ID NO: 1024926 - RNA, 20 nt, Mycobacterium avium subsp. paratuberculosis
cgccacaaacagcgcggccg

SEQ ID NO: 1024927 - RNA, 13 nt, Mycobacterium avium subsp. paratuberculosis
cgccacagcgccu

SEQ ID NO: 1024928 - RNA, 16 nt, Mycobacterium avium subsp. paratuberculosis
cgccacagcagcacca

SEQ ID NO: 1024929 - RNA, 21 nt, Mycobacterium avium subsp. paratuberculosis
cgccacagcagcaccagcgcg

SEQ ID NO: 1024930 - RNA, 15 nt, Mycobacterium avium subsp. paratuberculosis
cgccacagccgggga

SEQ ID NO: 1024931 - RNA, 17 nt, Mycobacterium avium subsp. paratuberculosis
cgccaaaucgaucaccc

SEQ ID NO: 1024932 - RNA, 18 nt, Mycobacterium avium subsp. paratuberculosis
cgccaaaucgaucaccca

SEQ ID NO: 1024933 - RNA, 20 nt, Mycobacterium avium subsp. paratuberculosis
cgccaacaacuacgagcagc

SEQ ID NO: 1024934 - RNA, 18 nt, Mycobacterium avium subsp. paratuberculosis
cgccaacaacucagaaca

SEQ ID NO: 1024935 - RNA, 14 nt, Mycobacterium avium subsp. paratuberculosis
cgccaacaacucga

SEQ ID NO: 1024936 - RNA, 14 nt, Mycobacterium avium subsp. paratuberculosis
cgcauucaccagcu

SEQ ID NO: 1024937 - RNA, 17 nt, Mycobacterium avium subsp. paratuberculosis
cgcauuccucggccagc

SEQ ID NO: 1024938 - RNA, 19 nt, Mycobacterium avium subsp. paratuberculosis
cgcauguugugcccgacgg

SEQ ID NO: 1024939 - RNA, 20 nt, Mycobacterium avium subsp. paratuberculosis
cgcauguugugcccgacggc

SEQ ID NO: 1024940 - RNA, 15 nt, Mycobacterium avium subsp. paratuberculosis
cgcauggucagguag

SEQ ID NO: 1024941 - RNA, 16 nt, Mycobacterium avium subsp. paratuberculosis
cgcaugaugcccaggc

SEQ ID NO: 1024942 - RNA, 21 nt, Mycobacterium avium subsp. paratuberculosis
cgcauggcgugcugaugcugu

SEQ ID NO: 1024943 - RNA, 23 nt, Mycobacterium avium subsp. paratuberculosis
cgcauggagaugcuucagcccuc

SEQ ID NO: 1024944 - RNA, 20 nt, Mycobacterium avium subsp. paratuberculosis
cgcauagcgguccauccagc

SEQ ID NO: 1024945 - RNA, 16 nt, Mycobacterium avium subsp. paratuberculosis
cgcaggugcucgccgg

SEQ ID NO: 1024946 - RNA, 18 nt, Mycobacterium avium subsp. paratuberculosis
cgcaggugcucgccggcg

SEQ ID NO: 1024947 - RNA, 20 nt, Mycobacterium avium subsp. paratuberculosis
cgcaggugcucgccggcgcg

SEQ ID NO: 1024948 - RNA, 19 nt, Mycobacterium avium subsp. paratuberculosis
cgcaucggucaccagcucc

SEQ ID NO: 1024949 - RNA, 23 nt, Mycobacterium avium subsp. paratuberculosis
cgcaucgucgcggcgcuaaagcc

SEQ ID NO: 1024950 - RNA, 17 nt, Mycobacterium avium subsp. paratuberculosis
cgcaucguugccggcgg

SEQ ID NO: 1024951 - RNA, 19 nt, Mycobacterium avium subsp. paratuberculosis
cgcaucgccgaaccgggcg

SEQ ID NO: 1024952 - RNA, 13 nt, Mycobacterium avium subsp. paratuberculosis
cgcaucagcucuu

SEQ ID NO: 1024953 - RNA, 16 nt, Mycobacterium avium subsp. paratuberculosis
cgcaucaacugcacca

SEQ ID NO: 1024954 - RNA, 19 nt, Mycobacterium avium subsp. paratuberculosis
cgcaucaacugcaccagcg

SEQ ID NO: 1024955 - RNA, 15 nt, Mycobacterium avium subsp. paratuberculosis
cgcaucaucgcccag

SEQ ID NO: 1024956 - RNA, 20 nt, Mycobacterium avium subsp. paratuberculosis
cgcaucaucgcccagcgcag

SEQ ID NO: 1024957 - RNA, 16 nt, Mycobacterium avium subsp. paratuberculosis
cgcaucaucucggcga

SEQ ID NO: 1024958 - RNA, 15 nt, Mycobacterium avium subsp. paratuberculosis
cgcaggaucgagccg

SEQ ID NO: 1024959 - RNA, 13 nt, Mycobacterium avium subsp. paratuberculosis
cgcaggaugccca

SEQ ID NO: 1024960 - RNA, 18 nt, Mycobacterium avium subsp. paratuberculosis
cgcaggaugcccagcacc

SEQ ID NO: 1024961 - RNA, 20 nt, Mycobacterium avium subsp. paratuberculosis
cgcaggaugcccagcaccac

SEQ ID NO: 1024962 - RNA, 14 nt, Mycobacterium avium subsp. paratuberculosis
cgcaggcagcagca

SEQ ID NO: 1024963 - RNA, 14 nt, Mycobacterium avium subsp. paratuberculosis
cgcaggccgcccgg

SEQ ID NO: 1024964 - RNA, 14 nt, Mycobacterium avium subsp. paratuberculosis
cgcaggcguggccc

SEQ ID NO: 1024965 - RNA, 15 nt, Mycobacterium avium subsp. paratuberculosis
cgcaggcggcgcgca

SEQ ID NO: 1024966 - RNA, 22 nt, Mycobacterium avium subsp. paratuberculosis
cgcaggcguccagggccaccgc

SEQ ID NO: 1024967 - RNA, 16 nt, Mycobacterium avium subsp. paratuberculosis
cgcaggcgcgcggcca

SEQ ID NO: 1024968 - RNA, 22 nt, Mycobacterium avium subsp. paratuberculosis
cgcaggcgcgcggccagccccg

SEQ ID NO: 1024969 - RNA, 15 nt, Mycobacterium avium subsp. paratuberculosis
cgcaggcgagccggu

SEQ ID NO: 1024970 - RNA, 12 nt, Mycobacterium avium subsp. paratuberculosis
cgcaggcgcgca

SEQ ID NO: 1024971 - RNA, 14 nt, Mycobacterium avium subsp. paratuberculosis
cgcaggcgcgcacc

SEQ ID NO: 1024972 - RNA, 18 nt, Mycobacterium avium subsp. paratuberculosis
cgcaggccguccagcagc

SEQ ID NO: 1024973 - RNA, 19 nt, Mycobacterium avium subsp. paratuberculosis
cgcaggccguccagcagca

SEQ ID NO: 1024974 - RNA, 23 nt, Mycobacterium avium subsp. paratuberculosis
cgcaggccguccagcagcagcgc

SEQ ID NO: 1024975 - RNA, 14 nt, Mycobacterium avium subsp. paratuberculosis
cgcagaacaccagc

SEQ ID NO: 1024976 - RNA, 16 nt, Mycobacterium avium subsp. paratuberculosis
cgcagaacaccagcgc

SEQ ID NO: 1024977 - RNA, 16 nt, Mycobacterium avium subsp. paratuberculosis
cgcagaucgccagcac

SEQ ID NO: 1024978 - RNA, 18 nt, Mycobacterium avium subsp. paratuberculosis
cgcagaucgccagcaccg

SEQ ID NO: 1024979 - RNA, 22 nt, Mycobacterium avium subsp. paratuberculosis
cgcagaucgucgaccugcucgu

SEQ ID NO: 1024980 - RNA, 22 nt, Mycobacterium avium subsp. paratuberculosis
cgcagaugaccggccugcagcg

SEQ ID NO: 1024981 - RNA, 19 nt, Mycobacterium avium subsp. paratuberculosis
cgcaggaacuccagcagcu

SEQ ID NO: 1024982 - RNA, 22 nt, Mycobacterium avium subsp. paratuberculosis
cgcagcgugucggggucggcgc

SEQ ID NO: 1024983 - RNA, 22 nt, Mycobacterium avium subsp. paratuberculosis
cgcagcgucggcgugcccgccg

SEQ ID NO: 1024984 - RNA, 16 nt, Mycobacterium avium subsp. paratuberculosis
cgcagcggugcagccc

SEQ ID NO: 1024985 - RNA, 22 nt, Mycobacterium avium subsp. paratuberculosis
cgcagcggggaggcccagcccg

SEQ ID NO: 1024986 - RNA, 15 nt, Mycobacterium avium subsp. paratuberculosis
cgcagcggcuugacc

SEQ ID NO: 1024987 - RNA, 13 nt, Mycobacterium avium subsp. paratuberculosis
cgcagcggcggca

SEQ ID NO: 1024988 - RNA, 12 nt, Mycobacterium avium subsp. paratuberculosis
cgcagcggcgcc

SEQ ID NO: 1024989 - RNA, 19 nt, Mycobacterium avium subsp. paratuberculosis
cgcaauugcgccagcagca

SEQ ID NO: 1024990 - RNA, 22 nt, Mycobacterium avium subsp. paratuberculosis
cgcaacggauuggucagagccc

SEQ ID NO: 1024991 - RNA, 19 nt, Mycobacterium avium subsp. paratuberculosis
cgcacacaccguaccgagg

SEQ ID NO: 1024992 - RNA, 14 nt, Mycobacterium avium subsp. paratuberculosis
cgcacacagcagca

SEQ ID NO: 1024993 - RNA, 16 nt, Mycobacterium avium subsp. paratuberculosis
cgcacaauucggucag

SEQ ID NO: 1024994 - RNA, 14 nt, Mycobacterium avium subsp. paratuberculosis
cgcacagccgcagc

SEQ ID NO: 1024995 - RNA, 21 nt, Mycobacterium avium subsp. paratuberculosis
cgcacagcguuauccaccagg

SEQ ID NO: 1024996 - RNA, 20 nt, Mycobacterium avium subsp. paratuberculosis
cgcacagaucgucucggcca

SEQ ID NO: 1024997 - RNA, 16 nt, Mycobacterium avium subsp. paratuberculosis
cgcaacaccgaaagcc

SEQ ID NO: 1024998 - RNA, 14 nt, Mycobacterium avium subsp. paratuberculosis
cgcaacaccacguc

SEQ ID NO: 1024999 - RNA, 20 nt, Mycobacterium avium subsp. paratuberculosis
cgcaaccgggccgcaccccc

SEQ ID NO: 1025000 - RNA, 19 nt, Mycobacterium avium subsp. paratuberculosis
cgcaacgauucacccagcg

SEQ ID NO: 1025001 - RNA, 13 nt, Mycobacterium avium subsp. paratuberculosis
cgcaacgcggcgg

SEQ ID NO: 1025002 - RNA, 16 nt, Mycobacterium avium subsp. paratuberculosis
cgcaacgcugaccgca

SEQ ID NO: 1025003 - RNA, 16 nt, Mycobacterium avium subsp. paratuberculosis
cgcaacggcucccagg

SEQ ID NO: 1025004 - RNA, 18 nt, Mycobacterium avium subsp. paratuberculosis
cgcaacgggccgcagccg

SEQ ID NO: 1025005 - RNA, 17 nt, Mycobacterium avium subsp. paratuberculosis
cgcaaccgccggcagcg

SEQ ID NO: 1025006 - RNA, 22 nt, Mycobacterium avium subsp. paratuberculosis
cgcaaccgcggcggcggcccgu

SEQ ID NO: 1025007 - RNA, 18 nt, Mycobacterium avium subsp. paratuberculosis
cgcagaaaaaggccgccg

SEQ ID NO: 1025008 - RNA, 19 nt, Mycobacterium avium subsp. paratuberculosis
cgcagaaaaaggccgccgc

SEQ ID NO: 1025009 - RNA, 15 nt, Mycobacterium avium subsp. paratuberculosis
cgcacucccgcguau

SEQ ID NO: 1025010 - RNA, 20 nt, Mycobacterium avium subsp. paratuberculosis
cgcacucgaacggcccggac

SEQ ID NO: 1025011 - RNA, 15 nt, Mycobacterium avium subsp. paratuberculosis
cgcacgugcgcgccg

SEQ ID NO: 1025012 - RNA, 15 nt, Mycobacterium avium subsp. paratuberculosis
cgcacguggcugacc

SEQ ID NO: 1025013 - RNA, 22 nt, Mycobacterium avium subsp. paratuberculosis
cgcacguuggcggccagcgcgc

SEQ ID NO: 1025014 - RNA, 22 nt, Mycobacterium avium subsp. paratuberculosis
cgcacguauccgcggucgacca

SEQ ID NO: 1025015 - RNA, 15 nt, Mycobacterium avium subsp. paratuberculosis
cgcacgucccgcccg

SEQ ID NO: 1025016 - RNA, 21 nt, Mycobacterium avium subsp. paratuberculosis
cgcacgucccgcccggcgccg

SEQ ID NO: 1025017 - RNA, 16 nt, Mycobacterium avium subsp. paratuberculosis
cgcacgucggccgcca

SEQ ID NO: 1025018 - RNA, 18 nt, Mycobacterium avium subsp. paratuberculosis
cgcacgucggccgccagg

SEQ ID NO: 1025019 - RNA, 19 nt, Mycobacterium avium subsp. paratuberculosis
cgcacgaucugcaggccga

SEQ ID NO: 1025020 - RNA, 14 nt, Mycobacterium avium subsp. paratuberculosis
cgcacgcagugccg

SEQ ID NO: 1025021 - RNA, 20 nt, Mycobacterium avium subsp. paratuberculosis
cgcacgcagugccgcaccag

SEQ ID NO: 1025022 - RNA, 18 nt, Mycobacterium avium subsp. paratuberculosis
cgcacgagcacccagaaa

SEQ ID NO: 1025023 - RNA, 20 nt, Mycobacterium avium subsp. paratuberculosis
cgcaccaaccggccccgagc

SEQ ID NO: 1025024 - RNA, 21 nt, Mycobacterium avium subsp. paratuberculosis
cgcaccaaccggccccgagcg

SEQ ID NO: 1025025 - RNA, 21 nt, Mycobacterium avium subsp. paratuberculosis
cgcacaucacgguggccgcca

SEQ ID NO: 1025026 - RNA, 12 nt, Mycobacterium avium subsp. paratuberculosis
cgcaccagcagg

SEQ ID NO: 1025027 - RNA, 15 nt, Mycobacterium avium subsp. paratuberculosis
cgcaccacgagcagc

SEQ ID NO: 1025028 - RNA, 12 nt, Mycobacterium avium subsp. paratuberculosis
cgcaccacgccc

SEQ ID NO: 1025029 - RNA, 24 nt, Mycobacterium avium subsp. paratuberculosis
cgcaccacgguggcgccgcgcagc

SEQ ID NO: 1025030 - RNA, 19 nt, Mycobacterium avium subsp. paratuberculosis
cgcaccacccagcccuugg

SEQ ID NO: 1025031 - RNA, 15 nt, Mycobacterium avium subsp. paratuberculosis
cgcaccaccgcccgg

SEQ ID NO: 1025032 - RNA, 15 nt, Mycobacterium avium subsp. paratuberculosis
cgcaccaccucggcg

SEQ ID NO: 1025033 - RNA, 17 nt, Mycobacterium avium subsp. paratuberculosis
cgcaccuucccggccgc

SEQ ID NO: 1025034 - RNA, 20 nt, Mycobacterium avium subsp. paratuberculosis
cgcaccuugcgcccguagcg

SEQ ID NO: 1025035 - RNA, 16 nt, Mycobacterium avium subsp. paratuberculosis
cgcaccuggcagcauc

SEQ ID NO: 1025036 - RNA, 20 nt, Mycobacterium avium subsp. paratuberculosis
cgcacgaccugaacgcgcag

SEQ ID NO: 1025037 - RNA, 22 nt, Mycobacterium avium subsp. paratuberculosis
cgcacgaacggcgcgaaccggg

SEQ ID NO: 1025038 - RNA, 15 nt, Mycobacterium avium subsp. paratuberculosis
cgcaccugccgucga

SEQ ID NO: 1025039 - RNA, 15 nt, Mycobacterium avium subsp. paratuberculosis
cgcaccugcgcgccg

SEQ ID NO: 1025040 - RNA, 14 nt, Mycobacterium avium subsp. paratuberculosis
cgcaccugcggccc

SEQ ID NO: 1025041 - RNA, 16 nt, Mycobacterium avium subsp. paratuberculosis
cgcaccugcggccccu

SEQ ID NO: 1025042 - RNA, 16 nt, Mycobacterium avium subsp. paratuberculosis
cgcaccugaaccgcgc

SEQ ID NO: 1025043 - RNA, 16 nt, Mycobacterium avium subsp. paratuberculosis
cgcaccucgccggccg

SEQ ID NO: 1025044 - RNA, 14 nt, Mycobacterium avium subsp. paratuberculosis
cgcaccucgcucag

SEQ ID NO: 1025045 - RNA, 15 nt, Mycobacterium avium subsp. paratuberculosis
cgcaccucgcucagc

SEQ ID NO: 1025046 - RNA, 23 nt, Mycobacterium avium subsp. paratuberculosis
cgauggcggcgugcagucccaga

SEQ ID NO: 1025047 - RNA, 19 nt, Mycobacterium avium subsp. paratuberculosis
cgaugggcaauaccggcag

SEQ ID NO: 1025048 - RNA, 21 nt, Mycobacterium avium subsp. paratuberculosis
cgaugggcaauaccggcagca

SEQ ID NO: 1025049 - RNA, 19 nt, Mycobacterium avium subsp. paratuberculosis
cgauggucagcugccgcac

SEQ ID NO: 1025050 - RNA, 20 nt, Mycobacterium avium subsp. paratuberculosis
cgauggugaaccacuucugg

SEQ ID NO: 1025051 - RNA, 15 nt, Mycobacterium avium subsp. paratuberculosis
cgaugcgguugauca

SEQ ID NO: 1025052 - RNA, 14 nt, Mycobacterium avium subsp. paratuberculosis
cgaugcggccggcg

SEQ ID NO: 1025053 - RNA, 15 nt, Mycobacterium avium subsp. paratuberculosis
cgaugcggccgucgg

SEQ ID NO: 1025054 - RNA, 15 nt, Mycobacterium avium subsp. paratuberculosis
cgaugcgcggcccgu

SEQ ID NO: 1025055 - RNA, 13 nt, Mycobacterium avium subsp. paratuberculosis
cgaugcgcggccc

SEQ ID NO: 1025056 - RNA, 13 nt, Mycobacterium avium subsp. paratuberculosis
cgaugcgccgcac

SEQ ID NO: 1025057 - RNA, 18 nt, Mycobacterium avium subsp. paratuberculosis
cgaucaaaucccgcagcu

SEQ ID NO: 1025058 - RNA, 16 nt, Mycobacterium avium subsp. paratuberculosis
cgaucaacaccgccag

SEQ ID NO: 1025059 - RNA, 13 nt, Mycobacterium avium subsp. paratuberculosis
cgaugaucaggcc

SEQ ID NO: 1025060 - RNA, 18 nt, Mycobacterium avium subsp. paratuberculosis
cgaugcgcaccaucaccu

SEQ ID NO: 1025061 - RNA, 20 nt, Mycobacterium avium subsp. paratuberculosis
cgaugcgacgcaccucggcc

SEQ ID NO: 1025062 - RNA, 12 nt, Mycobacterium avium subsp. paratuberculosis
cgaugccgcgcu

SEQ ID NO: 1025063 - RNA, 20 nt, Mycobacterium avium subsp. paratuberculosis
cgaugccgcgcugcgccggg

SEQ ID NO: 1025064 - RNA, 16 nt, Mycobacterium avium subsp. paratuberculosis
cgaugccggcaaccgc

SEQ ID NO: 1025065 - RNA, 17 nt, Mycobacterium avium subsp. paratuberculosis
cgaugccggccagcggc

SEQ ID NO: 1025066 - RNA, 15 nt, Mycobacterium avium subsp. paratuberculosis
cgaugccggccaggc

SEQ ID NO: 1025067 - RNA, 13 nt, Mycobacterium avium subsp. paratuberculosis
cgaugccggccgg

SEQ ID NO: 1025068 - RNA, 15 nt, Mycobacterium avium subsp. paratuberculosis
cgaugccggccuggc

SEQ ID NO: 1025069 - RNA, 23 nt, Mycobacterium avium subsp. paratuberculosis
cgaugccggccuggcccagccgc

SEQ ID NO: 1025070 - RNA, 20 nt, Mycobacterium avium subsp. paratuberculosis
cgaugaucgccggcgccgga

SEQ ID NO: 1025071 - RNA, 18 nt, Mycobacterium avium subsp. paratuberculosis
cgaugaucgucggcagcg

SEQ ID NO: 1025072 - RNA, 16 nt, Mycobacterium avium subsp. paratuberculosis
cgauucuugaccaccu

SEQ ID NO: 1025073 - RNA, 18 nt, Mycobacterium avium subsp. paratuberculosis
cgauugcccgacuccuca

SEQ ID NO: 1025074 - RNA, 19 nt, Mycobacterium avium subsp. paratuberculosis
cgauguugaccacccgcag

SEQ ID NO: 1025075 - RNA, 19 nt, Mycobacterium avium subsp. paratuberculosis
cgauguugaucguccccac

SEQ ID NO: 1025076 - RNA, 23 nt, Mycobacterium avium subsp. paratuberculosis
cgaugugcucggucaacccgauc

SEQ ID NO: 1025077 - RNA, 20 nt, Mycobacterium avium subsp. paratuberculosis
cgaugucggccagcgcggcg

SEQ ID NO: 1025078 - RNA, 19 nt, Mycobacterium avium subsp. paratuberculosis
cgccgcggaagccccaggc

SEQ ID NO: 1025079 - RNA, 15 nt, Mycobacterium avium subsp. paratuberculosis
cgccgcggccacacu

SEQ ID NO: 1025080 - RNA, 14 nt, Mycobacterium avium subsp. paratuberculosis
cgccgcggccaggu

SEQ ID NO: 1025081 - RNA, 11 nt, Mycobacterium avium subsp. paratuberculosis
cgccgcggcgc

SEQ ID NO: 1025082 - RNA, 14 nt, Mycobacterium avium subsp. paratuberculosis
cgccgcggcgcccu

SEQ ID NO: 1025083 - RNA, 16 nt, Mycobacterium avium subsp. paratuberculosis
cgccgcggcgccgcca

SEQ ID NO: 1025084 - RNA, 17 nt, Mycobacterium avium subsp. paratuberculosis
cgccgcggcgccgccac

SEQ ID NO: 1025085 - RNA, 11 nt, Mycobacterium avium subsp. paratuberculosis
cgccgcggcga

SEQ ID NO: 1025086 - RNA, 18 nt, Mycobacterium avium subsp. paratuberculosis
cgccgcggcgagccggcc

SEQ ID NO: 1025087 - RNA, 20 nt, Mycobacterium avium subsp. paratuberculosis
cgccgcggcgagccggccgu

SEQ ID NO: 1025088 - RNA, 18 nt, Mycobacterium avium subsp. paratuberculosis
cgccgcggccagcgcccc

SEQ ID NO: 1025089 - RNA, 21 nt, Mycobacterium avium subsp. paratuberculosis
cgccgcggccagcgccccgcc

SEQ ID NO: 1025090 - RNA, 17 nt, Mycobacterium avium subsp. paratuberculosis
cgccgcggccgcggcgg

SEQ ID NO: 1025091 - RNA, 13 nt, Mycobacterium avium subsp. paratuberculosis
cgccgcggccgcu

SEQ ID NO: 1025092 - RNA, 12 nt, Mycobacterium avium subsp. paratuberculosis
cgccgcggcggc

SEQ ID NO: 1025093 - RNA, 17 nt, Mycobacterium avium subsp. paratuberculosis
cgccgcggcggccugcu

SEQ ID NO: 1025094 - RNA, 13 nt, Mycobacterium avium subsp. paratuberculosis
cgccgcggcggcu

SEQ ID NO: 1025095 - RNA, 13 nt, Mycobacterium avium subsp. paratuberculosis
cgccgcgggcgcc

SEQ ID NO: 1025096 - RNA, 20 nt, Mycobacterium avium subsp. paratuberculosis
cgccgcgguagaaccaacgc

SEQ ID NO: 1025097 - RNA, 14 nt, Mycobacterium avium subsp. paratuberculosis
cgccgcggucaucg

SEQ ID NO: 1025098 - RNA, 20 nt, Mycobacterium avium subsp. paratuberculosis
cgccgcggucaucgagccgg

SEQ ID NO: 1025099 - RNA, 19 nt, Mycobacterium avium subsp. paratuberculosis
cgccgcgguggcgccgcgg

SEQ ID NO: 1025100 - RNA, 20 nt, Mycobacterium avium subsp. paratuberculosis
cgccgcgguggguccgccgg

SEQ ID NO: 1025101 - RNA, 21 nt, Mycobacterium avium subsp. paratuberculosis
cgccgcguacagcagcugccc

SEQ ID NO: 1025102 - RNA, 16 nt, Mycobacterium avium subsp. paratuberculosis
cgccgcguacagccag

SEQ ID NO: 1025103 - RNA, 17 nt, Mycobacterium avium subsp. paratuberculosis
cgccgcguacgccgccu

SEQ ID NO: 1025104 - RNA, 16 nt, Mycobacterium avium subsp. paratuberculosis
cgccgcuguccucguc

SEQ ID NO: 1025105 - RNA, 23 nt, Mycobacterium avium subsp. paratuberculosis
cgccgcugcgugcccggaucgcc

SEQ ID NO: 1025106 - RNA, 15 nt, Mycobacterium avium subsp. paratuberculosis
cgccgcugcgcgcgc

SEQ ID NO: 1025107 - RNA, 17 nt, Mycobacterium avium subsp. paratuberculosis
cgccgcuucgucgccgg

SEQ ID NO: 1025108 - RNA, 15 nt, Mycobacterium avium subsp. paratuberculosis
cgccgcucggccagc

SEQ ID NO: 1025109 - RNA, 23 nt, Mycobacterium avium subsp. paratuberculosis
cgccgcuagguuuggccagcacc

SEQ ID NO: 1025110 - RNA, 18 nt, Mycobacterium avium subsp. paratuberculosis
cgccgcgucgccgccggg

SEQ ID NO: 1025111 - RNA, 19 nt, Mycobacterium avium subsp. paratuberculosis
cgccgcgucgcgccgccgc

SEQ ID NO: 1025112 - RNA, 20 nt, Mycobacterium avium subsp. paratuberculosis
cgccgcgucggucagcgcca

SEQ ID NO: 1025113 - RNA, 19 nt, Mycobacterium avium subsp. paratuberculosis
cgccgcgcucgcaccagcg

SEQ ID NO: 1025114 - RNA, 13 nt, Mycobacterium avium subsp. paratuberculosis
cgccgcgcucggc

SEQ ID NO: 1025115 - RNA, 15 nt, Mycobacterium avium subsp. paratuberculosis
cgccgcgcucgugcu

SEQ ID NO: 1025116 - RNA, 22 nt, Mycobacterium avium subsp. paratuberculosis
cgccgcgcgcggccaccgcgcg

SEQ ID NO: 1025117 - RNA, 15 nt, Mycobacterium avium subsp. paratuberculosis
cgccgcgcgcgcggc

SEQ ID NO: 1025118 - RNA, 17 nt, Mycobacterium avium subsp. paratuberculosis
cgccgcgcgcgcggccu

SEQ ID NO: 1025119 - RNA, 22 nt, Mycobacterium avium subsp. paratuberculosis
cgccgcgcgcgcggccuccagc

SEQ ID NO: 1025120 - RNA, 16 nt, Mycobacterium avium subsp. paratuberculosis
cgccgcgccgcccggc

SEQ ID NO: 1025121 - RNA, 14 nt, Mycobacterium avium subsp. paratuberculosis
cgccgcgccggcac

SEQ ID NO: 1025122 - RNA, 14 nt, Mycobacterium avium subsp. paratuberculosis
cgccgcgccgccgg

SEQ ID NO: 1025123 - RNA, 13 nt, Mycobacterium avium subsp. paratuberculosis
cgccgcgccgccc

SEQ ID NO: 1025124 - RNA, 24 nt, Mycobacterium avium subsp. paratuberculosis
cgccgcgcccggcuucgccgcgcu

SEQ ID NO: 1025125 - RNA, 15 nt, Mycobacterium avium subsp. paratuberculosis
cgccgcgccagccgc

SEQ ID NO: 1025126 - RNA, 13 nt, Mycobacterium avium subsp. paratuberculosis
cgccgcgcaccgc

SEQ ID NO: 1025127 - RNA, 13 nt, Mycobacterium avium subsp. paratuberculosis
cgccgcgcacgac

SEQ ID NO: 1025128 - RNA, 19 nt, Mycobacterium avium subsp. paratuberculosis
cgccgcgaucuugccgccg

SEQ ID NO: 1025129 - RNA, 22 nt, Mycobacterium avium subsp. paratuberculosis
cgccgcgaugaucacacccacg

SEQ ID NO: 1025130 - RNA, 22 nt, Mycobacterium avium subsp. paratuberculosis
cgccgcgaugcaacaccgaacg

SEQ ID NO: 1025131 - RNA, 18 nt, Mycobacterium avium subsp. paratuberculosis
cgccgcgcccgccggccc

SEQ ID NO: 1025132 - RNA, 22 nt, Mycobacterium avium subsp. paratuberculosis
cgccgcgcagcggggcgcgcag

SEQ ID NO: 1025133 - RNA, 18 nt, Mycobacterium avium subsp. paratuberculosis
cgccgcgcaggccgccga

SEQ ID NO: 1025134 - RNA, 20 nt, Mycobacterium avium subsp. paratuberculosis
cgccgcgcaucaucgcccag

SEQ ID NO: 1025135 - RNA, 16 nt, Mycobacterium avium subsp. paratuberculosis
cgccgcgagccgccca

SEQ ID NO: 1025136 - RNA, 23 nt, Mycobacterium avium subsp. paratuberculosis
cgccgcgaacgacgaccuccccc

SEQ ID NO: 1025137 - RNA, 17 nt, Mycobacterium avium subsp. paratuberculosis
cgccgccugagcccgcc

SEQ ID NO: 1025138 - RNA, 16 nt, Mycobacterium avium subsp. paratuberculosis
cgccgccuccgacagc

SEQ ID NO: 1025139 - RNA, 16 nt, Mycobacterium avium subsp. paratuberculosis
cgccgccggucgcccc

SEQ ID NO: 1025140 - RNA, 20 nt, Mycobacterium avium subsp. paratuberculosis
cgccgccgucguagccgcgg

SEQ ID NO: 1025141 - RNA, 14 nt, Mycobacterium avium subsp. paratuberculosis
cgccgccguucgcc

SEQ ID NO: 1025142 - RNA, 19 nt, Mycobacterium avium subsp. paratuberculosis
cgccgccguucgccggcga

SEQ ID NO: 1025143 - RNA, 14 nt, Mycobacterium avium subsp. paratuberculosis
cgccgccggcggcg

SEQ ID NO: 1025144 - RNA, 13 nt, Mycobacterium avium subsp. paratuberculosis
cgccgccggcggu

SEQ ID NO: 1025145 - RNA, 14 nt, Mycobacterium avium subsp. paratuberculosis
cgccgccgggcgcc

SEQ ID NO: 1025146 - RNA, 19 nt, Mycobacterium avium subsp. paratuberculosis
cgccgcccccgccgcgagc

SEQ ID NO: 1025147 - RNA, 17 nt, Mycobacterium avium subsp. paratuberculosis
cgccgucgaaggccggg

SEQ ID NO: 1025148 - RNA, 16 nt, Mycobacterium avium subsp. paratuberculosis
cgccguaggccgcgcu

SEQ ID NO: 1025149 - RNA, 21 nt, Mycobacterium avium subsp. paratuberculosis
cgccguagaucacgccgguga

SEQ ID NO: 1025150 - RNA, 20 nt, Mycobacterium avium subsp. paratuberculosis
cgccguacgcgccggccagc

SEQ ID NO: 1025151 - RNA, 17 nt, Mycobacterium avium subsp. paratuberculosis
cgccguagaauccgccg

SEQ ID NO: 1025152 - RNA, 23 nt, Mycobacterium avium subsp. paratuberculosis
cgccguacagcugguccggccgg

SEQ ID NO: 1025153 - RNA, 18 nt, Mycobacterium avium subsp. paratuberculosis
cgccgguuuucggcgugu

SEQ ID NO: 1025154 - RNA, 23 nt, Mycobacterium avium subsp. paratuberculosis
cgccggugagcacgaccgccagc

SEQ ID NO: 1025155 - RNA, 15 nt, Mycobacterium avium subsp. paratuberculosis
cgccgguccggcccu

SEQ ID NO: 1025156 - RNA, 18 nt, Mycobacterium avium subsp. paratuberculosis
cgccggucgacgcggggc

SEQ ID NO: 1025157 - RNA, 18 nt, Mycobacterium avium subsp. paratuberculosis
cgccggucccgcggcggc

SEQ ID NO: 1025158 - RNA, 20 nt, Mycobacterium avium subsp. paratuberculosis
cgccggugaagcgggacagc

SEQ ID NO: 1025159 - RNA, 13 nt, Mycobacterium avium subsp. paratuberculosis
cgccggugaccug

SEQ ID NO: 1025160 - RNA, 21 nt, Mycobacterium avium subsp. paratuberculosis
cgccggugaccugcagcgccu

SEQ ID NO: 1025161 - RNA, 20 nt, Mycobacterium avium subsp. paratuberculosis
cgccgguccagugccggcga

SEQ ID NO: 1025162 - RNA, 21 nt, Mycobacterium avium subsp. paratuberculosis
cgccgguccagugccggcgag

SEQ ID NO: 1025163 - RNA, 20 nt, Mycobacterium avium subsp. paratuberculosis
cgccgguaucgagcaccagc

SEQ ID NO: 1025164 - RNA, 15 nt, Mycobacterium avium subsp. paratuberculosis
cgccggucagcggca

SEQ ID NO: 1025165 - RNA, 14 nt, Mycobacterium avium subsp. paratuberculosis
cgccggggacccgc

SEQ ID NO: 1025166 - RNA, 19 nt, Mycobacterium avium subsp. paratuberculosis
cgccggggacgacggcggg

SEQ ID NO: 1025167 - RNA, 19 nt, Mycobacterium avium subsp. paratuberculosis
cgccgguaggccgcgccga

SEQ ID NO: 1025168 - RNA, 15 nt, Mycobacterium avium subsp. paratuberculosis
cgccggcuccaccgc

SEQ ID NO: 1025169 - RNA, 18 nt, Mycobacterium avium subsp. paratuberculosis
cgccggcugacugccggc

SEQ ID NO: 1025170 - RNA, 19 nt, Mycobacterium avium subsp. paratuberculosis
cgccggcgugcacaggccg

SEQ ID NO: 1025171 - RNA, 18 nt, Mycobacterium avium subsp. paratuberculosis
cgccggcuagacgcgcag

SEQ ID NO: 1025172 - RNA, 13 nt, Mycobacterium avium subsp. paratuberculosis
cgccggcucagcg

SEQ ID NO: 1025173 - RNA, 17 nt, Mycobacterium avium subsp. paratuberculosis
cgccggcggcgcccgcg

SEQ ID NO: 1025174 - RNA, 19 nt, Mycobacterium avium subsp. paratuberculosis
cgccggcggugcggguggu

SEQ ID NO: 1025175 - RNA, 24 nt, Mycobacterium avium subsp. paratuberculosis
cgccggcguagaccagcgacgcca

SEQ ID NO: 1025176 - RNA, 16 nt, Mycobacterium avium subsp. paratuberculosis
cgccggcggccgccgc

SEQ ID NO: 1025177 - RNA, 14 nt, Mycobacterium avium subsp. paratuberculosis
cgccggcggccgcg

SEQ ID NO: 1025178 - RNA, 19 nt, Mycobacterium avium subsp. paratuberculosis
cgccggcggccuccgccac

SEQ ID NO: 1025179 - RNA, 13 nt, Mycobacterium avium subsp. paratuberculosis
cgccggcggccgc

SEQ ID NO: 1025180 - RNA, 16 nt, Mycobacterium avium subsp. paratuberculosis
cgccggcgcggccagc

SEQ ID NO: 1025181 - RNA, 19 nt, Mycobacterium avium subsp. paratuberculosis
cgccggcgcgggccgcagc

SEQ ID NO: 1025182 - RNA, 19 nt, Mycobacterium avium subsp. paratuberculosis
cgccggcgcgggggcggcc

SEQ ID NO: 1025183 - RNA, 13 nt, Mycobacterium avium subsp. paratuberculosis
cgccggcgcgucc

SEQ ID NO: 1025184 - RNA, 12 nt, Mycobacterium avium subsp. paratuberculosis
cgccggcgcgcu

SEQ ID NO: 1025185 - RNA, 20 nt, Mycobacterium avium subsp. paratuberculosis
cgccggcgcuuugccguccc

SEQ ID NO: 1025186 - RNA, 23 nt, Mycobacterium avium subsp. paratuberculosis
cgccgggauauucgcccagcggc

SEQ ID NO: 1025187 - RNA, 18 nt, Mycobacterium avium subsp. paratuberculosis
cgccgggaucacacgcgc

SEQ ID NO: 1025188 - RNA, 23 nt, Mycobacterium avium subsp. paratuberculosis
cgccgggaucggcagcgcgcccu

SEQ ID NO: 1025189 - RNA, 20 nt, Mycobacterium avium subsp. paratuberculosis
cgccgggaucggcggggcgc

SEQ ID NO: 1025190 - RNA, 20 nt, Mycobacterium avium subsp. paratuberculosis
cgccgggcauccgggccgcc

SEQ ID NO: 1025191 - RNA, 16 nt, Mycobacterium avium subsp. paratuberculosis
cgccggcuugccccgg

SEQ ID NO: 1025192 - RNA, 18 nt, Mycobacterium avium subsp. paratuberculosis
cgccggcuugccccgguc

SEQ ID NO: 1025193 - RNA, 14 nt, Mycobacterium avium subsp. paratuberculosis
cgccggcuggcggg

SEQ ID NO: 1025194 - RNA, 15 nt, Mycobacterium avium subsp. paratuberculosis
cgccgggaaaguugu

SEQ ID NO: 1025195 - RNA, 19 nt, Mycobacterium avium subsp. paratuberculosis
cgccggggaacaccggcga

SEQ ID NO: 1025196 - RNA, 20 nt, Mycobacterium avium subsp. paratuberculosis
cgccggggaacaccggcgag

SEQ ID NO: 1025197 - RNA, 16 nt, Mycobacterium avium subsp. paratuberculosis
cgccgggcgucgcgcu

SEQ ID NO: 1025198 - RNA, 16 nt, Mycobacterium avium subsp. paratuberculosis
cgccgggccggcggcc

SEQ ID NO: 1025199 - RNA, 14 nt, Mycobacterium avium subsp. paratuberculosis
cgccgggcacccgg

SEQ ID NO: 1025200 - RNA, 19 nt, Mycobacterium avium subsp. paratuberculosis
cgccgggcggcguccucga

SEQ ID NO: 1025201 - RNA, 14 nt, Mycobacterium avium subsp. paratuberculosis
cgccgggcgggccg

SEQ ID NO: 1025202 - RNA, 17 nt, Mycobacterium avium subsp. paratuberculosis
cgccgggcggcccgccu

SEQ ID NO: 1025203 - RNA, 12 nt, Mycobacterium avium subsp. paratuberculosis
cgccgggcggcg

SEQ ID NO: 1025204 - RNA, 20 nt, Mycobacterium avium subsp. paratuberculosis
cgccgggccggaucgcgcag

SEQ ID NO: 1025205 - RNA, 19 nt, Mycobacterium avium subsp. paratuberculosis
cgccggcgcagcggcccga

SEQ ID NO: 1025206 - RNA, 21 nt, Mycobacterium avium subsp. paratuberculosis
cgccggcgauaggcggccagc

SEQ ID NO: 1025207 - RNA, 22 nt, Mycobacterium avium subsp. paratuberculosis
cgccggcgauaggcggccagcu

SEQ ID NO: 1025208 - RNA, 21 nt, Mycobacterium avium subsp. paratuberculosis
cgccggccuuggcccgcgccc

SEQ ID NO: 1025209 - RNA, 24 nt, Mycobacterium avium subsp. paratuberculosis
cgccggccuuggcccgcgcccgcu

SEQ ID NO: 1025210 - RNA, 16 nt, Mycobacterium avium subsp. paratuberculosis
cgccggcgaccgccuu

SEQ ID NO: 1025211 - RNA, 23 nt, Mycobacterium avium subsp. paratuberculosis
cgccggcgaccgugcccaccagc

SEQ ID NO: 1025212 - RNA, 17 nt, Mycobacterium avium subsp. paratuberculosis
cgccggcgacggccagc

SEQ ID NO: 1025213 - RNA, 11 nt, Mycobacterium avium subsp. paratuberculosis
cgccggccucu

SEQ ID NO: 1025214 - RNA, 17 nt, Mycobacterium avium subsp. paratuberculosis
cgccggccucucgucga

SEQ ID NO: 1025215 - RNA, 20 nt, Mycobacterium avium subsp. paratuberculosis
cgccggccugcccgccgcgg

SEQ ID NO: 1025216 - RNA, 21 nt, Mycobacterium avium subsp. paratuberculosis
cgccggccgucacgcuggcgu

SEQ ID NO: 1025217 - RNA, 17 nt, Mycobacterium avium subsp. paratuberculosis
cgccggcgccgggcggg

SEQ ID NO: 1025218 - RNA, 20 nt, Mycobacterium avium subsp. paratuberculosis
cgccggccgcucgcgggcca

SEQ ID NO: 1025219 - RNA, 15 nt, Mycobacterium avium subsp. paratuberculosis
cgccggccgcggcgu

SEQ ID NO: 1025220 - RNA, 12 nt, Mycobacterium avium subsp. paratuberculosis
cgccggccggca

SEQ ID NO: 1025221 - RNA, 14 nt, Mycobacterium avium subsp. paratuberculosis
cgccggccggcgug

SEQ ID NO: 1025222 - RNA, 15 nt, Mycobacterium avium subsp. paratuberculosis
cgccggccgggcggg

SEQ ID NO: 1025223 - RNA, 15 nt, Mycobacterium avium subsp. paratuberculosis
cgccggccgggcugc

SEQ ID NO: 1025224 - RNA, 19 nt, Mycobacterium avium subsp. paratuberculosis
cgccggccgggcugcgcag

SEQ ID NO: 1025225 - RNA, 14 nt, Mycobacterium avium subsp. paratuberculosis
cgccggccgcgcag

SEQ ID NO: 1025226 - RNA, 12 nt, Mycobacterium avium subsp. paratuberculosis
cgccggccgccg

SEQ ID NO: 1025227 - RNA, 16 nt, Mycobacterium avium subsp. paratuberculosis
cgccggcccagcucca

SEQ ID NO: 1025228 - RNA, 22 nt, Mycobacterium avium subsp. paratuberculosis
cgccggaggggcgacgggccga

SEQ ID NO: 1025229 - RNA, 14 nt, Mycobacterium avium subsp. paratuberculosis
cgccggagcgcccc

SEQ ID NO: 1025230 - RNA, 15 nt, Mycobacterium avium subsp. paratuberculosis
cgccggaggccagcu

SEQ ID NO: 1025231 - RNA, 13 nt, Mycobacterium avium subsp. paratuberculosis
cgccggagagccc

SEQ ID NO: 1025232 - RNA, 17 nt, Mycobacterium avium subsp. paratuberculosis
cgccggagagcccgucg

SEQ ID NO: 1025233 - RNA, 17 nt, Mycobacterium avium subsp. paratuberculosis
cgccggaucgagcaccc

SEQ ID NO: 1025234 - RNA, 20 nt, Mycobacterium avium subsp. paratuberculosis
cgccggaucgagcacccggc

SEQ ID NO: 1025235 - RNA, 18 nt, Mycobacterium avium subsp. paratuberculosis
cgccggacagccggggca

SEQ ID NO: 1025236 - RNA, 18 nt, Mycobacterium avium subsp. paratuberculosis
cgccggacagcgggccga

SEQ ID NO: 1025237 - RNA, 15 nt, Mycobacterium avium subsp. paratuberculosis
cgccggacggcccgc

SEQ ID NO: 1025238 - RNA, 16 nt, Mycobacterium avium subsp. paratuberculosis
cgccggaccccacagc

SEQ ID NO: 1025239 - RNA, 21 nt, Mycobacterium avium subsp. paratuberculosis
cgccggaccgauccggcgccc

SEQ ID NO: 1025240 - RNA, 23 nt, Mycobacterium avium subsp. paratuberculosis
cgccggaccgauccggcgcccga

SEQ ID NO: 1025241 - RNA, 14 nt, Mycobacterium avium subsp. paratuberculosis
cgccggccagcagc

SEQ ID NO: 1025242 - RNA, 12 nt, Mycobacterium avium subsp. paratuberculosis
cgccggccagcc

SEQ ID NO: 1025243 - RNA, 12 nt, Mycobacterium avium subsp. paratuberculosis
cgccggccagca

SEQ ID NO: 1025244 - RNA, 13 nt, Mycobacterium avium subsp. paratuberculosis
cgccggccagcac

SEQ ID NO: 1025245 - RNA, 24 nt, Mycobacterium avium subsp. paratuberculosis
cgccggccagcacggccagccagc

SEQ ID NO: 1025246 - RNA, 20 nt, Mycobacterium avium subsp. paratuberculosis
cgccggccagcacggcggcg

SEQ ID NO: 1025247 - RNA, 14 nt, Mycobacterium avium subsp. paratuberculosis
cgccggccaccaac

SEQ ID NO: 1025248 - RNA, 15 nt, Mycobacterium avium subsp. paratuberculosis
cgccggcaguccgga

SEQ ID NO: 1025249 - RNA, 18 nt, Mycobacterium avium subsp. paratuberculosis
cgccggcaucgaccgccc

SEQ ID NO: 1025250 - RNA, 16 nt, Mycobacterium avium subsp. paratuberculosis
cgccggcaccagcagc

SEQ ID NO: 1025251 - RNA, 21 nt, Mycobacterium avium subsp. paratuberculosis
cgccggcaccagcagccgcag

SEQ ID NO: 1025252 - RNA, 13 nt, Mycobacterium avium subsp. paratuberculosis
cgccggcacugcu

SEQ ID NO: 1025253 - RNA, 21 nt, Mycobacterium avium subsp. paratuberculosis
cgccggcagcaaccggcggcu

SEQ ID NO: 1025254 - RNA, 13 nt, Mycobacterium avium subsp. paratuberculosis
cgccggaugcugc

SEQ ID NO: 1025255 - RNA, 14 nt, Mycobacterium avium subsp. paratuberculosis
cgccggaugcugcg

SEQ ID NO: 1025256 - RNA, 22 nt, Mycobacterium avium subsp. paratuberculosis
cgccggaucggcccccgggccc

SEQ ID NO: 1025257 - RNA, 19 nt, Mycobacterium avium subsp. paratuberculosis
cgccggcaacuggccgccc

SEQ ID NO: 1025258 - RNA, 21 nt, Mycobacterium avium subsp. paratuberculosis
cgccggcaacuggccgcccgg

SEQ ID NO: 1025259 - RNA, 15 nt, Mycobacterium avium subsp. paratuberculosis
cgcccucgccccgga

SEQ ID NO: 1025260 - RNA, 16 nt, Mycobacterium avium subsp. paratuberculosis
cgcccucgccccggau

SEQ ID NO: 1025261 - RNA, 16 nt, Mycobacterium avium subsp. paratuberculosis
cgcccucgcugccgcc

SEQ ID NO: 1025262 - RNA, 14 nt, Mycobacterium avium subsp. paratuberculosis
cgcccuggccgccg

SEQ ID NO: 1025263 - RNA, 18 nt, Mycobacterium avium subsp. paratuberculosis
cgcccuggcauccgucgg

SEQ ID NO: 1025264 - RNA, 20 nt, Mycobacterium avium subsp. paratuberculosis
cgcccugcugggagcggccc

SEQ ID NO: 1025265 - RNA, 17 nt, Mycobacterium avium subsp. paratuberculosis
cgccgaacgugcgcggc

SEQ ID NO: 1025266 - RNA, 18 nt, Mycobacterium avium subsp. paratuberculosis
cgccgaacucggcgccgc

SEQ ID NO: 1025267 - RNA, 21 nt, Mycobacterium avium subsp. paratuberculosis
cgccgaacucggcgccgccgg

SEQ ID NO: 1025268 - RNA, 17 nt, Mycobacterium avium subsp. paratuberculosis
cgccgaacugccggacc

SEQ ID NO: 1025269 - RNA, 16 nt, Mycobacterium avium subsp. paratuberculosis
cgcccuggccgccggc

SEQ ID NO: 1025270 - RNA, 18 nt, Mycobacterium avium subsp. paratuberculosis
cgccgaagcggcgcacgc

SEQ ID NO: 1025271 - RNA, 20 nt, Mycobacterium avium subsp. paratuberculosis
cgccgaagaucagcgcgucc

SEQ ID NO: 1025272 - RNA, 18 nt, Mycobacterium avium subsp. paratuberculosis
cgccgaagauggccagcg

SEQ ID NO: 1025273 - RNA, 17 nt, Mycobacterium avium subsp. paratuberculosis
cgccgaccucggccagc

SEQ ID NO: 1025274 - RNA, 21 nt, Mycobacterium avium subsp. paratuberculosis
cgccgaccgcggucgcggcgc

SEQ ID NO: 1025275 - RNA, 14 nt, Mycobacterium avium subsp. paratuberculosis
cgccgaccgguccg

SEQ ID NO: 1025276 - RNA, 18 nt, Mycobacterium avium subsp. paratuberculosis
cgccgaccgguccgccgc

SEQ ID NO: 1025277 - RNA, 17 nt, Mycobacterium avium subsp. paratuberculosis
cgccgacaccaccgcgc

SEQ ID NO: 1025278 - RNA, 14 nt, Mycobacterium avium subsp. paratuberculosis
cgccgacaccagcg

SEQ ID NO: 1025279 - RNA, 15 nt, Mycobacterium avium subsp. paratuberculosis
cgccgacaccagcgc

SEQ ID NO: 1025280 - RNA, 14 nt, Mycobacterium avium subsp. paratuberculosis
cgccgaccgcccgc

SEQ ID NO: 1025281 - RNA, 17 nt, Mycobacterium avium subsp. paratuberculosis
cgcccggaugccggcgc

SEQ ID NO: 1025282 - RNA, 23 nt, Mycobacterium avium subsp. paratuberculosis
cgcccggaccaggguggccccag

SEQ ID NO: 1025283 - RNA, 17 nt, Mycobacterium avium subsp. paratuberculosis
cgcccggacccgcucgc

SEQ ID NO: 1025284 - RNA, 20 nt, Mycobacterium avium subsp. paratuberculosis
cgcccgcugaccgccgcgcu

SEQ ID NO: 1025285 - RNA, 15 nt, Mycobacterium avium subsp. paratuberculosis
cgcccggcagccgcu

SEQ ID NO: 1025286 - RNA, 24 nt, Mycobacterium avium subsp. paratuberculosis
cgcccggcagccgcuccggcccga

SEQ ID NO: 1025287 - RNA, 14 nt, Mycobacterium avium subsp. paratuberculosis
cgcccggcaccggg

SEQ ID NO: 1025288 - RNA, 18 nt, Mycobacterium avium subsp. paratuberculosis
cgcccggauucgcggcgg

SEQ ID NO: 1025289 - RNA, 23 nt, Mycobacterium avium subsp. paratuberculosis
cgcccggauucgcggcggcgccg

SEQ ID NO: 1025290 - RNA, 14 nt, Mycobacterium avium subsp. paratuberculosis
cgcccggcaacacg

SEQ ID NO: 1025291 - RNA, 12 nt, Mycobacterium avium subsp. paratuberculosis
cgcccggcugcg

SEQ ID NO: 1025292 - RNA, 17 nt, Mycobacterium avium subsp. paratuberculosis
cgcccggcugcgccgcg

SEQ ID NO: 1025293 - RNA, 19 nt, Mycobacterium avium subsp. paratuberculosis
cgcccggcuucgccgcgcu

SEQ ID NO: 1025294 - RNA, 20 nt, Mycobacterium avium subsp. paratuberculosis
cgcccggcuucgccgcgcuu

SEQ ID NO: 1025295 - RNA, 20 nt, Mycobacterium avium subsp. paratuberculosis
cgcccgggcacgacggucag

SEQ ID NO: 1025296 - RNA, 16 nt, Mycobacterium avium subsp. paratuberculosis
cgcccgggccaggacc

SEQ ID NO: 1025297 - RNA, 21 nt, Mycobacterium avium subsp. paratuberculosis
cgcccggcguccagugcaugc

SEQ ID NO: 1025298 - RNA, 14 nt, Mycobacterium avium subsp. paratuberculosis
cgcccggcagcggu

SEQ ID NO: 1025299 - RNA, 16 nt, Mycobacterium avium subsp. paratuberculosis
cgcccgggccgcgccc

SEQ ID NO: 1025300 - RNA, 22 nt, Mycobacterium avium subsp. paratuberculosis
cgcccggucgaggucggccagc

SEQ ID NO: 1025301 - RNA, 15 nt, Mycobacterium avium subsp. paratuberculosis
cgcccgggcggcggg

SEQ ID NO: 1025302 - RNA, 17 nt, Mycobacterium avium subsp. paratuberculosis
cgcccgggugcugcggc

SEQ ID NO: 1025303 - RNA, 17 nt, Mycobacterium avium subsp. paratuberculosis
cgcccgguaggccgccg

SEQ ID NO: 1025304 - RNA, 18 nt, Mycobacterium avium subsp. paratuberculosis
cgcccgguaggccgccgc

SEQ ID NO: 1025305 - RNA, 20 nt, Mycobacterium avium subsp. paratuberculosis
cgcccgguaggccgccgcga

SEQ ID NO: 1025306 - RNA, 20 nt, Mycobacterium avium subsp. paratuberculosis
cgcccggucaggaacccggc

SEQ ID NO: 1025307 - RNA, 19 nt, Mycobacterium avium subsp. paratuberculosis
cgcccggucgaccaggguu

SEQ ID NO: 1025308 - RNA, 14 nt, Mycobacterium avium subsp. paratuberculosis
cgcccggggcggcg

SEQ ID NO: 1025309 - RNA, 13 nt, Mycobacterium avium subsp. paratuberculosis
cgcccgggcggcg

SEQ ID NO: 1025310 - RNA, 12 nt, Mycobacterium avium subsp. paratuberculosis
cgcccgggcgcg

SEQ ID NO: 1025311 - RNA, 18 nt, Mycobacterium avium subsp. paratuberculosis
cgcccuagucgacgccga

SEQ ID NO: 1025312 - RNA, 12 nt, Mycobacterium avium subsp. paratuberculosis
cgcccuccccgg

SEQ ID NO: 1025313 - RNA, 15 nt, Mycobacterium avium subsp. paratuberculosis
cgcccuccccggcca

SEQ ID NO: 1025314 - RNA, 12 nt, Mycobacterium avium subsp. paratuberculosis
cgcccuccuggc

SEQ ID NO: 1025315 - RNA, 23 nt, Mycobacterium avium subsp. paratuberculosis
cgcccucgauaauggcggccgcc

SEQ ID NO: 1025316 - RNA, 17 nt, Mycobacterium avium subsp. paratuberculosis
cgccgacgcccacagcg

SEQ ID NO: 1025317 - RNA, 15 nt, Mycobacterium avium subsp. paratuberculosis
cgccgacgcccaggc

SEQ ID NO: 1025318 - RNA, 12 nt, Mycobacterium avium subsp. paratuberculosis
cgccgacgcaug

SEQ ID NO: 1025319 - RNA, 20 nt, Mycobacterium avium subsp. paratuberculosis
cgccgacgcauguccgccgu

SEQ ID NO: 1025320 - RNA, 15 nt, Mycobacterium avium subsp. paratuberculosis
cgccgacgacgucgc

SEQ ID NO: 1025321 - RNA, 20 nt, Mycobacterium avium subsp. paratuberculosis
cgccgacgauccgcgccgcg

SEQ ID NO: 1025322 - RNA, 12 nt, Mycobacterium avium subsp. paratuberculosis
cgccgaccuugg

SEQ ID NO: 1025323 - RNA, 17 nt, Mycobacterium avium subsp. paratuberculosis
cgccgagcaccuggccg

SEQ ID NO: 1025324 - RNA, 19 nt, Mycobacterium avium subsp. paratuberculosis
cgccgagcacgaacgcggc

SEQ ID NO: 1025325 - RNA, 21 nt, Mycobacterium avium subsp. paratuberculosis
cgccgagcacgaacgcggccg

SEQ ID NO: 1025326 - RNA, 21 nt, Mycobacterium avium subsp. paratuberculosis
cgccgagcagaucggguccca

SEQ ID NO: 1025327 - RNA, 13 nt, Mycobacterium avium subsp. paratuberculosis
cgccgagcagcac

SEQ ID NO: 1025328 - RNA, 20 nt, Mycobacterium avium subsp. paratuberculosis
cgccgagccgcgccacgcgc

SEQ ID NO: 1025329 - RNA, 22 nt, Mycobacterium avium subsp. paratuberculosis
cgccgagccgcgccacgcgcag

SEQ ID NO: 1025330 - RNA, 19 nt, Mycobacterium avium subsp. paratuberculosis
cgccgagccgcuccaccgc

SEQ ID NO: 1025331 - RNA, 14 nt, Mycobacterium avium subsp. paratuberculosis
cgccgagccggcac

SEQ ID NO: 1025332 - RNA, 17 nt, Mycobacterium avium subsp. paratuberculosis
cgccgagcagcaccggc

SEQ ID NO: 1025333 - RNA, 21 nt, Mycobacterium avium subsp. paratuberculosis
cgccgaggcgcucggcccgcu

SEQ ID NO: 1025334 - RNA, 17 nt, Mycobacterium avium subsp. paratuberculosis
cgccgaggcgugccgcu

SEQ ID NO: 1025335 - RNA, 21 nt, Mycobacterium avium subsp. paratuberculosis
cgccgaggcgugccgcuggga

SEQ ID NO: 1025336 - RNA, 22 nt, Mycobacterium avium subsp. paratuberculosis
cgccgaggcgugccgcugggag

SEQ ID NO: 1025337 - RNA, 18 nt, Mycobacterium avium subsp. paratuberculosis
cgccgagggcccgggcag

SEQ ID NO: 1025338 - RNA, 18 nt, Mycobacterium avium subsp. paratuberculosis
cgccgaggucaccgcggg

SEQ ID NO: 1025339 - RNA, 22 nt, Mycobacterium avium subsp. paratuberculosis
cgccgagcgugcauucagugcg

SEQ ID NO: 1025340 - RNA, 17 nt, Mycobacterium avium subsp. paratuberculosis
cgccgaucaacaggccc

SEQ ID NO: 1025341 - RNA, 23 nt, Mycobacterium avium subsp. paratuberculosis
cgccgaucaacaggcccagcagc

SEQ ID NO: 1025342 - RNA, 17 nt, Mycobacterium avium subsp. paratuberculosis
cgccgaguccgggccgc

SEQ ID NO: 1025343 - RNA, 23 nt, Mycobacterium avium subsp. paratuberculosis
cgccgaguccgggccgccggccg

SEQ ID NO: 1025344 - RNA, 18 nt, Mycobacterium avium subsp. paratuberculosis
cgccgagucgaucgccag

SEQ ID NO: 1025345 - RNA, 24 nt, Mycobacterium avium subsp. paratuberculosis
cgccgagguggccgccagcaccuc

SEQ ID NO: 1025346 - RNA, 16 nt, Mycobacterium avium subsp. paratuberculosis
cgccgcccaucggcag

SEQ ID NO: 1025347 - RNA, 20 nt, Mycobacterium avium subsp. paratuberculosis
cgccgcccaggccccggccg

SEQ ID NO: 1025348 - RNA, 15 nt, Mycobacterium avium subsp. paratuberculosis
cgccgcccaggccga

SEQ ID NO: 1025349 - RNA, 18 nt, Mycobacterium avium subsp. paratuberculosis
cgccgccauccgcgccga

SEQ ID NO: 1025350 - RNA, 18 nt, Mycobacterium avium subsp. paratuberculosis
cgccgccaucgccgccgc

SEQ ID NO: 1025351 - RNA, 15 nt, Mycobacterium avium subsp. paratuberculosis
cgccgccaucuccuc

SEQ ID NO: 1025352 - RNA, 23 nt, Mycobacterium avium subsp. paratuberculosis
cgccgccaaccaggucgcggcgc

SEQ ID NO: 1025353 - RNA, 18 nt, Mycobacterium avium subsp. paratuberculosis
cgccgcaugaugcggcca

SEQ ID NO: 1025354 - RNA, 20 nt, Mycobacterium avium subsp. paratuberculosis
cgccgccaccccaggcgaug

SEQ ID NO: 1025355 - RNA, 18 nt, Mycobacterium avium subsp. paratuberculosis
cgccgcauuggugccggc

SEQ ID NO: 1025356 - RNA, 14 nt, Mycobacterium avium subsp. paratuberculosis
cgccgccaccggcc

SEQ ID NO: 1025357 - RNA, 16 nt, Mycobacterium avium subsp. paratuberculosis
cgccgccaccggccgg

SEQ ID NO: 1025358 - RNA, 17 nt, Mycobacterium avium subsp. paratuberculosis
cgccgccaccggccggu

SEQ ID NO: 1025359 - RNA, 20 nt, Mycobacterium avium subsp. paratuberculosis
cgccgcauaccgcccgcgcu

SEQ ID NO: 1025360 - RNA, 15 nt, Mycobacterium avium subsp. paratuberculosis
cgccgcaccucgccg

SEQ ID NO: 1025361 - RNA, 16 nt, Mycobacterium avium subsp. paratuberculosis
cgccgcaccucgccgg

SEQ ID NO: 1025362 - RNA, 17 nt, Mycobacterium avium subsp. paratuberculosis
cgccgcaccucgccggc

SEQ ID NO: 1025363 - RNA, 20 nt, Mycobacterium avium subsp. paratuberculosis
cgccgcaccucgccggccgc

SEQ ID NO: 1025364 - RNA, 18 nt, Mycobacterium avium subsp. paratuberculosis
cgccgcacugcacggccu

SEQ ID NO: 1025365 - RNA, 14 nt, Mycobacterium avium subsp. paratuberculosis
cgccgcagccuucu

SEQ ID NO: 1025366 - RNA, 15 nt, Mycobacterium avium subsp. paratuberculosis
cgccgcagcccaggc

SEQ ID NO: 1025367 - RNA, 16 nt, Mycobacterium avium subsp. paratuberculosis
cgccgcagcgcgcgcu

SEQ ID NO: 1025368 - RNA, 18 nt, Mycobacterium avium subsp. paratuberculosis
cgccgcagcagccgcgcc

SEQ ID NO: 1025369 - RNA, 21 nt, Mycobacterium avium subsp. paratuberculosis
cgccgcagcaggugcaucgcc

SEQ ID NO: 1025370 - RNA, 13 nt, Mycobacterium avium subsp. paratuberculosis
cgccaugccgucg

SEQ ID NO: 1025371 - RNA, 18 nt, Mycobacterium avium subsp. paratuberculosis
cgccaugccgucgcgcac

SEQ ID NO: 1025372 - RNA, 20 nt, Mycobacterium avium subsp. paratuberculosis
cgccaugaacggcggggccu

SEQ ID NO: 1025373 - RNA, 20 nt, Mycobacterium avium subsp. paratuberculosis
cgccaucuucacgugcgcgg

SEQ ID NO: 1025374 - RNA, 23 nt, Mycobacterium avium subsp. paratuberculosis
cgccaucuucacgugcgcggcgu

SEQ ID NO: 1025375 - RNA, 19 nt, Mycobacterium avium subsp. paratuberculosis
cgccacgcgucaggcgucg

SEQ ID NO: 1025376 - RNA, 20 nt, Mycobacterium avium subsp. paratuberculosis
cgccacgccguggcccgccc

SEQ ID NO: 1025377 - RNA, 23 nt, Mycobacterium avium subsp. paratuberculosis
cgccacgccguggcccgcccagc

SEQ ID NO: 1025378 - RNA, 16 nt, Mycobacterium avium subsp. paratuberculosis
cgccacgccgaccagg

SEQ ID NO: 1025379 - RNA, 17 nt, Mycobacterium avium subsp. paratuberculosis
cgccacgccgcccccgc

SEQ ID NO: 1025380 - RNA, 20 nt, Mycobacterium avium subsp. paratuberculosis
cgccaccgucgucgagcgcu

SEQ ID NO: 1025381 - RNA, 14 nt, Mycobacterium avium subsp. paratuberculosis
cgccacgcuggcgu

SEQ ID NO: 1025382 - RNA, 15 nt, Mycobacterium avium subsp. paratuberculosis
cgccacggcggccga

SEQ ID NO: 1025383 - RNA, 21 nt, Mycobacterium avium subsp. paratuberculosis
cgccacggcgaacaccucggg

SEQ ID NO: 1025384 - RNA, 21 nt, Mycobacterium avium subsp. paratuberculosis
cgccacggcgacgaccaccag

SEQ ID NO: 1025385 - RNA, 20 nt, Mycobacterium avium subsp. paratuberculosis
cgccacggcgccaugcgccg

SEQ ID NO: 1025386 - RNA, 14 nt, Mycobacterium avium subsp. paratuberculosis
cgccacggccaccg

SEQ ID NO: 1025387 - RNA, 15 nt, Mycobacterium avium subsp. paratuberculosis
cgcccacccgcgccg

SEQ ID NO: 1025388 - RNA, 12 nt, Mycobacterium avium subsp. paratuberculosis
cgcccacccggg

SEQ ID NO: 1025389 - RNA, 16 nt, Mycobacterium avium subsp. paratuberculosis
cgcccacccggggccg

SEQ ID NO: 1025390 - RNA, 12 nt, Mycobacterium avium subsp. paratuberculosis
cgcccaccgacg

SEQ ID NO: 1025391 - RNA, 18 nt, Mycobacterium avium subsp. paratuberculosis
cgcccaccgacgcggcgg

SEQ ID NO: 1025392 - RNA, 19 nt, Mycobacterium avium subsp. paratuberculosis
cgcccaccgacgcggcggc

SEQ ID NO: 1025393 - RNA, 22 nt, Mycobacterium avium subsp. paratuberculosis
cgcccaccgacgcggcggccga

SEQ ID NO: 1025394 - RNA, 16 nt, Mycobacterium avium subsp. paratuberculosis
cgcccagcagcccggc

SEQ ID NO: 1025395 - RNA, 18 nt, Mycobacterium avium subsp. paratuberculosis
cgcccagcagcccggcca

SEQ ID NO: 1025396 - RNA, 20 nt, Mycobacterium avium subsp. paratuberculosis
cgcccagcagcccggccagc

SEQ ID NO: 1025397 - RNA, 13 nt, Mycobacterium avium subsp. paratuberculosis
cgcccacgccgag

SEQ ID NO: 1025398 - RNA, 14 nt, Mycobacterium avium subsp. paratuberculosis
cgcccacgccgccc

SEQ ID NO: 1025399 - RNA, 11 nt, Mycobacterium avium subsp. paratuberculosis
cgcccagcagc

SEQ ID NO: 1025400 - RNA, 17 nt, Mycobacterium avium subsp. paratuberculosis
cgcccagcagcgggccc

SEQ ID NO: 1025401 - RNA, 20 nt, Mycobacterium avium subsp. paratuberculosis
cgcccagcagcgggcccggg

SEQ ID NO: 1025402 - RNA, 15 nt, Mycobacterium avium subsp. paratuberculosis
cgcccagccggcgga

SEQ ID NO: 1025403 - RNA, 21 nt, Mycobacterium avium subsp. paratuberculosis
cgcccagcccgagcaccagcg

SEQ ID NO: 1025404 - RNA, 14 nt, Mycobacterium avium subsp. paratuberculosis
cgcccagcccgcgc

SEQ ID NO: 1025405 - RNA, 17 nt, Mycobacterium avium subsp. paratuberculosis
cgcccagcccgcgccga

SEQ ID NO: 1025406 - RNA, 15 nt, Mycobacterium avium subsp. paratuberculosis
cgcccagcccgcggg

SEQ ID NO: 1025407 - RNA, 19 nt, Mycobacterium avium subsp. paratuberculosis
cgcccagccgagccgggcc

SEQ ID NO: 1025408 - RNA, 18 nt, Mycobacterium avium subsp. paratuberculosis
cgcccaccacgaacgcgc

SEQ ID NO: 1025409 - RNA, 21 nt, Mycobacterium avium subsp. paratuberculosis
cgcccaccacgaacgcgccgc

SEQ ID NO: 1025410 - RNA, 22 nt, Mycobacterium avium subsp. paratuberculosis
cgcccaccacgaacgcgccgcc

SEQ ID NO: 1025411 - RNA, 12 nt, Mycobacterium avium subsp. paratuberculosis
cgcccaccaccg

SEQ ID NO: 1025412 - RNA, 20 nt, Mycobacterium avium subsp. paratuberculosis
cgcccacccgcacgcccggg

SEQ ID NO: 1025413 - RNA, 21 nt, Mycobacterium avium subsp. paratuberculosis
cgcccacccgcacgcccgggc

SEQ ID NO: 1025414 - RNA, 17 nt, Mycobacterium avium subsp. paratuberculosis
cgcccacccgccagccc

SEQ ID NO: 1025415 - RNA, 14 nt, Mycobacterium avium subsp. paratuberculosis
cgcccacagcgcca

SEQ ID NO: 1025416 - RNA, 17 nt, Mycobacterium avium subsp. paratuberculosis
cgccaugugccggcgcu

SEQ ID NO: 1025417 - RNA, 22 nt, Mycobacterium avium subsp. paratuberculosis
cgcccacagcugacgggccggc

SEQ ID NO: 1025418 - RNA, 12 nt, Mycobacterium avium subsp. paratuberculosis
cgcccgcccggc

SEQ ID NO: 1025419 - RNA, 14 nt, Mycobacterium avium subsp. paratuberculosis
cgcccgcccggccc

SEQ ID NO: 1025420 - RNA, 15 nt, Mycobacterium avium subsp. paratuberculosis
cgcccgcccggcccg

SEQ ID NO: 1025421 - RNA, 17 nt, Mycobacterium avium subsp. paratuberculosis
cgcccgccgcguacacc

SEQ ID NO: 1025422 - RNA, 14 nt, Mycobacterium avium subsp. paratuberculosis
cgcccgaucccggg

SEQ ID NO: 1025423 - RNA, 19 nt, Mycobacterium avium subsp. paratuberculosis
cgcccgauuccccggcgug

SEQ ID NO: 1025424 - RNA, 16 nt, Mycobacterium avium subsp. paratuberculosis
cgcccgcagcacgccc

SEQ ID NO: 1025425 - RNA, 21 nt, Mycobacterium avium subsp. paratuberculosis
cgccccgcugccggaccucga

SEQ ID NO: 1025426 - RNA, 15 nt, Mycobacterium avium subsp. paratuberculosis
cgccccgcuaaagcc

SEQ ID NO: 1025427 - RNA, 14 nt, Mycobacterium avium subsp. paratuberculosis
cgccccgcccugcu

SEQ ID NO: 1025428 - RNA, 14 nt, Mycobacterium avium subsp. paratuberculosis
cgccccgccgcggc

SEQ ID NO: 1025429 - RNA, 16 nt, Mycobacterium avium subsp. paratuberculosis
cgccccgccgcggcca

SEQ ID NO: 1025430 - RNA, 13 nt, Mycobacterium avium subsp. paratuberculosis
cgccccggcccgg

SEQ ID NO: 1025431 - RNA, 13 nt, Mycobacterium avium subsp. paratuberculosis
cgccccggcccgu

SEQ ID NO: 1025432 - RNA, 13 nt, Mycobacterium avium subsp. paratuberculosis
cgccccggccgcg

SEQ ID NO: 1025433 - RNA, 16 nt, Mycobacterium avium subsp. paratuberculosis
cgccccggccgcgcac

SEQ ID NO: 1025434 - RNA, 13 nt, Mycobacterium avium subsp. paratuberculosis
cgccccggccuga

SEQ ID NO: 1025435 - RNA, 20 nt, Mycobacterium avium subsp. paratuberculosis
cgccccggcgacgucgccgg

SEQ ID NO: 1025436 - RNA, 22 nt, Mycobacterium avium subsp. paratuberculosis
cgcccgacauccaggaccgcgc

SEQ ID NO: 1025437 - RNA, 23 nt, Mycobacterium avium subsp. paratuberculosis
cgccccggccgcggugaccgcgc

SEQ ID NO: 1025438 - RNA, 18 nt, Mycobacterium avium subsp. paratuberculosis
cgcccgagucacccggcu

SEQ ID NO: 1025439 - RNA, 20 nt, Mycobacterium avium subsp. paratuberculosis
cgcccgagucacccggcugg

SEQ ID NO: 1025440 - RNA, 17 nt, Mycobacterium avium subsp. paratuberculosis
cgcccagucgccgccgc

SEQ ID NO: 1025441 - RNA, 21 nt, Mycobacterium avium subsp. paratuberculosis
cgcccagucgccgccgcgcac

SEQ ID NO: 1025442 - RNA, 14 nt, Mycobacterium avium subsp. paratuberculosis
cgcccaggcucagg

SEQ ID NO: 1025443 - RNA, 13 nt, Mycobacterium avium subsp. paratuberculosis
cgcccagcgcagc

SEQ ID NO: 1025444 - RNA, 20 nt, Mycobacterium avium subsp. paratuberculosis
cgcccagggcgugcgcggcc

SEQ ID NO: 1025445 - RNA, 23 nt, Mycobacterium avium subsp. paratuberculosis
cgcccagggcgugcgcggccgcc

SEQ ID NO: 1025446 - RNA, 18 nt, Mycobacterium avium subsp. paratuberculosis
cgcccaguguggggccua

SEQ ID NO: 1025447 - RNA, 20 nt, Mycobacterium avium subsp. paratuberculosis
cgccccgcaccgagccuggg

SEQ ID NO: 1025448 - RNA, 12 nt, Mycobacterium avium subsp. paratuberculosis
cgccccgcccgc

SEQ ID NO: 1025449 - RNA, 13 nt, Mycobacterium avium subsp. paratuberculosis
cgccccgcccggc

SEQ ID NO: 1025450 - RNA, 15 nt, Mycobacterium avium subsp. paratuberculosis
cgccccgcccggcgg

SEQ ID NO: 1025451 - RNA, 20 nt, Mycobacterium avium subsp. paratuberculosis
cgccccgacgaucgcgccgg

SEQ ID NO: 1025452 - RNA, 21 nt, Mycobacterium avium subsp. paratuberculosis
cgccccgacgaucgcgccggc

SEQ ID NO: 1025453 - RNA, 22 nt, Mycobacterium avium subsp. paratuberculosis
cgccccgacgaucgcgccggcc

SEQ ID NO: 1025454 - RNA, 22 nt, Mycobacterium avium subsp. paratuberculosis
cgccccacggucuuugccggcc

SEQ ID NO: 1025455 - RNA, 15 nt, Mycobacterium avium subsp. paratuberculosis
cgcccccucggccgg

SEQ ID NO: 1025456 - RNA, 16 nt, Mycobacterium avium subsp. paratuberculosis
cgccccgaacagcgcc

SEQ ID NO: 1025457 - RNA, 17 nt, Mycobacterium avium subsp. paratuberculosis
cgcggcaggcgacccgc

SEQ ID NO: 1025458 - RNA, 12 nt, Mycobacterium avium subsp. paratuberculosis
cgcggccaccac

SEQ ID NO: 1025459 - RNA, 13 nt, Mycobacterium avium subsp. paratuberculosis
cgcggccaccagc

SEQ ID NO: 1025460 - RNA, 12 nt, Mycobacterium avium subsp. paratuberculosis
cgcggccacccc

SEQ ID NO: 1025461 - RNA, 18 nt, Mycobacterium avium subsp. paratuberculosis
cgcggccaccccggagca

SEQ ID NO: 1025462 - RNA, 14 nt, Mycobacterium avium subsp. paratuberculosis
cgcggccagccccg

SEQ ID NO: 1025463 - RNA, 13 nt, Mycobacterium avium subsp. paratuberculosis
cgcggccagcacg

SEQ ID NO: 1025464 - RNA, 21 nt, Mycobacterium avium subsp. paratuberculosis
cgcggccagcacggucagcgg

SEQ ID NO: 1025465 - RNA, 20 nt, Mycobacterium avium subsp. paratuberculosis
cgcggccacgcucgggccgg

SEQ ID NO: 1025466 - RNA, 16 nt, Mycobacterium avium subsp. paratuberculosis
cgcggccaccuccagc

SEQ ID NO: 1025467 - RNA, 14 nt, Mycobacterium avium subsp. paratuberculosis
cgcggcacgccgcu

SEQ ID NO: 1025468 - RNA, 22 nt, Mycobacterium avium subsp. paratuberculosis
cgcggcagccagccuggcggcg

SEQ ID NO: 1025469 - RNA, 15 nt, Mycobacterium avium subsp. paratuberculosis
cgcggcaccaccagc

SEQ ID NO: 1025470 - RNA, 19 nt, Mycobacterium avium subsp. paratuberculosis
cgcggcaucgucaccucga

SEQ ID NO: 1025471 - RNA, 16 nt, Mycobacterium avium subsp. paratuberculosis
cgcggcaugaccggcc

SEQ ID NO: 1025472 - RNA, 23 nt, Mycobacterium avium subsp. paratuberculosis
cgcggcaugaccggccagcaugg

SEQ ID NO: 1025473 - RNA, 13 nt, Mycobacterium avium subsp. paratuberculosis
cgcggcaggaauu

SEQ ID NO: 1025474 - RNA, 14 nt, Mycobacterium avium subsp. paratuberculosis
cgcggcagccuuuc

SEQ ID NO: 1025475 - RNA, 19 nt, Mycobacterium avium subsp. paratuberculosis
cgcgcuugacggccgggcc

SEQ ID NO: 1025476 - RNA, 16 nt, Mycobacterium avium subsp. paratuberculosis
cgcggacagcucgccg

SEQ ID NO: 1025477 - RNA, 22 nt, Mycobacterium avium subsp. paratuberculosis
cgcggacagcucgccggccgcg

SEQ ID NO: 1025478 - RNA, 22 nt, Mycobacterium avium subsp. paratuberculosis
cgcggacggaucgagucccgcg

SEQ ID NO: 1025479 - RNA, 20 nt, Mycobacterium avium subsp. paratuberculosis
cgcggacggccagcccgucg

SEQ ID NO: 1025480 - RNA, 20 nt, Mycobacterium avium subsp. paratuberculosis
cgcggacggguugggcgcca

SEQ ID NO: 1025481 - RNA, 15 nt, Mycobacterium avium subsp. paratuberculosis
cgcggacuggugggc

SEQ ID NO: 1025482 - RNA, 23 nt, Mycobacterium avium subsp. paratuberculosis
cgcggagaucaccccuggcgggu

SEQ ID NO: 1025483 - RNA, 19 nt, Mycobacterium avium subsp. paratuberculosis
cgcggagcgggucagcgug

SEQ ID NO: 1025484 - RNA, 18 nt, Mycobacterium avium subsp. paratuberculosis
cgcggagcguuccagguu

SEQ ID NO: 1025485 - RNA, 19 nt, Mycobacterium avium subsp. paratuberculosis
cgcgcuguccacguccugc

SEQ ID NO: 1025486 - RNA, 14 nt, Mycobacterium avium subsp. paratuberculosis
cgcgcgcggcggcc

SEQ ID NO: 1025487 - RNA, 17 nt, Mycobacterium avium subsp. paratuberculosis
cgcgcgcggcggccacc

SEQ ID NO: 1025488 - RNA, 14 nt, Mycobacterium avium subsp. paratuberculosis
cgcgcgcggcguca

SEQ ID NO: 1025489 - RNA, 11 nt, Mycobacterium avium subsp. paratuberculosis
cgcgcgcggcg

SEQ ID NO: 1025490 - RNA, 13 nt, Mycobacterium avium subsp. paratuberculosis
cgcgggggccgcc

SEQ ID NO: 1025491 - RNA, 14 nt, Mycobacterium avium subsp. paratuberculosis
cgcgggggccgcga

SEQ ID NO: 1025492 - RNA, 16 nt, Mycobacterium avium subsp. paratuberculosis
cgcgggggcggccuga

SEQ ID NO: 1025493 - RNA, 14 nt, Mycobacterium avium subsp. paratuberculosis
cgcggggcggccgc

SEQ ID NO: 1025494 - RNA, 23 nt, Mycobacterium avium subsp. paratuberculosis
cgcggggccggcgcuggcgugcu

SEQ ID NO: 1025495 - RNA, 15 nt, Mycobacterium avium subsp. paratuberculosis
cgcggggccaccagg

SEQ ID NO: 1025496 - RNA, 19 nt, Mycobacterium avium subsp. paratuberculosis
cgcggggccaccaggcgcc

SEQ ID NO: 1025497 - RNA, 18 nt, Mycobacterium avium subsp. paratuberculosis
cgcggguccugcaaccgc

SEQ ID NO: 1025498 - RNA, 19 nt, Mycobacterium avium subsp. paratuberculosis
cgcgggucgccgggcaggu

SEQ ID NO: 1025499 - RNA, 15 nt, Mycobacterium avium subsp. paratuberculosis
cgcgggucgcggccc

SEQ ID NO: 1025500 - RNA, 22 nt, Mycobacterium avium subsp. paratuberculosis
cgcgggucggcgacggcgcuca

SEQ ID NO: 1025501 - RNA, 21 nt, Mycobacterium avium subsp. paratuberculosis
cgcgggucggcgccggccagc

SEQ ID NO: 1025502 - RNA, 18 nt, Mycobacterium avium subsp. paratuberculosis
cgcgggucagcgucgcca

SEQ ID NO: 1025503 - RNA, 20 nt, Mycobacterium avium subsp. paratuberculosis
cgcggguauccgugaccccg

SEQ ID NO: 1025504 - RNA, 18 nt, Mycobacterium avium subsp. paratuberculosis
cgcgggucgucgggcggc

SEQ ID NO: 1025505 - RNA, 13 nt, Mycobacterium avium subsp. paratuberculosis
cgcgggugacgcu

SEQ ID NO: 1025506 - RNA, 21 nt, Mycobacterium avium subsp. paratuberculosis
cgcgggugaggggcgcgcgcc

SEQ ID NO: 1025507 - RNA, 22 nt, Mycobacterium avium subsp. paratuberculosis
cgcgggugaggggcgcgcgccg

SEQ ID NO: 1025508 - RNA, 21 nt, Mycobacterium avium subsp. paratuberculosis
cgcggcuucauaugacgccgg

SEQ ID NO: 1025509 - RNA, 15 nt, Mycobacterium avium subsp. paratuberculosis
cgcgggaccgggccc

SEQ ID NO: 1025510 - RNA, 14 nt, Mycobacterium avium subsp. paratuberculosis
cgcgggaggacagc

SEQ ID NO: 1025511 - RNA, 23 nt, Mycobacterium avium subsp. paratuberculosis
cgcgggcggggccugcgggacgc

SEQ ID NO: 1025512 - RNA, 20 nt, Mycobacterium avium subsp. paratuberculosis
cgcgggcggucgcgcagccg

SEQ ID NO: 1025513 - RNA, 17 nt, Mycobacterium avium subsp. paratuberculosis
cgcgggcgucgggcagc

SEQ ID NO: 1025514 - RNA, 13 nt, Mycobacterium avium subsp. paratuberculosis
cgcgggcggcgca

SEQ ID NO: 1025515 - RNA, 22 nt, Mycobacterium avium subsp. paratuberculosis
cgcgggcggcaggucggcggga

SEQ ID NO: 1025516 - RNA, 16 nt, Mycobacterium avium subsp. paratuberculosis
cgcgggaguggccggc

SEQ ID NO: 1025517 - RNA, 19 nt, Mycobacterium avium subsp. paratuberculosis
cgcgggaucggccggcgag

SEQ ID NO: 1025518 - RNA, 20 nt, Mycobacterium avium subsp. paratuberculosis
cgcggcgaacccgagcaccc

SEQ ID NO: 1025519 - RNA, 14 nt, Mycobacterium avium subsp. paratuberculosis
cgcggccugcagca

SEQ ID NO: 1025520 - RNA, 11 nt, Mycobacterium avium subsp. paratuberculosis
cgcggccuucu

SEQ ID NO: 1025521 - RNA, 15 nt, Mycobacterium avium subsp. paratuberculosis
cgcggccuugcgggc

SEQ ID NO: 1025522 - RNA, 18 nt, Mycobacterium avium subsp. paratuberculosis
cgcggccuugcgggccgg

SEQ ID NO: 1025523 - RNA, 20 nt, Mycobacterium avium subsp. paratuberculosis
cgcggccucaccgcgggcca

SEQ ID NO: 1025524 - RNA, 16 nt, Mycobacterium avium subsp. paratuberculosis
cgcggccuccagccgc

SEQ ID NO: 1025525 - RNA, 24 nt, Mycobacterium avium subsp. paratuberculosis
cgcggccuccagccgcgcggccgc

SEQ ID NO: 1025526 - RNA, 18 nt, Mycobacterium avium subsp. paratuberculosis
cgcggccuccagccgcuc

SEQ ID NO: 1025527 - RNA, 13 nt, Mycobacterium avium subsp. paratuberculosis
cgcggccggcgug

SEQ ID NO: 1025528 - RNA, 13 nt, Mycobacterium avium subsp. paratuberculosis
cgcggccggccca

SEQ ID NO: 1025529 - RNA, 18 nt, Mycobacterium avium subsp. paratuberculosis
cgcggccggugccacggu

SEQ ID NO: 1025530 - RNA, 18 nt, Mycobacterium avium subsp. paratuberculosis
cgcggccggugcgcguca

SEQ ID NO: 1025531 - RNA, 13 nt, Mycobacterium avium subsp. paratuberculosis
cgcggccggcgag

SEQ ID NO: 1025532 - RNA, 11 nt, Mycobacterium avium subsp. paratuberculosis
cgcggccaggu

SEQ ID NO: 1025533 - RNA, 15 nt, Mycobacterium avium subsp. paratuberculosis
cgcggccagcugccc

SEQ ID NO: 1025534 - RNA, 11 nt, Mycobacterium avium subsp. paratuberculosis
cgcggccaggg

SEQ ID NO: 1025535 - RNA, 13 nt, Mycobacterium avium subsp. paratuberculosis
cgcggccagcgcc

SEQ ID NO: 1025536 - RNA, 14 nt, Mycobacterium avium subsp. paratuberculosis
cgcggccagcgccc

SEQ ID NO: 1025537 - RNA, 20 nt, Mycobacterium avium subsp. paratuberculosis
cgcggccagcgccccgccgg

SEQ ID NO: 1025538 - RNA, 14 nt, Mycobacterium avium subsp. paratuberculosis
cgcggcuggcgggu

SEQ ID NO: 1025539 - RNA, 13 nt, Mycobacterium avium subsp. paratuberculosis
cgcggcuggccgc

SEQ ID NO: 1025540 - RNA, 21 nt, Mycobacterium avium subsp. paratuberculosis
cgcggcggugacgaacccgcc

SEQ ID NO: 1025541 - RNA, 15 nt, Mycobacterium avium subsp. paratuberculosis
cgcggcggugccggu

SEQ ID NO: 1025542 - RNA, 20 nt, Mycobacterium avium subsp. paratuberculosis
cgcggcggugcgcagccgcu

SEQ ID NO: 1025543 - RNA, 20 nt, Mycobacterium avium subsp. paratuberculosis
cgcggcggugcucgcgccgg

SEQ ID NO: 1025544 - RNA, 17 nt, Mycobacterium avium subsp. paratuberculosis
cgcggcggucgcgcgcc

SEQ ID NO: 1025545 - RNA, 12 nt, Mycobacterium avium subsp. paratuberculosis
cgcggcggggca

SEQ ID NO: 1025546 - RNA, 14 nt, Mycobacterium avium subsp. paratuberculosis
cgcggcgaagcagg

SEQ ID NO: 1025547 - RNA, 13 nt, Mycobacterium avium subsp. paratuberculosis
cgcggcgggcgcg

SEQ ID NO: 1025548 - RNA, 23 nt, Mycobacterium avium subsp. paratuberculosis
cgcggcgggccuugagcaccgcg

SEQ ID NO: 1025549 - RNA, 14 nt, Mycobacterium avium subsp. paratuberculosis
cgcggcgggcaggu

SEQ ID NO: 1025550 - RNA, 23 nt, Mycobacterium avium subsp. paratuberculosis
cgcggcgggccagucgccgcgca

SEQ ID NO: 1025551 - RNA, 13 nt, Mycobacterium avium subsp. paratuberculosis
cgcggcggcggcg

SEQ ID NO: 1025552 - RNA, 16 nt, Mycobacterium avium subsp. paratuberculosis
cgcggcggcgucgacc

SEQ ID NO: 1025553 - RNA, 19 nt, Mycobacterium avium subsp. paratuberculosis
cgcggcggcgugccgcccg

SEQ ID NO: 1025554 - RNA, 15 nt, Mycobacterium avium subsp. paratuberculosis
cgcggcggccggcca

SEQ ID NO: 1025555 - RNA, 15 nt, Mycobacterium avium subsp. paratuberculosis
cgcggcggccggcga

SEQ ID NO: 1025556 - RNA, 15 nt, Mycobacterium avium subsp. paratuberculosis
cgcggcggccggcgc

SEQ ID NO: 1025557 - RNA, 14 nt, Mycobacterium avium subsp. paratuberculosis
cgcggcggccaccu

SEQ ID NO: 1025558 - RNA, 20 nt, Mycobacterium avium subsp. paratuberculosis
cgcggcggccagcucggccc

SEQ ID NO: 1025559 - RNA, 21 nt, Mycobacterium avium subsp. paratuberculosis
cgcggcggccaucucgugccc

SEQ ID NO: 1025560 - RNA, 14 nt, Mycobacterium avium subsp. paratuberculosis
cgcggcggcgccgc

SEQ ID NO: 1025561 - RNA, 12 nt, Mycobacterium avium subsp. paratuberculosis
cgcggcggcgcu

SEQ ID NO: 1025562 - RNA, 19 nt, Mycobacterium avium subsp. paratuberculosis
cgcgguuuggucagcgccc

SEQ ID NO: 1025563 - RNA, 22 nt, Mycobacterium avium subsp. paratuberculosis
cgcgguuuggucagcgcccccg

SEQ ID NO: 1025564 - RNA, 22 nt, Mycobacterium avium subsp. paratuberculosis
cgcgguuucaccgugcgcgcgc

SEQ ID NO: 1025565 - RNA, 16 nt, Mycobacterium avium subsp. paratuberculosis
cgcguacccgcgcggc

SEQ ID NO: 1025566 - RNA, 18 nt, Mycobacterium avium subsp. paratuberculosis
cgcguacccgcgcggcgu

SEQ ID NO: 1025567 - RNA, 18 nt, Mycobacterium avium subsp. paratuberculosis
cgcgguuggucaccaggu

SEQ ID NO: 1025568 - RNA, 19 nt, Mycobacterium avium subsp. paratuberculosis
cgcguauugcacggcggcg

SEQ ID NO: 1025569 - RNA, 14 nt, Mycobacterium avium subsp. paratuberculosis
cgcgucccgggccu

SEQ ID NO: 1025570 - RNA, 17 nt, Mycobacterium avium subsp. paratuberculosis
cgcguccgagcagcagc

SEQ ID NO: 1025571 - RNA, 22 nt, Mycobacterium avium subsp. paratuberculosis
cgcguccgagcagcagccgcag

SEQ ID NO: 1025572 - RNA, 21 nt, Mycobacterium avium subsp. paratuberculosis
cgcguggggcgucgccgcccc

SEQ ID NO: 1025573 - RNA, 23 nt, Mycobacterium avium subsp. paratuberculosis
cgcguggguguccuugcgcacca

SEQ ID NO: 1025574 - RNA, 14 nt, Mycobacterium avium subsp. paratuberculosis
cgcgugggccaacg

SEQ ID NO: 1025575 - RNA, 22 nt, Mycobacterium avium subsp. paratuberculosis
cgcgugggcaccccgaucaggu

SEQ ID NO: 1025576 - RNA, 19 nt, Mycobacterium avium subsp. paratuberculosis
cgcguuccaucagcgcccg

SEQ ID NO: 1025577 - RNA, 21 nt, Mycobacterium avium subsp. paratuberculosis
cgcguuccaucagcgcccgcg

SEQ ID NO: 1025578 - RNA, 19 nt, Mycobacterium avium subsp. paratuberculosis
cgcgucggcgucuugcugc

SEQ ID NO: 1025579 - RNA, 22 nt, Mycobacterium avium subsp. paratuberculosis
cgcgucgggcagguucaucccc

SEQ ID NO: 1025580 - RNA, 20 nt, Mycobacterium avium subsp. paratuberculosis
cgcgucgggcucggccgccg

SEQ ID NO: 1025581 - RNA, 17 nt, Mycobacterium avium subsp. paratuberculosis
cgcgucggucagcgcca

SEQ ID NO: 1025582 - RNA, 22 nt, Mycobacterium avium subsp. paratuberculosis
cgcgucguccgacaccaccugc

SEQ ID NO: 1025583 - RNA, 22 nt, Mycobacterium avium subsp. paratuberculosis
cgcgucgucgauggccaccagg

SEQ ID NO: 1025584 - RNA, 19 nt, Mycobacterium avium subsp. paratuberculosis
cgcgucgaccaccgccggc

SEQ ID NO: 1025585 - RNA, 17 nt, Mycobacterium avium subsp. paratuberculosis
cgcgucggcgaccgcgc

SEQ ID NO: 1025586 - RNA, 16 nt, Mycobacterium avium subsp. paratuberculosis
cgcgucggcgccggcc

SEQ ID NO: 1025587 - RNA, 19 nt, Mycobacterium avium subsp. paratuberculosis
cgcgucggcggucgccagc

SEQ ID NO: 1025588 - RNA, 22 nt, Mycobacterium avium subsp. paratuberculosis
cgcgucggcggucgccagcgcc

SEQ ID NO: 1025589 - RNA, 16 nt, Mycobacterium avium subsp. paratuberculosis
cgcgucgacaccccgc

SEQ ID NO: 1025590 - RNA, 17 nt, Mycobacterium avium subsp. paratuberculosis
cgcgucgaacagccggg

SEQ ID NO: 1025591 - RNA, 20 nt, Mycobacterium avium subsp. paratuberculosis
cgcgucgaacagccgggccg

SEQ ID NO: 1025592 - RNA, 14 nt, Mycobacterium avium subsp. paratuberculosis
cgcgucucccccga

SEQ ID NO: 1025593 - RNA, 18 nt, Mycobacterium avium subsp. paratuberculosis
cgcgucguguccgggccc

SEQ ID NO: 1025594 - RNA, 15 nt, Mycobacterium avium subsp. paratuberculosis
cgcgucugcucgccg

SEQ ID NO: 1025595 - RNA, 16 nt, Mycobacterium avium subsp. paratuberculosis
cgcgucugcucgccgg

SEQ ID NO: 1025596 - RNA, 21 nt, Mycobacterium avium subsp. paratuberculosis
cgcgugaccccggcgaccagc

SEQ ID NO: 1025597 - RNA, 13 nt, Mycobacterium avium subsp. paratuberculosis
cgcgggugcgggc

SEQ ID NO: 1025598 - RNA, 19 nt, Mycobacterium avium subsp. paratuberculosis
cgcggguguugccggaggg

SEQ ID NO: 1025599 - RNA, 14 nt, Mycobacterium avium subsp. paratuberculosis
cgcggguggcgcca

SEQ ID NO: 1025600 - RNA, 18 nt, Mycobacterium avium subsp. paratuberculosis
cgcggguggcgccacagc

SEQ ID NO: 1025601 - RNA, 14 nt, Mycobacterium avium subsp. paratuberculosis
cgcgggugcggccc

SEQ ID NO: 1025602 - RNA, 19 nt, Mycobacterium avium subsp. paratuberculosis
cgcgggugcggcgcugccg

SEQ ID NO: 1025603 - RNA, 16 nt, Mycobacterium avium subsp. paratuberculosis
cgcgggugcgcucgac

SEQ ID NO: 1025604 - RNA, 22 nt, Mycobacterium avium subsp. paratuberculosis
cgcgguagucgggauagggcgc

SEQ ID NO: 1025605 - RNA, 17 nt, Mycobacterium avium subsp. paratuberculosis
cgcgguagacaccgccg

SEQ ID NO: 1025606 - RNA, 17 nt, Mycobacterium avium subsp. paratuberculosis
cgcgguagaucgacagg

SEQ ID NO: 1025607 - RNA, 21 nt, Mycobacterium avium subsp. paratuberculosis
cgcgguagaugucggguccgc

SEQ ID NO: 1025608 - RNA, 21 nt, Mycobacterium avium subsp. paratuberculosis
cgcggucagcucgaucgccgc

SEQ ID NO: 1025609 - RNA, 15 nt, Mycobacterium avium subsp. paratuberculosis
cgcggucaccggcuc

SEQ ID NO: 1025610 - RNA, 21 nt, Mycobacterium avium subsp. paratuberculosis
cgcggucagacgaugggccgc

SEQ ID NO: 1025611 - RNA, 16 nt, Mycobacterium avium subsp. paratuberculosis
cgcggucagcgcgucc

SEQ ID NO: 1025612 - RNA, 13 nt, Mycobacterium avium subsp. paratuberculosis
cgcgguccuccug

SEQ ID NO: 1025613 - RNA, 16 nt, Mycobacterium avium subsp. paratuberculosis
cgcggucgcaggccgc

SEQ ID NO: 1025614 - RNA, 18 nt, Mycobacterium avium subsp. paratuberculosis
cgcggucgcaggccgccc

SEQ ID NO: 1025615 - RNA, 15 nt, Mycobacterium avium subsp. paratuberculosis
cgcggucgcaggcga

SEQ ID NO: 1025616 - RNA, 17 nt, Mycobacterium avium subsp. paratuberculosis
cgcggucgcaggcgagc

SEQ ID NO: 1025617 - RNA, 20 nt, Mycobacterium avium subsp. paratuberculosis
cgcgguccacuuccgcgcag

SEQ ID NO: 1025618 - RNA, 18 nt, Mycobacterium avium subsp. paratuberculosis
cgcgguccaucuccagcu

SEQ ID NO: 1025619 - RNA, 20 nt, Mycobacterium avium subsp. paratuberculosis
cgcgguccaucuccagcucc

SEQ ID NO: 1025620 - RNA, 17 nt, Mycobacterium avium subsp. paratuberculosis
cgcgguccacgccggcg

SEQ ID NO: 1025621 - RNA, 17 nt, Mycobacterium avium subsp. paratuberculosis
cgcggucaugcgcgggc

SEQ ID NO: 1025622 - RNA, 13 nt, Mycobacterium avium subsp. paratuberculosis
cgcggucgcggcg

SEQ ID NO: 1025623 - RNA, 14 nt, Mycobacterium avium subsp. paratuberculosis
cgcggucgcggcgc

SEQ ID NO: 1025624 - RNA, 14 nt, Mycobacterium avium subsp. paratuberculosis
cgcggucgcugacc

SEQ ID NO: 1025625 - RNA, 18 nt, Mycobacterium avium subsp. paratuberculosis
cgcggucgcugacccgcc

SEQ ID NO: 1025626 - RNA, 22 nt, Mycobacterium avium subsp. paratuberculosis
cgcggucggcgcccggcccagc

SEQ ID NO: 1025627 - RNA, 12 nt, Mycobacterium avium subsp. paratuberculosis
cgcggucggguc

SEQ ID NO: 1025628 - RNA, 21 nt, Mycobacterium avium subsp. paratuberculosis
cgcggucgggucccggcaaca

SEQ ID NO: 1025629 - RNA, 14 nt, Mycobacterium avium subsp. paratuberculosis
cgcggucugcgcca

SEQ ID NO: 1025630 - RNA, 19 nt, Mycobacterium avium subsp. paratuberculosis
cgcggucugcggugcgccc

SEQ ID NO: 1025631 - RNA, 14 nt, Mycobacterium avium subsp. paratuberculosis
cgcggugcgcgcgc

SEQ ID NO: 1025632 - RNA, 15 nt, Mycobacterium avium subsp. paratuberculosis
cgcggugcaccagga

SEQ ID NO: 1025633 - RNA, 13 nt, Mycobacterium avium subsp. paratuberculosis
cgcggugcccgga

SEQ ID NO: 1025634 - RNA, 20 nt, Mycobacterium avium subsp. paratuberculosis
cgcggugccgcagcucgauc

SEQ ID NO: 1025635 - RNA, 15 nt, Mycobacterium avium subsp. paratuberculosis
cgcggugaccgccgc

SEQ ID NO: 1025636 - RNA, 17 nt, Mycobacterium avium subsp. paratuberculosis
cgcggugaccgccgcca

SEQ ID NO: 1025637 - RNA, 17 nt, Mycobacterium avium subsp. paratuberculosis
cgcggugaccgcgccgc

SEQ ID NO: 1025638 - RNA, 20 nt, Mycobacterium avium subsp. paratuberculosis
cgcggugaccgcgccgcggg

SEQ ID NO: 1025639 - RNA, 19 nt, Mycobacterium avium subsp. paratuberculosis
cgcggugaaguugccgccg

SEQ ID NO: 1025640 - RNA, 16 nt, Mycobacterium avium subsp. paratuberculosis
cgcggugagcgcgccg

SEQ ID NO: 1025641 - RNA, 17 nt, Mycobacterium avium subsp. paratuberculosis
cgcggugugcggcggcu

SEQ ID NO: 1025642 - RNA, 15 nt, Mycobacterium avium subsp. paratuberculosis
cgcgguguuggcggc

SEQ ID NO: 1025643 - RNA, 14 nt, Mycobacterium avium subsp. paratuberculosis
cgcgguucgaggug

SEQ ID NO: 1025644 - RNA, 21 nt, Mycobacterium avium subsp. paratuberculosis
cgcgguucgaggugcucgcgc

SEQ ID NO: 1025645 - RNA, 19 nt, Mycobacterium avium subsp. paratuberculosis
cgcgguucggcgucggucc

SEQ ID NO: 1025646 - RNA, 23 nt, Mycobacterium avium subsp. paratuberculosis
cgcgguugaucacaccgucggcg

SEQ ID NO: 1025647 - RNA, 20 nt, Mycobacterium avium subsp. paratuberculosis
cgcgguugggccgccggccg

SEQ ID NO: 1025648 - RNA, 21 nt, Mycobacterium avium subsp. paratuberculosis
cgcgguucuugcgccaucccc

SEQ ID NO: 1025649 - RNA, 16 nt, Mycobacterium avium subsp. paratuberculosis
cgcgguugaccgccga

SEQ ID NO: 1025650 - RNA, 16 nt, Mycobacterium avium subsp. paratuberculosis
cgcggugugcggcagc

SEQ ID NO: 1025651 - RNA, 19 nt, Mycobacterium avium subsp. paratuberculosis
cgcggugggcucggcgccg

SEQ ID NO: 1025652 - RNA, 22 nt, Mycobacterium avium subsp. paratuberculosis
cgcgguggguccgccgggcgcg

SEQ ID NO: 1025653 - RNA, 18 nt, Mycobacterium avium subsp. paratuberculosis
cgcgguggugcucgcccc

SEQ ID NO: 1025654 - RNA, 19 nt, Mycobacterium avium subsp. paratuberculosis
cgcgguggugcucgccccg

SEQ ID NO: 1025655 - RNA, 14 nt, Mycobacterium avium subsp. paratuberculosis
cgcgguguacagcg

SEQ ID NO: 1025656 - RNA, 19 nt, Mycobacterium avium subsp. paratuberculosis
cgcgguguacagcgcgccg

SEQ ID NO: 1025657 - RNA, 21 nt, Mycobacterium avium subsp. paratuberculosis
cgcggugggcaccagcagcgc

SEQ ID NO: 1025658 - RNA, 15 nt, Mycobacterium avium subsp. paratuberculosis
cgcggugcggcccgc

SEQ ID NO: 1025659 - RNA, 19 nt, Mycobacterium avium subsp. paratuberculosis
cgcggugcggcccgcggca

SEQ ID NO: 1025660 - RNA, 13 nt, Mycobacterium avium subsp. paratuberculosis
cgcggugcucgcc

SEQ ID NO: 1025661 - RNA, 14 nt, Mycobacterium avium subsp. paratuberculosis
cgcggugcucgccc

SEQ ID NO: 1025662 - RNA, 17 nt, Mycobacterium avium subsp. paratuberculosis
cgcggugcucgcccugg

SEQ ID NO: 1025663 - RNA, 17 nt, Mycobacterium avium subsp. paratuberculosis
cgcggugcucggcgcgc

SEQ ID NO: 1025664 - RNA, 19 nt, Mycobacterium avium subsp. paratuberculosis
cgcgaucgucgaccaccac

SEQ ID NO: 1025665 - RNA, 17 nt, Mycobacterium avium subsp. paratuberculosis
cgcgaucgacagcucca

SEQ ID NO: 1025666 - RNA, 21 nt, Mycobacterium avium subsp. paratuberculosis
cgcgaucgaggaucucccggg

SEQ ID NO: 1025667 - RNA, 14 nt, Mycobacterium avium subsp. paratuberculosis
cgcgaucggcgagc

SEQ ID NO: 1025668 - RNA, 18 nt, Mycobacterium avium subsp. paratuberculosis
cgcgaugaucagcucgcg

SEQ ID NO: 1025669 - RNA, 14 nt, Mycobacterium avium subsp. paratuberculosis
cgcgaugccggcca

SEQ ID NO: 1025670 - RNA, 16 nt, Mycobacterium avium subsp. paratuberculosis
cgcgaugcgacaccgc

SEQ ID NO: 1025671 - RNA, 16 nt, Mycobacterium avium subsp. paratuberculosis
cgcgauggcggcgcgc

SEQ ID NO: 1025672 - RNA, 18 nt, Mycobacterium avium subsp. paratuberculosis
cgcgauggcggcgcgcuc

SEQ ID NO: 1025673 - RNA, 15 nt, Mycobacterium avium subsp. paratuberculosis
cgcgauggaagcgcc

SEQ ID NO: 1025674 - RNA, 14 nt, Mycobacterium avium subsp. paratuberculosis
cgcgauggccuccg

SEQ ID NO: 1025675 - RNA, 14 nt, Mycobacterium avium subsp. paratuberculosis
cgcgauggcgugcc

SEQ ID NO: 1025676 - RNA, 22 nt, Mycobacterium avium subsp. paratuberculosis
cgcgauguccgacagcccgccc

SEQ ID NO: 1025677 - RNA, 23 nt, Mycobacterium avium subsp. paratuberculosis
cgcgauuuccgguugcggcagca

SEQ ID NO: 1025678 - RNA, 19 nt, Mycobacterium avium subsp. paratuberculosis
cgcgcaaacugacaggcgg

SEQ ID NO: 1025679 - RNA, 16 nt, Mycobacterium avium subsp. paratuberculosis
cgcgcaacaacuucgc

SEQ ID NO: 1025680 - RNA, 14 nt, Mycobacterium avium subsp. paratuberculosis
cgcgcaaccgggcc

SEQ ID NO: 1025681 - RNA, 17 nt, Mycobacterium avium subsp. paratuberculosis
cgcgcagucgcaggccc

SEQ ID NO: 1025682 - RNA, 19 nt, Mycobacterium avium subsp. paratuberculosis
cgcgcaggucgggccggcc

SEQ ID NO: 1025683 - RNA, 21 nt, Mycobacterium avium subsp. paratuberculosis
cgcgcaggucgggccggccga

SEQ ID NO: 1025684 - RNA, 15 nt, Mycobacterium avium subsp. paratuberculosis
cgcgcauucaccagc

SEQ ID NO: 1025685 - RNA, 17 nt, Mycobacterium avium subsp. paratuberculosis
cgcgcauguuggugauc

SEQ ID NO: 1025686 - RNA, 23 nt, Mycobacterium avium subsp. paratuberculosis
cgcgcauguuggugaucagcccc

SEQ ID NO: 1025687 - RNA, 18 nt, Mycobacterium avium subsp. paratuberculosis
cgcgcaggaacuccagca

SEQ ID NO: 1025688 - RNA, 20 nt, Mycobacterium avium subsp. paratuberculosis
cgcgcaggaacuccagcagc

SEQ ID NO: 1025689 - RNA, 18 nt, Mycobacterium avium subsp. paratuberculosis
cgcgcaggaugcccagca

SEQ ID NO: 1025690 - RNA, 20 nt, Mycobacterium avium subsp. paratuberculosis
cgcgcaggaugcccagcacc

SEQ ID NO: 1025691 - RNA, 13 nt, Mycobacterium avium subsp. paratuberculosis
cgcgcaggccccg

SEQ ID NO: 1025692 - RNA, 16 nt, Mycobacterium avium subsp. paratuberculosis
cgcgcaggccccggcg

SEQ ID NO: 1025693 - RNA, 17 nt, Mycobacterium avium subsp. paratuberculosis
cgcgcagggacgggcgu

SEQ ID NO: 1025694 - RNA, 20 nt, Mycobacterium avium subsp. paratuberculosis
cgcgcaggcgcaccaccagc

SEQ ID NO: 1025695 - RNA, 20 nt, Mycobacterium avium subsp. paratuberculosis
cgcgcaggccguccagcagc

SEQ ID NO: 1025696 - RNA, 17 nt, Mycobacterium avium subsp. paratuberculosis
cgcgcaggcuggcaucg

SEQ ID NO: 1025697 - RNA, 20 nt, Mycobacterium avium subsp. paratuberculosis
cgcgcaccugaaccgcgcac

SEQ ID NO: 1025698 - RNA, 15 nt, Mycobacterium avium subsp. paratuberculosis
cgcgcaccgccaccg

SEQ ID NO: 1025699 - RNA, 16 nt, Mycobacterium avium subsp. paratuberculosis
cgcgcaccgccaccgc

SEQ ID NO: 1025700 - RNA, 12 nt, Mycobacterium avium subsp. paratuberculosis
cgcgcaccgccc

SEQ ID NO: 1025701 - RNA, 14 nt, Mycobacterium avium subsp. paratuberculosis
cgcgcaccgcgggc

SEQ ID NO: 1025702 - RNA, 15 nt, Mycobacterium avium subsp. paratuberculosis
cgcgcaccgcgggcu

SEQ ID NO: 1025703 - RNA, 15 nt, Mycobacterium avium subsp. paratuberculosis
cgcgcaacgaggcgg

SEQ ID NO: 1025704 - RNA, 18 nt, Mycobacterium avium subsp. paratuberculosis
cgcgcacgucaccgcgcu

SEQ ID NO: 1025705 - RNA, 22 nt, Mycobacterium avium subsp. paratuberculosis
cgcgcacgucaccgcgcuugcc

SEQ ID NO: 1025706 - RNA, 21 nt, Mycobacterium avium subsp. paratuberculosis
cgcgcacuucgcgggcggcgc

SEQ ID NO: 1025707 - RNA, 21 nt, Mycobacterium avium subsp. paratuberculosis
cgcgcacguuggcggccagcg

SEQ ID NO: 1025708 - RNA, 18 nt, Mycobacterium avium subsp. paratuberculosis
cgcgcagaacaccaccgc

SEQ ID NO: 1025709 - RNA, 19 nt, Mycobacterium avium subsp. paratuberculosis
cgcgcagaacaccaccgcc

SEQ ID NO: 1025710 - RNA, 23 nt, Mycobacterium avium subsp. paratuberculosis
cgcgcagcuggccgugcaccguc

SEQ ID NO: 1025711 - RNA, 20 nt, Mycobacterium avium subsp. paratuberculosis
cgcgcccaucgcggccgccc

SEQ ID NO: 1025712 - RNA, 14 nt, Mycobacterium avium subsp. paratuberculosis
cgcgccccggccug

SEQ ID NO: 1025713 - RNA, 16 nt, Mycobacterium avium subsp. paratuberculosis
cgcgccccggcgcagc

SEQ ID NO: 1025714 - RNA, 16 nt, Mycobacterium avium subsp. paratuberculosis
cgcgccccggcgcgcc

SEQ ID NO: 1025715 - RNA, 17 nt, Mycobacterium avium subsp. paratuberculosis
cgcgccccggcgcgccu

SEQ ID NO: 1025716 - RNA, 15 nt, Mycobacterium avium subsp. paratuberculosis
cgcgccccggcggcc

SEQ ID NO: 1025717 - RNA, 20 nt, Mycobacterium avium subsp. paratuberculosis
cgcgcccgagucacccggcu

SEQ ID NO: 1025718 - RNA, 14 nt, Mycobacterium avium subsp. paratuberculosis
cgcgccccagcccc

SEQ ID NO: 1025719 - RNA, 14 nt, Mycobacterium avium subsp. paratuberculosis
cgcgcccgccggcc

SEQ ID NO: 1025720 - RNA, 13 nt, Mycobacterium avium subsp. paratuberculosis
cgcgcccgcgaac

SEQ ID NO: 1025721 - RNA, 22 nt, Mycobacterium avium subsp. paratuberculosis
cgcgcccgagcauuucgcgcac

SEQ ID NO: 1025722 - RNA, 16 nt, Mycobacterium avium subsp. paratuberculosis
cgcgcccggcaccgcg

SEQ ID NO: 1025723 - RNA, 12 nt, Mycobacterium avium subsp. paratuberculosis
cgcgcccggcca

SEQ ID NO: 1025724 - RNA, 22 nt, Mycobacterium avium subsp. paratuberculosis
cgcgcccgucgagcgucauucc

SEQ ID NO: 1025725 - RNA, 20 nt, Mycobacterium avium subsp. paratuberculosis
cgcgcccuaacgugcccggc

SEQ ID NO: 1025726 - RNA, 12 nt, Mycobacterium avium subsp. paratuberculosis
cgcgcccagccc

SEQ ID NO: 1025727 - RNA, 14 nt, Mycobacterium avium subsp. paratuberculosis
cgcgcccaggaacg

SEQ ID NO: 1025728 - RNA, 11 nt, Mycobacterium avium subsp. paratuberculosis
cgcgcccaggc

SEQ ID NO: 1025729 - RNA, 13 nt, Mycobacterium avium subsp. paratuberculosis
cgcgcccaggccc

SEQ ID NO: 1025730 - RNA, 17 nt, Mycobacterium avium subsp. paratuberculosis
cgcgcccaggggagcgg

SEQ ID NO: 1025731 - RNA, 18 nt, Mycobacterium avium subsp. paratuberculosis
cgcgcccaggggagcggc

SEQ ID NO: 1025732 - RNA, 17 nt, Mycobacterium avium subsp. paratuberculosis
cgcgccaacgaggcacg

SEQ ID NO: 1025733 - RNA, 16 nt, Mycobacterium avium subsp. paratuberculosis
cgcgccgugcgccagc

SEQ ID NO: 1025734 - RNA, 17 nt, Mycobacterium avium subsp. paratuberculosis
cgcgccgugcgccagcg

SEQ ID NO: 1025735 - RNA, 23 nt, Mycobacterium avium subsp. paratuberculosis
cgcgccgugcgccagcgaccgca

SEQ ID NO: 1025736 - RNA, 22 nt, Mycobacterium avium subsp. paratuberculosis
cgcgccgucgucggacaccagc

SEQ ID NO: 1025737 - RNA, 15 nt, Mycobacterium avium subsp. paratuberculosis
cgcgccgucuccggc

SEQ ID NO: 1025738 - RNA, 21 nt, Mycobacterium avium subsp. paratuberculosis
cgcgcgccggcgcagcggccc

SEQ ID NO: 1025739 - RNA, 20 nt, Mycobacterium avium subsp. paratuberculosis
cgcgcgccgcagcgcgcgcu

SEQ ID NO: 1025740 - RNA, 12 nt, Mycobacterium avium subsp. paratuberculosis
cgcgccuccgac

SEQ ID NO: 1025741 - RNA, 13 nt, Mycobacterium avium subsp. paratuberculosis
cgcgccgcgccgc

SEQ ID NO: 1025742 - RNA, 12 nt, Mycobacterium avium subsp. paratuberculosis
cgcgccgcggcc

SEQ ID NO: 1025743 - RNA, 13 nt, Mycobacterium avium subsp. paratuberculosis
cgcgccgcgcgcc

SEQ ID NO: 1025744 - RNA, 14 nt, Mycobacterium avium subsp. paratuberculosis
cgcgccgcggcgcu

SEQ ID NO: 1025745 - RNA, 20 nt, Mycobacterium avium subsp. paratuberculosis
cgcgccgcguucggcggcgc

SEQ ID NO: 1025746 - RNA, 19 nt, Mycobacterium avium subsp. paratuberculosis
cgcgccgcucggccagcag

SEQ ID NO: 1025747 - RNA, 20 nt, Mycobacterium avium subsp. paratuberculosis
cgcgccgggguccucucggc

SEQ ID NO: 1025748 - RNA, 20 nt, Mycobacterium avium subsp. paratuberculosis
cgcgccgguaggcggccagc

SEQ ID NO: 1025749 - RNA, 23 nt, Mycobacterium avium subsp. paratuberculosis
cgcgccgguaggcggccagcgcc

SEQ ID NO: 1025750 - RNA, 16 nt, Mycobacterium avium subsp. paratuberculosis
cgcgccgguccggccc

SEQ ID NO: 1025751 - RNA, 13 nt, Mycobacterium avium subsp. paratuberculosis
cgcgccgccgccc

SEQ ID NO: 1025752 - RNA, 14 nt, Mycobacterium avium subsp. paratuberculosis
cgcgccgcccccgc

SEQ ID NO: 1025753 - RNA, 14 nt, Mycobacterium avium subsp. paratuberculosis
cgcgccgccgccgc

SEQ ID NO: 1025754 - RNA, 16 nt, Mycobacterium avium subsp. paratuberculosis
cgcgccgccgccgccc

SEQ ID NO: 1025755 - RNA, 20 nt, Mycobacterium avium subsp. paratuberculosis
cgcgcccuggugcaacaccg

SEQ ID NO: 1025756 - RNA, 20 nt, Mycobacterium avium subsp. paratuberculosis
cgcgccgccacgcggcgcgc

SEQ ID NO: 1025757 - RNA, 20 nt, Mycobacterium avium subsp. paratuberculosis
cgccuuugagcgacaaccgu

SEQ ID NO: 1025758 - RNA, 20 nt, Mycobacterium avium subsp. paratuberculosis
cgccuuguuggcccacagcu

SEQ ID NO: 1025759 - RNA, 19 nt, Mycobacterium avium subsp. paratuberculosis
cgccuuggugauccggggc

SEQ ID NO: 1025760 - RNA, 15 nt, Mycobacterium avium subsp. paratuberculosis
cgccuuggcgcgcuc

SEQ ID NO: 1025761 - RNA, 16 nt, Mycobacterium avium subsp. paratuberculosis
cgccuugacgccgggc

SEQ ID NO: 1025762 - RNA, 14 nt, Mycobacterium avium subsp. paratuberculosis
cgccuugcccggcu

SEQ ID NO: 1025763 - RNA, 14 nt, Mycobacterium avium subsp. paratuberculosis
cgccuugccgucga

SEQ ID NO: 1025764 - RNA, 18 nt, Mycobacterium avium subsp. paratuberculosis
cgccuugccgucgagcag

SEQ ID NO: 1025765 - RNA, 18 nt, Mycobacterium avium subsp. paratuberculosis
cgccuucuugcugcccgc

SEQ ID NO: 1025766 - RNA, 20 nt, Mycobacterium avium subsp. paratuberculosis
cgccuucuuggccgcgcccu

SEQ ID NO: 1025767 - RNA, 23 nt, Mycobacterium avium subsp. paratuberculosis
cgccuucuuggccgcgcccuucu

SEQ ID NO: 1025768 - RNA, 17 nt, Mycobacterium avium subsp. paratuberculosis
cgccuugaccgccuugg

SEQ ID NO: 1025769 - RNA, 21 nt, Mycobacterium avium subsp. paratuberculosis
cgccuucggcgccagcccgcc

SEQ ID NO: 1025770 - RNA, 17 nt, Mycobacterium avium subsp. paratuberculosis
cgccuguccgaccagcg

SEQ ID NO: 1025771 - RNA, 22 nt, Mycobacterium avium subsp. paratuberculosis
cgccugcuugaugaugccggcc

SEQ ID NO: 1025772 - RNA, 13 nt, Mycobacterium avium subsp. paratuberculosis
cgccugcuucugg

SEQ ID NO: 1025773 - RNA, 13 nt, Mycobacterium avium subsp. paratuberculosis
cgccugcgcgggc

SEQ ID NO: 1025774 - RNA, 15 nt, Mycobacterium avium subsp. paratuberculosis
cgccgucggccagca

SEQ ID NO: 1025775 - RNA, 19 nt, Mycobacterium avium subsp. paratuberculosis
cgccgucggccagcagcgc

SEQ ID NO: 1025776 - RNA, 16 nt, Mycobacterium avium subsp. paratuberculosis
cgccgucggcccacgg

SEQ ID NO: 1025777 - RNA, 20 nt, Mycobacterium avium subsp. paratuberculosis
cgccgucggggucgcgccgg

SEQ ID NO: 1025778 - RNA, 19 nt, Mycobacterium avium subsp. paratuberculosis
cgccgucguauucgacggc

SEQ ID NO: 1025779 - RNA, 22 nt, Mycobacterium avium subsp. paratuberculosis
cgccgucgucgucggccgggcc

SEQ ID NO: 1025780 - RNA, 22 nt, Mycobacterium avium subsp. paratuberculosis
cgcgaaagcagcaacggcggcg

SEQ ID NO: 1025781 - RNA, 16 nt, Mycobacterium avium subsp. paratuberculosis
cgcgaaaaccagcacc

SEQ ID NO: 1025782 - RNA, 16 nt, Mycobacterium avium subsp. paratuberculosis
cgcgaaaggcccaccg

SEQ ID NO: 1025783 - RNA, 17 nt, Mycobacterium avium subsp. paratuberculosis
cgcgaaaggcccaccgc

SEQ ID NO: 1025784 - RNA, 19 nt, Mycobacterium avium subsp. paratuberculosis
cgcgaagacgcuggccacg

SEQ ID NO: 1025785 - RNA, 23 nt, Mycobacterium avium subsp. paratuberculosis
cgcgaagcugggguaguucugcu

SEQ ID NO: 1025786 - RNA, 21 nt, Mycobacterium avium subsp. paratuberculosis
cgcgaccgguccgugccacgg

SEQ ID NO: 1025787 - RNA, 15 nt, Mycobacterium avium subsp. paratuberculosis
cgcgaccgucagcag

SEQ ID NO: 1025788 - RNA, 15 nt, Mycobacterium avium subsp. paratuberculosis
cgcgaccggccaucu

SEQ ID NO: 1025789 - RNA, 20 nt, Mycobacterium avium subsp. paratuberculosis
cgcgaccgucgggacggcca

SEQ ID NO: 1025790 - RNA, 21 nt, Mycobacterium avium subsp. paratuberculosis
cgcgaccgucgggacggccag

SEQ ID NO: 1025791 - RNA, 22 nt, Mycobacterium avium subsp. paratuberculosis
cgcgaccgucgggacggccagc

SEQ ID NO: 1025792 - RNA, 17 nt, Mycobacterium avium subsp. paratuberculosis
cgcgaccugcaucucga

SEQ ID NO: 1025793 - RNA, 14 nt, Mycobacterium avium subsp. paratuberculosis
cgcgaccgcgcggc

SEQ ID NO: 1025794 - RNA, 16 nt, Mycobacterium avium subsp. paratuberculosis
cgcgaccgcgcggcga

SEQ ID NO: 1025795 - RNA, 12 nt, Mycobacterium avium subsp. paratuberculosis
cgcgaccgccgg

SEQ ID NO: 1025796 - RNA, 22 nt, Mycobacterium avium subsp. paratuberculosis
cgcgaccccuacgggcgcaccg

SEQ ID NO: 1025797 - RNA, 15 nt, Mycobacterium avium subsp. paratuberculosis
cgcgaccgcagcagg

SEQ ID NO: 1025798 - RNA, 15 nt, Mycobacterium avium subsp. paratuberculosis
cgcgaagucgagcag

SEQ ID NO: 1025799 - RNA, 14 nt, Mycobacterium avium subsp. paratuberculosis
cgcgaagucgccgc

SEQ ID NO: 1025800 - RNA, 23 nt, Mycobacterium avium subsp. paratuberculosis
cgcgacccagacuugggcagcag

SEQ ID NO: 1025801 - RNA, 19 nt, Mycobacterium avium subsp. paratuberculosis
cgcgacccaggccgccgcc

SEQ ID NO: 1025802 - RNA, 19 nt, Mycobacterium avium subsp. paratuberculosis
cgcgagcagacgcaaaagc

SEQ ID NO: 1025803 - RNA, 16 nt, Mycobacterium avium subsp. paratuberculosis
cgcgagccgagccggu

SEQ ID NO: 1025804 - RNA, 20 nt, Mycobacterium avium subsp. paratuberculosis
cgcgagccgagccgguccga

SEQ ID NO: 1025805 - RNA, 19 nt, Mycobacterium avium subsp. paratuberculosis
cgcgacgaacagcaccgcc

SEQ ID NO: 1025806 - RNA, 15 nt, Mycobacterium avium subsp. paratuberculosis
cgcgacgagcgggcc

SEQ ID NO: 1025807 - RNA, 18 nt, Mycobacterium avium subsp. paratuberculosis
cgcgacgagcgggccgau

SEQ ID NO: 1025808 - RNA, 14 nt, Mycobacterium avium subsp. paratuberculosis
cgcgacugggcgcc

SEQ ID NO: 1025809 - RNA, 15 nt, Mycobacterium avium subsp. paratuberculosis
cgcgacugggcgccc

SEQ ID NO: 1025810 - RNA, 16 nt, Mycobacterium avium subsp. paratuberculosis
cgcgacugggcgccca

SEQ ID NO: 1025811 - RNA, 21 nt, Mycobacterium avium subsp. paratuberculosis
cgcgacugggcgcccacccgu

SEQ ID NO: 1025812 - RNA, 17 nt, Mycobacterium avium subsp. paratuberculosis
cgcgacugucggcgccc

SEQ ID NO: 1025813 - RNA, 19 nt, Mycobacterium avium subsp. paratuberculosis
cgcgacugucggcucgccc

SEQ ID NO: 1025814 - RNA, 14 nt, Mycobacterium avium subsp. paratuberculosis
cgcgagaagcgcgc

SEQ ID NO: 1025815 - RNA, 13 nt, Mycobacterium avium subsp. paratuberculosis
cgcgaucaacggg

SEQ ID NO: 1025816 - RNA, 20 nt, Mycobacterium avium subsp. paratuberculosis
cgcgauagaccucacggucg

SEQ ID NO: 1025817 - RNA, 16 nt, Mycobacterium avium subsp. paratuberculosis
cgcgaucaggccggcc

SEQ ID NO: 1025818 - RNA, 20 nt, Mycobacterium avium subsp. paratuberculosis
cgcgaucaggccggccacca

SEQ ID NO: 1025819 - RNA, 19 nt, Mycobacterium avium subsp. paratuberculosis
cgcgaucagggcccacagc

SEQ ID NO: 1025820 - RNA, 23 nt, Mycobacterium avium subsp. paratuberculosis
cgcgaucagggcccacagcagcc

SEQ ID NO: 1025821 - RNA, 17 nt, Mycobacterium avium subsp. paratuberculosis
cgcgaucaccgcggcca

SEQ ID NO: 1025822 - RNA, 15 nt, Mycobacterium avium subsp. paratuberculosis
cgcgaucagccccag

SEQ ID NO: 1025823 - RNA, 19 nt, Mycobacterium avium subsp. paratuberculosis
cgcgaucaccaccccggug

SEQ ID NO: 1025824 - RNA, 18 nt, Mycobacterium avium subsp. paratuberculosis
cggcaaaacgcugggcgc

SEQ ID NO: 1025825 - RNA, 17 nt, Mycobacterium avium subsp. paratuberculosis
cggcaacacgccggcgg

SEQ ID NO: 1025826 - RNA, 16 nt, Mycobacterium avium subsp. paratuberculosis
cggcaacagcaccagc

SEQ ID NO: 1025827 - RNA, 14 nt, Mycobacterium avium subsp. paratuberculosis
cggcaacccgaccu

SEQ ID NO: 1025828 - RNA, 14 nt, Mycobacterium avium subsp. paratuberculosis
cggcaaccgcugcg

SEQ ID NO: 1025829 - RNA, 13 nt, Mycobacterium avium subsp. paratuberculosis
cggcaacgccagc

SEQ ID NO: 1025830 - RNA, 20 nt, Mycobacterium avium subsp. paratuberculosis
cggcaacgaggccagggccc

SEQ ID NO: 1025831 - RNA, 15 nt, Mycobacterium avium subsp. paratuberculosis
cggcaaugccguugg

SEQ ID NO: 1025832 - RNA, 19 nt, Mycobacterium avium subsp. paratuberculosis
cggcaaggugccguccggg

SEQ ID NO: 1025833 - RNA, 21 nt, Mycobacterium avium subsp. paratuberculosis
cggcaagcccuuuggcggcca

SEQ ID NO: 1025834 - RNA, 16 nt, Mycobacterium avium subsp. paratuberculosis
cggcaaugguugcggc

SEQ ID NO: 1025835 - RNA, 13 nt, Mycobacterium avium subsp. paratuberculosis
cggcacaccagcg

SEQ ID NO: 1025836 - RNA, 15 nt, Mycobacterium avium subsp. paratuberculosis
cggcacaccagguag

SEQ ID NO: 1025837 - RNA, 14 nt, Mycobacterium avium subsp. paratuberculosis
cggcaccaccagcg

SEQ ID NO: 1025838 - RNA, 11 nt, Mycobacterium avium subsp. paratuberculosis
cggcaccagca

SEQ ID NO: 1025839 - RNA, 16 nt, Mycobacterium avium subsp. paratuberculosis
cggcaccagcaggccc

SEQ ID NO: 1025840 - RNA, 14 nt, Mycobacterium avium subsp. paratuberculosis
cggcaccagcagcc

SEQ ID NO: 1025841 - RNA, 17 nt, Mycobacterium avium subsp. paratuberculosis
cggcaccagcagccagc

SEQ ID NO: 1025842 - RNA, 19 nt, Mycobacterium avium subsp. paratuberculosis
cggcaccagcagccgcagc

SEQ ID NO: 1025843 - RNA, 17 nt, Mycobacterium avium subsp. paratuberculosis
cggcaccccgcggucgg

SEQ ID NO: 1025844 - RNA, 23 nt, Mycobacterium avium subsp. paratuberculosis
cggcaccccgcggucggcggcgu

SEQ ID NO: 1025845 - RNA, 13 nt, Mycobacterium avium subsp. paratuberculosis
cggcaccagcccg

SEQ ID NO: 1025846 - RNA, 14 nt, Mycobacterium avium subsp. paratuberculosis
cggcaccagcccgc

SEQ ID NO: 1025847 - RNA, 16 nt, Mycobacterium avium subsp. paratuberculosis
cggcaccagcggcauc

SEQ ID NO: 1025848 - RNA, 15 nt, Mycobacterium avium subsp. paratuberculosis
cggcaccagucgcgc

SEQ ID NO: 1025849 - RNA, 18 nt, Mycobacterium avium subsp. paratuberculosis
cggcaccagucgcgcagc

SEQ ID NO: 1025850 - RNA, 21 nt, Mycobacterium avium subsp. paratuberculosis
cggcaccuucaccgaccagcu

SEQ ID NO: 1025851 - RNA, 19 nt, Mycobacterium avium subsp. paratuberculosis
cggcaccgggaccuggguc

SEQ ID NO: 1025852 - RNA, 22 nt, Mycobacterium avium subsp. paratuberculosis
cggcaccgucaccgacggcugg

SEQ ID NO: 1025853 - RNA, 17 nt, Mycobacterium avium subsp. paratuberculosis
cggcaccuccugcaccc

SEQ ID NO: 1025854 - RNA, 18 nt, Mycobacterium avium subsp. paratuberculosis
cggcacuaccgccucgcc

SEQ ID NO: 1025855 - RNA, 17 nt, Mycobacterium avium subsp. paratuberculosis
cggcacguugcccagga

SEQ ID NO: 1025856 - RNA, 21 nt, Mycobacterium avium subsp. paratuberculosis
cggcacgguuggccggcccgc

SEQ ID NO: 1025857 - RNA, 13 nt, Mycobacterium avium subsp. paratuberculosis
cggcaccgccagc

SEQ ID NO: 1025858 - RNA, 21 nt, Mycobacterium avium subsp. paratuberculosis
cggcaccgcccccgcggcggc

SEQ ID NO: 1025859 - RNA, 23 nt, Mycobacterium avium subsp. paratuberculosis
cggcaccgcccccgcggcggcca

SEQ ID NO: 1025860 - RNA, 13 nt, Mycobacterium avium subsp. paratuberculosis
cggcaccgacagg

SEQ ID NO: 1025861 - RNA, 20 nt, Mycobacterium avium subsp. paratuberculosis
cggcaccgaccgggcgcucc

SEQ ID NO: 1025862 - RNA, 16 nt, Mycobacterium avium subsp. paratuberculosis
cggcacccgguccggc

SEQ ID NO: 1025863 - RNA, 18 nt, Mycobacterium avium subsp. paratuberculosis
cggcacccgguccggccc

SEQ ID NO: 1025864 - RNA, 23 nt, Mycobacterium avium subsp. paratuberculosis
cggcacccgguccggcccgggga

SEQ ID NO: 1025865 - RNA, 12 nt, Mycobacterium avium subsp. paratuberculosis
cggcacccggcc

SEQ ID NO: 1025866 - RNA, 17 nt, Mycobacterium avium subsp. paratuberculosis
cggcaccgccgcgcggc

SEQ ID NO: 1025867 - RNA, 18 nt, Mycobacterium avium subsp. paratuberculosis
cggcaccgccgcgcggcc

SEQ ID NO: 1025868 - RNA, 15 nt, Mycobacterium avium subsp. paratuberculosis
cggcaccgccggcgg

SEQ ID NO: 1025869 - RNA, 22 nt, Mycobacterium avium subsp. paratuberculosis
cggcaccgccggcggccuccgc

SEQ ID NO: 1025870 - RNA, 19 nt, Mycobacterium avium subsp. paratuberculosis
cggauacgcccggccaccu

SEQ ID NO: 1025871 - RNA, 21 nt, Mycobacterium avium subsp. paratuberculosis
cggauauagccgacgggaucc

SEQ ID NO: 1025872 - RNA, 21 nt, Mycobacterium avium subsp. paratuberculosis
cggaucagcaccgacgcggcg

SEQ ID NO: 1025873 - RNA, 12 nt, Mycobacterium avium subsp. paratuberculosis
cggaucagcuga

SEQ ID NO: 1025874 - RNA, 18 nt, Mycobacterium avium subsp. paratuberculosis
cggaucagcugaccggcg

SEQ ID NO: 1025875 - RNA, 20 nt, Mycobacterium avium subsp. paratuberculosis
cggaucaaccacaccagcau

SEQ ID NO: 1025876 - RNA, 11 nt, Mycobacterium avium subsp. paratuberculosis
cggaucaccug

SEQ ID NO: 1025877 - RNA, 19 nt, Mycobacterium avium subsp. paratuberculosis
cggaguuuggacaucacgu

SEQ ID NO: 1025878 - RNA, 22 nt, Mycobacterium avium subsp. paratuberculosis
cggaguugccgauggcggucca

SEQ ID NO: 1025879 - RNA, 20 nt, Mycobacterium avium subsp. paratuberculosis
cggaguugcgcagccgggcg

SEQ ID NO: 1025880 - RNA, 22 nt, Mycobacterium avium subsp. paratuberculosis
cggaguugaugaaaaccaccug

SEQ ID NO: 1025881 - RNA, 18 nt, Mycobacterium avium subsp. paratuberculosis
cggaguaguuccggcggu

SEQ ID NO: 1025882 - RNA, 17 nt, Mycobacterium avium subsp. paratuberculosis
cggagugaaguccauga

SEQ ID NO: 1025883 - RNA, 17 nt, Mycobacterium avium subsp. paratuberculosis
cggaggugccgcgcggc

SEQ ID NO: 1025884 - RNA, 19 nt, Mycobacterium avium subsp. paratuberculosis
cggaggcuucgcucauccc

SEQ ID NO: 1025885 - RNA, 13 nt, Mycobacterium avium subsp. paratuberculosis
cggaggucauggc

SEQ ID NO: 1025886 - RNA, 23 nt, Mycobacterium avium subsp. paratuberculosis
cggaggaguuuuucgggguggug

SEQ ID NO: 1025887 - RNA, 19 nt, Mycobacterium avium subsp. paratuberculosis
cggaggaugccggccagcu

SEQ ID NO: 1025888 - RNA, 20 nt, Mycobacterium avium subsp. paratuberculosis
cggaggcggcgggggcgggc

SEQ ID NO: 1025889 - RNA, 22 nt, Mycobacterium avium subsp. paratuberculosis
cggaggcggcgggggcgggccc

SEQ ID NO: 1025890 - RNA, 15 nt, Mycobacterium avium subsp. paratuberculosis
cggaggcgucgacgc

SEQ ID NO: 1025891 - RNA, 15 nt, Mycobacterium avium subsp. paratuberculosis
cggaggcgagcagcc

SEQ ID NO: 1025892 - RNA, 15 nt, Mycobacterium avium subsp. paratuberculosis
cggaggcgaucaggu

SEQ ID NO: 1025893 - RNA, 17 nt, Mycobacterium avium subsp. paratuberculosis
cggaggcgaucaggugg

SEQ ID NO: 1025894 - RNA, 18 nt, Mycobacterium avium subsp. paratuberculosis
cggaggcgaaugcggcca

SEQ ID NO: 1025895 - RNA, 17 nt, Mycobacterium avium subsp. paratuberculosis
cggaucggccauggugc

SEQ ID NO: 1025896 - RNA, 16 nt, Mycobacterium avium subsp. paratuberculosis
cggaucggccgggaga

SEQ ID NO: 1025897 - RNA, 15 nt, Mycobacterium avium subsp. paratuberculosis
cggaucggcggcgac

SEQ ID NO: 1025898 - RNA, 14 nt, Mycobacterium avium subsp. paratuberculosis
cggaucgagcaccc

SEQ ID NO: 1025899 - RNA, 23 nt, Mycobacterium avium subsp. paratuberculosis
cggaucgaguucagcgucgaugu

SEQ ID NO: 1025900 - RNA, 18 nt, Mycobacterium avium subsp. paratuberculosis
cggaucgcccuggcaucc

SEQ ID NO: 1025901 - RNA, 18 nt, Mycobacterium avium subsp. paratuberculosis
cggauccagcaccgccac

SEQ ID NO: 1025902 - RNA, 20 nt, Mycobacterium avium subsp. paratuberculosis
cggauccucaguccgccccg

SEQ ID NO: 1025903 - RNA, 17 nt, Mycobacterium avium subsp. paratuberculosis
cggauccgggcgccggu

SEQ ID NO: 1025904 - RNA, 16 nt, Mycobacterium avium subsp. paratuberculosis
cggaucgaacagggcg

SEQ ID NO: 1025905 - RNA, 16 nt, Mycobacterium avium subsp. paratuberculosis
cggaugacgugcacca

SEQ ID NO: 1025906 - RNA, 19 nt, Mycobacterium avium subsp. paratuberculosis
cggaugacgugcaccaccg

SEQ ID NO: 1025907 - RNA, 15 nt, Mycobacterium avium subsp. paratuberculosis
cggaugaccaagccc

SEQ ID NO: 1025908 - RNA, 17 nt, Mycobacterium avium subsp. paratuberculosis
cggaugaccaggguggu

SEQ ID NO: 1025909 - RNA, 22 nt, Mycobacterium avium subsp. paratuberculosis
cggaugaccaggucgccggcgg

SEQ ID NO: 1025910 - RNA, 15 nt, Mycobacterium avium subsp. paratuberculosis
cggaucggcugcggg

SEQ ID NO: 1025911 - RNA, 16 nt, Mycobacterium avium subsp. paratuberculosis
cggaugaaggacuggc

SEQ ID NO: 1025912 - RNA, 20 nt, Mycobacterium avium subsp. paratuberculosis
cggaugaaggacuggcccac

SEQ ID NO: 1025913 - RNA, 17 nt, Mycobacterium avium subsp. paratuberculosis
cggaucuugguguccag

SEQ ID NO: 1025914 - RNA, 21 nt, Mycobacterium avium subsp. paratuberculosis
cggaucuugguguccagcggc

SEQ ID NO: 1025915 - RNA, 16 nt, Mycobacterium avium subsp. paratuberculosis
cggaucuggcccuggc

SEQ ID NO: 1025916 - RNA, 20 nt, Mycobacterium avium subsp. paratuberculosis
cggaugccggggcagcaccc

SEQ ID NO: 1025917 - RNA, 18 nt, Mycobacterium avium subsp. paratuberculosis
cggaugaugguggccagu

SEQ ID NO: 1025918 - RNA, 14 nt, Mycobacterium avium subsp. paratuberculosis
cggaugcaccggca

SEQ ID NO: 1025919 - RNA, 14 nt, Mycobacterium avium subsp. paratuberculosis
cggauggccagcag

SEQ ID NO: 1025920 - RNA, 15 nt, Mycobacterium avium subsp. paratuberculosis
cggauggccagcagg

SEQ ID NO: 1025921 - RNA, 19 nt, Mycobacterium avium subsp. paratuberculosis
cggaugcugcgggucagca

SEQ ID NO: 1025922 - RNA, 16 nt, Mycobacterium avium subsp. paratuberculosis
cggauggccgggcagg

SEQ ID NO: 1025923 - RNA, 13 nt, Mycobacterium avium subsp. paratuberculosis
cggauggccucgg

SEQ ID NO: 1025924 - RNA, 13 nt, Mycobacterium avium subsp. paratuberculosis
cggauggagcgcg

SEQ ID NO: 1025925 - RNA, 14 nt, Mycobacterium avium subsp. paratuberculosis
cggauggagcgcga

SEQ ID NO: 1025926 - RNA, 17 nt, Mycobacterium avium subsp. paratuberculosis
cggauggagcgcgacgg

SEQ ID NO: 1025927 - RNA, 22 nt, Mycobacterium avium subsp. paratuberculosis
cggauggagcgcgacgggcugc

SEQ ID NO: 1025928 - RNA, 16 nt, Mycobacterium avium subsp. paratuberculosis
cggauucucgcccggc

SEQ ID NO: 1025929 - RNA, 16 nt, Mycobacterium avium subsp. paratuberculosis
cggauucggcgcggcu

SEQ ID NO: 1025930 - RNA, 14 nt, Mycobacterium avium subsp. paratuberculosis
cggauugaccagca

SEQ ID NO: 1025931 - RNA, 19 nt, Mycobacterium avium subsp. paratuberculosis
cggauuccagcgcgaccgc

SEQ ID NO: 1025932 - RNA, 19 nt, Mycobacterium avium subsp. paratuberculosis
cggaugugccuggcccaga

SEQ ID NO: 1025933 - RNA, 20 nt, Mycobacterium avium subsp. paratuberculosis
cggauguggucggccacgac

SEQ ID NO: 1025934 - RNA, 14 nt, Mycobacterium avium subsp. paratuberculosis
cggauguccgaccg

SEQ ID NO: 1025935 - RNA, 20 nt, Mycobacterium avium subsp. paratuberculosis
cggaugucggugugcagcag

SEQ ID NO: 1025936 - RNA, 16 nt, Mycobacterium avium subsp. paratuberculosis
cggauggugcccaccg

SEQ ID NO: 1025937 - RNA, 17 nt, Mycobacterium avium subsp. paratuberculosis
cggaccugggugcgcca

SEQ ID NO: 1025938 - RNA, 16 nt, Mycobacterium avium subsp. paratuberculosis
cggaccgcgcgggcca

SEQ ID NO: 1025939 - RNA, 15 nt, Mycobacterium avium subsp. paratuberculosis
cggaccggccagcag

SEQ ID NO: 1025940 - RNA, 14 nt, Mycobacterium avium subsp. paratuberculosis
cggaccgccgcggc

SEQ ID NO: 1025941 - RNA, 18 nt, Mycobacterium avium subsp. paratuberculosis
cggaccgccgcggcgccc

SEQ ID NO: 1025942 - RNA, 18 nt, Mycobacterium avium subsp. paratuberculosis
cggaccgauccggcgccc

SEQ ID NO: 1025943 - RNA, 14 nt, Mycobacterium avium subsp. paratuberculosis
cggaccgcaccccc

SEQ ID NO: 1025944 - RNA, 17 nt, Mycobacterium avium subsp. paratuberculosis
cggaccgcacccccagc

SEQ ID NO: 1025945 - RNA, 18 nt, Mycobacterium avium subsp. paratuberculosis
cggacgccucccccaccc

SEQ ID NO: 1025946 - RNA, 13 nt, Mycobacterium avium subsp. paratuberculosis
cggacgccucgcc

SEQ ID NO: 1025947 - RNA, 14 nt, Mycobacterium avium subsp. paratuberculosis
cggacgccggcagc

SEQ ID NO: 1025948 - RNA, 19 nt, Mycobacterium avium subsp. paratuberculosis
cggacgaugacccagccca

SEQ ID NO: 1025949 - RNA, 13 nt, Mycobacterium avium subsp. paratuberculosis
cggacgaccuggg

SEQ ID NO: 1025950 - RNA, 12 nt, Mycobacterium avium subsp. paratuberculosis
cggacgacggcc

SEQ ID NO: 1025951 - RNA, 16 nt, Mycobacterium avium subsp. paratuberculosis
cggacgacggccagcu

SEQ ID NO: 1025952 - RNA, 14 nt, Mycobacterium avium subsp. paratuberculosis
cggaccacgucccc

SEQ ID NO: 1025953 - RNA, 19 nt, Mycobacterium avium subsp. paratuberculosis
cggaccacguccccgggcg

SEQ ID NO: 1025954 - RNA, 20 nt, Mycobacterium avium subsp. paratuberculosis
cggaccaggguggccccagc

SEQ ID NO: 1025955 - RNA, 12 nt, Mycobacterium avium subsp. paratuberculosis
cggacccagccc

SEQ ID NO: 1025956 - RNA, 15 nt, Mycobacterium avium subsp. paratuberculosis
cggacccagcuccuc

SEQ ID NO: 1025957 - RNA, 15 nt, Mycobacterium avium subsp. paratuberculosis
cggacccaggcagcg

SEQ ID NO: 1025958 - RNA, 20 nt, Mycobacterium avium subsp. paratuberculosis
cggacccgacggucgggccc

SEQ ID NO: 1025959 - RNA, 14 nt, Mycobacterium avium subsp. paratuberculosis
cggacccgcucccg

SEQ ID NO: 1025960 - RNA, 15 nt, Mycobacterium avium subsp. paratuberculosis
cggacccgcucccgg

SEQ ID NO: 1025961 - RNA, 19 nt, Mycobacterium avium subsp. paratuberculosis
cggacccuggccagcaccg

SEQ ID NO: 1025962 - RNA, 15 nt, Mycobacterium avium subsp. paratuberculosis
cggacaucgccucgg

SEQ ID NO: 1025963 - RNA, 22 nt, Mycobacterium avium subsp. paratuberculosis
cggaauugcuuuuugaccaccg

SEQ ID NO: 1025964 - RNA, 17 nt, Mycobacterium avium subsp. paratuberculosis
cggaauugaagcccugc

SEQ ID NO: 1025965 - RNA, 23 nt, Mycobacterium avium subsp. paratuberculosis
cggaaugugcuugaucagcgggc

SEQ ID NO: 1025966 - RNA, 17 nt, Mycobacterium avium subsp. paratuberculosis
cggacaccccggccagu

SEQ ID NO: 1025967 - RNA, 14 nt, Mycobacterium avium subsp. paratuberculosis
cggacaccccguag

SEQ ID NO: 1025968 - RNA, 21 nt, Mycobacterium avium subsp. paratuberculosis
cggacaccccguaggugcaca

SEQ ID NO: 1025969 - RNA, 18 nt, Mycobacterium avium subsp. paratuberculosis
cggacacggcgccgugcg

SEQ ID NO: 1025970 - RNA, 24 nt, Mycobacterium avium subsp. paratuberculosis
cggacacggcgccgugcgccucga

SEQ ID NO: 1025971 - RNA, 14 nt, Mycobacterium avium subsp. paratuberculosis
cggacagcagcacc

SEQ ID NO: 1025972 - RNA, 15 nt, Mycobacterium avium subsp. paratuberculosis
cggacagcagcaccg

SEQ ID NO: 1025973 - RNA, 13 nt, Mycobacterium avium subsp. paratuberculosis
cggacagccccga

SEQ ID NO: 1025974 - RNA, 16 nt, Mycobacterium avium subsp. paratuberculosis
cggaauagcgcuccau

SEQ ID NO: 1025975 - RNA, 15 nt, Mycobacterium avium subsp. paratuberculosis
cggaaucacuuccgc

SEQ ID NO: 1025976 - RNA, 19 nt, Mycobacterium avium subsp. paratuberculosis
cggaaucgauuggugcgca

SEQ ID NO: 1025977 - RNA, 20 nt, Mycobacterium avium subsp. paratuberculosis
cggaaugaacgcggccaggg

SEQ ID NO: 1025978 - RNA, 14 nt, Mycobacterium avium subsp. paratuberculosis
cggaauggcagcag

SEQ ID NO: 1025979 - RNA, 15 nt, Mycobacterium avium subsp. paratuberculosis
cggacuggcugagca

SEQ ID NO: 1025980 - RNA, 21 nt, Mycobacterium avium subsp. paratuberculosis
cggagaccaggucggccuuca

SEQ ID NO: 1025981 - RNA, 18 nt, Mycobacterium avium subsp. paratuberculosis
cggagacccgcccggaga

SEQ ID NO: 1025982 - RNA, 18 nt, Mycobacterium avium subsp. paratuberculosis
cggagaccgccguggcgu

SEQ ID NO: 1025983 - RNA, 13 nt, Mycobacterium avium subsp. paratuberculosis
cggagacgacgac

SEQ ID NO: 1025984 - RNA, 16 nt, Mycobacterium avium subsp. paratuberculosis
cggagaaggugucgca

SEQ ID NO: 1025985 - RNA, 21 nt, Mycobacterium avium subsp. paratuberculosis
cggacgggaccacccgcagcg

SEQ ID NO: 1025986 - RNA, 19 nt, Mycobacterium avium subsp. paratuberculosis
cggacuauacacgccugga

SEQ ID NO: 1025987 - RNA, 22 nt, Mycobacterium avium subsp. paratuberculosis
cggacuauacacgccuggacag

SEQ ID NO: 1025988 - RNA, 19 nt, Mycobacterium avium subsp. paratuberculosis
cggacucgaucgccaccga

SEQ ID NO: 1025989 - RNA, 20 nt, Mycobacterium avium subsp. paratuberculosis
cggacucguuggggccacca

SEQ ID NO: 1025990 - RNA, 12 nt, Mycobacterium avium subsp. paratuberculosis
cggacgcgggga

SEQ ID NO: 1025991 - RNA, 18 nt, Mycobacterium avium subsp. paratuberculosis
cggacgcggccgagccga

SEQ ID NO: 1025992 - RNA, 17 nt, Mycobacterium avium subsp. paratuberculosis
cggacggaucgaguccc

SEQ ID NO: 1025993 - RNA, 13 nt, Mycobacterium avium subsp. paratuberculosis
cggacggccaccu

SEQ ID NO: 1025994 - RNA, 22 nt, Mycobacterium avium subsp. paratuberculosis
cggacggguugggcgccagcag

SEQ ID NO: 1025995 - RNA, 18 nt, Mycobacterium avium subsp. paratuberculosis
cggagcaaauccggcagc

SEQ ID NO: 1025996 - RNA, 15 nt, Mycobacterium avium subsp. paratuberculosis
cggagagcaacaccu

SEQ ID NO: 1025997 - RNA, 20 nt, Mycobacterium avium subsp. paratuberculosis
cggagacguugccgcacacc

SEQ ID NO: 1025998 - RNA, 19 nt, Mycobacterium avium subsp. paratuberculosis
cggagaucaccccuggcgg

SEQ ID NO: 1025999 - RNA, 15 nt, Mycobacterium avium subsp. paratuberculosis
cggagaucagggugc

SEQ ID NO: 1026000 - RNA, 20 nt, Mycobacterium avium subsp. paratuberculosis
cggagaucagggugcucagc

SEQ ID NO: 1026001 - RNA, 22 nt, Mycobacterium avium subsp. paratuberculosis
cggagaugauggccgcgccgcc

SEQ ID NO: 1026002 - RNA, 19 nt, Mycobacterium avium subsp. paratuberculosis
cggagaugcgggccaccgu

SEQ ID NO: 1026003 - RNA, 14 nt, Mycobacterium avium subsp. paratuberculosis
cggagcugcgcgcc

SEQ ID NO: 1026004 - RNA, 20 nt, Mycobacterium avium subsp. paratuberculosis
cggagcugcgcgccccggcc

SEQ ID NO: 1026005 - RNA, 15 nt, Mycobacterium avium subsp. paratuberculosis
cggagcguucuccac

SEQ ID NO: 1026006 - RNA, 19 nt, Mycobacterium avium subsp. paratuberculosis
cggagcggugcggcucggg

SEQ ID NO: 1026007 - RNA, 15 nt, Mycobacterium avium subsp. paratuberculosis
cggagcgcuccacca

SEQ ID NO: 1026008 - RNA, 16 nt, Mycobacterium avium subsp. paratuberculosis
cggagcgcuccaccac

SEQ ID NO: 1026009 - RNA, 18 nt, Mycobacterium avium subsp. paratuberculosis
cggagccgagcaccaggc

SEQ ID NO: 1026010 - RNA, 20 nt, Mycobacterium avium subsp. paratuberculosis
cggagccgaucgccuccguc

SEQ ID NO: 1026011 - RNA, 15 nt, Mycobacterium avium subsp. paratuberculosis
cggagcgccccaggg

SEQ ID NO: 1026012 - RNA, 21 nt, Mycobacterium avium subsp. paratuberculosis
cggagccuucuucgccgcagc

SEQ ID NO: 1026013 - RNA, 22 nt, Mycobacterium avium subsp. paratuberculosis
cggagccgucucggagcggugu

SEQ ID NO: 1026014 - RNA, 13 nt, Mycobacterium avium subsp. paratuberculosis
cggaacagccggc

SEQ ID NO: 1026015 - RNA, 18 nt, Mycobacterium avium subsp. paratuberculosis
cggaaccggccggggcgc

SEQ ID NO: 1026016 - RNA, 15 nt, Mycobacterium avium subsp. paratuberculosis
cggaaccgggcaccc

SEQ ID NO: 1026017 - RNA, 18 nt, Mycobacterium avium subsp. paratuberculosis
cggaaccgggcacccggc

SEQ ID NO: 1026018 - RNA, 15 nt, Mycobacterium avium subsp. paratuberculosis
cggaaccgggccgcu

SEQ ID NO: 1026019 - RNA, 23 nt, Mycobacterium avium subsp. paratuberculosis
cggaacacccagguugucaaggg

SEQ ID NO: 1026020 - RNA, 21 nt, Mycobacterium avium subsp. paratuberculosis
cggaacccacgugcggcgccc

SEQ ID NO: 1026021 - RNA, 22 nt, Mycobacterium avium subsp. paratuberculosis
cggaaaccgcugcggcacacca

SEQ ID NO: 1026022 - RNA, 15 nt, Mycobacterium avium subsp. paratuberculosis
cggaacugcucccag

SEQ ID NO: 1026023 - RNA, 16 nt, Mycobacterium avium subsp. paratuberculosis
cggaacugcucccagg

SEQ ID NO: 1026024 - RNA, 14 nt, Mycobacterium avium subsp. paratuberculosis
cggaacgcgccggg

SEQ ID NO: 1026025 - RNA, 22 nt, Mycobacterium avium subsp. paratuberculosis
cggaacgcgccgggcaacagcg

SEQ ID NO: 1026026 - RNA, 17 nt, Mycobacterium avium subsp. paratuberculosis
cggaacccguugcgccc

SEQ ID NO: 1026027 - RNA, 15 nt, Mycobacterium avium subsp. paratuberculosis
cggaacccugcccca

SEQ ID NO: 1026028 - RNA, 16 nt, Mycobacterium avium subsp. paratuberculosis
cggaagaucagcaggc

SEQ ID NO: 1026029 - RNA, 13 nt, Mycobacterium avium subsp. paratuberculosis
cggaauacagcag

SEQ ID NO: 1026030 - RNA, 17 nt, Mycobacterium avium subsp. paratuberculosis
cggaagccccaggcccg

SEQ ID NO: 1026031 - RNA, 19 nt, Mycobacterium avium subsp. paratuberculosis
cggaagccccaggcccggu

SEQ ID NO: 1026032 - RNA, 17 nt, Mycobacterium avium subsp. paratuberculosis
cggaagcccuugcagca

SEQ ID NO: 1026033 - RNA, 18 nt, Mycobacterium avium subsp. paratuberculosis
cggaagcccuugcagcac

SEQ ID NO: 1026034 - RNA, 17 nt, Mycobacterium avium subsp. paratuberculosis
cggaagcccacgaucac

SEQ ID NO: 1026035 - RNA, 22 nt, Mycobacterium avium subsp. paratuberculosis
cggaagcugccguugcgccagc

SEQ ID NO: 1026036 - RNA, 21 nt, Mycobacterium avium subsp. paratuberculosis
cggaaggccaaggccagcaac

SEQ ID NO: 1026037 - RNA, 12 nt, Mycobacterium avium subsp. paratuberculosis
cggaaggccagg

SEQ ID NO: 1026038 - RNA, 23 nt, Mycobacterium avium subsp. paratuberculosis
cggaaaaagcguugcgccagcag

SEQ ID NO: 1026039 - RNA, 19 nt, Mycobacterium avium subsp. paratuberculosis
cgcuaaagccgaccgcccc

SEQ ID NO: 1026040 - RNA, 20 nt, Mycobacterium avium subsp. paratuberculosis
cgcuaaagccgaccgccccg

SEQ ID NO: 1026041 - RNA, 17 nt, Mycobacterium avium subsp. paratuberculosis
cgcuugguggcgccggu

SEQ ID NO: 1026042 - RNA, 19 nt, Mycobacterium avium subsp. paratuberculosis
cgcuugucagcggccucgg

SEQ ID NO: 1026043 - RNA, 14 nt, Mycobacterium avium subsp. paratuberculosis
cggccuggcccagc

SEQ ID NO: 1026044 - RNA, 15 nt, Mycobacterium avium subsp. paratuberculosis
cggccuccgccaccu

SEQ ID NO: 1026045 - RNA, 17 nt, Mycobacterium avium subsp. paratuberculosis
cggccuaugcgcccggg

SEQ ID NO: 1026046 - RNA, 17 nt, Mycobacterium avium subsp. paratuberculosis
cggccuccgagcggcgc

SEQ ID NO: 1026047 - RNA, 18 nt, Mycobacterium avium subsp. paratuberculosis
cggccuccgagcggcgca

SEQ ID NO: 1026048 - RNA, 21 nt, Mycobacterium avium subsp. paratuberculosis
cggccuccgagcggcgcaggc

SEQ ID NO: 1026049 - RNA, 18 nt, Mycobacterium avium subsp. paratuberculosis
cggccugggcgaccacgu

SEQ ID NO: 1026050 - RNA, 22 nt, Mycobacterium avium subsp. paratuberculosis
cggccugguacagcaccgccgc

SEQ ID NO: 1026051 - RNA, 16 nt, Mycobacterium avium subsp. paratuberculosis
cggccucaggcgucgg

SEQ ID NO: 1026052 - RNA, 15 nt, Mycobacterium avium subsp. paratuberculosis
cggccucaccgcggg

SEQ ID NO: 1026053 - RNA, 14 nt, Mycobacterium avium subsp. paratuberculosis
cggccuccagccgc

SEQ ID NO: 1026054 - RNA, 21 nt, Mycobacterium avium subsp. paratuberculosis
cggccgguccgugcacggcca

SEQ ID NO: 1026055 - RNA, 21 nt, Mycobacterium avium subsp. paratuberculosis
cggccggucgaaggccccggu

SEQ ID NO: 1026056 - RNA, 22 nt, Mycobacterium avium subsp. paratuberculosis
cggccggugaucggucugccug

SEQ ID NO: 1026057 - RNA, 14 nt, Mycobacterium avium subsp. paratuberculosis
cggccggggcgggc

SEQ ID NO: 1026058 - RNA, 17 nt, Mycobacterium avium subsp. paratuberculosis
cggccgggggcgcgggc

SEQ ID NO: 1026059 - RNA, 19 nt, Mycobacterium avium subsp. paratuberculosis
cggccgggggcgcgggcgg

SEQ ID NO: 1026060 - RNA, 16 nt, Mycobacterium avium subsp. paratuberculosis
cggccgggucccuuug

SEQ ID NO: 1026061 - RNA, 15 nt, Mycobacterium avium subsp. paratuberculosis
cggccggguccugga

SEQ ID NO: 1026062 - RNA, 16 nt, Mycobacterium avium subsp. paratuberculosis
cggccgggucgagcgc

SEQ ID NO: 1026063 - RNA, 19 nt, Mycobacterium avium subsp. paratuberculosis
cggccgggucgagcgcgcc

SEQ ID NO: 1026064 - RNA, 19 nt, Mycobacterium avium subsp. paratuberculosis
cggccgggucgcaggcagc

SEQ ID NO: 1026065 - RNA, 18 nt, Mycobacterium avium subsp. paratuberculosis
cggccggggccagcaccc

SEQ ID NO: 1026066 - RNA, 15 nt, Mycobacterium avium subsp. paratuberculosis
cggccggggcgccac

SEQ ID NO: 1026067 - RNA, 16 nt, Mycobacterium avium subsp. paratuberculosis
cggcgaccgugcccac

SEQ ID NO: 1026068 - RNA, 16 nt, Mycobacterium avium subsp. paratuberculosis
cggcgaaucagcagcu

SEQ ID NO: 1026069 - RNA, 21 nt, Mycobacterium avium subsp. paratuberculosis
cggcgaauccacacaggacca

SEQ ID NO: 1026070 - RNA, 22 nt, Mycobacterium avium subsp. paratuberculosis
cggcgaauccacacaggaccag

SEQ ID NO: 1026071 - RNA, 13 nt, Mycobacterium avium subsp. paratuberculosis
cggcgacacccag

SEQ ID NO: 1026072 - RNA, 19 nt, Mycobacterium avium subsp. paratuberculosis
cggcgacacccagcggcgc

SEQ ID NO: 1026073 - RNA, 18 nt, Mycobacterium avium subsp. paratuberculosis
cggcgacacguccagcuc

SEQ ID NO: 1026074 - RNA, 21 nt, Mycobacterium avium subsp. paratuberculosis
cggcgaacugcuugaucaggu

SEQ ID NO: 1026075 - RNA, 15 nt, Mycobacterium avium subsp. paratuberculosis
cggcgaacuuggccg

SEQ ID NO: 1026076 - RNA, 15 nt, Mycobacterium avium subsp. paratuberculosis
cggcgaagccggccc

SEQ ID NO: 1026077 - RNA, 18 nt, Mycobacterium avium subsp. paratuberculosis
cggcgaagccggccccgc

SEQ ID NO: 1026078 - RNA, 14 nt, Mycobacterium avium subsp. paratuberculosis
cggcgaagccggcg

SEQ ID NO: 1026079 - RNA, 19 nt, Mycobacterium avium subsp. paratuberculosis
cggcgaacgguucgggaac

SEQ ID NO: 1026080 - RNA, 18 nt, Mycobacterium avium subsp. paratuberculosis
cggcgaacucgcggcggg

SEQ ID NO: 1026081 - RNA, 17 nt, Mycobacterium avium subsp. paratuberculosis
cggcgaaggugccccgc

SEQ ID NO: 1026082 - RNA, 18 nt, Mycobacterium avium subsp. paratuberculosis
cggcgaaguagcgggcgu

SEQ ID NO: 1026083 - RNA, 16 nt, Mycobacterium avium subsp. paratuberculosis
cggcgaaggacagccg

SEQ ID NO: 1026084 - RNA, 17 nt, Mycobacterium avium subsp. paratuberculosis
cggccuugaccaggaug

SEQ ID NO: 1026085 - RNA, 14 nt, Mycobacterium avium subsp. paratuberculosis
cggccuuggccacc

SEQ ID NO: 1026086 - RNA, 15 nt, Mycobacterium avium subsp. paratuberculosis
cggccuuggccaccg

SEQ ID NO: 1026087 - RNA, 23 nt, Mycobacterium avium subsp. paratuberculosis
cggccuucaccagggugccccgc

SEQ ID NO: 1026088 - RNA, 20 nt, Mycobacterium avium subsp. paratuberculosis
cggccuuacgcugcgcgacc

SEQ ID NO: 1026089 - RNA, 16 nt, Mycobacterium avium subsp. paratuberculosis
cggcccguccgccccg

SEQ ID NO: 1026090 - RNA, 17 nt, Mycobacterium avium subsp. paratuberculosis
cggcccguccgccccgc

SEQ ID NO: 1026091 - RNA, 19 nt, Mycobacterium avium subsp. paratuberculosis
cggcccguugagcaccgcg

SEQ ID NO: 1026092 - RNA, 13 nt, Mycobacterium avium subsp. paratuberculosis
cggcccugcagcg

SEQ ID NO: 1026093 - RNA, 16 nt, Mycobacterium avium subsp. paratuberculosis
cggcccugcagcgccu

SEQ ID NO: 1026094 - RNA, 22 nt, Mycobacterium avium subsp. paratuberculosis
cggcccggacggagccgugccc

SEQ ID NO: 1026095 - RNA, 14 nt, Mycobacterium avium subsp. paratuberculosis
cggcccggcccgcu

SEQ ID NO: 1026096 - RNA, 19 nt, Mycobacterium avium subsp. paratuberculosis
cggcccggcggccggccgc

SEQ ID NO: 1026097 - RNA, 16 nt, Mycobacterium avium subsp. paratuberculosis
cggcccggcgggcauc

SEQ ID NO: 1026098 - RNA, 22 nt, Mycobacterium avium subsp. paratuberculosis
cggccgauucggcgccgcgacc

SEQ ID NO: 1026099 - RNA, 17 nt, Mycobacterium avium subsp. paratuberculosis
cggccgauggcccaggc

SEQ ID NO: 1026100 - RNA, 20 nt, Mycobacterium avium subsp. paratuberculosis
cggccgcaaucggcgccggc

SEQ ID NO: 1026101 - RNA, 22 nt, Mycobacterium avium subsp. paratuberculosis
cggccgcaaucggcgccggcuc

SEQ ID NO: 1026102 - RNA, 22 nt, Mycobacterium avium subsp. paratuberculosis
cggccgcacaacagacgaucac

SEQ ID NO: 1026103 - RNA, 15 nt, Mycobacterium avium subsp. paratuberculosis
cggccgcaccccacc

SEQ ID NO: 1026104 - RNA, 18 nt, Mycobacterium avium subsp. paratuberculosis
cggccgcaccccacccgc

SEQ ID NO: 1026105 - RNA, 21 nt, Mycobacterium avium subsp. paratuberculosis
cggccgcacgucccgcccggc

SEQ ID NO: 1026106 - RNA, 22 nt, Mycobacterium avium subsp. paratuberculosis
cggccgaugagccucagcgcgc

SEQ ID NO: 1026107 - RNA, 14 nt, Mycobacterium avium subsp. paratuberculosis
cggccgagcgcagc

SEQ ID NO: 1026108 - RNA, 15 nt, Mycobacterium avium subsp. paratuberculosis
cggccgagcgcagcg

SEQ ID NO: 1026109 - RNA, 17 nt, Mycobacterium avium subsp. paratuberculosis
cggccgacgcccagcac

SEQ ID NO: 1026110 - RNA, 12 nt, Mycobacterium avium subsp. paratuberculosis
cggccgacgcgc

SEQ ID NO: 1026111 - RNA, 15 nt, Mycobacterium avium subsp. paratuberculosis
cggccgacgcggccu

SEQ ID NO: 1026112 - RNA, 17 nt, Mycobacterium avium subsp. paratuberculosis
cggccgaauccggccgg

SEQ ID NO: 1026113 - RNA, 18 nt, Mycobacterium avium subsp. paratuberculosis
cggccgacaacgacagca

SEQ ID NO: 1026114 - RNA, 19 nt, Mycobacterium avium subsp. paratuberculosis
cggccgacaccccgaugcc

SEQ ID NO: 1026115 - RNA, 20 nt, Mycobacterium avium subsp. paratuberculosis
cggccgaaaacccucagacc

SEQ ID NO: 1026116 - RNA, 18 nt, Mycobacterium avium subsp. paratuberculosis
cggccgaaaucaacgcgc

SEQ ID NO: 1026117 - RNA, 23 nt, Mycobacterium avium subsp. paratuberculosis
cggccgaaaucaacgcgccgaac

SEQ ID NO: 1026118 - RNA, 15 nt, Mycobacterium avium subsp. paratuberculosis
cggccgggcgccccg

SEQ ID NO: 1026119 - RNA, 13 nt, Mycobacterium avium subsp. paratuberculosis
cggccgggaucug

SEQ ID NO: 1026120 - RNA, 22 nt, Mycobacterium avium subsp. paratuberculosis
cggccgggaucuggccggugag

SEQ ID NO: 1026121 - RNA, 18 nt, Mycobacterium avium subsp. paratuberculosis
cggccgggaugccgccgg

SEQ ID NO: 1026122 - RNA, 17 nt, Mycobacterium avium subsp. paratuberculosis
cggccgggccgcggcgg

SEQ ID NO: 1026123 - RNA, 13 nt, Mycobacterium avium subsp. paratuberculosis
cggccgggccggc

SEQ ID NO: 1026124 - RNA, 15 nt, Mycobacterium avium subsp. paratuberculosis
cggccgggccggcgg

SEQ ID NO: 1026125 - RNA, 17 nt, Mycobacterium avium subsp. paratuberculosis
cggccgggacgcggucc

SEQ ID NO: 1026126 - RNA, 15 nt, Mycobacterium avium subsp. paratuberculosis
cggccggcugcagcc

SEQ ID NO: 1026127 - RNA, 18 nt, Mycobacterium avium subsp. paratuberculosis
cggccgggaaacccucga

SEQ ID NO: 1026128 - RNA, 16 nt, Mycobacterium avium subsp. paratuberculosis
cggccggcgggcagca

SEQ ID NO: 1026129 - RNA, 17 nt, Mycobacterium avium subsp. paratuberculosis
cggccggcgucacucug

SEQ ID NO: 1026130 - RNA, 19 nt, Mycobacterium avium subsp. paratuberculosis
cggccggcgucacucuggc

SEQ ID NO: 1026131 - RNA, 22 nt, Mycobacterium avium subsp. paratuberculosis
cggccggcgcgugcgcgacgaa

SEQ ID NO: 1026132 - RNA, 15 nt, Mycobacterium avium subsp. paratuberculosis
cggccggcgcggcgg

SEQ ID NO: 1026133 - RNA, 16 nt, Mycobacterium avium subsp. paratuberculosis
cggccggcgcggcggc

SEQ ID NO: 1026134 - RNA, 14 nt, Mycobacterium avium subsp. paratuberculosis
cggccggcgcgcac

SEQ ID NO: 1026135 - RNA, 20 nt, Mycobacterium avium subsp. paratuberculosis
cggccggcgcgcacggcagc

SEQ ID NO: 1026136 - RNA, 15 nt, Mycobacterium avium subsp. paratuberculosis
cggccggccgccggc

SEQ ID NO: 1026137 - RNA, 16 nt, Mycobacterium avium subsp. paratuberculosis
cggccggccuggugcg

SEQ ID NO: 1026138 - RNA, 13 nt, Mycobacterium avium subsp. paratuberculosis
cggccggcgcagc

SEQ ID NO: 1026139 - RNA, 15 nt, Mycobacterium avium subsp. paratuberculosis
cggccggcgcagccg

SEQ ID NO: 1026140 - RNA, 19 nt, Mycobacterium avium subsp. paratuberculosis
cggccggcgcagccggcca

SEQ ID NO: 1026141 - RNA, 14 nt, Mycobacterium avium subsp. paratuberculosis
cggccggcgccgcc

SEQ ID NO: 1026142 - RNA, 17 nt, Mycobacterium avium subsp. paratuberculosis
cggccggcgccgccggg

SEQ ID NO: 1026143 - RNA, 13 nt, Mycobacterium avium subsp. paratuberculosis
cggccggcccagc

SEQ ID NO: 1026144 - RNA, 15 nt, Mycobacterium avium subsp. paratuberculosis
cggccggccccggcc

SEQ ID NO: 1026145 - RNA, 14 nt, Mycobacterium avium subsp. paratuberculosis
cggccggccccggg

SEQ ID NO: 1026146 - RNA, 14 nt, Mycobacterium avium subsp. paratuberculosis
cggccggcccgccc

SEQ ID NO: 1026147 - RNA, 13 nt, Mycobacterium avium subsp. paratuberculosis
cggccggcccggc

SEQ ID NO: 1026148 - RNA, 15 nt, Mycobacterium avium subsp. paratuberculosis
cggccggcccggccc

SEQ ID NO: 1026149 - RNA, 21 nt, Mycobacterium avium subsp. paratuberculosis
cggccggccgaacacggccgc

SEQ ID NO: 1026150 - RNA, 17 nt, Mycobacterium avium subsp. paratuberculosis
cggccgcgucgccgacc

SEQ ID NO: 1026151 - RNA, 17 nt, Mycobacterium avium subsp. paratuberculosis
cggccggccagcagccg

SEQ ID NO: 1026152 - RNA, 20 nt, Mycobacterium avium subsp. paratuberculosis
cggccgcguacuucgcgccc

SEQ ID NO: 1026153 - RNA, 14 nt, Mycobacterium avium subsp. paratuberculosis
cggccgcggggccg

SEQ ID NO: 1026154 - RNA, 16 nt, Mycobacterium avium subsp. paratuberculosis
cggccgcggggccggc

SEQ ID NO: 1026155 - RNA, 16 nt, Mycobacterium avium subsp. paratuberculosis
cggccgcgcgcggcgc

SEQ ID NO: 1026156 - RNA, 15 nt, Mycobacterium avium subsp. paratuberculosis
cggccgcggauggug

SEQ ID NO: 1026157 - RNA, 17 nt, Mycobacterium avium subsp. paratuberculosis
cggccgcggcccggcca

SEQ ID NO: 1026158 - RNA, 14 nt, Mycobacterium avium subsp. paratuberculosis
cggccgcggcgcgc

SEQ ID NO: 1026159 - RNA, 16 nt, Mycobacterium avium subsp. paratuberculosis
cggccgcggcgcggcc

SEQ ID NO: 1026160 - RNA, 12 nt, Mycobacterium avium subsp. paratuberculosis
cggccgcggcgc

SEQ ID NO: 1026161 - RNA, 13 nt, Mycobacterium avium subsp. paratuberculosis
cggccgcggcggg

SEQ ID NO: 1026162 - RNA, 18 nt, Mycobacterium avium subsp. paratuberculosis
cggccgcgcguagaucau

SEQ ID NO: 1026163 - RNA, 19 nt, Mycobacterium avium subsp. paratuberculosis
cggccgcgcgugcccgcgg

SEQ ID NO: 1026164 - RNA, 22 nt, Mycobacterium avium subsp. paratuberculosis
cggccgcaucguugguccaggc

SEQ ID NO: 1026165 - RNA, 13 nt, Mycobacterium avium subsp. paratuberculosis
cggccgcagcgcc

SEQ ID NO: 1026166 - RNA, 14 nt, Mycobacterium avium subsp. paratuberculosis
cggccgcagcugcu

SEQ ID NO: 1026167 - RNA, 14 nt, Mycobacterium avium subsp. paratuberculosis
cggccccgggcgcu

SEQ ID NO: 1026168 - RNA, 18 nt, Mycobacterium avium subsp. paratuberculosis
cggccccgguagccagca

SEQ ID NO: 1026169 - RNA, 21 nt, Mycobacterium avium subsp. paratuberculosis
cggccccgguagccagcaccg

SEQ ID NO: 1026170 - RNA, 13 nt, Mycobacterium avium subsp. paratuberculosis
cggccccggccga

SEQ ID NO: 1026171 - RNA, 19 nt, Mycobacterium avium subsp. paratuberculosis
cggccccggccgagccggc

SEQ ID NO: 1026172 - RNA, 16 nt, Mycobacterium avium subsp. paratuberculosis
cggccccggccgggcg

SEQ ID NO: 1026173 - RNA, 15 nt, Mycobacterium avium subsp. paratuberculosis
cggccccggcucggg

SEQ ID NO: 1026174 - RNA, 14 nt, Mycobacterium avium subsp. paratuberculosis
cggccccgcgcauc

SEQ ID NO: 1026175 - RNA, 13 nt, Mycobacterium avium subsp. paratuberculosis
cggccccgcccgg

SEQ ID NO: 1026176 - RNA, 14 nt, Mycobacterium avium subsp. paratuberculosis
cggccccgcccggg

SEQ ID NO: 1026177 - RNA, 16 nt, Mycobacterium avium subsp. paratuberculosis
cggccccgcccggggc

SEQ ID NO: 1026178 - RNA, 17 nt, Mycobacterium avium subsp. paratuberculosis
cggccccgcccggggcg

SEQ ID NO: 1026179 - RNA, 15 nt, Mycobacterium avium subsp. paratuberculosis
cggcccagcucggug

SEQ ID NO: 1026180 - RNA, 16 nt, Mycobacterium avium subsp. paratuberculosis
cggcccagcgcggugu

SEQ ID NO: 1026181 - RNA, 21 nt, Mycobacterium avium subsp. paratuberculosis
cggcccagacgguuccaccgg

SEQ ID NO: 1026182 - RNA, 13 nt, Mycobacterium avium subsp. paratuberculosis
cggcccagcacca

SEQ ID NO: 1026183 - RNA, 16 nt, Mycobacterium avium subsp. paratuberculosis
cggcccagcaccaccu

SEQ ID NO: 1026184 - RNA, 13 nt, Mycobacterium avium subsp. paratuberculosis
cggcccagcgcgc

SEQ ID NO: 1026185 - RNA, 12 nt, Mycobacterium avium subsp. paratuberculosis
cggcccacccgg

SEQ ID NO: 1026186 - RNA, 19 nt, Mycobacterium avium subsp. paratuberculosis
cggcccaccgcgacccggc

SEQ ID NO: 1026187 - RNA, 14 nt, Mycobacterium avium subsp. paratuberculosis
cggcccagcccggc

SEQ ID NO: 1026188 - RNA, 18 nt, Mycobacterium avium subsp. paratuberculosis
cggcccagcccggccagc

SEQ ID NO: 1026189 - RNA, 11 nt, Mycobacterium avium subsp. paratuberculosis
cggcccagccg

SEQ ID NO: 1026190 - RNA, 14 nt, Mycobacterium avium subsp. paratuberculosis
cggcccagccgcug

SEQ ID NO: 1026191 - RNA, 22 nt, Mycobacterium avium subsp. paratuberculosis
cggccccgagcgucacgccagc

SEQ ID NO: 1026192 - RNA, 17 nt, Mycobacterium avium subsp. paratuberculosis
cggccccuaccgccgag

SEQ ID NO: 1026193 - RNA, 11 nt, Mycobacterium avium subsp. paratuberculosis
cggcccgacca

SEQ ID NO: 1026194 - RNA, 22 nt, Mycobacterium avium subsp. paratuberculosis
cggcccgacggguucgcgcagc

SEQ ID NO: 1026195 - RNA, 21 nt, Mycobacterium avium subsp. paratuberculosis
cggcccgagcccugcgccagc

SEQ ID NO: 1026196 - RNA, 14 nt, Mycobacterium avium subsp. paratuberculosis
cggcccgcagcgcc

SEQ ID NO: 1026197 - RNA, 15 nt, Mycobacterium avium subsp. paratuberculosis
cggcccgcagcgccu

SEQ ID NO: 1026198 - RNA, 20 nt, Mycobacterium avium subsp. paratuberculosis
cggcccgcagcgccucggcg

SEQ ID NO: 1026199 - RNA, 21 nt, Mycobacterium avium subsp. paratuberculosis
cggcccgcaggaucgagccgg

SEQ ID NO: 1026200 - RNA, 20 nt, Mycobacterium avium subsp. paratuberculosis
cggcccgcacggccgccagg

SEQ ID NO: 1026201 - RNA, 12 nt, Mycobacterium avium subsp. paratuberculosis
cggcccgcagcc

SEQ ID NO: 1026202 - RNA, 23 nt, Mycobacterium avium subsp. paratuberculosis
cggcccgcagccagcgcagcacu

SEQ ID NO: 1026203 - RNA, 13 nt, Mycobacterium avium subsp. paratuberculosis
cggcccgccgaac

SEQ ID NO: 1026204 - RNA, 21 nt, Mycobacterium avium subsp. paratuberculosis
cggcccgccgaacgccuccgc

SEQ ID NO: 1026205 - RNA, 13 nt, Mycobacterium avium subsp. paratuberculosis
cggcccgcggcac

SEQ ID NO: 1026206 - RNA, 14 nt, Mycobacterium avium subsp. paratuberculosis
cggcccgcggcauc

SEQ ID NO: 1026207 - RNA, 13 nt, Mycobacterium avium subsp. paratuberculosis
cggcccgcggcgg

SEQ ID NO: 1026208 - RNA, 13 nt, Mycobacterium avium subsp. paratuberculosis
cggcccgcggggc

SEQ ID NO: 1026209 - RNA, 16 nt, Mycobacterium avium subsp. paratuberculosis
cggcccgcgccccggc

SEQ ID NO: 1026210 - RNA, 17 nt, Mycobacterium avium subsp. paratuberculosis
cggcccgcgccccggcg

SEQ ID NO: 1026211 - RNA, 15 nt, Mycobacterium avium subsp. paratuberculosis
cggcccgccgcgccc

SEQ ID NO: 1026212 - RNA, 20 nt, Mycobacterium avium subsp. paratuberculosis
cggcccgccggagccgaucg

SEQ ID NO: 1026213 - RNA, 13 nt, Mycobacterium avium subsp. paratuberculosis
cggcccgccgggc

SEQ ID NO: 1026214 - RNA, 14 nt, Mycobacterium avium subsp. paratuberculosis
cggcccgccgggcc

SEQ ID NO: 1026215 - RNA, 15 nt, Mycobacterium avium subsp. paratuberculosis
cggcccgccucggcg

SEQ ID NO: 1026216 - RNA, 16 nt, Mycobacterium avium subsp. paratuberculosis
cggcccgcucggcggg

SEQ ID NO: 1026217 - RNA, 17 nt, Mycobacterium avium subsp. paratuberculosis
cggcccgcugcgcggcc

SEQ ID NO: 1026218 - RNA, 17 nt, Mycobacterium avium subsp. paratuberculosis
cggcccgcugcggcugg

SEQ ID NO: 1026219 - RNA, 14 nt, Mycobacterium avium subsp. paratuberculosis
cggcccgcuggccg

SEQ ID NO: 1026220 - RNA, 16 nt, Mycobacterium avium subsp. paratuberculosis
cggcccgcuggccgcc

SEQ ID NO: 1026221 - RNA, 18 nt, Mycobacterium avium subsp. paratuberculosis
cggcccgcuggccgccgc

SEQ ID NO: 1026222 - RNA, 22 nt, Mycobacterium avium subsp. paratuberculosis
cggcccgcuucaggcagcgcac

SEQ ID NO: 1026223 - RNA, 15 nt, Mycobacterium avium subsp. paratuberculosis
cggcccgcgcggggu

SEQ ID NO: 1026224 - RNA, 17 nt, Mycobacterium avium subsp. paratuberculosis
cggccaguccggcagca

SEQ ID NO: 1026225 - RNA, 16 nt, Mycobacterium avium subsp. paratuberculosis
cggccaguccugggcc

SEQ ID NO: 1026226 - RNA, 19 nt, Mycobacterium avium subsp. paratuberculosis
cggccaguccaggccgccg

SEQ ID NO: 1026227 - RNA, 20 nt, Mycobacterium avium subsp. paratuberculosis
cggccaguccaggccgccgu

SEQ ID NO: 1026228 - RNA, 17 nt, Mycobacterium avium subsp. paratuberculosis
cggcccaagacccgcgu

SEQ ID NO: 1026229 - RNA, 17 nt, Mycobacterium avium subsp. paratuberculosis
cggcccaccaccgccuc

SEQ ID NO: 1026230 - RNA, 17 nt, Mycobacterium avium subsp. paratuberculosis
cggcccaccggcccggc

SEQ ID NO: 1026231 - RNA, 18 nt, Mycobacterium avium subsp. paratuberculosis
cggccagguuccaccggg

SEQ ID NO: 1026232 - RNA, 18 nt, Mycobacterium avium subsp. paratuberculosis
cggccagguugaccacca

SEQ ID NO: 1026233 - RNA, 19 nt, Mycobacterium avium subsp. paratuberculosis
cggccagguugaccaccag

SEQ ID NO: 1026234 - RNA, 20 nt, Mycobacterium avium subsp. paratuberculosis
cggccagguugucgucgggc

SEQ ID NO: 1026235 - RNA, 20 nt, Mycobacterium avium subsp. paratuberculosis
cggccaggucgccgcgcagc

SEQ ID NO: 1026236 - RNA, 21 nt, Mycobacterium avium subsp. paratuberculosis
cggccagggugccgacgaccu

SEQ ID NO: 1026237 - RNA, 23 nt, Mycobacterium avium subsp. paratuberculosis
cggccaggguggggaucacgucg

SEQ ID NO: 1026238 - RNA, 21 nt, Mycobacterium avium subsp. paratuberculosis
cggccagggugucccagcgcc

SEQ ID NO: 1026239 - RNA, 18 nt, Mycobacterium avium subsp. paratuberculosis
cggccagguacugaucac

SEQ ID NO: 1026240 - RNA, 15 nt, Mycobacterium avium subsp. paratuberculosis
cggccagcgcgcggc

SEQ ID NO: 1026241 - RNA, 15 nt, Mycobacterium avium subsp. paratuberculosis
cggccagcgcggccg

SEQ ID NO: 1026242 - RNA, 18 nt, Mycobacterium avium subsp. paratuberculosis
cggccagcgcggccgggc

SEQ ID NO: 1026243 - RNA, 19 nt, Mycobacterium avium subsp. paratuberculosis
cggccagcgcggccgggcg

SEQ ID NO: 1026244 - RNA, 21 nt, Mycobacterium avium subsp. paratuberculosis
cggccagcgcggccgggcgcc

SEQ ID NO: 1026245 - RNA, 22 nt, Mycobacterium avium subsp. paratuberculosis
cggccagcgcggccgggcgccc

SEQ ID NO: 1026246 - RNA, 18 nt, Mycobacterium avium subsp. paratuberculosis
cggccagcgcgcgggcgu

SEQ ID NO: 1026247 - RNA, 16 nt, Mycobacterium avium subsp. paratuberculosis
cggccagcgcgaaagc

SEQ ID NO: 1026248 - RNA, 14 nt, Mycobacterium avium subsp. paratuberculosis
cggccagcgcgccg

SEQ ID NO: 1026249 - RNA, 18 nt, Mycobacterium avium subsp. paratuberculosis
cggccagcgcgccgccga

SEQ ID NO: 1026250 - RNA, 17 nt, Mycobacterium avium subsp. paratuberculosis
cggccagcgcgcgcagc

SEQ ID NO: 1026251 - RNA, 23 nt, Mycobacterium avium subsp. paratuberculosis
cggccagcgagaagucgcucagc

SEQ ID NO: 1026252 - RNA, 12 nt, Mycobacterium avium subsp. paratuberculosis
cggccagcgagg

SEQ ID NO: 1026253 - RNA, 13 nt, Mycobacterium avium subsp. paratuberculosis
cggccagcagcac

SEQ ID NO: 1026254 - RNA, 22 nt, Mycobacterium avium subsp. paratuberculosis
cggccagcacgaacaccacgua

SEQ ID NO: 1026255 - RNA, 24 nt, Mycobacterium avium subsp. paratuberculosis
cggccagcacggucagcggccagc

SEQ ID NO: 1026256 - RNA, 13 nt, Mycobacterium avium subsp. paratuberculosis
cggccagcgcccc

SEQ ID NO: 1026257 - RNA, 13 nt, Mycobacterium avium subsp. paratuberculosis
cggccagcgccgc

SEQ ID NO: 1026258 - RNA, 14 nt, Mycobacterium avium subsp. paratuberculosis
cggccagcgccgcc

SEQ ID NO: 1026259 - RNA, 19 nt, Mycobacterium avium subsp. paratuberculosis
cggccagcgccgcccgggc

SEQ ID NO: 1026260 - RNA, 15 nt, Mycobacterium avium subsp. paratuberculosis
cggccagcacacccu

SEQ ID NO: 1026261 - RNA, 12 nt, Mycobacterium avium subsp. paratuberculosis
cggccagcacca

SEQ ID NO: 1026262 - RNA, 14 nt, Mycobacterium avium subsp. paratuberculosis
cggccagcaccacg

SEQ ID NO: 1026263 - RNA, 15 nt, Mycobacterium avium subsp. paratuberculosis
cggccagcacccgcu

SEQ ID NO: 1026264 - RNA, 18 nt, Mycobacterium avium subsp. paratuberculosis
cggccagcacccgcugau

SEQ ID NO: 1026265 - RNA, 13 nt, Mycobacterium avium subsp. paratuberculosis
cggccagcaccgc

SEQ ID NO: 1026266 - RNA, 14 nt, Mycobacterium avium subsp. paratuberculosis
cggccacugccccg

SEQ ID NO: 1026267 - RNA, 17 nt, Mycobacterium avium subsp. paratuberculosis
cggccacugccccggcg

SEQ ID NO: 1026268 - RNA, 18 nt, Mycobacterium avium subsp. paratuberculosis
cggccacgccggguuugu

SEQ ID NO: 1026269 - RNA, 20 nt, Mycobacterium avium subsp. paratuberculosis
cggccacgaccucggggucg

SEQ ID NO: 1026270 - RNA, 22 nt, Mycobacterium avium subsp. paratuberculosis
cggccacgacgcgccacgcccc

SEQ ID NO: 1026271 - RNA, 17 nt, Mycobacterium avium subsp. paratuberculosis
cggccacgacgcggcgc

SEQ ID NO: 1026272 - RNA, 19 nt, Mycobacterium avium subsp. paratuberculosis
cggccacgcucgccagacc

SEQ ID NO: 1026273 - RNA, 21 nt, Mycobacterium avium subsp. paratuberculosis
cggccacgcucggcggcgcgc

SEQ ID NO: 1026274 - RNA, 19 nt, Mycobacterium avium subsp. paratuberculosis
cggccacgcucgggccggc

SEQ ID NO: 1026275 - RNA, 17 nt, Mycobacterium avium subsp. paratuberculosis
cggccaccaacaggucg

SEQ ID NO: 1026276 - RNA, 17 nt, Mycobacterium avium subsp. paratuberculosis
cggccaccaacggcagc

SEQ ID NO: 1026277 - RNA, 13 nt, Mycobacterium avium subsp. paratuberculosis
cggccaccaccac

SEQ ID NO: 1026278 - RNA, 14 nt, Mycobacterium avium subsp. paratuberculosis
cggccaccaccacg

SEQ ID NO: 1026279 - RNA, 21 nt, Mycobacterium avium subsp. paratuberculosis
cggccaccaccacggccaugc

SEQ ID NO: 1026280 - RNA, 15 nt, Mycobacterium avium subsp. paratuberculosis
cggccaccaccgcca

SEQ ID NO: 1026281 - RNA, 14 nt, Mycobacterium avium subsp. paratuberculosis
cggccaccugggcg

SEQ ID NO: 1026282 - RNA, 19 nt, Mycobacterium avium subsp. paratuberculosis
cggccaccugggcggggcu

SEQ ID NO: 1026283 - RNA, 20 nt, Mycobacterium avium subsp. paratuberculosis
cggccaccugggcggggcug

SEQ ID NO: 1026284 - RNA, 20 nt, Mycobacterium avium subsp. paratuberculosis
cggccaccgucagcgucagc

SEQ ID NO: 1026285 - RNA, 16 nt, Mycobacterium avium subsp. paratuberculosis
cggccaccuccagccc

SEQ ID NO: 1026286 - RNA, 17 nt, Mycobacterium avium subsp. paratuberculosis
cggccaccuccagcccg

SEQ ID NO: 1026287 - RNA, 19 nt, Mycobacterium avium subsp. paratuberculosis
cggccaccucgccgcaggc

SEQ ID NO: 1026288 - RNA, 12 nt, Mycobacterium avium subsp. paratuberculosis
cggccaccgcga

SEQ ID NO: 1026289 - RNA, 14 nt, Mycobacterium avium subsp. paratuberculosis
cggccaccgcgccc

SEQ ID NO: 1026290 - RNA, 15 nt, Mycobacterium avium subsp. paratuberculosis
cggccaccgcgcccc

SEQ ID NO: 1026291 - RNA, 20 nt, Mycobacterium avium subsp. paratuberculosis
cggccaccgcgccgugggcg

SEQ ID NO: 1026292 - RNA, 18 nt, Mycobacterium avium subsp. paratuberculosis
cggccaccgcgcgcugcc

SEQ ID NO: 1026293 - RNA, 21 nt, Mycobacterium avium subsp. paratuberculosis
cggccaccacgacgccgggcg

SEQ ID NO: 1026294 - RNA, 23 nt, Mycobacterium avium subsp. paratuberculosis
cggccaccagaugccgggcuccg

SEQ ID NO: 1026295 - RNA, 21 nt, Mycobacterium avium subsp. paratuberculosis
cggcagauggucucgaucucc

SEQ ID NO: 1026296 - RNA, 18 nt, Mycobacterium avium subsp. paratuberculosis
cggcagaucugcaggguu

SEQ ID NO: 1026297 - RNA, 15 nt, Mycobacterium avium subsp. paratuberculosis
cggcagcaccgccga

SEQ ID NO: 1026298 - RNA, 23 nt, Mycobacterium avium subsp. paratuberculosis
cggcagcaccgccgagccgucgu

SEQ ID NO: 1026299 - RNA, 16 nt, Mycobacterium avium subsp. paratuberculosis
cggcagcaccggcagc

SEQ ID NO: 1026300 - RNA, 13 nt, Mycobacterium avium subsp. paratuberculosis
cggcagcagcacc

SEQ ID NO: 1026301 - RNA, 21 nt, Mycobacterium avium subsp. paratuberculosis
cggcagcagcugcgucggcac

SEQ ID NO: 1026302 - RNA, 20 nt, Mycobacterium avium subsp. paratuberculosis
cggccacaccggggccaggu

SEQ ID NO: 1026303 - RNA, 16 nt, Mycobacterium avium subsp. paratuberculosis
cggcgccagcggccga

SEQ ID NO: 1026304 - RNA, 20 nt, Mycobacterium avium subsp. paratuberculosis
cggcgccagccgcaccgcga

SEQ ID NO: 1026305 - RNA, 16 nt, Mycobacterium avium subsp. paratuberculosis
cggcgcaaccucuucg

SEQ ID NO: 1026306 - RNA, 15 nt, Mycobacterium avium subsp. paratuberculosis
cggcgccagcccggu

SEQ ID NO: 1026307 - RNA, 23 nt, Mycobacterium avium subsp. paratuberculosis
cggcgccaccgggaccugcugcu

SEQ ID NO: 1026308 - RNA, 22 nt, Mycobacterium avium subsp. paratuberculosis
cggcgccacgaccagcggcagc

SEQ ID NO: 1026309 - RNA, 22 nt, Mycobacterium avium subsp. paratuberculosis
cggcgccacgcacaccgcgcgc

SEQ ID NO: 1026310 - RNA, 16 nt, Mycobacterium avium subsp. paratuberculosis
cggcgccacgccgcga

SEQ ID NO: 1026311 - RNA, 17 nt, Mycobacterium avium subsp. paratuberculosis
cggcgccacgccgcgau

SEQ ID NO: 1026312 - RNA, 23 nt, Mycobacterium avium subsp. paratuberculosis
cggcgauguugaccacccgcagc

SEQ ID NO: 1026313 - RNA, 22 nt, Mycobacterium avium subsp. paratuberculosis
cggcgauggugaugugcggcgc

SEQ ID NO: 1026314 - RNA, 19 nt, Mycobacterium avium subsp. paratuberculosis
cggcgauguaggacgccgc

SEQ ID NO: 1026315 - RNA, 18 nt, Mycobacterium avium subsp. paratuberculosis
cggcgaugucgucgacgc

SEQ ID NO: 1026316 - RNA, 21 nt, Mycobacterium avium subsp. paratuberculosis
cggcgaugucgucgacgcugc

SEQ ID NO: 1026317 - RNA, 16 nt, Mycobacterium avium subsp. paratuberculosis
cggcgauggcgcggcc

SEQ ID NO: 1026318 - RNA, 16 nt, Mycobacterium avium subsp. paratuberculosis
cggcgacggcgccuga

SEQ ID NO: 1026319 - RNA, 13 nt, Mycobacterium avium subsp. paratuberculosis
cggcgacggcggg

SEQ ID NO: 1026320 - RNA, 21 nt, Mycobacterium avium subsp. paratuberculosis
cggcgacggcguccagcugcg

SEQ ID NO: 1026321 - RNA, 13 nt, Mycobacterium avium subsp. paratuberculosis
cggcgacggcagc

SEQ ID NO: 1026322 - RNA, 14 nt, Mycobacterium avium subsp. paratuberculosis
cggcgacggcagcg

SEQ ID NO: 1026323 - RNA, 12 nt, Mycobacterium avium subsp. paratuberculosis
cggcgacggcca

SEQ ID NO: 1026324 - RNA, 17 nt, Mycobacterium avium subsp. paratuberculosis
cggcgacggccagaccg

SEQ ID NO: 1026325 - RNA, 15 nt, Mycobacterium avium subsp. paratuberculosis
cggcgacggccagcg

SEQ ID NO: 1026326 - RNA, 14 nt, Mycobacterium avium subsp. paratuberculosis
cggcgacgcggcgg

SEQ ID NO: 1026327 - RNA, 22 nt, Mycobacterium avium subsp. paratuberculosis
cggcgacggccguccggucgcu

SEQ ID NO: 1026328 - RNA, 22 nt, Mycobacterium avium subsp. paratuberculosis
cggcgacgauaucggccgcggg

SEQ ID NO: 1026329 - RNA, 14 nt, Mycobacterium avium subsp. paratuberculosis
cggcgacgaagcag

SEQ ID NO: 1026330 - RNA, 23 nt, Mycobacterium avium subsp. paratuberculosis
cggcgacgaagcagcucgcguag

SEQ ID NO: 1026331 - RNA, 20 nt, Mycobacterium avium subsp. paratuberculosis
cggcgacgaacgccggcauc

SEQ ID NO: 1026332 - RNA, 21 nt, Mycobacterium avium subsp. paratuberculosis
cggcgacgaacgccggcauca

SEQ ID NO: 1026333 - RNA, 17 nt, Mycobacterium avium subsp. paratuberculosis
cggcgccgaccucggcc

SEQ ID NO: 1026334 - RNA, 15 nt, Mycobacterium avium subsp. paratuberculosis
cggcgccgacggcca

SEQ ID NO: 1026335 - RNA, 23 nt, Mycobacterium avium subsp. paratuberculosis
cggcgccgaaccgggugacgacc

SEQ ID NO: 1026336 - RNA, 18 nt, Mycobacterium avium subsp. paratuberculosis
cggcgccgaucacgccgg

SEQ ID NO: 1026337 - RNA, 21 nt, Mycobacterium avium subsp. paratuberculosis
cggcgcccucgaugcgcaccg

SEQ ID NO: 1026338 - RNA, 15 nt, Mycobacterium avium subsp. paratuberculosis
cggcgcccucgccgg

SEQ ID NO: 1026339 - RNA, 16 nt, Mycobacterium avium subsp. paratuberculosis
cggcgcccucgccggc

SEQ ID NO: 1026340 - RNA, 18 nt, Mycobacterium avium subsp. paratuberculosis
cggcgcccucgccggcgg

SEQ ID NO: 1026341 - RNA, 15 nt, Mycobacterium avium subsp. paratuberculosis
cggcgcccugcaccc

SEQ ID NO: 1026342 - RNA, 23 nt, Human
ccgggaguggcgcgcgccaccac

SEQ ID NO: 1026343 - RNA, 18 nt, Human
cccuguacuccagccugg

SEQ ID NO: 1026344 - RNA, 13 nt, Human
ccucacaccaggc

SEQ ID NO: 1026345 - RNA, 15 nt, Human
ccugcaggcgugacc

SEQ ID NO: 1026346 - RNA, 16 nt, Human
ccugccccugagccca

SEQ ID NO: 1026347 - RNA, 15 nt, Human
ccuguacuccagccu

SEQ ID NO: 1026348 - RNA, 20 nt, Human
cgaaguauccuucagccuga

SEQ ID NO: 1026349 - RNA, 13 nt, Human
ccuuugggaaagg

SEQ ID NO: 1026350 - RNA, 11 nt, Human
uugggaaagga

SEQ ID NO: 1026351 - RNA, 14 nt, Human
uugcuugaacccag

SEQ ID NO: 1026352 - RNA, 16 nt, Human
cgagcguugcuggggg

SEQ ID NO: 1026353 - RNA, 14 nt, Human
cgcgccaccacgcc

SEQ ID NO: 1026354 - RNA, 19 nt, Human
cgucucccaaagugcuggg

SEQ ID NO: 1026355 - RNA, 21 nt, Human
cgggguuugccaugcuggcca

SEQ ID NO: 1026356 - RNA, 14 nt, Human
cgggaguggcgcgc

SEQ ID NO: 1026357 - RNA, 16 nt, Human
cgugacuggccugcug

SEQ ID NO: 1026358 - RNA, 19 nt, Human
cugaugagaacucugagca

SEQ ID NO: 1026359 - RNA, 15 nt, Human
cugacccagccccuu

SEQ ID NO: 1026360 - RNA, 16 nt, Human
cucuuuauucagcccc

SEQ ID NO: 1026361 - RNA, 12 nt, Human
cucugcuugcca

SEQ ID NO: 1026362 - RNA, 16 nt, Human
cucugcuugccauccc

SEQ ID NO: 1026363 - RNA, 14 nt, Human
cuccccuccucugc

SEQ ID NO: 1026364 - RNA, 15 nt, Human
cucccuccaccuccc

SEQ ID NO: 1026365 - RNA, 14 nt, Human
gcagugcuuggccc

SEQ ID NO: 1026366 - RNA, 18 nt, Human
gcccaggaguuuggccag

SEQ ID NO: 1026367 - RNA, 14 nt, Human
gccaucccucccuc

SEQ ID NO: 1026368 - RNA, 18 nt, Human
gaggaauauuugcaagac

SEQ ID NO: 1026369 - RNA, 20 nt, Human
gagcugcccucuccugggca

SEQ ID NO: 1026370 - RNA, 15 nt, Human
gagcugcccucuccu

SEQ ID NO: 1026371 - RNA, 14 nt, Human
gacuggccugcugg

SEQ ID NO: 1026372 - RNA, 12 nt, Human
gagaagaaugac

SEQ ID NO: 1026373 - RNA, 18 nt, Human
gagaccagccaaccuggg

SEQ ID NO: 1026374 - RNA, 14 nt, Human
gagugccuguaauc

SEQ ID NO: 1026375 - RNA, 16 nt, Human
gaguucugucuggacu

SEQ ID NO: 1026376 - RNA, 18 nt, Human
gagggcuugaggacuugg

SEQ ID NO: 1026377 - RNA, 13 nt, Human
gaugauguuucgu

SEQ ID NO: 1026378 - RNA, 15 nt, Human
cugggcagcugccuc

SEQ ID NO: 1026379 - RNA, 19 nt, Human
cugggguggguggggcagu

SEQ ID NO: 1026380 - RNA, 16 nt, Human
cuggcacuugggacaa

SEQ ID NO: 1026381 - RNA, 15 nt, Human
cuggccugcuggaug

SEQ ID NO: 1026382 - RNA, 17 nt, Human
cuggacuuuccagagac

SEQ ID NO: 1026383 - RNA, 14 nt, Human
cugcagacaugaga

SEQ ID NO: 1026384 - RNA, 22 nt, Human
cugcccucuccugggcagcugc

SEQ ID NO: 1026385 - RNA, 20 nt, Human
cuuagacccucaugcugcca

SEQ ID NO: 1026386 - RNA, 13 nt, Human
cuugccaucccuc

SEQ ID NO: 1026387 - RNA, 13 nt, Human
gacagaaagcaga

SEQ ID NO: 1026388 - RNA, 17 nt, Human
gacaccaccacccuugc

SEQ ID NO: 1026389 - RNA, 22 nt, Human
gaauugaauucccugccuggau

SEQ ID NO: 1026390 - RNA, 21 nt, Human
gacgguuuaaugggcacaggg

SEQ ID NO: 1026391 - RNA, 19 nt, Human
gaccagccaaccugggggc

SEQ ID NO: 1026392 - RNA, 14 nt, Human
ugacgugacuggcc

SEQ ID NO: 1026393 - RNA, 16 nt, Human
ucaucaaugaaugaau

SEQ ID NO: 1026394 - RNA, 13 nt, Human
ugcauaguaccaa

SEQ ID NO: 1026395 - RNA, 16 nt, Human
ugccuaagugcagccc

SEQ ID NO: 1026396 - RNA, 14 nt, Human
uguugccaaggcug

SEQ ID NO: 1026397 - RNA, 13 nt, Human
uggcacuugggac

SEQ ID NO: 1026398 - RNA, 19 nt, Human
gccuguaaucccagcacuu

SEQ ID NO: 1026399 - RNA, 13 nt, Human
gcgcgcgccacca

SEQ ID NO: 1026400 - RNA, 14 nt, Human
gcgcgcgccaccac

SEQ ID NO: 1026401 - RNA, 12 nt, Human
gcgcgcgccacc

SEQ ID NO: 1026402 - RNA, 18 nt, Human
gccuggcugggaguggca

SEQ ID NO: 1026403 - RNA, 18 nt, Human
gccugcaggcaugaguca

SEQ ID NO: 1026404 - RNA, 20 nt, Human
gcugccuccccuccucugcu

SEQ ID NO: 1026405 - RNA, 13 nt, Human
gcugaugaacucu

SEQ ID NO: 1026406 - RNA, 23 nt, Human
guuguagguaauauugcaaggca

SEQ ID NO: 1026407 - RNA, 13 nt, Human
gcucuggaaacca

SEQ ID NO: 1026408 - RNA, 13 nt, Human
gcugaggcgggug

SEQ ID NO: 1026409 - RNA, 17 nt, Human
guuuccauagggugaca

SEQ ID NO: 1026410 - RNA, 22 nt, Human
uagccgggcaugguggcgcgca

SEQ ID NO: 1026411 - RNA, 21 nt, Human
uaguaagagauuccugagcca

SEQ ID NO: 1026412 - RNA, 11 nt, Human
aaagugcuggg

SEQ ID NO: 1026413 - RNA, 21 nt, Human
aagcacuuucccucuuggugc

SEQ ID NO: 1026414 - RNA, 14 nt, Human
aagaguggguuuca

SEQ ID NO: 1026415 - RNA, 13 nt, Human
aaaaaggugacca

SEQ ID NO: 1026416 - RNA, 13 nt, Human
acaaccuguccca

SEQ ID NO: 1026417 - RNA, 21 nt, Human
acaccaggcuugccugcaggc

SEQ ID NO: 1026418 - RNA, 11 nt, Human
accugagcccc

SEQ ID NO: 1026419 - RNA, 15 nt, Human
acccucugggucuca

SEQ ID NO: 1026420 - RNA, 14 nt, Human
acccgggaggcaga

SEQ ID NO: 1026421 - RNA, 17 nt, Human
acugccgguuugaaaau

SEQ ID NO: 1026422 - RNA, 20 nt, Human
acuuauaggaauugacccac

SEQ ID NO: 1026423 - RNA, 21 nt, Human
aaccaaauggagugacuuagu

SEQ ID NO: 1026424 - RNA, 18 nt, Human
aacacaugauccugcaau

SEQ ID NO: 1026425 - RNA, 16 nt, Human
aacccggccugauuaa

SEQ ID NO: 1026426 - RNA, 15 nt, Human
aaauggguuuuacug

SEQ ID NO: 1026427 - RNA, 22 nt, Human
aacuaaauaaagcuugcaacaa

SEQ ID NO: 1026428 - RNA, 18 nt, Human
acaaaaauuagccgggca

SEQ ID NO: 1026429 - RNA, 15 nt, Human
aagagauggguuuga

SEQ ID NO: 1026430 - RNA, 19 nt, Human
auauguaccauguacauga

SEQ ID NO: 1026431 - RNA, 12 nt, Human
auaugugaaaua

SEQ ID NO: 1026432 - RNA, 13 nt, Human
agugcuuggccca

SEQ ID NO: 1026433 - RNA, 16 nt, Human
agugagacucugucuc

SEQ ID NO: 1026434 - RNA, 23 nt, Human
aggcuggucucgaacugcuggau

SEQ ID NO: 1026435 - RNA, 22 nt, Human
aggcuuagacccucaugcugcc

SEQ ID NO: 1026436 - RNA, 14 nt, Human
agggcuugaggacu

SEQ ID NO: 1026437 - RNA, 12 nt, Human
agacaccaccac

SEQ ID NO: 1026438 - RNA, 18 nt, Human
cccugcacuccagccuga

SEQ ID NO: 1026439 - RNA, 16 nt, Human
cccucuccugggcagc

SEQ ID NO: 1026440 - RNA, 23 nt, Human
cccgggaguggcgcgcgccacca

SEQ ID NO: 1026441 - RNA, 16 nt, Human
ccaggaguuuggccag

SEQ ID NO: 1026442 - RNA, 11 nt, Human
ccaugcuggcc

SEQ ID NO: 1026443 - RNA, 16 nt, Human
ccaugcuggccaggcu

SEQ ID NO: 1026444 - RNA, 11 nt, Human
ccucaagccag

SEQ ID NO: 1026445 - RNA, 15 nt, Human
ccucaagccagccuu

SEQ ID NO: 1026446 - RNA, 20 nt, Human
ccgucucccaaagugcuggg

SEQ ID NO: 1026447 - RNA, 15 nt, Human
ccugccccugagccc

SEQ ID NO: 1026448 - RNA, 21 nt, Human
ccuggcaaggguucaccuggg

SEQ ID NO: 1026449 - RNA, 18 nt, Human
ccucccuccaccucccug

SEQ ID NO: 1026450 - RNA, 19 nt, Human
ccucugcuugccaucccuc

SEQ ID NO: 1026451 - RNA, 14 nt, Human
ccugggcagcugcc

SEQ ID NO: 1026452 - RNA, 16 nt, Human
ccuucuggguucaagc

SEQ ID NO: 1026453 - RNA, 13 nt, Human
cagcuacuuggga

SEQ ID NO: 1026454 - RNA, 18 nt, Human
cauuguaauugcuaucgc

SEQ ID NO: 1026455 - RNA, 13 nt, Human
ccaaagugcuggg

SEQ ID NO: 1026456 - RNA, 13 nt, Human
ccaaauucacaag

SEQ ID NO: 1026457 - RNA, 22 nt, Human
cagagcugcccucuccugggca

SEQ ID NO: 1026458 - RNA, 16 nt, Human
cagagaaaauaaaagc

SEQ ID NO: 1026459 - RNA, 19 nt, Human
cagagaaaauaaaagcacu

SEQ ID NO: 1026460 - RNA, 14 nt, Human
cagccaaccugggg

SEQ ID NO: 1026461 - RNA, 16 nt, Human
cagccagcaguucaga

SEQ ID NO: 1026462 - RNA, 19 nt, Human
caauauucauagcagcuua

SEQ ID NO: 1026463 - RNA, 15 nt, Human
caaggcuggagugca

SEQ ID NO: 1026464 - RNA, 18 nt, Human
caaggcuuagacccucau

SEQ ID NO: 1026465 - RNA, 22 nt, Human
caacugggguggguggggcagu

SEQ ID NO: 1026466 - RNA, 19 nt, Human
cugccuccccuccucugcu

SEQ ID NO: 1026467 - RNA, 18 nt, Human
cuggagugcaguggcgca

SEQ ID NO: 1026468 - RNA, 19 nt, Human
cuggagugcaguggcgcaa

SEQ ID NO: 1026469 - RNA, 16 nt, Human
cuggcugggaguggca

SEQ ID NO: 1026470 - RNA, 22 nt, Human
cugggaauuacaggcgugagcc

SEQ ID NO: 1026471 - RNA, 23 nt, Human
cugggcagcugccuccccuccuc

SEQ ID NO: 1026472 - RNA, 14 nt, Human
cuugagaagagaau

SEQ ID NO: 1026473 - RNA, 21 nt, Human
cgggaguggcgcgcgccacca

SEQ ID NO: 1026474 - RNA, 23 nt, Human
cgucuugacuuuggcaaaugagc

SEQ ID NO: 1026475 - RNA, 16 nt, Human
cugcccucuccugggc

SEQ ID NO: 1026476 - RNA, 18 nt, Human
cugccuaagugcagcccc

SEQ ID NO: 1026477 - RNA, 18 nt, Human
cugcuguuuccuagcgca

SEQ ID NO: 1026478 - RNA, 16 nt, Human
cuaauaaaaaggugac

SEQ ID NO: 1026479 - RNA, 20 nt, Human
gcugcccucuccugggcagc

SEQ ID NO: 1026480 - RNA, 22 nt, Human
gcugcccucuccugggcagcug

SEQ ID NO: 1026481 - RNA, 14 nt, Human
gccgggcgcggugg

SEQ ID NO: 1026482 - RNA, 22 nt, Human
gcuuagacccucaugcugccaa

SEQ ID NO: 1026483 - RNA, 13 nt, Human
gcuugccaucccu

SEQ ID NO: 1026484 - RNA, 16 nt, Human
gaguggguuucacaag

SEQ ID NO: 1026485 - RNA, 18 nt, Human
gaguuccuaaccagccug

SEQ ID NO: 1026486 - RNA, 12 nt, Human
gagcugcccucu

SEQ ID NO: 1026487 - RNA, 23 nt, Human
gacacaggcuccaaacuggagcu

SEQ ID NO: 1026488 - RNA, 22 nt, Human
gacagcuucucauccugcaggc

SEQ ID NO: 1026489 - RNA, 14 nt, Human
uggugccucaguuu

SEQ ID NO: 1026490 - RNA, 15 nt, Human
uggagacaccaccac

SEQ ID NO: 1026491 - RNA, 16 nt, Human
uggcgcgcgccaccac

SEQ ID NO: 1026492 - RNA, 18 nt, Human
uggcgcgcgccaccacgc

SEQ ID NO: 1026493 - RNA, 17 nt, Human
ugggauagcugacccag

SEQ ID NO: 1026494 - RNA, 17 nt, Human
uggggcagugcuuggcc

SEQ ID NO: 1026495 - RNA, 13 nt, Human
uccugagaccagc

SEQ ID NO: 1026496 - RNA, 18 nt, Human
uccugggcagcugccucc

SEQ ID NO: 1026497 - RNA, 17 nt, Human
ucgagcguugcuggggg

SEQ ID NO: 1026498 - RNA, 19 nt, Human
ugaccaauaaccaugccca

SEQ ID NO: 1026499 - RNA, 20 nt, Human
ugccuccccuccucugcuug

SEQ ID NO: 1026500 - RNA, 17 nt, Human
ugacuauggcuaccaaa

SEQ ID NO: 1026501 - RNA, 18 nt, Human
uaucgccaucacagcuga

SEQ ID NO: 1026502 - RNA, 22 nt, Human
uauccuaauaaaaaggugacca

SEQ ID NO: 1026503 - RNA, 20 nt, Human
ggaguuaggcuauucacaac

SEQ ID NO: 1026504 - RNA, 14 nt, Human
ggaguuuggccaga

SEQ ID NO: 1026505 - RNA, 13 nt, Human
ggagacaccacca

SEQ ID NO: 1026506 - RNA, 22 nt, Human
guaucuuguuuuuccacuacug

SEQ ID NO: 1026507 - RNA, 23 nt, Human
gucacacaaccugucccagcgag

SEQ ID NO: 1026508 - RNA, 15 nt, Human
guuuaugauuccacc

SEQ ID NO: 1026509 - RNA, 16 nt, Human
gugaaaugcagaguca

SEQ ID NO: 1026510 - RNA, 21 nt, Human
ggcgcgcgccaccacgcccag

SEQ ID NO: 1026511 - RNA, 20 nt, Human
ggcggcuggaauugaauucc

SEQ ID NO: 1026512 - RNA, 21 nt, Human
ggcgugaccugacagcccaag

SEQ ID NO: 1026513 - RNA, 14 nt, Human
ggcgugagccacca

SEQ ID NO: 1026514 - RNA, 21 nt, Human
ggcgcgcaccuguaaucccag

SEQ ID NO: 1026515 - RNA, 17 nt, Human
ggcgcgcgccaccacgc

SEQ ID NO: 1026516 - RNA, 22 nt, Human
ggcccaggaguuuggccagaag

SEQ ID NO: 1026517 - RNA, 20 nt, Human
ggcuggucucgaacugcugg

SEQ ID NO: 1026518 - RNA, 14 nt, Human
gggaguggcgcgcg

SEQ ID NO: 1026519 - RNA, 17 nt, Human
gggaguggcgcgcgcca

SEQ ID NO: 1026520 - RNA, 17 nt, Human
ggucgucgucuugacuu

SEQ ID NO: 1026521 - RNA, 22 nt, Human
gguucuaggccgggcgcggugg

SEQ ID NO: 1026522 - RNA, 16 nt, Human
ggugaaacccugucuc

SEQ ID NO: 1026523 - RNA, 22 nt, Human
gcuugaggacuugggcgggaca

SEQ ID NO: 1026524 - RNA, 19 nt, Human
gcuuggcccaggaguuugg

SEQ ID NO: 1026525 - RNA, 14 nt, Human
gcuguggccagcuu

SEQ ID NO: 1026526 - RNA, 21 nt, Human
gcuuagacccucaugcugcca

SEQ ID NO: 1026527 - RNA, 19 nt, Human
gcuggauguggagggggcg

SEQ ID NO: 1026528 - RNA, 20 nt, Human
ccccugcacuccagccugag

SEQ ID NO: 1026529 - RNA, 18 nt, Human
cccaggaguuuggccaga

SEQ ID NO: 1026530 - RNA, 18 nt, Human
ggcagcuuuccucaaaac

SEQ ID NO: 1026531 - RNA, 21 nt, Human
ggcagugcuuggcccaggagu

SEQ ID NO: 1026532 - RNA, 18 nt, Human
ucccuccaccucccugca

SEQ ID NO: 1026533 - RNA, 23 nt, Human
ucaauauuuauuauuuucaccug

SEQ ID NO: 1026534 - RNA, 23 nt, Human
uauucagccccgggaguggcgcg

SEQ ID NO: 1026535 - RNA, 14 nt, Human
guucagagcugccc

SEQ ID NO: 1026536 - RNA, 15 nt, Human
guucagagcugcccu

SEQ ID NO: 1026537 - RNA, 13 nt, Human
guauggcagcuuu

SEQ ID NO: 1026538 - RNA, 18 nt, Human
gucucgaacugcuggauu

SEQ ID NO: 1026539 - RNA, 18 nt, Human
uuggcccaggaguuuggc

SEQ ID NO: 1026540 - RNA, 12 nt, Human
uugccaucccuc

SEQ ID NO: 1026541 - RNA, 21 nt, Human
uuuaaaaaaaaaccugagccc

SEQ ID NO: 1026542 - RNA, 20 nt, Human
uugguucuaauagaacucag

SEQ ID NO: 1026543 - RNA, 21 nt, Human
ugggauagcugacccagcccc

SEQ ID NO: 1026544 - RNA, 15 nt, Human
ugggguggguggggc

SEQ ID NO: 1026545 - RNA, 18 nt, Human
uggugcuuccaaauauug

SEQ ID NO: 1026546 - RNA, 12 nt, Human
uccugggcagcu

SEQ ID NO: 1026547 - RNA, 14 nt, Human
ucgaacugcuggau

SEQ ID NO: 1026548 - RNA, 17 nt, Human
ucugauaccucaacccc

SEQ ID NO: 1026549 - RNA, 14 nt, Human
aaaguucugcagau

SEQ ID NO: 1026550 - RNA, 13 nt, Human
aaauaaugaaaua

SEQ ID NO: 1026551 - RNA, 12 nt, Human
acaccaccaccc

SEQ ID NO: 1026552 - RNA, 22 nt, Human
acaccagagauaauaugagaau

SEQ ID NO: 1026553 - RNA, 16 nt, Human
acauuauuaucaacaa

SEQ ID NO: 1026554 - RNA, 23 nt, Human
acaagguucuucccuuuuacaua

SEQ ID NO: 1026555 - RNA, 20 nt, Human
aauuccuauauccugugacu

SEQ ID NO: 1026556 - RNA, 16 nt, Human
aaaauggugugaccac

SEQ ID NO: 1026557 - RNA, 14 nt, Human
aaaggccugucccu

SEQ ID NO: 1026558 - RNA, 15 nt, Human
accuguccccgaaac

SEQ ID NO: 1026559 - RNA, 14 nt, Human
accuucuggguuca

SEQ ID NO: 1026560 - RNA, 13 nt, Human
acccucugggucu

SEQ ID NO: 1026561 - RNA, 12 nt, Human
accacugcagaa

SEQ ID NO: 1026562 - RNA, 13 nt, Human
acccggccugauu

SEQ ID NO: 1026563 - RNA, 14 nt, Human
acccucaugcugcc

SEQ ID NO: 1026564 - RNA, 20 nt, Human
acgugacuggccugcuggau

SEQ ID NO: 1026565 - RNA, 17 nt, Human
acugggguggguggggc

SEQ ID NO: 1026566 - RNA, 21 nt, Human
acugggguggguggggcagug

SEQ ID NO: 1026567 - RNA, 22 nt, Human
agaagucaaggcuuagacccuc

SEQ ID NO: 1026568 - RNA, 14 nt, Human
acuugggaggcuga

SEQ ID NO: 1026569 - RNA, 20 nt, Human
acuuuaacacagugucuggc

SEQ ID NO: 1026570 - RNA, 20 nt, Human
aauacucuuaggaagagaaa

SEQ ID NO: 1026571 - RNA, 16 nt, Human
aauagugucugaugaa

SEQ ID NO: 1026572 - RNA, 19 nt, Human
aauccuuuguuuucugacu

SEQ ID NO: 1026573 - RNA, 10 nt, Human
aggccgggcg

SEQ ID NO: 1026574 - RNA, 14 nt, Human
agcuguugagcugu

SEQ ID NO: 1026575 - RNA, 14 nt, Human
agcugccuccccuc

SEQ ID NO: 1026576 - RNA, 12 nt, Human
aggcaagagaau

SEQ ID NO: 1026577 - RNA, 19 nt, Human
agccuugcuccuggcuggg

SEQ ID NO: 1026578 - RNA, 21 nt, Human
agcuaaaauuagaugaacuca

SEQ ID NO: 1026579 - RNA, 13 nt, Human
acagaggaucugc

SEQ ID NO: 1026580 - RNA, 15 nt, Human
auugcuaucgccauc

SEQ ID NO: 1026581 - RNA, 14 nt, Human
auugugggcucugg

SEQ ID NO: 1026582 - RNA, 12 nt, Human
caaauucacaag

SEQ ID NO: 1026583 - RNA, 15 nt, Human
caaaauugggaaagg

SEQ ID NO: 1026584 - RNA, 18 nt, Human
ucagugucaaugcagccc

SEQ ID NO: 1026585 - RNA, 22 nt, Human
ucagccugaaagaggaaugaag

SEQ ID NO: 1026586 - RNA, 15 nt, Human
ugagggcuugaggac

SEQ ID NO: 1026587 - RNA, 19 nt, Human
ugaggacuugggcgggaca

SEQ ID NO: 1026588 - RNA, 19 nt, Human
ucagccccgggaguggcgc

SEQ ID NO: 1026589 - RNA, 19 nt, Human
ucacuugugcaguguugac

SEQ ID NO: 1026590 - RNA, 16 nt, Human
ucacaagacccaaaag

SEQ ID NO: 1026591 - RNA, 18 nt, Human
ucaacaauagugauugau

SEQ ID NO: 1026592 - RNA, 22 nt, Human
guuccugagaccagccaaccug

SEQ ID NO: 1026593 - RNA, 16 nt, Human
guucagagcugcccuc

SEQ ID NO: 1026594 - RNA, 22 nt, Human
gggcagcugccuccccuccucu

SEQ ID NO: 1026595 - RNA, 15 nt, Human
ggcugaggcgggugg

SEQ ID NO: 1026596 - RNA, 22 nt, Human
gguauauaaauuuucccaaaac

SEQ ID NO: 1026597 - RNA, 12 nt, Human
ggguuucacaag

SEQ ID NO: 1026598 - RNA, 22 nt, Human
ggugacccugaugaaaacauag

SEQ ID NO: 1026599 - RNA, 17 nt, Human
gugucaggaggaaggcu

SEQ ID NO: 1026600 - RNA, 20 nt, Human
guuauuuagggaacugcuug

SEQ ID NO: 1026601 - RNA, 13 nt, Human
guggagggggcgc

SEQ ID NO: 1026602 - RNA, 13 nt, Human
gugggugggguga

SEQ ID NO: 1026603 - RNA, 15 nt, Human
guaacugacaacuug

SEQ ID NO: 1026604 - RNA, 12 nt, Human
gugagccaccaa

SEQ ID NO: 1026605 - RNA, 20 nt, Human
ggcagcugccuccccuccuc

SEQ ID NO: 1026606 - RNA, 17 nt, Human
ggcaggucacacaaccu

SEQ ID NO: 1026607 - RNA, 12 nt, Human
ggccuggcuggg

SEQ ID NO: 1026608 - RNA, 19 nt, Human
ggcgugaccugacagccca

SEQ ID NO: 1026609 - RNA, 13 nt, Human
ggcuauucacaac

SEQ ID NO: 1026610 - RNA, 21 nt, Human
ggcucacgccuguaaucccag

SEQ ID NO: 1026611 - RNA, 15 nt, Human
gccagaagucaaggc

SEQ ID NO: 1026612 - RNA, 19 nt, Human
gccagcaguucagagcugc

SEQ ID NO: 1026613 - RNA, 14 nt, Human
gcgugagccaccaa

SEQ ID NO: 1026614 - RNA, 14 nt, Human
caggcagcaggaua

SEQ ID NO: 1026615 - RNA, 21 nt, Human
caggcuccaaacuggagcuug

SEQ ID NO: 1026616 - RNA, 20 nt, Human
cacuugggacaaaaacaaac

SEQ ID NO: 1026617 - RNA, 13 nt, Human
cagggagccccuu

SEQ ID NO: 1026618 - RNA, 22 nt, Human
cagugucuggcacuugggacaa

SEQ ID NO: 1026619 - RNA, 16 nt, Human
cagugauuaccaggga

SEQ ID NO: 1026620 - RNA, 19 nt, Human
cagugucuggcacuuggga

SEQ ID NO: 1026621 - RNA, 17 nt, Human
cuccagccugggugaca

SEQ ID NO: 1026622 - RNA, 16 nt, Human
cuauguuguugcacuu

SEQ ID NO: 1026623 - RNA, 15 nt, Human
cuccugggcagcugc

SEQ ID NO: 1026624 - RNA, 16 nt, Human
cuccugggcagcugcc

SEQ ID NO: 1026625 - RNA, 19 nt, Human
agacagggaaagggucucc

SEQ ID NO: 1026626 - RNA, 23 nt, Human
agauaugaggcauuugcagcugu

SEQ ID NO: 1026627 - RNA, 18 nt, Human
gaacagugauuaccaggg

SEQ ID NO: 1026628 - RNA, 15 nt, Human
gacccucaugcugcc

SEQ ID NO: 1026629 - RNA, 20 nt, Human
gaaaagacauaagcaaagac

SEQ ID NO: 1026630 - RNA, 21 nt, Human
cuuugaugauuaauucaccuu

SEQ ID NO: 1026631 - RNA, 19 nt, Human
agccagcaguucagagcug

SEQ ID NO: 1026632 - RNA, 15 nt, Human
gcaggcgugaccuga

SEQ ID NO: 1026633 - RNA, 18 nt, Human
gcaggauagagugggaca

SEQ ID NO: 1026634 - RNA, 17 nt, Human
gcagugcuuggcccagg

SEQ ID NO: 1026635 - RNA, 15 nt, Human
gcauguaugacguga

SEQ ID NO: 1026636 - RNA, 13 nt, Human
gcauauguuucgc

SEQ ID NO: 1026637 - RNA, 17 nt, Human
gccaaggcuggagugca

SEQ ID NO: 1026638 - RNA, 15 nt, Human
gccaccaaacccggc

SEQ ID NO: 1026639 - RNA, 22 nt, Human
gagaccagccaaccugggggcu

SEQ ID NO: 1026640 - RNA, 12 nt, Human
gagccccaaaag

SEQ ID NO: 1026641 - RNA, 22 nt, Human
gauggaaguugcagugagcuga

SEQ ID NO: 1026642 - RNA, 21 nt, Human
uuugccaugcuggccaggcug

SEQ ID NO: 1026643 - RNA, 16 nt, Human
agcugcccucuccugg

SEQ ID NO: 1026644 - RNA, 17 nt, Human
agggccuggcugggagu

SEQ ID NO: 1026645 - RNA, 21 nt, Human
aggcuggagugcaguggcgca

SEQ ID NO: 1026646 - RNA, 22 nt, Human
aggcuggagugcaguggcgcaa

SEQ ID NO: 1026647 - RNA, 18 nt, Human
agucaaggcuuagacccu

SEQ ID NO: 1026648 - RNA, 19 nt, Human
augccuggugcuuccaaau

SEQ ID NO: 1026649 - RNA, 15 nt, Human
auccuucagccugaa

SEQ ID NO: 1026650 - RNA, 18 nt, Human
auuauggcugguaacaua

SEQ ID NO: 1026651 - RNA, 23 nt, Human
aucacagcuacuugggaggcuga

SEQ ID NO: 1026652 - RNA, 16 nt, Human
aguugcagugagcuga

SEQ ID NO: 1026653 - RNA, 18 nt, Human
auacuguauuuuuaccuu

SEQ ID NO: 1026654 - RNA, 23 nt, Human
cagagacgggguuugccaugcug

SEQ ID NO: 1026655 - RNA, 16 nt, Human
cagcaguucagagcug

SEQ ID NO: 1026656 - RNA, 14 nt, Human
cagccagcaguuca

SEQ ID NO: 1026657 - RNA, 22 nt, Human
cagccagcaguucagagcugcc

SEQ ID NO: 1026658 - RNA, 15 nt, Human
cacuugaacccggga

SEQ ID NO: 1026659 - RNA, 14 nt, Human
caccucccugcaau

SEQ ID NO: 1026660 - RNA, 23 nt, Human
cacauggcuucaccuguccccga

SEQ ID NO: 1026661 - RNA, 23 nt, Human
cacagcugaacuuguugagaucc

SEQ ID NO: 1026662 - RNA, 19 nt, Human
caagugauccgcccaucuc

SEQ ID NO: 1026663 - RNA, 22 nt, Human
caagcacuuucccucuuggugc

SEQ ID NO: 1026664 - RNA, 19 nt, Human
cacaagaaaugaaagcagg

SEQ ID NO: 1026665 - RNA, 20 nt, Human
auuugcugagcauguacuga

SEQ ID NO: 1026666 - RNA, 13 nt, Human
auugguuuaccug

SEQ ID NO: 1026667 - RNA, 15 nt, Human
ccauggagguuaagc

SEQ ID NO: 1026668 - RNA, 16 nt, Human
ccaccuucuggguuca

SEQ ID NO: 1026669 - RNA, 15 nt, Human
ccaccacgcccagcu

SEQ ID NO: 1026670 - RNA, 19 nt, Human
ccacaaaauugggaaagga

SEQ ID NO: 1026671 - RNA, 20 nt, Human
caugauccugcaauuccacu

SEQ ID NO: 1026672 - RNA, 22 nt, Human
cauggaucugguagggggaaaa

SEQ ID NO: 1026673 - RNA, 19 nt, Human
caugcugccaauauccuaa

SEQ ID NO: 1026674 - RNA, 15 nt, Human
caggcgugagccacc

SEQ ID NO: 1026675 - RNA, 16 nt, Human
caggaguuuggccaga

SEQ ID NO: 1026676 - RNA, 16 nt, Human
caggcgugagccacca

SEQ ID NO: 1026677 - RNA, 19 nt, Human
caggcgugagccaccaaac

SEQ ID NO: 1026678 - RNA, 22 nt, Human
caggaguuccuaaccagccugg

SEQ ID NO: 1026679 - RNA, 16 nt, Human
caucccucccuccacc

SEQ ID NO: 1026680 - RNA, 12 nt, Human
cauagcagcuua

SEQ ID NO: 1026681 - RNA, 18 nt, Human
cagugucaaugcagcccc

SEQ ID NO: 1026682 - RNA, 20 nt, Human
cagugcuuggcccaggaguu

SEQ ID NO: 1026683 - RNA, 14 nt, Human
cagucagaagaccu

SEQ ID NO: 1026684 - RNA, 17 nt, Human
uaaaaggccugucccug

SEQ ID NO: 1026685 - RNA, 18 nt, Human
ugguucuaauagaacuca

SEQ ID NO: 1026686 - RNA, 22 nt, Human
acuggcaguuuuccauugguuu

SEQ ID NO: 1026687 - RNA, 13 nt, Human
uagaauaauacua

SEQ ID NO: 1026688 - RNA, 15 nt, Human
aauaaugaaauaacu

SEQ ID NO: 1026689 - RNA, 15 nt, Human
uaucaguccucuuuc

SEQ ID NO: 1026690 - RNA, 18 nt, Human
uccagaaauaaugaaaua

SEQ ID NO: 1026691 - RNA, 18 nt, Human
acagaccuaggauuucau

SEQ ID NO: 1026692 - RNA, 13 nt, Human
uucaccuguuuuu

SEQ ID NO: 1026693 - RNA, 22 nt, Human
cuccgucucccaaagugcuggg

SEQ ID NO: 1026694 - RNA, 14 nt, Human
auaaucuuuuauac

SEQ ID NO: 1026695 - RNA, 22 nt, Human
aaauauauuuaagauaauuaua

SEQ ID NO: 1026696 - RNA, 18 nt, Human
acauguuuucuuugcuuu

SEQ ID NO: 1026697 - RNA, 16 nt, Human
uaauuucaugaaaaga

SEQ ID NO: 1026698 - RNA, 17 nt, Human
ccugcaggcaugaguca

SEQ ID NO: 1026699 - RNA, 17 nt, Human
gaaaaucaggcuggcca

SEQ ID NO: 1026700 - RNA, 18 nt, Human
auaaaguauauauagaau

SEQ ID NO: 1026701 - RNA, 17 nt, Human
auaagggaggaaaaaaa

SEQ ID NO: 1026702 - RNA, 15 nt, Human
auuuucaaaaucaaa

SEQ ID NO: 1026703 - RNA, 13 nt, Human
ccauuccaagccu

SEQ ID NO: 1026704 - RNA, 22 nt, Human
cagacuuuuuuuuuuuuuuaaa

SEQ ID NO: 1026705 - RNA, 16 nt, Human
ccucaaaacuucagac

SEQ ID NO: 1026706 - RNA, 17 nt, Human
cgugacuggccugcugg

SEQ ID NO: 1026707 - RNA, 14 nt, Human
ucccucuguugcca

SEQ ID NO: 1026708 - RNA, 17 nt, Human
gguccgaagucuuccau

SEQ ID NO: 1026709 - RNA, 17 nt, Human
aaaccuuauuguaccuc

SEQ ID NO: 1026710 - RNA, 16 nt, Human
ugcuggauucaaguga

SEQ ID NO: 1026711 - RNA, 18 nt, Human
uucuggguucaagcgauu

SEQ ID NO: 1026712 - RNA, 22 nt, Human
aaugggcacaggguuuauguuu

SEQ ID NO: 1026713 - RNA, 13 nt, Human
uuaugcuaaguga

SEQ ID NO: 1026714 - RNA, 15 nt, Human
cagaacuauggaaaa

SEQ ID NO: 1026715 - RNA, 14 nt, Human
agaugaacucaacu

SEQ ID NO: 1026716 - RNA, 13 nt, Human
ugggaggcugaga

SEQ ID NO: 1026717 - RNA, 15 nt, Human
uaacauagguuuuua

SEQ ID NO: 1026718 - RNA, 22 nt, Human
cuaacauauaauguuguuauuu

SEQ ID NO: 1026719 - RNA, 15 nt, Human
cugaagaguggguuu

SEQ ID NO: 1026720 - RNA, 22 nt, Human
uucuuaaaugggcuacuuuguc

SEQ ID NO: 1026721 - RNA, 15 nt, Human
auuuaacauuauuua

SEQ ID NO: 1026722 - RNA, 16 nt, Human
cuuuaaguguaacugg

SEQ ID NO: 1026723 - RNA, 20 nt, Human
ccaaauguucaucaaugaau

SEQ ID NO: 1026724 - RNA, 22 nt, Human
gccuccccuccucugcuugcca

SEQ ID NO: 1026725 - RNA, 23 nt, Human
uuuuaaacaaaaaaagcauugua

SEQ ID NO: 1026726 - RNA, 14 nt, Human
cuuuccagagacca

SEQ ID NO: 1026727 - RNA, 16 nt, Human
ccugggcagcugccuc

SEQ ID NO: 1026728 - RNA, 22 nt, Human
aucccucccuccaccucccugc

SEQ ID NO: 1026729 - RNA, 16 nt, Human
cacuuaaaaaugguuu

SEQ ID NO: 1026730 - RNA, 16 nt, Human
cuaaaucuauuuauua

SEQ ID NO: 1026731 - RNA, 13 nt, Human
ugcaguggcgcaa

SEQ ID NO: 1026732 - RNA, 21 nt, Human
aauaaaguauauauagaaucu

SEQ ID NO: 1026733 - RNA, 21 nt, Human
ucauucaaaaguugaaauuaa

SEQ ID NO: 1026734 - RNA, 21 nt, Human
ucaccugggcugaggcauccu

SEQ ID NO: 1026735 - RNA, 23 nt, Human
caacuuugaagucugauuuuccu

SEQ ID NO: 1026736 - RNA, 19 nt, Human
acugcuggauucaagugau

SEQ ID NO: 1026737 - RNA, 16 nt, Human
auauccaaagcugaau

SEQ ID NO: 1026738 - RNA, 21 nt, Human
ucaguuuccugaccuaugaaa

SEQ ID NO: 1026739 - RNA, 17 nt, Human
acauguucacuuauuga

SEQ ID NO: 1026740 - RNA, 19 nt, Human
cuacuaaaaauacaaaaau

SEQ ID NO: 1026741 - RNA, 15 nt, Human
ugaauaucuauuaau

SEQ ID NO: 1026742 - RNA, 18 nt, Human
aaaaguucugcagauaaa

SEQ ID NO: 1026743 - RNA, 14 nt, Human
ccucaucuguaaaa

SEQ ID NO: 1026744 - RNA, 14 nt, Human
ccugggcugaggca

SEQ ID NO: 1026745 - RNA, 15 nt, Human
gcaaccuccaccuuc

SEQ ID NO: 1026746 - RNA, 20 nt, Human
auaaaguauauauagaaucu

SEQ ID NO: 1026747 - RNA, 13 nt, Human
cgggaggcagagg

SEQ ID NO: 1026748 - RNA, 12 nt, Human
ccuucagccuga

SEQ ID NO: 1026749 - RNA, 12 nt, Human
aaaagaaagaaa

SEQ ID NO: 1026750 - RNA, 16 nt, Human
aucaguuacucugaag

SEQ ID NO: 1026751 - RNA, 15 nt, Human
caccgaguggcccuu

SEQ ID NO: 1026752 - RNA, 14 nt, Human
uuaugaaacauuac

SEQ ID NO: 1026753 - RNA, 18 nt, Human
aaaucuaaaucuauuuau

SEQ ID NO: 1026754 - RNA, 17 nt, Human
agaugggagaaucacuu

SEQ ID NO: 1026755 - RNA, 12 nt, Human
uagggaccugcu

SEQ ID NO: 1026756 - RNA, 21 nt, Human
aaauaaagcuugcaacaaaau

SEQ ID NO: 1026757 - RNA, 14 nt, Human
gaauuuucuuccaa

SEQ ID NO: 1026758 - RNA, 15 nt, Human
guacuggcugaugga

SEQ ID NO: 1026759 - RNA, 15 nt, Human
auauacuauauuuau

SEQ ID NO: 1026760 - RNA, 15 nt, Human
aagcacgaaauguua

SEQ ID NO: 1026761 - RNA, 12 nt, Human
guccucuuucaa

SEQ ID NO: 1026762 - RNA, 19 nt, Human
gcacuuuaacacagugucu

SEQ ID NO: 1026763 - RNA, 15 nt, Human
aucuagcaaauguua

SEQ ID NO: 1026764 - RNA, 16 nt, Human
caaggguggguggggu

SEQ ID NO: 1026765 - RNA, 20 nt, Human
agcuugcaacaaaauucucu

SEQ ID NO: 1026766 - RNA, 10 nt, Human
acauauuucu

SEQ ID NO: 1026767 - RNA, 21 nt, Human
gaagaaauuccaggaaaaucu

SEQ ID NO: 1026768 - RNA, 17 nt, Human
cuuguuauuuauaacaa

SEQ ID NO: 1026769 - RNA, 12 nt, Human
aaaacaaagaag

SEQ ID NO: 1026770 - RNA, 21 nt, Human
uauaacucaucauaaaauaaa

SEQ ID NO: 1026771 - RNA, 16 nt, Human
auccuuuguuuucuga

SEQ ID NO: 1026772 - RNA, 16 nt, Human
gccuggcugggagugg

SEQ ID NO: 1026773 - RNA, 13 nt, Human
acccuugccaugg

SEQ ID NO: 1026774 - RNA, 19 nt, Human
aacuauggaaaaaaaggaa

SEQ ID NO: 1026775 - RNA, 15 nt, Human
ucaauuccucuggga

SEQ ID NO: 1026776 - RNA, 15 nt, Human
ugcaauuccacuuau

SEQ ID NO: 1026777 - RNA, 16 nt, Human
ucauuuugguaaaaua

SEQ ID NO: 1026778 - RNA, 21 nt, Human
ucacuuaauccuuuguuuucu

SEQ ID NO: 1026779 - RNA, 15 nt, Human
uaauauauguauuau

SEQ ID NO: 1026780 - RNA, 14 nt, Human
gaaaggagaaguua

SEQ ID NO: 1026781 - RNA, 16 nt, Human
ucaccugggcugaggc

SEQ ID NO: 1026782 - RNA, 21 nt, Human
ucuuuucuggaauguaaucaa

SEQ ID NO: 1026783 - RNA, 17 nt, Human
acugugacuguacccaa

SEQ ID NO: 1026784 - RNA, 12 nt, Human
uuauauacaauu

SEQ ID NO: 1026785 - RNA, 23 nt, Human
aaauugugaucagaccauaaugu

SEQ ID NO: 1026786 - RNA, 15 nt, Human
acaucaacagauaaa

SEQ ID NO: 1026787 - RNA, 19 nt, Human
uacuucauuuaaaauauuu

SEQ ID NO: 1026788 - RNA, 23 nt, Human
aagugauccgcccaucuccgucu

SEQ ID NO: 1026789 - RNA, 15 nt, Human
ucuuguuuuuccacu

SEQ ID NO: 1026790 - RNA, 20 nt, Human
gauugugccccugcacucca

SEQ ID NO: 1026791 - RNA, 12 nt, Human
gcaguucagagc

SEQ ID NO: 1026792 - RNA, 15 nt, Human
cauccugcaggcagc

SEQ ID NO: 1026793 - RNA, 14 nt, Human
uugcuggagcucug

SEQ ID NO: 1026794 - RNA, 23 nt, Human
aucacagcuacuugggaggcuga

SEQ ID NO: 1026795 - RNA, 19 nt, Human
caccuguaaucccagcuac

SEQ ID NO: 1026796 - RNA, 15 nt, Human
acauguuuucuuugc

SEQ ID NO: 1026797 - RNA, 15 nt, Human
ggcuuagacccucau

SEQ ID NO: 1026798 - RNA, 13 nt, Human
gccucaguuuccu

SEQ ID NO: 1026799 - RNA, 17 nt, Human
cuucuagguucuaaaaa

SEQ ID NO: 1026800 - RNA, 15 nt, Human
cuauauuaucaugca

SEQ ID NO: 1026801 - RNA, 18 nt, Human
uucauagcagauuuuaau

SEQ ID NO: 1026802 - RNA, 15 nt, Human
ugagagacagcaggu

SEQ ID NO: 1026803 - RNA, 22 nt, Human
acucauuuccuauguaacugca

SEQ ID NO: 1026804 - RNA, 17 nt, Human
uagagugggacaguucc

SEQ ID NO: 1026805 - RNA, 13 nt, Human
auccugcaggcag

SEQ ID NO: 1026806 - RNA, 23 nt, Human
cugauaucaugccccuguacucc

SEQ ID NO: 1026807 - RNA, 16 nt, Human
uggcugggaguggcau

SEQ ID NO: 1026808 - RNA, 13 nt, Human
gucucaguguccu

SEQ ID NO: 1026809 - RNA, 20 nt, Human
caagaaugagaagaaugacu

SEQ ID NO: 1026810 - RNA, 23 nt, Human
agcuuccauuccaagccugacca

SEQ ID NO: 1026811 - RNA, 22 nt, Human
ugagacucugucucaguccaug

SEQ ID NO: 1026812 - RNA, 20 nt, Human
uuucuagggaaaugaaagaa

SEQ ID NO: 1026813 - RNA, 18 nt, Human
cuggacaguuuucugcuu

SEQ ID NO: 1026814 - RNA, 15 nt, Human
uucauuuaaaauauu

SEQ ID NO: 1026815 - RNA, 13 nt, Human
gaccuagaauaau

SEQ ID NO: 1026816 - RNA, 12 nt, Human
agugcagccccg

SEQ ID NO: 1026817 - RNA, 15 nt, Human
accaaggcugauuaa

SEQ ID NO: 1026818 - RNA, 20 nt, Human
aguucagagcugcccucucc

SEQ ID NO: 1026819 - RNA, 17 nt, Human
ucucaaaaaauaaaaau

SEQ ID NO: 1026820 - RNA, 17 nt, Human
uuccaagccucaugucc

SEQ ID NO: 1026821 - RNA, 16 nt, Human
aguaacggaacaguau

SEQ ID NO: 1026822 - RNA, 19 nt, Human
gaauggaacucaaggaaau

SEQ ID NO: 1026823 - RNA, 12 nt, Human
aucauuuucaaa

SEQ ID NO: 1026824 - RNA, 17 nt, Human
gcaugguuuagaaagcu

SEQ ID NO: 1026825 - RNA, 18 nt, Human
auuuugaauccagaaaua

SEQ ID NO: 1026826 - RNA, 23 nt, Human
uguaaucccagcacuuugggagg

SEQ ID NO: 1026827 - RNA, 21 nt, Human
ugugauuacccucugggucuc

SEQ ID NO: 1026828 - RNA, 20 nt, Human
acuaaauugacacuuaaaaa

SEQ ID NO: 1026829 - RNA, 16 nt, Human
uuuauaacucaucaua

SEQ ID NO: 1026830 - RNA, 15 nt, Human
gcagcugccuccccu

SEQ ID NO: 1026831 - RNA, 14 nt, Human
cacuuauaggaauu

SEQ ID NO: 1026832 - RNA, 12 nt, Human
uacaauugaaau

SEQ ID NO: 1026833 - RNA, 17 nt, Human
cuacacuccagugagac

SEQ ID NO: 1026834 - RNA, 16 nt, Human
aauuucagaagaaauu

SEQ ID NO: 1026835 - RNA, 13 nt, Human
ugccaaggcugga

SEQ ID NO: 1026836 - RNA, 22 nt, Human
caaggcuuagacccucaugcug

SEQ ID NO: 1026837 - RNA, 15 nt, Human
uaaagaauuuucaaa

SEQ ID NO: 1026838 - RNA, 20 nt, Human
uuugugaaaaaaaauuuuau

SEQ ID NO: 1026839 - RNA, 17 nt, Human
uguucuaagaagugaaa

SEQ ID NO: 1026840 - RNA, 16 nt, Human
ugccuccccuccucug

SEQ ID NO: 1026841 - RNA, 17 nt, Human
cccuccaccucccugca

SEQ ID NO: 1026842 - RNA, 18 nt, Human
guuuaugcauacaguaau

SEQ ID NO: 1026843 - RNA, 16 nt, Human
cuggccugcuggaugu

SEQ ID NO: 1026844 - RNA, 11 nt, Human
gcuguuuccau

SEQ ID NO: 1026845 - RNA, 16 nt, Human
ucaucaaugaaugaau

SEQ ID NO: 1026846 - RNA, 15 nt, Human
uuuguaauauuucuc

SEQ ID NO: 1026847 - RNA, 23 nt, Human
caguuagagauuuuuaaauaaag

SEQ ID NO: 1026848 - RNA, 20 nt, Human
uaccagcccuacaccauucc

SEQ ID NO: 1026849 - RNA, 19 nt, Human
cagagcugcccucuccugg

SEQ ID NO: 1026850 - RNA, 11 nt, Human
uaugugcaaua

SEQ ID NO: 1026851 - RNA, 23 nt, Human
ucaaucaaauaaguauuuauaau

SEQ ID NO: 1026852 - RNA, 15 nt, Human
ccaucccucccucca

SEQ ID NO: 1026853 - RNA, 21 nt, Human
acguaggaacgguaaauuucu

SEQ ID NO: 1026854 - RNA, 12 nt, Human
uaaguauuuaua

SEQ ID NO: 1026855 - RNA, 15 nt, Human
gauccugcaauucca

SEQ ID NO: 1026856 - RNA, 14 nt, Human
ucuauuuauuuacu

SEQ ID NO: 1026857 - RNA, 23 nt, Human
gcagccaugugauuacccucugg

SEQ ID NO: 1026858 - RNA, 13 nt, Human
uguauauuuuaua

SEQ ID NO: 1026859 - RNA, 16 nt, Human
cauccuuccucacacc

SEQ ID NO: 1026860 - RNA, 17 nt, Human
auuuauaacaaccuaaa

SEQ ID NO: 1026861 - RNA, 20 nt, Human
ccauaauguuacauuauuau

SEQ ID NO: 1026862 - RNA, 17 nt, Human
acaagaaaugaaagcag

SEQ ID NO: 1026863 - RNA, 22 nt, Human
uuuaauuauuauucuucauaac

SEQ ID NO: 1026864 - RNA, 18 nt, Human
guauuuguuuguauuuug

SEQ ID NO: 1026865 - RNA, 13 nt, Human
agggucucccucu

SEQ ID NO: 1026866 - RNA, 16 nt, Human
auuuuuccccaaaaag

SEQ ID NO: 1026867 - RNA, 15 nt, Human
agccccgggaguggc

SEQ ID NO: 1026868 - RNA, 18 nt, Human
uauuuauuuuuuuacuuc

SEQ ID NO: 1026869 - RNA, 22 nt, Human
ggcagcuuuccucaaaacuuca

SEQ ID NO: 1026870 - RNA, 15 nt, Human
uugaauccagaaaua

SEQ ID NO: 1026871 - RNA, 14 nt, Human
gcaaaugcuguauu

SEQ ID NO: 1026872 - RNA, 16 nt, Human
gaaucacuugaacccg

SEQ ID NO: 1026873 - RNA, 12 nt, Human
uuaucauuuuca

SEQ ID NO: 1026874 - RNA, 23 nt, Human
agcagugcuugaaugaaguugua

SEQ ID NO: 1026875 - RNA, 12 nt, Human
auacuauauuua

SEQ ID NO: 1026876 - RNA, 21 nt, Human
caucccucccuccaccucccu

SEQ ID NO: 1026877 - RNA, 18 nt, Human
ugaaaaaguucugcagau

SEQ ID NO: 1026878 - RNA, 19 nt, Human
agaaauucugcaagcuuuu

SEQ ID NO: 1026879 - RNA, 13 nt, Human
auuucaacuguuu

SEQ ID NO: 1026880 - RNA, 16 nt, Human
auuguuugucugucuu

SEQ ID NO: 1026881 - RNA, 23 nt, Human
cugacuaauuaggcaaggcuaug

SEQ ID NO: 1026882 - RNA, 19 nt, Human
caguuagagauuuuuaaau

SEQ ID NO: 1026883 - RNA, 11 nt, Human
gagaagagaau

SEQ ID NO: 1026884 - RNA, 21 nt, Human
cagugagacagcucugcauac

SEQ ID NO: 1026885 - RNA, 17 nt, Human
auauauguauuauuuau

SEQ ID NO: 1026886 - RNA, 18 nt, Human
gagcccuucaugcauuug

SEQ ID NO: 1026887 - RNA, 17 nt, Human
uuugaauccagaaauaa

SEQ ID NO: 1026888 - RNA, 19 nt, Human
ucaauucuauuacgugcaa

SEQ ID NO: 1026889 - RNA, 11 nt, Human
cagcugccucc

SEQ ID NO: 1026890 - RNA, 13 nt, Human
aaauaaaaauaaa

SEQ ID NO: 1026891 - RNA, 22 nt, Human
agaauucuuacauguuuucuuu

SEQ ID NO: 1026892 - RNA, 13 nt, Human
ugaaagcguaaag

SEQ ID NO: 1026893 - RNA, 13 nt, Human
ucuuauucacauc

SEQ ID NO: 1026894 - RNA, 18 nt, Human
cacuuucccucuuggugc

SEQ ID NO: 1026895 - RNA, 19 nt, Human
uauauguguuuuucacauu

SEQ ID NO: 1026896 - RNA, 20 nt, Human
auaaccaugcccaagaauga

SEQ ID NO: 1026897 - RNA, 12 nt, Human
cuauuauagaau

SEQ ID NO: 1026898 - RNA, 16 nt, Human
ugccuuuauaaucuuu

SEQ ID NO: 1026899 - RNA, 15 nt, Human
ccuuccagugucucg

SEQ ID NO: 1026900 - RNA, 20 nt, Human
cuccaccucccugcaauaaa

SEQ ID NO: 1026901 - RNA, 23 nt, Human
caaagacuaugaggaauauuugc

SEQ ID NO: 1026902 - RNA, 14 nt, Human
aggcaagagaauug

SEQ ID NO: 1026903 - RNA, 16 nt, Human
aacucaucauaaaaua

SEQ ID NO: 1026904 - RNA, 19 nt, Human
cuuugaaaaaguauaaaua

SEQ ID NO: 1026905 - RNA, 22 nt, Human
ucaggagauuucaugccuggug

SEQ ID NO: 1026906 - RNA, 17 nt, Human
uaaauccuuuacuguua

SEQ ID NO: 1026907 - RNA, 15 nt, Human
cacccuugccaugga

SEQ ID NO: 1026908 - RNA, 21 nt, Human
agagauuuuuaaauaaagaau

SEQ ID NO: 1026909 - RNA, 22 nt, Human
agugacuuaguguacaugaaag

SEQ ID NO: 1026910 - RNA, 22 nt, Human
uuuauaacucaucauaaaauaa

SEQ ID NO: 1026911 - RNA, 11 nt, Human
uuuuuaaacaa

SEQ ID NO: 1026912 - RNA, 18 nt, Human
cauauaauaaauguacau

SEQ ID NO: 1026913 - RNA, 19 nt, Human
aaguccuacaagcuaaaau

SEQ ID NO: 1026914 - RNA, 15 nt, Human
gcaggcaugagucag

SEQ ID NO: 1026915 - RNA, 15 nt, Human
acauuuccaaauuca

SEQ ID NO: 1026916 - RNA, 14 nt, Human
aaguaauuucagaa

SEQ ID NO: 1026917 - RNA, 11 nt, Human
ucuuuucucug

SEQ ID NO: 1026918 - RNA, 15 nt, Human
accugggcugaggca

SEQ ID NO: 1026919 - RNA, 24 nt, Human
acauuugcgaaugguuccauucuc

SEQ ID NO: 1026920 - RNA, 14 nt, Human
auagugucugauga

SEQ ID NO: 1026921 - RNA, 21 nt, Human
ugugauguggcaaaucucuau

SEQ ID NO: 1026922 - RNA, 12 nt, Human
acuauggaaaaa

SEQ ID NO: 1026923 - RNA, 19 nt, Human
auucaaaaguugaaauuaa

SEQ ID NO: 1026924 - RNA, 13 nt, Human
ugccaauauccua

SEQ ID NO: 1026925 - RNA, 15 nt, Human
acuacuuuaaaaaaa

SEQ ID NO: 1026926 - RNA, 21 nt, Human
aagacaacauuaaaacaauau

SEQ ID NO: 1026927 - RNA, 16 nt, Human
gcuuuuucucucccac

SEQ ID NO: 1026928 - RNA, 12 nt, Human
agccagcaguuc

SEQ ID NO: 1026929 - RNA, 23 nt, Human
acuuugugaaaaaaaauuuuaua

SEQ ID NO: 1026930 - RNA, 14 nt, Human
agaauauuagcuuu

SEQ ID NO: 1026931 - RNA, 16 nt, Human
aaaguauaaauaaaau

SEQ ID NO: 1026932 - RNA, 17 nt, Human
acaugaaagcguaaaga

SEQ ID NO: 1026933 - RNA, 17 nt, Human
cugcccucuccugggca

SEQ ID NO: 1026934 - RNA, 14 nt, Human
agcugaacuuguug

SEQ ID NO: 1026935 - RNA, 17 nt, Human
cuuguuagcaaaaugga

SEQ ID NO: 1026936 - RNA, 14 nt, Human
ucucccucuguugc

SEQ ID NO: 1026937 - RNA, 20 nt, Human
auuaaggcuucucuuaaaca

SEQ ID NO: 1026938 - RNA, 22 nt, Human
caguauggcagcuuuccucaaa

SEQ ID NO: 1026939 - RNA, 19 nt, Human
guacugagagugaacaaau

SEQ ID NO: 1026940 - RNA, 22 nt, Human
gugaacaaauuuacagagacag

SEQ ID NO: 1026941 - RNA, 22 nt, Human
acaagcuuuuuuuuuuuuucuu

SEQ ID NO: 1026942 - RNA, 19 nt, Human
auuugcaagacauagaaua

SEQ ID NO: 1026943 - RNA, 21 nt, Human
auugaaaggcauucucugaag

SEQ ID NO: 1026944 - RNA, 13 nt, Human
uauuuauuuuuuu

SEQ ID NO: 1026945 - RNA, 19 nt, Human
ugacaagguucuucccuuu

SEQ ID NO: 1026946 - RNA, 21 nt, Human
ccugcaauaaaauggguuuua

SEQ ID NO: 1026947 - RNA, 19 nt, Human
aaaacaaagaagacaacau

SEQ ID NO: 1026948 - RNA, 16 nt, Human
ccacuguuaucaaaac

SEQ ID NO: 1026949 - RNA, 14 nt, Human
acuggccugcugga

SEQ ID NO: 1026950 - RNA, 21 nt, Human
ucucuggcgacaguuuuccuu

SEQ ID NO: 1026951 - RNA, 17 nt, Human
gauuuuuaaauaaagaa

SEQ ID NO: 1026952 - RNA, 16 nt, Human
guuacauuauuaucaa

SEQ ID NO: 1026953 - RNA, 18 nt, Human
uaacuggcaguuuuccau

SEQ ID NO: 1026954 - RNA, 21 nt, Human
ugaacugauggguuucuccag

SEQ ID NO: 1026955 - RNA, 19 nt, Human
gauuuuuaaauaaagaauu

SEQ ID NO: 1026956 - RNA, 16 nt, Human
ucagaccuagaauaau

SEQ ID NO: 1026957 - RNA, 18 nt, Human
cagcuacuugggaggcug

SEQ ID NO: 1026958 - RNA, 15 nt, Human
agagacagaaagcag

SEQ ID NO: 1026959 - RNA, 13 nt, Human
augauuccaccua

SEQ ID NO: 1026960 - RNA, 17 nt, Human
ucccugcaauaaaaugg

SEQ ID NO: 1026961 - RNA, 13 nt, Human
ccuccccuccucu

SEQ ID NO: 1026962 - RNA, 19 nt, Human
auaaaauaaaguauauaua

SEQ ID NO: 1026963 - RNA, 19 nt, Human
auauuugcaagacauagaa

SEQ ID NO: 1026964 - RNA, 21 nt, Human
caucauaaaauaaaguauaua

SEQ ID NO: 1026965 - RNA, 16 nt, Human
auauccugugacuguc

SEQ ID NO: 1026966 - RNA, 19 nt, Human
cuugccaucccucccucca

SEQ ID NO: 1026967 - RNA, 22 nt, Human
gcagagacgggguuugccaugc

SEQ ID NO: 1026968 - RNA, 13 nt, Human
uuaacauuauuua

SEQ ID NO: 1026969 - RNA, 20 nt, Human
agcaguucagagcugcccuc

SEQ ID NO: 1026970 - RNA, 18 nt, Human
ucaauacuucauuuaaaa

SEQ ID NO: 1026971 - RNA, 19 nt, Human
aacuauauuaucaugcaaa

SEQ ID NO: 1026972 - RNA, 18 nt, Human
aagucugauuuuccugga

SEQ ID NO: 1026973 - RNA, 18 nt, Human
aaaaugugcaauauguga

SEQ ID NO: 1026974 - RNA, 17 nt, Human
agcgacagugagacucu

SEQ ID NO: 1026975 - RNA, 14 nt, Human
acccaaaaggcaga

SEQ ID NO: 1026976 - RNA, 12 nt, Human
gccaucccuccc

SEQ ID NO: 1026977 - RNA, 12 nt, Human
cuggccaggcug

SEQ ID NO: 1026978 - RNA, 17 nt, Human
guguaaugaaaaugaau

SEQ ID NO: 1026979 - RNA, 19 nt, Human
uaaaaauaaaaauaaauuu

SEQ ID NO: 1026980 - RNA, 21 nt, Human
caacccccauuucuauuuauu

SEQ ID NO: 1026981 - RNA, 15 nt, Human
ucaguccucuuucaa

SEQ ID NO: 1026982 - RNA, 16 nt, Human
ucccugcaauaaaaug

SEQ ID NO: 1026983 - RNA, 17 nt, Human
caaagcacgaaauguua

SEQ ID NO: 1026984 - RNA, 16 nt, Human
acugaauguaaacaaa

SEQ ID NO: 1026985 - RNA, 22 nt, Human
uagauacugaauguaaacaaag

SEQ ID NO: 1026986 - RNA, 20 nt, Human
aucuguaaaauggagacacc

SEQ ID NO: 1026987 - RNA, 20 nt, Human
ucagagcugcccucuccugg

SEQ ID NO: 1026988 - RNA, 18 nt, Human
ugaguggaugauguuucg

SEQ ID NO: 1026989 - RNA, 22 nt, Human
caccaaacccggccugauuaaa

SEQ ID NO: 1026990 - RNA, 19 nt, Human
uacaaaaaaaaaaaaaaau

SEQ ID NO: 1026991 - RNA, 17 nt, Human
aaaaguauaaauaaaau

SEQ ID NO: 1026992 - RNA, 19 nt, Human
uaaauguaucuuauucaca

SEQ ID NO: 1026993 - RNA, 17 nt, Human
cacuuuauauuauuuug

SEQ ID NO: 1026994 - RNA, 23 nt, Human
cuucacuuuuuuucuuuucucug

SEQ ID NO: 1026995 - RNA, 17 nt, Human
uggugaaaugcagaguc

SEQ ID NO: 1026996 - RNA, 12 nt, Human
ucauucaaaagu

SEQ ID NO: 1026997 - RNA, 17 nt, Human
auugagcaccugcaggc

SEQ ID NO: 1026998 - RNA, 16 nt, Human
cagagcugcccucucc

SEQ ID NO: 1026999 - RNA, 13 nt, Human
cuagaauuuauuc

SEQ ID NO: 1027000 - RNA, 14 nt, Human
uggacaguuuucug

SEQ ID NO: 1027001 - RNA, 18 nt, Human
aucuacacuccagugaga

SEQ ID NO: 1027002 - RNA, 17 nt, Human
aagcuugcaacaaaauu

SEQ ID NO: 1027003 - RNA, 16 nt, Human
gcuugaacccaggaga

SEQ ID NO: 1027004 - RNA, 14 nt, Human
gugggacaguuccu

SEQ ID NO: 1027005 - RNA, 21 nt, Human
cgacagugagacucugucuca

SEQ ID NO: 1027006 - RNA, 16 nt, Human
guuuauuucacuugau

SEQ ID NO: 1027007 - RNA, 24 nt, Human
ucccugcagacaugagagacagca

SEQ ID NO: 1027008 - RNA, 17 nt, Human
acacaaccugucccagc

SEQ ID NO: 1027009 - RNA, 13 nt, Human
acacuuaaaaaug

SEQ ID NO: 1027010 - RNA, 17 nt, Human
uaagauuuguaauauuu

SEQ ID NO: 1027011 - RNA, 20 nt, Human
uuccuaaccagccuggucaa

SEQ ID NO: 1027012 - RNA, 20 nt, Human
gauguagauaaacucagaaa

SEQ ID NO: 1027013 - RNA, 17 nt, Human
uucuagguucuaaaaau

SEQ ID NO: 1027014 - RNA, 18 nt, Human
ugugaccacugcagaaga

SEQ ID NO: 1027015 - RNA, 20 nt, Human
ucaaaacuucagacauagaa

SEQ ID NO: 1027016 - RNA, 18 nt, Human
agcaaauguuaugcauaa

SEQ ID NO: 1027017 - RNA, 21 nt, Human
agcuaaguugcaccaacuuug

SEQ ID NO: 1027018 - RNA, 12 nt, Human
ucuuaaagaauu

SEQ ID NO: 1027019 - RNA, 18 nt, Human
gaacgauuuagaaagaag

SEQ ID NO: 1027020 - RNA, 21 nt, Human
ggcaaaucucuauuaggaaau

SEQ ID NO: 1027021 - RNA, 15 nt, Human
accugggcauucuug

SEQ ID NO: 1027022 - RNA, 15 nt, Human
gaucauguauuuauu

SEQ ID NO: 1027023 - RNA, 18 nt, Human
cccucuccugggcagcug

SEQ ID NO: 1027024 - RNA, 19 nt, Human
uuuauaauuccuauauccu

SEQ ID NO: 1027025 - RNA, 12 nt, Human
acaugagguacu

SEQ ID NO: 1027026 - RNA, 14 nt, Human
ugaagauguagagg

SEQ ID NO: 1027027 - RNA, 21 nt, Human
uuuuuuuaaacaaaaaaagca

SEQ ID NO: 1027028 - RNA, 20 nt, Human
aucaaauuccagaaugauuu

SEQ ID NO: 1027029 - RNA, 21 nt, Human
uuccuggacaguuuucugcuu

SEQ ID NO: 1027030 - RNA, 15 nt, Human
acuagaauuuauuca

SEQ ID NO: 1027031 - RNA, 17 nt, Human
agauccccguguuacug

SEQ ID NO: 1027032 - RNA, 18 nt, Human
gagcgacagugagacucu

SEQ ID NO: 1027033 - RNA, 13 nt, Human
agagcaagacucu

SEQ ID NO: 1027034 - RNA, 20 nt, Human
cuaauucaaacuaauagaau

SEQ ID NO: 1027035 - RNA, 17 nt, Human
gugccuguaaucacagc

SEQ ID NO: 1027036 - RNA, 19 nt, Human
ccgggcgugguggugagug

SEQ ID NO: 1027037 - RNA, 18 nt, Human
uuuuuagacucaucaauc

SEQ ID NO: 1027038 - RNA, 17 nt, Human
uaaaaaaaaaaaaaaag

SEQ ID NO: 1027039 - RNA, 15 nt, Human
acaauuauaagcugu

SEQ ID NO: 1027040 - RNA, 14 nt, Human
agauguagaggaga

SEQ ID NO: 1027041 - RNA, 17 nt, Human
cuaucagcauuuuacua

SEQ ID NO: 1027042 - RNA, 17 nt, Human
cuuugaugauuaauuca

SEQ ID NO: 1027043 - RNA, 13 nt, Human
aaaaauacaaaaa

SEQ ID NO: 1027044 - RNA, 15 nt, Human
aucuaauauauauga

SEQ ID NO: 1027045 - RNA, 20 nt, Human
aaucucuauuaggaaauauu

SEQ ID NO: 1027046 - RNA, 16 nt, Human
uaagauaaauuauaag

SEQ ID NO: 1027047 - RNA, 12 nt, Human
aaaugaaagcag

SEQ ID NO: 1027048 - RNA, 14 nt, Human
gaagaaauucugca

SEQ ID NO: 1027049 - RNA, 12 nt, Human
cuucucuuaaac

SEQ ID NO: 1027050 - RNA, 11 nt, Human
uccucugggaa

SEQ ID NO: 1027051 - RNA, 19 nt, Human
aucuguaaaauggagacac

SEQ ID NO: 1027052 - RNA, 16 nt, Human
acuucacuuuuuuucu

SEQ ID NO: 1027053 - RNA, 15 nt, Human
ucuuuugccauuaaa

SEQ ID NO: 1027054 - RNA, 22 nt, Human
uaaucagggaggucauuuuggu

SEQ ID NO: 1027055 - RNA, 21 nt, Human
guacauuuccaaauucacaag

SEQ ID NO: 1027056 - RNA, 13 nt, Human
gguggggugaggg

SEQ ID NO: 1027057 - RNA, 17 nt, Human
cugaagggcaucaugca

SEQ ID NO: 1027058 - RNA, 21 nt, Human
uagaaagaagcccaauauuau

SEQ ID NO: 1027059 - RNA, 13 nt, Human
uacuauauuuaug

SEQ ID NO: 1027060 - RNA, 15 nt, Human
cugaggcaagagaau

SEQ ID NO: 1027061 - RNA, 16 nt, Human
uauuauuuauauaugu

SEQ ID NO: 1027062 - RNA, 12 nt, Human
guauauauagaa

SEQ ID NO: 1027063 - RNA, 17 nt, Human
ugguaaaauacuucuug

SEQ ID NO: 1027064 - RNA, 20 nt, Human
aaaucucuauuaggaaauau

SEQ ID NO: 1027065 - RNA, 22 nt, Human
uuacauguuuucuuugcuuuaa

SEQ ID NO: 1027066 - RNA, 15 nt, Human
ccuccccuccucugc

SEQ ID NO: 1027067 - RNA, 17 nt, Human
cuuugggaggcugaggc

SEQ ID NO: 1027068 - RNA, 22 nt, Human
uugcaagacauagaauaguguu

SEQ ID NO: 1027069 - RNA, 18 nt, Human
ugcuuguuagcaaaaugg

SEQ ID NO: 1027070 - RNA, 14 nt, Human
uaccuuuuuccuuc

SEQ ID NO: 1027071 - RNA, 17 nt, Human
augagccggagccccuu

SEQ ID NO: 1027072 - RNA, 16 nt, Human
aaaaugugauauguac

SEQ ID NO: 1027073 - RNA, 19 nt, Human
gaccugacagcccaagggu

SEQ ID NO: 1027074 - RNA, 18 nt, Human
aaaucuauuuauuaauau

SEQ ID NO: 1027075 - RNA, 20 nt, Human
auucagccccgggaguggcg

SEQ ID NO: 1027076 - RNA, 20 nt, Human
ccuccugccuaagugcagcc

SEQ ID NO: 1027077 - RNA, 13 nt, Human
aauguuacauuau

SEQ ID NO: 1027078 - RNA, 13 nt, Human
agcagauuuuaau

SEQ ID NO: 1027079 - RNA, 18 nt, Human
ucacaaccacucauucaa

SEQ ID NO: 1027080 - RNA, 21 nt, Human
guaaucauauaauaaauguac

SEQ ID NO: 1027081 - RNA, 14 nt, Human
uaugugaaauaaaa

SEQ ID NO: 1027082 - RNA, 21 nt, Human
uguuuuaagauaaauuauaag

SEQ ID NO: 1027083 - RNA, 17 nt, Human
cuuuagggaccugcugu

SEQ ID NO: 1027084 - RNA, 12 nt, Human
accagccaaccu

SEQ ID NO: 1027085 - RNA, 20 nt, Human
ugccuccccuccucugcuug

SEQ ID NO: 1027086 - RNA, 13 nt, Human
cuauuuauuaaua

SEQ ID NO: 1027087 - RNA, 14 nt, Human
gaaagcuguggcca

SEQ ID NO: 1027088 - RNA, 18 nt, Human
gagccaacagaagcuucc

SEQ ID NO: 1027089 - RNA, 14 nt, Human
uuaauuauuauucu

SEQ ID NO: 1027090 - RNA, 19 nt, Human
ccaccugccuauauuuuuu

SEQ ID NO: 1027091 - RNA, 14 nt, Human
ugagacucugucuc

SEQ ID NO: 1027092 - RNA, 19 nt, Human
cuuuuuuuuuuuuuuaaac

SEQ ID NO: 1027093 - RNA, 19 nt, Human
aauaaauguaucuuauuca

SEQ ID NO: 1027094 - RNA, 22 nt, Human
auagaauauuuauuaccucuga

SEQ ID NO: 1027095 - RNA, 16 nt, Human
auguaaucaauguuuc

SEQ ID NO: 1027096 - RNA, 15 nt, Human
guucugcagauaaac

SEQ ID NO: 1027097 - RNA, 21 nt, Human
uuacaggcgugagccaccaaa

SEQ ID NO: 1027098 - RNA, 21 nt, Human
acucugaagggcaucaugcau

SEQ ID NO: 1027099 - RNA, 17 nt, Human
agaaaugaaagcaggga

SEQ ID NO: 1027100 - RNA, 17 nt, Human
gucauaacuaaauaaag

SEQ ID NO: 1027101 - RNA, 14 nt, Human
ggcacuugggacaa

SEQ ID NO: 1027102 - RNA, 17 nt, Human
uuugaguguuuuaagau

SEQ ID NO: 1027103 - RNA, 13 nt, Human
uugggacaaaaac

SEQ ID NO: 1027104 - RNA, 10 nt, Human
ccugagcccc

SEQ ID NO: 1027105 - RNA, 19 nt, Human
gaaaauaaaagcacuuauu

SEQ ID NO: 1027106 - RNA, 14 nt, Human
ucuacuuuuaaguu

SEQ ID NO: 1027107 - RNA, 13 nt, Human
auugcauuaaaua

SEQ ID NO: 1027108 - RNA, 13 nt, Human
uagucuuauaaua

SEQ ID NO: 1027109 - RNA, 12 nt, Human
cuuagacccuca

SEQ ID NO: 1027110 - RNA, 16 nt, Human
aauaugcacaauagca

SEQ ID NO: 1027111 - RNA, 19 nt, Human
uuccucccuucucuucaca

SEQ ID NO: 1027112 - RNA, 21 nt, Human
uuaucagucauaacuaaauaa

SEQ ID NO: 1027113 - RNA, 13 nt, Human
uaaguuucuggga

SEQ ID NO: 1027114 - RNA, 15 nt, Human
uuuuuaaacaaaaaa

SEQ ID NO: 1027115 - RNA, 20 nt, Human
cauagaauaguguuggaaaa

SEQ ID NO: 1027116 - RNA, 23 nt, Human
cuaaguugcaccaacuuugaagu

SEQ ID NO: 1027117 - RNA, 13 nt, Human
aaauaaagaauuu

SEQ ID NO: 1027118 - RNA, 15 nt, Human
auuucagaagaaauu

SEQ ID NO: 1027119 - RNA, 12 nt, Human
uacaucuuucac

SEQ ID NO: 1027120 - RNA, 19 nt, Human
aucuauuuauuaauauuua

SEQ ID NO: 1027121 - RNA, 21 nt, Human
uugccaaggcuggagugcagu

SEQ ID NO: 1027122 - RNA, 19 nt, Human
uccagaaauaaugaaauaa

SEQ ID NO: 1027123 - RNA, 16 nt, Human
auuauaauuuuuuuca

SEQ ID NO: 1027124 - RNA, 20 nt, Human
agaccagccaaccugggggc

SEQ ID NO: 1027125 - RNA, 18 nt, Human
cugaccucccucuaauuu

SEQ ID NO: 1027126 - RNA, 22 nt, Human
cuggggcucugggauagcugac

SEQ ID NO: 1027127 - RNA, 21 nt, Human
accugacagcccaaggguggg

SEQ ID NO: 1027128 - RNA, 16 nt, Human
acuaguuucccuugca

SEQ ID NO: 1027129 - RNA, 15 nt, Human
uauuauuuauauaug

SEQ ID NO: 1027130 - RNA, 22 nt, Human
uaugcauacaguaauuuuaagu

SEQ ID NO: 1027131 - RNA, 12 nt, Human
uuuauaaauaua

SEQ ID NO: 1027132 - RNA, 15 nt, Human
aguguaaguucacaa

SEQ ID NO: 1027133 - RNA, 20 nt, Human
agacgggguuugccaugcug

SEQ ID NO: 1027134 - RNA, 16 nt, Human
ucuacuuuuaaguugc

SEQ ID NO: 1027135 - RNA, 12 nt, Human
aucccucccucc

SEQ ID NO: 1027136 - RNA, 21 nt, Human
cuaccuuuugcuguggcaaau

SEQ ID NO: 1027137 - RNA, 23 nt, Human
gcugucuauguggcuguaucuug

SEQ ID NO: 1027138 - RNA, 12 nt, Human
auguauuauuua

SEQ ID NO: 1027139 - RNA, 20 nt, Human
uagcauauguuuuuguaagu

SEQ ID NO: 1027140 - RNA, 14 nt, Human
gcugcaaaauguua

SEQ ID NO: 1027141 - RNA, 15 nt, Human
aucucacaagcacuu

SEQ ID NO: 1027142 - RNA, 21 nt, Human
uccugggcagcugccuccccu

SEQ ID NO: 1027143 - RNA, 20 nt, Human
caauuauuuuuacaguucuc

SEQ ID NO: 1027144 - RNA, 17 nt, Human
caagaaaugaaagcagg

SEQ ID NO: 1027145 - RNA, 18 nt, Human
uguugauagcaagugaau

SEQ ID NO: 1027146 - RNA, 18 nt, Human
accucccugcaauaaaau

SEQ ID NO: 1027147 - RNA, 15 nt, Human
gccuccccuccucug

SEQ ID NO: 1027148 - RNA, 21 nt, Human
cuuugaaaaaguauaaauaaa

SEQ ID NO: 1027149 - RNA, 21 nt, Human
uuuuaaauaaagaauuuuaaa

SEQ ID NO: 1027150 - RNA, 13 nt, Human
cugcuuucaucuu

SEQ ID NO: 1027151 - RNA, 17 nt, Human
agacauagaauaguguu

SEQ ID NO: 1027152 - RNA, 19 nt, Human
uguauuuauaaauauauuu

SEQ ID NO: 1027153 - RNA, 13 nt, Human
guuugauuucauu

SEQ ID NO: 1027154 - RNA, 11 nt, Human
ugggcagcugc

SEQ ID NO: 1027155 - RNA, 19 nt, Human
auauauuuauaacucauca

SEQ ID NO: 1027156 - RNA, 16 nt, Human
gaugaauguuaaauua

SEQ ID NO: 1027157 - RNA, 22 nt, Human
cugagcagugcuugaaugaagu

SEQ ID NO: 1027158 - RNA, 16 nt, Human
aucagucauaacuaaa

SEQ ID NO: 1027159 - RNA, 16 nt, Human
aaauaaugaaauaacu

SEQ ID NO: 1027160 - RNA, 22 nt, Human
uacauaagggaggaaaaaaaau

SEQ ID NO: 1027161 - RNA, 20 nt, Human
aaaaaccugagccccaaaag

SEQ ID NO: 1027162 - RNA, 20 nt, Human
auauguaccauguacaugaa

SEQ ID NO: 1027163 - RNA, 16 nt, Human
uuauaagcuguuuuua

SEQ ID NO: 1027164 - RNA, 18 nt, Human
cccaggaguuuggccaga

SEQ ID NO: 1027165 - RNA, 19 nt, Human
aacucuuaaucaaauagca

SEQ ID NO: 1027166 - RNA, 16 nt, Human
uguauuauuuauaauu

SEQ ID NO: 1027167 - RNA, 17 nt, Human
uagagacuuugugaaaa

SEQ ID NO: 1027168 - RNA, 21 nt, Human
acuuuuuuucuuuucucugcc

SEQ ID NO: 1027169 - RNA, 23 nt, Human
ucuggcacuugggacaaaaacaa

SEQ ID NO: 1027170 - RNA, 22 nt, Human
uccugaccuaugaaacagagaa

SEQ ID NO: 1027171 - RNA, 11 nt, Human
guuuuaucauu

SEQ ID NO: 1027172 - RNA, 19 nt, Human
ucuccugggcagcugccuc

SEQ ID NO: 1027173 - RNA, 21 nt, Human
ccugucccugcagacaugaga

SEQ ID NO: 1027174 - RNA, 20 nt, Human
ccagauacacccaaaguauc

SEQ ID NO: 1027175 - RNA, 18 nt, Human
agcuucucauccugcagg

SEQ ID NO: 1027176 - RNA, 16 nt, Human
cucauccugcaggcag

SEQ ID NO: 1027177 - RNA, 13 nt, Human
ucucaaaaaauaa

SEQ ID NO: 1027178 - RNA, 21 nt, Human
ucuagcaaauguuaugcauaa

SEQ ID NO: 1027179 - RNA, 16 nt, Human
auggagguuaagcacu

SEQ ID NO: 1027180 - RNA, 13 nt, Human
augaacuuuccac

SEQ ID NO: 1027181 - RNA, 19 nt, Human
ccugccuaagugcagcccc

SEQ ID NO: 1027182 - RNA, 18 nt, Human
auugaaaggcauucucug

SEQ ID NO: 1027183 - RNA, 20 nt, Human
aacaaacgaaaaacauuuca

SEQ ID NO: 1027184 - RNA, 15 nt, Human
guggguggggcagug

SEQ ID NO: 1027185 - RNA, 18 nt, Human
ggucacacaaccuguccc

SEQ ID NO: 1027186 - RNA, 14 nt, Human
uaagcuguuuccau

SEQ ID NO: 1027187 - RNA, 21 nt, Human
auuguugacaacugugacugu

SEQ ID NO: 1027188 - RNA, 20 nt, Human
cacuggcucccuggaagaga

SEQ ID NO: 1027189 - RNA, 17 nt, Human
uuuccguggcacugcau

SEQ ID NO: 1027190 - RNA, 14 nt, Human
ucaaugcagccccc

SEQ ID NO: 1027191 - RNA, 18 nt, Human
auaaauguaucuuauuca

SEQ ID NO: 1027192 - RNA, 16 nt, Human
gagcaccugcaggcgu

SEQ ID NO: 1027193 - RNA, 20 nt, Human
aauuuaugaguuuuugauag

SEQ ID NO: 1027194 - RNA, 13 nt, Human
ccuacaccauucc

SEQ ID NO: 1027195 - RNA, 20 nt, Human
auauaauguuguuauuuaaa

SEQ ID NO: 1027196 - RNA, 15 nt, Human
aaugaauggcuaagc

SEQ ID NO: 1027197 - RNA, 14 nt, Human
cuuaggaagagaaa

SEQ ID NO: 1027198 - RNA, 20 nt, Human
uccagagggaauugcagagu

SEQ ID NO: 1027199 - RNA, 18 nt, Human
cauaagggaggaaaaaaa

SEQ ID NO: 1027200 - RNA, 14 nt, Human
guuacucugaaggg

SEQ ID NO: 1027201 - RNA, 14 nt, Human
uccaccucccugca

SEQ ID NO: 1027202 - RNA, 19 nt, Human
gaggacuugggcgggacac

SEQ ID NO: 1027203 - RNA, 17 nt, Human
ugccuccccuccucugc

SEQ ID NO: 1027204 - RNA, 21 nt, Human
aaugugacuuaaugccacuaa

SEQ ID NO: 1027205 - RNA, 14 nt, Human
auguaaauagaaac

SEQ ID NO: 1027206 - RNA, 19 nt, Human
cuccugggcagcugccucc

SEQ ID NO: 1027207 - RNA, 19 nt, Human
ugaacaaauuuacagagac

SEQ ID NO: 1027208 - RNA, 17 nt, Human
cauuugcacuauuggaa

SEQ ID NO: 1027209 - RNA, 23 nt, Human
auaagcuguuuuuauauauguga

SEQ ID NO: 1027210 - RNA, 18 nt, Human
ggggcgcgugcaggcagc

SEQ ID NO: 1027211 - RNA, 14 nt, Human
aauaguuuaugauu

SEQ ID NO: 1027212 - RNA, 19 nt, Human
guuagagauuuuuaaauaa

SEQ ID NO: 1027213 - RNA, 21 nt, Human
cugcuugccaucccucccucc

SEQ ID NO: 1027214 - RNA, 15 nt, Human
uaacugcuacaaaua

SEQ ID NO: 1027215 - RNA, 19 nt, Human
cuucauuuaaaauauuuuu

SEQ ID NO: 1027216 - RNA, 19 nt, Human
aaaugaauaucuauuaaua

SEQ ID NO: 1027217 - RNA, 13 nt, Human
uuauugagcaccu

SEQ ID NO: 1027218 - RNA, 20 nt, Human
ccagcuacuugggaggcuga

SEQ ID NO: 1027219 - RNA, 20 nt, Human
cuuaaagaauuuucaaaauc

SEQ ID NO: 1027220 - RNA, 15 nt, Human
agacaccaccacccu

SEQ ID NO: 1027221 - RNA, 23 nt, Human
cagagguugcagugagccgagau

SEQ ID NO: 1027222 - RNA, 13 nt, Human
ccuaaccagccug

SEQ ID NO: 1027223 - RNA, 15 nt, Human
ucucugccuugguau

SEQ ID NO: 1027224 - RNA, 22 nt, Human
guaauuuaagauuuuguuuuua

SEQ ID NO: 1027225 - RNA, 17 nt, Human
cacaggcuccaaacugg

SEQ ID NO: 1027226 - RNA, 20 nt, Human
agaggagaaacuggaacucu

SEQ ID NO: 1027227 - RNA, 20 nt, Human
uucauuuaaaauauuuuuau

SEQ ID NO: 1027228 - RNA, 16 nt, Human
ucaguguccucaucug

SEQ ID NO: 1027229 - RNA, 15 nt, Human
auauaugugaaauaa

SEQ ID NO: 1027230 - RNA, 18 nt, Human
uucaauaucuuuuuuuua

SEQ ID NO: 1027231 - RNA, 16 nt, Human
auauguaccauguaca

SEQ ID NO: 1027232 - RNA, 16 nt, Human
cauuuugguaaaauac

SEQ ID NO: 1027233 - RNA, 21 nt, Human
cuaagauuuguaauauuucuc

SEQ ID NO: 1027234 - RNA, 21 nt, Human
ucaaaauuggacuuaaaaucu

SEQ ID NO: 1027235 - RNA, 19 nt, Human
auuugguucuaggccgggc

SEQ ID NO: 1027236 - RNA, 19 nt, Human
agcagcuuauucacaagac

SEQ ID NO: 1027237 - RNA, 19 nt, Human
uugccaucccucccuccac

SEQ ID NO: 1027238 - RNA, 15 nt, Human
gagaaucagaucauu

SEQ ID NO: 1027239 - RNA, 12 nt, Human
cucuaacucaga

SEQ ID NO: 1027240 - RNA, 18 nt, Human
auauguauuuauaaauau

SEQ ID NO: 1027241 - RNA, 22 nt, Human
auuuuuuaaguauuuauauauu

SEQ ID NO: 1027242 - RNA, 15 nt, Human
aauuuuuuucaucuu

SEQ ID NO: 1027243 - RNA, 21 nt, Human
acagugauuaccagggacuga

SEQ ID NO: 1027244 - RNA, 17 nt, Human
uuaaggcuucucuuaaa

SEQ ID NO: 1027245 - RNA, 17 nt, Human
agcugacccagccccuu

SEQ ID NO: 1027246 - RNA, 18 nt, Human
guuuccuagcgcagccau

SEQ ID NO: 1027247 - RNA, 20 nt, Human
ucaggaggaaggcuuacacc

SEQ ID NO: 1027248 - RNA, 16 nt, Human
ucuauuaggaaauauu

SEQ ID NO: 1027249 - RNA, 21 nt, Human
aagauuaugaucucagaaauu

SEQ ID NO: 1027250 - RNA, 12 nt, Human
guauaaauaaaa

SEQ ID NO: 1027251 - RNA, 21 nt, Human
uguaaaauggugugaccacug

SEQ ID NO: 1027252 - RNA, 21 nt, Human
ugaagguaaaauugaaaggca

SEQ ID NO: 1027253 - RNA, 23 nt, Human
aauauuuuuaugugcaauaaaau

SEQ ID NO: 1027254 - RNA, 19 nt, Human
auaaaguauauauagaauc

SEQ ID NO: 1027255 - RNA, 21 nt, Human
ugggaggcugagaugggagaa

SEQ ID NO: 1027256 - RNA, 21 nt, Human
gcuaaguugcaccaacuuuga

SEQ ID NO: 1027257 - RNA, 19 nt, Human
ggcagugcuuggcccagga

SEQ ID NO: 1027258 - RNA, 17 nt, Human
ggacacaggcuccaaac

SEQ ID NO: 1027259 - RNA, 19 nt, Human
uauaauauacuauauuuau

SEQ ID NO: 1027260 - RNA, 23 nt, Human
uccguggcacugcauacaaucug

SEQ ID NO: 1027261 - RNA, 18 nt, Human
cauauguaccauguacau

SEQ ID NO: 1027262 - RNA, 18 nt, Human
gccugagcgacagugaga

SEQ ID NO: 1027263 - RNA, 16 nt, Human
aauauauaugaauaaa

SEQ ID NO: 1027264 - RNA, 22 nt, Human
ucauugcaaccuccaccuucug

SEQ ID NO: 1027265 - RNA, 11 nt, Human
aaccugagccc

SEQ ID NO: 1027266 - RNA, 21 nt, Human
uauguauuauuuauaauuccu

SEQ ID NO: 1027267 - RNA, 13 nt, Human
ggucucccucugu

SEQ ID NO: 1027268 - RNA, 19 nt, Human
aaucuacacuccagugaga

SEQ ID NO: 1027269 - RNA, 21 nt, Human
acucugucucaaaaaauaaaa

SEQ ID NO: 1027270 - RNA, 13 nt, Human
ucucacuuaaucc

SEQ ID NO: 1027271 - RNA, 16 nt, Human
aaaaauacaaaaauua

SEQ ID NO: 1027272 - RNA, 15 nt, Human
aaccugggggcuuua

SEQ ID NO: 1027273 - RNA, 21 nt, Human
caagcuuuuuuuuuuuuucuu

SEQ ID NO: 1027274 - RNA, 18 nt, Human
ccucuccugggcagcugc

SEQ ID NO: 1027275 - RNA, 17 nt, Human
uucaaaaguugaaauua

SEQ ID NO: 1027276 - RNA, 21 nt, Human
ugcaggcagcuuuuucucucc

SEQ ID NO: 1027277 - RNA, 14 nt, Human
aacuaagauuugua

SEQ ID NO: 1027278 - RNA, 21 nt, Human
cucagugucaaugcagccccc

SEQ ID NO: 1027279 - RNA, 18 nt, Human
uuaaacacuaaaaaggca

SEQ ID NO: 1027280 - RNA, 19 nt, Human
accccuucauccucugagu

SEQ ID NO: 1027281 - RNA, 15 nt, Human
uuaccuuuuuccuuc

SEQ ID NO: 1027282 - RNA, 18 nt, Human
uuauauggggaauauauu

SEQ ID NO: 1027283 - RNA, 15 nt, Human
gcuugccaucccucc

SEQ ID NO: 1027284 - RNA, 11 nt, Human
ggucacaggaa

SEQ ID NO: 1027285 - RNA, 11 nt, Human
cagccagcagu

SEQ ID NO: 1027286 - RNA, 23 nt, Human
aucagcauuuuacuacuuuaaaa

SEQ ID NO: 1027287 - RNA, 17 nt, Human
uuaaauggucaauuuug

SEQ ID NO: 1027288 - RNA, 16 nt, Human
cucccaaagugcuggg

SEQ ID NO: 1027289 - RNA, 19 nt, Human
aaucuuaacucauugcaac

SEQ ID NO: 1027290 - RNA, 12 nt, Human
acaacugugacu

SEQ ID NO: 1027291 - RNA, 16 nt, Human
caggaaguagaggagg

SEQ ID NO: 1027292 - RNA, 13 nt, Human
cuggcuuaaaaug

SEQ ID NO: 1027293 - RNA, 14 nt, Human
cuggaauguaauca

SEQ ID NO: 1027294 - RNA, 15 nt, Human
agagcugcccucucc

SEQ ID NO: 1027295 - RNA, 21 nt, Human
ugugaucagaccauaauguua

SEQ ID NO: 1027296 - RNA, 12 nt, Human
cagaacagugau

SEQ ID NO: 1027297 - RNA, 20 nt, Human
auaacucaucauaaaauaaa

SEQ ID NO: 1027298 - RNA, 23 nt, Human
cgggguuugccaugcuggccagg

SEQ ID NO: 1027299 - RNA, 15 nt, Human
gugaccacugcagaa

SEQ ID NO: 1027300 - RNA, 23 nt, Human
gaaacguguauauuuuuuaugaa

SEQ ID NO: 1027301 - RNA, 20 nt, Human
uauaauaaauguacauuaau

SEQ ID NO: 1027302 - RNA, 20 nt, Human
uuaaguaauuucagaagaaa

SEQ ID NO: 1027303 - RNA, 21 nt, Human
uuacaguuagagauuuuuaaa

SEQ ID NO: 1027304 - RNA, 14 nt, Human
aaaaacauuucaaa

SEQ ID NO: 1027305 - RNA, 18 nt, Human
uggucaauuuuguuaugu

SEQ ID NO: 1027306 - RNA, 15 nt, Human
auuccccuaaccuca

SEQ ID NO: 1027307 - RNA, 24 nt, Human
aaucugaggccuccucucucaguu

SEQ ID NO: 1027308 - RNA, 19 nt, Human
ugacuuaguguacaugaaa

SEQ ID NO: 1027309 - RNA, 17 nt, Human
cuccuguacuuuuucca

SEQ ID NO: 1027310 - RNA, 17 nt, Human
aaggaaaucugugucag

SEQ ID NO: 1027311 - RNA, 13 nt, Human
uuauagaauauuu

SEQ ID NO: 1027312 - RNA, 14 nt, Human
auuuauuauuuuca

SEQ ID NO: 1027313 - RNA, 21 nt, Human
gaacuuuccacauucagagcu

SEQ ID NO: 1027314 - RNA, 16 nt, Human
augaaagcguaaagag

SEQ ID NO: 1027315 - RNA, 19 nt, Human
uuacugccgguuugaaaau

SEQ ID NO: 1027316 - RNA, 19 nt, Human
auauuuuuuaugaaacauu

SEQ ID NO: 1027317 - RNA, 16 nt, Human
uauuuauuaauauuua

SEQ ID NO: 1027318 - RNA, 21 nt, Human
ucuuucacauuggcuauuuaa

SEQ ID NO: 1027319 - RNA, 16 nt, Human
uccaccucccugcaau

SEQ ID NO: 1027320 - RNA, 11 nt, Human
uccucuuucaa

SEQ ID NO: 1027321 - RNA, 17 nt, Human
uaacugcauugagaacu

SEQ ID NO: 1027322 - RNA, 14 nt, Human
uccucugcuugcca

SEQ ID NO: 1027323 - RNA, 17 nt, Human
uauaagcuguuuuuaua

SEQ ID NO: 1027324 - RNA, 22 nt, Human
auuuuaauuuugaauaaauaaa

SEQ ID NO: 1027325 - RNA, 16 nt, Human
auguuauuuuuuaauu

SEQ ID NO: 1027326 - RNA, 16 nt, Human
ugcaauacuucaauac

SEQ ID NO: 1027327 - RNA, 14 nt, Human
cuguaaucacagcu

SEQ ID NO: 1027328 - RNA, 13 nt, Human
uggccaggcuggu

SEQ ID NO: 1027329 - RNA, 18 nt, Human
uuauuuagggaacugcuu

SEQ ID NO: 1027330 - RNA, 20 nt, Human
ugcauacaguaauuuuaagu

SEQ ID NO: 1027331 - RNA, 16 nt, Human
auugagcaccugcagg

SEQ ID NO: 1027332 - RNA, 21 nt, Human
uauaauaaauguacauuaauu

SEQ ID NO: 1027333 - RNA, 14 nt, Human
uccuguacuuuuuc

SEQ ID NO: 1027334 - RNA, 17 nt, Human
cauuguuugucugucuu

SEQ ID NO: 1027335 - RNA, 23 nt, Human
uuacauuauuaucaacaauagug

SEQ ID NO: 1027336 - RNA, 12 nt, Human
ucagaagaccug

SEQ ID NO: 1027337 - RNA, 17 nt, Human
uguaaugaaaaugaaua

SEQ ID NO: 1027338 - RNA, 19 nt, Human
uuuaaaaaaaaaaaaaaag

SEQ ID NO: 1027339 - RNA, 15 nt, Human
cuagauacugaaugu

SEQ ID NO: 1027340 - RNA, 19 nt, Human
gaaccuuuacauccagaua

SEQ ID NO: 1027341 - RNA, 18 nt, Human
aucuucagaccuagaaua

SEQ ID NO: 1027342 - RNA, 22 nt, Human
gccaauauccuaauaaaaaggu

SEQ ID NO: 1027343 - RNA, 19 nt, Human
aagcgauucucuuuauuca

SEQ ID NO: 1027344 - RNA, 13 nt, Human
cuguacuuuuucc

SEQ ID NO: 1027345 - RNA, 14 nt, Human
accuucuggguuca

SEQ ID NO: 1027346 - RNA, 16 nt, Human
aagggaggaaaaaaaa

SEQ ID NO: 1027347 - RNA, 11 nt, Human
aauaaauaaau

SEQ ID NO: 1027348 - RNA, 19 nt, Human
uacaauuauuuuuacaguu

SEQ ID NO: 1027349 - RNA, 17 nt, Human
ucagagcugcccucucc

SEQ ID NO: 1027350 - RNA, 24 nt, Human
uucacuuuuggcuuguaaaguaca

SEQ ID NO: 1027351 - RNA, 17 nt, Human
ccacugcagaagacagu

SEQ ID NO: 1027352 - RNA, 18 nt, Human
ccugaaagaggaaugaag

SEQ ID NO: 1027353 - RNA, 15 nt, Human
caaaaaccaaauuug

SEQ ID NO: 1027354 - RNA, 12 nt, Human
agcccaauauua

SEQ ID NO: 1027355 - RNA, 16 nt, Human
uccucacaccaggcuu

SEQ ID NO: 1027356 - RNA, 15 nt, Human
uuuuuaaauaaagaa

SEQ ID NO: 1027357 - RNA, 14 nt, Human
auauuaucaugcaa

SEQ ID NO: 1027358 - RNA, 21 nt, Human
cgaaguauccuucagccugaa

SEQ ID NO: 1027359 - RNA, 17 nt, Human
ggaauauguaaauagaa

SEQ ID NO: 1027360 - RNA, 21 nt, Human
aguuucaguugauuuuacaau

SEQ ID NO: 1027361 - RNA, 15 nt, Human
gacgugacuggccug

SEQ ID NO: 1027362 - RNA, 21 nt, Human
aacuuuuguguaaugaaaaug

SEQ ID NO: 1027363 - RNA, 20 nt, Human
aauuaauggaauauguaaau

SEQ ID NO: 1027364 - RNA, 22 nt, Human
aucauaaaauaaaguauauaua

SEQ ID NO: 1027365 - RNA, 17 nt, Human
cauagagacuuugugaa

SEQ ID NO: 1027366 - RNA, 17 nt, Human
ugcaagacauagaauag

SEQ ID NO: 1027367 - RNA, 15 nt, Human
gagauuucaugccug

SEQ ID NO: 1027368 - RNA, 21 nt, Human
uuguuuuaaaauuaaagcuaa

SEQ ID NO: 1027369 - RNA, 22 nt, Human
aaacuggaaauaaaagauugua

SEQ ID NO: 1027370 - RNA, 16 nt, Human
ucuaaaucuauuuauu

SEQ ID NO: 1027371 - RNA, 20 nt, Human
uaauaaauguacauuaauua

SEQ ID NO: 1027372 - RNA, 15 nt, Human
gaccacugcagaaga

SEQ ID NO: 1027373 - RNA, 14 nt, Human
acuuauugacuauu

SEQ ID NO: 1027374 - RNA, 13 nt, Human
guuggaggcugca

SEQ ID NO: 1027375 - RNA, 15 nt, Human
accacuguuaucaaa

SEQ ID NO: 1027376 - RNA, 13 nt, Human
ggggcucugggau

SEQ ID NO: 1027377 - RNA, 12 nt, Human
ucauuuuaauua

SEQ ID NO: 1027378 - RNA, 18 nt, Human
ucucaaaaaauaaaaaua

SEQ ID NO: 1027379 - RNA, 16 nt, Human
ccaucccucccuccac

SEQ ID NO: 1027380 - RNA, 13 nt, Human
auuuauuugagac

SEQ ID NO: 1027381 - RNA, 17 nt, Human
gacaguguuuucuggga

SEQ ID NO: 1027382 - RNA, 14 nt, Human
uguaacugcauuga

SEQ ID NO: 1027383 - RNA, 17 nt, Human
uuuacuuuguuauuuuu

SEQ ID NO: 1027384 - RNA, 18 nt, Human
uaacuagaauuuauucaa

SEQ ID NO: 1027385 - RNA, 23 nt, Human
aaauuaucaauaucuaauauaua

SEQ ID NO: 1027386 - RNA, 19 nt, Human
gagugacuuaguguacaug

SEQ ID NO: 1027387 - RNA, 24 nt, Human
accugcuguuuccuagcgcagcca

SEQ ID NO: 1027388 - RNA, 13 nt, Human
agcucugcccauc

SEQ ID NO: 1027389 - RNA, 16 nt, Human
cucaguguccucaucu

SEQ ID NO: 1027390 - RNA, 19 nt, Human
agcuucucauccugcaggc

SEQ ID NO: 1027391 - RNA, 19 nt, Human
caccuguuuuuaagcuguu

SEQ ID NO: 1027392 - RNA, 18 nt, Human
aauucacaaguuguguuu

SEQ ID NO: 1027393 - RNA, 14 nt, Human
aaaguauaaauaaa

SEQ ID NO: 1027394 - RNA, 21 nt, Human
ucuuugccuuuauaaucuuuu

SEQ ID NO: 1027395 - RNA, 23 nt, Human
gccaucccucccuccaccucccu

SEQ ID NO: 1027396 - RNA, 20 nt, Human
agugauacuauccaguuacu

SEQ ID NO: 1027397 - RNA, 15 nt, Human
auuuauuuuuuuacu

SEQ ID NO: 1027398 - RNA, 14 nt, Human
aacugcuggauuca

SEQ ID NO: 1027399 - RNA, 16 nt, Human
uaaauguacauuaauu

SEQ ID NO: 1027400 - RNA, 16 nt, Human
uauacuguauuuuuac

SEQ ID NO: 1027401 - RNA, 12 nt, Human
cuaagaagugaa

SEQ ID NO: 1027402 - RNA, 15 nt, Human
aauauaauaugcaca

SEQ ID NO: 1027403 - RNA, 14 nt, Human
guuacauuauuauc

SEQ ID NO: 1027404 - RNA, 16 nt, Human
guaaucauauaauaaa

SEQ ID NO: 1027405 - RNA, 15 nt, Human
cugaaagaggaauga

SEQ ID NO: 1027406 - RNA, 23 nt, Human
cugcaauaaaauggguuuuacug

SEQ ID NO: 1027407 - RNA, 21 nt, Human
aauguuauuuuuuaauuauua

SEQ ID NO: 1027408 - RNA, 13 nt, Human
uuuugcuguggca

SEQ ID NO: 1027409 - RNA, 23 nt, Human
ccugacagcccaagggugggugg

SEQ ID NO: 1027410 - RNA, 18 nt, Human
auuuucuuccaaacagaa

SEQ ID NO: 1027411 - RNA, 23 nt, Human
agcuuuuuuuuuuuuucuuaaag

SEQ ID NO: 1027412 - RNA, 14 nt, Human
ggaaguagaggagg

SEQ ID NO: 1027413 - RNA, 13 nt, Human
gaggcaagagaau

SEQ ID NO: 1027414 - RNA, 11 nt, Human
aauaucuauua

SEQ ID NO: 1027415 - RNA, 20 nt, Human
aaucauauaauaaauguaca

SEQ ID NO: 1027416 - RNA, 16 nt, Human
aauuuucccaaaacug

SEQ ID NO: 1027417 - RNA, 23 nt, Human
uuuagaaagaagcccaauauuau

SEQ ID NO: 1027418 - RNA, 21 nt, Human
ggaaaggaguagaaaaagcag

SEQ ID NO: 1027419 - RNA, 16 nt, Human
cagggccuggcuggga

SEQ ID NO: 1027420 - RNA, 22 nt, Human
gugauuacccucugggucucag

SEQ ID NO: 1027421 - RNA, 15 nt, Human
ugccuccccuccucu

SEQ ID NO: 1027422 - RNA, 13 nt, Human
cugccuccccucc

SEQ ID NO: 1027423 - RNA, 14 nt, Human
uucagccugaaaga

SEQ ID NO: 1027424 - RNA, 17 nt, Human
guguauuuucagcagag

SEQ ID NO: 1027425 - RNA, 14 nt, Human
uucacaagugaaaa

SEQ ID NO: 1027426 - RNA, 21 nt, Human
uuuucgaugguacauauuucu

SEQ ID NO: 1027427 - RNA, 14 nt, Human
gccgggcauggugg

SEQ ID NO: 1027428 - RNA, 20 nt, Human
auugaaucccuuaaacucag

SEQ ID NO: 1027429 - RNA, 22 nt, Human
uagcaguugaaacaagaagcca

SEQ ID NO: 1027430 - RNA, 23 nt, Human
cauagauguagauaaacucagaa

SEQ ID NO: 1027431 - RNA, 14 nt, Human
aauguaucuuauuc

SEQ ID NO: 1027432 - RNA, 14 nt, Human
caagacucugucuc

SEQ ID NO: 1027433 - RNA, 14 nt, Human
aaucuuguaaauau

SEQ ID NO: 1027434 - RNA, 21 nt, Human
cucugucucaaaaaauaaaaa

SEQ ID NO: 1027435 - RNA, 21 nt, Human
caguuacugccgguuugaaaa

SEQ ID NO: 1027436 - RNA, 15 nt, Human
uccccuccucugcuu

SEQ ID NO: 1027437 - RNA, 19 nt, Human
aaagaagacaacauuaaaa

SEQ ID NO: 1027438 - RNA, 21 nt, Human
uguaauuaaucuuguaaauau

SEQ ID NO: 1027439 - RNA, 20 nt, Human
gcuguaucuuguuuuuccac

SEQ ID NO: 1027440 - RNA, 16 nt, Human
aguagauuaagagaug

SEQ ID NO: 1027441 - RNA, 14 nt, Human
ucccuccaccuccc

SEQ ID NO: 1027442 - RNA, 21 nt, Human
uagcaucucaggagauuucau

SEQ ID NO: 1027443 - RNA, 23 nt, Human
acaguguuuucugggauaaguaa

SEQ ID NO: 1027444 - RNA, 14 nt, Human
agguugcagugagc

SEQ ID NO: 1027445 - RNA, 23 nt, Human
aaguauccuucagccugaaagag

SEQ ID NO: 1027446 - RNA, 15 nt, Human
cauagccaggaaacu

SEQ ID NO: 1027447 - RNA, 18 nt, Human
cacuccagugagacagcu

SEQ ID NO: 1027448 - RNA, 14 nt, Human
aaaacuucagacau

SEQ ID NO: 1027449 - RNA, 18 nt, Human
agucagucugaugagaac

SEQ ID NO: 1027450 - RNA, 16 nt, Human
uuuacaauugaaauga

SEQ ID NO: 1027451 - RNA, 13 nt, Human
auaaacucagaaa

SEQ ID NO: 1027452 - RNA, 20 nt, Human
gugagccaccaaacccggcc

SEQ ID NO: 1027453 - RNA, 17 nt, Human
agauagguuaccaguaa

SEQ ID NO: 1027454 - RNA, 16 nt, Human
uguggcauuuucacuu

SEQ ID NO: 1027455 - RNA, 14 nt, Human
aucaaaagaaagaa

SEQ ID NO: 1027456 - RNA, 21 nt, Human
uaaaauaaaguauauauagaa

SEQ ID NO: 1027457 - RNA, 16 nt, Human
cugauacuuuuuucau

SEQ ID NO: 1027458 - RNA, 23 nt, Human
aguguccucaucuguaaaaugga

SEQ ID NO: 1027459 - RNA, 22 nt, Human
ugccuccccuccucugcuugcc

SEQ ID NO: 1027460 - RNA, 12 nt, Human
gaauaucuauua

SEQ ID NO: 1027461 - RNA, 18 nt, Human
cuuaguguacaugaaagc

SEQ ID NO: 1027462 - RNA, 15 nt, Human
ugguuuagaaagcuu

SEQ ID NO: 1027463 - RNA, 16 nt, Human
gugagacagcucugca

SEQ ID NO: 1027464 - RNA, 16 nt, Human
ucuuggucucaguguc

SEQ ID NO: 1027465 - RNA, 19 nt, Human
aaaaguauaaauaaaauga

SEQ ID NO: 1027466 - RNA, 21 nt, Human
aucaagccaucggagcugcua

SEQ ID NO: 1027467 - RNA, 14 nt, Human
uuaaaguuaaauaa

SEQ ID NO: 1027468 - RNA, 15 nt, Human
auguaaacaaaggaa

SEQ ID NO: 1027469 - RNA, 23 nt, Human
aauagcaguugaaacaagaagcc

SEQ ID NO: 1027470 - RNA, 20 nt, Human
ggucucaguguccucaucug

SEQ ID NO: 1027471 - RNA, 16 nt, Human
aaauaaguauuuauaa

SEQ ID NO: 1027472 - RNA, 20 nt, Human
auuuauauggggaauauauu

SEQ ID NO: 1027473 - RNA, 23 nt, Human
uuuaguaagagauuccugagcca

SEQ ID NO: 1027474 - RNA, 15 nt, Human
cugcuggauguggag

SEQ ID NO: 1027475 - RNA, 14 nt, Human
aaaaauaaaaauaa

SEQ ID NO: 1027476 - RNA, 22 nt, Human
cagaagcuuccauuccaagccu

SEQ ID NO: 1027477 - RNA, 23 nt, Human
cauagagacuuugugaaaaaaaa

SEQ ID NO: 1027478 - RNA, 21 nt, Human
ugcaauaaaauggguuuuacu

SEQ ID NO: 1027479 - RNA, 12 nt, Human
uaacuuaugaac

SEQ ID NO: 1027480 - RNA, 19 nt, Human
ugauuacaaggcuuuaucu

SEQ ID NO: 1027481 - RNA, 19 nt, Human
uucucuaacucagaaacau

SEQ ID NO: 1027482 - RNA, 14 nt, Human
aaauuggacuuaaa

SEQ ID NO: 1027483 - RNA, 22 nt, Human
acacagugucuggcacuuggga

SEQ ID NO: 1027484 - RNA, 18 nt, Human
uaaaucuauuuauuaaua

SEQ ID NO: 1027485 - RNA, 16 nt, Human
cucuaggacauaaauu

SEQ ID NO: 1027486 - RNA, 16 nt, Human
uuuucaaaauuggacu

SEQ ID NO: 1027487 - RNA, 16 nt, Human
gaagauguagaggaga

SEQ ID NO: 1027488 - RNA, 21 nt, Human
auauacuccuaguaauuuaag

SEQ ID NO: 1027489 - RNA, 14 nt, Human
gccugucccugcag

SEQ ID NO: 1027490 - RNA, 17 nt, Human
ggaaaaaaaggaagaaa

SEQ ID NO: 1027491 - RNA, 21 nt, Human
uuucaaaacucauuuccuaug

SEQ ID NO: 1027492 - RNA, 15 nt, Human
uuuuaagauaaauua

SEQ ID NO: 1027493 - RNA, 21 nt, Human
uccaccucccugcaauaaaau

SEQ ID NO: 1027494 - RNA, 19 nt, Human
uggugagugccuguaauca

SEQ ID NO: 1027495 - RNA, 14 nt, Human
acucagaaacauca

SEQ ID NO: 1027496 - RNA, 15 nt, Human
acaaagacaaauucu

SEQ ID NO: 1027497 - RNA, 22 nt, Human
caaucaaauaaguauuuauaau

SEQ ID NO: 1027498 - RNA, 11 nt, Human
uccauuguaau

SEQ ID NO: 1027499 - RNA, 19 nt, Human
agagacgggguuugccaug

SEQ ID NO: 1027500 - RNA, 17 nt, Human
augcacuuuauauuauu

SEQ ID NO: 1027501 - RNA, 17 nt, Human
aucaugccccuguacuc

SEQ ID NO: 1027502 - RNA, 19 nt, Human
cugcuggauguggaggggg

SEQ ID NO: 1027503 - RNA, 17 nt, Human
ucuccugggcagcugcc

SEQ ID NO: 1027504 - RNA, 14 nt, Human
auaaagaauuuuaa

SEQ ID NO: 1027505 - RNA, 18 nt, Human
ugucuggacuuuccagag

SEQ ID NO: 1027506 - RNA, 13 nt, Human
guccucuuucaaa

SEQ ID NO: 1027507 - RNA, 18 nt, Human
ugaucagaccauaauguu

SEQ ID NO: 1027508 - RNA, 19 nt, Human
cuauuuauuuauuuauuug

SEQ ID NO: 1027509 - RNA, 19 nt, Human
gcuugccaucccucccucc

SEQ ID NO: 1027510 - RNA, 14 nt, Human
ugagcaaaaguuga

SEQ ID NO: 1027511 - RNA, 17 nt, Human
gacaaaugcuuaugaaa

SEQ ID NO: 1027512 - RNA, 22 nt, Human
acuucacuuuuuuucuuuucuc

SEQ ID NO: 1027513 - RNA, 17 nt, Human
uaucaauuuaaaaaaaa

SEQ ID NO: 1027514 - RNA, 15 nt, Human
guugccaaggcugga

SEQ ID NO: 1027515 - RNA, 14 nt, Human
aagggucucccucu

SEQ ID NO: 1027516 - RNA, 14 nt, Human
acuaaaaauacaaa

SEQ ID NO: 1027517 - RNA, 16 nt, Human
uauauguguuuuucac

SEQ ID NO: 1027518 - RNA, 15 nt, Human
augagaccacuguua

SEQ ID NO: 1027519 - RNA, 14 nt, Human
aacagaagcuucca

SEQ ID NO: 1027520 - RNA, 13 nt, Human
aaaaaauaaaaau

SEQ ID NO: 1027521 - RNA, 17 nt, Human
ccagcaguucagagcug

SEQ ID NO: 1027522 - RNA, 15 nt, Human
aaaauggguuuuacu

SEQ ID NO: 1027523 - RNA, 18 nt, Human
uggaauauguaaauagaa

SEQ ID NO: 1027524 - RNA, 14 nt, Human
augaaccuuuacau

SEQ ID NO: 1027525 - RNA, 21 nt, Human
gaagugaaaaucuacacucca

SEQ ID NO: 1027526 - RNA, 16 nt, Human
ugacaagguucuuccc

SEQ ID NO: 1027527 - RNA, 15 nt, Human
ucaaccaaauggagu

SEQ ID NO: 1027528 - RNA, 17 nt, Human
ucuccuguacuuuuucc

SEQ ID NO: 1027529 - RNA, 14 nt, Human
cacuguuaucaaaa

SEQ ID NO: 1027530 - RNA, 21 nt, Human
acuugggcgggacacaggcuc

SEQ ID NO: 1027531 - RNA, 14 nt, Human
aacucaguuuuaac

SEQ ID NO: 1027532 - RNA, 20 nt, Human
aaaguaacucauuuguuaaa

SEQ ID NO: 1027533 - RNA, 23 nt, Human
aaauuuacagagacagaaagcag

SEQ ID NO: 1027534 - RNA, 15 nt, Human
caaauucuguuucuu

SEQ ID NO: 1027535 - RNA, 21 nt, Human
cccugcagacaugagagacag

SEQ ID NO: 1027536 - RNA, 23 nt, Human
ugagcaccugcaggcgugaccug

SEQ ID NO: 1027537 - RNA, 14 nt, Human
cagugucaggagga

SEQ ID NO: 1027538 - RNA, 17 nt, Human
cauggagguuaagcacu

SEQ ID NO: 1027539 - RNA, 23 nt, Human
caguucauauguaccauguacau

SEQ ID NO: 1027540 - RNA, 21 nt, Human
auugaaaugacuaaaaaacaa

SEQ ID NO: 1027541 - RNA, 15 nt, Human
ggauagagugggaca

SEQ ID NO: 1027542 - RNA, 17 nt, Human
uccuacaagcuaaaauu

SEQ ID NO: 1027543 - RNA, 21 nt, Human
cagcauuuuacuacuuuaaaa

SEQ ID NO: 1027544 - RNA, 20 nt, Human
guaucaaaagaaagaaaauc

SEQ ID NO: 1027545 - RNA, 15 nt, Human
gugcaggcagcagga

SEQ ID NO: 1027546 - RNA, 15 nt, Human
gaugcacuuuauauu

SEQ ID NO: 1027547 - RNA, 10 nt, Human
uguguauuuu

SEQ ID NO: 1027548 - RNA, 21 nt, Human
ucucagaaauuguaucuuagu

SEQ ID NO: 1027549 - RNA, 20 nt, Human
auugguuuaccugugaaaua

SEQ ID NO: 1027550 - RNA, 15 nt, Human
uccaagccucauguc

SEQ ID NO: 1027551 - RNA, 17 nt, Human
gagauaucccaggaaaa

SEQ ID NO: 1027552 - RNA, 21 nt, Human
cggccugauuaaaguuaaaua

SEQ ID NO: 1027553 - RNA, 15 nt, Human
ucucauccugcaggc

SEQ ID NO: 1027554 - RNA, 23 nt, Human
caucauaaaauaaaguauauaua

SEQ ID NO: 1027555 - RNA, 17 nt, Human
aaauaaagaauuuuaaa

SEQ ID NO: 1027556 - RNA, 16 nt, Human
auaaaaugagcaaaag

SEQ ID NO: 1027557 - RNA, 17 nt, Human
ucagaccauaauguuac

SEQ ID NO: 1027558 - RNA, 18 nt, Human
acagcuucucauccugca

SEQ ID NO: 1027559 - RNA, 23 nt, Human
ucauauaauaaauguacauuaau

SEQ ID NO: 1027560 - RNA, 17 nt, Human
aagcccaauauuauaau

SEQ ID NO: 1027561 - RNA, 13 nt, Human
uuuuuuacuuccu

SEQ ID NO: 1027562 - RNA, 21 nt, Human
gugacauguuuacaaaccuca

SEQ ID NO: 1027563 - RNA, 16 nt, Human
cagcugccuccccucc

SEQ ID NO: 1027564 - RNA, 14 nt, Human
uaucuuguuuuucc

SEQ ID NO: 1027565 - RNA, 13 nt, Human
gcuugccaucccu

SEQ ID NO: 1027566 - RNA, 20 nt, Human
auuauaauuuuuuucaauau

SEQ ID NO: 1027567 - RNA, 19 nt, Human
aguucagagcugcccucuc

SEQ ID NO: 1027568 - RNA, 16 nt, Human
aaucauuuuaauuauu

SEQ ID NO: 1027569 - RNA, 20 nt, Human
cuuaacucauugcaaccucc

SEQ ID NO: 1027570 - RNA, 17 nt, Human
aauaaguauuuauaaua

SEQ ID NO: 1027571 - RNA, 16 nt, Human
auuucuauuuauuuac

SEQ ID NO: 1027572 - RNA, 15 nt, Human
uaucuaauauauaug

SEQ ID NO: 1027573 - RNA, 18 nt, Human
uucuagcuguugagcugu

SEQ ID NO: 1027574 - RNA, 16 nt, Human
auaauguuguuauuua

SEQ ID NO: 1027575 - RNA, 20 nt, Human
ggcaggucacacaaccuguc

SEQ ID NO: 1027576 - RNA, 18 nt, Human
uguuauuuuuuaauuauu

SEQ ID NO: 1027577 - RNA, 23 nt, Human
uugauagcaagugaauuuuucuc

SEQ ID NO: 1027578 - RNA, 22 nt, Human
caucccucccuccaccucccug

SEQ ID NO: 1027579 - RNA, 20 nt, Human
aaacagaacuauggaaaaaa

SEQ ID NO: 1027580 - RNA, 23 nt, Human
ggaggcagagguugcagugagcc

SEQ ID NO: 1027581 - RNA, 14 nt, Human
gaaacauuacaguu

SEQ ID NO: 1027582 - RNA, 12 nt, Human
uuuuuguaaguu

SEQ ID NO: 1027583 - RNA, 14 nt, Human
guuaagcaacaucu

SEQ ID NO: 1027584 - RNA, 22 nt, Human
cuccugggcagcugccuccccu

SEQ ID NO: 1027585 - RNA, 15 nt, Human
agccugaaagaggaa

SEQ ID NO: 1027586 - RNA, 17 nt, Human
cauucaaaaguugaaau

SEQ ID NO: 1027587 - RNA, 16 nt, Human
gcuugccugcaggcau

SEQ ID NO: 1027588 - RNA, 19 nt, Human
auaaugaaauaacuaggcg

SEQ ID NO: 1027589 - RNA, 22 nt, Human
uuauuuauaacaaccuaaauuu

SEQ ID NO: 1027590 - RNA, 21 nt, Human
uuuauaauagcaacuuuugug

SEQ ID NO: 1027591 - RNA, 20 nt, Human
uuccugaccuaugaaacaga

SEQ ID NO: 1027592 - RNA, 20 nt, Human
ccaccuucuggguucaagcg

SEQ ID NO: 1027593 - RNA, 16 nt, Human
ucaaagccaaguuuau

SEQ ID NO: 1027594 - RNA, 16 nt, Human
aacucuuaaucaaaua

SEQ ID NO: 1027595 - RNA, 21 nt, Human
aauuaggcaaggcuaugugau

SEQ ID NO: 1027596 - RNA, 21 nt, Human
cauuuuacuacuuuaaaaaaa

SEQ ID NO: 1027597 - RNA, 15 nt, Human
gauuccugagccagu

SEQ ID NO: 1027598 - RNA, 16 nt, Human
acuuaaaaucuaauuc

SEQ ID NO: 1027599 - RNA, 17 nt, Human
gaaagaagcccaauauu

SEQ ID NO: 1027600 - RNA, 23 nt, Human
auaucuuuuuuuuaauaaaccau

SEQ ID NO: 1027601 - RNA, 18 nt, Human
gaaaacauagcaucucag

SEQ ID NO: 1027602 - RNA, 21 nt, Human
uggcuuaaaauguaauuaauc

SEQ ID NO: 1027603 - RNA, 23 nt, Human
augaaacuaagauuuguaauauu

SEQ ID NO: 1027604 - RNA, 12 nt, Human
cauuugcugagc

SEQ ID NO: 1027605 - RNA, 23 nt, Human
ccagccugggugacagagcaaga

SEQ ID NO: 1027606 - RNA, 18 nt, Human
ugcuggauucaagugauc

SEQ ID NO: 1027607 - RNA, 19 nt, Human
gguauuuauugagcaccug

SEQ ID NO: 1027608 - RNA, 14 nt, Human
acucagaaauuuaa

SEQ ID NO: 1027609 - RNA, 16 nt, Human
auuuuaaguaauuuca

SEQ ID NO: 1027610 - RNA, 12 nt, Human
uauucacaagac

SEQ ID NO: 1027611 - RNA, 21 nt, Human
agauacugaauguaaacaaag

SEQ ID NO: 1027612 - RNA, 18 nt, Human
cugcagacaugagagaca

SEQ ID NO: 1027613 - RNA, 22 nt, Human
agugucuuacagagaaaagaca

SEQ ID NO: 1027614 - RNA, 21 nt, Human
auauuuauaacucaucauaaa

SEQ ID NO: 1027615 - RNA, 11 nt, Human
uauuauuuaua

SEQ ID NO: 1027616 - RNA, 11 nt, Human
aaauauauuua

SEQ ID NO: 1027617 - RNA, 13 nt, Human
aaaaaugguuuaa

SEQ ID NO: 1027618 - RNA, 14 nt, Human
aaauaaaagcacuu

SEQ ID NO: 1027619 - RNA, 20 nt, Human
cccugcacuccagccugagc

SEQ ID NO: 1027620 - RNA, 15 nt, Human
cagacagaacuugaa

SEQ ID NO: 1027621 - RNA, 13 nt, Human
gcugcccucuccu

SEQ ID NO: 1027622 - RNA, 20 nt, Human
ccauuguggucacaggaagu

SEQ ID NO: 1027623 - RNA, 14 nt, Human
aauggcuaagcaaa

SEQ ID NO: 1027624 - RNA, 15 nt, Human
auaucuauuaauaua

SEQ ID NO: 1027625 - RNA, 23 nt, Human
ccaccucccugcaauaaaauggg

SEQ ID NO: 1027626 - RNA, 20 nt, Human
aauucuaaaugaauguuuac

SEQ ID NO: 1027627 - RNA, 13 nt, Human
uaaguaauuucag

SEQ ID NO: 1027628 - RNA, 16 nt, Human
auaucuauuaauauau

SEQ ID NO: 1027629 - RNA, 15 nt, Human
aaucuaaaucuauuu

SEQ ID NO: 1027630 - RNA, 20 nt, Human
gcuggaauugaauucccugc

SEQ ID NO: 1027631 - RNA, 17 nt, Human
auaguguuggaaaaugu

SEQ ID NO: 1027632 - RNA, 16 nt, Human
auucugcaagcuuuuc

SEQ ID NO: 1027633 - RNA, 18 nt, Human
cauaguaccaaucauuuu

SEQ ID NO: 1027634 - RNA, 21 nt, Human
caaucugaggccuccucucuc

SEQ ID NO: 1027635 - RNA, 20 nt, Human
ucuucauagcagauuuuaau

SEQ ID NO: 1027636 - RNA, 19 nt, Human
uuuaugcauacaguaauuu

SEQ ID NO: 1027637 - RNA, 18 nt, Human
aauagcagacaguguuuu

SEQ ID NO: 1027638 - RNA, 15 nt, Human
acagaagcuuccauu

SEQ ID NO: 1027639 - RNA, 21 nt, Human
uacauaagggaggaaaaaaaa

SEQ ID NO: 1027640 - RNA, 19 nt, Human
uacugagccuuguaauucu

SEQ ID NO: 1027641 - RNA, 22 nt, Human
uuauaaucuuuuauacaguguc

SEQ ID NO: 1027642 - RNA, 18 nt, Human
ugcugccucuaaaaggcc

SEQ ID NO: 1027643 - RNA, 17 nt, Human
uggcuaagcaaaaugug

SEQ ID NO: 1027644 - RNA, 14 nt, Human
uaguuucccuugca

SEQ ID NO: 1027645 - RNA, 23 nt, Human
ugccucuaaaaggccugucccug

SEQ ID NO: 1027646 - RNA, 18 nt, Human
gagaccacuguuaucaaa

SEQ ID NO: 1027647 - RNA, 14 nt, Human
ggaguuccuaacca

SEQ ID NO: 1027648 - RNA, 21 nt, Human
uuauaauauacuauauuuaug

SEQ ID NO: 1027649 - RNA, 14 nt, Human
uuuuaauuauuauu

SEQ ID NO: 1027650 - RNA, 15 nt, Human
agccgggcauggugg

SEQ ID NO: 1027651 - RNA, 21 nt, Human
aaugacacuagcuaauaucaa

SEQ ID NO: 1027652 - RNA, 14 nt, Human
uaaacaaaggaauu

SEQ ID NO: 1027653 - RNA, 21 nt, Human
uccugagaccagccaaccugg

SEQ ID NO: 1027654 - RNA, 13 nt, Human
caaauuuguauuu

SEQ ID NO: 1027655 - RNA, 22 nt, Human
gaguggcgcgcgccaccacgcc

SEQ ID NO: 1027656 - RNA, 23 nt, Human
aguucugucuggacuuuccagag

SEQ ID NO: 1027657 - RNA, 14 nt, Human
agccagcaguucag

SEQ ID NO: 1027658 - RNA, 22 nt, Human
gaagaguggguuucacaaguga

SEQ ID NO: 1027659 - RNA, 20 nt, Human
ugagaacugcauauguuucg

SEQ ID NO: 1027660 - RNA, 15 nt, Human
ggucucgaacugcug

SEQ ID NO: 1027661 - RNA, 21 nt, Human
gaaacagagaaaauaaaagca

SEQ ID NO: 1027662 - RNA, 20 nt, Human
aagaaauucugcaagcuuuu

SEQ ID NO: 1027663 - RNA, 14 nt, Human
aaguagaauaaaca

SEQ ID NO: 1027664 - RNA, 15 nt, Human
uuauacagugucuua

SEQ ID NO: 1027665 - RNA, 20 nt, Human
uuuauaacucaucauaaaau

SEQ ID NO: 1027666 - RNA, 16 nt, Human
ggcagcugccuccccu

SEQ ID NO: 1027667 - RNA, 14 nt, Human
uuauuuuuuaagua

SEQ ID NO: 1027668 - RNA, 22 nt, Human
auuacaggcgugagccaccaaa

SEQ ID NO: 1027669 - RNA, 13 nt, Human
gguggguggggca

SEQ ID NO: 1027670 - RNA, 15 nt, Human
cagugucaggaggaa

SEQ ID NO: 1027671 - RNA, 20 nt, Human
ucucuccuguacuuuuucca

SEQ ID NO: 1027672 - RNA, 17 nt, Human
auuucaugaaaagauua

SEQ ID NO: 1027673 - RNA, 14 nt, Human
caaggcuagaacca

SEQ ID NO: 1027674 - RNA, 19 nt, Human
uuaaacaaaaaaagcauug

SEQ ID NO: 1027675 - RNA, 16 nt, Human
agauaaagauuucuug

SEQ ID NO: 1027676 - RNA, 16 nt, Human
caaccuaaauuugguu

SEQ ID NO: 1027677 - RNA, 18 nt, Human
uuuuuaauuauuauuuau

SEQ ID NO: 1027678 - RNA, 15 nt, Human
uauaauuuuuuucaa

SEQ ID NO: 1027679 - RNA, 15 nt, Human
ccucuaaaaggccug

SEQ ID NO: 1027680 - RNA, 15 nt, Human
acuucauuuaaaaua

SEQ ID NO: 1027681 - RNA, 22 nt, Human
caagacucugucucaaaaaaua

SEQ ID NO: 1027682 - RNA, 18 nt, Human
uguggucacaggaaguag

SEQ ID NO: 1027683 - RNA, 16 nt, Human
agugauccgcccaucu

SEQ ID NO: 1027684 - RNA, 12 nt, Human
uuguuuuuccac

SEQ ID NO: 1027685 - RNA, 19 nt, Human
aauuaauggaauauguaaa

SEQ ID NO: 1027686 - RNA, 13 nt, Human
uuaugaaacauua

SEQ ID NO: 1027687 - RNA, 15 nt, Human
aaagcguaaagagga

SEQ ID NO: 1027688 - RNA, 13 nt, Human
uugcaaccuccac

SEQ ID NO: 1027689 - RNA, 14 nt, Human
uugaggacuugggc

SEQ ID NO: 1027690 - RNA, 12 nt, Human
aauuuuucucua

SEQ ID NO: 1027691 - RNA, 12 nt, Human
guguauauuuuu

SEQ ID NO: 1027692 - RNA, 21 nt, Human
auaauuuuuuucaauauuuau

SEQ ID NO: 1027693 - RNA, 14 nt, Human
auuuaaaauauuuu

SEQ ID NO: 1027694 - RNA, 14 nt, Human
gccagcaguucaga

SEQ ID NO: 1027695 - RNA, 13 nt, Human
gcuugccugcagg

SEQ ID NO: 1027696 - RNA, 15 nt, Human
gucaaugcagccccc

SEQ ID NO: 1027697 - RNA, 21 nt, Human
gccugauuaaaguuaaauaaa

SEQ ID NO: 1027698 - RNA, 20 nt, Human
ugagaccacuguuaucaaaa

SEQ ID NO: 1027699 - RNA, 16 nt, Human
caccuguaaucccagc

SEQ ID NO: 1027700 - RNA, 23 nt, Human
cauucucucuccuguacuuuuuc

SEQ ID NO: 1027701 - RNA, 15 nt, Human
uaaauaaauguaucu

SEQ ID NO: 1027702 - RNA, 22 nt, Human
uacucugaagggcaucaugcau

SEQ ID NO: 1027703 - RNA, 13 nt, Human
gguauuugagugu

SEQ ID NO: 1027704 - RNA, 22 nt, Human
uuuuuccccaaaaagaauggga

SEQ ID NO: 1027705 - RNA, 9 nt, Human
uccucugcu

SEQ ID NO: 1027706 - RNA, 23 nt, Human
cagacuuuuuuuuuuuuuuaaac

SEQ ID NO: 1027707 - RNA, 13 nt, Human
aaaaagccaaaaa

SEQ ID NO: 1027708 - RNA, 15 nt, Human
cugcacuccagccug

SEQ ID NO: 1027709 - RNA, 16 nt, Human
gacaaccaugagacca

SEQ ID NO: 1027710 - RNA, 20 nt, Human
ugcuugccaucccucccucc

SEQ ID NO: 1027711 - RNA, 21 nt, Human
ucaugccccuguacuccagcc

SEQ ID NO: 1027712 - RNA, 16 nt, Human
augcauacaguaauuu

SEQ ID NO: 1027713 - RNA, 16 nt, Human
gcugccuccccuccuc

SEQ ID NO: 1027714 - RNA, 16 nt, Human
uuacagagaaaagaca

SEQ ID NO: 1027715 - RNA, 18 nt, Human
cagagcugcccucuccug

SEQ ID NO: 1027716 - RNA, 12 nt, Human
aguuuuccuucu

SEQ ID NO: 1027717 - RNA, 18 nt, Human
auuaugaucucagaaauu

SEQ ID NO: 1027718 - RNA, 15 nt, Human
aaauacaaaaauuag

SEQ ID NO: 1027719 - RNA, 17 nt, Human
agugauuaccagggacu

SEQ ID NO: 1027720 - RNA, 15 nt, Human
uuuccaaauucacaa

SEQ ID NO: 1027721 - RNA, 22 nt, Human
ugauuuuacggagauaucccag

SEQ ID NO: 1027722 - RNA, 14 nt, Human
uacaguaauuuuaa

SEQ ID NO: 1027723 - RNA, 13 nt, Human
acaugaagaagcu

SEQ ID NO: 1027724 - RNA, 17 nt, Human
auuuuaauuauuauucu

SEQ ID NO: 1027725 - RNA, 21 nt, Human
auuuauauauuuauaacucau

SEQ ID NO: 1027726 - RNA, 19 nt, Human
cuacuugggaggcugaggc

SEQ ID NO: 1027727 - RNA, 14 nt, Human
aagacuaugaggaa

SEQ ID NO: 1027728 - RNA, 18 nt, Human
agaaauaugcacaauagc

SEQ ID NO: 1027729 - RNA, 14 nt, Human
augaaacauuacag

SEQ ID NO: 1027730 - RNA, 13 nt, Human
gcucuggaaacca

SEQ ID NO: 1027731 - RNA, 13 nt, Human
agcugccuccccu

SEQ ID NO: 1027732 - RNA, 13 nt, Human
gcgugcaggcagc

SEQ ID NO: 1027733 - RNA, 18 nt, Human
gcuugaggacuugggcgg

SEQ ID NO: 1027734 - RNA, 13 nt, Human
cuauggaaaaaaa

SEQ ID NO: 1027735 - RNA, 11 nt, Human
augcugccaau

SEQ ID NO: 1027736 - RNA, 13 nt, Human
cuauuuaaagaca

SEQ ID NO: 1027737 - RNA, 13 nt, Human
auacuauccaguu

SEQ ID NO: 1027738 - RNA, 20 nt, Human
aaauguuauuuuuuaauuau

SEQ ID NO: 1027739 - RNA, 15 nt, Human
guuuccuagcgcagc

SEQ ID NO: 1027740 - RNA, 23 nt, Human
auuaauggaauauguaaauagaa

SEQ ID NO: 1027741 - RNA, 14 nt, Human
auuggacuuaaaau

SEQ ID NO: 1027742 - RNA, 16 nt, Human
aucaaauaaguauuua

SEQ ID NO: 1027743 - RNA, 22 nt, Human
acagagaaaauaaaagcacuua

SEQ ID NO: 1027744 - RNA, 10 nt, Human
accugagccc

SEQ ID NO: 1027745 - RNA, 16 nt, Human
uaugugcaauaaaaug

SEQ ID NO: 1027746 - RNA, 14 nt, Human
aaccugagccccaa

SEQ ID NO: 1027747 - RNA, 18 nt, Human
ucacacaaccugucccag

SEQ ID NO: 1027748 - RNA, 14 nt, Human
aucaccaaggcuga

SEQ ID NO: 1027749 - RNA, 22 nt, Human
augugcaauaugugauguggca

SEQ ID NO: 1027750 - RNA, 20 nt, Human
aacuaauagaauuaauggaa

SEQ ID NO: 1027751 - RNA, 14 nt, Human
cccucuccugggca

SEQ ID NO: 1027752 - RNA, 14 nt, Human
cagcagagacgggg

SEQ ID NO: 1027753 - RNA, 15 nt, Human
auuuguuuguauuuu

SEQ ID NO: 1027754 - RNA, 14 nt, Human
gagccagugucagg

SEQ ID NO: 1027755 - RNA, 13 nt, Human
uuugguucuaaua

SEQ ID NO: 1027756 - RNA, 14 nt, Human
uguuguuauuuaaa

SEQ ID NO: 1027757 - RNA, 15 nt, Human
cgacaguuuuccuuc

SEQ ID NO: 1027758 - RNA, 22 nt, Human
ugaauggcuaagcaaaauguga

SEQ ID NO: 1027759 - RNA, 15 nt, Human
auuaucaauaucuaa

SEQ ID NO: 1027760 - RNA, 14 nt, Human
uaguaucaaaagaa

SEQ ID NO: 1027761 - RNA, 19 nt, Human
aagacucuacccauauuac

SEQ ID NO: 1027762 - RNA, 22 nt, Human
cuaauugaaucccuuaaacuca

SEQ ID NO: 1027763 - RNA, 14 nt, Human
uugacccacaagaa

SEQ ID NO: 1027764 - RNA, 22 nt, Human
uagcagacaguguuuucuggga

SEQ ID NO: 1027765 - RNA, 15 nt, Human
acaaccugucccagc

SEQ ID NO: 1027766 - RNA, 18 nt, Human
auaauguuguuauuuaaa

SEQ ID NO: 1027767 - RNA, 16 nt, Human
agacaccaccacccuu

SEQ ID NO: 1027768 - RNA, 22 nt, Human
ucuacuaaaaauacaaaaaaaa

SEQ ID NO: 1027769 - RNA, 23 nt, Human
uccuuaucacugacacaaaaagu

SEQ ID NO: 1027770 - RNA, 22 nt, Human
aaaagauuaugaucucagaaau

SEQ ID NO: 1027771 - RNA, 16 nt, Human
auuuaacauuauuuau

SEQ ID NO: 1027772 - RNA, 16 nt, Human
aauaucuauuaauaua

SEQ ID NO: 1027773 - RNA, 15 nt, Human
auaucaauuuaaaaa

SEQ ID NO: 1027774 - RNA, 15 nt, Human
gcuguugagcuguuu

SEQ ID NO: 1027775 - RNA, 23 nt, Human
gcuauucacaaccacucauucaa

SEQ ID NO: 1027776 - RNA, 23 nt, Human
aucaccaaggcugauuaaaccaa

SEQ ID NO: 1027777 - RNA, 23 nt, Human
cugcccucuccugggcagcugcc

SEQ ID NO: 1027778 - RNA, 22 nt, Human
ucuccagagggaauugcagagu

SEQ ID NO: 1027779 - RNA, 23 nt, Human
auacuucauuuaaaauauuuuua

SEQ ID NO: 1027780 - RNA, 20 nt, Human
auaagccagacaucaacaga

SEQ ID NO: 1027781 - RNA, 13 nt, Human
uauuuauuaauau

SEQ ID NO: 1027782 - RNA, 13 nt, Human
uuuauauuauuuu

SEQ ID NO: 1027783 - RNA, 15 nt, Human
uuuauacagugucuu

SEQ ID NO: 1027784 - RNA, 20 nt, Human
accucccugcaauaaaaugg

SEQ ID NO: 1027785 - RNA, 16 nt, Human
gauaaacucagaaauu

SEQ ID NO: 1027786 - RNA, 17 nt, Human
caagaaugagaagaaug

SEQ ID NO: 1027787 - RNA, 19 nt, Human
uaauuccuauauccuguga

SEQ ID NO: 1027788 - RNA, 20 nt, Human
acuccagugagacagcucug

SEQ ID NO: 1027789 - RNA, 21 nt, Human
auugcuuguuagcaaaaugga

SEQ ID NO: 1027790 - RNA, 15 nt, Human
ucuaaaucuauuuau

SEQ ID NO: 1027791 - RNA, 13 nt, Human
aauuucaugaaaa

SEQ ID NO: 1027792 - RNA, 14 nt, Human
ggcagcugccuccc

SEQ ID NO: 1027793 - RNA, 14 nt, Human
gagccaccaaaccc

SEQ ID NO: 1027794 - RNA, 22 nt, Human
uccaaacuggagcuugaaauag

SEQ ID NO: 1027795 - RNA, 12 nt, Human
ugaugaaaacau

SEQ ID NO: 1027796 - RNA, 12 nt, Human
acaagaaaugaa

SEQ ID NO: 1027797 - RNA, 18 nt, Human
gaaacguguauauuuuuu

SEQ ID NO: 1027798 - RNA, 13 nt, Human
uaucuauuaauau

SEQ ID NO: 1027799 - RNA, 19 nt, Human
gugucuggcacuugggaca

SEQ ID NO: 1027800 - RNA, 21 nt, Human
ugccuguaaucacagcuacuu

SEQ ID NO: 1027801 - RNA, 23 nt, Human
acaaauacucuuaggaagagaaa

SEQ ID NO: 1027802 - RNA, 19 nt, Human
gcaccugcaggcgugaccu

SEQ ID NO: 1027803 - RNA, 20 nt, Human
uaugugaaauaaaaguagaa

SEQ ID NO: 1027804 - RNA, 16 nt, Human
acuacuuuaaaaaaaa

SEQ ID NO: 1027805 - RNA, 21 nt, Human
caauucuauuacgugcaauac

SEQ ID NO: 1027806 - RNA, 13 nt, Human
acuguuugccuuc

SEQ ID NO: 1027807 - RNA, 20 nt, Human
uucuguaaucuucagaccua

SEQ ID NO: 1027808 - RNA, 16 nt, Human
agccgagccucaagau

SEQ ID NO: 1027809 - RNA, 13 nt, Human
uuaggcuauucac

SEQ ID NO: 1027810 - RNA, 15 nt, Human
cagacaguguuuucu

SEQ ID NO: 1027811 - RNA, 20 nt, Human
auuaauauauguauuauuua

SEQ ID NO: 1027812 - RNA, 21 nt, Human
gaaagcagggacuugaaccca

SEQ ID NO: 1027813 - RNA, 13 nt, Human
cugcacuccagcc

SEQ ID NO: 1027814 - RNA, 15 nt, Human
acgaaauguuauuuu

SEQ ID NO: 1027815 - RNA, 13 nt, Human
uguaacuuaugaa

SEQ ID NO: 1027816 - RNA, 24 nt, Human
uuaaacaaaaaaagcauuguaacu

SEQ ID NO: 1027817 - RNA, 15 nt, Human
gggcuugaggacuug

SEQ ID NO: 1027818 - RNA, 13 nt, Human
acaagaaaugaaa

SEQ ID NO: 1027819 - RNA, 22 nt, Human
uaaacuggaaauaaaagauugu

SEQ ID NO: 1027820 - RNA, 15 nt, Human
uuccuucucaucugu

SEQ ID NO: 1027821 - RNA, 13 nt, Human
uauauauagaauc

SEQ ID NO: 1027822 - RNA, 18 nt, Human
ccuguaaucccagcuacu

SEQ ID NO: 1027823 - RNA, 23 nt, Human
ccagcacuuugggaggcugaggc

SEQ ID NO: 1027824 - RNA, 15 nt, Human
aaacauccagauaca

SEQ ID NO: 1027825 - RNA, 11 nt, Human
aauauuauaau

SEQ ID NO: 1027826 - RNA, 17 nt, Human
acaaguccagccuggca

SEQ ID NO: 1027827 - RNA, 20 nt, Human
ugauccgcccaucuccgucu

SEQ ID NO: 1027828 - RNA, 16 nt, Human
cuguacuccagccugg

SEQ ID NO: 1027829 - RNA, 15 nt, Human
uacccuuugaaaaag

SEQ ID NO: 1027830 - RNA, 21 nt, Human
aaaagguauuuuaaucaccaa

SEQ ID NO: 1027831 - RNA, 15 nt, Human
uauaauauacuauau

SEQ ID NO: 1027832 - RNA, 21 nt, Human
ccagcaguucagagcugcccu

SEQ ID NO: 1027833 - RNA, 14 nt, Human
cugagcauguacug

SEQ ID NO: 1027834 - RNA, 13 nt, Human
auguggcuguauc

SEQ ID NO: 1027835 - RNA, 17 nt, Human
cuuuuuuuuuuuuucuu

SEQ ID NO: 1027836 - RNA, 13 nt, Human
aauuaaucuugua

SEQ ID NO: 1027837 - RNA, 21 nt, Human
uucacaagugaaaaacaucca

SEQ ID NO: 1027838 - RNA, 19 nt, Human
ccuguaaucauauaauaaa

SEQ ID NO: 1027839 - RNA, 13 nt, Human
auagcauauguuu

SEQ ID NO: 1027840 - RNA, 15 nt, Human
gacaguauggcagcu

SEQ ID NO: 1027841 - RNA, 22 nt, Human
gccaucccucccuccaccuccc

SEQ ID NO: 1027842 - RNA, 17 nt, Human
ugaaaagauuaugaucu

SEQ ID NO: 1027843 - RNA, 15 nt, Human
uaaaaugagcaaaag

SEQ ID NO: 1027844 - RNA, 14 nt, Human
uaagcuguuuuuau

SEQ ID NO: 1027845 - RNA, 12 nt, Human
uccugcaggcag

SEQ ID NO: 1027846 - RNA, 23 nt, Human
caaagcaugggccuagcccacug

SEQ ID NO: 1027847 - RNA, 16 nt, Human
gucccagccagcaguu

SEQ ID NO: 1027848 - RNA, 15 nt, Human
uguaccauguacaug

SEQ ID NO: 1027849 - RNA, 13 nt, Human
uucuaggccgggc

SEQ ID NO: 1027850 - RNA, 18 nt, Human
acugagcuucucugugaa

SEQ ID NO: 1027851 - RNA, 16 nt, Human
ugaaguacucauacau

SEQ ID NO: 1027852 - RNA, 19 nt, Human
auuguauuuuaguaagaga

SEQ ID NO: 1027853 - RNA, 13 nt, Human
cuugucucugggc

SEQ ID NO: 1027854 - RNA, 17 nt, Human
ugugcaauaugugaugu

SEQ ID NO: 1027855 - RNA, 22 nt, Human
gaaaauguguauuuuauuacau

SEQ ID NO: 1027856 - RNA, 11 nt, Human
uuguuuuucca

SEQ ID NO: 1027857 - RNA, 14 nt, Human
cagcugccuccccu

SEQ ID NO: 1027858 - RNA, 17 nt, Human
aaauguucaucaaugaa

SEQ ID NO: 1027859 - RNA, 21 nt, Human
accaccugccuauauuuuuug

SEQ ID NO: 1027860 - RNA, 22 nt, Human
uguuugccuucuacuuuuaagu

SEQ ID NO: 1027861 - RNA, 14 nt, Human
aauaaaauggguuu

SEQ ID NO: 1027862 - RNA, 18 nt, Human
cacuuuuggcuuguaaag

SEQ ID NO: 1027863 - RNA, 17 nt, Human
caacauggugaaacccc

SEQ ID NO: 1027864 - RNA, 21 nt, Human
uucgcugauauauguguuuuu

SEQ ID NO: 1027865 - RNA, 21 nt, Human
cuaaaucuauuuauuaauauu

SEQ ID NO: 1027866 - RNA, 18 nt, Human
acucuaggacauaaauua

SEQ ID NO: 1027867 - RNA, 14 nt, Human
gcugccuccccucc

SEQ ID NO: 1027868 - RNA, 16 nt, Human
gaacucaaggaaaucu

SEQ ID NO: 1027869 - RNA, 20 nt, Human
ccugggcagcugccuccccu

SEQ ID NO: 1027870 - RNA, 22 nt, Human
cugaggcauccuuccucacacc

SEQ ID NO: 1027871 - RNA, 20 nt, Human
uccccaaaaagaaugggaug

SEQ ID NO: 1027872 - RNA, 19 nt, Human
cauuuuacuacuuuaaaaa

SEQ ID NO: 1027873 - RNA, 12 nt, Human
cacacagugcuu

SEQ ID NO: 1027874 - RNA, 16 nt, Human
aucauauaauaaaugu

SEQ ID NO: 1027875 - RNA, 13 nt, Human
aagugcugggaau

SEQ ID NO: 1027876 - RNA, 18 nt, Human
cugccuccccuccucugc

SEQ ID NO: 1027877 - RNA, 20 nt, Human
ccaggcauccuccacaauag

SEQ ID NO: 1027878 - RNA, 21 nt, Human
cucaaaacuucagacauagaa

SEQ ID NO: 1027879 - RNA, 14 nt, Human
auacaguaauuuua

SEQ ID NO: 1027880 - RNA, 13 nt, Human
agacagcucugca

SEQ ID NO: 1027881 - RNA, 23 nt, Human
gcuuuuuuuuuuuuucuuaaaga

SEQ ID NO: 1027882 - RNA, 18 nt, Human
caaauauuguugacaacu

SEQ ID NO: 1027883 - RNA, 16 nt, Human
caaccacuucauucuu

SEQ ID NO: 1027884 - RNA, 16 nt, Human
auaauuauaauauacu

SEQ ID NO: 1027885 - RNA, 18 nt, Human
uuuguuaaaugauuucau

SEQ ID NO: 1027886 - RNA, 20 nt, Human
agauuuuuaaauaaagaauu

SEQ ID NO: 1027887 - RNA, 18 nt, Human
auaaauggacaaaugcuu

SEQ ID NO: 1027888 - RNA, 20 nt, Human
ucuugggaauuuucuuccaa

SEQ ID NO: 1027889 - RNA, 18 nt, Human
ucuccuguacuuuuucca

SEQ ID NO: 1027890 - RNA, 12 nt, Human
ggggcucuggga

SEQ ID NO: 1027891 - RNA, 14 nt, Human
ucuugucucugggc

SEQ ID NO: 1027892 - RNA, 15 nt, Human
acaagacccaaaagg

SEQ ID NO: 1027893 - RNA, 12 nt, Human
aucaacaauagu

SEQ ID NO: 1027894 - RNA, 17 nt, Human
uuacagagacagaaagc

SEQ ID NO: 1027895 - RNA, 14 nt, Human
caacaguuuuuuau

SEQ ID NO: 1027896 - RNA, 21 nt, Human
auuuuuaaauaaagaauuuua

SEQ ID NO: 1027897 - RNA, 14 nt, Human
ccugccccugagcc

SEQ ID NO: 1027898 - RNA, 16 nt, Human
gacaaaaacaaacaaa

SEQ ID NO: 1027899 - RNA, 23 nt, Human
ccuucauccucugagugugacca

SEQ ID NO: 1027900 - RNA, 17 nt, Human
uaaaucuauuuauuaau

SEQ ID NO: 1027901 - RNA, 22 nt, Human
uucaauaucuuuuuuuuaauaa

SEQ ID NO: 1027902 - RNA, 21 nt, Human
acuaagauuuguaauauuucu

SEQ ID NO: 1027903 - RNA, 21 nt, Human
ggggagccaacagaagcuucc

SEQ ID NO: 1027904 - RNA, 18 nt, Human
caguauucccuuuugcug

SEQ ID NO: 1027905 - RNA, 15 nt, Human
auuuacugagcuucu

SEQ ID NO: 1027906 - RNA, 19 nt, Human
acaguuagagauuuuuaaa

SEQ ID NO: 1027907 - RNA, 13 nt, Human
uguaauucuaaau

SEQ ID NO: 1027908 - RNA, 20 nt, Human
auaucaguccucuuucaaag

SEQ ID NO: 1027909 - RNA, 11 nt, Human
augugcaauaa

SEQ ID NO: 1027910 - RNA, 16 nt, Human
cuggacuuuccagaga

SEQ ID NO: 1027911 - RNA, 15 nt, Human
aucaaccaaauggag

SEQ ID NO: 1027912 - RNA, 16 nt, Human
uucuggguucaagcga

SEQ ID NO: 1027913 - RNA, 14 nt, Human
uauuuaaagacaaa

SEQ ID NO: 1027914 - RNA, 11 nt, Human
cagcaguucag

SEQ ID NO: 1027915 - RNA, 17 nt, Human
augaucauguauuuauu

SEQ ID NO: 1027916 - RNA, 19 nt, Human
auauugcaaggcaaagacu

SEQ ID NO: 1027917 - RNA, 12 nt, Human
caccuguuuuua

SEQ ID NO: 1027918 - RNA, 16 nt, Human
auaaagaauuuuaaaa

SEQ ID NO: 1027919 - RNA, 12 nt, Human
gcgugcaggcag

SEQ ID NO: 1027920 - RNA, 18 nt, Human
gaagaugcuuguauuuua

SEQ ID NO: 1027921 - RNA, 22 nt, Human
gaaacuaccagcccuacaccau

SEQ ID NO: 1027922 - RNA, 15 nt, Human
cauguacauccaugg

SEQ ID NO: 1027923 - RNA, 16 nt, Human
gcagcugccuccccuc

SEQ ID NO: 1027924 - RNA, 19 nt, Human
ucacgccuguaaucccagc

SEQ ID NO: 1027925 - RNA, 18 nt, Human
cagauagguuaccaguaa

SEQ ID NO: 1027926 - RNA, 16 nt, Human
acuuuaacacaguguc

SEQ ID NO: 1027927 - RNA, 17 nt, Human
uauugcugaaugacuac

SEQ ID NO: 1027928 - RNA, 21 nt, Human
acaugagguacugagagugaa

SEQ ID NO: 1027929 - RNA, 18 nt, Human
auagaaacguguauauuu

SEQ ID NO: 1027930 - RNA, 16 nt, Human
ugguagggggaaaaug

SEQ ID NO: 1027931 - RNA, 16 nt, Human
uuagagauuuuuaaau

SEQ ID NO: 1027932 - RNA, 22 nt, Human
gucucccucuguugccaaggcu

SEQ ID NO: 1027933 - RNA, 14 nt, Human
uaucauuuucaaaa

SEQ ID NO: 1027934 - RNA, 20 nt, Human
agcagagacgggguuugcca

SEQ ID NO: 1027935 - RNA, 19 nt, Human
agcuugaaauagugucuga

SEQ ID NO: 1027936 - RNA, 16 nt, Human
uuaaauauaauaugca

SEQ ID NO: 1027937 - RNA, 20 nt, Human
acuaauagaauuaauggaau

SEQ ID NO: 1027938 - RNA, 17 nt, Human
uuucugcuuuaauuuca

SEQ ID NO: 1027939 - RNA, 14 nt, Human
uuaauuauuauuua

SEQ ID NO: 1027940 - RNA, 17 nt, Human
augcauacaguaauuuu

SEQ ID NO: 1027941 - RNA, 11 nt, Human
aauugcagagu

SEQ ID NO: 1027942 - RNA, 13 nt, Human
agcuguggccagc

SEQ ID NO: 1027943 - RNA, 14 nt, Human
uacuuuguccuuuu

SEQ ID NO: 1027944 - RNA, 23 nt, Human
uaguaccaaucauuuuaauuauu

SEQ ID NO: 1027945 - RNA, 16 nt, Human
ugacacuuaaaaaugg

SEQ ID NO: 1027946 - RNA, 20 nt, Human
guuuaugcauacaguaauuu

SEQ ID NO: 1027947 - RNA, 12 nt, Human
auauuauaauuu

SEQ ID NO: 1027948 - RNA, 19 nt, Human
gcauccuuccucacaccag

SEQ ID NO: 1027949 - RNA, 17 nt, Human
aauauuuuuaugugcaa

SEQ ID NO: 1027950 - RNA, 21 nt, Human
ccuccaccucccugcaauaaa

SEQ ID NO: 1027951 - RNA, 19 nt, Human
acagugauuaccagggacu

SEQ ID NO: 1027952 - RNA, 19 nt, Human
agggaauugcagaguacug

SEQ ID NO: 1027953 - RNA, 18 nt, Human
aggugacccugaugaaaa

SEQ ID NO: 1027954 - RNA, 16 nt, Human
ggcagcuuuuucucuc

SEQ ID NO: 1027955 - RNA, 17 nt, Human
gugacuguacccaaaug

SEQ ID NO: 1027956 - RNA, 19 nt, Human
auuacagaugggcaaauua

SEQ ID NO: 1027957 - RNA, 17 nt, Human
uguuaucagucauaacu

SEQ ID NO: 1027958 - RNA, 19 nt, Human
accugucccagcgagggac

SEQ ID NO: 1027959 - RNA, 14 nt, Human
aaaaucaaauucca

SEQ ID NO: 1027960 - RNA, 18 nt, Human
ucuauuaggaaauauucu

SEQ ID NO: 1027961 - RNA, 22 nt, Human
auuaugaucucagaaauuguau

SEQ ID NO: 1027962 - RNA, 14 nt, Human
agaagaaugacuau

SEQ ID NO: 1027963 - RNA, 14 nt, Human
uuaaguguaacugg

SEQ ID NO: 1027964 - RNA, 18 nt, Human
gaacucugagcagugcuu

SEQ ID NO: 1027965 - RNA, 16 nt, Human
accucaagccagccuu

SEQ ID NO: 1027966 - RNA, 23 nt, Human
aaaucucuauuaggaaauauucu

SEQ ID NO: 1027967 - RNA, 19 nt, Human
uaagcaacaucuagcaaau

SEQ ID NO: 1027968 - RNA, 21 nt, Human
caccagggccuggcugggagu

SEQ ID NO: 1027969 - RNA, 15 nt, Human
auuugaguguuuuaa

SEQ ID NO: 1027970 - RNA, 21 nt, Human
ccaaucauuuuaauuauuauu

SEQ ID NO: 1027971 - RNA, 19 nt, Human
caccauuccuucugcccug

SEQ ID NO: 1027972 - RNA, 17 nt, Human
ucuagguucuaaaaauu

SEQ ID NO: 1027973 - RNA, 13 nt, Human
ugcuugccauccc

SEQ ID NO: 1027974 - RNA, 22 nt, Human
cugcuugccaucccucccucca

SEQ ID NO: 1027975 - RNA, 14 nt, Human
uuuuaauuuugaau

SEQ ID NO: 1027976 - RNA, 14 nt, Human
gcauucucugaaga

SEQ ID NO: 1027977 - RNA, 18 nt, Human
ccugcuggauguggaggg

SEQ ID NO: 1027978 - RNA, 18 nt, Human
agugucuuacagagaaaa

SEQ ID NO: 1027979 - RNA, 16 nt, Human
auuuaagguauauaaa

SEQ ID NO: 1027980 - RNA, 15 nt, Human
uguuaaaugauuuca

SEQ ID NO: 1027981 - RNA, 21 nt, Human
aggguucaccugggcugaggc

SEQ ID NO: 1027982 - RNA, 16 nt, Human
aaacuggaaauaaaag

SEQ ID NO: 1027983 - RNA, 15 nt, Human
uccaaauucacaagu

SEQ ID NO: 1027984 - RNA, 17 nt, Human
gaauaucuauuaauaua

SEQ ID NO: 1027985 - RNA, 16 nt, Human
ccuccaccucccugca

SEQ ID NO: 1027986 - RNA, 16 nt, Human
caaauggaaaguaacu

SEQ ID NO: 1027987 - RNA, 17 nt, Human
guaucuuguuuuuccac

SEQ ID NO: 1027988 - RNA, 19 nt, Human
uagcaagugaauuuuucuc

SEQ ID NO: 1027989 - RNA, 16 nt, Human
aagacaaagacaaauu

SEQ ID NO: 1027990 - RNA, 19 nt, Human
ugucuggcacuugggacaa

SEQ ID NO: 1027991 - RNA, 16 nt, Human
accuguaaucauauaa

SEQ ID NO: 1027992 - RNA, 19 nt, Human
uccaaagcugaauacauuc

SEQ ID NO: 1027993 - RNA, 23 nt, Human
ucucugaagaguggguuucacaa

SEQ ID NO: 1027994 - RNA, 16 nt, Human
aauaaagaauuuuaaa

SEQ ID NO: 1027995 - RNA, 12 nt, Human
uugggaggcuga

SEQ ID NO: 1027996 - RNA, 18 nt, Human
ccuguaaucauauaauaa

SEQ ID NO: 1027997 - RNA, 15 nt, Human
agcaaaauggauaug

SEQ ID NO: 1027998 - RNA, 21 nt, Human
ugcccauccugccccugagcc

SEQ ID NO: 1027999 - RNA, 22 nt, Human
cgcaccuguaaucccagcuacu

SEQ ID NO: 1028000 - RNA, 19 nt, Human
uauuuacugagcuucucug

SEQ ID NO: 1028001 - RNA, 14 nt, Human
acuuccucagcugu

SEQ ID NO: 1028002 - RNA, 20 nt, Human
cagcaggucucaugggggug

SEQ ID NO: 1028003 - RNA, 21 nt, Human
aucuuuuuuuuaauaaaccau

SEQ ID NO: 1028004 - RNA, 18 nt, Human
cgaugguacauauuucuu

SEQ ID NO: 1028005 - RNA, 13 nt, Human
uaauuuuuuucaa

SEQ ID NO: 1028006 - RNA, 22 nt, Human
ugaaaaaguucugcagauaaac

SEQ ID NO: 1028007 - RNA, 23 nt, Human
agacagcuucucauccugcaggc

SEQ ID NO: 1028008 - RNA, 20 nt, Human
auuuugguaaaauacuucuu

SEQ ID NO: 1028009 - RNA, 21 nt, Human
cacuugaacccgggaggcaga

SEQ ID NO: 1028010 - RNA, 23 nt, Human
ucgcugauauauguguuuuucac

SEQ ID NO: 1028011 - RNA, 11 nt, Human
aaguauauaua

SEQ ID NO: 1028012 - RNA, 21 nt, Human
auuugaguguuuuaagauaaa

SEQ ID NO: 1028013 - RNA, 17 nt, Human
ugggaauuuucuuccaa

SEQ ID NO: 1028014 - RNA, 16 nt, Human
caaauuccagaaugau

SEQ ID NO: 1028015 - RNA, 15 nt, Human
accaaucauuuuaau

SEQ ID NO: 1028016 - RNA, 21 nt, Human
auucauagcagcuuauucaca

SEQ ID NO: 1028017 - RNA, 13 nt, Human
uuuaaaaaaaaac

SEQ ID NO: 1028018 - RNA, 16 nt, Human
uaugaaccuuuacauc

SEQ ID NO: 1028019 - RNA, 13 nt, Human
uuauaauauacua

SEQ ID NO: 1028020 - RNA, 18 nt, Human
acugauggguuucuccag

SEQ ID NO: 1028021 - RNA, 23 nt, Human
uuauaaauauauuuaagauaauu

SEQ ID NO: 1028022 - RNA, 15 nt, Human
agaagagaauauuag

SEQ ID NO: 1028023 - RNA, 14 nt, Human
uccuucacauccug

SEQ ID NO: 1028024 - RNA, 13 nt, Human
accaaauggagug

SEQ ID NO: 1028025 - RNA, 21 nt, Human
ucaauagaaggauguacauuu

SEQ ID NO: 1028026 - RNA, 21 nt, Human
auauuuaagauaauuauaaua

SEQ ID NO: 1028027 - RNA, 14 nt, Human
caauuccucuggga

SEQ ID NO: 1028028 - RNA, 22 nt, Human
uuccuagcgcagccaugugauu

SEQ ID NO: 1028029 - RNA, 14 nt, Human
auuuauauauguau

SEQ ID NO: 1028030 - RNA, 18 nt, Human
uuccauagagacuuugug

SEQ ID NO: 1028031 - RNA, 21 nt, Human
gucucagugucaaugcagccc

SEQ ID NO: 1028032 - RNA, 14 nt, Human
acaucuuucacauu

SEQ ID NO: 1028033 - RNA, 14 nt, Human
ugcuggagcucugc

SEQ ID NO: 1028034 - RNA, 20 nt, Human
aucaaguccuacaagcuaaa

SEQ ID NO: 1028035 - RNA, 22 nt, Human
cuggagcuugaaauagugucug

SEQ ID NO: 1028036 - RNA, 22 nt, Human
uagaauggaacucaaggaaauc

SEQ ID NO: 1028037 - RNA, 14 nt, Human
ggcgcgugcaggca

SEQ ID NO: 1028038 - RNA, 19 nt, Human
gaacacccuauauuuugca

SEQ ID NO: 1028039 - RNA, 22 nt, Human
uaugcaaccuuuggaugcacuu

SEQ ID NO: 1028040 - RNA, 15 nt, Human
gcuuuucaaaauugg

SEQ ID NO: 1028041 - RNA, 15 nt, Human
acuuaugaaccuuua

SEQ ID NO: 1028042 - RNA, 21 nt, Human
ugagggcuugaggacuugggc

SEQ ID NO: 1028043 - RNA, 19 nt, Human
agccagcaguucagagcug

SEQ ID NO: 1028044 - RNA, 23 nt, Human
ggggagccaacagaagcuuccau

SEQ ID NO: 1028045 - RNA, 23 nt, Human
caauuauaagcuguuuuuauaua

SEQ ID NO: 1028046 - RNA, 14 nt, Human
cccugaugaaaaca

SEQ ID NO: 1028047 - RNA, 19 nt, Human
acaaggcuuuaucucaggg

SEQ ID NO: 1028048 - RNA, 14 nt, Human
uuucacaagugaaa

SEQ ID NO: 1028049 - RNA, 20 nt, Human
caccagagauaauaugagaa

SEQ ID NO: 1028050 - RNA, 18 nt, Human
guugccaaggcuggagug

SEQ ID NO: 1028051 - RNA, 16 nt, Human
aacagaagcuuccauu

SEQ ID NO: 1028052 - RNA, 15 nt, Human
agaauuaauggaaua

SEQ ID NO: 1028053 - RNA, 13 nt, Human
aaaaugagcaaaa

SEQ ID NO: 1028054 - RNA, 21 nt, Human
cuauuuauuuauuuauuugag

SEQ ID NO: 1028055 - RNA, 13 nt, Human
ccacuucacuuuu

SEQ ID NO: 1028056 - RNA, 19 nt, Human
uauaucaguccucuuucaa

SEQ ID NO: 1028057 - RNA, 15 nt, Human
acuuuccagagacca

SEQ ID NO: 1028058 - RNA, 16 nt, Human
agugagacagcucugc

SEQ ID NO: 1028059 - RNA, 14 nt, Human
uauagaauauuuau

SEQ ID NO: 1028060 - RNA, 13 nt, Human
gaaugagaagaau

SEQ ID NO: 1028061 - RNA, 15 nt, Human
gagauuccugagcca

SEQ ID NO: 1028062 - RNA, 15 nt, Human
aaaauacaaaaaaaa

SEQ ID NO: 1028063 - RNA, 14 nt, Human
ccuccaccucccug

SEQ ID NO: 1028064 - RNA, 13 nt, Human
auaucuaauauau

SEQ ID NO: 1028065 - RNA, 17 nt, Human
agugagacagcucugca

SEQ ID NO: 1028066 - RNA, 12 nt, Human
uuuuuaaauaaa

SEQ ID NO: 1028067 - RNA, 15 nt, Human
uuuaaguaauuucag

SEQ ID NO: 1028068 - RNA, 19 nt, Human
auguacauuuccaaauuca

SEQ ID NO: 1028069 - RNA, 16 nt, Human
acugauggguuucucc

SEQ ID NO: 1028070 - RNA, 16 nt, Human
ucaaaagaaagaaaau

SEQ ID NO: 1028071 - RNA, 15 nt, Human
agccucaagaugaag

SEQ ID NO: 1028072 - RNA, 19 nt, Human
acuuaaaaucuaauucaaa

SEQ ID NO: 1028073 - RNA, 18 nt, Human
aaauauauuuaagauaau

SEQ ID NO: 1028074 - RNA, 14 nt, Human
gccugcaauauuug

SEQ ID NO: 1028075 - RNA, 22 nt, Human
gagcugcccucuccugggcagc

SEQ ID NO: 1028076 - RNA, 20 nt, Human
ccagugagacagcucugcau

SEQ ID NO: 1028077 - RNA, 16 nt, Human
gccuaagugcagcccc

SEQ ID NO: 1028078 - RNA, 21 nt, Human
uuaaaucuaaaucuauuuauu

SEQ ID NO: 1028079 - RNA, 16 nt, Human
acgccuguaaucccag

SEQ ID NO: 1028080 - RNA, 12 nt, Human
gcuggccaggcu

SEQ ID NO: 1028081 - RNA, 17 nt, Human
uccugccugcaauauuu

SEQ ID NO: 1028082 - RNA, 20 nt, Human
acaagcuuuuuuuuuuuuuc

SEQ ID NO: 1028083 - RNA, 18 nt, Human
uccuacaagcuaaaauua

SEQ ID NO: 1028084 - RNA, 22 nt, Human
ugaaacagagaaaauaaaagca

SEQ ID NO: 1028085 - RNA, 11 nt, Human
ccaaggcugga

SEQ ID NO: 1028086 - RNA, 23 nt, Human
cucugcuugccaucccucccucc

SEQ ID NO: 1028087 - RNA, 15 nt, Human
ccacuucacuuuuuu

SEQ ID NO: 1028088 - RNA, 16 nt, Human
uucacauccuguguuu

SEQ ID NO: 1028089 - RNA, 20 nt, Human
gacauaagcaaagacuauga

SEQ ID NO: 1028090 - RNA, 16 nt, Human
gaucucagaaauugua

SEQ ID NO: 1028091 - RNA, 20 nt, Human
cugaagaguggguuucacaa

SEQ ID NO: 1028092 - RNA, 18 nt, Human
gagugacauguuuacaaa

SEQ ID NO: 1028093 - RNA, 15 nt, Human
auccuaauaaaaagg

SEQ ID NO: 1028094 - RNA, 23 nt, Human
agagcaagacucugucucaaaaa

SEQ ID NO: 1028095 - RNA, 19 nt, Human
cccauggcacucuauguuc

SEQ ID NO: 1028096 - RNA, 20 nt, Human
augccugcaaucugagccag

SEQ ID NO: 1028097 - RNA, 22 nt, Human
caaaaacaaacaaacgaaaaac

SEQ ID NO: 1028098 - RNA, 16 nt, Human
agaacucugagcagug

SEQ ID NO: 1028099 - RNA, 13 nt, Human
aaaggaagaaauu

SEQ ID NO: 1028100 - RNA, 14 nt, Human
acaguaauuuuaag

SEQ ID NO: 1028101 - RNA, 17 nt, Human
acugauacccuuugaaa

SEQ ID NO: 1028102 - RNA, 16 nt, Human
uuucuuaaagaauuuu

SEQ ID NO: 1028103 - RNA, 19 nt, Human
auuaucuaucuaucuauuu

SEQ ID NO: 1028104 - RNA, 16 nt, Human
cuggaucucacaagca

SEQ ID NO: 1028105 - RNA, 17 nt, Human
ccucugcuugccauccc

SEQ ID NO: 1028106 - RNA, 22 nt, Human
caauuauaagcuguuuuuauau

SEQ ID NO: 1028107 - RNA, 14 nt, Human
acccgggaggcaga

SEQ ID NO: 1028108 - RNA, 22 nt, Human
caaaacugauacccuuugaaaa

SEQ ID NO: 1028109 - RNA, 15 nt, Human
auugugaucagacca

SEQ ID NO: 1028110 - RNA, 14 nt, Human
uauauuauuuugaa

SEQ ID NO: 1028111 - RNA, 18 nt, Human
uagagacuuugugaaaaa

SEQ ID NO: 1028112 - RNA, 16 nt, Human
auuuaagauaauuaua

SEQ ID NO: 1028113 - RNA, 17 nt, Human
agcugccuccccuccuc

SEQ ID NO: 1028114 - RNA, 22 nt, Human
ugcaauaaaauggguuuuacug

SEQ ID NO: 1028115 - RNA, 13 nt, Human
acaguaauuuuaa

SEQ ID NO: 1028116 - RNA, 17 nt, Human
ucaaauaaguauuuaua

SEQ ID NO: 1028117 - RNA, 20 nt, Human
cccgggaguggcgcgcgcca

SEQ ID NO: 1028118 - RNA, 21 nt, Human
aauuuuucucuaacucagaaa

SEQ ID NO: 1028119 - RNA, 22 nt, Human
cuucagccugaaagaggaauga

SEQ ID NO: 1028120 - RNA, 23 nt, Human
cuuuggcaaaugagccggagccc

SEQ ID NO: 1028121 - RNA, 20 nt, Human
acaguuagagauuuuuaaau

SEQ ID NO: 1028122 - RNA, 16 nt, Human
uauguaccauguacau

SEQ ID NO: 1028123 - RNA, 23 nt, Human
auucucucuccuguacuuuuucc

SEQ ID NO: 1028124 - RNA, 23 nt, Human
cugggguggguggggcagugcuu

SEQ ID NO: 1028125 - RNA, 13 nt, Human
aauucuaaaugaa

SEQ ID NO: 1028126 - RNA, 13 nt, Human
gcaggcagcagga

SEQ ID NO: 1028127 - RNA, 13 nt, Human
aaauaaaagauug

SEQ ID NO: 1028128 - RNA, 20 nt, Human
uccagccugagcgacaguga

SEQ ID NO: 1028129 - RNA, 13 nt, Human
agaauauuuauua

SEQ ID NO: 1028130 - RNA, 19 nt, Human
acucugucucaguccauga

SEQ ID NO: 1028131 - RNA, 13 nt, Human
gcuggagcucugc

SEQ ID NO: 1028132 - RNA, 15 nt, Human
ucuggggcucuggga

SEQ ID NO: 1028133 - RNA, 20 nt, Human
acaugagguacugagaguga

SEQ ID NO: 1028134 - RNA, 13 nt, Human
uguuagcaaaaug

SEQ ID NO: 1028135 - RNA, 15 nt, Human
uggcaguuuuccauu

SEQ ID NO: 1028136 - RNA, 18 nt, Human
guauagcauauguuuuug

SEQ ID NO: 1028137 - RNA, 13 nt, Human
aaaugaaagcagg

SEQ ID NO: 1028138 - RNA, 14 nt, Human
aucaugcaucuuac

SEQ ID NO: 1028139 - RNA, 20 nt, Human
accagccaaccugggggcuu

SEQ ID NO: 1028140 - RNA, 14 nt, Human
aauuauaauauacu

SEQ ID NO: 1028141 - RNA, 21 nt, Human
auggcagcuuuccucaaaacu

SEQ ID NO: 1028142 - RNA, 19 nt, Human
cauaagaaaacuaagaaau

SEQ ID NO: 1028143 - RNA, 19 nt, Human
ugcaccaacuuugaagucu

SEQ ID NO: 1028144 - RNA, 23 nt, Human
uacugccuaucagcauuuuacua

SEQ ID NO: 1028145 - RNA, 16 nt, Human
aaaggccugucccugc

SEQ ID NO: 1028146 - RNA, 17 nt, Human
aaauucugcaagcuuuu

SEQ ID NO: 1028147 - RNA, 18 nt, Human
auccuucagccugaaaga

SEQ ID NO: 1028148 - RNA, 15 nt, Human
gaagauguagaggag

SEQ ID NO: 1028149 - RNA, 22 nt, Human
ccugggcagcugccuccccucc

SEQ ID NO: 1028150 - RNA, 18 nt, Human
uugaaaaaguauaaauaa

SEQ ID NO: 1028151 - RNA, 13 nt, Human
aauaaaaauaaaa

SEQ ID NO: 1028152 - RNA, 22 nt, Human
cuuaccugggcauucuuguuuc

SEQ ID NO: 1028153 - RNA, 19 nt, Human
uauuugcaagacauagaau

SEQ ID NO: 1028154 - RNA, 20 nt, Human
aacucugcauucuaguacuu

SEQ ID NO: 1028155 - RNA, 16 nt, Human
accuguuuuuaagcug

SEQ ID NO: 1028156 - RNA, 21 nt, Human
ccauccugccccugagcccau

SEQ ID NO: 1028157 - RNA, 23 nt, Human
cugagaccagccaaccugggggc

SEQ ID NO: 1028158 - RNA, 16 nt, Human
cucuuuuuagagaaau

SEQ ID NO: 1028159 - RNA, 19 nt, Human
aaaauggagggaauaauac

SEQ ID NO: 1028160 - RNA, 19 nt, Human
ccaaucauuuuaauuauua

SEQ ID NO: 1028161 - RNA, 16 nt, Human
caucuagcaaauguua

SEQ ID NO: 1028162 - RNA, 20 nt, Human
caggaguuccuaaccagccu

SEQ ID NO: 1028163 - RNA, 21 nt, Human
aaacaucaguuacucugaagg

SEQ ID NO: 1028164 - RNA, 15 nt, Human
cacaagcacuuuccc

SEQ ID NO: 1028165 - RNA, 22 nt, Human
gaggggagcaugggaagugacg

SEQ ID NO: 1028166 - RNA, 22 nt, Human
gcagccaugugauuacccucug

SEQ ID NO: 1028167 - RNA, 15 nt, Human
gaaaugaaagcaggg

SEQ ID NO: 1028168 - RNA, 20 nt, Human
auaaauuuucccaaaacuga

SEQ ID NO: 1028169 - RNA, 16 nt, Human
aaagcauuguaacuua

SEQ ID NO: 1028170 - RNA, 16 nt, Human
agacaaauucuguuuc

SEQ ID NO: 1028171 - RNA, 21 nt, Human
aaaagcauuguaacuuaugaa

SEQ ID NO: 1028172 - RNA, 20 nt, Human
aaacugauacccuuugaaaa

SEQ ID NO: 1028173 - RNA, 14 nt, Human
auauuuauuaccuc

SEQ ID NO: 1028174 - RNA, 21 nt, Human
ggcuuguaaaguacagacuuu

SEQ ID NO: 1028175 - RNA, 21 nt, Human
caguauucccuuuugcugccu

SEQ ID NO: 1028176 - RNA, 17 nt, Human
caagacccaaaaggcag

SEQ ID NO: 1028177 - RNA, 17 nt, Human
ggcuugaggacuugggc

SEQ ID NO: 1028178 - RNA, 19 nt, Human
aacuagaauuuauucaauu

SEQ ID NO: 1028179 - RNA, 13 nt, Human
uaagugcagcccc

SEQ ID NO: 1028180 - RNA, 15 nt, Human
ggaaaugaaagaaag

SEQ ID NO: 1028181 - RNA, 14 nt, Human
caggaguuuggcca

SEQ ID NO: 1028182 - RNA, 21 nt, Human
guaaaauacuucuugaagccg

SEQ ID NO: 1028183 - RNA, 14 nt, Human
gaaagcagaacagu

SEQ ID NO: 1028184 - RNA, 18 nt, Human
uccagauacacccaaagu

SEQ ID NO: 1028185 - RNA, 17 nt, Human
cuggcaaggguucaccu

SEQ ID NO: 1028186 - RNA, 19 nt, Human
uuuccuaaaucaauucuau

SEQ ID NO: 1028187 - RNA, 13 nt, Human
gaaaauaugccug

SEQ ID NO: 1028188 - RNA, 16 nt, Human
ugcuccuggcuggggc

SEQ ID NO: 1028189 - RNA, 15 nt, Human
aagaauuuuaaaacu

SEQ ID NO: 1028190 - RNA, 19 nt, Human
aaugaaauggugaaaugca

SEQ ID NO: 1028191 - RNA, 13 nt, Human
uaaguauuuauaa

SEQ ID NO: 1028192 - RNA, 12 nt, Human
uguaacuuauga

SEQ ID NO: 1028193 - RNA, 19 nt, Human
uuaaagcuaaaguaucugu

SEQ ID NO: 1028194 - RNA, 16 nt, Human
acuaugaggaauauuu

SEQ ID NO: 1028195 - RNA, 13 nt, Human
aauaaaaagguga

SEQ ID NO: 1028196 - RNA, 16 nt, Human
agcauauguuuuugua

SEQ ID NO: 1028197 - RNA, 15 nt, Human
caacauuaaaacaau

SEQ ID NO: 1028198 - RNA, 21 nt, Human
aauuucagaagaaauucugca

SEQ ID NO: 1028199 - RNA, 20 nt, Human
aacauuauuuauauggggaa

SEQ ID NO: 1028200 - RNA, 21 nt, Human
ucuuaaagaauuuucaaaauc

SEQ ID NO: 1028201 - RNA, 19 nt, Human
auccauggugugcuggcuu

SEQ ID NO: 1028202 - RNA, 15 nt, Human
cuccugguuccuagg

SEQ ID NO: 1028203 - RNA, 22 nt, Human
ccaucccucccuccaccucccu

SEQ ID NO: 1028204 - RNA, 19 nt, Human
aauauuucucucuuuuuag

SEQ ID NO: 1028205 - RNA, 20 nt, Human
uaacugcauugagaacugca

SEQ ID NO: 1028206 - RNA, 18 nt, Human
cagaaagcagaacaguga

SEQ ID NO: 1028207 - RNA, 19 nt, Human
uaaacuggaaauaaaagau

SEQ ID NO: 1028208 - RNA, 13 nt, Human
auuuauugagcac

SEQ ID NO: 1028209 - RNA, 16 nt, Human
uauuugcaagacauag

SEQ ID NO: 1028210 - RNA, 17 nt, Human
uuagccgggcauggugg

SEQ ID NO: 1028211 - RNA, 22 nt, Human
gaaaggagaaguuaagcaacau

SEQ ID NO: 1028212 - RNA, 17 nt, Human
cugagcagugcuugaau

SEQ ID NO: 1028213 - RNA, 16 nt, Human
cugggucucagugucc

SEQ ID NO: 1028214 - RNA, 14 nt, Human
uggagacaccacca

SEQ ID NO: 1028215 - RNA, 14 nt, Human
uagaauauuuauua

SEQ ID NO: 1028216 - RNA, 21 nt, Human
ugggucucaguguccucaucu

SEQ ID NO: 1028217 - RNA, 15 nt, Human
uuuaauuucaugaaa

SEQ ID NO: 1028218 - RNA, 12 nt, Human
uaaaauugaaag

SEQ ID NO: 1028219 - RNA, 20 nt, Human
ugagagugaacaaauuuaca

SEQ ID NO: 1028220 - RNA, 16 nt, Human
uauauaaauuuuccca

SEQ ID NO: 1028221 - RNA, 13 nt, Human
ugagcgacaguga

SEQ ID NO: 1028222 - RNA, 16 nt, Human
ugugcuggcuuaaaau

SEQ ID NO: 1028223 - RNA, 16 nt, Human
ugacuauuauagaaug

SEQ ID NO: 1028224 - RNA, 18 nt, Human
acggagauaucccaggaa

SEQ ID NO: 1028225 - RNA, 22 nt, Human
cauguacauccauggugugcug

SEQ ID NO: 1028226 - RNA, 21 nt, Human
aaaaaguucugcagauaaaca

SEQ ID NO: 1028227 - RNA, 20 nt, Human
uuguaccucucuuauagaau

SEQ ID NO: 1028228 - RNA, 17 nt, Human
uuuuaucauuuucaaaa

SEQ ID NO: 1028229 - RNA, 17 nt, Human
uagaagcaucacagguu

SEQ ID NO: 1028230 - RNA, 21 nt, Human
uuuccauugguuuaccuguga

SEQ ID NO: 1028231 - RNA, 18 nt, Human
agguauuuauugagcacc

SEQ ID NO: 1028232 - RNA, 18 nt, Human
auauauuuauaacucauc

SEQ ID NO: 1028233 - RNA, 14 nt, Human
uccaagccugacca

SEQ ID NO: 1028234 - RNA, 13 nt, Human
aauguaaacaaag

SEQ ID NO: 1028235 - RNA, 21 nt, Human
caguucagagcugcccucucc

SEQ ID NO: 1028236 - RNA, 12 nt, Human
cuggcugggagu

SEQ ID NO: 1028237 - RNA, 15 nt, Human
uaauguuacauuauu

SEQ ID NO: 1028238 - RNA, 18 nt, Human
auguguggcauuuucacu

SEQ ID NO: 1028239 - RNA, 16 nt, Human
cuugccugcaggcaug

SEQ ID NO: 1028240 - RNA, 19 nt, Human
uauuuauugcugaaugacu

SEQ ID NO: 1028241 - RNA, 23 nt, Human
guauuugaguguuuuaagauaaa

SEQ ID NO: 1028242 - RNA, 22 nt, Human
agaggauguguggcauuuucac

SEQ ID NO: 1028243 - RNA, 21 nt, Human
auguacaugaagaagcuaaau

SEQ ID NO: 1028244 - RNA, 12 nt, Human
cccucuccuggg

SEQ ID NO: 1028245 - RNA, 14 nt, Human
agugugaccaggca

SEQ ID NO: 1028246 - RNA, 20 nt, Human
aguccuacaagcuaaaauua

SEQ ID NO: 1028247 - RNA, 19 nt, Human
ucaguccaugaagauguag

SEQ ID NO: 1028248 - RNA, 13 nt, Human
aaauaaaguauau

SEQ ID NO: 1028249 - RNA, 13 nt, Human
agccuugcuccug

SEQ ID NO: 1028250 - RNA, 13 nt, Human
ccucuccugggca

SEQ ID NO: 1028251 - RNA, 23 nt, Human
ccuaaccucauuccccaaccacu

SEQ ID NO: 1028252 - RNA, 16 nt, Human
ugugauuacccucugg

SEQ ID NO: 1028253 - RNA, 22 nt, Human
caaacagaacuauggaaaaaaa

SEQ ID NO: 1028254 - RNA, 23 nt, Human
auuaaagcuaaaguaucuguauu

SEQ ID NO: 1028255 - RNA, 14 nt, Human
cauuuucaaaaugg

SEQ ID NO: 1028256 - RNA, 16 nt, Human
ucaaaagguauuuauu

SEQ ID NO: 1028257 - RNA, 17 nt, Human
ucucauccugcaggcag

SEQ ID NO: 1028258 - RNA, 20 nt, Human
auauauguguuuuucacauu

SEQ ID NO: 1028259 - RNA, 14 nt, Human
auaauuauaauaua

SEQ ID NO: 1028260 - RNA, 16 nt, Human
gaagagaaaccaggga

SEQ ID NO: 1028261 - RNA, 21 nt, Human
uauguaaauagaaacguguau

SEQ ID NO: 1028262 - RNA, 16 nt, Human
ugcgaaugguuccauu

SEQ ID NO: 1028263 - RNA, 16 nt, Human
cguggacuuacuauuu

SEQ ID NO: 1028264 - RNA, 23 nt, Human
ucaugcauuugcacuauuggaag

SEQ ID NO: 1028265 - RNA, 22 nt, Human
cuacuugggaggcugaggcaag

SEQ ID NO: 1028266 - RNA, 18 nt, Human
uugggcgggacacaggcu

SEQ ID NO: 1028267 - RNA, 18 nt, Human
aacuagaauuuauucaau

SEQ ID NO: 1028268 - RNA, 12 nt, Human
ucagaaauuuaa

SEQ ID NO: 1028269 - RNA, 18 nt, Human
auuugcuggagcucugcc

SEQ ID NO: 1028270 - RNA, 14 nt, Human
acucuauagacucu

SEQ ID NO: 1028271 - RNA, 15 nt, Human
cuaugaggaauauuu

SEQ ID NO: 1028272 - RNA, 15 nt, Human
cagcaguucagagcu

SEQ ID NO: 1028273 - RNA, 13 nt, Human
agaaaugaaagca

SEQ ID NO: 1028274 - RNA, 20 nt, Human
cagaaacaucaguuacucug

SEQ ID NO: 1028275 - RNA, 16 nt, Human
cagcuuuccucaaaac

SEQ ID NO: 1028276 - RNA, 12 nt, Human
ucaugcugccaa

SEQ ID NO: 1028277 - RNA, 21 nt, Human
guauuuuuaccuuuuuccuuc

SEQ ID NO: 1028278 - RNA, 13 nt, Human
cacaccaggcuug

SEQ ID NO: 1028279 - RNA, 19 nt, Human
acaauagcagacaguguuu

SEQ ID NO: 1028280 - RNA, 22 nt, Human
agacuuugugaaaaaaaauuuu

SEQ ID NO: 1028281 - RNA, 17 nt, Human
cccucugggucucagug

SEQ ID NO: 1028282 - RNA, 23 nt, Human
cagaaauuuaauucauguuucuu

SEQ ID NO: 1028283 - RNA, 18 nt, Human
cccugaccucccucuaau

SEQ ID NO: 1028284 - RNA, 12 nt, Human
uucagccugaaa

SEQ ID NO: 1028285 - RNA, 16 nt, Human
acuuuggcaaaugagc

SEQ ID NO: 1028286 - RNA, 15 nt, Human
auuucaugaaaagau

SEQ ID NO: 1028287 - RNA, 21 nt, Human
gugcuuaucccauagccagga

SEQ ID NO: 1028288 - RNA, 19 nt, Human
uguuacauuauuaucaaca

SEQ ID NO: 1028289 - RNA, 17 nt, Human
uccugccccugagccca

SEQ ID NO: 1028290 - RNA, 18 nt, Human
agcugccuccccuccucu

SEQ ID NO: 1028291 - RNA, 14 nt, Human
aaaauuggacuuaa

SEQ ID NO: 1028292 - RNA, 12 nt, Human
gagugggacagu

SEQ ID NO: 1028293 - RNA, 17 nt, Human
agagcugcccucuccug

SEQ ID NO: 1028294 - RNA, 16 nt, Human
cuuguaauucuaaaug

SEQ ID NO: 1028295 - RNA, 17 nt, Human
aucuauuaauauaugua

SEQ ID NO: 1028296 - RNA, 23 nt, Human
uuguaacuuaugaaccuuuacau

SEQ ID NO: 1028297 - RNA, 15 nt, Human
accccuucauccucu

SEQ ID NO: 1028298 - RNA, 18 nt, Human
ugaauaucuauuaauaua

SEQ ID NO: 1028299 - RNA, 12 nt, Human
acagagacagaa

SEQ ID NO: 1028300 - RNA, 22 nt, Human
agcauauguuuuuguaaguuua

SEQ ID NO: 1028301 - RNA, 17 nt, Human
gagggggcgcgugcagg

SEQ ID NO: 1028302 - RNA, 13 nt, Human
aucaggcuggcca

SEQ ID NO: 1028303 - RNA, 19 nt, Human
uaauacagggcauuuuggu

SEQ ID NO: 1028304 - RNA, 14 nt, Human
agagacagaaagca

SEQ ID NO: 1028305 - RNA, 22 nt, Human
auugacuauuauagaauggaac

SEQ ID NO: 1028306 - RNA, 14 nt, Human
cuacuuuaaaaaaa

SEQ ID NO: 1028307 - RNA, 22 nt, Human
cagcaggauagagugggacagu

SEQ ID NO: 1028308 - RNA, 18 nt, Human
cauuuccuauguaacugc

SEQ ID NO: 1028309 - RNA, 23 nt, Human
uguuauagguuguuggauaaauc

SEQ ID NO: 1028310 - RNA, 14 nt, Human
ugcauuaaauauaa

SEQ ID NO: 1028311 - RNA, 14 nt, Human
aauaaaaauaaauu

SEQ ID NO: 1028312 - RNA, 19 nt, Human
gagggaauugcagaguacu

SEQ ID NO: 1028313 - RNA, 16 nt, Human
uugacaguucauaugu

SEQ ID NO: 1028314 - RNA, 12 nt, Human
caggucucaugg

SEQ ID NO: 1028315 - RNA, 14 nt, Human
aacugcauugagaa

SEQ ID NO: 1028316 - RNA, 15 nt, Human
acugcuggauucaag

SEQ ID NO: 1028317 - RNA, 15 nt, Human
aaacuaauagaauua

SEQ ID NO: 1028318 - RNA, 19 nt, Human
uuguuaaaauuaucaauau

SEQ ID NO: 1028319 - RNA, 18 nt, Human
uuuccuauguaacugcau

SEQ ID NO: 1028320 - RNA, 14 nt, Human
cuguaaucccagcu

SEQ ID NO: 1028321 - RNA, 13 nt, Human
gggaguggcgcgc

SEQ ID NO: 1028322 - RNA, 15 nt, Human
guggcgcgcaccugu

SEQ ID NO: 1028323 - RNA, 15 nt, Human
uuacuacuuuaaaaa

SEQ ID NO: 1028324 - RNA, 15 nt, Human
ugacaacuugaauaa

SEQ ID NO: 1028325 - RNA, 12 nt, Human
caucuuucacau

SEQ ID NO: 1028326 - RNA, 17 nt, Human
cagugcuuggcccagga

SEQ ID NO: 1028327 - RNA, 23 nt, Human
caagggaguuaggcuauucacaa

SEQ ID NO: 1028328 - RNA, 23 nt, Human
ggcgacucuauagacucuaggac

SEQ ID NO: 1028329 - RNA, 17 nt, Human
agaaacaucaguuacuc

SEQ ID NO: 1028330 - RNA, 18 nt, Human
aagaagacaacauuaaaa

SEQ ID NO: 1028331 - RNA, 16 nt, Human
uaaggcauaagaaaac

SEQ ID NO: 1028332 - RNA, 17 nt, Human
gagacaccaccacccuu

SEQ ID NO: 1028333 - RNA, 23 nt, Human
uaaauauaauaugcacacagugc

SEQ ID NO: 1028334 - RNA, 22 nt, Human
cugcuagaguucugucuggacu

SEQ ID NO: 1028335 - RNA, 18 nt, Human
aaaaauaaaaauaaaaau

SEQ ID NO: 1028336 - RNA, 17 nt, Human
uaaguugcugaugaacu

SEQ ID NO: 1028337 - RNA, 23 nt, Human
aauguauuuguuuguauuuugug

SEQ ID NO: 1028338 - RNA, 17 nt, Human
aucccagcacuuuggga

SEQ ID NO: 1028339 - RNA, 22 nt, Human
cauguauuuauuuuuuuacuuc

SEQ ID NO: 1028340 - RNA, 21 nt, Human
acucaucauaaaauaaaguau

SEQ ID NO: 1028341 - RNA, 23 nt, Human
aauagugucugaugaauguuaaa

SEQ ID NO: 1028342 - RNA, 15 nt, Human
acuggccugcuggau

SEQ ID NO: 1028343 - RNA, 17 nt, Human
aauuugguucuaggccg

SEQ ID NO: 1028344 - RNA, 18 nt, Human
uaauuauuauucuucaua

SEQ ID NO: 1028345 - RNA, 12 nt, Human
ccaucccucccu

SEQ ID NO: 1028346 - RNA, 20 nt, Human
cgaaauguuauuuuuuaauu

SEQ ID NO: 1028347 - RNA, 22 nt, Human
guacauuaauuaccuugagcca

SEQ ID NO: 1028348 - RNA, 12 nt, Human
aaguuucuggga

SEQ ID NO: 1028349 - RNA, 18 nt, Human
ugaauccagaaauaauga

SEQ ID NO: 1028350 - RNA, 18 nt, Human
guugaagaugcuuguauu

SEQ ID NO: 1028351 - RNA, 14 nt, Human
aguauuuauauauu

SEQ ID NO: 1028352 - RNA, 10 nt, Human
auagugucuu

SEQ ID NO: 1028353 - RNA, 20 nt, Human
cuaagaaauaugcacaauag

SEQ ID NO: 1028354 - RNA, 20 nt, Human
cugcacuccagccugagcga

SEQ ID NO: 1028355 - RNA, 15 nt, Human
uucauguacauccau

SEQ ID NO: 1028356 - RNA, 13 nt, Human
uuguauuuuacuu

SEQ ID NO: 1028357 - RNA, 12 nt, Human
aagcauuguaac

SEQ ID NO: 1028358 - RNA, 21 nt, Human
cuugaggacuugggcgggaca

SEQ ID NO: 1028359 - RNA, 13 nt, Human
aauccagaaauaa

SEQ ID NO: 1028360 - RNA, 15 nt, Human
ucaguuacucugaag

SEQ ID NO: 1028361 - RNA, 15 nt, Human
cuucucuucacaguc

SEQ ID NO: 1028362 - RNA, 16 nt, Human
ucuguuccuucacauc

SEQ ID NO: 1028363 - RNA, 20 nt, Human
cuuauucacaagacccaaaa

SEQ ID NO: 1028364 - RNA, 19 nt, Human
aaaacuaagaaauaugcac

SEQ ID NO: 1028365 - RNA, 17 nt, Human
cuggcugggaguggcau

SEQ ID NO: 1028366 - RNA, 12 nt, Human
aauuauuauuua

SEQ ID NO: 1028367 - RNA, 17 nt, Human
gcaccuguaaucccagc

SEQ ID NO: 1028368 - RNA, 14 nt, Human
agaaaugaaagcag

SEQ ID NO: 1028369 - RNA, 21 nt, Human
ugaaaaugaauaucuauuaau

SEQ ID NO: 1028370 - RNA, 16 nt, Human
acgggguuugccaugc

SEQ ID NO: 1028371 - RNA, 15 nt, Human
uuuguccuuuuuguu

SEQ ID NO: 1028372 - RNA, 17 nt, Human
ucucuuaaacacuaaaa

SEQ ID NO: 1028373 - RNA, 21 nt, Human
aaacauuacaguuagagauuu

SEQ ID NO: 1028374 - RNA, 19 nt, Human
cuccgucucccaaagugcu

SEQ ID NO: 1028375 - RNA, 22 nt, Human
uuaauggaauauguaaauagaa

SEQ ID NO: 1028376 - RNA, 22 nt, Human
auccagauagguuaccaguaac

SEQ ID NO: 1028377 - RNA, 22 nt, Human
aaugcuuaugaaacuaagauuu

SEQ ID NO: 1028378 - RNA, 20 nt, Human
acugucucacuuaauccuuu

SEQ ID NO: 1028379 - RNA, 16 nt, Human
ccuauauccugugacu

SEQ ID NO: 1028380 - RNA, 23 nt, Human
uacuugggagaccuguaaucaua

SEQ ID NO: 1028381 - RNA, 18 nt, Human
uuucuuaaagaauuuuca

SEQ ID NO: 1028382 - RNA, 21 nt, Human
uaaguuuaugcauacaguaau

SEQ ID NO: 1028383 - RNA, 19 nt, Human
cagcuucucauccugcagg

SEQ ID NO: 1028384 - RNA, 20 nt, Human
augguuuagaaagcuugccc

SEQ ID NO: 1028385 - RNA, 23 nt, Human
uuaucagucauaacuaaauaaag

SEQ ID NO: 1028386 - RNA, 13 nt, Human
cucaaaaaauaaa

SEQ ID NO: 1028387 - RNA, 21 nt, Human
ucagaucauuucaaaacucau

SEQ ID NO: 1028388 - RNA, 18 nt, Human
uaaaauggagacaccacc

SEQ ID NO: 1028389 - RNA, 15 nt, Human
gaaacauuacaguua

SEQ ID NO: 1028390 - RNA, 19 nt, Human
aaaauugugaucagaccau

SEQ ID NO: 1028391 - RNA, 20 nt, Human
uuucccucuuggugccucag

SEQ ID NO: 1028392 - RNA, 23 nt, Human
cagccaugugauuacccucuggg

SEQ ID NO: 1028393 - RNA, 19 nt, Human
auuguugacaacugugacu

SEQ ID NO: 1028394 - RNA, 16 nt, Human
ucuaguacuugggaga

SEQ ID NO: 1028395 - RNA, 16 nt, Human
cucgaacugcuggauu

SEQ ID NO: 1028396 - RNA, 18 nt, Human
aguaauuucagaagaaau

SEQ ID NO: 1028397 - RNA, 19 nt, Human
acuuauugacuauuauaga

SEQ ID NO: 1028398 - RNA, 19 nt, Human
aagacuaugaggaauauuu

SEQ ID NO: 1028399 - RNA, 19 nt, Human
auaauguuacauuauuauc

SEQ ID NO: 1028400 - RNA, 17 nt, Human
uucuaaaugaauguuua

SEQ ID NO: 1028401 - RNA, 17 nt, Human
cuguauugcauuaaaua

SEQ ID NO: 1028402 - RNA, 17 nt, Human
aaaaucuaauucaaacu

SEQ ID NO: 1028403 - RNA, 14 nt, Human
uauauuuauaacuc

SEQ ID NO: 1028404 - RNA, 17 nt, Human
cuccugggcagcugccu

SEQ ID NO: 1028405 - RNA, 19 nt, Human
agcugauaucaugccccug

SEQ ID NO: 1028406 - RNA, 16 nt, Human
aagaaugacuaugcaa

SEQ ID NO: 1028407 - RNA, 17 nt, Human
uauagcauauguuuuug

SEQ ID NO: 1028408 - RNA, 15 nt, Human
auacuguauuuuuac

SEQ ID NO: 1028409 - RNA, 13 nt, Human
cugcaauaaaaug

SEQ ID NO: 1028410 - RNA, 14 nt, Human
uaugcauacaguaa

SEQ ID NO: 1028411 - RNA, 16 nt, Human
aacugcuggauucaag

SEQ ID NO: 1028412 - RNA, 18 nt, Human
uguuucuugagaagagaa

SEQ ID NO: 1028413 - RNA, 19 nt, Human
cccaggaguuuggccagaa

SEQ ID NO: 1028414 - RNA, 19 nt, Human
cacacuaugguauuugagu

SEQ ID NO: 1028415 - RNA, 16 nt, Human
gggcuuuagggaccug

SEQ ID NO: 1028416 - RNA, 18 nt, Human
uacauacugcugucuaug

SEQ ID NO: 1028417 - RNA, 21 nt, Human
aaauccuuuacuguuagucau

SEQ ID NO: 1028418 - RNA, 17 nt, Human
agaaauuccaggaaaau

SEQ ID NO: 1028419 - RNA, 13 nt, Human
aucuacacuccag

SEQ ID NO: 1028420 - RNA, 20 nt, Human
uaagauuuuguuuuuaaacu

SEQ ID NO: 1028421 - RNA, 15 nt, Human
cagugucuggcacuu

SEQ ID NO: 1028422 - RNA, 22 nt, Human
uacaguuagagauuuuuaaaua

SEQ ID NO: 1028423 - RNA, 22 nt, Human
aauaaauguaucuuauucacau

SEQ ID NO: 1028424 - RNA, 19 nt, Human
caaacagaacuauggaaaa

SEQ ID NO: 1028425 - RNA, 19 nt, Human
uauaacucaucauaaaaua

SEQ ID NO: 1028426 - RNA, 20 nt, Human
auauaauaaauguacauuaa

SEQ ID NO: 1028427 - RNA, 20 nt, Human
acgugacuggccugcuggau

SEQ ID NO: 1028428 - RNA, 19 nt, Human
agcucugcccauccugccc

SEQ ID NO: 1028429 - RNA, 20 nt, Human
guucugcagauaaacaguag

SEQ ID NO: 1028430 - RNA, 18 nt, Human
auuauaagcuguuuuuau

SEQ ID NO: 1028431 - RNA, 22 nt, Human
aaacauuucaaaagguauuuau

SEQ ID NO: 1028432 - RNA, 21 nt, Human
cuauguucuaagaagugaaaa

SEQ ID NO: 1028433 - RNA, 16 nt, Human
acuccuaguaauuuaa

SEQ ID NO: 1028434 - RNA, 15 nt, Human
ccacaagaaaugaaa

SEQ ID NO: 1028435 - RNA, 20 nt, Human
cagagacgggguuugccaug

SEQ ID NO: 1028436 - RNA, 18 nt, Human
ggaaagacagcuucucau

SEQ ID NO: 1028437 - RNA, 20 nt, Human
gcugauauauguguuuuuca

SEQ ID NO: 1028438 - RNA, 17 nt, Human
ugaaauaagccagacau

SEQ ID NO: 1028439 - RNA, 18 nt, Human
uuugacaagguucuuccc

SEQ ID NO: 1028440 - RNA, 14 nt, Human
guauacuguauuuu

SEQ ID NO: 1028441 - RNA, 17 nt, Human
aucccucccuccaccuc

SEQ ID NO: 1028442 - RNA, 22 nt, Human
agaauggaacucaaggaaaucu

SEQ ID NO: 1028443 - RNA, 19 nt, Human
ucagugucaaugcagcccc

SEQ ID NO: 1028444 - RNA, 16 nt, Human
guaucuuguuuuucca

SEQ ID NO: 1028445 - RNA, 14 nt, Human
agcuguugagcugu

SEQ ID NO: 1028446 - RNA, 15 nt, Human
augaggaauauuugc

SEQ ID NO: 1028447 - RNA, 15 nt, Human
uaauauugcaaggca

SEQ ID NO: 1028448 - RNA, 13 nt, Human
ugugacuuuccua

SEQ ID NO: 1028449 - RNA, 22 nt, Human
cuuguaaaguacagacuuuuuu

SEQ ID NO: 1028450 - RNA, 20 nt, Human
cagcuuguuauuuauaacaa

SEQ ID NO: 1028451 - RNA, 17 nt, Human
uguuuuuauauauguga

SEQ ID NO: 1028452 - RNA, 23 nt, Human
gucuccaaaaucggaucuggggc

SEQ ID NO: 1028453 - RNA, 15 nt, Human
gacaaaugcuuauga

SEQ ID NO: 1028454 - RNA, 16 nt, Human
cuugccaucccucccu

SEQ ID NO: 1028455 - RNA, 13 nt, Human
agugucuggcacu

SEQ ID NO: 1028456 - RNA, 21 nt, Human
cauauguuuuuguaaguuuau

SEQ ID NO: 1028457 - RNA, 13 nt, Human
aagacucugucuc

SEQ ID NO: 1028458 - RNA, 21 nt, Human
auugugaucagaccauaaugu

SEQ ID NO: 1028459 - RNA, 17 nt, Human
gcaugucagacagaacu

SEQ ID NO: 1028460 - RNA, 14 nt, Human
aaugagcaaaaguu

SEQ ID NO: 1028461 - RNA, 19 nt, Human
ugagcaccugcaggcguga

SEQ ID NO: 1028462 - RNA, 19 nt, Human
aaauggagugacuuagugu

SEQ ID NO: 1028463 - RNA, 24 nt, Human
uggugugcuggcuuaaaauguaau

SEQ ID NO: 1028464 - RNA, 16 nt, Human
cuucacuuuuuuucuu

SEQ ID NO: 1028465 - RNA, 13 nt, Human
gcaguucagagcu

SEQ ID NO: 1028466 - RNA, 18 nt, Human
agaacuauggaaaaaaag

SEQ ID NO: 1028467 - RNA, 14 nt, Human
aauuccucugggaa

SEQ ID NO: 1028468 - RNA, 18 nt, Human
auuuuaauuuugaauaaa

SEQ ID NO: 1028469 - RNA, 16 nt, Human
uuuaagauuuuguuuu

SEQ ID NO: 1028470 - RNA, 17 nt, Human
caguauucccuuuugcu

SEQ ID NO: 1028471 - RNA, 14 nt, Human
agguucuucccuuu

SEQ ID NO: 1028472 - RNA, 13 nt, Human
uaaggcuucucuu

SEQ ID NO: 1028473 - RNA, 15 nt, Human
uagaaggauguacau

SEQ ID NO: 1028474 - RNA, 16 nt, Human
cauggugaaaccccgu

SEQ ID NO: 1028475 - RNA, 13 nt, Human
ucugauuuuccug

SEQ ID NO: 1028476 - RNA, 17 nt, Human
aaaaagcauuguaacuu

SEQ ID NO: 1028477 - RNA, 15 nt, Human
uuuaaagacaaagac

SEQ ID NO: 1028478 - RNA, 19 nt, Human
agccuggucaacaugguga

SEQ ID NO: 1028479 - RNA, 18 nt, Human
acagagacagaaagcaga

SEQ ID NO: 1028480 - RNA, 16 nt, Human
cacuuuuuuucuuuuc

SEQ ID NO: 1028481 - RNA, 15 nt, Human
gggacaguuccugag

SEQ ID NO: 1028482 - RNA, 17 nt, Human
auuuugaauaaauaaau

SEQ ID NO: 1028483 - RNA, 17 nt, Human
agcucugcccauccugc

SEQ ID NO: 1028484 - RNA, 20 nt, Human
aggagauggaaguugcagug

SEQ ID NO: 1028485 - RNA, 13 nt, Human
uuuguaauauuuc

SEQ ID NO: 1028486 - RNA, 21 nt, Human
uuucgaugguacauauuucuu

SEQ ID NO: 1028487 - RNA, 14 nt, Human
cagagguugcagug

SEQ ID NO: 1028488 - RNA, 18 nt, Human
cuggggccuguugaagau

SEQ ID NO: 1028489 - RNA, 15 nt, Human
gacuuacuauuuauu

SEQ ID NO: 1028490 - RNA, 20 nt, Human
uauauagauggcgagaaccu

SEQ ID NO: 1028491 - RNA, 18 nt, Human
ucuucuagguucuaaaaa

SEQ ID NO: 1028492 - RNA, 17 nt, Human
aagaagccacagaccua

SEQ ID NO: 1028493 - RNA, 21 nt, Human
cuauuauagaauggaacucaa

SEQ ID NO: 1028494 - RNA, 13 nt, Human
cuggccaggcugg

SEQ ID NO: 1028495 - RNA, 18 nt, Human
gacuauuauagaauggaa

SEQ ID NO: 1028496 - RNA, 19 nt, Human
uucagagcugcccucuccu

SEQ ID NO: 1028497 - RNA, 16 nt, Human
auagaauuaauggaau

SEQ ID NO: 1028498 - RNA, 21 nt, Human
gcccaagggugggugggguga

SEQ ID NO: 1028499 - RNA, 16 nt, Human
uguuuccuagcgcagc

SEQ ID NO: 1028500 - RNA, 15 nt, Human
ucucagaaauuguau

SEQ ID NO: 1028501 - RNA, 21 nt, Human
cccccauuguggucacaggaa

SEQ ID NO: 1028502 - RNA, 19 nt, Human
gagacuuugugaaaaaaaa

SEQ ID NO: 1028503 - RNA, 13 nt, Human
caaaaaaagcauu

SEQ ID NO: 1028504 - RNA, 20 nt, Human
cucccuccaccucccugcaa

SEQ ID NO: 1028505 - RNA, 22 nt, Human
caguguccucaucuguaaaaug

SEQ ID NO: 1028506 - RNA, 15 nt, Human
acucuuuugccauua

SEQ ID NO: 1028507 - RNA, 13 nt, Human
aucaaugaaugaa

SEQ ID NO: 1028508 - RNA, 15 nt, Human
auauauguauuuaua

SEQ ID NO: 1028509 - RNA, 23 nt, Human
acuuauuuauuguuguuggaggc

SEQ ID NO: 1028510 - RNA, 20 nt, Human
uauacuguauuuuuaccuuu

SEQ ID NO: 1028511 - RNA, 15 nt, Human
uuacagagacagaaa

SEQ ID NO: 1028512 - RNA, 21 nt, Human
cuagauacugaauguaaacaa

SEQ ID NO: 1028513 - RNA, 23 nt, Human
uucagcagagacgggguuugcca

SEQ ID NO: 1028514 - RNA, 22 nt, Human
cccuugccauggagguuaagca

SEQ ID NO: 1028515 - RNA, 15 nt, Human
aggcuggagugcagu

SEQ ID NO: 1028516 - RNA, 22 nt, Human
aauuuaaaaaaaaaccugagcc

SEQ ID NO: 1028517 - RNA, 12 nt, Human
cuuccucacacc

SEQ ID NO: 1028518 - RNA, 20 nt, Human
aucucugauacuuuuuucau

SEQ ID NO: 1028519 - RNA, 19 nt, Human
ugacacuagcuaauaucaa

SEQ ID NO: 1028520 - RNA, 18 nt, Human
ccaaguuuauauacaauu

SEQ ID NO: 1028521 - RNA, 18 nt, Human
guagccacuucacuuuuu

SEQ ID NO: 1028522 - RNA, 12 nt, Human
caucuucucugg

SEQ ID NO: 1028523 - RNA, 15 nt, Human
uguaacuuaugaacc

SEQ ID NO: 1028524 - RNA, 13 nt, Human
cagcaguucagag

SEQ ID NO: 1028525 - RNA, 16 nt, Human
agagggaauugcagag

SEQ ID NO: 1028526 - RNA, 17 nt, Human
ucuauuagccacaaaau

SEQ ID NO: 1028527 - RNA, 22 nt, Human
aauguuauuuuuuaauuauuau

SEQ ID NO: 1028528 - RNA, 19 nt, Human
aaauggugaaaugcagagu

SEQ ID NO: 1028529 - RNA, 20 nt, Human
aacucauuuguuaaaauuau

SEQ ID NO: 1028530 - RNA, 17 nt, Human
auuauuuauauauguau

SEQ ID NO: 1028531 - RNA, 18 nt, Human
accuguaaucauauaaua

SEQ ID NO: 1028532 - RNA, 20 nt, Human
uuuaguaagagauuccugag

SEQ ID NO: 1028533 - RNA, 15 nt, Human
auauguauuuauaaa

SEQ ID NO: 1028534 - RNA, 16 nt, Human
uguagauaaacucaga

SEQ ID NO: 1028535 - RNA, 16 nt, Human
auaucaauuuaaaaaa

SEQ ID NO: 1028536 - RNA, 19 nt, Human
agaccuguaaucauauaau

SEQ ID NO: 1028537 - RNA, 16 nt, Human
ccuguacuccagccug

SEQ ID NO: 1028538 - RNA, 15 nt, Human
gaccagagcuacuga

SEQ ID NO: 1028539 - RNA, 18 nt, Human
ucugggucucaguguccu

SEQ ID NO: 1028540 - RNA, 15 nt, Human
auuuauaacucauca

SEQ ID NO: 1028541 - RNA, 17 nt, Human
ugaccacugcagaagac

SEQ ID NO: 1028542 - RNA, 15 nt, Human
acucaucaaucaaau

SEQ ID NO: 1028543 - RNA, 21 nt, Human
auucccuccugcuacucuguu

SEQ ID NO: 1028544 - RNA, 21 nt, Human
aggcagcaggauagaguggga

SEQ ID NO: 1028545 - RNA, 16 nt, Human
cugcuggauucaagug

SEQ ID NO: 1028546 - RNA, 15 nt, Human
accuguaaucccagc

SEQ ID NO: 1028547 - RNA, 16 nt, Human
uacccucugggucuca

SEQ ID NO: 1028548 - RNA, 17 nt, Human
aaacaaaaaaagcauug

SEQ ID NO: 1028549 - RNA, 17 nt, Human
aauauuugaauuuuaaa

SEQ ID NO: 1028550 - RNA, 14 nt, Human
auagcaucucagga

SEQ ID NO: 1028551 - RNA, 16 nt, Human
ucaucuuggucacaua

SEQ ID NO: 1028552 - RNA, 18 nt, Human
ccugcagacaugagagac

SEQ ID NO: 1028553 - RNA, 16 nt, Human
guaauucuaaaugaau

SEQ ID NO: 1028554 - RNA, 17 nt, Human
guacauuuccaaauuca

SEQ ID NO: 1028555 - RNA, 13 nt, Human
uguaaaguacaga

SEQ ID NO: 1028556 - RNA, 13 nt, Human
gccaugcuggcca

SEQ ID NO: 1028557 - RNA, 16 nt, Human
guaacauagguuuuua

SEQ ID NO: 1028558 - RNA, 22 nt, Human
gaagggcaucaugcaucuuacu

SEQ ID NO: 1028559 - RNA, 10 nt, Human
caacauuaaa

SEQ ID NO: 1028560 - RNA, 14 nt, Human
gcaguucagagcug

SEQ ID NO: 1028561 - RNA, 17 nt, Human
auuugcagcugugccau

SEQ ID NO: 1028562 - RNA, 22 nt, Human
agugucugaugaauguuaaauu

SEQ ID NO: 1028563 - RNA, 15 nt, Human
cucgaacugcuggau

SEQ ID NO: 1028564 - RNA, 22 nt, Human
cucuccugggcagcugccuccc

SEQ ID NO: 1028565 - RNA, 15 nt, Human
acacuaacauauaau

SEQ ID NO: 1028566 - RNA, 13 nt, Human
acaacauuaaaac

SEQ ID NO: 1028567 - RNA, 13 nt, Human
gcagccaaccuaa

SEQ ID NO: 1028568 - RNA, 14 nt, Human
aucagucauaacua

SEQ ID NO: 1028569 - RNA, 16 nt, Human
auuccaccuacaugag

SEQ ID NO: 1028570 - RNA, 19 nt, Human
gccagcaguucagagcugc

SEQ ID NO: 1028571 - RNA, 15 nt, Human
uccagacacuuuuuu

SEQ ID NO: 1028572 - RNA, 14 nt, Human
augaaauaacuagg

SEQ ID NO: 1028573 - RNA, 13 nt, Human
auguaucuuauuc

SEQ ID NO: 1028574 - RNA, 19 nt, Human
cuucuggguucaagcgauu

SEQ ID NO: 1028575 - RNA, 13 nt, Human
auuuauugcugaa

SEQ ID NO: 1028576 - RNA, 23 nt, Human
ggagggggcgcgugcaggcagca

SEQ ID NO: 1028577 - RNA, 15 nt, Human
caaaacuuucuuuuc

SEQ ID NO: 1028578 - RNA, 22 nt, Human
aaaaaaccugagccccaaaagg

SEQ ID NO: 1028579 - RNA, 14 nt, Human
ucuuuuuuuuaaua

SEQ ID NO: 1028580 - RNA, 22 nt, Human
gcgacucuauagacucuaggac

SEQ ID NO: 1028581 - RNA, 19 nt, Human
cucugcauacucauuagga

SEQ ID NO: 1028582 - RNA, 18 nt, Human
caugaagauguagaggag

SEQ ID NO: 1028583 - RNA, 15 nt, Human
aagauuucuugaguu

SEQ ID NO: 1028584 - RNA, 20 nt, Human
acggacgaaccuugaaaacu

SEQ ID NO: 1028585 - RNA, 13 nt, Human
agaauuuauucaa

SEQ ID NO: 1028586 - RNA, 22 nt, Human
uuaagcacuuuaacacaguguc

SEQ ID NO: 1028587 - RNA, 15 nt, Human
ggaauuuucuuccaa

SEQ ID NO: 1028588 - RNA, 16 nt, Human
uaccuuuugcuguggc

SEQ ID NO: 1028589 - RNA, 23 nt, Human
augguauuugaguguuuuaagau

SEQ ID NO: 1028590 - RNA, 12 nt, Human
uugccugcaggc

SEQ ID NO: 1028591 - RNA, 12 nt, Human
gguauuuuaauc

SEQ ID NO: 1028592 - RNA, 15 nt, Human
cacuaugguauuuga

SEQ ID NO: 1028593 - RNA, 16 nt, Human
caguguccucaucugu

SEQ ID NO: 1028594 - RNA, 21 nt, Human
cuuuucaaaauuggacuuaaa

SEQ ID NO: 1028595 - RNA, 21 nt, Human
aaggaagaaauuccaggaaaa

SEQ ID NO: 1028596 - RNA, 14 nt, Human
ccagacacuuuuuu

SEQ ID NO: 1028597 - RNA, 19 nt, Human
uucaauacuucauuuaaaa

SEQ ID NO: 1028598 - RNA, 15 nt, Human
uuugguaaaauacuu

SEQ ID NO: 1028599 - RNA, 14 nt, Human
uugaauuuuaaauc

SEQ ID NO: 1028600 - RNA, 12 nt, Human
auaaaaauaaau

SEQ ID NO: 1028601 - RNA, 22 nt, Human
guauuuuuaccuuuuuccuucc

SEQ ID NO: 1028602 - RNA, 23 nt, Human
cacaagaaaugaaagcagggacu

SEQ ID NO: 1028603 - RNA, 15 nt, Human
auggugaaaugcaga

SEQ ID NO: 1028604 - RNA, 17 nt, Human
aaaugcuguauucuucu

SEQ ID NO: 1028605 - RNA, 18 nt, Human
uacuuuuuucauuauugg

SEQ ID NO: 1028606 - RNA, 13 nt, Human
acaugagagacag

SEQ ID NO: 1028607 - RNA, 17 nt, Human
aaugacuaaaaaacaaa

SEQ ID NO: 1028608 - RNA, 13 nt, Human
uuugccaugcugg

SEQ ID NO: 1028609 - RNA, 17 nt, Human
ugaaaugacuaaaaaac

SEQ ID NO: 1028610 - RNA, 17 nt, Human
uacuauuuauugcugaa

SEQ ID NO: 1028611 - RNA, 17 nt, Human
ugcccaagaaugagaag

SEQ ID NO: 1028612 - RNA, 15 nt, Human
uugacccacaagaaa

SEQ ID NO: 1028613 - RNA, 11 nt, Human
ggcuuguaaag

SEQ ID NO: 1028614 - RNA, 20 nt, Human
ucccuuuugcugccucuaaa

SEQ ID NO: 1028615 - RNA, 15 nt, Human
agacagcucugcaua

SEQ ID NO: 1028616 - RNA, 16 nt, Human
uuuaacacagugucug

SEQ ID NO: 1028617 - RNA, 14 nt, Human
cuuuauauuauuuu

SEQ ID NO: 1028618 - RNA, 16 nt, Human
gauguggagggggcgc

SEQ ID NO: 1028619 - RNA, 23 nt, Human
gcccuggugccucaccccuugcc

SEQ ID NO: 1028620 - RNA, 15 nt, Human
cuuacuauuuauugc

SEQ ID NO: 1028621 - RNA, 13 nt, Human
ccaaaagguauuu

SEQ ID NO: 1028622 - RNA, 12 nt, Human
cuuuaauuucau

SEQ ID NO: 1028623 - RNA, 17 nt, Human
gccaucccucccuccac

SEQ ID NO: 1028624 - RNA, 13 nt, Human
guauuuauauauu

SEQ ID NO: 1028625 - RNA, 16 nt, Human
ccucuccugggcagcu

SEQ ID NO: 1028626 - RNA, 15 nt, Human
cacuucacuuuuuuu

SEQ ID NO: 1028627 - RNA, 15 nt, Human
uaauuauuauuuaua

SEQ ID NO: 1028628 - RNA, 15 nt, Human
cucccuccaccuccc

SEQ ID NO: 1028629 - RNA, 19 nt, Human
auugaaaggcauucucuga

SEQ ID NO: 1028630 - RNA, 18 nt, Human
caagugauccgcccaucu

SEQ ID NO: 1028631 - RNA, 14 nt, Human
ggcgggacacaggc

SEQ ID NO: 1028632 - RNA, 22 nt, Human
aaagcacgaaauguuauuuuuu

SEQ ID NO: 1028633 - RNA, 14 nt, Human
auuuauugagcacc

SEQ ID NO: 1028634 - RNA, 20 nt, Human
uaagaaauaugcacaauagc

SEQ ID NO: 1028635 - RNA, 23 nt, Human
ccagcuacuugggaggcugaggc

SEQ ID NO: 1028636 - RNA, 20 nt, Human
cuuuugcugccucuaaaagg

SEQ ID NO: 1028637 - RNA, 21 nt, Human
aaacaaaaaaagcauuguaac

SEQ ID NO: 1028638 - RNA, 18 nt, Human
ggauagcugacccagccc

SEQ ID NO: 1028639 - RNA, 22 nt, Human
uuaugugcaauaaaauguauuu

SEQ ID NO: 1028640 - RNA, 15 nt, Human
aaguauuuauauauu

SEQ ID NO: 1028641 - RNA, 14 nt, Human
aggcugaggcaaga

SEQ ID NO: 1028642 - RNA, 20 nt, Human
acuaaauaaagcuugcaaca

SEQ ID NO: 1028643 - RNA, 14 nt, Human
auauuuauuauuuu

SEQ ID NO: 1028644 - RNA, 22 nt, Human
auagagacuuugugaaaaaaaa

SEQ ID NO: 1028645 - RNA, 13 nt, Human
uauauuuuuagac

SEQ ID NO: 1028646 - RNA, 17 nt, Human
auuaauggaauauguaa

SEQ ID NO: 1028647 - RNA, 15 nt, Human
uuuaagauaauuaua

SEQ ID NO: 1028648 - RNA, 23 nt, Human
uguaaucccagcuacuugggagg

SEQ ID NO: 1028649 - RNA, 14 nt, Human
uauuauuuauauau

SEQ ID NO: 1028650 - RNA, 17 nt, Human
cacgccuguaaucccag

SEQ ID NO: 1028651 - RNA, 17 nt, Human
aaauuccaggaaaaucu

SEQ ID NO: 1028652 - RNA, 21 nt, Human
cagagucaaugaacuuuccac

SEQ ID NO: 1028653 - RNA, 15 nt, Human
uuuucugcuuuaauu

SEQ ID NO: 1028654 - RNA, 18 nt, Human
accaggcuugccugcagg

SEQ ID NO: 1028655 - RNA, 14 nt, Human
aagaaugacuaugc

SEQ ID NO: 1028656 - RNA, 15 nt, Human
uaaguauuuauauau

SEQ ID NO: 1028657 - RNA, 19 nt, Human
aauuuuguuauguauauuu

SEQ ID NO: 1028658 - RNA, 17 nt, Human
gccugcuggauguggag

SEQ ID NO: 1028659 - RNA, 23 nt, Human
acauagaauaguguuggaaaaug

SEQ ID NO: 1028660 - RNA, 14 nt, Human
aaaauacaaaaaaa

SEQ ID NO: 1028661 - RNA, 15 nt, Human
gcaacccaaauguuc

SEQ ID NO: 1028662 - RNA, 11 nt, Human
aauuauuauuu

SEQ ID NO: 1028663 - RNA, 16 nt, Human
agaaauaaugaaauaa

SEQ ID NO: 1028664 - RNA, 16 nt, Human
acucagggagcauuua

SEQ ID NO: 1028665 - RNA, 12 nt, Human
caugggaaguga

SEQ ID NO: 1028666 - RNA, 19 nt, Human
uuuauaucaauuuaaaaaa

SEQ ID NO: 1028667 - RNA, 14 nt, Human
guauuauuuauaau

SEQ ID NO: 1028668 - RNA, 21 nt, Human
ucuccugggcagcugccuccc

SEQ ID NO: 1028669 - RNA, 20 nt, Human
agcaagugaauuuuucucua

SEQ ID NO: 1028670 - RNA, 13 nt, Human
acggggugaaacc

SEQ ID NO: 1028671 - RNA, 22 nt, Human
ccggagccccuugggcagguca

SEQ ID NO: 1028672 - RNA, 19 nt, Human
ccagcaguucagagcugcc

SEQ ID NO: 1028673 - RNA, 11 nt, Human
auuauuauuua

SEQ ID NO: 1028674 - RNA, 19 nt, Human
aguaacucauuuguuaaaa

SEQ ID NO: 1028675 - RNA, 15 nt, Human
cuaauauauaugaau

SEQ ID NO: 1028676 - RNA, 22 nt, Human
agcuacuugggaggcugaggca

SEQ ID NO: 1028677 - RNA, 16 nt, Human
gcaucuuacugaaggu

SEQ ID NO: 1028678 - RNA, 15 nt, Human
cauuccaagccucau

SEQ ID NO: 1028679 - RNA, 14 nt, Human
uauuuuuuaugaaa

SEQ ID NO: 1028680 - RNA, 21 nt, Human
gugaaauaguucaaagccaag

SEQ ID NO: 1028681 - RNA, 17 nt, Human
aaauuaaggcauaagaa

SEQ ID NO: 1028682 - RNA, 19 nt, Human
gaucucagaaauuguaucu

SEQ ID NO: 1028683 - RNA, 16 nt, Human
ucaaaaaauaaaaaua

SEQ ID NO: 1028684 - RNA, 19 nt, Human
cacuuuaacacagugucug

SEQ ID NO: 1028685 - RNA, 14 nt, Human
uuucuuaaagaauu

SEQ ID NO: 1028686 - RNA, 18 nt, Human
uggugugcuggcuuaaaa

SEQ ID NO: 1028687 - RNA, 19 nt, Human
ucaacauggugaaaccccg

SEQ ID NO: 1028688 - RNA, 13 nt, Human
ugcaacaaaauuc

SEQ ID NO: 1028689 - RNA, 14 nt, Human
cauguaauugcuug

SEQ ID NO: 1028690 - RNA, 14 nt, Human
ucccucccuccacc

SEQ ID NO: 1028691 - RNA, 19 nt, Human
ucucuuaaacacuaaaaag

SEQ ID NO: 1028692 - RNA, 17 nt, Human
uguugacaacugugacu

SEQ ID NO: 1028693 - RNA, 14 nt, Human
aucauauaauaaau

SEQ ID NO: 1028694 - RNA, 18 nt, Human
ucuccgucucccaaagug

SEQ ID NO: 1028695 - RNA, 17 nt, Human
guugauagcaagugaau

SEQ ID NO: 1028696 - RNA, 12 nt, Human
uuuacuuuucca

SEQ ID NO: 1028697 - RNA, 21 nt, Human
caagacccaaaaggcagaagc

SEQ ID NO: 1028698 - RNA, 17 nt, Human
accagggccuggcuggg

SEQ ID NO: 1028699 - RNA, 14 nt, Human
cagucugaugagaa

SEQ ID NO: 1028700 - RNA, 21 nt, Human
augaggcauuugcagcugugc

SEQ ID NO: 1028701 - RNA, 16 nt, Human
auacaauuauuuuuac

SEQ ID NO: 1028702 - RNA, 15 nt, Human
aagucugauuuuccu

SEQ ID NO: 1028703 - RNA, 13 nt, Human
gacauaagcaaag

SEQ ID NO: 1028704 - RNA, 15 nt, Human
uugacacuuaaaaau

SEQ ID NO: 1028705 - RNA, 16 nt, Human
aguugcagugagcuga

SEQ ID NO: 1028706 - RNA, 20 nt, Human
cuuugacaaccaugagacca

SEQ ID NO: 1028707 - RNA, 19 nt, Human
acaguuuuccuucucaucu

SEQ ID NO: 1028708 - RNA, 16 nt, Human
gccuaucagcauuuua

SEQ ID NO: 1028709 - RNA, 14 nt, Human
ugagaaaccuuauu

SEQ ID NO: 1028710 - RNA, 16 nt, Human
guacccaaauggaaag

SEQ ID NO: 1028711 - RNA, 18 nt, Human
uaauuuugaauaaauaaa

SEQ ID NO: 1028712 - RNA, 20 nt, Human
gcaaaucucuauuaggaaau

SEQ ID NO: 1028713 - RNA, 23 nt, Human
gggucucccucuguugccaaggc

SEQ ID NO: 1028714 - RNA, 24 nt, Human
guccucaucuguaaaauggagaca

SEQ ID NO: 1028715 - RNA, 12 nt, Human
accaaucauuuu

SEQ ID NO: 1028716 - RNA, 16 nt, Human
gaaccuuuacauccag

SEQ ID NO: 1028717 - RNA, 20 nt, Human
uggacuuuccagagaccagu

SEQ ID NO: 1028718 - RNA, 14 nt, Human
cgcccaucuccguc

SEQ ID NO: 1028719 - RNA, 18 nt, Human
accaccugccuauauuuu

SEQ ID NO: 1028720 - RNA, 14 nt, Human
gaaggcuuacaccc

SEQ ID NO: 1028721 - RNA, 22 nt, Human
gggcagugcuuggcccaggagu

SEQ ID NO: 1028722 - RNA, 15 nt, Human
ucauuuguuaaaauu

SEQ ID NO: 1028723 - RNA, 19 nt, Human
auuauggcugguaacauag

SEQ ID NO: 1028724 - RNA, 14 nt, Human
uugaauaaauaaau

SEQ ID NO: 1028725 - RNA, 18 nt, Human
uguauuuuuaccuuuuuc

SEQ ID NO: 1028726 - RNA, 14 nt, Human
auuaauucaccuuc

SEQ ID NO: 1028727 - RNA, 21 nt, Human
ugccuaucagcauuuuacuac

SEQ ID NO: 1028728 - RNA, 20 nt, Human
auagagacuuugugaaaaaa

SEQ ID NO: 1028729 - RNA, 15 nt, Human
aauugacccacaaga

SEQ ID NO: 1028730 - RNA, 11 nt, Human
ggguuucucca

SEQ ID NO: 1028731 - RNA, 16 nt, Human
caaaaaccaaauuugu

SEQ ID NO: 1028732 - RNA, 16 nt, Human
uacauuuccaaauuca

SEQ ID NO: 1028733 - RNA, 22 nt, Human
gaccuguaaucauauaauaaau

SEQ ID NO: 1028734 - RNA, 18 nt, Human
uaaaaugagcaaaaguug

SEQ ID NO: 1028735 - RNA, 22 nt, Human
aauuguauuuuaguaagagauu

SEQ ID NO: 1028736 - RNA, 21 nt, Human
gaccuggucgucgucuugacu

SEQ ID NO: 1028737 - RNA, 16 nt, Human
uauguauuauuuauaa

SEQ ID NO: 1028738 - RNA, 22 nt, Human
cugucucacuuaauccuuuguu

SEQ ID NO: 1028739 - RNA, 15 nt, Human
uguauuuauaaauau

SEQ ID NO: 1028740 - RNA, 19 nt, Human
aucggagcugcuagaguuc

SEQ ID NO: 1028741 - RNA, 22 nt, Human
uauuuauaaauauauuuaagau

SEQ ID NO: 1028742 - RNA, 18 nt, Human
caaccuccaccuucuggg

SEQ ID NO: 1028743 - RNA, 13 nt, Human
ccucugcuugcca

SEQ ID NO: 1028744 - RNA, 18 nt, Human
uuuccuucucaucuguga

SEQ ID NO: 1028745 - RNA, 18 nt, Human
ucacauuggcuauuuaaa

SEQ ID NO: 1028746 - RNA, 13 nt, Human
aauaaauguacau

SEQ ID NO: 1028747 - RNA, 20 nt, Human
uagaauaguguuggaaaaug

SEQ ID NO: 1028748 - RNA, 14 nt, Human
uccuaguaauuuaa

SEQ ID NO: 1028749 - RNA, 21 nt, Human
gcugcccucuccugggcagcu

SEQ ID NO: 1028750 - RNA, 22 nt, Human
cucugggauagcugacccagcc

SEQ ID NO: 1028751 - RNA, 14 nt, Human
uuccugagccagug

SEQ ID NO: 1028752 - RNA, 21 nt, Human
augucauuugcuggagcucug

SEQ ID NO: 1028753 - RNA, 22 nt, Human
guacaauuauaagcuguuuuua

SEQ ID NO: 1028754 - RNA, 18 nt, Human
ccacauucagagcuuacu

SEQ ID NO: 1028755 - RNA, 18 nt, Human
gaugaacucuuaaucaaa

SEQ ID NO: 1028756 - RNA, 17 nt, Human
guugcugggggggauug

SEQ ID NO: 1028757 - RNA, 21 nt, Human
uuaaaauauuuuuaugugcaa

SEQ ID NO: 1028758 - RNA, 16 nt, Human
uuaauauauguauuau

SEQ ID NO: 1028759 - RNA, 19 nt, Human
uaguuuaugauuccaccua

SEQ ID NO: 1028760 - RNA, 22 nt, Human
uccuuuucgaugguacauauuu

SEQ ID NO: 1028761 - RNA, 16 nt, Human
ucuguauugcauuaaa

SEQ ID NO: 1028762 - RNA, 22 nt, Human
gggacaguuccugagaccagcc

SEQ ID NO: 1028763 - RNA, 22 nt, Human
uagaauauuuauuaccucugau

SEQ ID NO: 1028764 - RNA, 23 nt, Human
ccuugggcaggucacacaaccug

SEQ ID NO: 1028765 - RNA, 20 nt, Human
gcccauccugccccugagcc

SEQ ID NO: 1028766 - RNA, 14 nt, Human
acuauggaaaaaaa

SEQ ID NO: 1028767 - RNA, 16 nt, Human
ucacaagugaaaaaca

SEQ ID NO: 1028768 - RNA, 20 nt, Human
ugagcagugcuugaaugaag

SEQ ID NO: 1028769 - RNA, 22 nt, Human
auuuuauuacaucuuucacauu

SEQ ID NO: 1028770 - RNA, 18 nt, Human
aguuuaugcauacaguaa

SEQ ID NO: 1028771 - RNA, 23 nt, Human
auuacaucuuucacauuggcuau

SEQ ID NO: 1028772 - RNA, 21 nt, Human
agaaauuugccaauuuacuuu

SEQ ID NO: 1028773 - RNA, 14 nt, Human
cuggagcucugccc

SEQ ID NO: 1028774 - RNA, 22 nt, Human
uauauauuuauaacucaucaua

SEQ ID NO: 1028775 - RNA, 20 nt, Human
uaaagaauuuucaaaaucaa

SEQ ID NO: 1028776 - RNA, 17 nt, Human
aauauuuauuaccucug

SEQ ID NO: 1028777 - RNA, 19 nt, Human
ccauccugccccugagccc

SEQ ID NO: 1028778 - RNA, 14 nt, Human
aauugcagaguacu

SEQ ID NO: 1028779 - RNA, 18 nt, Human
ggacacaggcuccaaacu

SEQ ID NO: 1028780 - RNA, 14 nt, Human
uccaaacagaacua

SEQ ID NO: 1028781 - RNA, 14 nt, Human
uuuguaauauuucu

SEQ ID NO: 1028782 - RNA, 20 nt, Human
uuaaauggucaauuuuguua

SEQ ID NO: 1028783 - RNA, 18 nt, Human
gguuaagcacuuuaacac

SEQ ID NO: 1028784 - RNA, 19 nt, Human
uacaguuagagauuuuuaa

SEQ ID NO: 1028785 - RNA, 14 nt, Human
cugucucaguccau

SEQ ID NO: 1028786 - RNA, 18 nt, Human
gccccgggaguggcgcgc

SEQ ID NO: 1028787 - RNA, 14 nt, Human
cccacuggcucccu

SEQ ID NO: 1028788 - RNA, 17 nt, Human
auaucaauuuaaaaaaa

SEQ ID NO: 1028789 - RNA, 14 nt, Human
aaacaaaaaaagca

SEQ ID NO: 1028790 - RNA, 17 nt, Human
uuuauuacaucuuucac

SEQ ID NO: 1028791 - RNA, 19 nt, Human
aauucuaaaugaauguuua

SEQ ID NO: 1028792 - RNA, 16 nt, Human
aagucugauuuuccug

SEQ ID NO: 1028793 - RNA, 15 nt, Human
aagaaauaugcacaa

SEQ ID NO: 1028794 - RNA, 16 nt, Human
uaugacacaucucuga

SEQ ID NO: 1028795 - RNA, 22 nt, Human
aguguugacaguucauauguac

SEQ ID NO: 1028796 - RNA, 16 nt, Human
aguccucuuucaaagg

SEQ ID NO: 1028797 - RNA, 22 nt, Human
aaucugcacugugggcuuuuau

SEQ ID NO: 1028798 - RNA, 21 nt, Human
uccuucagccugaaagaggaa

SEQ ID NO: 1028799 - RNA, 21 nt, Human
cuuuuaaguugcugaugaacu

SEQ ID NO: 1028800 - RNA, 12 nt, Human
agcuugcaacaa

SEQ ID NO: 1028801 - RNA, 21 nt, Human
aaucaccaaggcugauuaaac

SEQ ID NO: 1028802 - RNA, 18 nt, Human
gccagcaguucagagcug

SEQ ID NO: 1028803 - RNA, 17 nt, Human
caccagggccuggcugg

SEQ ID NO: 1028804 - RNA, 20 nt, Human
uucgaugguacauauuucuu

SEQ ID NO: 1028805 - RNA, 15 nt, Human
acuuuggcaaaugag

SEQ ID NO: 1028806 - RNA, 16 nt, Human
acugacaacuugaaua

SEQ ID NO: 1028807 - RNA, 18 nt, Human
gaaauggugaaaugcaga

SEQ ID NO: 1028808 - RNA, 23 nt, Human
uguagauaaacucagaaauuuaa

SEQ ID NO: 1028809 - RNA, 20 nt, Human
uaaaauuaucaauaucuaau

SEQ ID NO: 1028810 - RNA, 15 nt, Human
uucacaagugaaaaa

SEQ ID NO: 1028811 - RNA, 15 nt, Human
acccggccugauuaa

SEQ ID NO: 1028812 - RNA, 17 nt, Human
aauauugcaaggcaaag

SEQ ID NO: 1028813 - RNA, 13 nt, Human
guuacucugaagg

SEQ ID NO: 1028814 - RNA, 17 nt, Human
auuauaauauacuauau

SEQ ID NO: 1028815 - RNA, 21 nt, Human
aauggauaugacacaucucug

SEQ ID NO: 1028816 - RNA, 16 nt, Human
gauagcuuuauuuuuu

SEQ ID NO: 1028817 - RNA, 20 nt, Human
augaaguuguagguaauauu

SEQ ID NO: 1028818 - RNA, 13 nt, Human
gaucauguauuua

SEQ ID NO: 1028819 - RNA, 13 nt, Human
ccuccaccucccu

SEQ ID NO: 1028820 - RNA, 17 nt, Human
aacguguauauuuuuua

SEQ ID NO: 1028821 - RNA, 17 nt, Human
ccaaaagguauuuuaau

SEQ ID NO: 1028822 - RNA, 16 nt, Human
ccuacaugagguacug

SEQ ID NO: 1028823 - RNA, 16 nt, Human
uguaugacgugacugg

SEQ ID NO: 1028824 - RNA, 11 nt, Human
aaggcuggagu

SEQ ID NO: 1028825 - RNA, 19 nt, Human
cuaguaucaaaagaaagaa

SEQ ID NO: 1028826 - RNA, 13 nt, Human
gagaauauuagcu

SEQ ID NO: 1028827 - RNA, 15 nt, Human
uuuaccuuuuuccuu

SEQ ID NO: 1028828 - RNA, 22 nt, Human
ucccuuuugcugccucuaaaag

SEQ ID NO: 1028829 - RNA, 17 nt, Human
agggccuggcugggagu

SEQ ID NO: 1028830 - RNA, 18 nt, Human
auggugaaaugcagaguc

SEQ ID NO: 1028831 - RNA, 23 nt, Human
gauuacaaggcuuuaucucaggg

SEQ ID NO: 1028832 - RNA, 12 nt, Human
acaguuuuccuu

SEQ ID NO: 1028833 - RNA, 23 nt, Human
caacugugacuguacccaaaugg

SEQ ID NO: 1028834 - RNA, 15 nt, Human
ucuauuuauuaauau

SEQ ID NO: 1028835 - RNA, 15 nt, Human
aaucaaauuccagaa

SEQ ID NO: 1028836 - RNA, 20 nt, Human
aauauauguauuauuuauaa

SEQ ID NO: 1028837 - RNA, 14 nt, Human
agcuugaaauagug

SEQ ID NO: 1028838 - RNA, 17 nt, Human
auguauuuauaaauaua

SEQ ID NO: 1028839 - RNA, 17 nt, Human
ucaaaaguugaaauuaa

SEQ ID NO: 1028840 - RNA, 21 nt, Human
uaauuuugaauaaauaaaugu

SEQ ID NO: 1028841 - RNA, 20 nt, Human
uuuaauuuugaauaaauaaa

SEQ ID NO: 1028842 - RNA, 19 nt, Human
gaggcagagguugcaguga

SEQ ID NO: 1028843 - RNA, 21 nt, Human
uacaugagguacugagaguga

SEQ ID NO: 1028844 - RNA, 15 nt, Human
cuaagugcagccccg

SEQ ID NO: 1028845 - RNA, 12 nt, Human
aacucagaaauu

SEQ ID NO: 1028846 - RNA, 16 nt, Human
ucuucccuuuuacaua

SEQ ID NO: 1028847 - RNA, 17 nt, Human
uuuuuccagacacuuuu

SEQ ID NO: 1028848 - RNA, 14 nt, Human
uauuuuuaccuuuu

SEQ ID NO: 1028849 - RNA, 23 nt, Human
ucaggaguuccuaaccagccugg

SEQ ID NO: 1028850 - RNA, 12 nt, Human
ggacgagaauga

SEQ ID NO: 1028851 - RNA, 21 nt, Human
gccaucccucccuccaccucc

SEQ ID NO: 1028852 - RNA, 22 nt, Human
agacucugucucaaaaaauaaa

SEQ ID NO: 1028853 - RNA, 18 nt, Human
cuuguaauucuaaaugaa

SEQ ID NO: 1028854 - RNA, 16 nt, Human
acagagacagaaagca

SEQ ID NO: 1028855 - RNA, 15 nt, Human
aaguauauauagaau

SEQ ID NO: 1028856 - RNA, 21 nt, Human
auucagagcuuacuuaaaauu

SEQ ID NO: 1028857 - RNA, 23 nt, Human
auugcagaguacuggcugaugga

SEQ ID NO: 1028858 - RNA, 15 nt, Human
ucugucucaguccau

SEQ ID NO: 1028859 - RNA, 17 nt, Human
uuauaucaauuuaaaaa

SEQ ID NO: 1028860 - RNA, 13 nt, Human
ccgggaguggcgc

SEQ ID NO: 1028861 - RNA, 17 nt, Human
gacuuuccuaaaucaau

SEQ ID NO: 1028862 - RNA, 18 nt, Human
cuguaucuuguuuuucca

SEQ ID NO: 1028863 - RNA, 15 nt, Human
aggcgugagccacca

SEQ ID NO: 1028864 - RNA, 17 nt, Human
gccugagcgacagugag

SEQ ID NO: 1028865 - RNA, 14 nt, Human
uuuauaauuccuau

SEQ ID NO: 1028866 - RNA, 16 nt, Human
caggcuugccugcagg

SEQ ID NO: 1028867 - RNA, 13 nt, Human
ugaaaugcagagu

SEQ ID NO: 1028868 - RNA, 15 nt, Human
auaaagaauuuuaaa

SEQ ID NO: 1028869 - RNA, 16 nt, Human
uaacauuauuuauaug

SEQ ID NO: 1028870 - RNA, 14 nt, Human
aagaagugaaaauc

SEQ ID NO: 1028871 - RNA, 16 nt, Human
caccacccuugccaug

SEQ ID NO: 1028872 - RNA, 16 nt, Human
aaguaauuucagaaga

SEQ ID NO: 1028873 - RNA, 16 nt, Human
auuucaugauuucauu

SEQ ID NO: 1028874 - RNA, 19 nt, Human
caaucaaauaaguauuuau

SEQ ID NO: 1028875 - RNA, 19 nt, Human
uuagacccucaugcugcca

SEQ ID NO: 1028876 - RNA, 18 nt, Human
guaauauugcaaggcaaa

SEQ ID NO: 1028877 - RNA, 20 nt, Human
ggcuuagacccucaugcugc

SEQ ID NO: 1028878 - RNA, 18 nt, Human
aggaagaaauuccaggaa

SEQ ID NO: 1028879 - RNA, 17 nt, Human
aagcugaauacauucug

SEQ ID NO: 1028880 - RNA, 21 nt, Human
ucucacaagcacuuucccucu

SEQ ID NO: 1028881 - RNA, 20 nt, Human
ucauuccccaaccacuucau

SEQ ID NO: 1028882 - RNA, 14 nt, Human
uucaauauuuauua

SEQ ID NO: 1028883 - RNA, 14 nt, Human
uauaauuccuauau

SEQ ID NO: 1028884 - RNA, 23 nt, Human
uaaguaaguuugauuucauuaau

SEQ ID NO: 1028885 - RNA, 21 nt, Human
acuccuaguaauuuaagauuu

SEQ ID NO: 1028886 - RNA, 16 nt, Human
uuaaagaauuuucaaa

SEQ ID NO: 1028887 - RNA, 12 nt, Human
ucuacacuccag

SEQ ID NO: 1028888 - RNA, 17 nt, Human
auucaaaaguugaaauu

SEQ ID NO: 1028889 - RNA, 15 nt, Human
uuguuauuuaaagaa

SEQ ID NO: 1028890 - RNA, 16 nt, Human
uaggauguugaaaaag

SEQ ID NO: 1028891 - RNA, 18 nt, Human
aaaugacuaaaaaacaaa

SEQ ID NO: 1028892 - RNA, 16 nt, Human
cagcuucucauccugc

SEQ ID NO: 1028893 - RNA, 13 nt, Human
cuggccugcugga

SEQ ID NO: 1028894 - RNA, 19 nt, Human
gggaccugcuguuuccuag

SEQ ID NO: 1028895 - RNA, 13 nt, Human
cugagagugaaca

SEQ ID NO: 1028896 - RNA, 16 nt, Human
gacuggccugcuggau

SEQ ID NO: 1028897 - RNA, 15 nt, Human
ugacuggccugcugg

SEQ ID NO: 1028898 - RNA, 17 nt, Human
auggaacucaaggaaau

SEQ ID NO: 1028899 - RNA, 17 nt, Human
cugauggguuucuccag

SEQ ID NO: 1028900 - RNA, 17 nt, Human
uaagaaauaugcacaau

SEQ ID NO: 1028901 - RNA, 13 nt, Human
cuaagaaauaugc

SEQ ID NO: 1028902 - RNA, 14 nt, Human
uauaauaugcacac

SEQ ID NO: 1028903 - RNA, 14 nt, Human
uaauuauuauucuu

SEQ ID NO: 1028904 - RNA, 21 nt, Human
cacaacuauauuaucaugcaa

SEQ ID NO: 1028905 - RNA, 20 nt, Human
gcccaucuccgucucccaaa

SEQ ID NO: 1028906 - RNA, 21 nt, Human
aguauacuguauuuuuaccuu

SEQ ID NO: 1028907 - RNA, 17 nt, Human
cugggucucaguguccu

SEQ ID NO: 1028908 - RNA, 21 nt, Human
cuaaauugacacuuaaaaaug

SEQ ID NO: 1028909 - RNA, 18 nt, Human
uucacaagugaaaaacau

SEQ ID NO: 1028910 - RNA, 20 nt, Human
uauauguguuuuucacauuu

SEQ ID NO: 1028911 - RNA, 23 nt, Human
gacuuuuuuuuuuuuuuaaacaa

SEQ ID NO: 1028912 - RNA, 18 nt, Human
cgggaguggcgcgcgcca

SEQ ID NO: 1028913 - RNA, 16 nt, Human
ccuuuauaaucuuuua

SEQ ID NO: 1028914 - RNA, 14 nt, Human
cuuguauuuuacuu

SEQ ID NO: 1028915 - RNA, 14 nt, Human
aauacucuuaggaa

SEQ ID NO: 1028916 - RNA, 13 nt, Human
acaucuuucacau

SEQ ID NO: 1028917 - RNA, 21 nt, Human
uuaucuaucuaucuauuuauu

SEQ ID NO: 1028918 - RNA, 15 nt, Human
auggaacucaaggaa

SEQ ID NO: 1028919 - RNA, 14 nt, Human
uugccugcaggcau

SEQ ID NO: 1028920 - RNA, 20 nt, Human
auugcuugaacccaggagau

SEQ ID NO: 1028921 - RNA, 16 nt, Human
gaugaucauguauuua

SEQ ID NO: 1028922 - RNA, 13 nt, Human
ucuacuaaaaaua

SEQ ID NO: 1028923 - RNA, 18 nt, Human
ucuuugguggagauaaag

SEQ ID NO: 1028924 - RNA, 22 nt, Human
cuccagccugagcgacagugag

SEQ ID NO: 1028925 - RNA, 20 nt, Human
aaaagauuaugaucucagaa

SEQ ID NO: 1028926 - RNA, 15 nt, Human
caggaggaaggcuua

SEQ ID NO: 1028927 - RNA, 13 nt, Human
gagcaccugcagg

SEQ ID NO: 1028928 - RNA, 14 nt, Human
ccacccuugccaug

SEQ ID NO: 1028929 - RNA, 17 nt, Human
aagaaaggccagcaaau

SEQ ID NO: 1028930 - RNA, 17 nt, Human
augauuucauuucaacu

SEQ ID NO: 1028931 - RNA, 17 nt, Human
agaaaggccagcaaauu

SEQ ID NO: 1028932 - RNA, 17 nt, Human
gcgccaccacgcccagc

SEQ ID NO: 1028933 - RNA, 16 nt, Human
guauuuauaaauauau

SEQ ID NO: 1028934 - RNA, 16 nt, Human
caugguuuagaaagcu

SEQ ID NO: 1028935 - RNA, 13 nt, Human
ucugcuugccauc

SEQ ID NO: 1028936 - RNA, 20 nt, Human
uugcaagacauagaauagug

SEQ ID NO: 1028937 - RNA, 14 nt, Human
uagcauauguuuuu

SEQ ID NO: 1028938 - RNA, 14 nt, Human
accauuuuuacuug

SEQ ID NO: 1028939 - RNA, 20 nt, Human
aguuccugagaccagccaac

SEQ ID NO: 1028940 - RNA, 24 nt, Human
cugauauauguguuuuucacauuu

SEQ ID NO: 1028941 - RNA, 15 nt, Human
cugcagauaaacagu

SEQ ID NO: 1028942 - RNA, 12 nt, Human
auagaauauuua

SEQ ID NO: 1028943 - RNA, 13 nt, Human
cccugcacuccag

SEQ ID NO: 1028944 - RNA, 23 nt, Human
ccagagggaauugcagaguacug

SEQ ID NO: 1028945 - RNA, 13 nt, Human
auugcaaggcaaa

SEQ ID NO: 1028946 - RNA, 23 nt, Human
cuuguaaaguacagacuuuuuuu

SEQ ID NO: 1028947 - RNA, 23 nt, Human
agaccauaauguuacauuauuau

SEQ ID NO: 1028948 - RNA, 12 nt, Human
uuucuauuuauu

SEQ ID NO: 1028949 - RNA, 18 nt, Human
caugcccaagaaugagaa

SEQ ID NO: 1028950 - RNA, 18 nt, Human
auuuuuaaauaaagaauu

SEQ ID NO: 1028951 - RNA, 23 nt, Human
cucuacuaaaaauacaaaaaaaa

SEQ ID NO: 1028952 - RNA, 20 nt, Human
gcugccuccccuccucugcu

SEQ ID NO: 1028953 - RNA, 15 nt, Human
uuaaagacaaagaca

SEQ ID NO: 1028954 - RNA, 20 nt, Human
auguuauuuuuuaauuauua

SEQ ID NO: 1028955 - RNA, 15 nt, Human
cauguccacugguuc

SEQ ID NO: 1028956 - RNA, 21 nt, Human
accaacacuaacauauaaugu

SEQ ID NO: 1028957 - RNA, 21 nt, Human
cuggcuuaaaauguaauuaau

SEQ ID NO: 1028958 - RNA, 16 nt, Human
ugggucucaguguccu

SEQ ID NO: 1028959 - RNA, 15 nt, Human
uuuaccugugaaaua

SEQ ID NO: 1028960 - RNA, 14 nt, Human
auuacaucuuucac

SEQ ID NO: 1028961 - RNA, 23 nt, Human
uacuucauuuaaaauauuuuuau

SEQ ID NO: 1028962 - RNA, 16 nt, Human
ucuauuuauuaauauu

SEQ ID NO: 1028963 - RNA, 19 nt, Human
uggggcagugcuuggccca

SEQ ID NO: 1028964 - RNA, 15 nt, Human
auauuuaacauuauu

SEQ ID NO: 1028965 - RNA, 21 nt, Human
aauacuucauuuaaaauauuu

SEQ ID NO: 1028966 - RNA, 12 nt, Human
agcuaaaguauc

SEQ ID NO: 1028967 - RNA, 18 nt, Human
ccucccuccaccucccug

SEQ ID NO: 1028968 - RNA, 19 nt, Human
agcaucucaggagauuuca

SEQ ID NO: 1028969 - RNA, 16 nt, Human
cugagcgacagugaga

SEQ ID NO: 1028970 - RNA, 21 nt, Human
acuggcucccuggaagagauc

SEQ ID NO: 1028971 - RNA, 14 nt, Human
augaagaagcuaaa

SEQ ID NO: 1028972 - RNA, 21 nt, Human
uugccaugcuggccaggcugg

SEQ ID NO: 1028973 - RNA, 15 nt, Human
auaaauauauuuaag

SEQ ID NO: 1028974 - RNA, 21 nt, Human
ugggcauucuuguuucaauuc

SEQ ID NO: 1028975 - RNA, 21 nt, Human
guuacucugaagggcaucaug

SEQ ID NO: 1028976 - RNA, 13 nt, Human
acccucugggucu

SEQ ID NO: 1028977 - RNA, 15 nt, Human
gcgugagccaccaaa

SEQ ID NO: 1028978 - RNA, 18 nt, Human
uauuuaagguauauaaau

SEQ ID NO: 1028979 - RNA, 15 nt, Human
caaagaagacaacau

SEQ ID NO: 1028980 - RNA, 18 nt, Human
acauuguuugucugucuu

SEQ ID NO: 1028981 - RNA, 22 nt, Human
accuaacgaaguauccuucagc

SEQ ID NO: 1028982 - RNA, 16 nt, Human
gaauggcuaagcaaaa

SEQ ID NO: 1028983 - RNA, 20 nt, Human
uagagacuuugugaaaaaaa

SEQ ID NO: 1028984 - RNA, 22 nt, Human
acuggccugcuggauguggagg

SEQ ID NO: 1028985 - RNA, 20 nt, Human
acuuaccugggcauucuugu

SEQ ID NO: 1028986 - RNA, 24 nt, Human
aaagacagcuucucauccugcagg

SEQ ID NO: 1028987 - RNA, 14 nt, Human
accugggcauucuu

SEQ ID NO: 1028988 - RNA, 18 nt, Human
guaaauagaaacguguau

SEQ ID NO: 1028989 - RNA, 22 nt, Human
ucucuacuaaaaauacaaaaau

SEQ ID NO: 1028990 - RNA, 16 nt, Human
ucugcagauaaacagu

SEQ ID NO: 1028991 - RNA, 19 nt, Human
auuuauaaauggacaaaug

SEQ ID NO: 1028992 - RNA, 15 nt, Human
uuaauauuuaacauu

SEQ ID NO: 1028993 - RNA, 20 nt, Human
uacugccgguuugaaaauau

SEQ ID NO: 1028994 - RNA, 15 nt, Human
cucuacuaaaaauac

SEQ ID NO: 1028995 - RNA, 16 nt, Human
uggaaaaugugcaaua

SEQ ID NO: 1028996 - RNA, 18 nt, Human
gauuaugaucucagaaau

SEQ ID NO: 1028997 - RNA, 13 nt, Human
uugccaucccucc

SEQ ID NO: 1028998 - RNA, 19 nt, Human
gugacuuaaugccacuaaa

SEQ ID NO: 1028999 - RNA, 23 nt, Human
ucaauaucuuuuuuuuaauaaac

SEQ ID NO: 1029000 - RNA, 18 nt, Human
acagaaagcagaacagug

SEQ ID NO: 1029001 - RNA, 17 nt, Human
uuuucaccuguuuuuaa

SEQ ID NO: 1029002 - RNA, 21 nt, Human
uacuucauuuaaaauauuuuu

SEQ ID NO: 1029003 - RNA, 15 nt, Human
uccgaagucuuccau

SEQ ID NO: 1029004 - RNA, 19 nt, Human
auuacaggcgugagccacc

SEQ ID NO: 1029005 - RNA, 17 nt, Human
auucacaaccacucauu

SEQ ID NO: 1029006 - RNA, 12 nt, Human
uacccucugggu

SEQ ID NO: 1029007 - RNA, 14 nt, Human
cugggcagcugccu

SEQ ID NO: 1029008 - RNA, 18 nt, Human
gaauucuuacauguuuuc

SEQ ID NO: 1029009 - RNA, 23 nt, Human
aggcaugagucagucugaugaga

SEQ ID NO: 1029010 - RNA, 18 nt, Human
ccugccugcaauauuuga

SEQ ID NO: 1029011 - RNA, 22 nt, Human
gacagggaaagggucucccucu

SEQ ID NO: 1029012 - RNA, 15 nt, Human
cuuugaugauuaauu

SEQ ID NO: 1029013 - RNA, 23 nt, Human
aauaugugauguggcaaaucucu

SEQ ID NO: 1029014 - RNA, 15 nt, Human
caccuguaaucccag

SEQ ID NO: 1029015 - RNA, 14 nt, Human
uuuucaauauuuau

SEQ ID NO: 1029016 - RNA, 14 nt, Human
uauaaucuuuuaua

SEQ ID NO: 1029017 - RNA, 15 nt, Human
gccagugucaggagg

SEQ ID NO: 1029018 - RNA, 17 nt, Human
caauacuucauuuaaaa

SEQ ID NO: 1029019 - RNA, 22 nt, Human
aaauccuuuacuguuagucauu

SEQ ID NO: 1029020 - RNA, 21 nt, Human
ugcccucuccugggcagcugc

SEQ ID NO: 1029021 - RNA, 17 nt, Human
uaucuauuaauauaugu

SEQ ID NO: 1029022 - RNA, 19 nt, Human
acaaucugaggccuccucu

SEQ ID NO: 1029023 - RNA, 18 nt, Human
cucauccugcaggcagcu

SEQ ID NO: 1029024 - RNA, 16 nt, Human
cauaauguuacauuau

SEQ ID NO: 1029025 - RNA, 10 nt, Human
uucccugccu

SEQ ID NO: 1029026 - RNA, 16 nt, Human
cagaagaaauucugca

SEQ ID NO: 1029027 - RNA, 19 nt, Human
aaaaagcauuguaacuuau

SEQ ID NO: 1029028 - RNA, 16 nt, Human
gacaaagacaaauucu

SEQ ID NO: 1029029 - RNA, 13 nt, Human
gcagaacagugau

SEQ ID NO: 1029030 - RNA, 17 nt, Human
cuauauccugugacugu

SEQ ID NO: 1029031 - RNA, 23 nt, Human
guuucacaagugaaaaacaucca

SEQ ID NO: 1029032 - RNA, 18 nt, Human
cugcaauaaaauggguuu

SEQ ID NO: 1029033 - RNA, 16 nt, Human
aggcuugccugcaggc

SEQ ID NO: 1029034 - RNA, 12 nt, Human
ucaccccuugcc

SEQ ID NO: 1029035 - RNA, 14 nt, Human
cucccucuaauuua

SEQ ID NO: 1029036 - RNA, 23 nt, Human
aaugcuuaugaaacuaagauuug

SEQ ID NO: 1029037 - RNA, 15 nt, Human
cagaucauuucaaaa

SEQ ID NO: 1029038 - RNA, 17 nt, Human
aaaauuggacuuaaaau

SEQ ID NO: 1029039 - RNA, 20 nt, Human
auuugccaauuuacuuuguu

SEQ ID NO: 1029040 - RNA, 12 nt, Human
ccugucccagcg

SEQ ID NO: 1029041 - RNA, 11 nt, Human
aacugcuggau

SEQ ID NO: 1029042 - RNA, 14 nt, Human
uguaaguuuaugca

SEQ ID NO: 1029043 - RNA, 18 nt, Human
uaguaucaaaagaaagaa

SEQ ID NO: 1029044 - RNA, 15 nt, Human
ucuuauagaauauuu

SEQ ID NO: 1029045 - RNA, 14 nt, Human
gagcccauggcacu

SEQ ID NO: 1029046 - RNA, 21 nt, Human
cuugccaucccucccuccacc

SEQ ID NO: 1029047 - RNA, 17 nt, Human
cauguauuuauuuuuuu

SEQ ID NO: 1029048 - RNA, 17 nt, Human
gcuuuauuuuuuaagua

SEQ ID NO: 1029049 - RNA, 22 nt, Human
gcaugaauuuuuuucaucuucu

SEQ ID NO: 1029050 - RNA, 19 nt, Human
uuucacaagugaaaaacau

SEQ ID NO: 1029051 - RNA, 21 nt, Human
uucacaaccacucauucaaaa

SEQ ID NO: 1029052 - RNA, 17 nt, Human
uucaguugauuuuacaa

SEQ ID NO: 1029053 - RNA, 14 nt, Human
cauuuuaauuauua

SEQ ID NO: 1029054 - RNA, 23 nt, Human
aggcuuacacccacaguggaaag

SEQ ID NO: 1029055 - RNA, 17 nt, Human
ggcgcgugcaggcagca

SEQ ID NO: 1029056 - RNA, 19 nt, Human
gaauguaaucaauguuucu

SEQ ID NO: 1029057 - RNA, 20 nt, Human
auuacaguuagagauuuuua

SEQ ID NO: 1029058 - RNA, 22 nt, Human
aagacccaaaaggcagaagcaa

SEQ ID NO: 1029059 - RNA, 12 nt, Human
cuaaaucuauuu

SEQ ID NO: 1029060 - RNA, 21 nt, Human
agcaguucagagcugcccucu

SEQ ID NO: 1029061 - RNA, 15 nt, Human
gcagagacgggguuu

SEQ ID NO: 1029062 - RNA, 15 nt, Human
aacaucuagcaaaug

SEQ ID NO: 1029063 - RNA, 18 nt, Human
aagacucugucucaaaaa

SEQ ID NO: 1029064 - RNA, 14 nt, Human
cuaaauuugguucu

SEQ ID NO: 1029065 - RNA, 12 nt, Human
uucccugaccuc

SEQ ID NO: 1029066 - RNA, 16 nt, Human
agucuuauaauagguu

SEQ ID NO: 1029067 - RNA, 18 nt, Human
auauacuccuaguaauuu

SEQ ID NO: 1029068 - RNA, 12 nt, Human
ugcaggcagcag

SEQ ID NO: 1029069 - RNA, 21 nt, Human
cuuucaucuuggucacauaca

SEQ ID NO: 1029070 - RNA, 16 nt, Human
agauaauuauaauaua

SEQ ID NO: 1029071 - RNA, 18 nt, Human
gccuggucaacaugguga

SEQ ID NO: 1029072 - RNA, 19 nt, Human
gaauuacaggcgugagcca

SEQ ID NO: 1029073 - RNA, 16 nt, Human
gucagaagaccugguc

SEQ ID NO: 1029074 - RNA, 15 nt, Human
uauuaucaugcaaau

SEQ ID NO: 1029075 - RNA, 17 nt, Human
ucacaagugaaaaacau

SEQ ID NO: 1029076 - RNA, 21 nt, Human
caauuuuguuauguauauuuu

SEQ ID NO: 1029077 - RNA, 15 nt, Human
cugagcauguacuga

SEQ ID NO: 1029078 - RNA, 17 nt, Human
ugaucagaccauaaugu

SEQ ID NO: 1029079 - RNA, 14 nt, Human
aaaggccugucccu

SEQ ID NO: 1029080 - RNA, 18 nt, Human
cugcaggcgugaccugac

SEQ ID NO: 1029081 - RNA, 19 nt, Human
ccucaacccccauuucuau

SEQ ID NO: 1029082 - RNA, 19 nt, Human
ugaauaucuauuaauauau

SEQ ID NO: 1029083 - RNA, 21 nt, Human
ugaauuuuucucuaacucaga

SEQ ID NO: 1029084 - RNA, 23 nt, Human
cggagauaucccaggaaaauuaa

SEQ ID NO: 1029085 - RNA, 16 nt, Human
uugcuaggucacagag

SEQ ID NO: 1029086 - RNA, 16 nt, Human
uacuuuguuauuuuuc

SEQ ID NO: 1029087 - RNA, 14 nt, Human
cugauuuuccugga

SEQ ID NO: 1029088 - RNA, 16 nt, Human
uugccauaauuacuau

SEQ ID NO: 1029089 - RNA, 14 nt, Human
gcuggagcucugcc

SEQ ID NO: 1029090 - RNA, 14 nt, Human
aguucagagcugcc

SEQ ID NO: 1029091 - RNA, 15 nt, Human
auugcugaaugacua

SEQ ID NO: 1029092 - RNA, 18 nt, Human
aauuccaccugcaaucaa

SEQ ID NO: 1029093 - RNA, 22 nt, Human
ucaguugauuuuacaauugaaa

SEQ ID NO: 1029094 - RNA, 22 nt, Human
caaccaaauggagugacuuagu

SEQ ID NO: 1029095 - RNA, 18 nt, Human
augcccaagaaugagaag

SEQ ID NO: 1029096 - RNA, 18 nt, Human
auucaaacuaauagaauu

SEQ ID NO: 1029097 - RNA, 15 nt, Human
uggggcuuccuaacu

SEQ ID NO: 1029098 - RNA, 15 nt, Human
cugccuccccuccuc

SEQ ID NO: 1029099 - RNA, 14 nt, Human
aagcacuuucccuc

SEQ ID NO: 1029100 - RNA, 19 nt, Human
auaauacaccagagauaau

SEQ ID NO: 1029101 - RNA, 17 nt, Human
cagcaggauagaguggg

SEQ ID NO: 1029102 - RNA, 16 nt, Human
gauaauuauaauauac

SEQ ID NO: 1029103 - RNA, 14 nt, Human
guacuccagccugg

SEQ ID NO: 1029104 - RNA, 23 nt, Human
uaauccuuuguuuucugacuaau

SEQ ID NO: 1029105 - RNA, 16 nt, Human
augacuaaaaaacaaa

SEQ ID NO: 1029106 - RNA, 15 nt, Human
caaauaaguauuuau

SEQ ID NO: 1029107 - RNA, 16 nt, Human
uguucuaagaagugaa

SEQ ID NO: 1029108 - RNA, 13 nt, Human
caaaaagaauggg

SEQ ID NO: 1029109 - RNA, 17 nt, Human
uugccaucccucccucc

SEQ ID NO: 1029110 - RNA, 20 nt, Human
acuaaaaaggcauguaauug

SEQ ID NO: 1029111 - RNA, 18 nt, Human
uauuucucucuuuuuaga

SEQ ID NO: 1029112 - RNA, 22 nt, Human
aauaguguuggaaaaugugcaa

SEQ ID NO: 1029113 - RNA, 13 nt, Human
aaucauauaauaa

SEQ ID NO: 1029114 - RNA, 15 nt, Human
aucugagccagugcu

SEQ ID NO: 1029115 - RNA, 22 nt, Human
augagaccacuguuaucaaaac

SEQ ID NO: 1029116 - RNA, 12 nt, Human
gccccugagccc

SEQ ID NO: 1029117 - RNA, 21 nt, Human
acaauuauaagcuguuuuuau

SEQ ID NO: 1029118 - RNA, 19 nt, Human
aguguuaucagucauaacu

SEQ ID NO: 1029119 - RNA, 15 nt, Human
acuggcucccuggaa

SEQ ID NO: 1029120 - RNA, 15 nt, Human
acaaaaacaaacaaa

SEQ ID NO: 1029121 - RNA, 19 nt, Human
uagcaacuuuuguguaaug

SEQ ID NO: 1029122 - RNA, 22 nt, Human
uugacccacaagaaaugaaagc

SEQ ID NO: 1029123 - RNA, 21 nt, Human
uauggaaaaaaaggaagaaau

SEQ ID NO: 1029124 - RNA, 16 nt, Human
gaaagggucucccucu

SEQ ID NO: 1029125 - RNA, 16 nt, Human
ucugcuuuaauuucau

SEQ ID NO: 1029126 - RNA, 18 nt, Human
uggaugcacuuuauauua

SEQ ID NO: 1029127 - RNA, 22 nt, Human
aaacagaacuauggaaaaaaag

SEQ ID NO: 1029128 - RNA, 13 nt, Human
uggcaguuuucca

SEQ ID NO: 1029129 - RNA, 13 nt, Human
aguguccucaucu

SEQ ID NO: 1029130 - RNA, 13 nt, Human
auaauaaauguac

SEQ ID NO: 1029131 - RNA, 13 nt, Human
cacuuuuuuucuu

SEQ ID NO: 1029132 - RNA, 14 nt, Human
accugcuguuuccu

SEQ ID NO: 1029133 - RNA, 22 nt, Human
ugaaaccccgucucuacuaaaa

SEQ ID NO: 1029134 - RNA, 20 nt, Human
caaagcacgaaauguuauuu

SEQ ID NO: 1029135 - RNA, 19 nt, Human
uagcuuuauuuuuuaagua

SEQ ID NO: 1029136 - RNA, 21 nt, Human
uaaaaaggcauguaauugcuu

SEQ ID NO: 1029137 - RNA, 17 nt, Human
uugugaaaaaaaauuuu

SEQ ID NO: 1029138 - RNA, 15 nt, Human
uauauuuuuuaugaa

SEQ ID NO: 1029139 - RNA, 21 nt, Human
gcugccuccccuccucugcuu

SEQ ID NO: 1029140 - RNA, 20 nt, Human
agcugcccucuccugggcag

SEQ ID NO: 1029141 - RNA, 22 nt, Human
cauuaaaacaauauuguuucua

SEQ ID NO: 1029142 - RNA, 20 nt, Human
aaguaaguuugauuucauua

SEQ ID NO: 1029143 - RNA, 16 nt, Human
augcuaagugaaauaa

SEQ ID NO: 1029144 - RNA, 23 nt, Human
agaaugagaagaaugacuaugca

SEQ ID NO: 1029145 - RNA, 22 nt, Human
aaccaugagaccacuguuauca

SEQ ID NO: 1029146 - RNA, 19 nt, Human
cauauguuuuuguaaguuu

SEQ ID NO: 1029147 - RNA, 15 nt, Human
auauuuuuuguuaaa

SEQ ID NO: 1029148 - RNA, 18 nt, Human
uuagagauuuuuaaauaa

SEQ ID NO: 1029149 - RNA, 17 nt, Human
agaaggauguacauuuc

SEQ ID NO: 1029150 - RNA, 14 nt, Human
ggacaguuuucugc

SEQ ID NO: 1029151 - RNA, 22 nt, Human
uaaauaaagcuugcaacaaaau

SEQ ID NO: 1029152 - RNA, 18 nt, Human
auuucaugauuucauuuc

SEQ ID NO: 1029153 - RNA, 18 nt, Human
caguuagagauuuuuaaa

SEQ ID NO: 1029154 - RNA, 18 nt, Human
uaaauugacacuuaaaaa

SEQ ID NO: 1029155 - RNA, 14 nt, Human
cugccgcaacaguu

SEQ ID NO: 1029156 - RNA, 22 nt, Human
uuugagacagggaaagggucuc

SEQ ID NO: 1029157 - RNA, 19 nt, Human
acaaauuuacagagacaga

SEQ ID NO: 1029158 - RNA, 20 nt, Human
caggugacccugaugaaaac

SEQ ID NO: 1029159 - RNA, 16 nt, Human
ccacuuauaggaauug

SEQ ID NO: 1029160 - RNA, 14 nt, Human
gacaguuuuccuuc

SEQ ID NO: 1029161 - RNA, 16 nt, Human
aaggguggguggggug

SEQ ID NO: 1029162 - RNA, 17 nt, Human
cagugcuugaaugaagu

SEQ ID NO: 1029163 - RNA, 15 nt, Human
ugccaucccucccuc

SEQ ID NO: 1029164 - RNA, 22 nt, Human
aagacucugucucaaaaaauaa

SEQ ID NO: 1029165 - RNA, 20 nt, Human
ugcuggauucaagugauccg

SEQ ID NO: 1029166 - RNA, 23 nt, Human
uaaucauauaauaaauguacauu

SEQ ID NO: 1029167 - RNA, 18 nt, Human
agugucaaugcagccccc

SEQ ID NO: 1029168 - RNA, 15 nt, Human
uaccuuuuuccuucc

SEQ ID NO: 1029169 - RNA, 14 nt, Human
cuuaugaaccuuua

SEQ ID NO: 1029170 - RNA, 17 nt, Human
cugagaugggagaauca

SEQ ID NO: 1029171 - RNA, 22 nt, Human
auguacauuuccaaauucacaa

SEQ ID NO: 1029172 - RNA, 23 nt, Human
caaggcuggagugcaguggcgca

SEQ ID NO: 1029173 - RNA, 22 nt, Human
ugucucuacuaaaaauacaaaa

SEQ ID NO: 1029174 - RNA, 15 nt, Human
gaggucaggaguucc

SEQ ID NO: 1029175 - RNA, 16 nt, Human
aagaaugagaagaaug

SEQ ID NO: 1029176 - RNA, 19 nt, Human
ucaccaaggcugauuaaac

SEQ ID NO: 1029177 - RNA, 17 nt, Human
ugugaacgauuuagaaa

SEQ ID NO: 1029178 - RNA, 13 nt, Human
cuugacuuuggca

SEQ ID NO: 1029179 - RNA, 15 nt, Human
aaaucuaaaucuauu

SEQ ID NO: 1029180 - RNA, 23 nt, Human
aauauugcaaggcaaagacuauu

SEQ ID NO: 1029181 - RNA, 14 nt, Human
guugccaaggcugg

SEQ ID NO: 1029182 - RNA, 13 nt, Human
cccaaaaggcaga

SEQ ID NO: 1029183 - RNA, 19 nt, Human
uugugccccugcacuccag

SEQ ID NO: 1029184 - RNA, 15 nt, Human
gacucaucaaucaaa

SEQ ID NO: 1029185 - RNA, 20 nt, Human
aguuuaugcauacaguaauu

SEQ ID NO: 1029186 - RNA, 17 nt, Human
ugaaauggugaaaugca

SEQ ID NO: 1029187 - RNA, 19 nt, Human
ucaauauuuauuauuuuca

SEQ ID NO: 1029188 - RNA, 23 nt, Human
uaaauauacuccuaguaauuuaa

SEQ ID NO: 1029189 - RNA, 14 nt, Human
auccagaaauaaug

SEQ ID NO: 1029190 - RNA, 14 nt, Human
guauucuucuuugg

SEQ ID NO: 1029191 - RNA, 18 nt, Human
aucauuucaaaacucauu

SEQ ID NO: 1029192 - RNA, 13 nt, Human
accuagaauaaua

SEQ ID NO: 1029193 - RNA, 23 nt, Human
uauaugugaaauaaaaguagaau

SEQ ID NO: 1029194 - RNA, 17 nt, Human
gccuaagugcagccccg

SEQ ID NO: 1029195 - RNA, 19 nt, Human
acuagacaaguccagccug

SEQ ID NO: 1029196 - RNA, 17 nt, Human
cuaaaauuagaugaacu

SEQ ID NO: 1029197 - RNA, 20 nt, Human
auuauuuugaauccagaaau

SEQ ID NO: 1029198 - RNA, 16 nt, Human
auccuccacaauagca

SEQ ID NO: 1029199 - RNA, 15 nt, Human
auagcagauuuuaau

SEQ ID NO: 1029200 - RNA, 19 nt, Human
uagaaaaagcaguaacuga

SEQ ID NO: 1029201 - RNA, 18 nt, Human
aaagaaaaucaggcuggc

SEQ ID NO: 1029202 - RNA, 13 nt, Human
agagauuccugag

SEQ ID NO: 1029203 - RNA, 14 nt, Human
ggcugggaguggca

SEQ ID NO: 1029204 - RNA, 15 nt, Human
aacauagguuuuuag

SEQ ID NO: 1029205 - RNA, 12 nt, Human
aaugcagccccc

SEQ ID NO: 1029206 - RNA, 18 nt, Human
agaaaacuaagaaauaug

SEQ ID NO: 1029207 - RNA, 12 nt, Human
uuauuuuuuaau

SEQ ID NO: 1029208 - RNA, 21 nt, Human
caaauuaaggcauaagaaaac

SEQ ID NO: 1029209 - RNA, 20 nt, Human
agcaaagacuaugaggaaua

SEQ ID NO: 1029210 - RNA, 22 nt, Human
uugaauaauacaccagagauaa

SEQ ID NO: 1029211 - RNA, 22 nt, Human
uacugagagugaacaaauuuac

SEQ ID NO: 1029212 - RNA, 21 nt, Human
auuccuauauccugugacugu

SEQ ID NO: 1029213 - RNA, 19 nt, Human
uuuuuuaugaaacauuaca

SEQ ID NO: 1029214 - RNA, 18 nt, Human
ccuccaccucccugcaau

SEQ ID NO: 1029215 - RNA, 14 nt, Human
ucuauuaggaaaua

SEQ ID NO: 1029216 - RNA, 17 nt, Human
agaaucacuugaacccg

SEQ ID NO: 1029217 - RNA, 16 nt, Human
ccccugcacuccagcc

SEQ ID NO: 1029218 - RNA, 19 nt, Human
agaccuaggauuucaugau

SEQ ID NO: 1029219 - RNA, 12 nt, Human
gagaaauuugcc

SEQ ID NO: 1029220 - RNA, 18 nt, Human
gcagugcuuggcccagga

SEQ ID NO: 1029221 - RNA, 19 nt, Human
uaagauuuuguuuuuaaac

SEQ ID NO: 1029222 - RNA, 22 nt, Human
aggauggcuaguaucaaaagaa

SEQ ID NO: 1029223 - RNA, 20 nt, Human
acuuugugaaaaaaaauuuu

SEQ ID NO: 1029224 - RNA, 15 nt, Human
aauaucuaauauaua

SEQ ID NO: 1029225 - RNA, 19 nt, Human
ggaaaggagaaguuaagca

SEQ ID NO: 1029226 - RNA, 20 nt, Human
aacucaucauaaaauaaagu

SEQ ID NO: 1029227 - RNA, 15 nt, Human
ucagucauaacuaaa

SEQ ID NO: 1029228 - RNA, 13 nt, Human
aagaauuuuaaaa

SEQ ID NO: 1029229 - RNA, 19 nt, Human
uucuagggaaaugaaagaa

SEQ ID NO: 1029230 - RNA, 22 nt, Human
aaguaacucauuuguuaaaauu

SEQ ID NO: 1029231 - RNA, 18 nt, Human
gccuagcccacuggcucc

SEQ ID NO: 1029232 - RNA, 11 nt, Human
gugaaaaaaaa

SEQ ID NO: 1029233 - RNA, 14 nt, Human
cauuuccaaauuca

SEQ ID NO: 1029234 - RNA, 22 nt, Human
gaauaguguuggaaaaugugca

SEQ ID NO: 1029235 - RNA, 17 nt, Human
ucagacauagaauuaac

SEQ ID NO: 1029236 - RNA, 22 nt, Human
ccuguugaagaugcuuguauuu

SEQ ID NO: 1029237 - RNA, 18 nt, Human
aacucagggagcauuuau

SEQ ID NO: 1029238 - RNA, 21 nt, Human
cuguuccuucacauccugugu

SEQ ID NO: 1029239 - RNA, 19 nt, Human
gugcaauaaaauguauuug

SEQ ID NO: 1029240 - RNA, 20 nt, Human
cugaagggcaucaugcaucu

SEQ ID NO: 1029241 - RNA, 16 nt, Human
gagaaacuggaacucu

SEQ ID NO: 1029242 - RNA, 14 nt, Human
uguacuuuuuccag

SEQ ID NO: 1029243 - RNA, 12 nt, Human
ugcccucuccug

SEQ ID NO: 1029244 - RNA, 23 nt, Human
aaauuaaggcuucucuuaaacac

SEQ ID NO: 1029245 - RNA, 13 nt, Human
gcauacaguaauu

SEQ ID NO: 1029246 - RNA, 15 nt, Human
uuauauuauuuugaa

SEQ ID NO: 1029247 - RNA, 10 nt, Human
acaccaccac

SEQ ID NO: 1029248 - RNA, 23 nt, Human
gaagccgagccucaagaugaagg

SEQ ID NO: 1029249 - RNA, 18 nt, Human
cuuugaagucugauuuuc

SEQ ID NO: 1029250 - RNA, 20 nt, Human
augaauaucuauuaauauau

SEQ ID NO: 1029251 - RNA, 18 nt, Human
gcaauaaaauggguuuua

SEQ ID NO: 1029252 - RNA, 20 nt, Human
auuuauauauuuauaacuca

SEQ ID NO: 1029253 - RNA, 15 nt, Human
uaucuauuaauauau

SEQ ID NO: 1029254 - RNA, 16 nt, Human
uauuuuacuuuuccau

SEQ ID NO: 1029255 - RNA, 14 nt, Human
cuuugugaaaaaaa

SEQ ID NO: 1029256 - RNA, 17 nt, Human
auggcuaguaucaaaag

SEQ ID NO: 1029257 - RNA, 11 nt, Human
augugcaauau

SEQ ID NO: 1029258 - RNA, 20 nt, Human
uacaguaauuuuaaguaauu

SEQ ID NO: 1029259 - RNA, 15 nt, Human
auauuuauuaccucu

SEQ ID NO: 1029260 - RNA, 18 nt, Human
caccuguccccgaaacua

SEQ ID NO: 1029261 - RNA, 18 nt, Human
agcuuacuuaaaauugua

SEQ ID NO: 1029262 - RNA, 16 nt, Human
cacuguuaucaaaacu

SEQ ID NO: 1029263 - RNA, 20 nt, Human
ucuuaacucauugcaaccuc

SEQ ID NO: 1029264 - RNA, 13 nt, Human
auagaguguuauc

SEQ ID NO: 1029265 - RNA, 12 nt, Human
caacccaaaugu

SEQ ID NO: 1029266 - RNA, 19 nt, Human
aaauuugccaauuuacuuu

SEQ ID NO: 1029267 - RNA, 23 nt, Human
ccacuucauucuugaaagcugug

SEQ ID NO: 1029268 - RNA, 15 nt, Human
uuucuugaguuuugu

SEQ ID NO: 1029269 - RNA, 20 nt, Human
gugugcuggcuuaaaaugua

SEQ ID NO: 1029270 - RNA, 16 nt, Human
aacaguauccaguacu

SEQ ID NO: 1029271 - RNA, 20 nt, Human
cagccugagcgacagugaga

SEQ ID NO: 1029272 - RNA, 13 nt, Human
cauuucuauuuau

SEQ ID NO: 1029273 - RNA, 23 nt, Human
uugccugcaggcaugagucaguc

SEQ ID NO: 1029274 - RNA, 14 nt, Human
gccccgggaguggc

SEQ ID NO: 1029275 - RNA, 21 nt, Human
augcaucuuacugaagguaaa

SEQ ID NO: 1029276 - RNA, 21 nt, Human
uauauauguauuuauaaauau

SEQ ID NO: 1029277 - RNA, 19 nt, Human
uuaucaauaucuaauauau

SEQ ID NO: 1029278 - RNA, 19 nt, Human
cgaucuuugacucuuuugc

SEQ ID NO: 1029279 - RNA, 14 nt, Human
ccugggcagcugcc

SEQ ID NO: 1029280 - RNA, 18 nt, Human
acuucaauacuucauuua

SEQ ID NO: 1029281 - RNA, 19 nt, Human
gauccgcccaucuccgucu

SEQ ID NO: 1029282 - RNA, 13 nt, Human
ggaaguagaggag

SEQ ID NO: 1029283 - RNA, 22 nt, Human
aagacauaagcaaagacuauga

SEQ ID NO: 1029284 - RNA, 18 nt, Human
auauuuuuaugugcaaua

SEQ ID NO: 1029285 - RNA, 10 nt, Human
auaacucauc

SEQ ID NO: 1029286 - RNA, 18 nt, Human
caaagacuaugaggaaua

SEQ ID NO: 1029287 - RNA, 14 nt, Human
uagcugacccagcc

SEQ ID NO: 1029288 - RNA, 12 nt, Human
auuuauauaugu

SEQ ID NO: 1029289 - RNA, 18 nt, Human
caugagaccacuguuauc

SEQ ID NO: 1029290 - RNA, 14 nt, Human
uaacaauuuuagga

SEQ ID NO: 1029291 - RNA, 17 nt, Human
cuggagugcaguggcgc

SEQ ID NO: 1029292 - RNA, 14 nt, Human
ucuccugggcagcu

SEQ ID NO: 1029293 - RNA, 16 nt, Human
cauucucucuccugua

SEQ ID NO: 1029294 - RNA, 23 nt, Human
auucaauaucuuuuuuuuaauaa

SEQ ID NO: 1029295 - RNA, 23 nt, Human
aaaauguguauuuuauuacaucu

SEQ ID NO: 1029296 - RNA, 18 nt, Human
agaaccuaaguuucaguu

SEQ ID NO: 1029297 - RNA, 13 nt, Human
acacagugucugg

SEQ ID NO: 1029298 - RNA, 15 nt, Human
cccuguacuccagcc

SEQ ID NO: 1029299 - RNA, 16 nt, Human
auuuuacuuuuccauu

SEQ ID NO: 1029300 - RNA, 22 nt, Human
uacuccuaguaauuuaagauuu

SEQ ID NO: 1029301 - RNA, 21 nt, Human
gauaaguaaguuugauuucau

SEQ ID NO: 1029302 - RNA, 17 nt, Human
auagaauggaacucaag

SEQ ID NO: 1029303 - RNA, 22 nt, Human
gaaauaagccagacaucaacag

SEQ ID NO: 1029304 - RNA, 16 nt, Human
cccuccaccucccugc

SEQ ID NO: 1029305 - RNA, 15 nt, Human
auuaaauauaauaug

SEQ ID NO: 1029306 - RNA, 21 nt, Human
cuauucacaaccacucauuca

SEQ ID NO: 1029307 - RNA, 15 nt, Human
cagcugccuccccuc

SEQ ID NO: 1029308 - RNA, 16 nt, Human
aaucuaauucaaacua

SEQ ID NO: 1029309 - RNA, 16 nt, Human
uuaacauuauuuauau

SEQ ID NO: 1029310 - RNA, 13 nt, Human
uaauuuuaaguaa

SEQ ID NO: 1029311 - RNA, 19 nt, Human
aggcauccuccacaauagc

SEQ ID NO: 1029312 - RNA, 15 nt, Human
uaugaaacauuacag

SEQ ID NO: 1029313 - RNA, 12 nt, Human
uaucuaauauau

SEQ ID NO: 1029314 - RNA, 18 nt, Human
cgcgccaccacgcccagc

SEQ ID NO: 1029315 - RNA, 19 nt, Human
uauuauucuucauaacaau

SEQ ID NO: 1029316 - RNA, 17 nt, Human
caaucuuaacucauugc

SEQ ID NO: 1029317 - RNA, 20 nt, Human
uuauuaccucugauaccuca

SEQ ID NO: 1029318 - RNA, 20 nt, Human
gccauggagguuaagcacuu

SEQ ID NO: 1029319 - RNA, 13 nt, Human
cauuuucacuuuu

SEQ ID NO: 1029320 - RNA, 12 nt, Human
uguuuuucacau

SEQ ID NO: 1029321 - RNA, 19 nt, Human
aaauuagaggucuccaaaa

SEQ ID NO: 1029322 - RNA, 21 nt, Human
caacuuuuguguaaugaaaau

SEQ ID NO: 1029323 - RNA, 22 nt, Human
ucccagccagcaguucagagcu

SEQ ID NO: 1029324 - RNA, 14 nt, Human
auacaaaaaaaaaa

SEQ ID NO: 1029325 - RNA, 14 nt, Human
cuccaccucccugc

SEQ ID NO: 1029326 - RNA, 19 nt, Human
ccaugcuggccaggcuggu

SEQ ID NO: 1029327 - RNA, 19 nt, Human
uauaauuuuuuucaauauu

SEQ ID NO: 1029328 - RNA, 21 nt, Human
gacagaaagcagaacagugau

SEQ ID NO: 1029329 - RNA, 19 nt, Human
cugcuugccaucccucccu

SEQ ID NO: 1029330 - RNA, 16 nt, Human
uaaaaucuaauucaaa

SEQ ID NO: 1029331 - RNA, 12 nt, Human
gcuggauucaag

SEQ ID NO: 1029332 - RNA, 14 nt, Human
cgcuaccuuuugcu

SEQ ID NO: 1029333 - RNA, 15 nt, Human
aauguuacauuauua

SEQ ID NO: 1029334 - RNA, 14 nt, Human
agcuuuucaaaauu

SEQ ID NO: 1029335 - RNA, 14 nt, Human
auuuaugaguuuuu

SEQ ID NO: 1029336 - RNA, 20 nt, Human
gccaauauccuaauaaaaag

SEQ ID NO: 1029337 - RNA, 17 nt, Human
cugugacugucucacuu

SEQ ID NO: 1029338 - RNA, 14 nt, Human
aaaagaaagaaaau

SEQ ID NO: 1029339 - RNA, 15 nt, Human
ucugcagauaaacag

SEQ ID NO: 1029340 - RNA, 22 nt, Human
cuccugccuaagugcagccccg

SEQ ID NO: 1029341 - RNA, 13 nt, Human
gcugggaguggca

SEQ ID NO: 1029342 - RNA, 20 nt, Human
uaccaacagugagagcccuu

SEQ ID NO: 1029343 - RNA, 19 nt, Human
ucagagcugcccucuccug

SEQ ID NO: 1029344 - RNA, 20 nt, Human
cucuacuaaaaauacaaaaa

SEQ ID NO: 1029345 - RNA, 17 nt, Human
auucccuuuugcugccu

SEQ ID NO: 1029346 - RNA, 20 nt, Human
acaguggaaagacagcuucu

SEQ ID NO: 1029347 - RNA, 17 nt, Human
aauuucaugaaaagauu

SEQ ID NO: 1029348 - RNA, 21 nt, Human
guuugacaagguucuucccuu

SEQ ID NO: 1029349 - RNA, 20 nt, Human
caauucuauuacgugcaaua

SEQ ID NO: 1029350 - RNA, 23 nt, Human
aauagaaacguguauauuuuuua

SEQ ID NO: 1029351 - RNA, 12 nt, Human
auaaaauggguu

SEQ ID NO: 1029352 - RNA, 18 nt, Human
gcacuccagccugagcga

SEQ ID NO: 1029353 - RNA, 20 nt, Human
cuguaaaauggagacaccac

SEQ ID NO: 1029354 - RNA, 19 nt, Human
gaggcugaggcaagagaau

SEQ ID NO: 1029355 - RNA, 20 nt, Human
aaucuauuuauuaauauuua

SEQ ID NO: 1029356 - RNA, 15 nt, Human
uuaacauuauuuaua

SEQ ID NO: 1029357 - RNA, 18 nt, Human
uaaggcuucucuuaaaca

SEQ ID NO: 1029358 - RNA, 14 nt, Human
cuggcuuaaaaugu

SEQ ID NO: 1029359 - RNA, 16 nt, Human
ugcaugguuuagaaag

SEQ ID NO: 1029360 - RNA, 13 nt, Human
cacuuucccucuu

SEQ ID NO: 1029361 - RNA, 16 nt, Human
aguucagagcugcccu

SEQ ID NO: 1029362 - RNA, 23 nt, Human
aaaucuauuuauuaauauuuaac

SEQ ID NO: 1029363 - RNA, 19 nt, Human
ccuggucgucgucuugacu

SEQ ID NO: 1029364 - RNA, 13 nt, Human
aauauuuaacauu

SEQ ID NO: 1029365 - RNA, 15 nt, Human
gccccugcacuccag

SEQ ID NO: 1029366 - RNA, 19 nt, Human
agaaacaucaguuacucug

SEQ ID NO: 1029367 - RNA, 15 nt, Human
gcagagguugcagug

SEQ ID NO: 1029368 - RNA, 22 nt, Human
cuagauacugaauguaaacaaa

SEQ ID NO: 1029369 - RNA, 14 nt, Human
uuaugaaccuuuac

SEQ ID NO: 1029370 - RNA, 15 nt, Human
aacuauggaaaaaaa

SEQ ID NO: 1029371 - RNA, 19 nt, Human
ugcuuguuagcaaaaugga

SEQ ID NO: 1029372 - RNA, 17 nt, Human
auuuuuaccuuuuuccu

SEQ ID NO: 1029373 - RNA, 14 nt, Human
ucaccuguuuuuaa

SEQ ID NO: 1029374 - RNA, 19 nt, Human
aagguauuuauugagcacc

SEQ ID NO: 1029375 - RNA, 15 nt, Human
aauuguaucuuaguu

SEQ ID NO: 1029376 - RNA, 19 nt, Human
uacauguuuucuuugcuuu

SEQ ID NO: 1029377 - RNA, 18 nt, Human
aggaaggcuuacacccac

SEQ ID NO: 1029378 - RNA, 20 nt, Human
accaaucauuuuaauuauua

SEQ ID NO: 1029379 - RNA, 17 nt, Human
aguuccugagaccagcc

SEQ ID NO: 1029380 - RNA, 15 nt, Human
auguguggcauuuuc

SEQ ID NO: 1029381 - RNA, 16 nt, Human
ugccucaccccuugcc

SEQ ID NO: 1029382 - RNA, 16 nt, Human
ucaucaaucaaauaag

SEQ ID NO: 1029383 - RNA, 16 nt, Human
gcaggauagaguggga

SEQ ID NO: 1029384 - RNA, 22 nt, Human
auuucuugaguuuuguuuuaaa

SEQ ID NO: 1029385 - RNA, 20 nt, Human
uaggaauugacccacaagaa

SEQ ID NO: 1029386 - RNA, 20 nt, Human
auaguucaaagccaaguuua

SEQ ID NO: 1029387 - RNA, 14 nt, Human
uaacauuauuuaua

SEQ ID NO: 1029388 - RNA, 13 nt, Human
ggaaagggucucc

SEQ ID NO: 1029389 - RNA, 19 nt, Human
cuuugguggagauaaagau

SEQ ID NO: 1029390 - RNA, 11 nt, Human
cagcaaauucg

SEQ ID NO: 1029391 - RNA, 21 nt, Human
augugaaauaaaaguagaaua

SEQ ID NO: 1029392 - RNA, 18 nt, Human
acuagaauuuauucaauu

SEQ ID NO: 1029393 - RNA, 12 nt, Human
uuuuuuuuaaac

SEQ ID NO: 1029394 - RNA, 19 nt, Human
uguugacaacugugacugu

SEQ ID NO: 1029395 - RNA, 18 nt, Human
ccuaacugcuacaaauac

SEQ ID NO: 1029396 - RNA, 20 nt, Human
ugaccaggcauccuccacaa

SEQ ID NO: 1029397 - RNA, 16 nt, Human
cugauggguuucucca

SEQ ID NO: 1029398 - RNA, 14 nt, Human
gcugggaauuacag

SEQ ID NO: 1029399 - RNA, 16 nt, Human
acacaaccugucccag

SEQ ID NO: 1029400 - RNA, 18 nt, Human
aaauugaaaggcauucuc

SEQ ID NO: 1029401 - RNA, 14 nt, Human
caguaacggaacag

SEQ ID NO: 1029402 - RNA, 23 nt, Human
uagagacuuugugaaaaaaaauu

SEQ ID NO: 1029403 - RNA, 12 nt, Human
caaauuccagaa

SEQ ID NO: 1029404 - RNA, 22 nt, Human
cuuccauuccaagccugaccac

SEQ ID NO: 1029405 - RNA, 13 nt, Human
ccaccugccuaua

SEQ ID NO: 1029406 - RNA, 24 nt, Human
aaaggccugucccugcagacauga

SEQ ID NO: 1029407 - RNA, 18 nt, Human
aagacaacauuaaaacaa

SEQ ID NO: 1029408 - RNA, 22 nt, Human
auuuauauggggaauauauuuu

SEQ ID NO: 1029409 - RNA, 14 nt, Human
ucuaucuauuuauu

SEQ ID NO: 1029410 - RNA, 22 nt, Human
cgucucccaaagugcugggaau

SEQ ID NO: 1029411 - RNA, 18 nt, Human
gauggguuugacaagguu

SEQ ID NO: 1029412 - RNA, 16 nt, Human
ccuaagugcagccccg

SEQ ID NO: 1029413 - RNA, 22 nt, Human
auucuugaaagcuguggccagc

SEQ ID NO: 1029414 - RNA, 16 nt, Human
uagagugggacaguuc

SEQ ID NO: 1029415 - RNA, 17 nt, Human
auauuuuuuaugaaaca

SEQ ID NO: 1029416 - RNA, 17 nt, Human
cugauuaaaguuaaaua

SEQ ID NO: 1029417 - RNA, 17 nt, Human
acuuuauauuauuuuga

SEQ ID NO: 1029418 - RNA, 14 nt, Human
gaccuagaauaaua

SEQ ID NO: 1029419 - RNA, 15 nt, Human
ugcagauaaacagua

SEQ ID NO: 1029420 - RNA, 22 nt, Human
augggaugaucauguauuuauu

SEQ ID NO: 1029421 - RNA, 16 nt, Human
cugccuccccuccucu

SEQ ID NO: 1029422 - RNA, 23 nt, Human
aauagcagacaguguuuucuggg

SEQ ID NO: 1029423 - RNA, 19 nt, Human
gcugcccucuccugggcag

SEQ ID NO: 1029424 - RNA, 12 nt, Human
gccaaggcugga

SEQ ID NO: 1029425 - RNA, 16 nt, Human
cuguaucuuguuuuuc

SEQ ID NO: 1029426 - RNA, 16 nt, Human
uaauuuaagauuuugu

SEQ ID NO: 1029427 - RNA, 13 nt, Human
uagauaaacucag

SEQ ID NO: 1029428 - RNA, 14 nt, Human
uguggcuguaucuu

SEQ ID NO: 1029429 - RNA, 19 nt, Human
acuuuuuuuuuuuuuuaaa

SEQ ID NO: 1029430 - RNA, 24 nt, Human
uugccaaggcuggagugcaguggc

SEQ ID NO: 1029431 - RNA, 22 nt, Human
cugauauauguguuuuucacau

SEQ ID NO: 1029432 - RNA, 20 nt, Human
uuucagaagaaauucugcaa

SEQ ID NO: 1029433 - RNA, 13 nt, Human
ugccugcaggcau

SEQ ID NO: 1029434 - RNA, 13 nt, Human
uuacaauugaaau

SEQ ID NO: 1029435 - RNA, 23 nt, Human
auagcauauguuuuuguaaguuu

SEQ ID NO: 1029436 - RNA, 16 nt, Human
cgccuguaaucccagc

SEQ ID NO: 1029437 - RNA, 15 nt, Human
uccgucucccaaagu

SEQ ID NO: 1029438 - RNA, 16 nt, Human
uguauuuauuuuuuua

SEQ ID NO: 1029439 - RNA, 20 nt, Human
aucccucccuccaccucccu

SEQ ID NO: 1029440 - RNA, 22 nt, Human
gaacuuuccacauucagagcuu

SEQ ID NO: 1029441 - RNA, 14 nt, Human
cuagcgcagccaug

SEQ ID NO: 1029442 - RNA, 17 nt, Human
ucugggauagcugaccc

SEQ ID NO: 1029443 - RNA, 13 nt, Human
cagugcuuggccc

SEQ ID NO: 1029444 - RNA, 16 nt, Human
aaugaaagcagggacu

SEQ ID NO: 1029445 - RNA, 18 nt, Human
cugauauauguguuuuuc

SEQ ID NO: 1029446 - RNA, 16 nt, Human
aaauuagccgggcaug

SEQ ID NO: 1029447 - RNA, 13 nt, Human
uuauucacaagac

SEQ ID NO: 1029448 - RNA, 13 nt, Human
cuccaccucccug

SEQ ID NO: 1029449 - RNA, 21 nt, Human
uagcagacaguguuuucuggg

SEQ ID NO: 1029450 - RNA, 19 nt, Human
augaaguacucauacaugu

SEQ ID NO: 1029451 - RNA, 22 nt, Human
augcccaagaaugagaagaaug

SEQ ID NO: 1029452 - RNA, 21 nt, Human
guggccagcuuguuauuuaua

SEQ ID NO: 1029453 - RNA, 15 nt, Human
gcugcccucuccugg

SEQ ID NO: 1029454 - RNA, 14 nt, Human
ugcuuguuagcaaa

SEQ ID NO: 1029455 - RNA, 22 nt, Human
ugacuaugcaaccuuuggaugc

SEQ ID NO: 1029456 - RNA, 21 nt, Human
uuguaauucuaaaugaauguu

SEQ ID NO: 1029457 - RNA, 15 nt, Human
ggcagcuuuuucucu

SEQ ID NO: 1029458 - RNA, 16 nt, Human
auuuugguaaaauacu

SEQ ID NO: 1029459 - RNA, 14 nt, Human
ugacacuuaaaaau

SEQ ID NO: 1029460 - RNA, 18 nt, Human
gccuaucagcauuuuacu

SEQ ID NO: 1029461 - RNA, 17 nt, Human
uuuuccacuacugcuac

SEQ ID NO: 1029462 - RNA, 16 nt, Human
aucaaaagaaagaaaa

SEQ ID NO: 1029463 - RNA, 18 nt, Human
aauucaaacuaauagaau

SEQ ID NO: 1029464 - RNA, 13 nt, Human
acuucacuuuuuu

SEQ ID NO: 1029465 - RNA, 12 nt, Human
gcaguuuuccau

SEQ ID NO: 1029466 - RNA, 15 nt, Human
guugcagugagcuga

SEQ ID NO: 1029467 - RNA, 15 nt, Human
aauuccaggaaaauc

SEQ ID NO: 1029468 - RNA, 15 nt, Human
ucugcccugcuuuug

SEQ ID NO: 1029469 - RNA, 21 nt, Human
cugcuggauucaagugauccg

SEQ ID NO: 1029470 - RNA, 14 nt, Human
agaaugagaagaau

SEQ ID NO: 1029471 - RNA, 19 nt, Human
ucaucaaucaaauaaguau

SEQ ID NO: 1029472 - RNA, 15 nt, Human
ccuugguauagcaua

SEQ ID NO: 1029473 - RNA, 19 nt, Human
gccaucccucccuccaccu

SEQ ID NO: 1029474 - RNA, 17 nt, Human
accugagccccaaaagg

SEQ ID NO: 1029475 - RNA, 14 nt, Human
aacauuauuuauau

SEQ ID NO: 1029476 - RNA, 15 nt, Human
uuuaugcauacagua

SEQ ID NO: 1029477 - RNA, 16 nt, Human
ggaaagggucucccuc

SEQ ID NO: 1029478 - RNA, 14 nt, Human
auuauaauauacua

SEQ ID NO: 1029479 - RNA, 17 nt, Human
uuuaagauaauuauaau

SEQ ID NO: 1029480 - RNA, 15 nt, Human
aagaagcuaaauccu

SEQ ID NO: 1029481 - RNA, 18 nt, Human
ugcuacucuguuccuuca

SEQ ID NO: 1029482 - RNA, 14 nt, Human
agggcuugaggacu

SEQ ID NO: 1029483 - RNA, 19 nt, Human
auuuuccuggacaguuuuc

SEQ ID NO: 1029484 - RNA, 23 nt, Human
cuaaauaaagcuugcaacaaaau

SEQ ID NO: 1029485 - RNA, 21 nt, Human
aagaagcccaauauuauaauu

SEQ ID NO: 1029486 - RNA, 22 nt, Human
gucacaggaaguagaggaggcc

SEQ ID NO: 1029487 - RNA, 15 nt, Human
aguuuuugauagcuu

SEQ ID NO: 1029488 - RNA, 16 nt, Human
aguaagagauuccuga

SEQ ID NO: 1029489 - RNA, 22 nt, Human
uggugugcuggcuuaaaaugua

SEQ ID NO: 1029490 - RNA, 22 nt, Human
uauaagcuguuuuuauauaugu

SEQ ID NO: 1029491 - RNA, 19 nt, Human
cugcuggauucaagugauc

SEQ ID NO: 1029492 - RNA, 21 nt, Human
ucaaauuccagaaugauuuua

SEQ ID NO: 1029493 - RNA, 17 nt, Human
ucauccugcaggcagcu

SEQ ID NO: 1029494 - RNA, 19 nt, Human
gcuaccuuuugcuguggca

SEQ ID NO: 1029495 - RNA, 14 nt, Human
cucugcuugccauc

SEQ ID NO: 1029496 - RNA, 22 nt, Human
auucuaaaugaauguuuacacu

SEQ ID NO: 1029497 - RNA, 13 nt, Human
caucccucccucc

SEQ ID NO: 1029498 - RNA, 18 nt, Human
guuggaaaaugugcaaua

SEQ ID NO: 1029499 - RNA, 22 nt, Human
caaauuuacagagacagaaagc

SEQ ID NO: 1029500 - RNA, 12 nt, Human
acacuuaaaaau

SEQ ID NO: 1029501 - RNA, 23 nt, Human
gaaaaaguucugcagauaaacag

SEQ ID NO: 1029502 - RNA, 17 nt, Human
agaauugcuugaaccca

SEQ ID NO: 1029503 - RNA, 17 nt, Human
caucccucccuccaccu

SEQ ID NO: 1029504 - RNA, 20 nt, Human
aaauuaaggcauaagaaaac

SEQ ID NO: 1029505 - RNA, 17 nt, Human
gucacacaaccuguccc

SEQ ID NO: 1029506 - RNA, 19 nt, Human
auuuacagagacagaaagc

SEQ ID NO: 1029507 - RNA, 11 nt, Human
guaaugaaaau

SEQ ID NO: 1029508 - RNA, 17 nt, Human
acucuacccauauuaca

SEQ ID NO: 1029509 - RNA, 15 nt, Human
uaauauacuauauuu

SEQ ID NO: 1029510 - RNA, 18 nt, Human
uggccaggcuggucucga

SEQ ID NO: 1029511 - RNA, 16 nt, Human
uaacucagaaacauca

SEQ ID NO: 1029512 - RNA, 20 nt, Human
uuuaugaaacauuacaguua

SEQ ID NO: 1029513 - RNA, 12 nt, Human
acuuguugagau

SEQ ID NO: 1029514 - RNA, 19 nt, Human
uauauuuuuuaugaaacau

SEQ ID NO: 1029515 - RNA, 14 nt, Human
auuuucccaaaacu

SEQ ID NO: 1029516 - RNA, 20 nt, Human
acaccaccacccuugccaug

SEQ ID NO: 1029517 - RNA, 16 nt, Human
uaaugaaaaugaauau

SEQ ID NO: 1029518 - RNA, 11 nt, Human
aagucuuccau

SEQ ID NO: 1029519 - RNA, 21 nt, Human
guuugccaugcuggccaggcu

SEQ ID NO: 1029520 - RNA, 17 nt, Human
agcagucagaagaccug

SEQ ID NO: 1029521 - RNA, 23 nt, Human
uacuguauuuuuaccuuuuuccu

SEQ ID NO: 1029522 - RNA, 20 nt, Human
aaaagacauaagcaaagacu

SEQ ID NO: 1029523 - RNA, 20 nt, Human
aggcugagaugggagaauca

SEQ ID NO: 1029524 - RNA, 18 nt, Human
auuuauuuacugagcuuc

SEQ ID NO: 1029525 - RNA, 13 nt, Human
ggaaaauguguau

SEQ ID NO: 1029526 - RNA, 21 nt, Human
aauggaauauguaaauagaaa

SEQ ID NO: 1029527 - RNA, 14 nt, Human
gcugauuaaaccaa

SEQ ID NO: 1029528 - RNA, 12 nt, Human
auuauuauuuau

SEQ ID NO: 1029529 - RNA, 17 nt, Human
uuagcuuuacuguuugu

SEQ ID NO: 1029530 - RNA, 18 nt, Human
ucauuauugguugggcug

SEQ ID NO: 1029531 - RNA, 14 nt, Human
auauuuaagauaau

SEQ ID NO: 1029532 - RNA, 15 nt, Human
ucuucagaccuagaa

SEQ ID NO: 1029533 - RNA, 18 nt, Human
cugggaauuacaggcgug

SEQ ID NO: 1029534 - RNA, 15 nt, Human
uaaaucuaaaucuau

SEQ ID NO: 1029535 - RNA, 16 nt, Human
cuuugaugauuaauuc

SEQ ID NO: 1029536 - RNA, 23 nt, Human
acuggcucccuggaagagaucaa

SEQ ID NO: 1029537 - RNA, 10 nt, Human
aaaauguaau

SEQ ID NO: 1029538 - RNA, 14 nt, Human
uacuguauuuuuac

SEQ ID NO: 1029539 - RNA, 18 nt, Human
auauuauaauuuuuuuca

SEQ ID NO: 1029540 - RNA, 18 nt, Human
uuuuauaucaauuuaaaa

SEQ ID NO: 1029541 - RNA, 15 nt, Human
agucugaugagaacu

SEQ ID NO: 1029542 - RNA, 18 nt, Human
aaaggcauucucugaaga

SEQ ID NO: 1029543 - RNA, 22 nt, Human
gaauaauacuagucuuauaaua

SEQ ID NO: 1029544 - RNA, 21 nt, Human
acuaauagaauuaauggaaua

SEQ ID NO: 1029545 - RNA, 18 nt, Human
ugacuuaguguacaugaa

SEQ ID NO: 1029546 - RNA, 23 nt, Human
aaguaucuguauugcauuaaaua

SEQ ID NO: 1029547 - RNA, 19 nt, Human
uccaccucccugcaauaaa

SEQ ID NO: 1029548 - RNA, 15 nt, Human
guguacaugaaagcg

SEQ ID NO: 1029549 - RNA, 19 nt, Human
auucugcaagcuuuucaaa

SEQ ID NO: 1029550 - RNA, 18 nt, Human
uaauucaaacuaauagaa

SEQ ID NO: 1029551 - RNA, 16 nt, Human
cuagaaccaccugccu

SEQ ID NO: 1029552 - RNA, 20 nt, Human
uccaagccucauguccacug

SEQ ID NO: 1029553 - RNA, 14 nt, Human
aaagaggaaugaag

SEQ ID NO: 1029554 - RNA, 19 nt, Human
uaaagaacacccuauauuu

SEQ ID NO: 1029555 - RNA, 15 nt, Human
caucauaaaauaaag

SEQ ID NO: 1029556 - RNA, 15 nt, Human
gauagguuaccagua

SEQ ID NO: 1029557 - RNA, 19 nt, Human
augaaagcagggacuugaa

SEQ ID NO: 1029558 - RNA, 20 nt, Human
aauaucuuuuuuuuaauaaa

SEQ ID NO: 1029559 - RNA, 20 nt, Human
gccaaggcuggagugcagug

SEQ ID NO: 1029560 - RNA, 13 nt, Human
auuacccucuggg

SEQ ID NO: 1029561 - RNA, 10 nt, Human
gcuugccauc

SEQ ID NO: 1029562 - RNA, 11 nt, Human
aagccaaaaac

SEQ ID NO: 1029563 - RNA, 12 nt, Human
agauaucccagg

SEQ ID NO: 1029564 - RNA, 13 nt, Human
aagcuguggccag

SEQ ID NO: 1029565 - RNA, 18 nt, Human
uuuggcuuguaaaguaca

SEQ ID NO: 1029566 - RNA, 21 nt, Human
accacccuugccauggagguu

SEQ ID NO: 1029567 - RNA, 13 nt, Human
ucuaagaagugaa

SEQ ID NO: 1029568 - RNA, 18 nt, Human
caguucauauguaccaug

SEQ ID NO: 1029569 - RNA, 13 nt, Human
gauuguaaaaugg

SEQ ID NO: 1029570 - RNA, 17 nt, Human
auguacaugaagaagcu

SEQ ID NO: 1029571 - RNA, 14 nt, Human
caaucaaauaagua

SEQ ID NO: 1029572 - RNA, 18 nt, Human
acugggguggguggggca

SEQ ID NO: 1029573 - RNA, 19 nt, Human
gauugauagaguguuauca

SEQ ID NO: 1029574 - RNA, 16 nt, Human
uauaucaauuuaaaaa

SEQ ID NO: 1029575 - RNA, 18 nt, Human
ccauaauguuacauuauu

SEQ ID NO: 1029576 - RNA, 19 nt, Human
cugucucaaaaaauaaaaa

SEQ ID NO: 1029577 - RNA, 15 nt, Human
gguggggcagugcuu

SEQ ID NO: 1029578 - RNA, 15 nt, Human
aagaagugaaaaucu

SEQ ID NO: 1029579 - RNA, 23 nt, Human
cagaaugauuuuacggagauauc

SEQ ID NO: 1029580 - RNA, 14 nt, Human
cacuaacauauaau

SEQ ID NO: 1029581 - RNA, 16 nt, Human
auuaauucaccuucca

SEQ ID NO: 1029582 - RNA, 22 nt, Human
uucuaauagaacucaguuuuaa

SEQ ID NO: 1029583 - RNA, 20 nt, Human
uagauaaacucagaaauuua

SEQ ID NO: 1029584 - RNA, 21 nt, Human
agagacuuugugaaaaaaaau

SEQ ID NO: 1029585 - RNA, 14 nt, Human
uuguaauucuaaau

SEQ ID NO: 1029586 - RNA, 21 nt, Human
ugaacaaauuuacagagacag

SEQ ID NO: 1029587 - RNA, 14 nt, Human
gacuggccugcugg

SEQ ID NO: 1029588 - RNA, 15 nt, Human
ggauuccccuaaccu

SEQ ID NO: 1029589 - RNA, 18 nt, Human
gaaaugaaagcagggacu

SEQ ID NO: 1029590 - RNA, 23 nt, Human
caagagaauugcuugaacccagg

SEQ ID NO: 1029591 - RNA, 16 nt, Human
ccugagcgacagugag

SEQ ID NO: 1029592 - RNA, 18 nt, Human
caucccucccuccaccuc

SEQ ID NO: 1029593 - RNA, 12 nt, Human
auuuucaaaaug

SEQ ID NO: 1029594 - RNA, 21 nt, Human
aauuuacagagacagaaagca

SEQ ID NO: 1029595 - RNA, 20 nt, Human
uagcuuuacuguuuguuaug

SEQ ID NO: 1029596 - RNA, 20 nt, Human
uuguagguaauauugcaagg

SEQ ID NO: 1029597 - RNA, 23 nt, Human
uaggcguggacuuacuauuuauu

SEQ ID NO: 1029598 - RNA, 13 nt, Human
aagauuuguaaua

SEQ ID NO: 1029599 - RNA, 20 nt, Human
cucuccugggcagcugccuc

SEQ ID NO: 1029600 - RNA, 14 nt, Human
gugagccaccaaac

SEQ ID NO: 1029601 - RNA, 22 nt, Human
aucaccaaggcugauuaaacca

SEQ ID NO: 1029602 - RNA, 13 nt, Human
aguuuuccuucuc

SEQ ID NO: 1029603 - RNA, 22 nt, Human
cugucuggacuuuccagagacc

SEQ ID NO: 1029604 - RNA, 18 nt, Human
caugccccuguacuccag

SEQ ID NO: 1029605 - RNA, 23 nt, Human
auauauguauuuauaaauauauu

SEQ ID NO: 1029606 - RNA, 14 nt, Human
aaauaaguauuuau

SEQ ID NO: 1029607 - RNA, 22 nt, Human
agacucuacccauauuacagau

SEQ ID NO: 1029608 - RNA, 12 nt, Human
uuaauaaaccau

SEQ ID NO: 1029609 - RNA, 13 nt, Human
cagcugccucccc

SEQ ID NO: 1029610 - RNA, 20 nt, Human
uacaguuagagauuuuuaaa

SEQ ID NO: 1029611 - RNA, 14 nt, Human
uaaauaguuuauga

SEQ ID NO: 1029612 - RNA, 14 nt, Human
augcuguauucuuc

SEQ ID NO: 1029613 - RNA, 14 nt, Human
acaggcgugagcca

SEQ ID NO: 1029614 - RNA, 11 nt, Human
gcaugguuuag

SEQ ID NO: 1029615 - RNA, 23 nt, Human
aucccucccuccaccucccugca

SEQ ID NO: 1029616 - RNA, 18 nt, Human
gauagguuaccaguaacg

SEQ ID NO: 1029617 - RNA, 13 nt, Human
uugcaagacauag

SEQ ID NO: 1029618 - RNA, 23 nt, Human
agcucugcccauccugccccuga

SEQ ID NO: 1029619 - RNA, 17 nt, Human
uuucaaaacucauuucc

SEQ ID NO: 1029620 - RNA, 17 nt, Human
ccucugggucucagugu

SEQ ID NO: 1029621 - RNA, 21 nt, Human
gcuaaaguaucuguauugcau

SEQ ID NO: 1029622 - RNA, 23 nt, Human
cucauguccacugguucuucuug

SEQ ID NO: 1029623 - RNA, 15 nt, Human
ggacaguuccugaga

SEQ ID NO: 1029624 - RNA, 17 nt, Human
acaaaugcuuaugaaac

SEQ ID NO: 1029625 - RNA, 17 nt, Human
ucccaaagugcugggaa

SEQ ID NO: 1029626 - RNA, 14 nt, Human
auagagugggacag

SEQ ID NO: 1029627 - RNA, 16 nt, Human
cuuguauuuuacuuuu

SEQ ID NO: 1029628 - RNA, 15 nt, Human
gccuaagugcagccc

SEQ ID NO: 1029629 - RNA, 17 nt, Human
cauucugcuuucaucuu

SEQ ID NO: 1029630 - RNA, 21 nt, Human
uagauaaacucagaaauuuaa

SEQ ID NO: 1029631 - RNA, 17 nt, Human
cccaaagugcugggaau

SEQ ID NO: 1029632 - RNA, 21 nt, Human
uaccaaucauuuuaauuauua

SEQ ID NO: 1029633 - RNA, 19 nt, Human
uggguuucacaagugaaaa

SEQ ID NO: 1029634 - RNA, 17 nt, Human
caguucagagcugcccu

SEQ ID NO: 1029635 - RNA, 18 nt, Human
uauuuugcauaguaccaa

SEQ ID NO: 1029636 - RNA, 15 nt, Human
ucaaucaaauaagua

SEQ ID NO: 1029637 - RNA, 15 nt, Human
ucuugagaagagaau

SEQ ID NO: 1029638 - RNA, 18 nt, Human
agacuuugugaaaaaaaa

SEQ ID NO: 1029639 - RNA, 13 nt, Human
uacagacuuuuuu

SEQ ID NO: 1029640 - RNA, 14 nt, Human
aaauuuucccaaaa

SEQ ID NO: 1029641 - RNA, 20 nt, Human
aauguuacauuauuaucaac

SEQ ID NO: 1029642 - RNA, 14 nt, Human
gagaagagaauauu

SEQ ID NO: 1029643 - RNA, 13 nt, Human
acuaaaaaacaaa

SEQ ID NO: 1029644 - RNA, 15 nt, Human
uguuuuaaaauuaaa

SEQ ID NO: 1029645 - RNA, 17 nt, Human
caaaauuggacuuaaaa

SEQ ID NO: 1029646 - RNA, 15 nt, Human
uuugaauaaauaaau

SEQ ID NO: 1029647 - RNA, 15 nt, Human
gaaauucugcaagcu

SEQ ID NO: 1029648 - RNA, 17 nt, Human
augcacacagugcuuuc

SEQ ID NO: 1029649 - RNA, 20 nt, Human
uauuagcuuuacuguuuguu

SEQ ID NO: 1029650 - RNA, 19 nt, Human
cugacagcccaaggguggg

SEQ ID NO: 1029651 - RNA, 17 nt, Human
ccugcaauaaaaugggu

SEQ ID NO: 1029652 - RNA, 18 nt, Human
agugcuuggcccaggagu

SEQ ID NO: 1029653 - RNA, 15 nt, Human
aucaauuuaaaaaaa

SEQ ID NO: 1029654 - RNA, 19 nt, Human
aaccaaauuuguauuuaag

SEQ ID NO: 1029655 - RNA, 18 nt, Human
aaacccggccugauuaaa

SEQ ID NO: 1029656 - RNA, 20 nt, Human
uguauuuguuuguauuuugu

SEQ ID NO: 1029657 - RNA, 14 nt, Human
caugagucagucug

SEQ ID NO: 1029658 - RNA, 18 nt, Human
caaggcugauuaaaccaa

SEQ ID NO: 1029659 - RNA, 22 nt, Human
cucugcuugccaucccucccuc

SEQ ID NO: 1029660 - RNA, 17 nt, Human
auuuguuaaaauuauca

SEQ ID NO: 1029661 - RNA, 14 nt, Human
ugugcaauauguga

SEQ ID NO: 1029662 - RNA, 18 nt, Human
gaggcugaggcgggugga

SEQ ID NO: 1029663 - RNA, 15 nt, Human
gccuguaaucccagc

SEQ ID NO: 1029664 - RNA, 19 nt, Human
accucaguuuuaucauuuu

SEQ ID NO: 1029665 - RNA, 17 nt, Human
uauaauaaauguacauu

SEQ ID NO: 1029666 - RNA, 18 nt, Human
auagaauuaacacaugau

SEQ ID NO: 1029667 - RNA, 12 nt, Human
ucuccugggcag

SEQ ID NO: 1029668 - RNA, 14 nt, Human
cgcgcgccaccacg

SEQ ID NO: 1029669 - RNA, 20 nt, Human
auuuuuaaauaaagaauuuu

SEQ ID NO: 1029670 - RNA, 16 nt, Human
acccagccccuugaga

SEQ ID NO: 1029671 - RNA, 14 nt, Human
aauaucuauuaaua

SEQ ID NO: 1029672 - RNA, 13 nt, Human
gcgggacacaggc

SEQ ID NO: 1029673 - RNA, 21 nt, Human
aggcagcuuuuucucucccac

SEQ ID NO: 1029674 - RNA, 15 nt, Human
caagguucuucccuu

SEQ ID NO: 1029675 - RNA, 13 nt, Human
aauuagaugaacu

SEQ ID NO: 1029676 - RNA, 15 nt, Human
ugccucuaaaaggcc

SEQ ID NO: 1029677 - RNA, 12 nt, Human
aaauauuuuuau

SEQ ID NO: 1029678 - RNA, 14 nt, Human
gccuccccuccucu

SEQ ID NO: 1029679 - RNA, 14 nt, Human
cuccaccuucuggg

SEQ ID NO: 1029680 - RNA, 17 nt, Human
uaaagaauuuucaaaau

SEQ ID NO: 1029681 - RNA, 21 nt, Human
aaugaauggcuaagcaaaaug

SEQ ID NO: 1029682 - RNA, 20 nt, Human
acaagacccaaaaggcagaa

SEQ ID NO: 1029683 - RNA, 19 nt, Human
aauagcauaaguuucuggg

SEQ ID NO: 1029684 - RNA, 18 nt, Human
acagugucuuacagagaa

SEQ ID NO: 1029685 - RNA, 16 nt, Human
gcaagcuuuucaaaau

SEQ ID NO: 1029686 - RNA, 15 nt, Human
ggcugggaguggcau

SEQ ID NO: 1029687 - RNA, 17 nt, Human
ugacagcccaagggugg

SEQ ID NO: 1029688 - RNA, 19 nt, Human
uugggaaaggaguagaaaa

SEQ ID NO: 1029689 - RNA, 18 nt, Human
auauaauguuguuauuua

SEQ ID NO: 1029690 - RNA, 19 nt, Human
aucccucccuccaccuccc

SEQ ID NO: 1029691 - RNA, 17 nt, Human
uguuucgcugauauaug

SEQ ID NO: 1029692 - RNA, 18 nt, Human
uacaguaauuuuaaguaa

SEQ ID NO: 1029693 - RNA, 21 nt, Human
cugggauagcugacccagccc

SEQ ID NO: 1029694 - RNA, 11 nt, Human
ugcagugagcc

SEQ ID NO: 1029695 - RNA, 15 nt, Human
cacaggcuccaaacu

SEQ ID NO: 1029696 - RNA, 19 nt, Human
cuaaaauuagaugaacuca

SEQ ID NO: 1029697 - RNA, 14 nt, Human
uacagagaaaagac

SEQ ID NO: 1029698 - RNA, 22 nt, Human
acauuacaguuagagauuuuua

SEQ ID NO: 1029699 - RNA, 21 nt, Human
uuuucucuaacucagaaacau

SEQ ID NO: 1029700 - RNA, 20 nt, Human
ggagauggaaguugcaguga

SEQ ID NO: 1029701 - RNA, 23 nt, Human
caacggggugaaacccugucucu

SEQ ID NO: 1029702 - RNA, 15 nt, Human
aaagaaagaaaauca

SEQ ID NO: 1029703 - RNA, 22 nt, Human
aucccagcuacuugggaggcug

SEQ ID NO: 1029704 - RNA, 21 nt, Human
uccucugcuugccaucccucc

SEQ ID NO: 1029705 - RNA, 17 nt, Human
agaaacguguauauuuu

SEQ ID NO: 1029706 - RNA, 15 nt, Human
uugaaauagugucug

SEQ ID NO: 1029707 - RNA, 14 nt, Human
cucauccugcaggc

SEQ ID NO: 1029708 - RNA, 19 nt, Human
cuaauuuguguauuuucag

SEQ ID NO: 1029709 - RNA, 17 nt, Human
auauauguauuuauaaa

SEQ ID NO: 1029710 - RNA, 15 nt, Human
uguuuuuaaacugga

SEQ ID NO: 1029711 - RNA, 20 nt, Human
cugugguccgaagucuucca

SEQ ID NO: 1029712 - RNA, 21 nt, Human
uaaacuuaccugggcauucuu

SEQ ID NO: 1029713 - RNA, 12 nt, Human
uacuaaaaauac

SEQ ID NO: 1029714 - RNA, 22 nt, Human
ccagcaaauucgcugcaaccug

SEQ ID NO: 1029715 - RNA, 19 nt, Human
gugucaggugacccugaug

SEQ ID NO: 1029716 - RNA, 17 nt, Human
acuugaaugugucaggu

SEQ ID NO: 1029717 - RNA, 22 nt, Human
aaugaaagaaaggccagcaaau

SEQ ID NO: 1029718 - RNA, 19 nt, Human
uagagauuuuuaaauaaag

SEQ ID NO: 1029719 - RNA, 22 nt, Human
aguugguaucaaccaaauggag

SEQ ID NO: 1029720 - RNA, 16 nt, Human
uuacauguuuucuuug

SEQ ID NO: 1029721 - RNA, 14 nt, Human
uagggaccugcugu

SEQ ID NO: 1029722 - RNA, 20 nt, Human
ucugcuugccaucccucccu

SEQ ID NO: 1029723 - RNA, 18 nt, Human
ucugaugagaacucugag

SEQ ID NO: 1029724 - RNA, 19 nt, Human
auauuuaacauuauuuaua

SEQ ID NO: 1029725 - RNA, 12 nt, Human
ggaggcugagau

SEQ ID NO: 1029726 - RNA, 18 nt, Human
acucauugcaaccuccac

SEQ ID NO: 1029727 - RNA, 16 nt, Human
uaauacuagucuuaua

SEQ ID NO: 1029728 - RNA, 13 nt, Human
accgaguggcccu

SEQ ID NO: 1029729 - RNA, 14 nt, Human
auuuuaaguaauuu

SEQ ID NO: 1029730 - RNA, 14 nt, Human
uaacucagaaacau

SEQ ID NO: 1029731 - RNA, 12 nt, Human
agacucugucuc

SEQ ID NO: 1029732 - RNA, 14 nt, Human
aaauuccagaauga

SEQ ID NO: 1029733 - RNA, 17 nt, Human
agcauuuauaaauggac

SEQ ID NO: 1029734 - RNA, 21 nt, Human
aauuuuuuucaucuucucugg

SEQ ID NO: 1029735 - RNA, 19 nt, Human
uacauucugcuuucaucuu

SEQ ID NO: 1029736 - RNA, 15 nt, Human
uauuagccacaaaau

SEQ ID NO: 1029737 - RNA, 16 nt, Human
auacaguaauuuuaag

SEQ ID NO: 1029738 - RNA, 11 nt, Human
ccugagcccca

SEQ ID NO: 1029739 - RNA, 11 nt, Human
accucccugca

SEQ ID NO: 1029740 - RNA, 18 nt, Human
auucuuacauguuuucuu

SEQ ID NO: 1029741 - RNA, 14 nt, Human
uuucugcuuuaauu

SEQ ID NO: 1029742 - RNA, 13 nt, Human
accucaguuuuau

SEQ ID NO: 1029743 - RNA, 17 nt, Human
aguaauuucagaagaaa

SEQ ID NO: 1029744 - RNA, 12 nt, Human
aaucaauguuuc

SEQ ID NO: 1029745 - RNA, 13 nt, Human
uuccccuaaccuc

SEQ ID NO: 1029746 - RNA, 24 nt, Human
cucaucuguaaaauggagacacca

SEQ ID NO: 1029747 - RNA, 15 nt, Human
cagaccauaauguua

SEQ ID NO: 1029748 - RNA, 22 nt, Human
aagcacuuuaacacagugucug

SEQ ID NO: 1029749 - RNA, 16 nt, Human
ucaggugacccugaug

SEQ ID NO: 1029750 - RNA, 24 nt, Human
uuuucgaugguacauauuucuuug

SEQ ID NO: 1029751 - RNA, 23 nt, Human
gccccugcacuccagccugagcg

SEQ ID NO: 1029752 - RNA, 18 nt, Human
ugggcacaggguuuaugu

SEQ ID NO: 1029753 - RNA, 22 nt, Human
agacucugucucaguccaugaa

SEQ ID NO: 1029754 - RNA, 15 nt, Human
uuacaucuuucacau

SEQ ID NO: 1029755 - RNA, 15 nt, Human
uaaaaucuaauucaa

SEQ ID NO: 1029756 - RNA, 20 nt, Human
cugcaauauuugaauuuuaa

SEQ ID NO: 1029757 - RNA, 16 nt, Human
auaauguuacauuauu

SEQ ID NO: 1029758 - RNA, 18 nt, Human
uucagagcugcccucucc

SEQ ID NO: 1029759 - RNA, 12 nt, Human
ucaacaugguga

SEQ ID NO: 1029760 - RNA, 17 nt, Human
cugcauauguuucgcug

SEQ ID NO: 1029761 - RNA, 22 nt, Human
gagacgggguuugccaugcugg

SEQ ID NO: 1029762 - RNA, 22 nt, Human
gugccucaccccuugccauaau

SEQ ID NO: 1029763 - RNA, 18 nt, Human
ucccuccaccucccugca

SEQ ID NO: 1029764 - RNA, 14 nt, Human
cuacaaauacucuu

SEQ ID NO: 1029765 - RNA, 22 nt, Human
gcccaucuccgucucccaaagu

SEQ ID NO: 1029766 - RNA, 21 nt, Human
cuuuauuuuuuaaguauuuau

SEQ ID NO: 1029767 - RNA, 17 nt, Human
gaacuuuccacauucag

SEQ ID NO: 1029768 - RNA, 14 nt, Human
caccaacuuugaag

SEQ ID NO: 1029769 - RNA, 21 nt, Human
gaaauuccaggaaaaucugca

SEQ ID NO: 1029770 - RNA, 18 nt, Human
aaccuuauuguaccucuc

SEQ ID NO: 1029771 - RNA, 18 nt, Human
cuaaaaaggcauguaauu

SEQ ID NO: 1029772 - RNA, 17 nt, Human
cugaugaauguuaaauu

SEQ ID NO: 1029773 - RNA, 13 nt, Human
ucaucauaaaaua

SEQ ID NO: 1029774 - RNA, 14 nt, Human
ugagaccagccaac

SEQ ID NO: 1029775 - RNA, 22 nt, Human
gcgacaguuuuccuucucaucu

SEQ ID NO: 1029776 - RNA, 17 nt, Human
aucaauaucuaauauau

SEQ ID NO: 1029777 - RNA, 11 nt, Human
acuaaaaauac

SEQ ID NO: 1029778 - RNA, 20 nt, Human
gcuacucuguuccuucacau

SEQ ID NO: 1029779 - RNA, 17 nt, Human
agagacagaaagcagaa

SEQ ID NO: 1029780 - RNA, 15 nt, Human
ucuuuucucugccuu

SEQ ID NO: 1029781 - RNA, 22 nt, Human
agcauuuuacuacuuuaaaaaa

SEQ ID NO: 1029782 - RNA, 13 nt, Human
agcauuuauaaau

SEQ ID NO: 1029783 - RNA, 20 nt, Human
gggaggcagagguugcagug

SEQ ID NO: 1029784 - RNA, 14 nt, Human
cucuaggacauaaa

SEQ ID NO: 1029785 - RNA, 16 nt, Human
agugucaaugcagccc

SEQ ID NO: 1029786 - RNA, 17 nt, Human
uuaaacuggaaauaaaa

SEQ ID NO: 1029787 - RNA, 14 nt, Human
cuccagugagacag

SEQ ID NO: 1029788 - RNA, 14 nt, Human
auaaauauauuuaa

SEQ ID NO: 1029789 - RNA, 17 nt, Human
cuccaccucccugcaau

SEQ ID NO: 1029790 - RNA, 13 nt, Human
ggccuggcuggga

SEQ ID NO: 1029791 - RNA, 12 nt, Human
aaggccuguccc

SEQ ID NO: 1029792 - RNA, 15 nt, Human
aauugaauucccugc

SEQ ID NO: 1029793 - RNA, 20 nt, Human
gccgggcgugguggugagug

SEQ ID NO: 1029794 - RNA, 15 nt, Human
cugcccucuccuggg

SEQ ID NO: 1029795 - RNA, 22 nt, Human
auuucugugggagaauucuuac

SEQ ID NO: 1029796 - RNA, 20 nt, Human
uagguucuaaaaauugugau

SEQ ID NO: 1029797 - RNA, 21 nt, Human
ccuucacauccuguguuucua

SEQ ID NO: 1029798 - RNA, 20 nt, Human
gcacuugggacaaaaacaaa

SEQ ID NO: 1029799 - RNA, 18 nt, Human
caagccucauguccacug

SEQ ID NO: 1029800 - RNA, 11 nt, Human
accauuuuuac

SEQ ID NO: 1029801 - RNA, 23 nt, Human
aaaugaauaucuauuaauauaug

SEQ ID NO: 1029802 - RNA, 19 nt, Human
ggcaaggguucaccugggc

SEQ ID NO: 1029803 - RNA, 19 nt, Human
aauuccaggaaaaucugca

SEQ ID NO: 1029804 - RNA, 12 nt, Human
auuaauauaugu

SEQ ID NO: 1029805 - RNA, 11 nt, Human
aggaguuuggc

SEQ ID NO: 1029806 - RNA, 21 nt, Human
cuguuuguuauggcuuaauga

SEQ ID NO: 1029807 - RNA, 13 nt, Human
aagugcagccccg

SEQ ID NO: 1029808 - RNA, 18 nt, Human
aaucauauaauaaaugua

SEQ ID NO: 1029809 - RNA, 23 nt, Human
aauuauggcugguaacauagguu

SEQ ID NO: 1029810 - RNA, 17 nt, Human
acuuuuaaguugcugau

SEQ ID NO: 1029811 - RNA, 15 nt, Human
gaaauaguucaaagc

SEQ ID NO: 1029812 - RNA, 17 nt, Human
gacaguuccugagacca

SEQ ID NO: 1029813 - RNA, 22 nt, Human
uguaauuaaucuuguaaauaua

SEQ ID NO: 1029814 - RNA, 17 nt, Human
ucagucauaacuaaaua

SEQ ID NO: 1029815 - RNA, 12 nt, Human
uguaaauagaaa

SEQ ID NO: 1029816 - RNA, 23 nt, Human
gcaauaugugauguggcaaaucu

SEQ ID NO: 1029817 - RNA, 14 nt, Human
auuccaccugcaau

SEQ ID NO: 1029818 - RNA, 12 nt, Human
agaccagccaac

SEQ ID NO: 1029819 - RNA, 22 nt, Human
ugaaacuaagauuuguaauauu

SEQ ID NO: 1029820 - RNA, 19 nt, Human
uccucugcuugccaucccu

SEQ ID NO: 1029821 - RNA, 22 nt, Human
ucuccugggcagcugccucccc

SEQ ID NO: 1029822 - RNA, 17 nt, Human
ccucaguuuuaucauuu

SEQ ID NO: 1029823 - RNA, 12 nt, Human
agcaguaacuga

SEQ ID NO: 1029824 - RNA, 21 nt, Human
ccuggaucucacaagcacuuu

SEQ ID NO: 1029825 - RNA, 14 nt, Human
uagcaaauguuaug

SEQ ID NO: 1029826 - RNA, 13 nt, Human
gcuuuaaguguaa

SEQ ID NO: 1029827 - RNA, 19 nt, Human
uguuaugcauaaagucagu

SEQ ID NO: 1029828 - RNA, 22 nt, Human
uccaaacagaacuauggaaaaa

SEQ ID NO: 1029829 - RNA, 13 nt, Human
agcuguugagcug

SEQ ID NO: 1029830 - RNA, 18 nt, Human
ucacagaggaucugcuug

SEQ ID NO: 1029831 - RNA, 18 nt, Human
aaaagccaaaaaccaaau

SEQ ID NO: 1029832 - RNA, 17 nt, Human
ucuuauagaauauuuau

SEQ ID NO: 1029833 - RNA, 18 nt, Human
acauguuacaacacggac

SEQ ID NO: 1029834 - RNA, 15 nt, Human
augcuggccaggcug

SEQ ID NO: 1029835 - RNA, 17 nt, Human
gcuucucauccugcagg

SEQ ID NO: 1029836 - RNA, 17 nt, Human
augcuggccaggcuggu

SEQ ID NO: 1029837 - RNA, 14 nt, Human
uucuagguucuaaa

SEQ ID NO: 1029838 - RNA, 17 nt, Human
auuugcacuauuggaag

SEQ ID NO: 1029839 - RNA, 16 nt, Human
agugggacaguuccug

SEQ ID NO: 1029840 - RNA, 15 nt, Human
cacuuuaacacagug

SEQ ID NO: 1029841 - RNA, 17 nt, Human
cacuagacaaguccagc

SEQ ID NO: 1029842 - RNA, 17 nt, Human
gaacucugagcagugcu

SEQ ID NO: 1029843 - RNA, 19 nt, Human
uuaauauauguauuauuua

SEQ ID NO: 1029844 - RNA, 16 nt, Human
uauguucuaagaagug

SEQ ID NO: 1029845 - RNA, 20 nt, Human
cuggauguggagggggcgcg

SEQ ID NO: 1029846 - RNA, 19 nt, Human
ugugcuggcuuaaaaugua

SEQ ID NO: 1029847 - RNA, 22 nt, Human
cuuacuauuuauugcugaauga

SEQ ID NO: 1029848 - RNA, 14 nt, Human
auauuuaacauuau

SEQ ID NO: 1029849 - RNA, 15 nt, Human
uguuacauuauuauc

SEQ ID NO: 1029850 - RNA, 17 nt, Human
cagcaguucagagcugc

SEQ ID NO: 1029851 - RNA, 17 nt, Human
ugaaaaaaaauuuuaua

SEQ ID NO: 1029852 - RNA, 23 nt, Human
caucaacagauaaauaguuuaug

SEQ ID NO: 1029853 - RNA, 14 nt, Human
ucucuacuaaaaau

SEQ ID NO: 1029854 - RNA, 16 nt, Human
uuaaacuggaaauaaa

SEQ ID NO: 1029855 - RNA, 21 nt, Human
accaaucauuuuaauuauuau

SEQ ID NO: 1029856 - RNA, 20 nt, Human
cuuuuuuuuuuuuuuaaaca

SEQ ID NO: 1029857 - RNA, 16 nt, Human
accaggcuugccugca

SEQ ID NO: 1029858 - RNA, 16 nt, Human
cuuagacccucaugcu

SEQ ID NO: 1029859 - RNA, 12 nt, Human
uuauuauuuaua

SEQ ID NO: 1029860 - RNA, 19 nt, Human
ugugaaaaaaaauuuuaua

SEQ ID NO: 1029861 - RNA, 15 nt, Human
ugccugcaggcauga

SEQ ID NO: 1029862 - RNA, 20 nt, Human
auauguauuuauaaauauau

SEQ ID NO: 1029863 - RNA, 22 nt, Human
aaccagggagccccuuugauga

SEQ ID NO: 1029864 - RNA, 19 nt, Human
aauguuacauuauuaucaa

SEQ ID NO: 1029865 - RNA, 18 nt, Human
gacuuugugaaaaaaaau

SEQ ID NO: 1029866 - RNA, 14 nt, Human
ucucaaaaaauaaa

SEQ ID NO: 1029867 - RNA, 23 nt, Human
auuagggugguauuuagucuauu

SEQ ID NO: 1029868 - RNA, 17 nt, Human
uaauuuaugaguuuuug

SEQ ID NO: 1029869 - RNA, 19 nt, Human
aauuuucuuccaaacagaa

SEQ ID NO: 1029870 - RNA, 17 nt, Human
cugcaggcgugaccuga

SEQ ID NO: 1029871 - RNA, 23 nt, Human
ugauggguuucuccagagggaau

SEQ ID NO: 1029872 - RNA, 22 nt, Human
uguaccucucuuauagaauauu

SEQ ID NO: 1029873 - RNA, 19 nt, Human
cgauuuagaaagaagccca

SEQ ID NO: 1029874 - RNA, 14 nt, Human
aauaaaguauauau

SEQ ID NO: 1029875 - RNA, 22 nt, Human
gaagugauacuauccaguuacu

SEQ ID NO: 1029876 - RNA, 18 nt, Human
uuaacuagaauuuauuca

SEQ ID NO: 1029877 - RNA, 13 nt, Human
cuuccaaacagaa

SEQ ID NO: 1029878 - RNA, 11 nt, Human
uaaaaauaaau

SEQ ID NO: 1029879 - RNA, 14 nt, Human
uguuauuuuuuaau

SEQ ID NO: 1029880 - RNA, 16 nt, Human
gcuguuuuuauauaug

SEQ ID NO: 1029881 - RNA, 17 nt, Human
cugcacuccagccugag

SEQ ID NO: 1029882 - RNA, 10 nt, Human
uauaacucau

SEQ ID NO: 1029883 - RNA, 15 nt, Human
caauaaaauggguuu

SEQ ID NO: 1029884 - RNA, 14 nt, Human
auggugugcuggcu

SEQ ID NO: 1029885 - RNA, 20 nt, Human
ggcuggagugcaguggcgca

SEQ ID NO: 1029886 - RNA, 14 nt, Human
cacaaaauugggaa

SEQ ID NO: 1029887 - RNA, 17 nt, Human
ccuguaaucccagcacu

SEQ ID NO: 1029888 - RNA, 23 nt, Human
uacauuguuugucugucuucaua

SEQ ID NO: 1029889 - RNA, 17 nt, Human
gaggcauccuuccucac

SEQ ID NO: 1029890 - RNA, 22 nt, Human
caagagaauugcuugaacccag

SEQ ID NO: 1029891 - RNA, 14 nt, Human
ugagcauguacuga

SEQ ID NO: 1029892 - RNA, 18 nt, Human
agagauuuuuaaauaaag

SEQ ID NO: 1029893 - RNA, 21 nt, Human
uuuuaaguaauuucagaagaa

SEQ ID NO: 1029894 - RNA, 21 nt, Human
cuggucucgaacugcuggauu

SEQ ID NO: 1029895 - RNA, 15 nt, Human
aaucccuuaaacuca

SEQ ID NO: 1029896 - RNA, 15 nt, Human
aagugaaaaucuaca

SEQ ID NO: 1029897 - RNA, 23 nt, Human
ccucuguugccaaggcuggagug

SEQ ID NO: 1029898 - RNA, 21 nt, Human
cagccugggugacagagcaag

SEQ ID NO: 1029899 - RNA, 20 nt, Human
accuuuugcuguggcaaaug

SEQ ID NO: 1029900 - RNA, 18 nt, Human
cugggcagcugccucccc

SEQ ID NO: 1029901 - RNA, 12 nt, Human
ucaauauuuauu

SEQ ID NO: 1029902 - RNA, 22 nt, Human
ccgggaggcagagguugcagug

SEQ ID NO: 1029903 - RNA, 14 nt, Human
ccaaauuuguauuu

SEQ ID NO: 1029904 - RNA, 16 nt, Human
ucucuauuaggaaaua

SEQ ID NO: 1029905 - RNA, 15 nt, Human
cuguacuuuuuccag

SEQ ID NO: 1029906 - RNA, 12 nt, Human
ccccuugccaua

SEQ ID NO: 1029907 - RNA, 12 nt, Human
gcuauucacaac

SEQ ID NO: 1029908 - RNA, 15 nt, Human
uuugaguguuuuaag

SEQ ID NO: 1029909 - RNA, 12 nt, Human
acccuauauuuu

SEQ ID NO: 1029910 - RNA, 14 nt, Human
gaugcuuguauuuu

SEQ ID NO: 1029911 - RNA, 19 nt, Human
cugcccucuccugggcagc

SEQ ID NO: 1029912 - RNA, 17 nt, Human
cugagcgacagugagac

SEQ ID NO: 1029913 - RNA, 22 nt, Human
aucccagcacuuugggaggcug

SEQ ID NO: 1029914 - RNA, 23 nt, Human
uauuucucucuuuuuagagaaau

SEQ ID NO: 1029915 - RNA, 12 nt, Human
cauauaauguug

SEQ ID NO: 1029916 - RNA, 15 nt, Human
auguuguuauuuaaa

SEQ ID NO: 1029917 - RNA, 13 nt, Human
uauuuauauauuu

SEQ ID NO: 1029918 - RNA, 13 nt, Human
uguauugcauuaa

SEQ ID NO: 1029919 - RNA, 18 nt, Human
cucuacuaaaaauacaaa

SEQ ID NO: 1029920 - RNA, 15 nt, Human
caagacucugucuca

SEQ ID NO: 1029921 - RNA, 23 nt, Human
cugcaaucugagccagugcuuua

SEQ ID NO: 1029922 - RNA, 21 nt, Human
aaaucuauuuauuaauauuua

SEQ ID NO: 1029923 - RNA, 20 nt, Human
gcagacaguguuuucuggga

SEQ ID NO: 1029924 - RNA, 17 nt, Human
agacgggguuugccaug

SEQ ID NO: 1029925 - RNA, 17 nt, Human
uagcauaaguuucuggg

SEQ ID NO: 1029926 - RNA, 17 nt, Human
ccccauuucuauuuauu

SEQ ID NO: 1029927 - RNA, 17 nt, Human
uuuacuacuuuaaaaaa

SEQ ID NO: 1029928 - RNA, 16 nt, Human
cagggacuugaaccca

SEQ ID NO: 1029929 - RNA, 19 nt, Human
ugaguuuuugauagcuuua

SEQ ID NO: 1029930 - RNA, 13 nt, Human
ugagccaccaaac

SEQ ID NO: 1029931 - RNA, 18 nt, Human
uaagaaaacuaagaaaua

SEQ ID NO: 1029932 - RNA, 21 nt, Human
auuaucuaucuaucuauuuau

SEQ ID NO: 1029933 - RNA, 15 nt, Human
augagaagaaugacu

SEQ ID NO: 1029934 - RNA, 15 nt, Human
uaugugaaauaaaag

SEQ ID NO: 1029935 - RNA, 21 nt, Human
uauuuauaacaaccuaaauuu

SEQ ID NO: 1029936 - RNA, 14 nt, Human
gagagugaacaaau

SEQ ID NO: 1029937 - RNA, 14 nt, Human
cuguuuuuaagcug

SEQ ID NO: 1029938 - RNA, 23 nt, Human
uaggauggcuaguaucaaaagaa

SEQ ID NO: 1029939 - RNA, 14 nt, Human
gacagcaggucuca

SEQ ID NO: 1029940 - RNA, 21 nt, Human
aggcaugagucagucugauga

SEQ ID NO: 1029941 - RNA, 16 nt, Human
caacaguuuuuuaugc

SEQ ID NO: 1029942 - RNA, 16 nt, Human
guuggaaaaugugcaa

SEQ ID NO: 1029943 - RNA, 11 nt, Human
cgaaauguuau

SEQ ID NO: 1029944 - RNA, 18 nt, Human
acuuuuguguaaugaaaa

SEQ ID NO: 1029945 - RNA, 21 nt, Human
cgggguuugccaugcuggcca

SEQ ID NO: 1029946 - RNA, 18 nt, Human
acaucuagcaaauguuau

SEQ ID NO: 1029947 - RNA, 21 nt, Human
uuaacuagaauuuauucaauu

SEQ ID NO: 1029948 - RNA, 17 nt, Human
gcuccaaacuggagcuu

SEQ ID NO: 1029949 - RNA, 19 nt, Human
aagauuaugaucucagaaa

SEQ ID NO: 1029950 - RNA, 14 nt, Human
uuucaauauuuauu

SEQ ID NO: 1029951 - RNA, 16 nt, Human
acuuuccagagaccag

SEQ ID NO: 1029952 - RNA, 13 nt, Human
cucuaacucagaa

SEQ ID NO: 1029953 - RNA, 18 nt, Human
cgccuguaaucccagcac

SEQ ID NO: 1029954 - RNA, 18 nt, Human
uaugugauguggcaaauc

SEQ ID NO: 1029955 - RNA, 12 nt, Human
gaagucuuccau

SEQ ID NO: 1029956 - RNA, 17 nt, Human
uggcgcaaucuuaacuc

SEQ ID NO: 1029957 - RNA, 16 nt, Human
cagacaugagagacag

SEQ ID NO: 1029958 - RNA, 13 nt, Human
cucgaacugcugg

SEQ ID NO: 1029959 - RNA, 16 nt, Human
aguauucccuuuugcu

SEQ ID NO: 1029960 - RNA, 19 nt, Human
ucacaagugaaaaacaucc

SEQ ID NO: 1029961 - RNA, 22 nt, Human
aaagggucucccucuguugcca

SEQ ID NO: 1029962 - RNA, 15 nt, Human
uggcucacgccugua

SEQ ID NO: 1029963 - RNA, 15 nt, Human
uguguuuauuucacu

SEQ ID NO: 1029964 - RNA, 19 nt, Human
cagcuuuuucucucccacu

SEQ ID NO: 1029965 - RNA, 20 nt, Human
ccagcacuuugggaggcuga

SEQ ID NO: 1029966 - RNA, 15 nt, Human
ccccaaaaagaaugg

SEQ ID NO: 1029967 - RNA, 11 nt, Human
uucccugccug

SEQ ID NO: 1029968 - RNA, 21 nt, Human
gcccaagaaugagaagaauga

SEQ ID NO: 1029969 - RNA, 20 nt, Human
cuccacaauagcagacagug

SEQ ID NO: 1029970 - RNA, 18 nt, Human
agaagcaacccaaauguu

SEQ ID NO: 1029971 - RNA, 17 nt, Human
uaaaauaaaguauauau

SEQ ID NO: 1029972 - RNA, 23 nt, Human
caaaagguauuuauugagcaccu

SEQ ID NO: 1029973 - RNA, 23 nt, Human
gauguacauuuccaaauucacaa

SEQ ID NO: 1029974 - RNA, 17 nt, Human
uaucuuuuuuuuaauaa

SEQ ID NO: 1029975 - RNA, 23 nt, Human
caggcaugagucagucugaugag

SEQ ID NO: 1029976 - RNA, 22 nt, Human
aaugaaauggugaaaugcagag

SEQ ID NO: 1029977 - RNA, 16 nt, Human
auugcugaaugacuac

SEQ ID NO: 1029978 - RNA, 15 nt, Human
uauccuaauaaaaag

SEQ ID NO: 1029979 - RNA, 14 nt, Human
uugcagugagcuga

SEQ ID NO: 1029980 - RNA, 16 nt, Human
ucuuacugaagguaaa

SEQ ID NO: 1029981 - RNA, 15 nt, Human
uuugaaaauaugccu

SEQ ID NO: 1029982 - RNA, 21 nt, Human
auuuuuaugugcaauaaaaug

SEQ ID NO: 1029983 - RNA, 15 nt, Human
cuaagcaaaauguga

SEQ ID NO: 1029984 - RNA, 20 nt, Human
caugagagacagcaggucuc

SEQ ID NO: 1029985 - RNA, 14 nt, Human
agaugcuuguauuu

SEQ ID NO: 1029986 - RNA, 18 nt, Human
guucaaagccaaguuuau

SEQ ID NO: 1029987 - RNA, 15 nt, Human
ugugggcuuuuauug

SEQ ID NO: 1029988 - RNA, 20 nt, Human
acaucucugauacuuuuuuc

SEQ ID NO: 1029989 - RNA, 12 nt, Human
cauucucugaag

SEQ ID NO: 1029990 - RNA, 17 nt, Human
aaagcagggacuugaac

SEQ ID NO: 1029991 - RNA, 20 nt, Human
ucaugcaaaugcuguauucu

SEQ ID NO: 1029992 - RNA, 17 nt, Human
uauuucuuugccuuuau

SEQ ID NO: 1029993 - RNA, 13 nt, Human
acaguuuuccuuc

SEQ ID NO: 1029994 - RNA, 22 nt, Human
ucgucgucuugacuuuggcaaa

SEQ ID NO: 1029995 - RNA, 20 nt, Human
guuauuuauaacaaccuaaa

SEQ ID NO: 1029996 - RNA, 16 nt, Human
uauauuuuuuaugaaa

SEQ ID NO: 1029997 - RNA, 21 nt, Human
cuugaaauagugucugaugaa

SEQ ID NO: 1029998 - RNA, 12 nt, Human
uaucuuauucac

SEQ ID NO: 1029999 - RNA, 19 nt, Human
cucugucucaaaaaauaaa

SEQ ID NO: 1030000 - RNA, 16 nt, Human
aauuuaagauuuuguu

SEQ ID NO: 1030001 - RNA, 18 nt, Human
uauguauuuauaaauaua

SEQ ID NO: 1030002 - RNA, 21 nt, Human
acaauuauuuuuacaguucuc

SEQ ID NO: 1030003 - RNA, 20 nt, Human
ccugccuaagugcagccccg

SEQ ID NO: 1030004 - RNA, 12 nt, Human
ccuggcugggag

SEQ ID NO: 1030005 - RNA, 15 nt, Human
uauuuauuaauauuu

SEQ ID NO: 1030006 - RNA, 21 nt, Human
uuucaaaaucaaauuccagaa

SEQ ID NO: 1030007 - RNA, 23 nt, Human
auucuuacauguuuucuuugcuu

SEQ ID NO: 1030008 - RNA, 17 nt, Human
cccagccagcaguucag

SEQ ID NO: 1030009 - RNA, 19 nt, Human
ucauaacaauuuuaggagg

SEQ ID NO: 1030010 - RNA, 16 nt, Human
cauuuuacuacuuuaa

SEQ ID NO: 1030011 - RNA, 19 nt, Human
ggaucucacaagcacuuuc

SEQ ID NO: 1030012 - RNA, 22 nt, Human
auaaagcuugcaacaaaauucu

SEQ ID NO: 1030013 - RNA, 14 nt, Human
uggccugcuggaug

SEQ ID NO: 1030014 - RNA, 12 nt, Human
aauuagaugaac

SEQ ID NO: 1030015 - RNA, 23 nt, Human
ucacaccaggcuugccugcaggc

SEQ ID NO: 1030016 - RNA, 18 nt, Human
cuugggaauuuucuucca

SEQ ID NO: 1030017 - RNA, 11 nt, Human
ugcuugccauc

SEQ ID NO: 1030018 - RNA, 23 nt, Human
gauuuuguuuuuaaacuggaaau

SEQ ID NO: 1030019 - RNA, 18 nt, Human
ggccuggcugggaguggc

SEQ ID NO: 1030020 - RNA, 16 nt, Human
cuuaaagaauuuucaa

SEQ ID NO: 1030021 - RNA, 19 nt, Human
aggucacacaaccuguccc

SEQ ID NO: 1030022 - RNA, 12 nt, Human
augagagacagc

SEQ ID NO: 1030023 - RNA, 19 nt, Human
aucucugauacuuuuuuca

SEQ ID NO: 1030024 - RNA, 21 nt, Human
accagggccuggcugggagug

SEQ ID NO: 1030025 - RNA, 22 nt, Human
aauaguucaaagccaaguuuau

SEQ ID NO: 1030026 - RNA, 16 nt, Human
cuggcaguuuuccauu

SEQ ID NO: 1030027 - RNA, 17 nt, Human
uaaacaaaaaaagcauu

SEQ ID NO: 1030028 - RNA, 17 nt, Human
acuugaacccauauuug

SEQ ID NO: 1030029 - RNA, 14 nt, Human
gccaugcuggccag

SEQ ID NO: 1030030 - RNA, 22 nt, Human
uaucaaaacuuucuuuucugga

SEQ ID NO: 1030031 - RNA, 12 nt, Human
aggcuggagugc

SEQ ID NO: 1030032 - RNA, 19 nt, Human
auuuugguaaaauacuucu

SEQ ID NO: 1030033 - RNA, 20 nt, Human
uauuuuguguucaguacaau

SEQ ID NO: 1030034 - RNA, 17 nt, Human
ccuccaccuucuggguu

SEQ ID NO: 1030035 - RNA, 17 nt, Human
uuuccacauucagagcu

SEQ ID NO: 1030036 - RNA, 19 nt, Human
gauuuuacaauugaaauga

SEQ ID NO: 1030037 - RNA, 21 nt, Human
aucggagcugcuagaguucug

SEQ ID NO: 1030038 - RNA, 21 nt, Human
gagggaauaauaccuaagccu

SEQ ID NO: 1030039 - RNA, 18 nt, Human
uuccugagaccagccaac

SEQ ID NO: 1030040 - RNA, 23 nt, Human
ccaggagauggaaguugcaguga

SEQ ID NO: 1030041 - RNA, 21 nt, Human
cuguauuuuuaccuuuuuccu

SEQ ID NO: 1030042 - RNA, 20 nt, Human
acagcuucucauccugcagg

SEQ ID NO: 1030043 - RNA, 22 nt, Human
gaauuaauggaauauguaaaua

SEQ ID NO: 1030044 - RNA, 15 nt, Human
cuaaaaaacaaagaa

SEQ ID NO: 1030045 - RNA, 16 nt, Human
accuuauuguaccucu

SEQ ID NO: 1030046 - RNA, 15 nt, Human
ugauuucauucaaua

SEQ ID NO: 1030047 - RNA, 15 nt, Human
ccuguacuccagccu

SEQ ID NO: 1030048 - RNA, 16 nt, Human
aucccucccuccaccu

SEQ ID NO: 1030049 - RNA, 14 nt, Human
ucugcuugccaucc

SEQ ID NO: 1030050 - RNA, 20 nt, Human
uuaacacaugauccugcaau

SEQ ID NO: 1030051 - RNA, 22 nt, Human
gugugaccacugcagaagacag

SEQ ID NO: 1030052 - RNA, 22 nt, Human
cuccagagggaauugcagagua

SEQ ID NO: 1030053 - RNA, 15 nt, Human
cccucccuccaccuc

SEQ ID NO: 1030054 - RNA, 17 nt, Human
ucuauuaauauauguau

SEQ ID NO: 1030055 - RNA, 15 nt, Human
acaguucauauguac

SEQ ID NO: 1030056 - RNA, 18 nt, Human
ucacgccuguaaucccag

SEQ ID NO: 1030057 - RNA, 15 nt, Human
caucaguuacucuga

SEQ ID NO: 1030058 - RNA, 15 nt, Human
acucugagcagugcu

SEQ ID NO: 1030059 - RNA, 22 nt, Human
uacagugucuuacagagaaaag

SEQ ID NO: 1030060 - RNA, 16 nt, Human
gacaacugugacugua

SEQ ID NO: 1030061 - RNA, 20 nt, Human
cuguauuuuuaccuuuuucc

SEQ ID NO: 1030062 - RNA, 16 nt, Human
ugacuuaaugccacua

SEQ ID NO: 1030063 - RNA, 22 nt, Human
guaaguuuaugcauacaguaau

SEQ ID NO: 1030064 - RNA, 16 nt, Human
aguguuggaaaaugug

SEQ ID NO: 1030065 - RNA, 21 nt, Human
gcccauccugccccugagccc

SEQ ID NO: 1030066 - RNA, 18 nt, Human
aaaacuuucuuuucugga

SEQ ID NO: 1030067 - RNA, 22 nt, Human
gaauuuuucucuaacucagaaa

SEQ ID NO: 1030068 - RNA, 16 nt, Human
uauuugaauuuuaaau

SEQ ID NO: 1030069 - RNA, 17 nt, Human
caagaagccacagaccu

SEQ ID NO: 1030070 - RNA, 23 nt, Human
cuugccaucccucccuccaccuc

SEQ ID NO: 1030071 - RNA, 18 nt, Human
cucuauguucuaagaagu

SEQ ID NO: 1030072 - RNA, 22 nt, Human
uucuagcuguugagcuguuuuc

SEQ ID NO: 1030073 - RNA, 19 nt, Human
uaaucauauaauaaaugua

SEQ ID NO: 1030074 - RNA, 18 nt, Human
auaauauacuauauuuau

SEQ ID NO: 1030075 - RNA, 16 nt, Human
gucucccaaagugcug

SEQ ID NO: 1030076 - RNA, 17 nt, Human
uauaauuuuuuucaaua

SEQ ID NO: 1030077 - RNA, 16 nt, Human
cuuuaacacagugucu

SEQ ID NO: 1030078 - RNA, 19 nt, Human
gaucauguauuuauuuuuu

SEQ ID NO: 1030079 - RNA, 16 nt, Human
uggagacaccaccacc

SEQ ID NO: 1030080 - RNA, 22 nt, Human
agaguggaaccaacacuaacau

SEQ ID NO: 1030081 - RNA, 15 nt, Human
caggcagcuuuuucu

SEQ ID NO: 1030082 - RNA, 20 nt, Human
uauaacucaucauaaaauaa

SEQ ID NO: 1030083 - RNA, 21 nt, Human
ucuuuguaagaguggaaccaa

SEQ ID NO: 1030084 - RNA, 16 nt, Human
aauugacccacaagaa

SEQ ID NO: 1030085 - RNA, 13 nt, Human
ucccucccuccac

SEQ ID NO: 1030086 - RNA, 15 nt, Human
agucugauuuuccug

SEQ ID NO: 1030087 - RNA, 16 nt, Human
ucccuccaccucccug

SEQ ID NO: 1030088 - RNA, 14 nt, Human
ggccaacuaggcag

SEQ ID NO: 1030089 - RNA, 15 nt, Human
acaggguuuauguuu

SEQ ID NO: 1030090 - RNA, 16 nt, Human
gccucuaaaaggccug

SEQ ID NO: 1030091 - RNA, 13 nt, Human
uaaauaaagaauu

SEQ ID NO: 1030092 - RNA, 20 nt, Human
acuguuaucaaaacuuucuu

SEQ ID NO: 1030093 - RNA, 16 nt, Human
ucaaauaaguauuuau

SEQ ID NO: 1030094 - RNA, 19 nt, Human
ggcuuuagggaccugcugu

SEQ ID NO: 1030095 - RNA, 16 nt, Human
uuauagaauauuuauu

SEQ ID NO: 1030096 - RNA, 14 nt, Human
accaggcauccucc

SEQ ID NO: 1030097 - RNA, 18 nt, Human
ccuggaucucacaagcac

SEQ ID NO: 1030098 - RNA, 19 nt, Human
caccaacuuugaagucuga

SEQ ID NO: 1030099 - RNA, 11 nt, Human
ggcacuuggga

SEQ ID NO: 1030100 - RNA, 18 nt, Human
ccaauauuauaauuuuuu

SEQ ID NO: 1030101 - RNA, 12 nt, Human
uuuguaauauuu

SEQ ID NO: 1030102 - RNA, 14 nt, Human
ccagccagcaguuc

SEQ ID NO: 1030103 - RNA, 18 nt, Human
uccugccugcaauauuug

SEQ ID NO: 1030104 - RNA, 20 nt, Human
ugcauugagaacugcauaug

SEQ ID NO: 1030105 - RNA, 14 nt, Human
acacuaacauauaa

SEQ ID NO: 1030106 - RNA, 16 nt, Human
gaguggguuucacaag

SEQ ID NO: 1030107 - RNA, 15 nt, Human
aaauaaguauuuaua

SEQ ID NO: 1030108 - RNA, 22 nt, Human
ugaauuuuuuucaucuucucug

SEQ ID NO: 1030109 - RNA, 18 nt, Human
guaauuucagaagaaauu

SEQ ID NO: 1030110 - RNA, 12 nt, Human
cugauuuuccug

SEQ ID NO: 1030111 - RNA, 15 nt, Human
augaaccuuuacauc

SEQ ID NO: 1030112 - RNA, 20 nt, Human
ugauuuuacaauugaaauga

SEQ ID NO: 1030113 - RNA, 19 nt, Human
cucuccugggcagcugccu

SEQ ID NO: 1030114 - RNA, 14 nt, Human
uuuucaaaauggag

SEQ ID NO: 1030115 - RNA, 19 nt, Human
cagcuacuugggaggcuga

SEQ ID NO: 1030116 - RNA, 23 nt, Human
uaucaauagaaggauguacauuu

SEQ ID NO: 1030117 - RNA, 19 nt, Human
aaugaauggcuaagcaaaa

SEQ ID NO: 1030118 - RNA, 15 nt, Human
ugugucaguggaugc

SEQ ID NO: 1030119 - RNA, 19 nt, Human
uauauuuuuuguuaaauga

SEQ ID NO: 1030120 - RNA, 14 nt, Human
agacaucaacagau

SEQ ID NO: 1030121 - RNA, 18 nt, Human
gugacuuuccuaaaucaa

SEQ ID NO: 1030122 - RNA, 23 nt, Human
ccagcaguucagagcugcccucu

SEQ ID NO: 1030123 - RNA, 15 nt, Human
auuuuuuaauuauua

SEQ ID NO: 1030124 - RNA, 17 nt, Human
uaaauaaagaauuuuaa

SEQ ID NO: 1030125 - RNA, 13 nt, Human
agcaguucagagc

SEQ ID NO: 1030126 - RNA, 16 nt, Human
uaaauggacaaaugcu

SEQ ID NO: 1030127 - RNA, 23 nt, Human
ugacguaggaacgguaaauuucu

SEQ ID NO: 1030128 - RNA, 20 nt, Human
gagauaucccaggaaaauua

SEQ ID NO: 1030129 - RNA, 22 nt, Human
gucucuacuaaaaauacaaaaa

SEQ ID NO: 1030130 - RNA, 12 nt, Human
uauaaauaaaau

SEQ ID NO: 1030131 - RNA, 13 nt, Human
auaauuauaauau

SEQ ID NO: 1030132 - RNA, 23 nt, Human
cuccuguacuuuuuccagacacu

SEQ ID NO: 1030133 - RNA, 22 nt, Human
uguugagcuguuuucccugacc

SEQ ID NO: 1030134 - RNA, 23 nt, Human
uagucauuugcugagcauguacu

SEQ ID NO: 1030135 - RNA, 21 nt, Human
ccuggugccucaccccuugcc

SEQ ID NO: 1030136 - RNA, 12 nt, Human
guauuauuuaua

SEQ ID NO: 1030137 - RNA, 17 nt, Human
uauaauauacuauauuu

SEQ ID NO: 1030138 - RNA, 16 nt, Human
uuuggcuuguaaagua

SEQ ID NO: 1030139 - RNA, 13 nt, Human
aacuaauagaauu

SEQ ID NO: 1030140 - RNA, 15 nt, Human
gacccugaugaaaac

SEQ ID NO: 1030141 - RNA, 19 nt, Human
auuacaguuagagauuuuu

SEQ ID NO: 1030142 - RNA, 19 nt, Human
cggagccccuugggcaggu

SEQ ID NO: 1030143 - RNA, 18 nt, Human
auagcaagugaauuuuuc

SEQ ID NO: 1030144 - RNA, 20 nt, Human
uuaaugccacuaaauugaca

SEQ ID NO: 1030145 - RNA, 13 nt, Human
uuaguguacauga

SEQ ID NO: 1030146 - RNA, 16 nt, Human
aagauuuguaauauuu

SEQ ID NO: 1030147 - RNA, 19 nt, Human
cauuguuugucugucuuca

SEQ ID NO: 1030148 - RNA, 13 nt, Human
uuacaaggcuuua

SEQ ID NO: 1030149 - RNA, 16 nt, Human
uagauacugaauguaa

SEQ ID NO: 1030150 - RNA, 16 nt, Human
uaucaaaagaaagaaa

SEQ ID NO: 1030151 - RNA, 20 nt, Human
uggucucgaacugcuggauu

SEQ ID NO: 1030152 - RNA, 17 nt, Human
ugaagguaaaauugaaa

SEQ ID NO: 1030153 - RNA, 15 nt, Human
gccaucccucccucc

SEQ ID NO: 1030154 - RNA, 12 nt, Human
aaugaauguuua

SEQ ID NO: 1030155 - RNA, 14 nt, Human
uugagaagagaaua

SEQ ID NO: 1030156 - RNA, 13 nt, Human
uuaaacaaaaaaa

SEQ ID NO: 1030157 - RNA, 18 nt, Human
augguauuugaguguuuu

SEQ ID NO: 1030158 - RNA, 13 nt, Human
gcuguugagcugu

SEQ ID NO: 1030159 - RNA, 15 nt, Human
cuugaaaacuuuaug

SEQ ID NO: 1030160 - RNA, 18 nt, Human
ugccauaauuacuauguc

SEQ ID NO: 1030161 - RNA, 13 nt, Human
uacauguuuucuu

SEQ ID NO: 1030162 - RNA, 16 nt, Human
gugacuggccugcugg

SEQ ID NO: 1030163 - RNA, 15 nt, Human
ugaaacccugucucu

SEQ ID NO: 1030164 - RNA, 20 nt, Human
aaacuuuaugcuaagugaaa

SEQ ID NO: 1030165 - RNA, 11 nt, Human
agguauuuauu

SEQ ID NO: 1030166 - RNA, 19 nt, Human
ugaaacauuacaguuagag

SEQ ID NO: 1030167 - RNA, 22 nt, Human
aauugacccacaagaaaugaaa

SEQ ID NO: 1030168 - RNA, 18 nt, Human
uuguugacaacugugacu

SEQ ID NO: 1030169 - RNA, 20 nt, Human
auuaaggcauaagaaaacua

SEQ ID NO: 1030170 - RNA, 19 nt, Human
uggagggggcgcgugcagg

SEQ ID NO: 1030171 - RNA, 12 nt, Human
gcuguugagcug

SEQ ID NO: 1030172 - RNA, 23 nt, Human
uuuucaaaaucaaauuccagaau

SEQ ID NO: 1030173 - RNA, 23 nt, Human
ucccagccagcaguucagagcug

SEQ ID NO: 1030174 - RNA, 18 nt, Human
ugguuccauucucucucc

SEQ ID NO: 1030175 - RNA, 16 nt, Human
uugggcugagcaguca

SEQ ID NO: 1030176 - RNA, 15 nt, Human
gauuaaaguuaaaua

SEQ ID NO: 1030177 - RNA, 13 nt, Human
agggaccugcugu

SEQ ID NO: 1030178 - RNA, 21 nt, Human
cucugcuugccaucccucccu

SEQ ID NO: 1030179 - RNA, 22 nt, Human
uuggucuugauaagcuauguug

SEQ ID NO: 1030180 - RNA, 13 nt, Human
uuuaaacaaaaaa

SEQ ID NO: 1030181 - RNA, 23 nt, Human
uucucucuccuguacuuuuucca

SEQ ID NO: 1030182 - RNA, 14 nt, Human
ugaggucaggaguu

SEQ ID NO: 1030183 - RNA, 17 nt, Human
caauuauaucaguccuc

SEQ ID NO: 1030184 - RNA, 13 nt, Human
ugcuuggcccagg

SEQ ID NO: 1030185 - RNA, 15 nt, Human
caggaaguagaggag

SEQ ID NO: 1030186 - RNA, 18 nt, Human
ccuguuuuuaagcuguuu

SEQ ID NO: 1030187 - RNA, 15 nt, Human
cuauuuauugcugaa

SEQ ID NO: 1030188 - RNA, 21 nt, Human
cucuccugggcagcugccucc

SEQ ID NO: 1030189 - RNA, 15 nt, Human
uauguauuauuuaua

SEQ ID NO: 1030190 - RNA, 13 nt, Human
caguauccaguac

SEQ ID NO: 1030191 - RNA, 20 nt, Human
agauaucccaggaaaauuaa

SEQ ID NO: 1030192 - RNA, 18 nt, Human
gcaagacauagaauagug

SEQ ID NO: 1030193 - RNA, 15 nt, Human
caguuuuaucauuuu

SEQ ID NO: 1030194 - RNA, 20 nt, Human
uauauauguauuuauaaaua

SEQ ID NO: 1030195 - RNA, 19 nt, Human
gagguacugagagugaaca

SEQ ID NO: 1030196 - RNA, 17 nt, Human
aggcuagaaccaccugc

SEQ ID NO: 1030197 - RNA, 20 nt, Human
uuuguuauggcuuaaugaca

SEQ ID NO: 1030198 - RNA, 14 nt, Human
cucaccccuugcca

SEQ ID NO: 1030199 - RNA, 23 nt, Human
accuuuguagccacuucacuuuu

SEQ ID NO: 1030200 - RNA, 22 nt, Human
aggguccuuugggaaaggagaa

SEQ ID NO: 1030201 - RNA, 20 nt, Human
uugaacccgggaggcagagg

SEQ ID NO: 1030202 - RNA, 22 nt, Human
cugcacugugggcuuuuauugc

SEQ ID NO: 1030203 - RNA, 18 nt, Human
agauuaugaucucagaaa

SEQ ID NO: 1030204 - RNA, 20 nt, Human
auauuuuauaucaauuuaaa

SEQ ID NO: 1030205 - RNA, 16 nt, Human
uccugcaauuccacuu

SEQ ID NO: 1030206 - RNA, 14 nt, Human
aaagaauuuuaaaa

SEQ ID NO: 1030207 - RNA, 23 nt, Human
ugcaauauuugaauuuuaaaucu

SEQ ID NO: 1030208 - RNA, 14 nt, Human
agaaauaaugaaau

SEQ ID NO: 1030209 - RNA, 14 nt, Human
cuucucuucacagu

SEQ ID NO: 1030210 - RNA, 23 nt, Human
aaacucagggagcauuuauaaau

SEQ ID NO: 1030211 - RNA, 21 nt, Human
cuccugggcagcugccucccc

SEQ ID NO: 1030212 - RNA, 17 nt, Human
cagacaucaacagauaa

SEQ ID NO: 1030213 - RNA, 18 nt, Human
uaucaaaagaaagaaaau

SEQ ID NO: 1030214 - RNA, 23 nt, Human
agauuaugaucucagaaauugua

SEQ ID NO: 1030215 - RNA, 20 nt, Human
aauuaccuugagccaguaau

SEQ ID NO: 1030216 - RNA, 20 nt, Human
gaauccagaaauaaugaaau

SEQ ID NO: 1030217 - RNA, 17 nt, Human
cacuggcucccuggaag

SEQ ID NO: 1030218 - RNA, 12 nt, Human
uacagagaaaag

SEQ ID NO: 1030219 - RNA, 19 nt, Human
gaauuuuuuucaucuucuc

SEQ ID NO: 1030220 - RNA, 21 nt, Human
ccuuuacauccagauagguua

SEQ ID NO: 1030221 - RNA, 15 nt, Human
accagggagccccuu

SEQ ID NO: 1030222 - RNA, 22 nt, Human
acuucauuuaaaauauuuuuau

SEQ ID NO: 1030223 - RNA, 13 nt, Human
gcugccuccccuc

SEQ ID NO: 1030224 - RNA, 14 nt, Human
uccuauguaacugc

SEQ ID NO: 1030225 - RNA, 16 nt, Human
gacauagaauuaacac

SEQ ID NO: 1030226 - RNA, 14 nt, Human
cauagguuuuuagu

SEQ ID NO: 1030227 - RNA, 14 nt, Human
ggcgcgcgccacca

SEQ ID NO: 1030228 - RNA, 18 nt, Human
cuuuacuguuagucauuu

SEQ ID NO: 1030229 - RNA, 13 nt, Human
ugggacaguuccu

SEQ ID NO: 1030230 - RNA, 11 nt, Human
cuuugccuuua

SEQ ID NO: 1030231 - RNA, 16 nt, Human
cuggauguggaggggg

SEQ ID NO: 1030232 - RNA, 13 nt, Human
aaaaaaagccaaa

SEQ ID NO: 1030233 - RNA, 21 nt, Human
auaguuguaccgcaaugugac

SEQ ID NO: 1030234 - RNA, 15 nt, Human
agaaauuguaucuua

SEQ ID NO: 1030235 - RNA, 17 nt, Human
gaaguugcagugagcug

SEQ ID NO: 1030236 - RNA, 19 nt, Human
caauuauaucaguccucuu

SEQ ID NO: 1030237 - RNA, 16 nt, Human
ugguacuagauacuga

SEQ ID NO: 1030238 - RNA, 18 nt, Human
agcaacaucuagcaaaug

SEQ ID NO: 1030239 - RNA, 15 nt, Human
auuuuuuaaguauuu

SEQ ID NO: 1030240 - RNA, 16 nt, Human
ugaauccagaaauaau

SEQ ID NO: 1030241 - RNA, 12 nt, Human
ucacauacaauu

SEQ ID NO: 1030242 - RNA, 23 nt, Human
ccaagaaugagaagaaugacuau

SEQ ID NO: 1030243 - RNA, 18 nt, Human
ccauccugccccugagcc

SEQ ID NO: 1030244 - RNA, 13 nt, Human
uuuucaauauuua

SEQ ID NO: 1030245 - RNA, 20 nt, Human
aaaugaauaucuauuaauau

SEQ ID NO: 1030246 - RNA, 14 nt, Human
uaaagaauuuuaaa

SEQ ID NO: 1030247 - RNA, 19 nt, Human
aucauuuuaauuauuauuc

SEQ ID NO: 1030248 - RNA, 13 nt, Human
uguacuuuuucca

SEQ ID NO: 1030249 - RNA, 20 nt, Human
ugccaugcuggccaggcugg

SEQ ID NO: 1030250 - RNA, 17 nt, Human
uaugcuaagugaaauaa

SEQ ID NO: 1030251 - RNA, 16 nt, Human
aaauaguuuaugauuc

SEQ ID NO: 1030252 - RNA, 19 nt, Human
guauuuaagguauauaaau

SEQ ID NO: 1030253 - RNA, 16 nt, Human
cuuuaugcuaagugaa

SEQ ID NO: 1030254 - RNA, 18 nt, Human
cagagacagaaagcagaa

SEQ ID NO: 1030255 - RNA, 18 nt, Human
ucuuauagaauauuuauu

SEQ ID NO: 1030256 - RNA, 16 nt, Human
uuacaucuuucacauu

SEQ ID NO: 1030257 - RNA, 17 nt, Human
gccuccccuccucugcu

SEQ ID NO: 1030258 - RNA, 20 nt, Human
ccaaucauuuuaauuauuau

SEQ ID NO: 1030259 - RNA, 20 nt, Human
uauuuauaaauauauuuaag

SEQ ID NO: 1030260 - RNA, 16 nt, Human
gagaccuguaaucaua

SEQ ID NO: 1030261 - RNA, 18 nt, Human
aaagcacuuauuuauugu

SEQ ID NO: 1030262 - RNA, 20 nt, Human
uaagugaaauaagccagaca

SEQ ID NO: 1030263 - RNA, 13 nt, Human
acacaggcuccaa

SEQ ID NO: 1030264 - RNA, 23 nt, Human
uuuuccuuccuuaucacugacac

SEQ ID NO: 1030265 - RNA, 15 nt, Human
aguauuuauauauuu

SEQ ID NO: 1030266 - RNA, 13 nt, Human
cagucugaugaga

SEQ ID NO: 1030267 - RNA, 14 nt, Human
auaucuaauauaua

SEQ ID NO: 1030268 - RNA, 14 nt, Human
ccuaaccagccugg

SEQ ID NO: 1030269 - RNA, 21 nt, Human
uaauuauaauauacuauauuu

SEQ ID NO: 1030270 - RNA, 18 nt, Human
ugccuccccuccucugcu

SEQ ID NO: 1030271 - RNA, 15 nt, Human
auuucauucaauauc

SEQ ID NO: 1030272 - RNA, 18 nt, Human
caacaguuuuuuaugcua

SEQ ID NO: 1030273 - RNA, 15 nt, Human
uaucaauuuaaaaaa

SEQ ID NO: 1030274 - RNA, 13 nt, Human
gaauguaaucaau

SEQ ID NO: 1030275 - RNA, 15 nt, Human
ccucauguccacugg

SEQ ID NO: 1030276 - RNA, 22 nt, Human
cuaaauaaagcuugcaacaaaa

SEQ ID NO: 1030277 - RNA, 19 nt, Human
uauccaaagcugaauacau

SEQ ID NO: 1030278 - RNA, 23 nt, Human
aguacucauacauguuacaacac

SEQ ID NO: 1030279 - RNA, 22 nt, Human
gccucuaaaaggccugucccug

SEQ ID NO: 1030280 - RNA, 17 nt, Human
gucucccaaagugcugg

SEQ ID NO: 1030281 - RNA, 22 nt, Human
aauuaucuaucuaucuauuuau

SEQ ID NO: 1030282 - RNA, 11 nt, Human
uuuucaucuuc

SEQ ID NO: 1030283 - RNA, 16 nt, Human
uguacaugaagaagcu

SEQ ID NO: 1030284 - RNA, 21 nt, Human
gaggcugaggcggguggauca

SEQ ID NO: 1030285 - RNA, 18 nt, Human
gauaauaugagaaucaga

SEQ ID NO: 1030286 - RNA, 19 nt, Human
aaauguaauuaaucuugua

SEQ ID NO: 1030287 - RNA, 17 nt, Human
aauguaucuuauucaca

SEQ ID NO: 1030288 - RNA, 20 nt, Human
aagaauuuucaaaaucaaau

SEQ ID NO: 1030289 - RNA, 17 nt, Human
gacuauuauagaaugga

SEQ ID NO: 1030290 - RNA, 19 nt, Human
ugccucaguuuccugaccu

SEQ ID NO: 1030291 - RNA, 13 nt, Human
ucauccugcaggc

SEQ ID NO: 1030292 - RNA, 16 nt, Human
cugcacuccagccuga

SEQ ID NO: 1030293 - RNA, 20 nt, Human
gccucuaaaaggccuguccc

SEQ ID NO: 1030294 - RNA, 18 nt, Human
ccugccuaagugcagccc

SEQ ID NO: 1030295 - RNA, 17 nt, Human
aggcaugagucagucug

SEQ ID NO: 1030296 - RNA, 14 nt, Human
aucuuguuuuucca

SEQ ID NO: 1030297 - RNA, 23 nt, Human
uccaccucccugcaauaaaaugg

SEQ ID NO: 1030298 - RNA, 23 nt, Human
augcuaaucagggaggucauuuu

SEQ ID NO: 1030299 - RNA, 17 nt, Human
cuuaaagaauuuucaaa

SEQ ID NO: 1030300 - RNA, 21 nt, Human
caauuauaagcuguuuuuaua

SEQ ID NO: 1030301 - RNA, 14 nt, Human
caacacuaacauau

SEQ ID NO: 1030302 - RNA, 18 nt, Human
ucuucagaccuagaauaa

SEQ ID NO: 1030303 - RNA, 22 nt, Human
gaaaaugaauaucuauuaauau

SEQ ID NO: 1030304 - RNA, 15 nt, Human
cuggccaggcugguc

SEQ ID NO: 1030305 - RNA, 22 nt, Human
ccucuccugggcagcugccucc

SEQ ID NO: 1030306 - RNA, 16 nt, Human
uuuguaauauuucucu

SEQ ID NO: 1030307 - RNA, 21 nt, Human
ugagccagugucaggaggaag

SEQ ID NO: 1030308 - RNA, 20 nt, Human
agagauuuuuaaauaaagaa

SEQ ID NO: 1030309 - RNA, 13 nt, Human
gccuggcugggag

SEQ ID NO: 1030310 - RNA, 23 nt, Human
cuuaaagaauuuucaaaaucaaa

SEQ ID NO: 1030311 - RNA, 14 nt, Human
ucuggcacuuggga

SEQ ID NO: 1030312 - RNA, 19 nt, Human
cagaaagcagaacagugau

SEQ ID NO: 1030313 - RNA, 17 nt, Human
agacuuugugaaaaaaa

SEQ ID NO: 1030314 - RNA, 15 nt, Human
uggaaauaaaagauu

SEQ ID NO: 1030315 - RNA, 19 nt, Human
uccagccuggcaaggguuc

SEQ ID NO: 1030316 - RNA, 17 nt, Human
uuguuagcaaaauggau

SEQ ID NO: 1030317 - RNA, 16 nt, Human
auaugugaaauaaaag

SEQ ID NO: 1030318 - RNA, 17 nt, Human
auuuuaaaucuaaaucu

SEQ ID NO: 1030319 - RNA, 17 nt, Human
ucaacccccauuucuau

SEQ ID NO: 1030320 - RNA, 15 nt, Human
cuacaagcuaaaauu

SEQ ID NO: 1030321 - RNA, 16 nt, Human
auauggggaauauauu

SEQ ID NO: 1030322 - RNA, 15 nt, Human
accuguaaucauaua

SEQ ID NO: 1030323 - RNA, 21 nt, Human
cuaguaucaaaagaaagaaaa

SEQ ID NO: 1030324 - RNA, 19 nt, Human
gcaugggccuagcccacug

SEQ ID NO: 1030325 - RNA, 22 nt, Human
auuacaguuagagauuuuuaaa

SEQ ID NO: 1030326 - RNA, 14 nt, Human
ucuuguuuuuccac

SEQ ID NO: 1030327 - RNA, 18 nt, Human
gccaucccucccuccacc

SEQ ID NO: 1030328 - RNA, 19 nt, Human
uggcgcgcgccaccacgcc

SEQ ID NO: 1030329 - RNA, 23 nt, Human
cauuguggucacaggaaguagag

SEQ ID NO: 1030330 - RNA, 15 nt, Human
uccuguacuuuuucc

SEQ ID NO: 1030331 - RNA, 22 nt, Human
auacugaauguaaacaaaggaa

SEQ ID NO: 1030332 - RNA, 15 nt, Human
aggagauggaaguug

SEQ ID NO: 1030333 - RNA, 21 nt, Human
auuuauauggggaauauauuu

SEQ ID NO: 1030334 - RNA, 21 nt, Human
uaucuaauauauaugaauaaa

SEQ ID NO: 1030335 - RNA, 13 nt, Human
agaagacaacauu

SEQ ID NO: 1030336 - RNA, 14 nt, Human
cuuaaaauguaauu

SEQ ID NO: 1030337 - RNA, 13 nt, Human
gagacagcucugc

SEQ ID NO: 1030338 - RNA, 14 nt, Human
uguuucuuaaaugg

SEQ ID NO: 1030339 - RNA, 14 nt, Human
uuauauauguauuu

SEQ ID NO: 1030340 - RNA, 12 nt, Human
aauugcagagua

SEQ ID NO: 1030341 - RNA, 19 nt, Human
uaaauuuucccaaaacuga

SEQ ID NO: 1030342 - RNA, 18 nt, Human
acugccgguuugaaaaua

SEQ ID NO: 1030343 - RNA, 21 nt, Human
gacagcuucucauccugcagg

SEQ ID NO: 1030344 - RNA, 15 nt, Human
ucaaaagguauuuau

SEQ ID NO: 1030345 - RNA, 23 nt, Human
ggucucagugucaaugcagcccc

SEQ ID NO: 1030346 - RNA, 21 nt, Human
auaguaccaaucauuuuaauu

SEQ ID NO: 1030347 - RNA, 16 nt, Human
aucaauuuaaaaaaaa

SEQ ID NO: 1030348 - RNA, 16 nt, Human
ucaaucaaauaaguau

SEQ ID NO: 1030349 - RNA, 20 nt, Human
auuuuuaccuuuuuccuucc

SEQ ID NO: 1030350 - RNA, 15 nt, Human
aguacagacuuuuuu

SEQ ID NO: 1030351 - RNA, 16 nt, Human
uuuccacuacugcuac

SEQ ID NO: 1030352 - RNA, 22 nt, Human
cucccacuagacaaguccagcc

SEQ ID NO: 1030353 - RNA, 23 nt, Human
ugagcugauaucaugccccugua

SEQ ID NO: 1030354 - RNA, 19 nt, Human
cucauugcaaccuccaccu

SEQ ID NO: 1030355 - RNA, 17 nt, Human
cuuuacuguuagucauu

SEQ ID NO: 1030356 - RNA, 23 nt, Human
accuguaaucauauaauaaaugu

SEQ ID NO: 1030357 - RNA, 18 nt, Human
gccccugcacuccagccu

SEQ ID NO: 1030358 - RNA, 21 nt, Human
uccguggcacugcauacaauc

SEQ ID NO: 1030359 - RNA, 20 nt, Human
agaaugggaugaucauguau

SEQ ID NO: 1030360 - RNA, 20 nt, Human
ccacauggcuucaccugucc

SEQ ID NO: 1030361 - RNA, 20 nt, Human
uaaaauguaauuaaucuugu

SEQ ID NO: 1030362 - RNA, 13 nt, Human
cauacaguaauuu

SEQ ID NO: 1030363 - RNA, 16 nt, Human
uauaauaaauguacau

SEQ ID NO: 1030364 - RNA, 16 nt, Human
cuuauagaauauuuau

SEQ ID NO: 1030365 - RNA, 13 nt, Human
ucauuuaaaauau

SEQ ID NO: 1030366 - RNA, 15 nt, Human
gggcucuggaaacca

SEQ ID NO: 1030367 - RNA, 12 nt, Human
aaacaaaaaaag

SEQ ID NO: 1030368 - RNA, 22 nt, Human
gaaaauaugccugcaaucugag

SEQ ID NO: 1030369 - RNA, 14 nt, Human
uauaaauuuuccca

SEQ ID NO: 1030370 - RNA, 20 nt, Human
aaguauuuauauauuuauaa

SEQ ID NO: 1030371 - RNA, 23 nt, Human
gccaaaaaccaaauuuguauuua

SEQ ID NO: 1030372 - RNA, 15 nt, Human
uauuguaccucucuu

SEQ ID NO: 1030373 - RNA, 20 nt, Human
caggcuccaaacuggagcuu

SEQ ID NO: 1030374 - RNA, 16 nt, Human
cagcuuuuucucuccc

SEQ ID NO: 1030375 - RNA, 20 nt, Human
uucgugaaguauacuguauu

SEQ ID NO: 1030376 - RNA, 15 nt, Human
cugccucuaaaaggc

SEQ ID NO: 1030377 - RNA, 19 nt, Human
uaaaucuauuuauuaauau

SEQ ID NO: 1030378 - RNA, 18 nt, Human
ucaaauuccagaaugauu

SEQ ID NO: 1030379 - RNA, 11 nt, Human
uacgugcaaua

SEQ ID NO: 1030380 - RNA, 16 nt, Human
caguucagagcugccc

SEQ ID NO: 1030381 - RNA, 22 nt, Human
cagaguacuggcugauggagua

SEQ ID NO: 1030382 - RNA, 19 nt, Human
uaaauauauuuaagauaau

SEQ ID NO: 1030383 - RNA, 13 nt, Human
aaagccaaaaacc

SEQ ID NO: 1030384 - RNA, 18 nt, Human
aaaugugcaauaugugau

SEQ ID NO: 1030385 - RNA, 13 nt, Human
ugauagcuuuauu

SEQ ID NO: 1030386 - RNA, 15 nt, Human
uagauguagauaaac

SEQ ID NO: 1030387 - RNA, 21 nt, Human
guuuuuauauaugugaaauaa

SEQ ID NO: 1030388 - RNA, 13 nt, Human
gcaaccuccaccu

SEQ ID NO: 1030389 - RNA, 21 nt, Human
auuuuaguaagagauuccuga

SEQ ID NO: 1030390 - RNA, 15 nt, Human
caccuucuggguuca

SEQ ID NO: 1030391 - RNA, 14 nt, Human
uuauaaguuacaua

SEQ ID NO: 1030392 - RNA, 14 nt, Human
uagaauuaauggaa

SEQ ID NO: 1030393 - RNA, 19 nt, Human
aaauuggacuuaaaaucua

SEQ ID NO: 1030394 - RNA, 14 nt, Human
cugacccagccccu

SEQ ID NO: 1030395 - RNA, 16 nt, Human
ucacuuaauccuuugu

SEQ ID NO: 1030396 - RNA, 13 nt, Human
agcgacagugaga

SEQ ID NO: 1030397 - RNA, 20 nt, Human
uugauagaguguuaucaguc

SEQ ID NO: 1030398 - RNA, 22 nt, Human
gaagugaaaaucuacacuccag

SEQ ID NO: 1030399 - RNA, 14 nt, Human
aagcaacccaaaug

SEQ ID NO: 1030400 - RNA, 21 nt, Human
uacauuauuaucaacaauagu

SEQ ID NO: 1030401 - RNA, 22 nt, Human
ccucuaauuuaucuugucucug

SEQ ID NO: 1030402 - RNA, 17 nt, Human
acuucauuuaaaauauu

SEQ ID NO: 1030403 - RNA, 21 nt, Human
uggcuguaucuuguuuuucca

SEQ ID NO: 1030404 - RNA, 18 nt, Human
cuaauuuaucuugucucu

SEQ ID NO: 1030405 - RNA, 15 nt, Human
uauguauuuauaaau

SEQ ID NO: 1030406 - RNA, 15 nt, Human
cuuaaaauguaauua

SEQ ID NO: 1030407 - RNA, 14 nt, Human
agaguacuggcuga

SEQ ID NO: 1030408 - RNA, 15 nt, Human
caauauuugaauuuu

SEQ ID NO: 1030409 - RNA, 19 nt, Human
cauuucaaaagguauuuau

SEQ ID NO: 1030410 - RNA, 20 nt, Human
gcagcugccuccccuccucu

SEQ ID NO: 1030411 - RNA, 15 nt, Human
uggaguaaaucgcua

SEQ ID NO: 1030412 - RNA, 22 nt, Human
ucucuuaaacacuaaaaaggca

SEQ ID NO: 1030413 - RNA, 21 nt, Human
accuccaccuucuggguucaa

SEQ ID NO: 1030414 - RNA, 22 nt, Human
gacucugucucaaaaaauaaaa

SEQ ID NO: 1030415 - RNA, 20 nt, Human
uugcaaccuccaccuucugg

SEQ ID NO: 1030416 - RNA, 14 nt, Human
aaugaacacuuaua

SEQ ID NO: 1030417 - RNA, 17 nt, Human
ucugucucaaaaaauaa

SEQ ID NO: 1030418 - RNA, 17 nt, Human
uagaauaguguuggaaa

SEQ ID NO: 1030419 - RNA, 17 nt, Human
aaggccugucccugcag

SEQ ID NO: 1030420 - RNA, 15 nt, Human
aggcuccaaacugga

SEQ ID NO: 1030421 - RNA, 19 nt, Human
agucaaugaacuuuccaca

SEQ ID NO: 1030422 - RNA, 13 nt, Human
uuuaagauaaauu

SEQ ID NO: 1030423 - RNA, 19 nt, Human
cacuuuauauuauuuugaa

SEQ ID NO: 1030424 - RNA, 23 nt, Human
ggcaaagacuauucccuucuaac

SEQ ID NO: 1030425 - RNA, 21 nt, Human
auugggaaaggaguagaaaaa

SEQ ID NO: 1030426 - RNA, 18 nt, Human
uacagagaaaagacauaa

SEQ ID NO: 1030427 - RNA, 21 nt, Human
cuucuaaccugaacugauggg

SEQ ID NO: 1030428 - RNA, 22 nt, Human
gcaaccuccaccuucuggguuc

SEQ ID NO: 1030429 - RNA, 13 nt, Human
ucuaucuauuuau

SEQ ID NO: 1030430 - RNA, 13 nt, Human
aaaaauuuuauag

SEQ ID NO: 1030431 - RNA, 19 nt, Human
gcuggagugcaguggcgca

SEQ ID NO: 1030432 - RNA, 17 nt, Human
acaccagagauaauaug

SEQ ID NO: 1030433 - RNA, 14 nt, Human
uuaauuucaugaaa

SEQ ID NO: 1030434 - RNA, 14 nt, Human
ggccagaagucaag

SEQ ID NO: 1030435 - RNA, 15 nt, Human
cuauauccugugacu

SEQ ID NO: 1030436 - RNA, 15 nt, Human
ugcaaccuccaccuu

SEQ ID NO: 1030437 - RNA, 20 nt, Human
gcugcccucuccugggcagc

SEQ ID NO: 1030438 - RNA, 20 nt, Human
ugugcuggcuuaaaauguaa

SEQ ID NO: 1030439 - RNA, 14 nt, Human
uauguauauuuuau

SEQ ID NO: 1030440 - RNA, 21 nt, Human
gcuggaauugaauucccugcc

SEQ ID NO: 1030441 - RNA, 22 nt, Human
aaggcaaagcacgaaauguuau

SEQ ID NO: 1030442 - RNA, 16 nt, Human
aaguugcagugagcug

SEQ ID NO: 1030443 - RNA, 16 nt, Human
cccucccuccaccucc

SEQ ID NO: 1030444 - RNA, 18 nt, Human
caaggcuagaaccaccug

SEQ ID NO: 1030445 - RNA, 22 nt, Human
auuaaggcuucucuuaaacacu

SEQ ID NO: 1030446 - RNA, 15 nt, Human
uacaucuuucacauu

SEQ ID NO: 1030447 - RNA, 23 nt, Human
aguguacaugaaagcguaaagag

SEQ ID NO: 1030448 - RNA, 15 nt, Human
acuugugcaguguug

SEQ ID NO: 1030449 - RNA, 16 nt, Human
agcaagacucugucuc

SEQ ID NO: 1030450 - RNA, 12 nt, Human
aaugaaagaaag

SEQ ID NO: 1030451 - RNA, 17 nt, Human
auuuuacaauugaaaug

SEQ ID NO: 1030452 - RNA, 17 nt, Human
ccucccuccaccucccu

SEQ ID NO: 1030453 - RNA, 19 nt, Human
cuguauuuuuaccuuuuuc

SEQ ID NO: 1030454 - RNA, 13 nt, Human
aacucuuaaucaa

SEQ ID NO: 1030455 - RNA, 19 nt, Human
ugccaucccucccuccacc

SEQ ID NO: 1030456 - RNA, 18 nt, Human
cuuuuuuuuuuuuuuaaa

SEQ ID NO: 1030457 - RNA, 16 nt, Human
auacauguuacaacac

SEQ ID NO: 1030458 - RNA, 22 nt, Human
uccauggugugcuggcuuaaaa

SEQ ID NO: 1030459 - RNA, 20 nt, Human
ucaucugugauucccuccug

SEQ ID NO: 1030460 - RNA, 20 nt, Human
uuaugugcaauaaaauguau

SEQ ID NO: 1030461 - RNA, 14 nt, Human
auauuauuuugaau

SEQ ID NO: 1030462 - RNA, 15 nt, Human
auccugccccugagc

SEQ ID NO: 1030463 - RNA, 14 nt, Human
aaaaauacaaaaau

SEQ ID NO: 1030464 - RNA, 23 nt, Human
ugagucagucugaugagaacucu

SEQ ID NO: 1030465 - RNA, 16 nt, Human
cuguaaucccagcacu

SEQ ID NO: 1030466 - RNA, 15 nt, Human
uuccugagaccagcc

SEQ ID NO: 1030467 - RNA, 21 nt, Human
ucccugcaauaaaauggguuu

SEQ ID NO: 1030468 - RNA, 23 nt, Human
ucauuucaaaacucauuuccuau

SEQ ID NO: 1030469 - RNA, 21 nt, Human
cuggagcuugaaauagugucu

SEQ ID NO: 1030470 - RNA, 20 nt, Human
uuaauauuuaacauuauuua

SEQ ID NO: 1030471 - RNA, 11 nt, Human
cccucccucca

SEQ ID NO: 1030472 - RNA, 19 nt, Human
cauccauggugugcuggcu

SEQ ID NO: 1030473 - RNA, 16 nt, Human
gcacuuuaaacauuua

SEQ ID NO: 1030474 - RNA, 16 nt, Human
gaggacuugggcggga

SEQ ID NO: 1030475 - RNA, 13 nt, Human
cuugccugcaggc

SEQ ID NO: 1030476 - RNA, 20 nt, Human
cuugccauaauuacuauguc

SEQ ID NO: 1030477 - RNA, 20 nt, Human
cuggacuuuccagagaccag

SEQ ID NO: 1030478 - RNA, 14 nt, Human
uauuugaauuuuaa

SEQ ID NO: 1030479 - RNA, 17 nt, Human
auuuacuuuguuauuuu

SEQ ID NO: 1030480 - RNA, 19 nt, Human
uauguaacugcauugagaa

SEQ ID NO: 1030481 - RNA, 18 nt, Human
cuuuaauuucaugaaaag

SEQ ID NO: 1030482 - RNA, 12 nt, Human
auuuauuaauau

SEQ ID NO: 1030483 - RNA, 22 nt, Human
cuggcaaggguucaccugggcu

SEQ ID NO: 1030484 - RNA, 14 nt, Human
ugccaucccucccu

SEQ ID NO: 1030485 - RNA, 13 nt, Human
uuuauagugucuu

SEQ ID NO: 1030486 - RNA, 19 nt, Human
uuguguaaugaaaaugaau

SEQ ID NO: 1030487 - RNA, 17 nt, Human
ugagaagagaauauuag

SEQ ID NO: 1030488 - RNA, 14 nt, Human
ugacagcccaaggg

SEQ ID NO: 1030489 - RNA, 19 nt, Human
aguaauuucagaagaaauu

SEQ ID NO: 1030490 - RNA, 20 nt, Human
caguuagagauuuuuaaaua

SEQ ID NO: 1030491 - RNA, 20 nt, Human
ugcaauaaaauguauuuguu

SEQ ID NO: 1030492 - RNA, 21 nt, Human
caagacucugucucaaaaaau

SEQ ID NO: 1030493 - RNA, 19 nt, Human
ggucucaguguccucaucu

SEQ ID NO: 1030494 - RNA, 19 nt, Human
cuugccugcaggcaugagu

SEQ ID NO: 1030495 - RNA, 18 nt, Human
gaaaggccagcaaauucg

SEQ ID NO: 1030496 - RNA, 18 nt, Human
aauuuuuuucaauauuua

SEQ ID NO: 1030497 - RNA, 13 nt, Human
aauaaaaauaaau

SEQ ID NO: 1030498 - RNA, 21 nt, Human
ucuauuaggaaauauucugua

SEQ ID NO: 1030499 - RNA, 21 nt, Human
auaagcaaagacuaugaggaa

SEQ ID NO: 1030500 - RNA, 13 nt, Human
aacuggaaauaaa

SEQ ID NO: 1030501 - RNA, 20 nt, Human
aauaagccagacaucaacag

SEQ ID NO: 1030502 - RNA, 22 nt, Human
aaguuguagguaauauugcaag

SEQ ID NO: 1030503 - RNA, 16 nt, Human
aaacaaacgaaaaaca

SEQ ID NO: 1030504 - RNA, 13 nt, Human
gcccucuccuggg

SEQ ID NO: 1030505 - RNA, 16 nt, Human
aaauuuucccaaaacu

SEQ ID NO: 1030506 - RNA, 14 nt, Human
ugaaacaagaagcc

SEQ ID NO: 1030507 - RNA, 13 nt, Human
cuuacagagaaaa

SEQ ID NO: 1030508 - RNA, 16 nt, Human
uacagggcauuuuggu

SEQ ID NO: 1030509 - RNA, 22 nt, Human
aacuuucuuuucuggaauguaa

SEQ ID NO: 1030510 - RNA, 12 nt, Human
gcgcagccaugu

SEQ ID NO: 1030511 - RNA, 19 nt, Human
cugucccagcgagggacac

SEQ ID NO: 1030512 - RNA, 14 nt, Human
caaacgaaaaacau

SEQ ID NO: 1030513 - RNA, 14 nt, Human
aaaaggaagaaauu

SEQ ID NO: 1030514 - RNA, 23 nt, Human
acucuauguucuaagaagugaaa

SEQ ID NO: 1030515 - RNA, 16 nt, Human
cuccucugcuugccau

SEQ ID NO: 1030516 - RNA, 21 nt, Human
uguacauuuccaaauucacaa

SEQ ID NO: 1030517 - RNA, 14 nt, Human
cacaagaaaugaaa

SEQ ID NO: 1030518 - RNA, 20 nt, Human
ucaggugacccugaugaaaa

SEQ ID NO: 1030519 - RNA, 22 nt, Human
augaauuuuuuucaucuucucu

SEQ ID NO: 1030520 - RNA, 18 nt, Human
cagaguacuggcugaugg

SEQ ID NO: 1030521 - RNA, 21 nt, Human
cuucucuuaaacacuaaaaag

SEQ ID NO: 1030522 - RNA, 22 nt, Human
gcuucucauccugcaggcagcu

SEQ ID NO: 1030523 - RNA, 13 nt, Human
gccuccccuccuc

SEQ ID NO: 1030524 - RNA, 19 nt, Human
uauuauaauuuuuuucaau

SEQ ID NO: 1030525 - RNA, 16 nt, Human
uuuaauuucaugaaaa

SEQ ID NO: 1030526 - RNA, 19 nt, Human
gaaauaaaaguagaauaaa

SEQ ID NO: 1030527 - RNA, 23 nt, Human
cucuccugggcagcugccucccc

SEQ ID NO: 1030528 - RNA, 15 nt, Human
cuuuggggagccaac

SEQ ID NO: 1030529 - RNA, 15 nt, Human
auguauuuauaaaua

SEQ ID NO: 1030530 - RNA, 18 nt, Human
cucucuuauagaauauuu

SEQ ID NO: 1030531 - RNA, 14 nt, Human
uaauuucaugaaaa

SEQ ID NO: 1030532 - RNA, 23 nt, Human
gaugaaaacauagcaucucagga

SEQ ID NO: 1030533 - RNA, 22 nt, Human
auaucuuuuuuuuaauaaacca

SEQ ID NO: 1030534 - RNA, 21 nt, Human
cucaguccaugaagauguaga

SEQ ID NO: 1030535 - RNA, 22 nt, Human
cagagcugcccucuccugggca

SEQ ID NO: 1030536 - RNA, 22 nt, Human
agaaaccuuauuguaccucucu

SEQ ID NO: 1030537 - RNA, 22 nt, Human
ugauaguuguaccgcaauguga

SEQ ID NO: 1030538 - RNA, 15 nt, Human
auggaauauguaaau

SEQ ID NO: 1030539 - RNA, 17 nt, Human
cuacaagcuaaaauuag

SEQ ID NO: 1030540 - RNA, 19 nt, Human
ggaucuggggcucugggau

SEQ ID NO: 1030541 - RNA, 21 nt, Human
uaaauaaauguaucuuauuca

SEQ ID NO: 1030542 - RNA, 15 nt, Human
uaaaaguagaauaaa

SEQ ID NO: 1030543 - RNA, 15 nt, Human
uugccaugagcuaga

SEQ ID NO: 1030544 - RNA, 16 nt, Human
uaagaaauaugcacaa

SEQ ID NO: 1030545 - RNA, 23 nt, Human
gggcagcugccuccccuccucug

SEQ ID NO: 1030546 - RNA, 16 nt, Human
cuacacuccagugaga

SEQ ID NO: 1030547 - RNA, 15 nt, Human
agaauuuuaaaacuc

SEQ ID NO: 1030548 - RNA, 16 nt, Human
cagaagcaacccaaau

SEQ ID NO: 1030549 - RNA, 18 nt, Human
cugaugaauguuaaauua

SEQ ID NO: 1030550 - RNA, 21 nt, Human
auauuucuuugccuuuauaau

SEQ ID NO: 1030551 - RNA, 15 nt, Human
accugacagcccaag

SEQ ID NO: 1030552 - RNA, 21 nt, Human
cauuucaaaagguauuuauug

SEQ ID NO: 1030553 - RNA, 22 nt, Human
uacaugagguacugagagugaa

SEQ ID NO: 1030554 - RNA, 20 nt, Human
ucaaaauggagggaauaaua

SEQ ID NO: 1030555 - RNA, 17 nt, Human
ccaccucccugcaauaa

SEQ ID NO: 1030556 - RNA, 17 nt, Human
caguccucuuucaaagg

SEQ ID NO: 1030557 - RNA, 14 nt, Human
agcgcagccaugug

SEQ ID NO: 1030558 - RNA, 18 nt, Human
cuccagccugagcgacag

SEQ ID NO: 1030559 - RNA, 15 nt, Human
uggcgcgcaccugua

SEQ ID NO: 1030560 - RNA, 23 nt, Human
ucaauaucuaauauauaugaaua

SEQ ID NO: 1030561 - RNA, 13 nt, Human
uaccuuuuuccuu

SEQ ID NO: 1030562 - RNA, 13 nt, Human
acauuaaaacaau

SEQ ID NO: 1030563 - RNA, 16 nt, Human
cuccugggcagcugcc

SEQ ID NO: 1030564 - RNA, 23 nt, Human
caauauuugaauuuuaaaucuaa

SEQ ID NO: 1030565 - RNA, 11 nt, Human
cucaucauaaa

SEQ ID NO: 1030566 - RNA, 14 nt, Human
auuaauauauguau

SEQ ID NO: 1030567 - RNA, 12 nt, Human
uucuaaaugaau

SEQ ID NO: 1030568 - RNA, 15 nt, Human
ucauuuaaaauauuu

SEQ ID NO: 1030569 - RNA, 13 nt, Human
acucugcauucua

SEQ ID NO: 1030570 - RNA, 21 nt, Human
aaugacuaaaaaacaaagaag

SEQ ID NO: 1030571 - RNA, 22 nt, Human
aaagauuaugaucucagaaauu

SEQ ID NO: 1030572 - RNA, 20 nt, Human
caaauguucaucaaugaaug

SEQ ID NO: 1030573 - RNA, 11 nt, Human
caguucagagc

SEQ ID NO: 1030574 - RNA, 14 nt, Human
agaccagccaaccu

SEQ ID NO: 1030575 - RNA, 18 nt, Human
uuuauauaugugaaauaa

SEQ ID NO: 1030576 - RNA, 18 nt, Human
acuuuaugcuaagugaaa

SEQ ID NO: 1030577 - RNA, 15 nt, Human
acauaagggaggaaa

SEQ ID NO: 1030578 - RNA, 22 nt, Human
acaugagguacugagagugaac

SEQ ID NO: 1030579 - RNA, 21 nt, Human
ugcagaguacuggcugaugga

SEQ ID NO: 1030580 - RNA, 15 nt, Human
uaagauaauuauaau

SEQ ID NO: 1030581 - RNA, 23 nt, Human
ucaaccaaauggagugacuuagu

SEQ ID NO: 1030582 - RNA, 12 nt, Human
auacagugucuu

SEQ ID NO: 1030583 - RNA, 23 nt, Human
auaauguuacauuauuaucaaca

SEQ ID NO: 1030584 - RNA, 14 nt, Human
cuauggaaaaaaag

SEQ ID NO: 1030585 - RNA, 24 nt, Human
uauuuauaaauauauuuaagauaa

SEQ ID NO: 1030586 - RNA, 13 nt, Human
uacagagacagaa

SEQ ID NO: 1030587 - RNA, 16 nt, Human
cuuuggaugcacuuua

SEQ ID NO: 1030588 - RNA, 15 nt, Human
uuuuacaauugaaau

SEQ ID NO: 1030589 - RNA, 19 nt, Human
uaguaccaaucauuuuaau

SEQ ID NO: 1030590 - RNA, 13 nt, Human
uaaauuugguucu

SEQ ID NO: 1030591 - RNA, 19 nt, Human
caaaugcuuaugaaacuaa

SEQ ID NO: 1030592 - RNA, 12 nt, Human
gggcgcgguggc

SEQ ID NO: 1030593 - RNA, 16 nt, Human
agguugcagugagccg

SEQ ID NO: 1030594 - RNA, 23 nt, Human
auuacaguuagagauuuuuaaau

SEQ ID NO: 1030595 - RNA, 16 nt, Human
ccaggaaacucugcau

SEQ ID NO: 1030596 - RNA, 16 nt, Human
gaaggcuuacacccac

SEQ ID NO: 1030597 - RNA, 13 nt, Human
uuuuuuuuuuucu

SEQ ID NO: 1030598 - RNA, 23 nt, Human
acaguucauauguaccauguaca

SEQ ID NO: 1030599 - RNA, 13 nt, Human
aaaugacuaaaaa

SEQ ID NO: 1030600 - RNA, 15 nt, Human
caacuuuuguguaau

SEQ ID NO: 1030601 - RNA, 14 nt, Human
ucaucauaaaauaa

SEQ ID NO: 1030602 - RNA, 13 nt, Mycobacterium bovis subsp bovis AF2122/97
uuuugaaccgggu

SEQ ID NO: 1030603 - RNA, 16 nt, Mycobacterium bovis subsp bovis AF2122/97
uuugcacucgucggug

SEQ ID NO: 1030604 - RNA, 18 nt, Mycobacterium bovis subsp bovis AF2122/97
uuucgugccaugguugau

SEQ ID NO: 1030605 - RNA, 17 nt, Mycobacterium bovis subsp bovis AF2122/97
uuucggcgccgucgccc

SEQ ID NO: 1030606 - RNA, 17 nt, Mycobacterium bovis subsp bovis AF2122/97
uuuggguucgucgacac

SEQ ID NO: 1030607 - RNA, 13 nt, Mycobacterium bovis subsp bovis AF2122/97
uuugcccccggug

SEQ ID NO: 1030608 - RNA, 17 nt, Mycobacterium bovis subsp bovis AF2122/97
uuugccgguucggcgau

SEQ ID NO: 1030609 - RNA, 14 nt, Mycobacterium bovis subsp bovis AF2122/97
uuugcagccuucga

SEQ ID NO: 1030610 - RNA, 18 nt, Mycobacterium bovis subsp bovis AF2122/97
uuugcagccuucgacgca

SEQ ID NO: 1030611 - RNA, 24 nt, Mycobacterium bovis subsp bovis AF2122/97
uuucgaugaugggcgguuccacgc

SEQ ID NO: 1030612 - RNA, 13 nt, Mycobacterium bovis subsp bovis AF2122/97
uuuagcgccgguu

SEQ ID NO: 1030613 - RNA, 19 nt, Mycobacterium bovis subsp bovis AF2122/97
uuguccacgaggcaaccag

SEQ ID NO: 1030614 - RNA, 15 nt, Mycobacterium bovis subsp bovis AF2122/97
uugugaccgccgaug

SEQ ID NO: 1030615 - RNA, 22 nt, Mycobacterium bovis subsp bovis AF2122/97
uugugagcaauggcgcgaccga

SEQ ID NO: 1030616 - RNA, 14 nt, Mycobacterium bovis subsp bovis AF2122/97
uugugcccgccggc

SEQ ID NO: 1030617 - RNA, 13 nt, Mycobacterium bovis subsp bovis AF2122/97
uuggccgggucga

SEQ ID NO: 1030618 - RNA, 16 nt, Mycobacterium bovis subsp bovis AF2122/97
uuggccuugugcagau

SEQ ID NO: 1030619 - RNA, 15 nt, Mycobacterium bovis subsp bovis AF2122/97
uuggcgacgaugcag

SEQ ID NO: 1030620 - RNA, 13 nt, Mycobacterium bovis subsp bovis AF2122/97
uuggcgacgaggc

SEQ ID NO: 1030621 - RNA, 21 nt, Mycobacterium bovis subsp bovis AF2122/97
uuggccuagccgcggcaccgc

SEQ ID NO: 1030622 - RNA, 16 nt, Mycobacterium bovis subsp bovis AF2122/97
uugggcgcggcaggcc

SEQ ID NO: 1030623 - RNA, 20 nt, Mycobacterium bovis subsp bovis AF2122/97
uuggcgaucaaugcgaugcg

SEQ ID NO: 1030624 - RNA, 21 nt, Mycobacterium bovis subsp bovis AF2122/97
uuggggugcuuucgcgucugc

SEQ ID NO: 1030625 - RNA, 16 nt, Mycobacterium bovis subsp bovis AF2122/97
uuggggauggucccgc

SEQ ID NO: 1030626 - RNA, 18 nt, Mycobacterium bovis subsp bovis AF2122/97
uugggcuugcgccggaug

SEQ ID NO: 1030627 - RNA, 23 nt, Mycobacterium bovis subsp bovis AF2122/97
uuggucaccaccuggugcaaccg

SEQ ID NO: 1030628 - RNA, 19 nt, Mycobacterium bovis subsp bovis AF2122/97
uugguaucugucgggauga

SEQ ID NO: 1030629 - RNA, 20 nt, Mycobacterium bovis subsp bovis AF2122/97
uuggucaccugcugcaaccg

SEQ ID NO: 1030630 - RNA, 22 nt, Mycobacterium bovis subsp bovis AF2122/97
uuggugaacaugugaccggcga

SEQ ID NO: 1030631 - RNA, 14 nt, Mycobacterium bovis subsp bovis AF2122/97
uuggugaacggugc

SEQ ID NO: 1030632 - RNA, 13 nt, Mycobacterium bovis subsp bovis AF2122/97
uuggucgccggcg

SEQ ID NO: 1030633 - RNA, 15 nt, Mycobacterium bovis subsp bovis AF2122/97
uuggucgcgaugacg

SEQ ID NO: 1030634 - RNA, 14 nt, Mycobacterium bovis subsp bovis AF2122/97
uuggugguguucau

SEQ ID NO: 1030635 - RNA, 18 nt, Mycobacterium bovis subsp bovis AF2122/97
uuggugcucuugcgggga

SEQ ID NO: 1030636 - RNA, 22 nt, Mycobacterium bovis subsp bovis AF2122/97
uuggugcggaccugcgccggug

SEQ ID NO: 1030637 - RNA, 15 nt, Mycobacterium bovis subsp bovis AF2122/97
uuggugccgccugug

SEQ ID NO: 1030638 - RNA, 21 nt, Mycobacterium bovis subsp bovis AF2122/97
uuggugaccccguaggcgccg

SEQ ID NO: 1030639 - RNA, 16 nt, Mycobacterium bovis subsp bovis AF2122/97
uuggugauggccgacg

SEQ ID NO: 1030640 - RNA, 16 nt, Mycobacterium bovis subsp bovis AF2122/97
uugguguucgggucga

SEQ ID NO: 1030641 - RNA, 14 nt, Mycobacterium bovis subsp bovis AF2122/97
uuggucggugcuga

SEQ ID NO: 1030642 - RNA, 16 nt, Mycobacterium bovis subsp bovis AF2122/97
uugguggccgggucga

SEQ ID NO: 1030643 - RNA, 20 nt, Mycobacterium bovis subsp bovis AF2122/97
uugccggcggcgacgucugc

SEQ ID NO: 1030644 - RNA, 22 nt, Mycobacterium bovis subsp bovis AF2122/97
uugccggcgccuuggucgccgc

SEQ ID NO: 1030645 - RNA, 19 nt, Mycobacterium bovis subsp bovis AF2122/97
uugccggccaccagccugg

SEQ ID NO: 1030646 - RNA, 20 nt, Mycobacterium bovis subsp bovis AF2122/97
uugccggacaaccuggggcc

SEQ ID NO: 1030647 - RNA, 12 nt, Mycobacterium bovis subsp bovis AF2122/97
uugccgggcgcu

SEQ ID NO: 1030648 - RNA, 23 nt, Mycobacterium bovis subsp bovis AF2122/97
uugccgggcgcuggacggcgggc

SEQ ID NO: 1030649 - RNA, 20 nt, Mycobacterium bovis subsp bovis AF2122/97
uugccgucgugaucggcgaa

SEQ ID NO: 1030650 - RNA, 12 nt, Mycobacterium bovis subsp bovis AF2122/97
uugccgccggug

SEQ ID NO: 1030651 - RNA, 20 nt, Mycobacterium bovis subsp bovis AF2122/97
uugccgccggccccgccagc

SEQ ID NO: 1030652 - RNA, 20 nt, Mycobacterium bovis subsp bovis AF2122/97
uugccgccggccccgccggc

SEQ ID NO: 1030653 - RNA, 14 nt, Mycobacterium bovis subsp bovis AF2122/97
uugccgccggcgcc

SEQ ID NO: 1030654 - RNA, 17 nt, Mycobacterium bovis subsp bovis AF2122/97
uugccgccgccuccgcc

SEQ ID NO: 1030655 - RNA, 15 nt, Mycobacterium bovis subsp bovis AF2122/97
uugccgccgacgccg

SEQ ID NO: 1030656 - RNA, 20 nt, Mycobacterium bovis subsp bovis AF2122/97
uugccgccgagggcgccggg

SEQ ID NO: 1030657 - RNA, 23 nt, Mycobacterium bovis subsp bovis AF2122/97
uugccgcccgcuccgccgucgcc

SEQ ID NO: 1030658 - RNA, 18 nt, Mycobacterium bovis subsp bovis AF2122/97
uugccgccgaacagcugg

SEQ ID NO: 1030659 - RNA, 13 nt, Mycobacterium bovis subsp bovis AF2122/97
uugccgccgucgc

SEQ ID NO: 1030660 - RNA, 14 nt, Mycobacterium bovis subsp bovis AF2122/97
uugccgccgucgcc

SEQ ID NO: 1030661 - RNA, 21 nt, Mycobacterium bovis subsp bovis AF2122/97
uugccgccgucgccgccguug

SEQ ID NO: 1030662 - RNA, 11 nt, Mycobacterium bovis subsp bovis AF2122/97
uugccgccguu

SEQ ID NO: 1030663 - RNA, 19 nt, Mycobacterium bovis subsp bovis AF2122/97
uugccgccguuaccgccgc

SEQ ID NO: 1030664 - RNA, 21 nt, Mycobacterium bovis subsp bovis AF2122/97
uugccgccguuaccgccgcug

SEQ ID NO: 1030665 - RNA, 15 nt, Mycobacterium bovis subsp bovis AF2122/97
uugccgccguugccg

SEQ ID NO: 1030666 - RNA, 15 nt, Mycobacterium bovis subsp bovis AF2122/97
uugccgccuccggug

SEQ ID NO: 1030667 - RNA, 21 nt, Mycobacterium bovis subsp bovis AF2122/97
uugccgccuggguugaccgcc

SEQ ID NO: 1030668 - RNA, 21 nt, Mycobacterium bovis subsp bovis AF2122/97
uugccgccugucccgccggcc

SEQ ID NO: 1030669 - RNA, 14 nt, Mycobacterium bovis subsp bovis AF2122/97
uugccgccuuggcc

SEQ ID NO: 1030670 - RNA, 18 nt, Mycobacterium bovis subsp bovis AF2122/97
uugccgaaccacgcgccc

SEQ ID NO: 1030671 - RNA, 15 nt, Mycobacterium bovis subsp bovis AF2122/97
uugcccgucggcgcc

SEQ ID NO: 1030672 - RNA, 20 nt, Mycobacterium bovis subsp bovis AF2122/97
uugcccguucaugcggcggc

SEQ ID NO: 1030673 - RNA, 24 nt, Mycobacterium bovis subsp bovis AF2122/97
uugcgucguggggaccggcaggcc

SEQ ID NO: 1030674 - RNA, 16 nt, Mycobacterium bovis subsp bovis AF2122/97
uugcguccauccgcag

SEQ ID NO: 1030675 - RNA, 23 nt, Mycobacterium bovis subsp bovis AF2122/97
uugcguccauccgcagcagguga

SEQ ID NO: 1030676 - RNA, 14 nt, Mycobacterium bovis subsp bovis AF2122/97
uugcgguucgaacg

SEQ ID NO: 1030677 - RNA, 19 nt, Mycobacterium bovis subsp bovis AF2122/97
uugcgggacuagguccgau

SEQ ID NO: 1030678 - RNA, 19 nt, Mycobacterium bovis subsp bovis AF2122/97
uugcgcucguugguucagc

SEQ ID NO: 1030679 - RNA, 14 nt, Mycobacterium bovis subsp bovis AF2122/97
uugcgcgcaggugc

SEQ ID NO: 1030680 - RNA, 19 nt, Mycobacterium bovis subsp bovis AF2122/97
uugcggaaacccggccgcc

SEQ ID NO: 1030681 - RNA, 17 nt, Mycobacterium bovis subsp bovis AF2122/97
uugcgaucugcggcgcc

SEQ ID NO: 1030682 - RNA, 22 nt, Mycobacterium bovis subsp bovis AF2122/97
uugcgaugcccacggugccggc

SEQ ID NO: 1030683 - RNA, 16 nt, Mycobacterium bovis subsp bovis AF2122/97
uugcgcccagcgaccc

SEQ ID NO: 1030684 - RNA, 19 nt, Mycobacterium bovis subsp bovis AF2122/97
uugcgcggcaguggccaga

SEQ ID NO: 1030685 - RNA, 18 nt, Mycobacterium bovis subsp bovis AF2122/97
uugcgcggcaucccgcca

SEQ ID NO: 1030686 - RNA, 23 nt, Mycobacterium bovis subsp bovis AF2122/97
uugcguucggucagugggacggg

SEQ ID NO: 1030687 - RNA, 17 nt, Mycobacterium bovis subsp bovis AF2122/97
uugcuagguucgcgacg

SEQ ID NO: 1030688 - RNA, 18 nt, Mycobacterium bovis subsp bovis AF2122/97
uugcgucugcucggcggc

SEQ ID NO: 1030689 - RNA, 23 nt, Mycobacterium bovis subsp bovis AF2122/97
uugcguuccaguccccgccggcc

SEQ ID NO: 1030690 - RNA, 22 nt, Mycobacterium bovis subsp bovis AF2122/97
uugcguggcguugguggucugc

SEQ ID NO: 1030691 - RNA, 23 nt, Mycobacterium bovis subsp bovis AF2122/97
uugcucgaucugucgcgccggug

SEQ ID NO: 1030692 - RNA, 21 nt, Mycobacterium bovis subsp bovis AF2122/97
uuggccgaacagcugcccgcc

SEQ ID NO: 1030693 - RNA, 16 nt, Mycobacterium bovis subsp bovis AF2122/97
uuggccgcaaggcgug

SEQ ID NO: 1030694 - RNA, 19 nt, Mycobacterium bovis subsp bovis AF2122/97
uuggccgccacaccgccgc

SEQ ID NO: 1030695 - RNA, 12 nt, Mycobacterium bovis subsp bovis AF2122/97
uuggccgcccga

SEQ ID NO: 1030696 - RNA, 18 nt, Mycobacterium bovis subsp bovis AF2122/97
uuggccggccccgcccgc

SEQ ID NO: 1030697 - RNA, 14 nt, Mycobacterium bovis subsp bovis AF2122/97
uuggcccagcgugu

SEQ ID NO: 1030698 - RNA, 21 nt, Mycobacterium bovis subsp bovis AF2122/97
uuggccaggucggccaccgug

SEQ ID NO: 1030699 - RNA, 15 nt, Mycobacterium bovis subsp bovis AF2122/97
uuggcccgaguuggc

SEQ ID NO: 1030700 - RNA, 13 nt, Mycobacterium bovis subsp bovis AF2122/97
uuggccagcagca

SEQ ID NO: 1030701 - RNA, 13 nt, Mycobacterium bovis subsp bovis AF2122/97
uuggccagcagcg

SEQ ID NO: 1030702 - RNA, 16 nt, Mycobacterium bovis subsp bovis AF2122/97
uuggccagaccgcgcg

SEQ ID NO: 1030703 - RNA, 22 nt, Mycobacterium bovis subsp bovis AF2122/97
uuggccaccaucgccgccguug

SEQ ID NO: 1030704 - RNA, 18 nt, Mycobacterium bovis subsp bovis AF2122/97
uuggcacgcaacaccgcc

SEQ ID NO: 1030705 - RNA, 18 nt, Mycobacterium bovis subsp bovis AF2122/97
uuggcagggccagcggca

SEQ ID NO: 1030706 - RNA, 22 nt, Mycobacterium bovis subsp bovis AF2122/97
uuggcaaugaccccggcguugc

SEQ ID NO: 1030707 - RNA, 21 nt, Mycobacterium bovis subsp bovis AF2122/97
uuggagcucaucgacgagccg

SEQ ID NO: 1030708 - RNA, 14 nt, Mycobacterium bovis subsp bovis AF2122/97
uuggagaucgccgc

SEQ ID NO: 1030709 - RNA, 14 nt, Mycobacterium bovis subsp bovis AF2122/97
uuggaccguugccg

SEQ ID NO: 1030710 - RNA, 14 nt, Mycobacterium bovis subsp bovis AF2122/97
uuggaucacccgcc

SEQ ID NO: 1030711 - RNA, 13 nt, Mycobacterium bovis subsp bovis AF2122/97
uuggaucacgcga

SEQ ID NO: 1030712 - RNA, 18 nt, Mycobacterium bovis subsp bovis AF2122/97
uugcccgacggcgucuuc

SEQ ID NO: 1030713 - RNA, 18 nt, Mycobacterium bovis subsp bovis AF2122/97
uugccccguugagcagca

SEQ ID NO: 1030714 - RNA, 23 nt, Mycobacterium bovis subsp bovis AF2122/97
uugccaccgagaucaugccggcg

SEQ ID NO: 1030715 - RNA, 17 nt, Mycobacterium bovis subsp bovis AF2122/97
uugcagugccgccggcc

SEQ ID NO: 1030716 - RNA, 15 nt, Mycobacterium bovis subsp bovis AF2122/97
uugcaucagcacguc

SEQ ID NO: 1030717 - RNA, 18 nt, Mycobacterium bovis subsp bovis AF2122/97
uugcagaauccggucggc

SEQ ID NO: 1030718 - RNA, 13 nt, Mycobacterium bovis subsp bovis AF2122/97
uugcaccuucucc

SEQ ID NO: 1030719 - RNA, 14 nt, Mycobacterium bovis subsp bovis AF2122/97
uugcacaccgaucg

SEQ ID NO: 1030720 - RNA, 21 nt, Mycobacterium bovis subsp bovis AF2122/97
uugcaccgagaaagugcaguu

SEQ ID NO: 1030721 - RNA, 15 nt, Mycobacterium bovis subsp bovis AF2122/97
uugaugccgaugucg

SEQ ID NO: 1030722 - RNA, 15 nt, Mycobacterium bovis subsp bovis AF2122/97
uugaugccgccggag

SEQ ID NO: 1030723 - RNA, 15 nt, Mycobacterium bovis subsp bovis AF2122/97
uugaugcucgaugcg

SEQ ID NO: 1030724 - RNA, 15 nt, Mycobacterium bovis subsp bovis AF2122/97
uugaugcuucgaacc

SEQ ID NO: 1030725 - RNA, 19 nt, Mycobacterium bovis subsp bovis AF2122/97
uugaugggcagccgcccgc

SEQ ID NO: 1030726 - RNA, 23 nt, Mycobacterium bovis subsp bovis AF2122/97
uugaugggcagccgcccgcccac

SEQ ID NO: 1030727 - RNA, 16 nt, Mycobacterium bovis subsp bovis AF2122/97
uugauggucuccacca

SEQ ID NO: 1030728 - RNA, 12 nt, Mycobacterium bovis subsp bovis AF2122/97
uugaucggcgag

SEQ ID NO: 1030729 - RNA, 12 nt, Mycobacterium bovis subsp bovis AF2122/97
uugauccgcacc

SEQ ID NO: 1030730 - RNA, 20 nt, Mycobacterium bovis subsp bovis AF2122/97
uugacgucgagcagcgccac

SEQ ID NO: 1030731 - RNA, 13 nt, Mycobacterium bovis subsp bovis AF2122/97
uugacguccaaca

SEQ ID NO: 1030732 - RNA, 17 nt, Mycobacterium bovis subsp bovis AF2122/97
uugacguaggcggcggc

SEQ ID NO: 1030733 - RNA, 21 nt, Mycobacterium bovis subsp bovis AF2122/97
uugacugcacaccaccgccga

SEQ ID NO: 1030734 - RNA, 21 nt, Mycobacterium bovis subsp bovis AF2122/97
uugacgugugagggccgggug

SEQ ID NO: 1030735 - RNA, 17 nt, Mycobacterium bovis subsp bovis AF2122/97
uugacgacaaacggcga

SEQ ID NO: 1030736 - RNA, 19 nt, Mycobacterium bovis subsp bovis AF2122/97
uugacgacaaacggcgacc

SEQ ID NO: 1030737 - RNA, 22 nt, Mycobacterium bovis subsp bovis AF2122/97
uugacgagacgacgaccggcua

SEQ ID NO: 1030738 - RNA, 18 nt, Mycobacterium bovis subsp bovis AF2122/97
uugacggcuucggcagcc

SEQ ID NO: 1030739 - RNA, 16 nt, Mycobacterium bovis subsp bovis AF2122/97
uugacgcgacgagccg

SEQ ID NO: 1030740 - RNA, 17 nt, Mycobacterium bovis subsp bovis AF2122/97
uugacgaacccaccgug

SEQ ID NO: 1030741 - RNA, 20 nt, Mycobacterium bovis subsp bovis AF2122/97
uugacgaacccaccgugccg

SEQ ID NO: 1030742 - RNA, 21 nt, Mycobacterium bovis subsp bovis AF2122/97
uugaccgggucgccgaugacg

SEQ ID NO: 1030743 - RNA, 17 nt, Mycobacterium bovis subsp bovis AF2122/97
uugagcucagguucagc

SEQ ID NO: 1030744 - RNA, 22 nt, Mycobacterium bovis subsp bovis AF2122/97
uugagcgaguugcagucgcgag

SEQ ID NO: 1030745 - RNA, 16 nt, Mycobacterium bovis subsp bovis AF2122/97
uugagcgcggccacca

SEQ ID NO: 1030746 - RNA, 23 nt, Mycobacterium bovis subsp bovis AF2122/97
uugaggcuggucugcaggcggcc

SEQ ID NO: 1030747 - RNA, 15 nt, Mycobacterium bovis subsp bovis AF2122/97
uugaggauccgcacc

SEQ ID NO: 1030748 - RNA, 22 nt, Mycobacterium bovis subsp bovis AF2122/97
uugagccgggcaaccagcagca

SEQ ID NO: 1030749 - RNA, 19 nt, Mycobacterium bovis subsp bovis AF2122/97
uugagccacguucgcggcc

SEQ ID NO: 1030750 - RNA, 23 nt, Mycobacterium bovis subsp bovis AF2122/97
uugagcaaaauggccaccggcgg

SEQ ID NO: 1030751 - RNA, 18 nt, Mycobacterium bovis subsp bovis AF2122/97
uugagaacaacgcgucga

SEQ ID NO: 1030752 - RNA, 14 nt, Mycobacterium bovis subsp bovis AF2122/97
uugaagccgcccga

SEQ ID NO: 1030753 - RNA, 13 nt, Mycobacterium bovis subsp bovis AF2122/97
uugaccagcagcu

SEQ ID NO: 1030754 - RNA, 21 nt, Mycobacterium bovis subsp bovis AF2122/97
uugaccaggcuccggccggcc

SEQ ID NO: 1030755 - RNA, 22 nt, Mycobacterium bovis subsp bovis AF2122/97
uugaccgcggucugcgcgucgc

SEQ ID NO: 1030756 - RNA, 19 nt, Mycobacterium bovis subsp bovis AF2122/97
uugaccaccacgaugaccg

SEQ ID NO: 1030757 - RNA, 16 nt, Mycobacterium bovis subsp bovis AF2122/97
uugaccaacccucgcc

SEQ ID NO: 1030758 - RNA, 22 nt, Mycobacterium bovis subsp bovis AF2122/97
uugaacaugggaugcucaccgg

SEQ ID NO: 1030759 - RNA, 21 nt, Mycobacterium bovis subsp bovis AF2122/97
uugaagaugucuuccugcgcc

SEQ ID NO: 1030760 - RNA, 18 nt, Mycobacterium bovis subsp bovis AF2122/97
uugaagaauuucggcgcc

SEQ ID NO: 1030761 - RNA, 20 nt, Mycobacterium bovis subsp bovis AF2122/97
uuccgugcgggucguccgcc

SEQ ID NO: 1030762 - RNA, 15 nt, Mycobacterium bovis subsp bovis AF2122/97
uuccuccgacgcgau

SEQ ID NO: 1030763 - RNA, 20 nt, Mycobacterium bovis subsp bovis AF2122/97
uggccgacgauagcggcccg

SEQ ID NO: 1030764 - RNA, 20 nt, Mycobacterium bovis subsp bovis AF2122/97
uggccgacuuguacgcaucg

SEQ ID NO: 1030765 - RNA, 20 nt, Mycobacterium bovis subsp bovis AF2122/97
uggccgagcagggccggcac

SEQ ID NO: 1030766 - RNA, 13 nt, Mycobacterium bovis subsp bovis AF2122/97
uggccgagccgcg

SEQ ID NO: 1030767 - RNA, 17 nt, Mycobacterium bovis subsp bovis AF2122/97
uggccgaacuaccgacg

SEQ ID NO: 1030768 - RNA, 21 nt, Mycobacterium bovis subsp bovis AF2122/97
uggccgaacagcugcccgcca

SEQ ID NO: 1030769 - RNA, 18 nt, Mycobacterium bovis subsp bovis AF2122/97
uggccgaacaggaugaug

SEQ ID NO: 1030770 - RNA, 16 nt, Mycobacterium bovis subsp bovis AF2122/97
uggccgaaagccaggc

SEQ ID NO: 1030771 - RNA, 19 nt, Mycobacterium bovis subsp bovis AF2122/97
uggccgcccagaccgccga

SEQ ID NO: 1030772 - RNA, 15 nt, Mycobacterium bovis subsp bovis AF2122/97
uggccgcccgcucca

SEQ ID NO: 1030773 - RNA, 18 nt, Mycobacterium bovis subsp bovis AF2122/97
uggccgcccgcugcggcg

SEQ ID NO: 1030774 - RNA, 21 nt, Mycobacterium bovis subsp bovis AF2122/97
uggccgcccgcugcggcggcu

SEQ ID NO: 1030775 - RNA, 18 nt, Mycobacterium bovis subsp bovis AF2122/97
uggccgcccuggccgccc

SEQ ID NO: 1030776 - RNA, 13 nt, Mycobacterium bovis subsp bovis AF2122/97
uggccgccggccc

SEQ ID NO: 1030777 - RNA, 22 nt, Mycobacterium bovis subsp bovis AF2122/97
uggccgccgaauccgacgucga

SEQ ID NO: 1030778 - RNA, 21 nt, Mycobacterium bovis subsp bovis AF2122/97
uggccgccgacaaccccgcca

SEQ ID NO: 1030779 - RNA, 18 nt, Mycobacterium bovis subsp bovis AF2122/97
uggccgcauuggcgaccg

SEQ ID NO: 1030780 - RNA, 21 nt, Mycobacterium bovis subsp bovis AF2122/97
uggccgccagauuggcgcugc

SEQ ID NO: 1030781 - RNA, 17 nt, Mycobacterium bovis subsp bovis AF2122/97
uggccgccaccgcgacg

SEQ ID NO: 1030782 - RNA, 13 nt, Mycobacterium bovis subsp bovis AF2122/97
uggccgccaccgc

SEQ ID NO: 1030783 - RNA, 13 nt, Mycobacterium bovis subsp bovis AF2122/97
uggccggcaccgu

SEQ ID NO: 1030784 - RNA, 14 nt, Mycobacterium bovis subsp bovis AF2122/97
uggccgcgaugacg

SEQ ID NO: 1030785 - RNA, 18 nt, Mycobacterium bovis subsp bovis AF2122/97
uggccgcgaugacgaccg

SEQ ID NO: 1030786 - RNA, 21 nt, Mycobacterium bovis subsp bovis AF2122/97
uggccgcgaugacgaccgauc

SEQ ID NO: 1030787 - RNA, 23 nt, Mycobacterium bovis subsp bovis AF2122/97
uggccggcaacggcgcgccgacc

SEQ ID NO: 1030788 - RNA, 16 nt, Mycobacterium bovis subsp bovis AF2122/97
uggccgccggccgcgc

SEQ ID NO: 1030789 - RNA, 17 nt, Mycobacterium bovis subsp bovis AF2122/97
uggccgccggccgcgca

SEQ ID NO: 1030790 - RNA, 18 nt, Mycobacterium bovis subsp bovis AF2122/97
uggccgccggcgccgcca

SEQ ID NO: 1030791 - RNA, 14 nt, Mycobacterium bovis subsp bovis AF2122/97
uggccgccgggcag

SEQ ID NO: 1030792 - RNA, 13 nt, Mycobacterium bovis subsp bovis AF2122/97
uggccgccgcgca

SEQ ID NO: 1030793 - RNA, 19 nt, Mycobacterium bovis subsp bovis AF2122/97
uggccgccguggcgucggc

SEQ ID NO: 1030794 - RNA, 14 nt, Mycobacterium bovis subsp bovis AF2122/97
uggccggccagcca

SEQ ID NO: 1030795 - RNA, 18 nt, Mycobacterium bovis subsp bovis AF2122/97
uggccggccagccauggc

SEQ ID NO: 1030796 - RNA, 16 nt, Mycobacterium bovis subsp bovis AF2122/97
uggccggccaucgccc

SEQ ID NO: 1030797 - RNA, 15 nt, Mycobacterium bovis subsp bovis AF2122/97
uggccggcgauggcc

SEQ ID NO: 1030798 - RNA, 15 nt, Mycobacterium bovis subsp bovis AF2122/97
uggccgggcacgcga

SEQ ID NO: 1030799 - RNA, 13 nt, Mycobacterium bovis subsp bovis AF2122/97
uggccgggcggua

SEQ ID NO: 1030800 - RNA, 17 nt, Mycobacterium bovis subsp bovis AF2122/97
uggccgggcgguaggcu

SEQ ID NO: 1030801 - RNA, 19 nt, Mycobacterium bovis subsp bovis AF2122/97
uggccggccaucgcccgau

SEQ ID NO: 1030802 - RNA, 14 nt, Mycobacterium bovis subsp bovis AF2122/97
uggccugcccagca

SEQ ID NO: 1030803 - RNA, 22 nt, Mycobacterium bovis subsp bovis AF2122/97
uggccugcggcaggugcgguca

SEQ ID NO: 1030804 - RNA, 13 nt, Mycobacterium bovis subsp bovis AF2122/97
uggccugcucaac

SEQ ID NO: 1030805 - RNA, 13 nt, Mycobacterium bovis subsp bovis AF2122/97
uggccuugcugcg

SEQ ID NO: 1030806 - RNA, 19 nt, Mycobacterium bovis subsp bovis AF2122/97
uggccuuggcaguccagcc

SEQ ID NO: 1030807 - RNA, 15 nt, Mycobacterium bovis subsp bovis AF2122/97
uggccuugugcagau

SEQ ID NO: 1030808 - RNA, 16 nt, Mycobacterium bovis subsp bovis AF2122/97
uggccuuugagcgcgg

SEQ ID NO: 1030809 - RNA, 18 nt, Mycobacterium bovis subsp bovis AF2122/97
uggccuuugagcgcggcc

SEQ ID NO: 1030810 - RNA, 16 nt, Mycobacterium bovis subsp bovis AF2122/97
uggccuuugccgucga

SEQ ID NO: 1030811 - RNA, 22 nt, Mycobacterium bovis subsp bovis AF2122/97
uggccugucgaagauccagcgc

SEQ ID NO: 1030812 - RNA, 14 nt, Mycobacterium bovis subsp bovis AF2122/97
uggcgccagggccu

SEQ ID NO: 1030813 - RNA, 19 nt, Mycobacterium bovis subsp bovis AF2122/97
uggcgccaacgcaacggug

SEQ ID NO: 1030814 - RNA, 12 nt, Mycobacterium bovis subsp bovis AF2122/97
uggcgccaccag

SEQ ID NO: 1030815 - RNA, 11 nt, Mycobacterium bovis subsp bovis AF2122/97
uggcgccaccg

SEQ ID NO: 1030816 - RNA, 14 nt, Mycobacterium bovis subsp bovis AF2122/97
uggcgccaccggcc

SEQ ID NO: 1030817 - RNA, 21 nt, Mycobacterium bovis subsp bovis AF2122/97
uggcgcagccugccgaugacg

SEQ ID NO: 1030818 - RNA, 20 nt, Mycobacterium bovis subsp bovis AF2122/97
uggcgcagcucaccgacgga

SEQ ID NO: 1030819 - RNA, 23 nt, Mycobacterium bovis subsp bovis AF2122/97
uggcgcaccaccgccccgcgccc

SEQ ID NO: 1030820 - RNA, 14 nt, Mycobacterium bovis subsp bovis AF2122/97
uggcgcaccaccgc

SEQ ID NO: 1030821 - RNA, 18 nt, Mycobacterium bovis subsp bovis AF2122/97
uggcgcaccggcgucggc

SEQ ID NO: 1030822 - RNA, 22 nt, Mycobacterium bovis subsp bovis AF2122/97
uggcgcaccggcgucggcgcgg

SEQ ID NO: 1030823 - RNA, 17 nt, Mycobacterium bovis subsp bovis AF2122/97
uggcgcacgaaccccac

SEQ ID NO: 1030824 - RNA, 14 nt, Mycobacterium bovis subsp bovis AF2122/97
uggcgaagcccgac

SEQ ID NO: 1030825 - RNA, 20 nt, Mycobacterium bovis subsp bovis AF2122/97
uggcgaacugguagcccgga

SEQ ID NO: 1030826 - RNA, 16 nt, Mycobacterium bovis subsp bovis AF2122/97
uggcgaacccggucaa

SEQ ID NO: 1030827 - RNA, 15 nt, Mycobacterium bovis subsp bovis AF2122/97
uggcgaacacgucgg

SEQ ID NO: 1030828 - RNA, 17 nt, Mycobacterium bovis subsp bovis AF2122/97
uggcgaacacgucggcc

SEQ ID NO: 1030829 - RNA, 19 nt, Mycobacterium bovis subsp bovis AF2122/97
uggcgaacacgucggccag

SEQ ID NO: 1030830 - RNA, 17 nt, Mycobacterium bovis subsp bovis AF2122/97
uggcggacagggcggca

SEQ ID NO: 1030831 - RNA, 15 nt, Mycobacterium bovis subsp bovis AF2122/97
uggcggacggcgucg

SEQ ID NO: 1030832 - RNA, 18 nt, Mycobacterium bovis subsp bovis AF2122/97
uggcggacggcgucgagu

SEQ ID NO: 1030833 - RNA, 18 nt, Mycobacterium bovis subsp bovis AF2122/97
uggcggaucgcgagcgcc

SEQ ID NO: 1030834 - RNA, 14 nt, Mycobacterium bovis subsp bovis AF2122/97
uggcggaugcccgc

SEQ ID NO: 1030835 - RNA, 14 nt, Mycobacterium bovis subsp bovis AF2122/97
uggcggcagcaacg

SEQ ID NO: 1030836 - RNA, 19 nt, Mycobacterium bovis subsp bovis AF2122/97
uggcggcagcaacgacguc

SEQ ID NO: 1030837 - RNA, 24 nt, Mycobacterium bovis subsp bovis AF2122/97
uggcggaacagcuucgcgcagccg

SEQ ID NO: 1030838 - RNA, 20 nt, Mycobacterium bovis subsp bovis AF2122/97
uggcggaacuguaggucaca

SEQ ID NO: 1030839 - RNA, 21 nt, Mycobacterium bovis subsp bovis AF2122/97
uggcggaacuugccggugcgc

SEQ ID NO: 1030840 - RNA, 23 nt, Mycobacterium bovis subsp bovis AF2122/97
uggcgcccgugccgcccgcgccg

SEQ ID NO: 1030841 - RNA, 21 nt, Mycobacterium bovis subsp bovis AF2122/97
uggcgcccgucuccagcacca

SEQ ID NO: 1030842 - RNA, 21 nt, Mycobacterium bovis subsp bovis AF2122/97
uggcgccgaacgccagcagcu

SEQ ID NO: 1030843 - RNA, 19 nt, Mycobacterium bovis subsp bovis AF2122/97
uggcgccgaaguagccgac

SEQ ID NO: 1030844 - RNA, 17 nt, Mycobacterium bovis subsp bovis AF2122/97
uggcgcccuugccggcg

SEQ ID NO: 1030845 - RNA, 19 nt, Mycobacterium bovis subsp bovis AF2122/97
uggcgcccuugccggcgag

SEQ ID NO: 1030846 - RNA, 14 nt, Mycobacterium bovis subsp bovis AF2122/97
uggcgcggacccgc

SEQ ID NO: 1030847 - RNA, 14 nt, Mycobacterium bovis subsp bovis AF2122/97
uggggucguucgcc

SEQ ID NO: 1030848 - RNA, 17 nt, Mycobacterium bovis subsp bovis AF2122/97
uggggucagugcgggcg

SEQ ID NO: 1030849 - RNA, 19 nt, Mycobacterium bovis subsp bovis AF2122/97
uggggucagugcgggcggc

SEQ ID NO: 1030850 - RNA, 16 nt, Mycobacterium bovis subsp bovis AF2122/97
ugggguccagcguccc

SEQ ID NO: 1030851 - RNA, 16 nt, Mycobacterium bovis subsp bovis AF2122/97
ugggguccgcgucggc

SEQ ID NO: 1030852 - RNA, 20 nt, Mycobacterium bovis subsp bovis AF2122/97
ugggguccgcgucggcggcg

SEQ ID NO: 1030853 - RNA, 19 nt, Mycobacterium bovis subsp bovis AF2122/97
ugggggugguaccggcggc

SEQ ID NO: 1030854 - RNA, 23 nt, Mycobacterium bovis subsp bovis AF2122/97
ugggguagaucucuucggagccg

SEQ ID NO: 1030855 - RNA, 18 nt, Mycobacterium bovis subsp bovis AF2122/97
ugggggcuucugcgucug

SEQ ID NO: 1030856 - RNA, 14 nt, Mycobacterium bovis subsp bovis AF2122/97
ugggugacgguggc

SEQ ID NO: 1030857 - RNA, 22 nt, Mycobacterium bovis subsp bovis AF2122/97
ugggugagguuggagcgccagc

SEQ ID NO: 1030858 - RNA, 18 nt, Mycobacterium bovis subsp bovis AF2122/97
ugggugcagcacguccgc

SEQ ID NO: 1030859 - RNA, 22 nt, Mycobacterium bovis subsp bovis AF2122/97
ugggugaccucgucgaccggga

SEQ ID NO: 1030860 - RNA, 21 nt, Mycobacterium bovis subsp bovis AF2122/97
uggggugcuuucgcgucugcu

SEQ ID NO: 1030861 - RNA, 16 nt, Mycobacterium bovis subsp bovis AF2122/97
ugggguggcggugccg

SEQ ID NO: 1030862 - RNA, 21 nt, Mycobacterium bovis subsp bovis AF2122/97
ugggguguagccagcggcugc

SEQ ID NO: 1030863 - RNA, 16 nt, Mycobacterium bovis subsp bovis AF2122/97
ugggugugcugccacc

SEQ ID NO: 1030864 - RNA, 20 nt, Mycobacterium bovis subsp bovis AF2122/97
uggguguguucggagcuggg

SEQ ID NO: 1030865 - RNA, 16 nt, Mycobacterium bovis subsp bovis AF2122/97
uggguguugucgucga

SEQ ID NO: 1030866 - RNA, 17 nt, Mycobacterium bovis subsp bovis AF2122/97
ugggugccggcagcggc

SEQ ID NO: 1030867 - RNA, 20 nt, Mycobacterium bovis subsp bovis AF2122/97
ugggugccggcagcggcgcg

SEQ ID NO: 1030868 - RNA, 15 nt, Mycobacterium bovis subsp bovis AF2122/97
ugggugccggcgucg

SEQ ID NO: 1030869 - RNA, 17 nt, Mycobacterium bovis subsp bovis AF2122/97
ugggugccggcgucgcu

SEQ ID NO: 1030870 - RNA, 15 nt, Mycobacterium bovis subsp bovis AF2122/97
ugggugcagugaccu

SEQ ID NO: 1030871 - RNA, 13 nt, Mycobacterium bovis subsp bovis AF2122/97
uggguggcgucgc

SEQ ID NO: 1030872 - RNA, 18 nt, Mycobacterium bovis subsp bovis AF2122/97
ugggcgguccgcgucugg

SEQ ID NO: 1030873 - RNA, 20 nt, Mycobacterium bovis subsp bovis AF2122/97
ugggcggugaaggccccgcc

SEQ ID NO: 1030874 - RNA, 15 nt, Mycobacterium bovis subsp bovis AF2122/97
ugggcgguugaucgc

SEQ ID NO: 1030875 - RNA, 18 nt, Mycobacterium bovis subsp bovis AF2122/97
ugggcgggauggccgccg

SEQ ID NO: 1030876 - RNA, 20 nt, Mycobacterium bovis subsp bovis AF2122/97
ugggcgggcaaucaccgccg

SEQ ID NO: 1030877 - RNA, 22 nt, Mycobacterium bovis subsp bovis AF2122/97
ugggcgggcaaucaccgccggc

SEQ ID NO: 1030878 - RNA, 22 nt, Mycobacterium bovis subsp bovis AF2122/97
ugggcgggcuuggcgucgacgu

SEQ ID NO: 1030879 - RNA, 19 nt, Mycobacterium bovis subsp bovis AF2122/97
ugggcgucgaccacgcaag

SEQ ID NO: 1030880 - RNA, 18 nt, Mycobacterium bovis subsp bovis AF2122/97
ugggcgugacugguggcg

SEQ ID NO: 1030881 - RNA, 14 nt, Mycobacterium bovis subsp bovis AF2122/97
uggggcgccaccac

SEQ ID NO: 1030882 - RNA, 12 nt, Mycobacterium bovis subsp bovis AF2122/97
ugggggcgcacc

SEQ ID NO: 1030883 - RNA, 14 nt, Mycobacterium bovis subsp bovis AF2122/97
ugggggagccggug

SEQ ID NO: 1030884 - RNA, 18 nt, Mycobacterium bovis subsp bovis AF2122/97
ugggggauaccgcugggu

SEQ ID NO: 1030885 - RNA, 20 nt, Mycobacterium bovis subsp bovis AF2122/97
ugggcgucgucuugaccgcu

SEQ ID NO: 1030886 - RNA, 16 nt, Mycobacterium bovis subsp bovis AF2122/97
ugggcagcaggcccac

SEQ ID NO: 1030887 - RNA, 21 nt, Mycobacterium bovis subsp bovis AF2122/97
ugggcagcaggcccacccggg

SEQ ID NO: 1030888 - RNA, 22 nt, Mycobacterium bovis subsp bovis AF2122/97
ugggacgcgcggauuucgccgu

SEQ ID NO: 1030889 - RNA, 12 nt, Mycobacterium bovis subsp bovis AF2122/97
ugggacggcggc

SEQ ID NO: 1030890 - RNA, 11 nt, Mycobacterium bovis subsp bovis AF2122/97
ugggaccggca

SEQ ID NO: 1030891 - RNA, 13 nt, Mycobacterium bovis subsp bovis AF2122/97
ugggcaucaccgc

SEQ ID NO: 1030892 - RNA, 14 nt, Mycobacterium bovis subsp bovis AF2122/97
ugggcaucaccgcc

SEQ ID NO: 1030893 - RNA, 22 nt, Mycobacterium bovis subsp bovis AF2122/97
ugggcaucaccgacgcgucggc

SEQ ID NO: 1030894 - RNA, 18 nt, Mycobacterium bovis subsp bovis AF2122/97
ugggccaacgacgccaug

SEQ ID NO: 1030895 - RNA, 15 nt, Mycobacterium bovis subsp bovis AF2122/97
ugggcaucaccgccg

SEQ ID NO: 1030896 - RNA, 23 nt, Mycobacterium bovis subsp bovis AF2122/97
ugggccaacucauuaacgccauc

SEQ ID NO: 1030897 - RNA, 16 nt, Mycobacterium bovis subsp bovis AF2122/97
ugggccaccaccucgg

SEQ ID NO: 1030898 - RNA, 13 nt, Mycobacterium bovis subsp bovis AF2122/97
ugggccagcagca

SEQ ID NO: 1030899 - RNA, 19 nt, Mycobacterium bovis subsp bovis AF2122/97
ugggccagcagcaaccgcc

SEQ ID NO: 1030900 - RNA, 14 nt, Mycobacterium bovis subsp bovis AF2122/97
ugggccagcagccg

SEQ ID NO: 1030901 - RNA, 15 nt, Mycobacterium bovis subsp bovis AF2122/97
ugggccugcgcagac

SEQ ID NO: 1030902 - RNA, 23 nt, Mycobacterium bovis subsp bovis AF2122/97
ugggcgacaguagggucguacgu

SEQ ID NO: 1030903 - RNA, 23 nt, Mycobacterium bovis subsp bovis AF2122/97
ugggcgacggccaagaucggcgc

SEQ ID NO: 1030904 - RNA, 21 nt, Mycobacterium bovis subsp bovis AF2122/97
ugggcgacgucaucgccgacc

SEQ ID NO: 1030905 - RNA, 16 nt, Mycobacterium bovis subsp bovis AF2122/97
ugggcgacuaccggcu

SEQ ID NO: 1030906 - RNA, 23 nt, Mycobacterium bovis subsp bovis AF2122/97
ugggcgagcagacgcagaaucgc

SEQ ID NO: 1030907 - RNA, 14 nt, Mycobacterium bovis subsp bovis AF2122/97
ugggcggcgagcgc

SEQ ID NO: 1030908 - RNA, 18 nt, Mycobacterium bovis subsp bovis AF2122/97
ugggcggcuucgaugucg

SEQ ID NO: 1030909 - RNA, 16 nt, Mycobacterium bovis subsp bovis AF2122/97
ugggcgggauggccgc

SEQ ID NO: 1030910 - RNA, 18 nt, Mycobacterium bovis subsp bovis AF2122/97
ugggcgauggcaccggcg

SEQ ID NO: 1030911 - RNA, 21 nt, Mycobacterium bovis subsp bovis AF2122/97
ugggcgcagagucaacgucgu

SEQ ID NO: 1030912 - RNA, 18 nt, Mycobacterium bovis subsp bovis AF2122/97
ugggcgauuuugcgucuc

SEQ ID NO: 1030913 - RNA, 19 nt, Mycobacterium bovis subsp bovis AF2122/97
ugggcgauuuugcgucugc

SEQ ID NO: 1030914 - RNA, 20 nt, Mycobacterium bovis subsp bovis AF2122/97
ugggcgauucugugucugcu

SEQ ID NO: 1030915 - RNA, 18 nt, Mycobacterium bovis subsp bovis AF2122/97
ugggcgacgcggcgccgc

SEQ ID NO: 1030916 - RNA, 14 nt, Mycobacterium bovis subsp bovis AF2122/97
ugggcgagucgggg

SEQ ID NO: 1030917 - RNA, 22 nt, Mycobacterium bovis subsp bovis AF2122/97
uggcgucgacgucgacggcgau

SEQ ID NO: 1030918 - RNA, 17 nt, Mycobacterium bovis subsp bovis AF2122/97
uggcgucgacaucggug

SEQ ID NO: 1030919 - RNA, 12 nt, Mycobacterium bovis subsp bovis AF2122/97
uggcgucaccgc

SEQ ID NO: 1030920 - RNA, 17 nt, Mycobacterium bovis subsp bovis AF2122/97
uggcgucgugcgcggcc

SEQ ID NO: 1030921 - RNA, 20 nt, Mycobacterium bovis subsp bovis AF2122/97
uggcgucuuggaaggcgcgc

SEQ ID NO: 1030922 - RNA, 15 nt, Mycobacterium bovis subsp bovis AF2122/97
uggcggcagcagcgc

SEQ ID NO: 1030923 - RNA, 23 nt, Mycobacterium bovis subsp bovis AF2122/97
uggcggccaguucggcggccgcc

SEQ ID NO: 1030924 - RNA, 15 nt, Mycobacterium bovis subsp bovis AF2122/97
uggcgguggugccgc

SEQ ID NO: 1030925 - RNA, 19 nt, Mycobacterium bovis subsp bovis AF2122/97
uggcgguguaacccggaac

SEQ ID NO: 1030926 - RNA, 22 nt, Mycobacterium bovis subsp bovis AF2122/97
uggcggcccggguuggccgaac

SEQ ID NO: 1030927 - RNA, 19 nt, Mycobacterium bovis subsp bovis AF2122/97
uggcggccgcaaucauguc

SEQ ID NO: 1030928 - RNA, 16 nt, Mycobacterium bovis subsp bovis AF2122/97
uggcggcaggugcggc

SEQ ID NO: 1030929 - RNA, 20 nt, Mycobacterium bovis subsp bovis AF2122/97
uggcggcaggugcggcggca

SEQ ID NO: 1030930 - RNA, 20 nt, Mycobacterium bovis subsp bovis AF2122/97
uggcggccagcgcaccgccg

SEQ ID NO: 1030931 - RNA, 19 nt, Mycobacterium bovis subsp bovis AF2122/97
uggcggccaccgucagcgc

SEQ ID NO: 1030932 - RNA, 15 nt, Mycobacterium bovis subsp bovis AF2122/97
uggcguagugcagcu

SEQ ID NO: 1030933 - RNA, 16 nt, Mycobacterium bovis subsp bovis AF2122/97
uggcguagugcagcug

SEQ ID NO: 1030934 - RNA, 12 nt, Mycobacterium bovis subsp bovis AF2122/97
uggcguagcaac

SEQ ID NO: 1030935 - RNA, 19 nt, Mycobacterium bovis subsp bovis AF2122/97
uggcguaauugucgauguc

SEQ ID NO: 1030936 - RNA, 14 nt, Mycobacterium bovis subsp bovis AF2122/97
uggcguacucgggg

SEQ ID NO: 1030937 - RNA, 21 nt, Mycobacterium bovis subsp bovis AF2122/97
uggcgguuccggccggcuccg

SEQ ID NO: 1030938 - RNA, 16 nt, Mycobacterium bovis subsp bovis AF2122/97
uggcggugucggcgcc

SEQ ID NO: 1030939 - RNA, 15 nt, Mycobacterium bovis subsp bovis AF2122/97
uggcgugccgucgcc

SEQ ID NO: 1030940 - RNA, 21 nt, Mycobacterium bovis subsp bovis AF2122/97
uggcguggaucuuggccagca

SEQ ID NO: 1030941 - RNA, 19 nt, Mycobacterium bovis subsp bovis AF2122/97
uggcguucagcggccagca

SEQ ID NO: 1030942 - RNA, 17 nt, Mycobacterium bovis subsp bovis AF2122/97
uggcugaacaccgcggg

SEQ ID NO: 1030943 - RNA, 14 nt, Mycobacterium bovis subsp bovis AF2122/97
uggcugaucccggc

SEQ ID NO: 1030944 - RNA, 22 nt, Mycobacterium bovis subsp bovis AF2122/97
uggcugagcccgccgcgaccac

SEQ ID NO: 1030945 - RNA, 17 nt, Mycobacterium bovis subsp bovis AF2122/97
uggcugaugacgcggac

SEQ ID NO: 1030946 - RNA, 17 nt, Mycobacterium bovis subsp bovis AF2122/97
uggcuggaccacucgcc

SEQ ID NO: 1030947 - RNA, 13 nt, Mycobacterium bovis subsp bovis AF2122/97
uggcuggacccgc

SEQ ID NO: 1030948 - RNA, 23 nt, Mycobacterium bovis subsp bovis AF2122/97
uggcugccggcaacagcucgccu

SEQ ID NO: 1030949 - RNA, 18 nt, Mycobacterium bovis subsp bovis AF2122/97
ugggaaacccggccagcu

SEQ ID NO: 1030950 - RNA, 15 nt, Mycobacterium bovis subsp bovis AF2122/97
ugggaaggauggucg

SEQ ID NO: 1030951 - RNA, 17 nt, Mycobacterium bovis subsp bovis AF2122/97
ugggaagugcggugaga

SEQ ID NO: 1030952 - RNA, 15 nt, Mycobacterium bovis subsp bovis AF2122/97
uggcuuucgguaugc

SEQ ID NO: 1030953 - RNA, 19 nt, Mycobacterium bovis subsp bovis AF2122/97
uggcccgggucuccggcgc

SEQ ID NO: 1030954 - RNA, 22 nt, Mycobacterium bovis subsp bovis AF2122/97
uggcccgggucuccggcgcacc

SEQ ID NO: 1030955 - RNA, 16 nt, Mycobacterium bovis subsp bovis AF2122/97
uggcccuccucgguga

SEQ ID NO: 1030956 - RNA, 22 nt, Mycobacterium bovis subsp bovis AF2122/97
uggcccuccucggugagguagc

SEQ ID NO: 1030957 - RNA, 18 nt, Mycobacterium bovis subsp bovis AF2122/97
uggcccgucacgcccgcg

SEQ ID NO: 1030958 - RNA, 22 nt, Mycobacterium bovis subsp bovis AF2122/97
uggcccgucauacucgacaccg

SEQ ID NO: 1030959 - RNA, 15 nt, Mycobacterium bovis subsp bovis AF2122/97
uggcccgucggcgug

SEQ ID NO: 1030960 - RNA, 13 nt, Mycobacterium bovis subsp bovis AF2122/97
uggcccgugcggu

SEQ ID NO: 1030961 - RNA, 17 nt, Mycobacterium bovis subsp bovis AF2122/97
uggcccguuggcagcac

SEQ ID NO: 1030962 - RNA, 19 nt, Mycobacterium bovis subsp bovis AF2122/97
uggcccgccacgaugucgu

SEQ ID NO: 1030963 - RNA, 12 nt, Mycobacterium bovis subsp bovis AF2122/97
uggcccgcaugc

SEQ ID NO: 1030964 - RNA, 20 nt, Mycobacterium bovis subsp bovis AF2122/97
uggcccgccagaacggcguc

SEQ ID NO: 1030965 - RNA, 17 nt, Mycobacterium bovis subsp bovis AF2122/97
uggcccgaucgaccgcu

SEQ ID NO: 1030966 - RNA, 21 nt, Mycobacterium bovis subsp bovis AF2122/97
uggcccgccagaacggcgucg

SEQ ID NO: 1030967 - RNA, 18 nt, Mycobacterium bovis subsp bovis AF2122/97
uggccccgguggugcugc

SEQ ID NO: 1030968 - RNA, 16 nt, Mycobacterium bovis subsp bovis AF2122/97
uggcccgaccgggaac

SEQ ID NO: 1030969 - RNA, 14 nt, Mycobacterium bovis subsp bovis AF2122/97
uggcccgaguuggc

SEQ ID NO: 1030970 - RNA, 16 nt, Mycobacterium bovis subsp bovis AF2122/97
uggcccgaucgaccgc

SEQ ID NO: 1030971 - RNA, 20 nt, Mycobacterium bovis subsp bovis AF2122/97
uggccaucaucgacggugau

SEQ ID NO: 1030972 - RNA, 14 nt, Mycobacterium bovis subsp bovis AF2122/97
uggccaugccacaa

SEQ ID NO: 1030973 - RNA, 18 nt, Mycobacterium bovis subsp bovis AF2122/97
uggccaugccacaacgcc

SEQ ID NO: 1030974 - RNA, 18 nt, Mycobacterium bovis subsp bovis AF2122/97
uggccaugguggcgccga

SEQ ID NO: 1030975 - RNA, 17 nt, Mycobacterium bovis subsp bovis AF2122/97
uggccauguccaccagc

SEQ ID NO: 1030976 - RNA, 16 nt, Mycobacterium bovis subsp bovis AF2122/97
uggcccaccgccguug

SEQ ID NO: 1030977 - RNA, 15 nt, Mycobacterium bovis subsp bovis AF2122/97
uggcccccgccggcc

SEQ ID NO: 1030978 - RNA, 12 nt, Mycobacterium bovis subsp bovis AF2122/97
uggcccccgggu

SEQ ID NO: 1030979 - RNA, 13 nt, Mycobacterium bovis subsp bovis AF2122/97
uggccagcacggu

SEQ ID NO: 1030980 - RNA, 14 nt, Mycobacterium bovis subsp bovis AF2122/97
uggccagacccgaa

SEQ ID NO: 1030981 - RNA, 22 nt, Mycobacterium bovis subsp bovis AF2122/97
uggccagacccgaauccaccag

SEQ ID NO: 1030982 - RNA, 20 nt, Mycobacterium bovis subsp bovis AF2122/97
uggccagcaacugccgcacc

SEQ ID NO: 1030983 - RNA, 19 nt, Mycobacterium bovis subsp bovis AF2122/97
uggccacggggcugccggu

SEQ ID NO: 1030984 - RNA, 21 nt, Mycobacterium bovis subsp bovis AF2122/97
uggccaccucgggugugguca

SEQ ID NO: 1030985 - RNA, 21 nt, Mycobacterium bovis subsp bovis AF2122/97
uggccagcaccacggccagcg

SEQ ID NO: 1030986 - RNA, 13 nt, Mycobacterium bovis subsp bovis AF2122/97
uggccagacccac

SEQ ID NO: 1030987 - RNA, 13 nt, Mycobacterium bovis subsp bovis AF2122/97
uggccagcagccg

SEQ ID NO: 1030988 - RNA, 15 nt, Mycobacterium bovis subsp bovis AF2122/97
uggccagcccgccca

SEQ ID NO: 1030989 - RNA, 14 nt, Mycobacterium bovis subsp bovis AF2122/97
uggccagcaggcgg

SEQ ID NO: 1030990 - RNA, 20 nt, Mycobacterium bovis subsp bovis AF2122/97
uggccagcagggccaccacc

SEQ ID NO: 1030991 - RNA, 18 nt, Mycobacterium bovis subsp bovis AF2122/97
uggccagccacagccgac

SEQ ID NO: 1030992 - RNA, 17 nt, Mycobacterium bovis subsp bovis AF2122/97
uggccagccacuccucg

SEQ ID NO: 1030993 - RNA, 17 nt, Mycobacterium bovis subsp bovis AF2122/97
uggccagcgcggcgucg

SEQ ID NO: 1030994 - RNA, 22 nt, Mycobacterium bovis subsp bovis AF2122/97
uggccagcgcuucgucggccgg

SEQ ID NO: 1030995 - RNA, 12 nt, Mycobacterium bovis subsp bovis AF2122/97
uggccagcgcgu

SEQ ID NO: 1030996 - RNA, 18 nt, Mycobacterium bovis subsp bovis AF2122/97
uggccagcgucgcgauug

SEQ ID NO: 1030997 - RNA, 18 nt, Mycobacterium bovis subsp bovis AF2122/97
uggccagccagcggguga

SEQ ID NO: 1030998 - RNA, 12 nt, Mycobacterium bovis subsp bovis AF2122/97
uggccaggccgg

SEQ ID NO: 1030999 - RNA, 23 nt, Mycobacterium bovis subsp bovis AF2122/97
uggccaggccguaguggccggcu

SEQ ID NO: 1031000 - RNA, 14 nt, Mycobacterium bovis subsp bovis AF2122/97
uggccaggucggcc

SEQ ID NO: 1031001 - RNA, 17 nt, Mycobacterium bovis subsp bovis AF2122/97
uggccaggucggccacc

SEQ ID NO: 1031002 - RNA, 18 nt, Mycobacterium bovis subsp bovis AF2122/97
uggccaggucggccaccg

SEQ ID NO: 1031003 - RNA, 19 nt, Mycobacterium bovis subsp bovis AF2122/97
uggccaggucggccaccgu

SEQ ID NO: 1031004 - RNA, 20 nt, Mycobacterium bovis subsp bovis AF2122/97
uggccagguugccgucggcc

SEQ ID NO: 1031005 - RNA, 19 nt, Mycobacterium bovis subsp bovis AF2122/97
uggccagugacucaccgug

SEQ ID NO: 1031006 - RNA, 19 nt, Mycobacterium bovis subsp bovis AF2122/97
uggccagugucccgcgcgg

SEQ ID NO: 1031007 - RNA, 22 nt, Mycobacterium bovis subsp bovis AF2122/97
uggccauagguuugggcacgga

SEQ ID NO: 1031008 - RNA, 12 nt, Mycobacterium bovis subsp bovis AF2122/97
uggccaccuggu

SEQ ID NO: 1031009 - RNA, 19 nt, Mycobacterium bovis subsp bovis AF2122/97
uggccaccgcccagugcca

SEQ ID NO: 1031010 - RNA, 14 nt, Mycobacterium bovis subsp bovis AF2122/97
uggccaccgccgaa

SEQ ID NO: 1031011 - RNA, 21 nt, Mycobacterium bovis subsp bovis AF2122/97
uggccaccgccgaaaaccucg

SEQ ID NO: 1031012 - RNA, 20 nt, Mycobacterium bovis subsp bovis AF2122/97
uggccaccgaacgcggccac

SEQ ID NO: 1031013 - RNA, 21 nt, Mycobacterium bovis subsp bovis AF2122/97
uggccaccgaacgcggccacc

SEQ ID NO: 1031014 - RNA, 18 nt, Mycobacterium bovis subsp bovis AF2122/97
uggccacccgguggcguu

SEQ ID NO: 1031015 - RNA, 21 nt, Mycobacterium bovis subsp bovis AF2122/97
uggccaauagaagcacgucgu

SEQ ID NO: 1031016 - RNA, 19 nt, Mycobacterium bovis subsp bovis AF2122/97
uggccaacgccgggucgua

SEQ ID NO: 1031017 - RNA, 14 nt, Mycobacterium bovis subsp bovis AF2122/97
uggccaccaccgug

SEQ ID NO: 1031018 - RNA, 24 nt, Mycobacterium bovis subsp bovis AF2122/97
uggccaauagaagcacgucgucgc

SEQ ID NO: 1031019 - RNA, 21 nt, Mycobacterium bovis subsp bovis AF2122/97
uggccaauccggcggcgacgu

SEQ ID NO: 1031020 - RNA, 18 nt, Mycobacterium bovis subsp bovis AF2122/97
uggccaaccaaccgguca

SEQ ID NO: 1031021 - RNA, 21 nt, Mycobacterium bovis subsp bovis AF2122/97
uggccaaccaaccggucacgu

SEQ ID NO: 1031022 - RNA, 22 nt, Mycobacterium bovis subsp bovis AF2122/97
uggcauuuccugauccgccugc

SEQ ID NO: 1031023 - RNA, 16 nt, Mycobacterium bovis subsp bovis AF2122/97
uggcauguugcggacc

SEQ ID NO: 1031024 - RNA, 22 nt, Mycobacterium bovis subsp bovis AF2122/97
uggcauguugcggaccaguucg

SEQ ID NO: 1031025 - RNA, 20 nt, Mycobacterium bovis subsp bovis AF2122/97
uggcauggucaggcggccgu

SEQ ID NO: 1031026 - RNA, 14 nt, Mycobacterium bovis subsp bovis AF2122/97
uggcauugaccacc

SEQ ID NO: 1031027 - RNA, 14 nt, Mycobacterium bovis subsp bovis AF2122/97
uggcaucucgauac

SEQ ID NO: 1031028 - RNA, 19 nt, Mycobacterium bovis subsp bovis AF2122/97
uggcaugaccgcugccgac

SEQ ID NO: 1031029 - RNA, 17 nt, Mycobacterium bovis subsp bovis AF2122/97
uggcaucgcgagccagc

SEQ ID NO: 1031030 - RNA, 13 nt, Mycobacterium bovis subsp bovis AF2122/97
uggcaucggccug

SEQ ID NO: 1031031 - RNA, 15 nt, Mycobacterium bovis subsp bovis AF2122/97
uggcaucccgggcag

SEQ ID NO: 1031032 - RNA, 19 nt, Mycobacterium bovis subsp bovis AF2122/97
uggcagggccagcggcagc

SEQ ID NO: 1031033 - RNA, 19 nt, Mycobacterium bovis subsp bovis AF2122/97
uggcauaaccgcugauagc

SEQ ID NO: 1031034 - RNA, 23 nt, Mycobacterium bovis subsp bovis AF2122/97
uggcaguccagccgggugccggc

SEQ ID NO: 1031035 - RNA, 16 nt, Mycobacterium bovis subsp bovis AF2122/97
uggcagucgcacggug

SEQ ID NO: 1031036 - RNA, 15 nt, Mycobacterium bovis subsp bovis AF2122/97
uggcaaugaccccgg

SEQ ID NO: 1031037 - RNA, 20 nt, Mycobacterium bovis subsp bovis AF2122/97
uggcaagcggccgcggguug

SEQ ID NO: 1031038 - RNA, 22 nt, Mycobacterium bovis subsp bovis AF2122/97
uggcaagcugccccgccaccuc

SEQ ID NO: 1031039 - RNA, 22 nt, Mycobacterium bovis subsp bovis AF2122/97
uggcaagcacgcgacggcgcgg

SEQ ID NO: 1031040 - RNA, 17 nt, Mycobacterium bovis subsp bovis AF2122/97
uggcaagcacggcgucg

SEQ ID NO: 1031041 - RNA, 20 nt, Mycobacterium bovis subsp bovis AF2122/97
uggcaccgguuucgucgguc

SEQ ID NO: 1031042 - RNA, 14 nt, Mycobacterium bovis subsp bovis AF2122/97
uggcaccucccggg

SEQ ID NO: 1031043 - RNA, 16 nt, Mycobacterium bovis subsp bovis AF2122/97
uggcaccgccagccac

SEQ ID NO: 1031044 - RNA, 20 nt, Mycobacterium bovis subsp bovis AF2122/97
uggcaccgcccccgucggcc

SEQ ID NO: 1031045 - RNA, 20 nt, Mycobacterium bovis subsp bovis AF2122/97
uggcacccgcgucgagugcc

SEQ ID NO: 1031046 - RNA, 21 nt, Mycobacterium bovis subsp bovis AF2122/97
uggcacccgcgucgagugccg

SEQ ID NO: 1031047 - RNA, 17 nt, Mycobacterium bovis subsp bovis AF2122/97
uggcaccagccggugag

SEQ ID NO: 1031048 - RNA, 22 nt, Mycobacterium bovis subsp bovis AF2122/97
uggcacacagguccugcgccgc

SEQ ID NO: 1031049 - RNA, 14 nt, Mycobacterium bovis subsp bovis AF2122/97
uggcaccagccggu

SEQ ID NO: 1031050 - RNA, 17 nt, Mycobacterium bovis subsp bovis AF2122/97
uggcagcgcgcugaggu

SEQ ID NO: 1031051 - RNA, 17 nt, Mycobacterium bovis subsp bovis AF2122/97
uggcagccgaaguggcg

SEQ ID NO: 1031052 - RNA, 20 nt, Mycobacterium bovis subsp bovis AF2122/97
uggcagccgaaguggcgccu

SEQ ID NO: 1031053 - RNA, 14 nt, Mycobacterium bovis subsp bovis AF2122/97
uggcaggccagcau

SEQ ID NO: 1031054 - RNA, 15 nt, Mycobacterium bovis subsp bovis AF2122/97
uggcaggccagcaug

SEQ ID NO: 1031055 - RNA, 20 nt, Mycobacterium bovis subsp bovis AF2122/97
uggcagcuccucgcgcucgc

SEQ ID NO: 1031056 - RNA, 13 nt, Mycobacterium bovis subsp bovis AF2122/97
uggcagcggugua

SEQ ID NO: 1031057 - RNA, 23 nt, Mycobacterium bovis subsp bovis AF2122/97
uggcacgcaacaccgccaacucc

SEQ ID NO: 1031058 - RNA, 17 nt, Mycobacterium bovis subsp bovis AF2122/97
uggcaccggcggcgacg

SEQ ID NO: 1031059 - RNA, 16 nt, Mycobacterium bovis subsp bovis AF2122/97
uggcacugacgcgccc

SEQ ID NO: 1031060 - RNA, 22 nt, Mycobacterium bovis subsp bovis AF2122/97
uggcacggccccugccacgacg

SEQ ID NO: 1031061 - RNA, 15 nt, Mycobacterium bovis subsp bovis AF2122/97
uggcacgggucguca

SEQ ID NO: 1031062 - RNA, 20 nt, Mycobacterium bovis subsp bovis AF2122/97
uggaccggcacgucgucguc

SEQ ID NO: 1031063 - RNA, 15 nt, Mycobacterium bovis subsp bovis AF2122/97
uggaccgccgccgac

SEQ ID NO: 1031064 - RNA, 16 nt, Mycobacterium bovis subsp bovis AF2122/97
uggacccgcauggcgc

SEQ ID NO: 1031065 - RNA, 16 nt, Mycobacterium bovis subsp bovis AF2122/97
uggacccggccggccc

SEQ ID NO: 1031066 - RNA, 22 nt, Mycobacterium bovis subsp bovis AF2122/97
uggaccagcgccccggcgcguu

SEQ ID NO: 1031067 - RNA, 15 nt, Mycobacterium bovis subsp bovis AF2122/97
uggaccacagccgcg

SEQ ID NO: 1031068 - RNA, 15 nt, Mycobacterium bovis subsp bovis AF2122/97
uggaccacgugaucg

SEQ ID NO: 1031069 - RNA, 17 nt, Mycobacterium bovis subsp bovis AF2122/97
uggacaucgggcggcac

SEQ ID NO: 1031070 - RNA, 23 nt, Mycobacterium bovis subsp bovis AF2122/97
uggacagaaucgaccgccgcuac

SEQ ID NO: 1031071 - RNA, 14 nt, Mycobacterium bovis subsp bovis AF2122/97
uggacaccaaccca

SEQ ID NO: 1031072 - RNA, 20 nt, Mycobacterium bovis subsp bovis AF2122/97
uggaauugaagaauuucggc

SEQ ID NO: 1031073 - RNA, 22 nt, Mycobacterium bovis subsp bovis AF2122/97
uggacaacagcuuggagaucgc

SEQ ID NO: 1031074 - RNA, 18 nt, Mycobacterium bovis subsp bovis AF2122/97
uggacgcggccaauggcc

SEQ ID NO: 1031075 - RNA, 20 nt, Mycobacterium bovis subsp bovis AF2122/97
uggacgcggccaauggccgc

SEQ ID NO: 1031076 - RNA, 22 nt, Mycobacterium bovis subsp bovis AF2122/97
uggacgggguacugcggcucgc

SEQ ID NO: 1031077 - RNA, 11 nt, Mycobacterium bovis subsp bovis AF2122/97
uggaccggucg

SEQ ID NO: 1031078 - RNA, 20 nt, Mycobacterium bovis subsp bovis AF2122/97
uggaccguugccgaugguga

SEQ ID NO: 1031079 - RNA, 15 nt, Mycobacterium bovis subsp bovis AF2122/97
uggacgaccgcgcgg

SEQ ID NO: 1031080 - RNA, 15 nt, Mycobacterium bovis subsp bovis AF2122/97
uggacgccgccggag

SEQ ID NO: 1031081 - RNA, 15 nt, Mycobacterium bovis subsp bovis AF2122/97
uggacgcgaugaccg

SEQ ID NO: 1031082 - RNA, 13 nt, Mycobacterium bovis subsp bovis AF2122/97
uggacgcgcaugc

SEQ ID NO: 1031083 - RNA, 18 nt, Mycobacterium bovis subsp bovis AF2122/97
uggacgaugaaccgggca

SEQ ID NO: 1031084 - RNA, 21 nt, Mycobacterium bovis subsp bovis AF2122/97
uggacgcagagucaacagaua

SEQ ID NO: 1031085 - RNA, 20 nt, Mycobacterium bovis subsp bovis AF2122/97
ugcgggcucguguccgccgu

SEQ ID NO: 1031086 - RNA, 19 nt, Mycobacterium bovis subsp bovis AF2122/97
ugcgggcuuugagcgcccg

SEQ ID NO: 1031087 - RNA, 15 nt, Mycobacterium bovis subsp bovis AF2122/97
ugcgggggacacguc

SEQ ID NO: 1031088 - RNA, 16 nt, Mycobacterium bovis subsp bovis AF2122/97
ugcggggauuggugcc

SEQ ID NO: 1031089 - RNA, 22 nt, Mycobacterium bovis subsp bovis AF2122/97
ugcggggauuggugcccagcgc

SEQ ID NO: 1031090 - RNA, 19 nt, Mycobacterium bovis subsp bovis AF2122/97
ugcgggggcuuaugcgucu

SEQ ID NO: 1031091 - RNA, 17 nt, Mycobacterium bovis subsp bovis AF2122/97
ugcgggggacacgucgu

SEQ ID NO: 1031092 - RNA, 17 nt, Mycobacterium bovis subsp bovis AF2122/97
ugcgggggacgggucgc

SEQ ID NO: 1031093 - RNA, 20 nt, Mycobacterium bovis subsp bovis AF2122/97
ugcgggggcuuaugcgucug

SEQ ID NO: 1031094 - RNA, 23 nt, Mycobacterium bovis subsp bovis AF2122/97
ugcggguagccgucgaucccggu

SEQ ID NO: 1031095 - RNA, 17 nt, Mycobacterium bovis subsp bovis AF2122/97
uggaaccaaaccugggc

SEQ ID NO: 1031096 - RNA, 16 nt, Mycobacterium bovis subsp bovis AF2122/97
uggaagacggugcggg

SEQ ID NO: 1031097 - RNA, 20 nt, Mycobacterium bovis subsp bovis AF2122/97
uggaagaagagguuggcggc

SEQ ID NO: 1031098 - RNA, 21 nt, Mycobacterium bovis subsp bovis AF2122/97
uggaagcccgucgcggccggc

SEQ ID NO: 1031099 - RNA, 15 nt, Mycobacterium bovis subsp bovis AF2122/97
uggaagaucacgcgu

SEQ ID NO: 1031100 - RNA, 15 nt, Mycobacterium bovis subsp bovis AF2122/97
uggaacuccguccgc

SEQ ID NO: 1031101 - RNA, 20 nt, Mycobacterium bovis subsp bovis AF2122/97
uggaacuccguccgccguau

SEQ ID NO: 1031102 - RNA, 17 nt, Mycobacterium bovis subsp bovis AF2122/97
uggaacuggacaccgug

SEQ ID NO: 1031103 - RNA, 14 nt, Mycobacterium bovis subsp bovis AF2122/97
uggaauggcgccgg

SEQ ID NO: 1031104 - RNA, 15 nt, Mycobacterium bovis subsp bovis AF2122/97
uggaauggcgccggc

SEQ ID NO: 1031105 - RNA, 22 nt, Mycobacterium bovis subsp bovis AF2122/97
uggagggaaucuccggcuggcc

SEQ ID NO: 1031106 - RNA, 19 nt, Mycobacterium bovis subsp bovis AF2122/97
uggagguaauccggcugcc

SEQ ID NO: 1031107 - RNA, 21 nt, Mycobacterium bovis subsp bovis AF2122/97
uggaguauccggcagaccggu

SEQ ID NO: 1031108 - RNA, 15 nt, Mycobacterium bovis subsp bovis AF2122/97
uggaguucucaucgc

SEQ ID NO: 1031109 - RNA, 22 nt, Mycobacterium bovis subsp bovis AF2122/97
uggauacggugcgacgauccag

SEQ ID NO: 1031110 - RNA, 23 nt, Mycobacterium bovis subsp bovis AF2122/97
uggagcgcgccucgcccagcaag

SEQ ID NO: 1031111 - RNA, 12 nt, Mycobacterium bovis subsp bovis AF2122/97
uggagccggccg

SEQ ID NO: 1031112 - RNA, 13 nt, Mycobacterium bovis subsp bovis AF2122/97
uggagccggccgu

SEQ ID NO: 1031113 - RNA, 14 nt, Mycobacterium bovis subsp bovis AF2122/97
uggagccccgacug

SEQ ID NO: 1031114 - RNA, 22 nt, Mycobacterium bovis subsp bovis AF2122/97
uggagcucaucgacgagccgcg

SEQ ID NO: 1031115 - RNA, 16 nt, Mycobacterium bovis subsp bovis AF2122/97
uggagaucacgugccg

SEQ ID NO: 1031116 - RNA, 18 nt, Mycobacterium bovis subsp bovis AF2122/97
uggagaucacgugccggc

SEQ ID NO: 1031117 - RNA, 20 nt, Mycobacterium bovis subsp bovis AF2122/97
uggaucccacgaguuggcca

SEQ ID NO: 1031118 - RNA, 17 nt, Mycobacterium bovis subsp bovis AF2122/97
uggaugccgacggcggg

SEQ ID NO: 1031119 - RNA, 19 nt, Mycobacterium bovis subsp bovis AF2122/97
uggaugcgccgcacggcga

SEQ ID NO: 1031120 - RNA, 16 nt, Mycobacterium bovis subsp bovis AF2122/97
uggaucgccaccggcg

SEQ ID NO: 1031121 - RNA, 19 nt, Mycobacterium bovis subsp bovis AF2122/97
uggaucgccaccggcgcca

SEQ ID NO: 1031122 - RNA, 16 nt, Mycobacterium bovis subsp bovis AF2122/97
uggaucagggucauca

SEQ ID NO: 1031123 - RNA, 15 nt, Mycobacterium bovis subsp bovis AF2122/97
uggauccagcccgac

SEQ ID NO: 1031124 - RNA, 21 nt, Mycobacterium bovis subsp bovis AF2122/97
uggaucgugccgaacacggug

SEQ ID NO: 1031125 - RNA, 17 nt, Mycobacterium bovis subsp bovis AF2122/97
uggaucggcagcccggu

SEQ ID NO: 1031126 - RNA, 18 nt, Mycobacterium bovis subsp bovis AF2122/97
uggaucggcagcccggug

SEQ ID NO: 1031127 - RNA, 14 nt, Mycobacterium bovis subsp bovis AF2122/97
uggauugccaccag

SEQ ID NO: 1031128 - RNA, 20 nt, Mycobacterium bovis subsp bovis AF2122/97
uggauguaggcuucgccgag

SEQ ID NO: 1031129 - RNA, 16 nt, Mycobacterium bovis subsp bovis AF2122/97
uggauggcucgccgaa

SEQ ID NO: 1031130 - RNA, 13 nt, Mycobacterium bovis subsp bovis AF2122/97
uggaugggcucga

SEQ ID NO: 1031131 - RNA, 15 nt, Mycobacterium bovis subsp bovis AF2122/97
uggaugggcucgacg

SEQ ID NO: 1031132 - RNA, 19 nt, Mycobacterium bovis subsp bovis AF2122/97
uggcaacggaggugccggc

SEQ ID NO: 1031133 - RNA, 21 nt, Mycobacterium bovis subsp bovis AF2122/97
uggcaaccacguccgcaaccu

SEQ ID NO: 1031134 - RNA, 18 nt, Mycobacterium bovis subsp bovis AF2122/97
ugucgcggucgcccgcua

SEQ ID NO: 1031135 - RNA, 13 nt, Mycobacterium bovis subsp bovis AF2122/97
ugucgcggugcgg

SEQ ID NO: 1031136 - RNA, 16 nt, Mycobacterium bovis subsp bovis AF2122/97
ugucgcgcgcuaggug

SEQ ID NO: 1031137 - RNA, 17 nt, Mycobacterium bovis subsp bovis AF2122/97
ugucgcguucggccgac

SEQ ID NO: 1031138 - RNA, 20 nt, Mycobacterium bovis subsp bovis AF2122/97
ugucgcgcagcaucuccgcc

SEQ ID NO: 1031139 - RNA, 24 nt, Mycobacterium bovis subsp bovis AF2122/97
ugucgcgcauugccgacgcgcggc

SEQ ID NO: 1031140 - RNA, 14 nt, Mycobacterium bovis subsp bovis AF2122/97
ugucgcggugcggc

SEQ ID NO: 1031141 - RNA, 14 nt, Mycobacterium bovis subsp bovis AF2122/97
ugucgcugcaaccg

SEQ ID NO: 1031142 - RNA, 16 nt, Mycobacterium bovis subsp bovis AF2122/97
ugucgcugcaaccgcc

SEQ ID NO: 1031143 - RNA, 13 nt, Mycobacterium bovis subsp bovis AF2122/97
ugucgcugccgcc

SEQ ID NO: 1031144 - RNA, 19 nt, Mycobacterium bovis subsp bovis AF2122/97
ugucgauagcccgccaccc

SEQ ID NO: 1031145 - RNA, 15 nt, Mycobacterium bovis subsp bovis AF2122/97
ugucgaucacggccg

SEQ ID NO: 1031146 - RNA, 13 nt, Mycobacterium bovis subsp bovis AF2122/97
ugucgaucagccg

SEQ ID NO: 1031147 - RNA, 14 nt, Mycobacterium bovis subsp bovis AF2122/97
ugucgaucagccgc

SEQ ID NO: 1031148 - RNA, 16 nt, Mycobacterium bovis subsp bovis AF2122/97
ugucgaucagccgcau

SEQ ID NO: 1031149 - RNA, 16 nt, Mycobacterium bovis subsp bovis AF2122/97
ugucgaucucggccag

SEQ ID NO: 1031150 - RNA, 14 nt, Mycobacterium bovis subsp bovis AF2122/97
ugugaccccggcca

SEQ ID NO: 1031151 - RNA, 17 nt, Mycobacterium bovis subsp bovis AF2122/97
ugugaccggcgaucggg

SEQ ID NO: 1031152 - RNA, 19 nt, Mycobacterium bovis subsp bovis AF2122/97
ugugaccggcgaucgggcg

SEQ ID NO: 1031153 - RNA, 14 nt, Mycobacterium bovis subsp bovis AF2122/97
ugugaccgucagcc

SEQ ID NO: 1031154 - RNA, 19 nt, Mycobacterium bovis subsp bovis AF2122/97
ugugacagcccgcuggccg

SEQ ID NO: 1031155 - RNA, 23 nt, Mycobacterium bovis subsp bovis AF2122/97
ugugacaucgggccgccgagcuc

SEQ ID NO: 1031156 - RNA, 19 nt, Mycobacterium bovis subsp bovis AF2122/97
ugugaaucugacgacgcga

SEQ ID NO: 1031157 - RNA, 17 nt, Mycobacterium bovis subsp bovis AF2122/97
ugucgcugccgccgccg

SEQ ID NO: 1031158 - RNA, 23 nt, Mycobacterium bovis subsp bovis AF2122/97
ugucgcugcggcgcuggccagca

SEQ ID NO: 1031159 - RNA, 22 nt, Mycobacterium bovis subsp bovis AF2122/97
ugugaacgaagggaaggacgcg

SEQ ID NO: 1031160 - RNA, 17 nt, Mycobacterium bovis subsp bovis AF2122/97
ugugaacggugucaacg

SEQ ID NO: 1031161 - RNA, 17 nt, Mycobacterium bovis subsp bovis AF2122/97
ugugaacuggucgacgu

SEQ ID NO: 1031162 - RNA, 18 nt, Mycobacterium bovis subsp bovis AF2122/97
ugugaggccuucgccgac

SEQ ID NO: 1031163 - RNA, 23 nt, Mycobacterium bovis subsp bovis AF2122/97
ugugagguagucggcgcgucguu

SEQ ID NO: 1031164 - RNA, 17 nt, Mycobacterium bovis subsp bovis AF2122/97
ugugacuuauccggcca

SEQ ID NO: 1031165 - RNA, 18 nt, Mycobacterium bovis subsp bovis AF2122/97
ugugacuuauccggccag

SEQ ID NO: 1031166 - RNA, 16 nt, Mycobacterium bovis subsp bovis AF2122/97
ugugagcaauggcgcg

SEQ ID NO: 1031167 - RNA, 17 nt, Mycobacterium bovis subsp bovis AF2122/97
ugugcaaaggcgccguc

SEQ ID NO: 1031168 - RNA, 19 nt, Mycobacterium bovis subsp bovis AF2122/97
ugugggugaacaccgaggu

SEQ ID NO: 1031169 - RNA, 20 nt, Mycobacterium bovis subsp bovis AF2122/97
uguggcuugcgucgcggacg

SEQ ID NO: 1031170 - RNA, 17 nt, Mycobacterium bovis subsp bovis AF2122/97
uguggucugccagcacc

SEQ ID NO: 1031171 - RNA, 22 nt, Mycobacterium bovis subsp bovis AF2122/97
ugugggcgagucgggggccgcg

SEQ ID NO: 1031172 - RNA, 17 nt, Mycobacterium bovis subsp bovis AF2122/97
uguggucaacggccgac

SEQ ID NO: 1031173 - RNA, 13 nt, Mycobacterium bovis subsp bovis AF2122/97
uguggugcggcgc

SEQ ID NO: 1031174 - RNA, 14 nt, Mycobacterium bovis subsp bovis AF2122/97
uguggugcggcgcg

SEQ ID NO: 1031175 - RNA, 13 nt, Mycobacterium bovis subsp bovis AF2122/97
ugugguggcgccg

SEQ ID NO: 1031176 - RNA, 15 nt, Mycobacterium bovis subsp bovis AF2122/97
ugugguggcgccggc

SEQ ID NO: 1031177 - RNA, 19 nt, Mycobacterium bovis subsp bovis AF2122/97
uguggugugccugcgucuc

SEQ ID NO: 1031178 - RNA, 22 nt, Mycobacterium bovis subsp bovis AF2122/97
uguguuccaacuccugcagccc

SEQ ID NO: 1031179 - RNA, 14 nt, Mycobacterium bovis subsp bovis AF2122/97
uguguggcgccggg

SEQ ID NO: 1031180 - RNA, 23 nt, Mycobacterium bovis subsp bovis AF2122/97
ugugugcgccuccgggacggugg

SEQ ID NO: 1031181 - RNA, 14 nt, Mycobacterium bovis subsp bovis AF2122/97
ugugugcucgucgc

SEQ ID NO: 1031182 - RNA, 21 nt, Mycobacterium bovis subsp bovis AF2122/97
ugugucggcgagggcgcgccg

SEQ ID NO: 1031183 - RNA, 17 nt, Mycobacterium bovis subsp bovis AF2122/97
ugugucugcucgcgccg

SEQ ID NO: 1031184 - RNA, 17 nt, Mycobacterium bovis subsp bovis AF2122/97
ugugugcaaaggcgccg

SEQ ID NO: 1031185 - RNA, 17 nt, Mycobacterium bovis subsp bovis AF2122/97
uguguauucgccgacgu

SEQ ID NO: 1031186 - RNA, 20 nt, Mycobacterium bovis subsp bovis AF2122/97
ugugcacgcgggcguuggcc

SEQ ID NO: 1031187 - RNA, 19 nt, Mycobacterium bovis subsp bovis AF2122/97
ugugcacggcuucggcgag

SEQ ID NO: 1031188 - RNA, 22 nt, Mycobacterium bovis subsp bovis AF2122/97
ugugcagggacccggcgccguc

SEQ ID NO: 1031189 - RNA, 17 nt, Mycobacterium bovis subsp bovis AF2122/97
ugugcauagcaauccgc

SEQ ID NO: 1031190 - RNA, 22 nt, Mycobacterium bovis subsp bovis AF2122/97
ugugcaucgccggcacggugaa

SEQ ID NO: 1031191 - RNA, 16 nt, Mycobacterium bovis subsp bovis AF2122/97
ugugcaucggcgaccg

SEQ ID NO: 1031192 - RNA, 13 nt, Mycobacterium bovis subsp bovis AF2122/97
ugugccaccgcug

SEQ ID NO: 1031193 - RNA, 17 nt, Mycobacterium bovis subsp bovis AF2122/97
uguggcgggucagcgcg

SEQ ID NO: 1031194 - RNA, 14 nt, Mycobacterium bovis subsp bovis AF2122/97
uguggcguguggcu

SEQ ID NO: 1031195 - RNA, 13 nt, Mycobacterium bovis subsp bovis AF2122/97
ugugggccccgcc

SEQ ID NO: 1031196 - RNA, 18 nt, Mycobacterium bovis subsp bovis AF2122/97
uguggcugaacaccgcgg

SEQ ID NO: 1031197 - RNA, 20 nt, Mycobacterium bovis subsp bovis AF2122/97
uguucggugguccuggcgaa

SEQ ID NO: 1031198 - RNA, 15 nt, Mycobacterium bovis subsp bovis AF2122/97
uguucgggucgauca

SEQ ID NO: 1031199 - RNA, 17 nt, Mycobacterium bovis subsp bovis AF2122/97
uguucgaugggugcacc

SEQ ID NO: 1031200 - RNA, 20 nt, Mycobacterium bovis subsp bovis AF2122/97
uguugaccaggcuccggccg

SEQ ID NO: 1031201 - RNA, 14 nt, Mycobacterium bovis subsp bovis AF2122/97
uguugacccaucau

SEQ ID NO: 1031202 - RNA, 23 nt, Mycobacterium bovis subsp bovis AF2122/97
uguugaccguguggccguuggcc

SEQ ID NO: 1031203 - RNA, 20 nt, Mycobacterium bovis subsp bovis AF2122/97
uguugacucugcguccaccg

SEQ ID NO: 1031204 - RNA, 14 nt, Mycobacterium bovis subsp bovis AF2122/97
uguugaggccggug

SEQ ID NO: 1031205 - RNA, 18 nt, Mycobacterium bovis subsp bovis AF2122/97
uguugaggccggugaacg

SEQ ID NO: 1031206 - RNA, 15 nt, Mycobacterium bovis subsp bovis AF2122/97
uguugagggugcccg

SEQ ID NO: 1031207 - RNA, 20 nt, Mycobacterium bovis subsp bovis AF2122/97
uguugaugggcagccgcccg

SEQ ID NO: 1031208 - RNA, 20 nt, Mycobacterium bovis subsp bovis AF2122/97
uguugagggugcccgaguuc

SEQ ID NO: 1031209 - RNA, 19 nt, Mycobacterium bovis subsp bovis AF2122/97
uguugccuaaguucgccac

SEQ ID NO: 1031210 - RNA, 20 nt, Mycobacterium bovis subsp bovis AF2122/97
uguugccuaaguucgccacg

SEQ ID NO: 1031211 - RNA, 21 nt, Mycobacterium bovis subsp bovis AF2122/97
uguugccgcccggguugaccg

SEQ ID NO: 1031212 - RNA, 14 nt, Mycobacterium bovis subsp bovis AF2122/97
uguugccgccggug

SEQ ID NO: 1031213 - RNA, 18 nt, Mycobacterium bovis subsp bovis AF2122/97
uguugccggagacgucgc

SEQ ID NO: 1031214 - RNA, 21 nt, Mycobacterium bovis subsp bovis AF2122/97
uguugccccggucggcgacgu

SEQ ID NO: 1031215 - RNA, 20 nt, Mycobacterium bovis subsp bovis AF2122/97
uguugcccuugggacugcgg

SEQ ID NO: 1031216 - RNA, 14 nt, Mycobacterium bovis subsp bovis AF2122/97
uguugccgaagccc

SEQ ID NO: 1031217 - RNA, 16 nt, Mycobacterium bovis subsp bovis AF2122/97
uguugccgaagcccga

SEQ ID NO: 1031218 - RNA, 14 nt, Mycobacterium bovis subsp bovis AF2122/97
uguugcaucgccgc

SEQ ID NO: 1031219 - RNA, 22 nt, Mycobacterium bovis subsp bovis AF2122/97
uguuccgugcgggucguccgcc

SEQ ID NO: 1031220 - RNA, 15 nt, Mycobacterium bovis subsp bovis AF2122/97
uguuccccgucgcca

SEQ ID NO: 1031221 - RNA, 22 nt, Mycobacterium bovis subsp bovis AF2122/97
uguuccaacuccugcagcccgg

SEQ ID NO: 1031222 - RNA, 16 nt, Mycobacterium bovis subsp bovis AF2122/97
uguucacguucagccc

SEQ ID NO: 1031223 - RNA, 14 nt, Mycobacterium bovis subsp bovis AF2122/97
uguucaacucgggc

SEQ ID NO: 1031224 - RNA, 18 nt, Mycobacterium bovis subsp bovis AF2122/97
uguuaacgcgcguccgcc

SEQ ID NO: 1031225 - RNA, 20 nt, Mycobacterium bovis subsp bovis AF2122/97
ugucgacgagcaccgcgccg

SEQ ID NO: 1031226 - RNA, 14 nt, Mycobacterium bovis subsp bovis AF2122/97
ugucgacggucggc

SEQ ID NO: 1031227 - RNA, 13 nt, Mycobacterium bovis subsp bovis AF2122/97
ugucgacgguguc

SEQ ID NO: 1031228 - RNA, 20 nt, Mycobacterium bovis subsp bovis AF2122/97
ugucgagccggugccgcggu

SEQ ID NO: 1031229 - RNA, 16 nt, Mycobacterium bovis subsp bovis AF2122/97
ugucgagccggugccg

SEQ ID NO: 1031230 - RNA, 16 nt, Mycobacterium bovis subsp bovis AF2122/97
uguccgauaacccggu

SEQ ID NO: 1031231 - RNA, 14 nt, Mycobacterium bovis subsp bovis AF2122/97
uguccgagcggccc

SEQ ID NO: 1031232 - RNA, 22 nt, Mycobacterium bovis subsp bovis AF2122/97
uguccgacgccaccgccaccac

SEQ ID NO: 1031233 - RNA, 20 nt, Mycobacterium bovis subsp bovis AF2122/97
uguccgcagcaccgucgggc

SEQ ID NO: 1031234 - RNA, 17 nt, Mycobacterium bovis subsp bovis AF2122/97
uguccgcagcggugcgc

SEQ ID NO: 1031235 - RNA, 20 nt, Mycobacterium bovis subsp bovis AF2122/97
uguccgccaaguacugggcc

SEQ ID NO: 1031236 - RNA, 14 nt, Mycobacterium bovis subsp bovis AF2122/97
uguccgccgacgua

SEQ ID NO: 1031237 - RNA, 13 nt, Mycobacterium bovis subsp bovis AF2122/97
uguccgcgacggc

SEQ ID NO: 1031238 - RNA, 22 nt, Mycobacterium bovis subsp bovis AF2122/97
uguccgcgacguaguggaagcc

SEQ ID NO: 1031239 - RNA, 17 nt, Mycobacterium bovis subsp bovis AF2122/97
uguccagcaugcccgcc

SEQ ID NO: 1031240 - RNA, 18 nt, Mycobacterium bovis subsp bovis AF2122/97
uguccgaccucgccgcgc

SEQ ID NO: 1031241 - RNA, 19 nt, Mycobacterium bovis subsp bovis AF2122/97
uguccgacgcaccaacgcg

SEQ ID NO: 1031242 - RNA, 17 nt, Mycobacterium bovis subsp bovis AF2122/97
ugucccgguguccagcc

SEQ ID NO: 1031243 - RNA, 19 nt, Mycobacterium bovis subsp bovis AF2122/97
ugucccgguguccagccac

SEQ ID NO: 1031244 - RNA, 19 nt, Mycobacterium bovis subsp bovis AF2122/97
uguccacgaugacgucgac

SEQ ID NO: 1031245 - RNA, 14 nt, Mycobacterium bovis subsp bovis AF2122/97
uguccacgccgugc

SEQ ID NO: 1031246 - RNA, 19 nt, Mycobacterium bovis subsp bovis AF2122/97
uguccacgccgugcuugcg

SEQ ID NO: 1031247 - RNA, 22 nt, Mycobacterium bovis subsp bovis AF2122/97
uguccacggcguuacguggugg

SEQ ID NO: 1031248 - RNA, 14 nt, Mycobacterium bovis subsp bovis AF2122/97
uguccaccgugcgg

SEQ ID NO: 1031249 - RNA, 22 nt, Mycobacterium bovis subsp bovis AF2122/97
uguccagaacgguggcgcggug

SEQ ID NO: 1031250 - RNA, 12 nt, Mycobacterium bovis subsp bovis AF2122/97
ugucaggcggcg

SEQ ID NO: 1031251 - RNA, 16 nt, Mycobacterium bovis subsp bovis AF2122/97
ugucagugaucaccaa

SEQ ID NO: 1031252 - RNA, 20 nt, Mycobacterium bovis subsp bovis AF2122/97
uguccacccagacaccggcu

SEQ ID NO: 1031253 - RNA, 16 nt, Mycobacterium bovis subsp bovis AF2122/97
uguccaccgaugccac

SEQ ID NO: 1031254 - RNA, 15 nt, Mycobacterium bovis subsp bovis AF2122/97
uguccaccgcaucgg

SEQ ID NO: 1031255 - RNA, 21 nt, Mycobacterium bovis subsp bovis AF2122/97
uguagcugcgggucucgccga

SEQ ID NO: 1031256 - RNA, 14 nt, Mycobacterium bovis subsp bovis AF2122/97
uguagcgcaucgcc

SEQ ID NO: 1031257 - RNA, 16 nt, Mycobacterium bovis subsp bovis AF2122/97
uguagcgcaucgccaa

SEQ ID NO: 1031258 - RNA, 22 nt, Mycobacterium bovis subsp bovis AF2122/97
uguagcgaaugaucuugccacu

SEQ ID NO: 1031259 - RNA, 17 nt, Mycobacterium bovis subsp bovis AF2122/97
uguagagcauucgggcg

SEQ ID NO: 1031260 - RNA, 14 nt, Mycobacterium bovis subsp bovis AF2122/97
uguagccggcgccg

SEQ ID NO: 1031261 - RNA, 16 nt, Mycobacterium bovis subsp bovis AF2122/97
uguagacggcggcauc

SEQ ID NO: 1031262 - RNA, 15 nt, Mycobacterium bovis subsp bovis AF2122/97
ugucaccccgcccag

SEQ ID NO: 1031263 - RNA, 15 nt, Mycobacterium bovis subsp bovis AF2122/97
ugucacccgcccgag

SEQ ID NO: 1031264 - RNA, 23 nt, Mycobacterium bovis subsp bovis AF2122/97
ugucaccguacggccacguuguc

SEQ ID NO: 1031265 - RNA, 14 nt, Mycobacterium bovis subsp bovis AF2122/97
ugucacgcaccgcg

SEQ ID NO: 1031266 - RNA, 15 nt, Mycobacterium bovis subsp bovis AF2122/97
ugucacgcaccgcgg

SEQ ID NO: 1031267 - RNA, 20 nt, Mycobacterium bovis subsp bovis AF2122/97
ugucagcgcugagccgcuca

SEQ ID NO: 1031268 - RNA, 18 nt, Mycobacterium bovis subsp bovis AF2122/97
ugucagcggccgcgacgu

SEQ ID NO: 1031269 - RNA, 18 nt, Mycobacterium bovis subsp bovis AF2122/97
ugucagcuuuaucggccc

SEQ ID NO: 1031270 - RNA, 19 nt, Mycobacterium bovis subsp bovis AF2122/97
ugucaccgccgggaagccg

SEQ ID NO: 1031271 - RNA, 14 nt, Mycobacterium bovis subsp bovis AF2122/97
ugucacaguggugg

SEQ ID NO: 1031272 - RNA, 13 nt, Mycobacterium bovis subsp bovis AF2122/97
uggugcucgucgg

SEQ ID NO: 1031273 - RNA, 19 nt, Mycobacterium bovis subsp bovis AF2122/97
uggugcugaccgcgccgga

SEQ ID NO: 1031274 - RNA, 14 nt, Mycobacterium bovis subsp bovis AF2122/97
uggugcuagcgccg

SEQ ID NO: 1031275 - RNA, 15 nt, Mycobacterium bovis subsp bovis AF2122/97
uggugcucagcggcu

SEQ ID NO: 1031276 - RNA, 22 nt, Mycobacterium bovis subsp bovis AF2122/97
ugguggaagguguuggugcggg

SEQ ID NO: 1031277 - RNA, 14 nt, Mycobacterium bovis subsp bovis AF2122/97
ugguggaccuccgg

SEQ ID NO: 1031278 - RNA, 23 nt, Mycobacterium bovis subsp bovis AF2122/97
ugguggcaacggguccgacggug

SEQ ID NO: 1031279 - RNA, 14 nt, Mycobacterium bovis subsp bovis AF2122/97
ugguggcaccgguu

SEQ ID NO: 1031280 - RNA, 20 nt, Mycobacterium bovis subsp bovis AF2122/97
ugguggccaugacggcuccg

SEQ ID NO: 1031281 - RNA, 23 nt, Mycobacterium bovis subsp bovis AF2122/97
ugguggccgaacgggucggcgac

SEQ ID NO: 1031282 - RNA, 15 nt, Mycobacterium bovis subsp bovis AF2122/97
ugguggacgaugcgg

SEQ ID NO: 1031283 - RNA, 21 nt, Mycobacterium bovis subsp bovis AF2122/97
ugguggcgaucuggucgccug

SEQ ID NO: 1031284 - RNA, 12 nt, Mycobacterium bovis subsp bovis AF2122/97
ugguggcggcga

SEQ ID NO: 1031285 - RNA, 23 nt, Mycobacterium bovis subsp bovis AF2122/97
ugguggcggcgacacgccaggug

SEQ ID NO: 1031286 - RNA, 22 nt, Mycobacterium bovis subsp bovis AF2122/97
ugguggcggucaccacgcggcg

SEQ ID NO: 1031287 - RNA, 20 nt, Mycobacterium bovis subsp bovis AF2122/97
uggugggcgcagagucaacg

SEQ ID NO: 1031288 - RNA, 19 nt, Mycobacterium bovis subsp bovis AF2122/97
uggugggccgugggugucg

SEQ ID NO: 1031289 - RNA, 15 nt, Mycobacterium bovis subsp bovis AF2122/97
ugguggucgggcgca

SEQ ID NO: 1031290 - RNA, 15 nt, Mycobacterium bovis subsp bovis AF2122/97
ugguggucugccaaa

SEQ ID NO: 1031291 - RNA, 20 nt, Mycobacterium bovis subsp bovis AF2122/97
uggugggggagcggccgccg

SEQ ID NO: 1031292 - RNA, 17 nt, Mycobacterium bovis subsp bovis AF2122/97
ugguggguugaucgcgc

SEQ ID NO: 1031293 - RNA, 22 nt, Mycobacterium bovis subsp bovis AF2122/97
uggugcgcucgcgguagcgccg

SEQ ID NO: 1031294 - RNA, 20 nt, Mycobacterium bovis subsp bovis AF2122/97
uggugcguagcccacccggg

SEQ ID NO: 1031295 - RNA, 12 nt, Mycobacterium bovis subsp bovis AF2122/97
ugguaccggcgg

SEQ ID NO: 1031296 - RNA, 18 nt, Mycobacterium bovis subsp bovis AF2122/97
ugguaccggcggcgccgg

SEQ ID NO: 1031297 - RNA, 17 nt, Mycobacterium bovis subsp bovis AF2122/97
ugguaacaccggcgagu

SEQ ID NO: 1031298 - RNA, 17 nt, Mycobacterium bovis subsp bovis AF2122/97
ugguaaccagggcagcc

SEQ ID NO: 1031299 - RNA, 19 nt, Mycobacterium bovis subsp bovis AF2122/97
ugguaaccagggcagccgg

SEQ ID NO: 1031300 - RNA, 15 nt, Mycobacterium bovis subsp bovis AF2122/97
ugguuucgcaccgug

SEQ ID NO: 1031301 - RNA, 13 nt, Mycobacterium bovis subsp bovis AF2122/97
ugguuggcgccga

SEQ ID NO: 1031302 - RNA, 12 nt, Mycobacterium bovis subsp bovis AF2122/97
ugguugcgacgg

SEQ ID NO: 1031303 - RNA, 16 nt, Mycobacterium bovis subsp bovis AF2122/97
ugguugcggccgucga

SEQ ID NO: 1031304 - RNA, 20 nt, Mycobacterium bovis subsp bovis AF2122/97
uggugguuccgcccggugcu

SEQ ID NO: 1031305 - RNA, 18 nt, Mycobacterium bovis subsp bovis AF2122/97
uggugggagaccugucgg

SEQ ID NO: 1031306 - RNA, 21 nt, Mycobacterium bovis subsp bovis AF2122/97
ugguggucuuggccggugcgc

SEQ ID NO: 1031307 - RNA, 21 nt, Mycobacterium bovis subsp bovis AF2122/97
ugguguacccgccucgggccg

SEQ ID NO: 1031308 - RNA, 21 nt, Mycobacterium bovis subsp bovis AF2122/97
ugguugacggcgaagucgagu

SEQ ID NO: 1031309 - RNA, 13 nt, Mycobacterium bovis subsp bovis AF2122/97
ugguugacgucga

SEQ ID NO: 1031310 - RNA, 19 nt, Mycobacterium bovis subsp bovis AF2122/97
ugguucgaaccguugcgca

SEQ ID NO: 1031311 - RNA, 13 nt, Mycobacterium bovis subsp bovis AF2122/97
ugguguccaccac

SEQ ID NO: 1031312 - RNA, 19 nt, Mycobacterium bovis subsp bovis AF2122/97
uggugucaaugacaccggg

SEQ ID NO: 1031313 - RNA, 18 nt, Mycobacterium bovis subsp bovis AF2122/97
uggugucagccaccggug

SEQ ID NO: 1031314 - RNA, 16 nt, Mycobacterium bovis subsp bovis AF2122/97
uguaaguuuucggccg

SEQ ID NO: 1031315 - RNA, 19 nt, Mycobacterium bovis subsp bovis AF2122/97
uguacaacgccgucgucgu

SEQ ID NO: 1031316 - RNA, 16 nt, Mycobacterium bovis subsp bovis AF2122/97
uguacccgaccagcac

SEQ ID NO: 1031317 - RNA, 13 nt, Mycobacterium bovis subsp bovis AF2122/97
uucccggugacca

SEQ ID NO: 1031318 - RNA, 18 nt, Mycobacterium bovis subsp bovis AF2122/97
uuccgcgcggcagguugc

SEQ ID NO: 1031319 - RNA, 16 nt, Mycobacterium bovis subsp bovis AF2122/97
uuccgcgucgccggcc

SEQ ID NO: 1031320 - RNA, 23 nt, Mycobacterium bovis subsp bovis AF2122/97
uuccgcgugcgauucugcgucug

SEQ ID NO: 1031321 - RNA, 16 nt, Mycobacterium bovis subsp bovis AF2122/97
uuccgcugcggugccg

SEQ ID NO: 1031322 - RNA, 16 nt, Mycobacterium bovis subsp bovis AF2122/97
uuccgcugucgagccg

SEQ ID NO: 1031323 - RNA, 16 nt, Mycobacterium bovis subsp bovis AF2122/97
uuccgcucgagggaug

SEQ ID NO: 1031324 - RNA, 16 nt, Mycobacterium bovis subsp bovis AF2122/97
uuccggccgacacgcc

SEQ ID NO: 1031325 - RNA, 23 nt, Mycobacterium bovis subsp bovis AF2122/97
uuccggccgacacgccgaugccg

SEQ ID NO: 1031326 - RNA, 14 nt, Mycobacterium bovis subsp bovis AF2122/97
uuccggccgccugc

SEQ ID NO: 1031327 - RNA, 16 nt, Mycobacterium bovis subsp bovis AF2122/97
uuccgguccagcggcc

SEQ ID NO: 1031328 - RNA, 19 nt, Mycobacterium bovis subsp bovis AF2122/97
uuccgguccagcggccgcc

SEQ ID NO: 1031329 - RNA, 19 nt, Mycobacterium bovis subsp bovis AF2122/97
uuccgggacuaccacccgc

SEQ ID NO: 1031330 - RNA, 22 nt, Mycobacterium bovis subsp bovis AF2122/97
uuccggcuggugggacgcggcc

SEQ ID NO: 1031331 - RNA, 22 nt, Mycobacterium bovis subsp bovis AF2122/97
uuccccgguagcguucggcgag

SEQ ID NO: 1031332 - RNA, 23 nt, Mycobacterium bovis subsp bovis AF2122/97
uuccagccgacguaccagggugu

SEQ ID NO: 1031333 - RNA, 13 nt, Mycobacterium bovis subsp bovis AF2122/97
uuccagcggcacc

SEQ ID NO: 1031334 - RNA, 15 nt, Mycobacterium bovis subsp bovis AF2122/97
uucccggaagcgccg

SEQ ID NO: 1031335 - RNA, 18 nt, Mycobacterium bovis subsp bovis AF2122/97
uucccggaagcgccggcc

SEQ ID NO: 1031336 - RNA, 20 nt, Mycobacterium bovis subsp bovis AF2122/97
uucccggauagacggcgacg

SEQ ID NO: 1031337 - RNA, 14 nt, Mycobacterium bovis subsp bovis AF2122/97
uucccgcucgcagg

SEQ ID NO: 1031338 - RNA, 21 nt, Mycobacterium bovis subsp bovis AF2122/97
uuccccgcccuugccgccagc

SEQ ID NO: 1031339 - RNA, 14 nt, Mycobacterium bovis subsp bovis AF2122/97
uucccgacgucggc

SEQ ID NO: 1031340 - RNA, 15 nt, Mycobacterium bovis subsp bovis AF2122/97
uuccacccggugccg

SEQ ID NO: 1031341 - RNA, 13 nt, Mycobacterium bovis subsp bovis AF2122/97
uuccaccgccgac

SEQ ID NO: 1031342 - RNA, 18 nt, Mycobacterium bovis subsp bovis AF2122/97
uuccacgagucgucgucc

SEQ ID NO: 1031343 - RNA, 12 nt, Mycobacterium bovis subsp bovis AF2122/97
uuccacaggggc

SEQ ID NO: 1031344 - RNA, 17 nt, Mycobacterium bovis subsp bovis AF2122/97
uuccagcagccugcgcc

SEQ ID NO: 1031345 - RNA, 21 nt, Mycobacterium bovis subsp bovis AF2122/97
uuccagcaguacaccgcccgg

SEQ ID NO: 1031346 - RNA, 22 nt, Mycobacterium bovis subsp bovis AF2122/97
uuccagccacagcccggcggcg

SEQ ID NO: 1031347 - RNA, 14 nt, Mycobacterium bovis subsp bovis AF2122/97
uucaucacgggacg

SEQ ID NO: 1031348 - RNA, 18 nt, Mycobacterium bovis subsp bovis AF2122/97
uucaacccgggcagcauc

SEQ ID NO: 1031349 - RNA, 13 nt, Mycobacterium bovis subsp bovis AF2122/97
uucaacaccggca

SEQ ID NO: 1031350 - RNA, 15 nt, Mycobacterium bovis subsp bovis AF2122/97
uucaacaccggcauc

SEQ ID NO: 1031351 - RNA, 15 nt, Mycobacterium bovis subsp bovis AF2122/97
uucaacuccggcacc

SEQ ID NO: 1031352 - RNA, 19 nt, Mycobacterium bovis subsp bovis AF2122/97
uucaacuccggcaccggca

SEQ ID NO: 1031353 - RNA, 15 nt, Mycobacterium bovis subsp bovis AF2122/97
uucaacgcgcgcacg

SEQ ID NO: 1031354 - RNA, 14 nt, Mycobacterium bovis subsp bovis AF2122/97
uucacaugcgccga

SEQ ID NO: 1031355 - RNA, 19 nt, Mycobacterium bovis subsp bovis AF2122/97
uucagguccaccgcugccg

SEQ ID NO: 1031356 - RNA, 13 nt, Mycobacterium bovis subsp bovis AF2122/97
uucagggcgucga

SEQ ID NO: 1031357 - RNA, 14 nt, Mycobacterium bovis subsp bovis AF2122/97
uguugcugcugccg

SEQ ID NO: 1031358 - RNA, 15 nt, Mycobacterium bovis subsp bovis AF2122/97
uguugcugucgaagu

SEQ ID NO: 1031359 - RNA, 17 nt, Mycobacterium bovis subsp bovis AF2122/97
uguuggcgaaggccgca

SEQ ID NO: 1031360 - RNA, 21 nt, Mycobacterium bovis subsp bovis AF2122/97
uguuggccguaccggugaucg

SEQ ID NO: 1031361 - RNA, 18 nt, Mycobacterium bovis subsp bovis AF2122/97
uguuggagaugucgauca

SEQ ID NO: 1031362 - RNA, 19 nt, Mycobacterium bovis subsp bovis AF2122/97
uguuggauccggccaccac

SEQ ID NO: 1031363 - RNA, 21 nt, Mycobacterium bovis subsp bovis AF2122/97
uguuggccauguccaccagcg

SEQ ID NO: 1031364 - RNA, 21 nt, Mycobacterium bovis subsp bovis AF2122/97
uguuggcgcccgggcccacgu

SEQ ID NO: 1031365 - RNA, 21 nt, Mycobacterium bovis subsp bovis AF2122/97
uguugggagccaccggcgucg

SEQ ID NO: 1031366 - RNA, 22 nt, Mycobacterium bovis subsp bovis AF2122/97
uuaaccgagccgaccggcggca

SEQ ID NO: 1031367 - RNA, 19 nt, Mycobacterium bovis subsp bovis AF2122/97
uuaggggcuuuugcgucug

SEQ ID NO: 1031368 - RNA, 20 nt, Mycobacterium bovis subsp bovis AF2122/97
uuaggcgauucugcgucugc

SEQ ID NO: 1031369 - RNA, 17 nt, Mycobacterium bovis subsp bovis AF2122/97
uuaccaccgucaccgcc

SEQ ID NO: 1031370 - RNA, 13 nt, Mycobacterium bovis subsp bovis AF2122/97
uuaccgacaccgu

SEQ ID NO: 1031371 - RNA, 17 nt, Mycobacterium bovis subsp bovis AF2122/97
uuaccaacgcggugacg

SEQ ID NO: 1031372 - RNA, 16 nt, Mycobacterium bovis subsp bovis AF2122/97
uuacuggagauaccga

SEQ ID NO: 1031373 - RNA, 14 nt, Mycobacterium bovis subsp bovis AF2122/97
guugccgccggcgc

SEQ ID NO: 1031374 - RNA, 17 nt, Mycobacterium bovis subsp bovis AF2122/97
guugccgccggcgccgc

SEQ ID NO: 1031375 - RNA, 16 nt, Mycobacterium bovis subsp bovis AF2122/97
guugccgccggucauc

SEQ ID NO: 1031376 - RNA, 13 nt, Mycobacterium bovis subsp bovis AF2122/97
guugccgccggug

SEQ ID NO: 1031377 - RNA, 16 nt, Mycobacterium bovis subsp bovis AF2122/97
guugccgccggugccg

SEQ ID NO: 1031378 - RNA, 19 nt, Mycobacterium bovis subsp bovis AF2122/97
guugccgccgucgccgccg

SEQ ID NO: 1031379 - RNA, 14 nt, Mycobacterium bovis subsp bovis AF2122/97
guugccgccgucgu

SEQ ID NO: 1031380 - RNA, 20 nt, Mycobacterium bovis subsp bovis AF2122/97
guugccgccgucguugcccg

SEQ ID NO: 1031381 - RNA, 13 nt, Mycobacterium bovis subsp bovis AF2122/97
guugccgccguug

SEQ ID NO: 1031382 - RNA, 11 nt, Mycobacterium bovis subsp bovis AF2122/97
guugccgccga

SEQ ID NO: 1031383 - RNA, 23 nt, Mycobacterium bovis subsp bovis AF2122/97
guugccgccgccuccgccgaggc

SEQ ID NO: 1031384 - RNA, 15 nt, Mycobacterium bovis subsp bovis AF2122/97
guugccgcgccacug

SEQ ID NO: 1031385 - RNA, 11 nt, Mycobacterium bovis subsp bovis AF2122/97
guugccgccgg

SEQ ID NO: 1031386 - RNA, 13 nt, Mycobacterium bovis subsp bovis AF2122/97
guugcgacgaacc

SEQ ID NO: 1031387 - RNA, 15 nt, Mycobacterium bovis subsp bovis AF2122/97
guugcgacggcguug

SEQ ID NO: 1031388 - RNA, 18 nt, Mycobacterium bovis subsp bovis AF2122/97
guugccuuguucgcccac

SEQ ID NO: 1031389 - RNA, 17 nt, Mycobacterium bovis subsp bovis AF2122/97
guugccgcaccagucgc

SEQ ID NO: 1031390 - RNA, 19 nt, Mycobacterium bovis subsp bovis AF2122/97
guugccgaucccggcgagc

SEQ ID NO: 1031391 - RNA, 22 nt, Mycobacterium bovis subsp bovis AF2122/97
guugccgaucccggcgagcacc

SEQ ID NO: 1031392 - RNA, 16 nt, Mycobacterium bovis subsp bovis AF2122/97
guugccgccacgggcg

SEQ ID NO: 1031393 - RNA, 15 nt, Mycobacterium bovis subsp bovis AF2122/97
guugccgccaucacc

SEQ ID NO: 1031394 - RNA, 19 nt, Mycobacterium bovis subsp bovis AF2122/97
guugccgccaucaccgccg

SEQ ID NO: 1031395 - RNA, 19 nt, Mycobacterium bovis subsp bovis AF2122/97
guugccgccgacgccgccg

SEQ ID NO: 1031396 - RNA, 21 nt, Mycobacterium bovis subsp bovis AF2122/97
guugccgccgacgccgccggc

SEQ ID NO: 1031397 - RNA, 22 nt, Mycobacterium bovis subsp bovis AF2122/97
guugccgaucaaccccccgggc

SEQ ID NO: 1031398 - RNA, 15 nt, Mycobacterium bovis subsp bovis AF2122/97
guugccgaucaccac

SEQ ID NO: 1031399 - RNA, 16 nt, Mycobacterium bovis subsp bovis AF2122/97
guugccgaucaccacg

SEQ ID NO: 1031400 - RNA, 19 nt, Mycobacterium bovis subsp bovis AF2122/97
guugccgaucaccacggcg

SEQ ID NO: 1031401 - RNA, 16 nt, Mycobacterium bovis subsp bovis AF2122/97
guugccgaucccggcg

SEQ ID NO: 1031402 - RNA, 18 nt, Mycobacterium bovis subsp bovis AF2122/97
guugccgaucccggcgag

SEQ ID NO: 1031403 - RNA, 19 nt, Mycobacterium bovis subsp bovis AF2122/97
guugccgaaccacgcgccc

SEQ ID NO: 1031404 - RNA, 14 nt, Mycobacterium bovis subsp bovis AF2122/97
guugccgaagccgg

SEQ ID NO: 1031405 - RNA, 18 nt, Mycobacterium bovis subsp bovis AF2122/97
guugccgacgaucgacgc

SEQ ID NO: 1031406 - RNA, 17 nt, Mycobacterium bovis subsp bovis AF2122/97
guugccgacgagacggc

SEQ ID NO: 1031407 - RNA, 20 nt, Mycobacterium bovis subsp bovis AF2122/97
guugcgcauaggcgaucguc

SEQ ID NO: 1031408 - RNA, 21 nt, Mycobacterium bovis subsp bovis AF2122/97
guugcgcacccgcgggucguc

SEQ ID NO: 1031409 - RNA, 16 nt, Mycobacterium bovis subsp bovis AF2122/97
guugcgaggccgcacg

SEQ ID NO: 1031410 - RNA, 17 nt, Mycobacterium bovis subsp bovis AF2122/97
guugcggucaucggcgc

SEQ ID NO: 1031411 - RNA, 13 nt, Mycobacterium bovis subsp bovis AF2122/97
guugcgggcgugg

SEQ ID NO: 1031412 - RNA, 19 nt, Mycobacterium bovis subsp bovis AF2122/97
guugcgggccaggcccucg

SEQ ID NO: 1031413 - RNA, 23 nt, Mycobacterium bovis subsp bovis AF2122/97
guugcgggccaggcccucgacgg

SEQ ID NO: 1031414 - RNA, 17 nt, Mycobacterium bovis subsp bovis AF2122/97
guugcggugugccgaga

SEQ ID NO: 1031415 - RNA, 20 nt, Mycobacterium bovis subsp bovis AF2122/97
guugcggggugcucagcgac

SEQ ID NO: 1031416 - RNA, 18 nt, Mycobacterium bovis subsp bovis AF2122/97
guugcguuggcgccacca

SEQ ID NO: 1031417 - RNA, 16 nt, Mycobacterium bovis subsp bovis AF2122/97
guugcguuguccacca

SEQ ID NO: 1031418 - RNA, 18 nt, Mycobacterium bovis subsp bovis AF2122/97
guugcguuguccaccauc

SEQ ID NO: 1031419 - RNA, 16 nt, Mycobacterium bovis subsp bovis AF2122/97
guugaucuggcguuca

SEQ ID NO: 1031420 - RNA, 19 nt, Mycobacterium bovis subsp bovis AF2122/97
guugaucgacaccgagcca

SEQ ID NO: 1031421 - RNA, 21 nt, Mycobacterium bovis subsp bovis AF2122/97
guugaucgcguagcuggccag

SEQ ID NO: 1031422 - RNA, 16 nt, Mycobacterium bovis subsp bovis AF2122/97
guugacgaugugcccg

SEQ ID NO: 1031423 - RNA, 23 nt, Mycobacterium bovis subsp bovis AF2122/97
guugacgauccggucggcgggca

SEQ ID NO: 1031424 - RNA, 18 nt, Mycobacterium bovis subsp bovis AF2122/97
guugacccucgggucguc

SEQ ID NO: 1031425 - RNA, 20 nt, Mycobacterium bovis subsp bovis AF2122/97
guugacccggcagcccggcg

SEQ ID NO: 1031426 - RNA, 18 nt, Mycobacterium bovis subsp bovis AF2122/97
guugaccgcggucugcgc

SEQ ID NO: 1031427 - RNA, 23 nt, Mycobacterium bovis subsp bovis AF2122/97
guugaccgcggucugcgcgucgc

SEQ ID NO: 1031428 - RNA, 21 nt, Mycobacterium bovis subsp bovis AF2122/97
guugacccagaccggcucguc

SEQ ID NO: 1031429 - RNA, 12 nt, Mycobacterium bovis subsp bovis AF2122/97
guugaccaggcu

SEQ ID NO: 1031430 - RNA, 15 nt, Mycobacterium bovis subsp bovis AF2122/97
guugaccgggucguc

SEQ ID NO: 1031431 - RNA, 13 nt, Mycobacterium bovis subsp bovis AF2122/97
guugaccugcgca

SEQ ID NO: 1031432 - RNA, 18 nt, Mycobacterium bovis subsp bovis AF2122/97
guugcccgacgccgguca

SEQ ID NO: 1031433 - RNA, 15 nt, Mycobacterium bovis subsp bovis AF2122/97
guugccccggcgacc

SEQ ID NO: 1031434 - RNA, 15 nt, Mycobacterium bovis subsp bovis AF2122/97
guugccccggucggc

SEQ ID NO: 1031435 - RNA, 16 nt, Mycobacterium bovis subsp bovis AF2122/97
guugcccccguugccg

SEQ ID NO: 1031436 - RNA, 17 nt, Mycobacterium bovis subsp bovis AF2122/97
guugccccgaccgccgu

SEQ ID NO: 1031437 - RNA, 13 nt, Mycobacterium bovis subsp bovis AF2122/97
guugaugccgccg

SEQ ID NO: 1031438 - RNA, 14 nt, Mycobacterium bovis subsp bovis AF2122/97
guugaugccgccgg

SEQ ID NO: 1031439 - RNA, 15 nt, Mycobacterium bovis subsp bovis AF2122/97
guugaugccgccgga

SEQ ID NO: 1031440 - RNA, 22 nt, Mycobacterium bovis subsp bovis AF2122/97
guugaucuggcguucagcggcc

SEQ ID NO: 1031441 - RNA, 17 nt, Mycobacterium bovis subsp bovis AF2122/97
guugaugaccgccgccg

SEQ ID NO: 1031442 - RNA, 14 nt, Mycobacterium bovis subsp bovis AF2122/97
guugaugacggcgu

SEQ ID NO: 1031443 - RNA, 16 nt, Mycobacterium bovis subsp bovis AF2122/97
guugaugcggccgcgg

SEQ ID NO: 1031444 - RNA, 23 nt, Mycobacterium bovis subsp bovis AF2122/97
guugaugcguagugcggcgugga

SEQ ID NO: 1031445 - RNA, 14 nt, Mycobacterium bovis subsp bovis AF2122/97
guugggccgcgccc

SEQ ID NO: 1031446 - RNA, 21 nt, Mycobacterium bovis subsp bovis AF2122/97
guugggagccaccggcgucga

SEQ ID NO: 1031447 - RNA, 14 nt, Mycobacterium bovis subsp bovis AF2122/97
guuggcucggcgca

SEQ ID NO: 1031448 - RNA, 23 nt, Mycobacterium bovis subsp bovis AF2122/97
guuggcguggaucuuggccagca

SEQ ID NO: 1031449 - RNA, 18 nt, Mycobacterium bovis subsp bovis AF2122/97
guuggcgguggucccgau

SEQ ID NO: 1031450 - RNA, 13 nt, Mycobacterium bovis subsp bovis AF2122/97
guuggcggcucgc

SEQ ID NO: 1031451 - RNA, 21 nt, Mycobacterium bovis subsp bovis AF2122/97
guuggcgcccgaagccgggcc

SEQ ID NO: 1031452 - RNA, 21 nt, Mycobacterium bovis subsp bovis AF2122/97
guuggcgguggucccgauggc

SEQ ID NO: 1031453 - RNA, 15 nt, Mycobacterium bovis subsp bovis AF2122/97
guuggcggcaagggu

SEQ ID NO: 1031454 - RNA, 19 nt, Mycobacterium bovis subsp bovis AF2122/97
guuggcggccagcgcaccg

SEQ ID NO: 1031455 - RNA, 16 nt, Mycobacterium bovis subsp bovis AF2122/97
guuggcggcggucggc

SEQ ID NO: 1031456 - RNA, 21 nt, Mycobacterium bovis subsp bovis AF2122/97
guuggcggcgauccagaacaa

SEQ ID NO: 1031457 - RNA, 23 nt, Mycobacterium bovis subsp bovis AF2122/97
guuggcgaaugcggccccgacac

SEQ ID NO: 1031458 - RNA, 11 nt, Mycobacterium bovis subsp bovis AF2122/97
guuggcgacga

SEQ ID NO: 1031459 - RNA, 15 nt, Mycobacterium bovis subsp bovis AF2122/97
guuggccgggucguc

SEQ ID NO: 1031460 - RNA, 14 nt, Mycobacterium bovis subsp bovis AF2122/97
guuggccgcgcuca

SEQ ID NO: 1031461 - RNA, 17 nt, Mycobacterium bovis subsp bovis AF2122/97
guuggccgcgcucaucg

SEQ ID NO: 1031462 - RNA, 14 nt, Mycobacterium bovis subsp bovis AF2122/97
guugcugacgacug

SEQ ID NO: 1031463 - RNA, 18 nt, Mycobacterium bovis subsp bovis AF2122/97
guugcucggccgaugcgc

SEQ ID NO: 1031464 - RNA, 17 nt, Mycobacterium bovis subsp bovis AF2122/97
guugcucccggccgccg

SEQ ID NO: 1031465 - RNA, 21 nt, Mycobacterium bovis subsp bovis AF2122/97
guugcucgagcgguggcgucg

SEQ ID NO: 1031466 - RNA, 14 nt, Mycobacterium bovis subsp bovis AF2122/97
guugugauccggug

SEQ ID NO: 1031467 - RNA, 18 nt, Mycobacterium bovis subsp bovis AF2122/97
guugugauccgguggugg

SEQ ID NO: 1031468 - RNA, 15 nt, Mycobacterium bovis subsp bovis AF2122/97
guugucuuucacaug

SEQ ID NO: 1031469 - RNA, 16 nt, Mycobacterium bovis subsp bovis AF2122/97
guugucgucgccgccg

SEQ ID NO: 1031470 - RNA, 13 nt, Mycobacterium bovis subsp bovis AF2122/97
guuggucggugcu

SEQ ID NO: 1031471 - RNA, 20 nt, Mycobacterium bovis subsp bovis AF2122/97
guugucgggggcguggccgu

SEQ ID NO: 1031472 - RNA, 23 nt, Mycobacterium bovis subsp bovis AF2122/97
guugggugccggacuuggccugc

SEQ ID NO: 1031473 - RNA, 16 nt, Mycobacterium bovis subsp bovis AF2122/97
guugggguggcggugc

SEQ ID NO: 1031474 - RNA, 15 nt, Mycobacterium bovis subsp bovis AF2122/97
guuggggcacgacgc

SEQ ID NO: 1031475 - RNA, 16 nt, Mycobacterium bovis subsp bovis AF2122/97
guuggucccgaucacc

SEQ ID NO: 1031476 - RNA, 15 nt, Mycobacterium bovis subsp bovis AF2122/97
guugguccucggcgg

SEQ ID NO: 1031477 - RNA, 21 nt, Mycobacterium bovis subsp bovis AF2122/97
guugugcagaucgucgccgau

SEQ ID NO: 1031478 - RNA, 16 nt, Mycobacterium bovis subsp bovis AF2122/97
guugugcgcgcgcccg

SEQ ID NO: 1031479 - RNA, 13 nt, Mycobacterium bovis subsp bovis AF2122/97
guugugcggcguu

SEQ ID NO: 1031480 - RNA, 16 nt, Mycobacterium bovis subsp bovis AF2122/97
guugugcucggugacg

SEQ ID NO: 1031481 - RNA, 14 nt, Mycobacterium bovis subsp bovis AF2122/97
guuguucaccgacg

SEQ ID NO: 1031482 - RNA, 15 nt, Mycobacterium bovis subsp bovis AF2122/97
guuguucgccaccgc

SEQ ID NO: 1031483 - RNA, 19 nt, Mycobacterium bovis subsp bovis AF2122/97
guuguugaagggggcgucg

SEQ ID NO: 1031484 - RNA, 20 nt, Mycobacterium bovis subsp bovis AF2122/97
guuguugacagacacagcac

SEQ ID NO: 1031485 - RNA, 15 nt, Mycobacterium bovis subsp bovis AF2122/97
guuguugucgguguc

SEQ ID NO: 1031486 - RNA, 17 nt, Mycobacterium bovis subsp bovis AF2122/97
guuguugacgcccgagu

SEQ ID NO: 1031487 - RNA, 14 nt, Mycobacterium bovis subsp bovis AF2122/97
guuguugcugcccc

SEQ ID NO: 1031488 - RNA, 22 nt, Mycobacterium bovis subsp bovis AF2122/97
guuccgcgacaaccacgaaagc

SEQ ID NO: 1031489 - RNA, 19 nt, Mycobacterium bovis subsp bovis AF2122/97
guuccgcggggccgaaucc

SEQ ID NO: 1031490 - RNA, 17 nt, Mycobacterium bovis subsp bovis AF2122/97
guuccgcugucgagccg

SEQ ID NO: 1031491 - RNA, 17 nt, Mycobacterium bovis subsp bovis AF2122/97
guuccgggccgaucacc

SEQ ID NO: 1031492 - RNA, 16 nt, Mycobacterium bovis subsp bovis AF2122/97
guuccucgaguucggg

SEQ ID NO: 1031493 - RNA, 15 nt, Mycobacterium bovis subsp bovis AF2122/97
guuccugcacgguca

SEQ ID NO: 1031494 - RNA, 20 nt, Mycobacterium bovis subsp bovis AF2122/97
guuccguugaugccgccgga

SEQ ID NO: 1031495 - RNA, 15 nt, Mycobacterium bovis subsp bovis AF2122/97
guuccuccagcagcg

SEQ ID NO: 1031496 - RNA, 12 nt, Mycobacterium bovis subsp bovis AF2122/97
guuccucgaccg

SEQ ID NO: 1031497 - RNA, 16 nt, Mycobacterium bovis subsp bovis AF2122/97
guucccgccggcgccg

SEQ ID NO: 1031498 - RNA, 14 nt, Mycobacterium bovis subsp bovis AF2122/97
guucccgcuugauc

SEQ ID NO: 1031499 - RNA, 18 nt, Mycobacterium bovis subsp bovis AF2122/97
guuccgaucggcaaucga

SEQ ID NO: 1031500 - RNA, 23 nt, Mycobacterium bovis subsp bovis AF2122/97
guuccgcaaugaccuggccgccc

SEQ ID NO: 1031501 - RNA, 16 nt, Mycobacterium bovis subsp bovis AF2122/97
guuccgcaucggcccc

SEQ ID NO: 1031502 - RNA, 22 nt, Mycobacterium bovis subsp bovis AF2122/97
guucccgacaucgugauccccg

SEQ ID NO: 1031503 - RNA, 21 nt, Mycobacterium bovis subsp bovis AF2122/97
guuccccgggcucggugaccc

SEQ ID NO: 1031504 - RNA, 15 nt, Mycobacterium bovis subsp bovis AF2122/97
guuccccgucgccag

SEQ ID NO: 1031505 - RNA, 15 nt, Mycobacterium bovis subsp bovis AF2122/97
guucccgaaccccga

SEQ ID NO: 1031506 - RNA, 16 nt, Mycobacterium bovis subsp bovis AF2122/97
guuccaucacggacca

SEQ ID NO: 1031507 - RNA, 15 nt, Mycobacterium bovis subsp bovis AF2122/97
guuccauacagccgc

SEQ ID NO: 1031508 - RNA, 18 nt, Mycobacterium bovis subsp bovis AF2122/97
guuccauacagccgccga

SEQ ID NO: 1031509 - RNA, 16 nt, Mycobacterium bovis subsp bovis AF2122/97
guucccaccaccaccg

SEQ ID NO: 1031510 - RNA, 20 nt, Mycobacterium bovis subsp bovis AF2122/97
guucccaccaccaccgccgg

SEQ ID NO: 1031511 - RNA, 18 nt, Mycobacterium bovis subsp bovis AF2122/97
guucgccggagacccggg

SEQ ID NO: 1031512 - RNA, 15 nt, Mycobacterium bovis subsp bovis AF2122/97
guucgccgcccggcg

SEQ ID NO: 1031513 - RNA, 18 nt, Mycobacterium bovis subsp bovis AF2122/97
guucgccacgcccgacgc

SEQ ID NO: 1031514 - RNA, 14 nt, Mycobacterium bovis subsp bovis AF2122/97
guucgcccgucgcc

SEQ ID NO: 1031515 - RNA, 21 nt, Mycobacterium bovis subsp bovis AF2122/97
guucgaugggugcaccgaaga

SEQ ID NO: 1031516 - RNA, 19 nt, Mycobacterium bovis subsp bovis AF2122/97
guucgcaccggagucggcg

SEQ ID NO: 1031517 - RNA, 15 nt, Mycobacterium bovis subsp bovis AF2122/97
guucgauggcaucgg

SEQ ID NO: 1031518 - RNA, 21 nt, Mycobacterium bovis subsp bovis AF2122/97
guucgaccaucaucucggugg

SEQ ID NO: 1031519 - RNA, 20 nt, Mycobacterium bovis subsp bovis AF2122/97
guucgacggugccgucugcg

SEQ ID NO: 1031520 - RNA, 21 nt, Mycobacterium bovis subsp bovis AF2122/97
guucgacgucuuugacgaacu

SEQ ID NO: 1031521 - RNA, 14 nt, Mycobacterium bovis subsp bovis AF2122/97
guucgagggugacc

SEQ ID NO: 1031522 - RNA, 18 nt, Mycobacterium bovis subsp bovis AF2122/97
guuccuugaugcggccgc

SEQ ID NO: 1031523 - RNA, 19 nt, Mycobacterium bovis subsp bovis AF2122/97
guuccuugaugcggccgcg

SEQ ID NO: 1031524 - RNA, 14 nt, Mycobacterium bovis subsp bovis AF2122/97
guucgggcaacggc

SEQ ID NO: 1031525 - RNA, 18 nt, Mycobacterium bovis subsp bovis AF2122/97
guucggggcgcaccacga

SEQ ID NO: 1031526 - RNA, 23 nt, Mycobacterium bovis subsp bovis AF2122/97
guucgggacgaaaaaaucgugcg

SEQ ID NO: 1031527 - RNA, 17 nt, Mycobacterium bovis subsp bovis AF2122/97
guucgggcaacggcagc

SEQ ID NO: 1031528 - RNA, 17 nt, Mycobacterium bovis subsp bovis AF2122/97
guucggggcgcgguacc

SEQ ID NO: 1031529 - RNA, 19 nt, Mycobacterium bovis subsp bovis AF2122/97
guucgggucgagccggacc

SEQ ID NO: 1031530 - RNA, 16 nt, Mycobacterium bovis subsp bovis AF2122/97
guucgggucgaucacc

SEQ ID NO: 1031531 - RNA, 20 nt, Mycobacterium bovis subsp bovis AF2122/97
guucgggucgaucaccgaca

SEQ ID NO: 1031532 - RNA, 23 nt, Mycobacterium bovis subsp bovis AF2122/97
guucgggucgaucaccgacaccg

SEQ ID NO: 1031533 - RNA, 14 nt, Mycobacterium bovis subsp bovis AF2122/97
guucggugagccgg

SEQ ID NO: 1031534 - RNA, 18 nt, Mycobacterium bovis subsp bovis AF2122/97
guucggugagccgggcgg

SEQ ID NO: 1031535 - RNA, 17 nt, Mycobacterium bovis subsp bovis AF2122/97
guucggggugcgcccag

SEQ ID NO: 1031536 - RNA, 20 nt, Mycobacterium bovis subsp bovis AF2122/97
guucgggugguuguucggcc

SEQ ID NO: 1031537 - RNA, 15 nt, Mycobacterium bovis subsp bovis AF2122/97
guucggcgucgaccc

SEQ ID NO: 1031538 - RNA, 12 nt, Mycobacterium bovis subsp bovis AF2122/97
guucggcgucgu

SEQ ID NO: 1031539 - RNA, 18 nt, Mycobacterium bovis subsp bovis AF2122/97
guucggcguagaugcgcc

SEQ ID NO: 1031540 - RNA, 22 nt, Mycobacterium bovis subsp bovis AF2122/97
guucggcuaagccuucgguguc

SEQ ID NO: 1031541 - RNA, 17 nt, Mycobacterium bovis subsp bovis AF2122/97
guucggcgucguugccg

SEQ ID NO: 1031542 - RNA, 12 nt, Mycobacterium bovis subsp bovis AF2122/97
guucggcgcuga

SEQ ID NO: 1031543 - RNA, 20 nt, Mycobacterium bovis subsp bovis AF2122/97
guucggcccgcacccguccg

SEQ ID NO: 1031544 - RNA, 18 nt, Mycobacterium bovis subsp bovis AF2122/97
guucggcgcugaucgcgc

SEQ ID NO: 1031545 - RNA, 15 nt, Mycobacterium bovis subsp bovis AF2122/97
guucugcgaucacga

SEQ ID NO: 1031546 - RNA, 17 nt, Mycobacterium bovis subsp bovis AF2122/97
guucugcgcccacccgc

SEQ ID NO: 1031547 - RNA, 21 nt, Mycobacterium bovis subsp bovis AF2122/97
guucuggcaacccccgccggc

SEQ ID NO: 1031548 - RNA, 13 nt, Mycobacterium bovis subsp bovis AF2122/97
guugaccagcacg

SEQ ID NO: 1031549 - RNA, 21 nt, Mycobacterium bovis subsp bovis AF2122/97
guucuuuugcgucugcuggcg

SEQ ID NO: 1031550 - RNA, 17 nt, Mycobacterium bovis subsp bovis AF2122/97
guucuucuccaccaccg

SEQ ID NO: 1031551 - RNA, 22 nt, Mycobacterium bovis subsp bovis AF2122/97
guucuucuccaccaccgucgag

SEQ ID NO: 1031552 - RNA, 15 nt, Mycobacterium bovis subsp bovis AF2122/97
guucggacucacucg

SEQ ID NO: 1031553 - RNA, 16 nt, Mycobacterium bovis subsp bovis AF2122/97
guucggcagcgcggca

SEQ ID NO: 1031554 - RNA, 15 nt, Mycobacterium bovis subsp bovis AF2122/97
guucggccaccaacc

SEQ ID NO: 1031555 - RNA, 21 nt, Mycobacterium bovis subsp bovis AF2122/97
guucggccaccagaaccagcg

SEQ ID NO: 1031556 - RNA, 18 nt, Mycobacterium bovis subsp bovis AF2122/97
guucggccaucguccagc

SEQ ID NO: 1031557 - RNA, 21 nt, Mycobacterium bovis subsp bovis AF2122/97
guucggccaucguccagcagg

SEQ ID NO: 1031558 - RNA, 15 nt, Mycobacterium bovis subsp bovis AF2122/97
guucggccgcggugu

SEQ ID NO: 1031559 - RNA, 17 nt, Mycobacterium bovis subsp bovis AF2122/97
guucggccggagccgcc

SEQ ID NO: 1031560 - RNA, 21 nt, Mycobacterium bovis subsp bovis AF2122/97
guucggccggagccgccggcc

SEQ ID NO: 1031561 - RNA, 20 nt, Mycobacterium bovis subsp bovis AF2122/97
guucggccauggcggcgccg

SEQ ID NO: 1031562 - RNA, 17 nt, Mycobacterium bovis subsp bovis AF2122/97
guucggcaaugacggcc

SEQ ID NO: 1031563 - RNA, 20 nt, Mycobacterium bovis subsp bovis AF2122/97
guucggcaaugacggccugc

SEQ ID NO: 1031564 - RNA, 19 nt, Mycobacterium bovis subsp bovis AF2122/97
guucggcacaaccaacgac

SEQ ID NO: 1031565 - RNA, 17 nt, Mycobacterium bovis subsp bovis AF2122/97
guucgcugaccgcuacc

SEQ ID NO: 1031566 - RNA, 14 nt, Mycobacterium bovis subsp bovis AF2122/97
guucgcugacggcc

SEQ ID NO: 1031567 - RNA, 15 nt, Mycobacterium bovis subsp bovis AF2122/97
guucgcgcgccgcga

SEQ ID NO: 1031568 - RNA, 22 nt, Mycobacterium bovis subsp bovis AF2122/97
guucgcgccacgcacccggcaa

SEQ ID NO: 1031569 - RNA, 17 nt, Mycobacterium bovis subsp bovis AF2122/97
guucgcgcgccgcgacg

SEQ ID NO: 1031570 - RNA, 21 nt, Mycobacterium bovis subsp bovis AF2122/97
guucgcggccaucgccgacac

SEQ ID NO: 1031571 - RNA, 23 nt, Mycobacterium bovis subsp bovis AF2122/97
guucgcgucugacaucgucgacg

SEQ ID NO: 1031572 - RNA, 20 nt, Mycobacterium bovis subsp bovis AF2122/97
guucgcgaagcugugcccgg

SEQ ID NO: 1031573 - RNA, 14 nt, Mycobacterium bovis subsp bovis AF2122/97
guucaacgaggccg

SEQ ID NO: 1031574 - RNA, 16 nt, Mycobacterium bovis subsp bovis AF2122/97
guucaacaccgguaac

SEQ ID NO: 1031575 - RNA, 21 nt, Mycobacterium bovis subsp bovis AF2122/97
guucaaccggacgcccucacg

SEQ ID NO: 1031576 - RNA, 22 nt, Mycobacterium bovis subsp bovis AF2122/97
guucaacuccggcaccggcaac

SEQ ID NO: 1031577 - RNA, 23 nt, Mycobacterium bovis subsp bovis AF2122/97
guucaacuccggcaccggcaaca

SEQ ID NO: 1031578 - RNA, 18 nt, Mycobacterium bovis subsp bovis AF2122/97
guucaacucgggcagcuu

SEQ ID NO: 1031579 - RNA, 15 nt, Mycobacterium bovis subsp bovis AF2122/97
guucaacuugggguc

SEQ ID NO: 1031580 - RNA, 20 nt, Mycobacterium bovis subsp bovis AF2122/97
guuaucgccgagauccgcgc

SEQ ID NO: 1031581 - RNA, 24 nt, Mycobacterium bovis subsp bovis AF2122/97
guuaucccagacugucgagcgacg

SEQ ID NO: 1031582 - RNA, 20 nt, Mycobacterium bovis subsp bovis AF2122/97
guuaugaccucgacgucggg

SEQ ID NO: 1031583 - RNA, 20 nt, Mycobacterium bovis subsp bovis AF2122/97
guuauguauccgcgccgcac

SEQ ID NO: 1031584 - RNA, 22 nt, Mycobacterium bovis subsp bovis AF2122/97
guuaucgucggcuugcugcccc

SEQ ID NO: 1031585 - RNA, 19 nt, Mycobacterium bovis subsp bovis AF2122/97
guuaggaguggccgggcgg

SEQ ID NO: 1031586 - RNA, 22 nt, Mycobacterium bovis subsp bovis AF2122/97
guuagcggugaugggggugcac

SEQ ID NO: 1031587 - RNA, 23 nt, Mycobacterium bovis subsp bovis AF2122/97
guuagccuccagauucgccgccc

SEQ ID NO: 1031588 - RNA, 18 nt, Mycobacterium bovis subsp bovis AF2122/97
guuagccccgaagccggu

SEQ ID NO: 1031589 - RNA, 13 nt, Mycobacterium bovis subsp bovis AF2122/97
guuagccgcggcc

SEQ ID NO: 1031590 - RNA, 13 nt, Mycobacterium bovis subsp bovis AF2122/97
guuacggagggca

SEQ ID NO: 1031591 - RNA, 13 nt, Mycobacterium bovis subsp bovis AF2122/97
guuacgcucggcg

SEQ ID NO: 1031592 - RNA, 19 nt, Mycobacterium bovis subsp bovis AF2122/97
guuagaucacccgcagccg

SEQ ID NO: 1031593 - RNA, 16 nt, Mycobacterium bovis subsp bovis AF2122/97
guuaccaccgucaccg

SEQ ID NO: 1031594 - RNA, 20 nt, Mycobacterium bovis subsp bovis AF2122/97
guuaccaccgucaccgccgg

SEQ ID NO: 1031595 - RNA, 17 nt, Mycobacterium bovis subsp bovis AF2122/97
guuacccggaccgucgu

SEQ ID NO: 1031596 - RNA, 16 nt, Mycobacterium bovis subsp bovis AF2122/97
guuaccgaaggucauc

SEQ ID NO: 1031597 - RNA, 16 nt, Mycobacterium bovis subsp bovis AF2122/97
guuaccgccggcgccg

SEQ ID NO: 1031598 - RNA, 14 nt, Mycobacterium bovis subsp bovis AF2122/97
guuaccgccgucgc

SEQ ID NO: 1031599 - RNA, 16 nt, Mycobacterium bovis subsp bovis AF2122/97
guuaccgccgucgcca

SEQ ID NO: 1031600 - RNA, 16 nt, Mycobacterium bovis subsp bovis AF2122/97
guuaccgccguugccg

SEQ ID NO: 1031601 - RNA, 18 nt, Mycobacterium bovis subsp bovis AF2122/97
guuacgcaucgucagcga

SEQ ID NO: 1031602 - RNA, 23 nt, Mycobacterium bovis subsp bovis AF2122/97
guuacagaugaaggugacgacga

SEQ ID NO: 1031603 - RNA, 22 nt, Mycobacterium bovis subsp bovis AF2122/97
guuacaccaucaaggacucgga

SEQ ID NO: 1031604 - RNA, 16 nt, Mycobacterium bovis subsp bovis AF2122/97
guucaccucggcgacg

SEQ ID NO: 1031605 - RNA, 21 nt, Mycobacterium bovis subsp bovis AF2122/97
guucaccucggcgacgaugau

SEQ ID NO: 1031606 - RNA, 20 nt, Mycobacterium bovis subsp bovis AF2122/97
guucacgcucgacgacgggc

SEQ ID NO: 1031607 - RNA, 18 nt, Mycobacterium bovis subsp bovis AF2122/97
guucacccacuccgccga

SEQ ID NO: 1031608 - RNA, 19 nt, Mycobacterium bovis subsp bovis AF2122/97
guucacccacuccgccgau

SEQ ID NO: 1031609 - RNA, 19 nt, Mycobacterium bovis subsp bovis AF2122/97
guucaccgcgcgcucgccc

SEQ ID NO: 1031610 - RNA, 22 nt, Mycobacterium bovis subsp bovis AF2122/97
guucacccugccagagaucagc

SEQ ID NO: 1031611 - RNA, 13 nt, Mycobacterium bovis subsp bovis AF2122/97
guucacgccgccg

SEQ ID NO: 1031612 - RNA, 13 nt, Mycobacterium bovis subsp bovis AF2122/97
guucacggccgca

SEQ ID NO: 1031613 - RNA, 17 nt, Mycobacterium bovis subsp bovis AF2122/97
guucacggggaccagau

SEQ ID NO: 1031614 - RNA, 14 nt, Mycobacterium bovis subsp bovis AF2122/97
guucacguucggcg

SEQ ID NO: 1031615 - RNA, 17 nt, Mycobacterium bovis subsp bovis AF2122/97
guucacguucggcgacg

SEQ ID NO: 1031616 - RNA, 22 nt, Mycobacterium bovis subsp bovis AF2122/97
guucacguucggcgacgcgccg

SEQ ID NO: 1031617 - RNA, 16 nt, Mycobacterium bovis subsp bovis AF2122/97
guucagcacgugggcc

SEQ ID NO: 1031618 - RNA, 18 nt, Mycobacterium bovis subsp bovis AF2122/97
guucagggguggcgcggg

SEQ ID NO: 1031619 - RNA, 16 nt, Mycobacterium bovis subsp bovis AF2122/97
guucagcgccagcgcc

SEQ ID NO: 1031620 - RNA, 17 nt, Mycobacterium bovis subsp bovis AF2122/97
guucagcggccagcagu

SEQ ID NO: 1031621 - RNA, 16 nt, Mycobacterium bovis subsp bovis AF2122/97
guucagcuuccgaauc

SEQ ID NO: 1031622 - RNA, 20 nt, Mycobacterium bovis subsp bovis AF2122/97
guucagcgcuggcaggccgg

SEQ ID NO: 1031623 - RNA, 14 nt, Mycobacterium bovis subsp bovis AF2122/97
guucagccugagca

SEQ ID NO: 1031624 - RNA, 15 nt, Mycobacterium bovis subsp bovis AF2122/97
guuccagcgcaucga

SEQ ID NO: 1031625 - RNA, 15 nt, Mycobacterium bovis subsp bovis AF2122/97
guuccagcggcaccg

SEQ ID NO: 1031626 - RNA, 18 nt, Mycobacterium bovis subsp bovis AF2122/97
guuccagcggcaccgcgg

SEQ ID NO: 1031627 - RNA, 19 nt, Mycobacterium bovis subsp bovis AF2122/97
guuccagggucacggucgg

SEQ ID NO: 1031628 - RNA, 18 nt, Mycobacterium bovis subsp bovis AF2122/97
guuccaguccccgccggc

SEQ ID NO: 1031629 - RNA, 17 nt, Mycobacterium bovis subsp bovis AF2122/97
guuccagcaucgagcag

SEQ ID NO: 1031630 - RNA, 18 nt, Mycobacterium bovis subsp bovis AF2122/97
guuccagaaggccgcacc

SEQ ID NO: 1031631 - RNA, 20 nt, Mycobacterium bovis subsp bovis AF2122/97
guuccacuccccagccccac

SEQ ID NO: 1031632 - RNA, 19 nt, Mycobacterium bovis subsp bovis AF2122/97
guuccacgacaaccguagg

SEQ ID NO: 1031633 - RNA, 15 nt, Mycobacterium bovis subsp bovis AF2122/97
guuccacgagucguc

SEQ ID NO: 1031634 - RNA, 17 nt, Mycobacterium bovis subsp bovis AF2122/97
guuccacccggugccgc

SEQ ID NO: 1031635 - RNA, 18 nt, Mycobacterium bovis subsp bovis AF2122/97
guuccacccggugccgca

SEQ ID NO: 1031636 - RNA, 14 nt, Mycobacterium bovis subsp bovis AF2122/97
guuccacaccaggc

SEQ ID NO: 1031637 - RNA, 23 nt, Mycobacterium bovis subsp bovis AF2122/97
guuccacaucaaaacggcggugg

SEQ ID NO: 1031638 - RNA, 17 nt, Mycobacterium bovis subsp bovis AF2122/97
guuccaccagcgcccgu

SEQ ID NO: 1031639 - RNA, 17 nt, Mycobacterium bovis subsp bovis AF2122/97
guucaucacgccgccgg

SEQ ID NO: 1031640 - RNA, 16 nt, Mycobacterium bovis subsp bovis AF2122/97
guucaucgccggcgcg

SEQ ID NO: 1031641 - RNA, 20 nt, Mycobacterium bovis subsp bovis AF2122/97
guucaucgcuauggaugggg

SEQ ID NO: 1031642 - RNA, 18 nt, Mycobacterium bovis subsp bovis AF2122/97
guucaucgggcaccaacc

SEQ ID NO: 1031643 - RNA, 22 nt, Mycobacterium bovis subsp bovis AF2122/97
guucaugcggcggcgcucgucg

SEQ ID NO: 1031644 - RNA, 17 nt, Mycobacterium bovis subsp bovis AF2122/97
guuccaacuccugcagc

SEQ ID NO: 1031645 - RNA, 18 nt, Mycobacterium bovis subsp bovis AF2122/97
gugcgugggcgcggcgcc

SEQ ID NO: 1031646 - RNA, 20 nt, Mycobacterium bovis subsp bovis AF2122/97
gugcguugucggcuggacgg

SEQ ID NO: 1031647 - RNA, 21 nt, Mycobacterium bovis subsp bovis AF2122/97
gugcguuugcacuguucgcgg

SEQ ID NO: 1031648 - RNA, 14 nt, Mycobacterium bovis subsp bovis AF2122/97
gugcuaaccgacgc

SEQ ID NO: 1031649 - RNA, 14 nt, Mycobacterium bovis subsp bovis AF2122/97
guggugccggcgcc

SEQ ID NO: 1031650 - RNA, 13 nt, Mycobacterium bovis subsp bovis AF2122/97
guggugucgcggc

SEQ ID NO: 1031651 - RNA, 12 nt, Mycobacterium bovis subsp bovis AF2122/97
guggugucgcuc

SEQ ID NO: 1031652 - RNA, 13 nt, Mycobacterium bovis subsp bovis AF2122/97
guggugucggcga

SEQ ID NO: 1031653 - RNA, 18 nt, Mycobacterium bovis subsp bovis AF2122/97
guggugucgguucgucgg

SEQ ID NO: 1031654 - RNA, 14 nt, Mycobacterium bovis subsp bovis AF2122/97
guggugcucgucgg

SEQ ID NO: 1031655 - RNA, 15 nt, Mycobacterium bovis subsp bovis AF2122/97
gugguggacgaugcg

SEQ ID NO: 1031656 - RNA, 14 nt, Mycobacterium bovis subsp bovis AF2122/97
gugguggcgguguu

SEQ ID NO: 1031657 - RNA, 13 nt, Mycobacterium bovis subsp bovis AF2122/97
guggugggcggga

SEQ ID NO: 1031658 - RNA, 13 nt, Mycobacterium bovis subsp bovis AF2122/97
guggugggcgugg

SEQ ID NO: 1031659 - RNA, 13 nt, Mycobacterium bovis subsp bovis AF2122/97
guggugggccgug

SEQ ID NO: 1031660 - RNA, 17 nt, Mycobacterium bovis subsp bovis AF2122/97
guguagaucagcaacgg

SEQ ID NO: 1031661 - RNA, 14 nt, Mycobacterium bovis subsp bovis AF2122/97
guguagcagcgcca

SEQ ID NO: 1031662 - RNA, 20 nt, Mycobacterium bovis subsp bovis AF2122/97
guguagaagcgggcgucgcg

SEQ ID NO: 1031663 - RNA, 16 nt, Mycobacterium bovis subsp bovis AF2122/97
guguagccgagcacgg

SEQ ID NO: 1031664 - RNA, 14 nt, Mycobacterium bovis subsp bovis AF2122/97
guguagggcggcgu

SEQ ID NO: 1031665 - RNA, 13 nt, Mycobacterium bovis subsp bovis AF2122/97
guguagccgccgg

SEQ ID NO: 1031666 - RNA, 14 nt, Mycobacterium bovis subsp bovis AF2122/97
guguagccgccggc

SEQ ID NO: 1031667 - RNA, 19 nt, Mycobacterium bovis subsp bovis AF2122/97
guguacagucgcgcgcucg

SEQ ID NO: 1031668 - RNA, 16 nt, Mycobacterium bovis subsp bovis AF2122/97
guguaauugccgacgc

SEQ ID NO: 1031669 - RNA, 12 nt, Mycobacterium bovis subsp bovis AF2122/97
guguaccgcgac

SEQ ID NO: 1031670 - RNA, 17 nt, Mycobacterium bovis subsp bovis AF2122/97
gugguugccgaagccgg

SEQ ID NO: 1031671 - RNA, 16 nt, Mycobacterium bovis subsp bovis AF2122/97
gugguugcggccgucg

SEQ ID NO: 1031672 - RNA, 14 nt, Mycobacterium bovis subsp bovis AF2122/97
gugguugaucagcc

SEQ ID NO: 1031673 - RNA, 19 nt, Mycobacterium bovis subsp bovis AF2122/97
gugguucaccucggcgacg

SEQ ID NO: 1031674 - RNA, 13 nt, Mycobacterium bovis subsp bovis AF2122/97
gugguucgaaccg

SEQ ID NO: 1031675 - RNA, 18 nt, Mycobacterium bovis subsp bovis AF2122/97
gugguuuucccgucgccg

SEQ ID NO: 1031676 - RNA, 22 nt, Mycobacterium bovis subsp bovis AF2122/97
gugguuuucccgucgccgcccg

SEQ ID NO: 1031677 - RNA, 20 nt, Mycobacterium bovis subsp bovis AF2122/97
guguacaccgcgcccgccga

SEQ ID NO: 1031678 - RNA, 18 nt, Mycobacterium bovis subsp bovis AF2122/97
gugucgaaaucgauuccg

SEQ ID NO: 1031679 - RNA, 12 nt, Mycobacterium bovis subsp bovis AF2122/97
guguccgccgga

SEQ ID NO: 1031680 - RNA, 23 nt, Mycobacterium bovis subsp bovis AF2122/97
guguccgccggauagcaccggca

SEQ ID NO: 1031681 - RNA, 17 nt, Mycobacterium bovis subsp bovis AF2122/97
guguccggggaccucgg

SEQ ID NO: 1031682 - RNA, 12 nt, Mycobacterium bovis subsp bovis AF2122/97
guguccgccgaa

SEQ ID NO: 1031683 - RNA, 13 nt, Mycobacterium bovis subsp bovis AF2122/97
gugucacccucgg

SEQ ID NO: 1031684 - RNA, 19 nt, Mycobacterium bovis subsp bovis AF2122/97
guguccaccaccggcaccc

SEQ ID NO: 1031685 - RNA, 15 nt, Mycobacterium bovis subsp bovis AF2122/97
guguaucgacggcgg

SEQ ID NO: 1031686 - RNA, 15 nt, Mycobacterium bovis subsp bovis AF2122/97
gugucaccgccggga

SEQ ID NO: 1031687 - RNA, 12 nt, Mycobacterium bovis subsp bovis AF2122/97
gugucaccggcg

SEQ ID NO: 1031688 - RNA, 16 nt, Mycobacterium bovis subsp bovis AF2122/97
gugucacgcgaccacc

SEQ ID NO: 1031689 - RNA, 13 nt, Mycobacterium bovis subsp bovis AF2122/97
gugucaccgccgg

SEQ ID NO: 1031690 - RNA, 19 nt, Mycobacterium bovis subsp bovis AF2122/97
gugucaaugugguucgucg

SEQ ID NO: 1031691 - RNA, 20 nt, Mycobacterium bovis subsp bovis AF2122/97
gugucagguaauucguccac

SEQ ID NO: 1031692 - RNA, 20 nt, Mycobacterium bovis subsp bovis AF2122/97
gugucggugguaccggcggc

SEQ ID NO: 1031693 - RNA, 21 nt, Mycobacterium bovis subsp bovis AF2122/97
gugucgguucggucggccugc

SEQ ID NO: 1031694 - RNA, 12 nt, Mycobacterium bovis subsp bovis AF2122/97
gugucgucgagg

SEQ ID NO: 1031695 - RNA, 18 nt, Mycobacterium bovis subsp bovis AF2122/97
gugucgucgaucgcggac

SEQ ID NO: 1031696 - RNA, 22 nt, Mycobacterium bovis subsp bovis AF2122/97
gugucgggugugcaggccgcgg

SEQ ID NO: 1031697 - RNA, 14 nt, Mycobacterium bovis subsp bovis AF2122/97
gugucggcgccgaa

SEQ ID NO: 1031698 - RNA, 16 nt, Mycobacterium bovis subsp bovis AF2122/97
gugucgcggccgcccc

SEQ ID NO: 1031699 - RNA, 23 nt, Mycobacterium bovis subsp bovis AF2122/97
gugucggggcccccgccggacac

SEQ ID NO: 1031700 - RNA, 17 nt, Mycobacterium bovis subsp bovis AF2122/97
gugucggcgagagggcg

SEQ ID NO: 1031701 - RNA, 12 nt, Mycobacterium bovis subsp bovis AF2122/97
gugucggccagc

SEQ ID NO: 1031702 - RNA, 23 nt, Mycobacterium bovis subsp bovis AF2122/97
gugucgcugcaaccgccggugcc

SEQ ID NO: 1031703 - RNA, 13 nt, Mycobacterium bovis subsp bovis AF2122/97
gugucgccgucgc

SEQ ID NO: 1031704 - RNA, 22 nt, Mycobacterium bovis subsp bovis AF2122/97
gugucgccacaccggggcggcc

SEQ ID NO: 1031705 - RNA, 19 nt, Mycobacterium bovis subsp bovis AF2122/97
gugucgccgaucaccgcau

SEQ ID NO: 1031706 - RNA, 20 nt, Mycobacterium bovis subsp bovis AF2122/97
gugucgccgaucaccgcauc

SEQ ID NO: 1031707 - RNA, 14 nt, Mycobacterium bovis subsp bovis AF2122/97
gugucgccgccguu

SEQ ID NO: 1031708 - RNA, 15 nt, Mycobacterium bovis subsp bovis AF2122/97
gugucgccgcucggu

SEQ ID NO: 1031709 - RNA, 20 nt, Mycobacterium bovis subsp bovis AF2122/97
gugucgccgcucgguccccg

SEQ ID NO: 1031710 - RNA, 22 nt, Mycobacterium bovis subsp bovis AF2122/97
gugucgacgcgggcguugacga

SEQ ID NO: 1031711 - RNA, 19 nt, Mycobacterium bovis subsp bovis AF2122/97
gugucgacuccgaucgggc

SEQ ID NO: 1031712 - RNA, 14 nt, Mycobacterium bovis subsp bovis AF2122/97
gugugcgucgaggu

SEQ ID NO: 1031713 - RNA, 20 nt, Mycobacterium bovis subsp bovis AF2122/97
gugugcggcauugguaccgg

SEQ ID NO: 1031714 - RNA, 13 nt, Mycobacterium bovis subsp bovis AF2122/97
gugugcgugcggu

SEQ ID NO: 1031715 - RNA, 15 nt, Mycobacterium bovis subsp bovis AF2122/97
gugugcgugucaccc

SEQ ID NO: 1031716 - RNA, 14 nt, Mycobacterium bovis subsp bovis AF2122/97
gugugcgacgacgg

SEQ ID NO: 1031717 - RNA, 19 nt, Mycobacterium bovis subsp bovis AF2122/97
gugugcggaagcaucggcu

SEQ ID NO: 1031718 - RNA, 19 nt, Mycobacterium bovis subsp bovis AF2122/97
gugugcggacaguucccgg

SEQ ID NO: 1031719 - RNA, 18 nt, Mycobacterium bovis subsp bovis AF2122/97
gugugcaggccgcggaga

SEQ ID NO: 1031720 - RNA, 16 nt, Mycobacterium bovis subsp bovis AF2122/97
gugucgugguagcggu

SEQ ID NO: 1031721 - RNA, 22 nt, Mycobacterium bovis subsp bovis AF2122/97
gugucgucgguguuccgccgcg

SEQ ID NO: 1031722 - RNA, 15 nt, Mycobacterium bovis subsp bovis AF2122/97
gugucuacgccggga

SEQ ID NO: 1031723 - RNA, 20 nt, Mycobacterium bovis subsp bovis AF2122/97
gugucucccuugccgccauu

SEQ ID NO: 1031724 - RNA, 22 nt, Mycobacterium bovis subsp bovis AF2122/97
gugucugccaugugucccggac

SEQ ID NO: 1031725 - RNA, 14 nt, Mycobacterium bovis subsp bovis AF2122/97
gugucugcccgagg

SEQ ID NO: 1031726 - RNA, 14 nt, Mycobacterium bovis subsp bovis AF2122/97
gugugaggccuucg

SEQ ID NO: 1031727 - RNA, 13 nt, Mycobacterium bovis subsp bovis AF2122/97
gugugacggcggc

SEQ ID NO: 1031728 - RNA, 14 nt, Mycobacterium bovis subsp bovis AF2122/97
gugugacggcggcc

SEQ ID NO: 1031729 - RNA, 23 nt, Mycobacterium bovis subsp bovis AF2122/97
gugugagaucguagggacgccga

SEQ ID NO: 1031730 - RNA, 15 nt, Mycobacterium bovis subsp bovis AF2122/97
gugugaagaccaccg

SEQ ID NO: 1031731 - RNA, 15 nt, Mycobacterium bovis subsp bovis AF2122/97
gugucugcucgccga

SEQ ID NO: 1031732 - RNA, 22 nt, Mycobacterium bovis subsp bovis AF2122/97
gugucugggaccccgcugcgac

SEQ ID NO: 1031733 - RNA, 21 nt, Mycobacterium bovis subsp bovis AF2122/97
guguucggugguccuggcgaa

SEQ ID NO: 1031734 - RNA, 23 nt, Mycobacterium bovis subsp bovis AF2122/97
guguucagcuucgccagguggcc

SEQ ID NO: 1031735 - RNA, 19 nt, Mycobacterium bovis subsp bovis AF2122/97
guguucaucacgccgccgg

SEQ ID NO: 1031736 - RNA, 16 nt, Mycobacterium bovis subsp bovis AF2122/97
guguuacgguucgacc

SEQ ID NO: 1031737 - RNA, 15 nt, Mycobacterium bovis subsp bovis AF2122/97
gugugcugccaccgg

SEQ ID NO: 1031738 - RNA, 19 nt, Mycobacterium bovis subsp bovis AF2122/97
gugugcucgccgaccagcu

SEQ ID NO: 1031739 - RNA, 13 nt, Mycobacterium bovis subsp bovis AF2122/97
gugugcucgucgc

SEQ ID NO: 1031740 - RNA, 19 nt, Mycobacterium bovis subsp bovis AF2122/97
gugugcucgucgccugcga

SEQ ID NO: 1031741 - RNA, 22 nt, Mycobacterium bovis subsp bovis AF2122/97
guguggacuucagcaggcccag

SEQ ID NO: 1031742 - RNA, 23 nt, Mycobacterium bovis subsp bovis AF2122/97
guguggacuucagcaggcccagc

SEQ ID NO: 1031743 - RNA, 19 nt, Mycobacterium bovis subsp bovis AF2122/97
guguggaauggaccagcgc

SEQ ID NO: 1031744 - RNA, 14 nt, Mycobacterium bovis subsp bovis AF2122/97
guguggcccaacac

SEQ ID NO: 1031745 - RNA, 23 nt, Mycobacterium bovis subsp bovis AF2122/97
guguggccuugcgucaucggcuc

SEQ ID NO: 1031746 - RNA, 13 nt, Mycobacterium bovis subsp bovis AF2122/97
guguggcgccggg

SEQ ID NO: 1031747 - RNA, 14 nt, Mycobacterium bovis subsp bovis AF2122/97
guguggcgccgggg

SEQ ID NO: 1031748 - RNA, 20 nt, Mycobacterium bovis subsp bovis AF2122/97
guguggcgccggggaccacg

SEQ ID NO: 1031749 - RNA, 13 nt, Mycobacterium bovis subsp bovis AF2122/97
guguggcggcggg

SEQ ID NO: 1031750 - RNA, 19 nt, Mycobacterium bovis subsp bovis AF2122/97
guguggcuuugacugcugg

SEQ ID NO: 1031751 - RNA, 14 nt, Mycobacterium bovis subsp bovis AF2122/97
gugugggccccgcc

SEQ ID NO: 1031752 - RNA, 23 nt, Mycobacterium bovis subsp bovis AF2122/97
guguggucccggcacgaccaccg

SEQ ID NO: 1031753 - RNA, 18 nt, Mycobacterium bovis subsp bovis AF2122/97
guuaaugaccgcguccac

SEQ ID NO: 1031754 - RNA, 17 nt, Mycobacterium bovis subsp bovis AF2122/97
guuaacacccugggcaa

SEQ ID NO: 1031755 - RNA, 15 nt, Mycobacterium bovis subsp bovis AF2122/97
guguucuggucgcgu

SEQ ID NO: 1031756 - RNA, 20 nt, Mycobacterium bovis subsp bovis AF2122/97
guguucgucgaccaugcgac

SEQ ID NO: 1031757 - RNA, 16 nt, Mycobacterium bovis subsp bovis AF2122/97
guguucguggccgaca

SEQ ID NO: 1031758 - RNA, 16 nt, Mycobacterium bovis subsp bovis AF2122/97
guguucggcccgcacc

SEQ ID NO: 1031759 - RNA, 12 nt, Mycobacterium bovis subsp bovis AF2122/97
guguugaccagg

SEQ ID NO: 1031760 - RNA, 19 nt, Mycobacterium bovis subsp bovis AF2122/97
guguugagggugcccgagu

SEQ ID NO: 1031761 - RNA, 18 nt, Mycobacterium bovis subsp bovis AF2122/97
guguugaugggcagccgc

SEQ ID NO: 1031762 - RNA, 23 nt, Mycobacterium bovis subsp bovis AF2122/97
guguugaugggcagccgcccgcc

SEQ ID NO: 1031763 - RNA, 19 nt, Mycobacterium bovis subsp bovis AF2122/97
guguugccguuaccgccaa

SEQ ID NO: 1031764 - RNA, 15 nt, Mycobacterium bovis subsp bovis AF2122/97
guguugccgacgaga

SEQ ID NO: 1031765 - RNA, 13 nt, Mycobacterium bovis subsp bovis AF2122/97
guguugcgguggg

SEQ ID NO: 1031766 - RNA, 19 nt, Mycobacterium bovis subsp bovis AF2122/97
guguugccagaucagcacc

SEQ ID NO: 1031767 - RNA, 19 nt, Mycobacterium bovis subsp bovis AF2122/97
guguugguggccgggucga

SEQ ID NO: 1031768 - RNA, 19 nt, Mycobacterium bovis subsp bovis AF2122/97
guguugguguucgggucga

SEQ ID NO: 1031769 - RNA, 22 nt, Mycobacterium bovis subsp bovis AF2122/97
guguuggaagucccgccguugc

SEQ ID NO: 1031770 - RNA, 16 nt, Mycobacterium bovis subsp bovis AF2122/97
guguuggccgggucgu

SEQ ID NO: 1031771 - RNA, 20 nt, Mycobacterium bovis subsp bovis AF2122/97
guguuuauggcccugggccc

SEQ ID NO: 1031772 - RNA, 14 nt, Mycobacterium bovis subsp bovis AF2122/97
guguuugucgcggu

SEQ ID NO: 1031773 - RNA, 20 nt, Mycobacterium bovis subsp bovis AF2122/97
guguuuuuguauguucggcg

SEQ ID NO: 1031774 - RNA, 24 nt, Mycobacterium bovis subsp bovis AF2122/97
guguuugcggcuucggcagaccgg

SEQ ID NO: 1031775 - RNA, 21 nt, Mycobacterium bovis subsp bovis AF2122/97
uaaaccgcugcuugucgaggc

SEQ ID NO: 1031776 - RNA, 15 nt, Mycobacterium bovis subsp bovis AF2122/97
uaaacagcgcgccgg

SEQ ID NO: 1031777 - RNA, 19 nt, Mycobacterium bovis subsp bovis AF2122/97
guuucaccacucggucguu

SEQ ID NO: 1031778 - RNA, 16 nt, Mycobacterium bovis subsp bovis AF2122/97
guuucaccgacgacgc

SEQ ID NO: 1031779 - RNA, 19 nt, Mycobacterium bovis subsp bovis AF2122/97
uaacgccaagcucggccca

SEQ ID NO: 1031780 - RNA, 12 nt, Mycobacterium bovis subsp bovis AF2122/97
uaaccuggcggu

SEQ ID NO: 1031781 - RNA, 16 nt, Mycobacterium bovis subsp bovis AF2122/97
uaacccaaccgcgcca

SEQ ID NO: 1031782 - RNA, 21 nt, Mycobacterium bovis subsp bovis AF2122/97
uaaaugccugcccaccuucga

SEQ ID NO: 1031783 - RNA, 18 nt, Mycobacterium bovis subsp bovis AF2122/97
uaaaugcuucgaccgccg

SEQ ID NO: 1031784 - RNA, 18 nt, Mycobacterium bovis subsp bovis AF2122/97
uacagcaccccgccgggg

SEQ ID NO: 1031785 - RNA, 14 nt, Mycobacterium bovis subsp bovis AF2122/97
uacagcaucaaccg

SEQ ID NO: 1031786 - RNA, 21 nt, Mycobacterium bovis subsp bovis AF2122/97
uaauucaacagcaccgcgacg

SEQ ID NO: 1031787 - RNA, 23 nt, Mycobacterium bovis subsp bovis AF2122/97
uaauucaacagcaccgcgacgac

SEQ ID NO: 1031788 - RNA, 14 nt, Mycobacterium bovis subsp bovis AF2122/97
uaaugccagcggca

SEQ ID NO: 1031789 - RNA, 15 nt, Mycobacterium bovis subsp bovis AF2122/97
uaauccagcgccgac

SEQ ID NO: 1031790 - RNA, 22 nt, Mycobacterium bovis subsp bovis AF2122/97
uaauccuuugggguugcuggug

SEQ ID NO: 1031791 - RNA, 11 nt, Mycobacterium bovis subsp bovis AF2122/97
uaaucgccacc

SEQ ID NO: 1031792 - RNA, 19 nt, Mycobacterium bovis subsp bovis AF2122/97
uaauagcuguuggccagcc

SEQ ID NO: 1031793 - RNA, 19 nt, Mycobacterium bovis subsp bovis AF2122/97
uaagcccggucgcugaucc

SEQ ID NO: 1031794 - RNA, 15 nt, Mycobacterium bovis subsp bovis AF2122/97
uaacuguccgcccgg

SEQ ID NO: 1031795 - RNA, 21 nt, Mycobacterium bovis subsp bovis AF2122/97
uaacucgccugcacccggcga

SEQ ID NO: 1031796 - RNA, 22 nt, Mycobacterium bovis subsp bovis AF2122/97
uaagcgguuguccggucgccaa

SEQ ID NO: 1031797 - RNA, 15 nt, Mycobacterium bovis subsp bovis AF2122/97
uaagcgauucccaac

SEQ ID NO: 1031798 - RNA, 23 nt, Mycobacterium bovis subsp bovis AF2122/97
uaccacggaggguugccgccgac

SEQ ID NO: 1031799 - RNA, 15 nt, Mycobacterium bovis subsp bovis AF2122/97
uaccacggcgauccg

SEQ ID NO: 1031800 - RNA, 11 nt, Mycobacterium bovis subsp bovis AF2122/97
uaccacgggcu

SEQ ID NO: 1031801 - RNA, 19 nt, Mycobacterium bovis subsp bovis AF2122/97
uaccacgguggucccccgc

SEQ ID NO: 1031802 - RNA, 12 nt, Mycobacterium bovis subsp bovis AF2122/97
uaccaccgccgc

SEQ ID NO: 1031803 - RNA, 21 nt, Mycobacterium bovis subsp bovis AF2122/97
uaccacuuugcguucccaucc

SEQ ID NO: 1031804 - RNA, 22 nt, Mycobacterium bovis subsp bovis AF2122/97
uaccagccgaagaaccggucgc

SEQ ID NO: 1031805 - RNA, 12 nt, Mycobacterium bovis subsp bovis AF2122/97
uacaucagcgcg

SEQ ID NO: 1031806 - RNA, 23 nt, Mycobacterium bovis subsp bovis AF2122/97
uaccaacguuuugggcgccggag

SEQ ID NO: 1031807 - RNA, 20 nt, Mycobacterium bovis subsp bovis AF2122/97
uacaguccacgcguagcggu

SEQ ID NO: 1031808 - RNA, 23 nt, Mycobacterium bovis subsp bovis AF2122/97
uacagcgcaaagcccuccucgau

SEQ ID NO: 1031809 - RNA, 21 nt, Mycobacterium bovis subsp bovis AF2122/97
uacccguagcaccacaucggu

SEQ ID NO: 1031810 - RNA, 15 nt, Mycobacterium bovis subsp bovis AF2122/97
uaccgaaaucaccuc

SEQ ID NO: 1031811 - RNA, 21 nt, Mycobacterium bovis subsp bovis AF2122/97
uacccggacagggcggcgagg

SEQ ID NO: 1031812 - RNA, 16 nt, Mycobacterium bovis subsp bovis AF2122/97
uaccccgacggcgacc

SEQ ID NO: 1031813 - RNA, 19 nt, Mycobacterium bovis subsp bovis AF2122/97
uaccccuccgaucacgcug

SEQ ID NO: 1031814 - RNA, 13 nt, Mycobacterium bovis subsp bovis AF2122/97
uaccaggcgccgu

SEQ ID NO: 1031815 - RNA, 16 nt, Mycobacterium bovis subsp bovis AF2122/97
uacccccgauggcguc

SEQ ID NO: 1031816 - RNA, 16 nt, Mycobacterium bovis subsp bovis AF2122/97
uacccauucggcggcg

SEQ ID NO: 1031817 - RNA, 18 nt, Mycobacterium bovis subsp bovis AF2122/97
uaccccagaccgccacac

SEQ ID NO: 1031818 - RNA, 19 nt, Mycobacterium bovis subsp bovis AF2122/97
uacccaucaacaucggccc

SEQ ID NO: 1031819 - RNA, 18 nt, Mycobacterium bovis subsp bovis AF2122/97
uaccggccuuuccagcac

SEQ ID NO: 1031820 - RNA, 17 nt, Mycobacterium bovis subsp bovis AF2122/97
uaccggcuacggcgaca

SEQ ID NO: 1031821 - RNA, 22 nt, Mycobacterium bovis subsp bovis AF2122/97
uaccggcuucgucggccagcag

SEQ ID NO: 1031822 - RNA, 19 nt, Mycobacterium bovis subsp bovis AF2122/97
uaccgggaucccacggcgg

SEQ ID NO: 1031823 - RNA, 17 nt, Mycobacterium bovis subsp bovis AF2122/97
uaccggcacgccggcgg

SEQ ID NO: 1031824 - RNA, 22 nt, Mycobacterium bovis subsp bovis AF2122/97
uaccgcuggggcuguagucgau

SEQ ID NO: 1031825 - RNA, 19 nt, Mycobacterium bovis subsp bovis AF2122/97
uaccgccguuugcgccguu

SEQ ID NO: 1031826 - RNA, 17 nt, Mycobacterium bovis subsp bovis AF2122/97
uaccgccguuaccgacg

SEQ ID NO: 1031827 - RNA, 19 nt, Mycobacterium bovis subsp bovis AF2122/97
uaccgccguuaccgacgcc

SEQ ID NO: 1031828 - RNA, 15 nt, Mycobacterium bovis subsp bovis AF2122/97
uaccgccgcugccga

SEQ ID NO: 1031829 - RNA, 20 nt, Mycobacterium bovis subsp bovis AF2122/97
uaccgccggccccaccggug

SEQ ID NO: 1031830 - RNA, 20 nt, Mycobacterium bovis subsp bovis AF2122/97
uaccgccuuugcccgccgcg

SEQ ID NO: 1031831 - RNA, 14 nt, Mycobacterium bovis subsp bovis AF2122/97
uaccgcccgcgcca

SEQ ID NO: 1031832 - RNA, 20 nt, Mycobacterium bovis subsp bovis AF2122/97
uaccgcccgcgccaccggca

SEQ ID NO: 1031833 - RNA, 14 nt, Mycobacterium bovis subsp bovis AF2122/97
uaccgacgccggug

SEQ ID NO: 1031834 - RNA, 18 nt, Mycobacterium bovis subsp bovis AF2122/97
uaccgaggccaugcucgc

SEQ ID NO: 1031835 - RNA, 16 nt, Mycobacterium bovis subsp bovis AF2122/97
uaccgagaucaccgcc

SEQ ID NO: 1031836 - RNA, 14 nt, Mycobacterium bovis subsp bovis AF2122/97
uaccgaucgccaag

SEQ ID NO: 1031837 - RNA, 16 nt, Mycobacterium bovis subsp bovis AF2122/97
uaccgcaggugccacc

SEQ ID NO: 1031838 - RNA, 14 nt, Mycobacterium bovis subsp bovis AF2122/97
uaccgcacccuggg

SEQ ID NO: 1031839 - RNA, 13 nt, Mycobacterium bovis subsp bovis AF2122/97
uacgcaucgccgu

SEQ ID NO: 1031840 - RNA, 23 nt, Mycobacterium bovis subsp bovis AF2122/97
uacgccaccggcaaucggcggca

SEQ ID NO: 1031841 - RNA, 19 nt, Mycobacterium bovis subsp bovis AF2122/97
uacgcaccgaggccgccga

SEQ ID NO: 1031842 - RNA, 15 nt, Mycobacterium bovis subsp bovis AF2122/97
uacgcaacgggucgg

SEQ ID NO: 1031843 - RNA, 22 nt, Mycobacterium bovis subsp bovis AF2122/97
uaccgguugcggucaucggcgc

SEQ ID NO: 1031844 - RNA, 19 nt, Mycobacterium bovis subsp bovis AF2122/97
uaccggugguagcggcggu

SEQ ID NO: 1031845 - RNA, 17 nt, Mycobacterium bovis subsp bovis AF2122/97
uaccggcggcgccgggg

SEQ ID NO: 1031846 - RNA, 19 nt, Mycobacterium bovis subsp bovis AF2122/97
uaccgggcccgcguucucg

SEQ ID NO: 1031847 - RNA, 21 nt, Mycobacterium bovis subsp bovis AF2122/97
uaccgguccgucaccaccgcc

SEQ ID NO: 1031848 - RNA, 23 nt, Mycobacterium bovis subsp bovis AF2122/97
uaccgguccgucaccaccgccgc

SEQ ID NO: 1031849 - RNA, 14 nt, Mycobacterium bovis subsp bovis AF2122/97
uacgaggacgacga

SEQ ID NO: 1031850 - RNA, 16 nt, Mycobacterium bovis subsp bovis AF2122/97
uaccgugccgcccggu

SEQ ID NO: 1031851 - RNA, 16 nt, Mycobacterium bovis subsp bovis AF2122/97
uaccgucaugggcggc

SEQ ID NO: 1031852 - RNA, 13 nt, Mycobacterium bovis subsp bovis AF2122/97
uaccgucgaccac

SEQ ID NO: 1031853 - RNA, 19 nt, Mycobacterium bovis subsp bovis AF2122/97
uagcccgauggugccgacc

SEQ ID NO: 1031854 - RNA, 22 nt, Mycobacterium bovis subsp bovis AF2122/97
uagcccgauggugccgacccgc

SEQ ID NO: 1031855 - RNA, 13 nt, Mycobacterium bovis subsp bovis AF2122/97
uagcccggccgcg

SEQ ID NO: 1031856 - RNA, 16 nt, Mycobacterium bovis subsp bovis AF2122/97
uagccgaccggcagcg

SEQ ID NO: 1031857 - RNA, 20 nt, Mycobacterium bovis subsp bovis AF2122/97
uagccgaccggcagcgaugc

SEQ ID NO: 1031858 - RNA, 18 nt, Mycobacterium bovis subsp bovis AF2122/97
uagccgacgucgccgacg

SEQ ID NO: 1031859 - RNA, 19 nt, Mycobacterium bovis subsp bovis AF2122/97
uagccgacuaucggccgcc

SEQ ID NO: 1031860 - RNA, 20 nt, Mycobacterium bovis subsp bovis AF2122/97
uagccgaggaaguccagcug

SEQ ID NO: 1031861 - RNA, 14 nt, Mycobacterium bovis subsp bovis AF2122/97
uagccgaacagcgg

SEQ ID NO: 1031862 - RNA, 22 nt, Mycobacterium bovis subsp bovis AF2122/97
uagccauccgugaaucgagcac

SEQ ID NO: 1031863 - RNA, 18 nt, Mycobacterium bovis subsp bovis AF2122/97
uagcccaggucgaugcgg

SEQ ID NO: 1031864 - RNA, 22 nt, Mycobacterium bovis subsp bovis AF2122/97
uagcccccgcgggggcggccgg

SEQ ID NO: 1031865 - RNA, 16 nt, Mycobacterium bovis subsp bovis AF2122/97
uagcccaugccgaugc

SEQ ID NO: 1031866 - RNA, 14 nt, Mycobacterium bovis subsp bovis AF2122/97
uagcgcaaccgcgc

SEQ ID NO: 1031867 - RNA, 17 nt, Mycobacterium bovis subsp bovis AF2122/97
uagcgcaaugcggcccg

SEQ ID NO: 1031868 - RNA, 22 nt, Mycobacterium bovis subsp bovis AF2122/97
uagcgcaccaccgucucgccgc

SEQ ID NO: 1031869 - RNA, 16 nt, Mycobacterium bovis subsp bovis AF2122/97
uagccgccggcgccga

SEQ ID NO: 1031870 - RNA, 21 nt, Mycobacterium bovis subsp bovis AF2122/97
uagccgccguggauacgcacg

SEQ ID NO: 1031871 - RNA, 18 nt, Mycobacterium bovis subsp bovis AF2122/97
uagccgaccaggaccacc

SEQ ID NO: 1031872 - RNA, 18 nt, Mycobacterium bovis subsp bovis AF2122/97
uagccgcagaugcaguuc

SEQ ID NO: 1031873 - RNA, 17 nt, Mycobacterium bovis subsp bovis AF2122/97
uagccgcagccccgaca

SEQ ID NO: 1031874 - RNA, 23 nt, Mycobacterium bovis subsp bovis AF2122/97
uagcgcaugucgauccggcgcca

SEQ ID NO: 1031875 - RNA, 16 nt, Mycobacterium bovis subsp bovis AF2122/97
uagcgcacugccgggu

SEQ ID NO: 1031876 - RNA, 20 nt, Mycobacterium bovis subsp bovis AF2122/97
uagcgcaggagcgcgaugac

SEQ ID NO: 1031877 - RNA, 20 nt, Mycobacterium bovis subsp bovis AF2122/97
uagcgcagcgccuccucgau

SEQ ID NO: 1031878 - RNA, 20 nt, Mycobacterium bovis subsp bovis AF2122/97
uagccagcaggaacgccgug

SEQ ID NO: 1031879 - RNA, 15 nt, Mycobacterium bovis subsp bovis AF2122/97
uagccaggucgauac

SEQ ID NO: 1031880 - RNA, 21 nt, Mycobacterium bovis subsp bovis AF2122/97
uagccagucggccaccugguc

SEQ ID NO: 1031881 - RNA, 22 nt, Mycobacterium bovis subsp bovis AF2122/97
uagccaaugcccuuggccagca

SEQ ID NO: 1031882 - RNA, 17 nt, Mycobacterium bovis subsp bovis AF2122/97
uagcagguguaggugcc

SEQ ID NO: 1031883 - RNA, 17 nt, Mycobacterium bovis subsp bovis AF2122/97
uagcauugucgccggau

SEQ ID NO: 1031884 - RNA, 21 nt, Mycobacterium bovis subsp bovis AF2122/97
uagcacagcagcaacgcggug

SEQ ID NO: 1031885 - RNA, 22 nt, Mycobacterium bovis subsp bovis AF2122/97
uagcaccaguuugugccgccgc

SEQ ID NO: 1031886 - RNA, 23 nt, Mycobacterium bovis subsp bovis AF2122/97
uagcaccaguuugugccgccgcg

SEQ ID NO: 1031887 - RNA, 13 nt, Mycobacterium bovis subsp bovis AF2122/97
uagcaccgcgccg

SEQ ID NO: 1031888 - RNA, 19 nt, Mycobacterium bovis subsp bovis AF2122/97
uagcaacgguagcggcggg

SEQ ID NO: 1031889 - RNA, 18 nt, Mycobacterium bovis subsp bovis AF2122/97
uagacgacgucggccgca

SEQ ID NO: 1031890 - RNA, 15 nt, Mycobacterium bovis subsp bovis AF2122/97
uagacggggcgagca

SEQ ID NO: 1031891 - RNA, 20 nt, Mycobacterium bovis subsp bovis AF2122/97
uagacggggcgagcaugccg

SEQ ID NO: 1031892 - RNA, 20 nt, Mycobacterium bovis subsp bovis AF2122/97
uagacguagaaugcgccguc

SEQ ID NO: 1031893 - RNA, 15 nt, Mycobacterium bovis subsp bovis AF2122/97
uagaccgagcccgau

SEQ ID NO: 1031894 - RNA, 22 nt, Mycobacterium bovis subsp bovis AF2122/97
uagacccacagucgccggccgg

SEQ ID NO: 1031895 - RNA, 18 nt, Mycobacterium bovis subsp bovis AF2122/97
uagacccgucaccgccga

SEQ ID NO: 1031896 - RNA, 17 nt, Mycobacterium bovis subsp bovis AF2122/97
uagaccgaaauggucgu

SEQ ID NO: 1031897 - RNA, 16 nt, Mycobacterium bovis subsp bovis AF2122/97
uagaccagugaccgca

SEQ ID NO: 1031898 - RNA, 22 nt, Mycobacterium bovis subsp bovis AF2122/97
uagagcaugccgcccgcgccgc

SEQ ID NO: 1031899 - RNA, 21 nt, Mycobacterium bovis subsp bovis AF2122/97
uagacgaaggauucgaagccg

SEQ ID NO: 1031900 - RNA, 13 nt, Mycobacterium bovis subsp bovis AF2122/97
uagacgucgaccg

SEQ ID NO: 1031901 - RNA, 19 nt, Mycobacterium bovis subsp bovis AF2122/97
uacgccgagaugcugcacc

SEQ ID NO: 1031902 - RNA, 13 nt, Mycobacterium bovis subsp bovis AF2122/97
uacgccgcgccga

SEQ ID NO: 1031903 - RNA, 13 nt, Mycobacterium bovis subsp bovis AF2122/97
uacgccggccgcg

SEQ ID NO: 1031904 - RNA, 15 nt, Mycobacterium bovis subsp bovis AF2122/97
uacgccggucggugc

SEQ ID NO: 1031905 - RNA, 16 nt, Mycobacterium bovis subsp bovis AF2122/97
uacuggcuauccaccu

SEQ ID NO: 1031906 - RNA, 22 nt, Mycobacterium bovis subsp bovis AF2122/97
uacugcggugccacggugaccc

SEQ ID NO: 1031907 - RNA, 14 nt, Mycobacterium bovis subsp bovis AF2122/97
uacugcgcagcgcc

SEQ ID NO: 1031908 - RNA, 16 nt, Mycobacterium bovis subsp bovis AF2122/97
uacugcguugacguca

SEQ ID NO: 1031909 - RNA, 13 nt, Mycobacterium bovis subsp bovis AF2122/97
uacugcgaucgcg

SEQ ID NO: 1031910 - RNA, 13 nt, Mycobacterium bovis subsp bovis AF2122/97
uaucucggugacg

SEQ ID NO: 1031911 - RNA, 19 nt, Mycobacterium bovis subsp bovis AF2122/97
uaucggcacggucacacgc

SEQ ID NO: 1031912 - RNA, 17 nt, Mycobacterium bovis subsp bovis AF2122/97
uagcgggucagcugacg

SEQ ID NO: 1031913 - RNA, 16 nt, Mycobacterium bovis subsp bovis AF2122/97
uagcgggugccagccc

SEQ ID NO: 1031914 - RNA, 17 nt, Mycobacterium bovis subsp bovis AF2122/97
uagcgggcgcccuugag

SEQ ID NO: 1031915 - RNA, 13 nt, Mycobacterium bovis subsp bovis AF2122/97
uagcgggcgguag

SEQ ID NO: 1031916 - RNA, 20 nt, Mycobacterium bovis subsp bovis AF2122/97
uagcgggcgguagccauccg

SEQ ID NO: 1031917 - RNA, 18 nt, Mycobacterium bovis subsp bovis AF2122/97
uagcgggcaagaugaucg

SEQ ID NO: 1031918 - RNA, 21 nt, Mycobacterium bovis subsp bovis AF2122/97
uauccuuugccgccgaacgcc

SEQ ID NO: 1031919 - RNA, 23 nt, Mycobacterium bovis subsp bovis AF2122/97
uaucgaaagccaacucgaccgac

SEQ ID NO: 1031920 - RNA, 13 nt, Mycobacterium bovis subsp bovis AF2122/97
uagcggcuuggcc

SEQ ID NO: 1031921 - RNA, 17 nt, Mycobacterium bovis subsp bovis AF2122/97
uagcggcucaccgcgca

SEQ ID NO: 1031922 - RNA, 17 nt, Mycobacterium bovis subsp bovis AF2122/97
uagcggcgggcacgcac

SEQ ID NO: 1031923 - RNA, 20 nt, Mycobacterium bovis subsp bovis AF2122/97
uagcggcggcggcacgcucg

SEQ ID NO: 1031924 - RNA, 12 nt, Mycobacterium bovis subsp bovis AF2122/97
uagcggccgcag

SEQ ID NO: 1031925 - RNA, 18 nt, Mycobacterium bovis subsp bovis AF2122/97
uagcggcccuucgacgag

SEQ ID NO: 1031926 - RNA, 20 nt, Mycobacterium bovis subsp bovis AF2122/97
uagcgcccaccguagacgac

SEQ ID NO: 1031927 - RNA, 15 nt, Mycobacterium bovis subsp bovis AF2122/97
uagcggcaaagccgg

SEQ ID NO: 1031928 - RNA, 19 nt, Mycobacterium bovis subsp bovis AF2122/97
uagcggauucagcgucgcc

SEQ ID NO: 1031929 - RNA, 22 nt, Mycobacterium bovis subsp bovis AF2122/97
uaucgccgcgggcgaaccgcuc

SEQ ID NO: 1031930 - RNA, 13 nt, Mycobacterium bovis subsp bovis AF2122/97
uaucgaccgccgc

SEQ ID NO: 1031931 - RNA, 16 nt, Mycobacterium bovis subsp bovis AF2122/97
uaucgaugcggcgacc

SEQ ID NO: 1031932 - RNA, 17 nt, Mycobacterium bovis subsp bovis AF2122/97
uaucgauugaugcgugg

SEQ ID NO: 1031933 - RNA, 17 nt, Mycobacterium bovis subsp bovis AF2122/97
uaucgcagcaucugcgg

SEQ ID NO: 1031934 - RNA, 22 nt, Mycobacterium bovis subsp bovis AF2122/97
uaugcgccaucucgacggugac

SEQ ID NO: 1031935 - RNA, 15 nt, Mycobacterium bovis subsp bovis AF2122/97
uauggaccgccgccg

SEQ ID NO: 1031936 - RNA, 13 nt, Mycobacterium bovis subsp bovis AF2122/97
ucaaaaagcucgg

SEQ ID NO: 1031937 - RNA, 19 nt, Mycobacterium bovis subsp bovis AF2122/97
uauugcggugcaucgccac

SEQ ID NO: 1031938 - RNA, 16 nt, Mycobacterium bovis subsp bovis AF2122/97
uauugcgcccggccau

SEQ ID NO: 1031939 - RNA, 15 nt, Mycobacterium bovis subsp bovis AF2122/97
uauugcggcgccgug

SEQ ID NO: 1031940 - RNA, 17 nt, Mycobacterium bovis subsp bovis AF2122/97
uauugccuaucgacaac

SEQ ID NO: 1031941 - RNA, 22 nt, Mycobacterium bovis subsp bovis AF2122/97
ucaaccgguguaauugccgacg

SEQ ID NO: 1031942 - RNA, 15 nt, Mycobacterium bovis subsp bovis AF2122/97
ucaaccugaaccggc

SEQ ID NO: 1031943 - RNA, 18 nt, Mycobacterium bovis subsp bovis AF2122/97
ucaaccugaaccggccgc

SEQ ID NO: 1031944 - RNA, 20 nt, Mycobacterium bovis subsp bovis AF2122/97
ucaaccugaaccggccgcga

SEQ ID NO: 1031945 - RNA, 15 nt, Mycobacterium bovis subsp bovis AF2122/97
ucaaccucuggcggc

SEQ ID NO: 1031946 - RNA, 14 nt, Mycobacterium bovis subsp bovis AF2122/97
ucaacccggccuuc

SEQ ID NO: 1031947 - RNA, 17 nt, Mycobacterium bovis subsp bovis AF2122/97
ucaaccagggugccggc

SEQ ID NO: 1031948 - RNA, 22 nt, Mycobacterium bovis subsp bovis AF2122/97
ucaacgaucccggggugccgau

SEQ ID NO: 1031949 - RNA, 14 nt, Mycobacterium bovis subsp bovis AF2122/97
ucaacgaucgcgcc

SEQ ID NO: 1031950 - RNA, 16 nt, Mycobacterium bovis subsp bovis AF2122/97
ucaacgaucgcgccgu

SEQ ID NO: 1031951 - RNA, 19 nt, Mycobacterium bovis subsp bovis AF2122/97
ucaacgaaaauuugacgac

SEQ ID NO: 1031952 - RNA, 18 nt, Mycobacterium bovis subsp bovis AF2122/97
ucaaccggacgaccggaa

SEQ ID NO: 1031953 - RNA, 19 nt, Mycobacterium bovis subsp bovis AF2122/97
ucaacgcaaucgacugauc

SEQ ID NO: 1031954 - RNA, 16 nt, Mycobacterium bovis subsp bovis AF2122/97
ucaacgccacgccgau

SEQ ID NO: 1031955 - RNA, 15 nt, Mycobacterium bovis subsp bovis AF2122/97
ucaacacccggccga

SEQ ID NO: 1031956 - RNA, 17 nt, Mycobacterium bovis subsp bovis AF2122/97
ucaacaccgaguuccuc

SEQ ID NO: 1031957 - RNA, 14 nt, Mycobacterium bovis subsp bovis AF2122/97
ucaacaccgcggcc

SEQ ID NO: 1031958 - RNA, 17 nt, Mycobacterium bovis subsp bovis AF2122/97
ucaacaccgcggccgag

SEQ ID NO: 1031959 - RNA, 20 nt, Mycobacterium bovis subsp bovis AF2122/97
ucaacagaccuagcaccgcg

SEQ ID NO: 1031960 - RNA, 17 nt, Mycobacterium bovis subsp bovis AF2122/97
ucaacaggccggcucgc

SEQ ID NO: 1031961 - RNA, 16 nt, Mycobacterium bovis subsp bovis AF2122/97
ucaacaggccguggcg

SEQ ID NO: 1031962 - RNA, 14 nt, Mycobacterium bovis subsp bovis AF2122/97
ucaacagggccaga

SEQ ID NO: 1031963 - RNA, 14 nt, Mycobacterium bovis subsp bovis AF2122/97
ucaacagcaccgcg

SEQ ID NO: 1031964 - RNA, 15 nt, Mycobacterium bovis subsp bovis AF2122/97
ucaaccacggccgcc

SEQ ID NO: 1031965 - RNA, 13 nt, Mycobacterium bovis subsp bovis AF2122/97
ucaaagcagcgca

SEQ ID NO: 1031966 - RNA, 16 nt, Mycobacterium bovis subsp bovis AF2122/97
ucaaacgcgcgcgcca

SEQ ID NO: 1031967 - RNA, 22 nt, Mycobacterium bovis subsp bovis AF2122/97
ucaacacacugaagaucgcgcc

SEQ ID NO: 1031968 - RNA, 23 nt, Mycobacterium bovis subsp bovis AF2122/97
ucaacaccaacgcgcaccuggcg

SEQ ID NO: 1031969 - RNA, 19 nt, Mycobacterium bovis subsp bovis AF2122/97
ucaacaccaacgacagcga

SEQ ID NO: 1031970 - RNA, 16 nt, Mycobacterium bovis subsp bovis AF2122/97
ucaacaaggggcagca

SEQ ID NO: 1031971 - RNA, 22 nt, Mycobacterium bovis subsp bovis AF2122/97
ucaaaucaacggcgucggcuuc

SEQ ID NO: 1031972 - RNA, 20 nt, Mycobacterium bovis subsp bovis AF2122/97
ucaaggucuuuagccgccgc

SEQ ID NO: 1031973 - RNA, 20 nt, Mycobacterium bovis subsp bovis AF2122/97
ucaaggugucaacgcgcggc

SEQ ID NO: 1031974 - RNA, 15 nt, Mycobacterium bovis subsp bovis AF2122/97
ucaaggugucgacgg

SEQ ID NO: 1031975 - RNA, 21 nt, Mycobacterium bovis subsp bovis AF2122/97
ucaaggccaccucuucgaucu

SEQ ID NO: 1031976 - RNA, 18 nt, Mycobacterium bovis subsp bovis AF2122/97
ucaaggccaccucuucga

SEQ ID NO: 1031977 - RNA, 14 nt, Mycobacterium bovis subsp bovis AF2122/97
ucaaggaagccgcg

SEQ ID NO: 1031978 - RNA, 20 nt, Mycobacterium bovis subsp bovis AF2122/97
ucaaggaagccgcggccacg

SEQ ID NO: 1031979 - RNA, 19 nt, Mycobacterium bovis subsp bovis AF2122/97
ucaaggaccgcucugcggc

SEQ ID NO: 1031980 - RNA, 23 nt, Mycobacterium bovis subsp bovis AF2122/97
ucaaggaccgcucugcggccacg

SEQ ID NO: 1031981 - RNA, 20 nt, Mycobacterium bovis subsp bovis AF2122/97
ucaaugaacgcgcuuggugu

SEQ ID NO: 1031982 - RNA, 19 nt, Mycobacterium bovis subsp bovis AF2122/97
ucaaucccacgcccggccc

SEQ ID NO: 1031983 - RNA, 12 nt, Mycobacterium bovis subsp bovis AF2122/97
ucaaggaagccg

SEQ ID NO: 1031984 - RNA, 16 nt, Mycobacterium bovis subsp bovis AF2122/97
ucaagcgggcuggcgu

SEQ ID NO: 1031985 - RNA, 17 nt, Mycobacterium bovis subsp bovis AF2122/97
ucaagccggcgcccgcc

SEQ ID NO: 1031986 - RNA, 19 nt, Mycobacterium bovis subsp bovis AF2122/97
ucaagccguguucgaccgc

SEQ ID NO: 1031987 - RNA, 19 nt, Mycobacterium bovis subsp bovis AF2122/97
ucaagaaggccagcgcgcc

SEQ ID NO: 1031988 - RNA, 18 nt, Mycobacterium bovis subsp bovis AF2122/97
ucaagaucggugccagca

SEQ ID NO: 1031989 - RNA, 23 nt, Mycobacterium bovis subsp bovis AF2122/97
ucaagcaaguccaccggaucguc

SEQ ID NO: 1031990 - RNA, 22 nt, Mycobacterium bovis subsp bovis AF2122/97
ucaacggcagaucccacgccag

SEQ ID NO: 1031991 - RNA, 15 nt, Mycobacterium bovis subsp bovis AF2122/97
ucaacggcgacaucg

SEQ ID NO: 1031992 - RNA, 20 nt, Mycobacterium bovis subsp bovis AF2122/97
ucaacggcgacaucggcccg

SEQ ID NO: 1031993 - RNA, 17 nt, Mycobacterium bovis subsp bovis AF2122/97
ucaacggcggcaacggc

SEQ ID NO: 1031994 - RNA, 20 nt, Mycobacterium bovis subsp bovis AF2122/97
ucaacggcggcaacggcggc

SEQ ID NO: 1031995 - RNA, 21 nt, Mycobacterium bovis subsp bovis AF2122/97
ucaacggcggcaacggcggca

SEQ ID NO: 1031996 - RNA, 15 nt, Mycobacterium bovis subsp bovis AF2122/97
ucaacgcgcgcacgc

SEQ ID NO: 1031997 - RNA, 14 nt, Mycobacterium bovis subsp bovis AF2122/97
ucaacggaaugaag

SEQ ID NO: 1031998 - RNA, 15 nt, Mycobacterium bovis subsp bovis AF2122/97
ucaacguggaaaccg

SEQ ID NO: 1031999 - RNA, 15 nt, Mycobacterium bovis subsp bovis AF2122/97
ucaacucgggcagcg

SEQ ID NO: 1032000 - RNA, 18 nt, Mycobacterium bovis subsp bovis AF2122/97
ucaacgggaugccggcga

SEQ ID NO: 1032001 - RNA, 13 nt, Mycobacterium bovis subsp bovis AF2122/97
ucaacgggccgca

SEQ ID NO: 1032002 - RNA, 21 nt, Mycobacterium bovis subsp bovis AF2122/97
ucaacgggccgcaucgucgcc

SEQ ID NO: 1032003 - RNA, 20 nt, Mycobacterium bovis subsp bovis AF2122/97
ucaacggucucaacgcaucg

SEQ ID NO: 1032004 - RNA, 17 nt, Mycobacterium bovis subsp bovis AF2122/97
ucaacguauccccgacc

SEQ ID NO: 1032005 - RNA, 14 nt, Mycobacterium bovis subsp bovis AF2122/97
ucagcagaugggcg

SEQ ID NO: 1032006 - RNA, 16 nt, Mycobacterium bovis subsp bovis AF2122/97
ucagcagaugggcguc

SEQ ID NO: 1032007 - RNA, 20 nt, Mycobacterium bovis subsp bovis AF2122/97
ucagcaccgugacagcggca

SEQ ID NO: 1032008 - RNA, 16 nt, Mycobacterium bovis subsp bovis AF2122/97
ucagcaccgacagccc

SEQ ID NO: 1032009 - RNA, 16 nt, Mycobacterium bovis subsp bovis AF2122/97
ucagcaccuccaccgc

SEQ ID NO: 1032010 - RNA, 12 nt, Mycobacterium bovis subsp bovis AF2122/97
ucagcacguggg

SEQ ID NO: 1032011 - RNA, 20 nt, Mycobacterium bovis subsp bovis AF2122/97
ucagcacggugggcgcuggg

SEQ ID NO: 1032012 - RNA, 19 nt, Mycobacterium bovis subsp bovis AF2122/97
ucagcacgguguacgcccg

SEQ ID NO: 1032013 - RNA, 23 nt, Mycobacterium bovis subsp bovis AF2122/97
ucagaugcggcccgggcucggcg

SEQ ID NO: 1032014 - RNA, 15 nt, Mycobacterium bovis subsp bovis AF2122/97
ucagagacagcagcg

SEQ ID NO: 1032015 - RNA, 19 nt, Mycobacterium bovis subsp bovis AF2122/97
ucagaauugugugcagcag

SEQ ID NO: 1032016 - RNA, 16 nt, Mycobacterium bovis subsp bovis AF2122/97
ucagcccaucuaccag

SEQ ID NO: 1032017 - RNA, 21 nt, Mycobacterium bovis subsp bovis AF2122/97
ucagcccgaacucguuggcga

SEQ ID NO: 1032018 - RNA, 20 nt, Mycobacterium bovis subsp bovis AF2122/97
ucagcccggcacugaccgcg

SEQ ID NO: 1032019 - RNA, 20 nt, Mycobacterium bovis subsp bovis AF2122/97
ucagcccggccuugccgccg

SEQ ID NO: 1032020 - RNA, 15 nt, Mycobacterium bovis subsp bovis AF2122/97
ucagcccggccagcc

SEQ ID NO: 1032021 - RNA, 18 nt, Mycobacterium bovis subsp bovis AF2122/97
ucagcccggccagccgca

SEQ ID NO: 1032022 - RNA, 20 nt, Mycobacterium bovis subsp bovis AF2122/97
ucagccgguggucugcgcgg

SEQ ID NO: 1032023 - RNA, 16 nt, Mycobacterium bovis subsp bovis AF2122/97
ucagccguucggcuaa

SEQ ID NO: 1032024 - RNA, 14 nt, Mycobacterium bovis subsp bovis AF2122/97
ucagccguccgggc

SEQ ID NO: 1032025 - RNA, 20 nt, Mycobacterium bovis subsp bovis AF2122/97
ucagcccagccaacucaggc

SEQ ID NO: 1032026 - RNA, 18 nt, Mycobacterium bovis subsp bovis AF2122/97
ucagcagcuccacuggcg

SEQ ID NO: 1032027 - RNA, 18 nt, Mycobacterium bovis subsp bovis AF2122/97
ucagcaggaucggcagca

SEQ ID NO: 1032028 - RNA, 21 nt, Mycobacterium bovis subsp bovis AF2122/97
ucagcaggcccagcggaucga

SEQ ID NO: 1032029 - RNA, 14 nt, Mycobacterium bovis subsp bovis AF2122/97
ucagcagcgccgcg

SEQ ID NO: 1032030 - RNA, 13 nt, Mycobacterium bovis subsp bovis AF2122/97
ucagcagcggcga

SEQ ID NO: 1032031 - RNA, 21 nt, Mycobacterium bovis subsp bovis AF2122/97
ucagcaugggaauccgcuguu

SEQ ID NO: 1032032 - RNA, 22 nt, Mycobacterium bovis subsp bovis AF2122/97
ucagcaugguccacagccggcg

SEQ ID NO: 1032033 - RNA, 21 nt, Mycobacterium bovis subsp bovis AF2122/97
ucagcagcggcgaccgcgguc

SEQ ID NO: 1032034 - RNA, 22 nt, Mycobacterium bovis subsp bovis AF2122/97
ucagcauaucgauucgggcguc

SEQ ID NO: 1032035 - RNA, 21 nt, Mycobacterium bovis subsp bovis AF2122/97
ucaccguucuugucgaaguaa

SEQ ID NO: 1032036 - RNA, 15 nt, Mycobacterium bovis subsp bovis AF2122/97
ucaccguuggccgcg

SEQ ID NO: 1032037 - RNA, 23 nt, Mycobacterium bovis subsp bovis AF2122/97
ucaccguuguucccauagccagc

SEQ ID NO: 1032038 - RNA, 18 nt, Mycobacterium bovis subsp bovis AF2122/97
ucaccguguugcacgcgg

SEQ ID NO: 1032039 - RNA, 21 nt, Mycobacterium bovis subsp bovis AF2122/97
ucaccgucgagguacacgccg

SEQ ID NO: 1032040 - RNA, 14 nt, Mycobacterium bovis subsp bovis AF2122/97
ucaccguccacgac

SEQ ID NO: 1032041 - RNA, 20 nt, Mycobacterium bovis subsp bovis AF2122/97
ucaccgucguacucggcggc

SEQ ID NO: 1032042 - RNA, 21 nt, Mycobacterium bovis subsp bovis AF2122/97
ucaccgucguacucggcggcc

SEQ ID NO: 1032043 - RNA, 15 nt, Mycobacterium bovis subsp bovis AF2122/97
ucaccgucugcaccg

SEQ ID NO: 1032044 - RNA, 21 nt, Mycobacterium bovis subsp bovis AF2122/97
ucaccgucugcggaccggcgc

SEQ ID NO: 1032045 - RNA, 22 nt, Mycobacterium bovis subsp bovis AF2122/97
ucaccgucugcggaccggcgcg

SEQ ID NO: 1032046 - RNA, 16 nt, Mycobacterium bovis subsp bovis AF2122/97
ucaccgugaaccgccc

SEQ ID NO: 1032047 - RNA, 20 nt, Mycobacterium bovis subsp bovis AF2122/97
ucaccgugaaccgcccgccc

SEQ ID NO: 1032048 - RNA, 19 nt, Mycobacterium bovis subsp bovis AF2122/97
ucaccucggugccggccgc

SEQ ID NO: 1032049 - RNA, 20 nt, Mycobacterium bovis subsp bovis AF2122/97
ucaccucggugccggccgca

SEQ ID NO: 1032050 - RNA, 14 nt, Mycobacterium bovis subsp bovis AF2122/97
ucaccucgaugccg

SEQ ID NO: 1032051 - RNA, 13 nt, Mycobacterium bovis subsp bovis AF2122/97
ucaccucgccaca

SEQ ID NO: 1032052 - RNA, 18 nt, Mycobacterium bovis subsp bovis AF2122/97
ucaccucgcacgacaccu

SEQ ID NO: 1032053 - RNA, 19 nt, Mycobacterium bovis subsp bovis AF2122/97
ucacgccggccucgccgaa

SEQ ID NO: 1032054 - RNA, 23 nt, Mycobacterium bovis subsp bovis AF2122/97
ucacgccggccucgccgaagcgg

SEQ ID NO: 1032055 - RNA, 20 nt, Mycobacterium bovis subsp bovis AF2122/97
ucacgccgccccugcgcggc

SEQ ID NO: 1032056 - RNA, 22 nt, Mycobacterium bovis subsp bovis AF2122/97
ucacgccgccccugcgcggcca

SEQ ID NO: 1032057 - RNA, 14 nt, Mycobacterium bovis subsp bovis AF2122/97
ucacgccgccggag

SEQ ID NO: 1032058 - RNA, 20 nt, Mycobacterium bovis subsp bovis AF2122/97
ucaccugccagugggccgac

SEQ ID NO: 1032059 - RNA, 23 nt, Mycobacterium bovis subsp bovis AF2122/97
ucaccugccagugggccgacgug

SEQ ID NO: 1032060 - RNA, 23 nt, Mycobacterium bovis subsp bovis AF2122/97
ucacggcggggaucgcuggccgc

SEQ ID NO: 1032061 - RNA, 17 nt, Mycobacterium bovis subsp bovis AF2122/97
ucacgcgcucaccgacg

SEQ ID NO: 1032062 - RNA, 16 nt, Mycobacterium bovis subsp bovis AF2122/97
ucacgcguacgucggu

SEQ ID NO: 1032063 - RNA, 22 nt, Mycobacterium bovis subsp bovis AF2122/97
ucacgcguacgucgguccaccc

SEQ ID NO: 1032064 - RNA, 14 nt, Mycobacterium bovis subsp bovis AF2122/97
ucacgccgccggcg

SEQ ID NO: 1032065 - RNA, 18 nt, Mycobacterium bovis subsp bovis AF2122/97
ucacgcgaggcgaagcgg

SEQ ID NO: 1032066 - RNA, 18 nt, Mycobacterium bovis subsp bovis AF2122/97
ucacgcggaaaccaucgc

SEQ ID NO: 1032067 - RNA, 13 nt, Mycobacterium bovis subsp bovis AF2122/97
ucacgguggccgc

SEQ ID NO: 1032068 - RNA, 19 nt, Mycobacterium bovis subsp bovis AF2122/97
ucacguucggcgacgcgcc

SEQ ID NO: 1032069 - RNA, 22 nt, Mycobacterium bovis subsp bovis AF2122/97
ucacguucagcccaugcccggc

SEQ ID NO: 1032070 - RNA, 15 nt, Mycobacterium bovis subsp bovis AF2122/97
ucacggugggcgccg

SEQ ID NO: 1032071 - RNA, 21 nt, Mycobacterium bovis subsp bovis AF2122/97
ucacggugggcgccgacaccg

SEQ ID NO: 1032072 - RNA, 19 nt, Mycobacterium bovis subsp bovis AF2122/97
ucacggucaucucgguggu

SEQ ID NO: 1032073 - RNA, 20 nt, Mycobacterium bovis subsp bovis AF2122/97
ucacggucggaucgauuccg

SEQ ID NO: 1032074 - RNA, 13 nt, Mycobacterium bovis subsp bovis AF2122/97
ucacggucgacga

SEQ ID NO: 1032075 - RNA, 19 nt, Mycobacterium bovis subsp bovis AF2122/97
ucacggcgucgacuggccg

SEQ ID NO: 1032076 - RNA, 16 nt, Mycobacterium bovis subsp bovis AF2122/97
ucacgcguuccauggc

SEQ ID NO: 1032077 - RNA, 14 nt, Mycobacterium bovis subsp bovis AF2122/97
ucacgggacgacgg

SEQ ID NO: 1032078 - RNA, 17 nt, Mycobacterium bovis subsp bovis AF2122/97
ucacgggcuaccggcag

SEQ ID NO: 1032079 - RNA, 21 nt, Mycobacterium bovis subsp bovis AF2122/97
ucacucguugaccggccggac

SEQ ID NO: 1032080 - RNA, 12 nt, Mycobacterium bovis subsp bovis AF2122/97
ucacucgccgaa

SEQ ID NO: 1032081 - RNA, 16 nt, Mycobacterium bovis subsp bovis AF2122/97
ucagaacgucggugug

SEQ ID NO: 1032082 - RNA, 16 nt, Mycobacterium bovis subsp bovis AF2122/97
ucaccgaauaccgccg

SEQ ID NO: 1032083 - RNA, 16 nt, Mycobacterium bovis subsp bovis AF2122/97
ucaccgacaugacgcg

SEQ ID NO: 1032084 - RNA, 18 nt, Mycobacterium bovis subsp bovis AF2122/97
ucaccgcccuugccgccg

SEQ ID NO: 1032085 - RNA, 19 nt, Mycobacterium bovis subsp bovis AF2122/97
ucacccugucgcgcaccgg

SEQ ID NO: 1032086 - RNA, 18 nt, Mycobacterium bovis subsp bovis AF2122/97
ucaccgaacgacccuggc

SEQ ID NO: 1032087 - RNA, 17 nt, Mycobacterium bovis subsp bovis AF2122/97
ucacccugucgcgcacc

SEQ ID NO: 1032088 - RNA, 18 nt, Mycobacterium bovis subsp bovis AF2122/97
ucacccgggaugaccacc

SEQ ID NO: 1032089 - RNA, 13 nt, Mycobacterium bovis subsp bovis AF2122/97
ucaccccuucgcc

SEQ ID NO: 1032090 - RNA, 16 nt, Mycobacterium bovis subsp bovis AF2122/97
ucacccgagccaucac

SEQ ID NO: 1032091 - RNA, 15 nt, Mycobacterium bovis subsp bovis AF2122/97
ucacccgcacguaga

SEQ ID NO: 1032092 - RNA, 16 nt, Mycobacterium bovis subsp bovis AF2122/97
ucacccgcaggucgau

SEQ ID NO: 1032093 - RNA, 13 nt, Mycobacterium bovis subsp bovis AF2122/97
ucacccgcaucgg

SEQ ID NO: 1032094 - RNA, 12 nt, Mycobacterium bovis subsp bovis AF2122/97
ucacccgcccga

SEQ ID NO: 1032095 - RNA, 14 nt, Mycobacterium bovis subsp bovis AF2122/97
ucacccgcccggaa

SEQ ID NO: 1032096 - RNA, 23 nt, Mycobacterium bovis subsp bovis AF2122/97
ucacccgcucacgcucacccggc

SEQ ID NO: 1032097 - RNA, 16 nt, Mycobacterium bovis subsp bovis AF2122/97
ucaccgcgcccgccgc

SEQ ID NO: 1032098 - RNA, 18 nt, Mycobacterium bovis subsp bovis AF2122/97
ucaccgccguuaccgccg

SEQ ID NO: 1032099 - RNA, 21 nt, Mycobacterium bovis subsp bovis AF2122/97
ucaccgccguugccgccggcg

SEQ ID NO: 1032100 - RNA, 18 nt, Mycobacterium bovis subsp bovis AF2122/97
ucaccgccugugccgccg

SEQ ID NO: 1032101 - RNA, 21 nt, Mycobacterium bovis subsp bovis AF2122/97
ucaccgccuuugccgccggca

SEQ ID NO: 1032102 - RNA, 22 nt, Mycobacterium bovis subsp bovis AF2122/97
ucaccgccuuugccgccggcac

SEQ ID NO: 1032103 - RNA, 19 nt, Mycobacterium bovis subsp bovis AF2122/97
ucaccgcgaaacccaugac

SEQ ID NO: 1032104 - RNA, 12 nt, Mycobacterium bovis subsp bovis AF2122/97
ucaccgcgaccc

SEQ ID NO: 1032105 - RNA, 19 nt, Mycobacterium bovis subsp bovis AF2122/97
ucaccgccgcuaccgcccg

SEQ ID NO: 1032106 - RNA, 13 nt, Mycobacterium bovis subsp bovis AF2122/97
ucaccgccggcac

SEQ ID NO: 1032107 - RNA, 15 nt, Mycobacterium bovis subsp bovis AF2122/97
ucaccgccggcggcg

SEQ ID NO: 1032108 - RNA, 19 nt, Mycobacterium bovis subsp bovis AF2122/97
ucaccgccggugcugacga

SEQ ID NO: 1032109 - RNA, 16 nt, Mycobacterium bovis subsp bovis AF2122/97
ucaccgccgcgaccgc

SEQ ID NO: 1032110 - RNA, 16 nt, Mycobacterium bovis subsp bovis AF2122/97
ucaccgccgcggccgc

SEQ ID NO: 1032111 - RNA, 18 nt, Mycobacterium bovis subsp bovis AF2122/97
ucaccgaauaccgccgcg

SEQ ID NO: 1032112 - RNA, 19 nt, Mycobacterium bovis subsp bovis AF2122/97
ucaccgguacugcgaugug

SEQ ID NO: 1032113 - RNA, 18 nt, Mycobacterium bovis subsp bovis AF2122/97
ucaccggucaccgcgcag

SEQ ID NO: 1032114 - RNA, 19 nt, Mycobacterium bovis subsp bovis AF2122/97
ucaccggugcgcuggaggc

SEQ ID NO: 1032115 - RNA, 21 nt, Mycobacterium bovis subsp bovis AF2122/97
ucaccgcgggcauaggcgcug

SEQ ID NO: 1032116 - RNA, 21 nt, Mycobacterium bovis subsp bovis AF2122/97
ucaccggucaccgcgcagcga

SEQ ID NO: 1032117 - RNA, 15 nt, Mycobacterium bovis subsp bovis AF2122/97
ucaccgguucgguga

SEQ ID NO: 1032118 - RNA, 19 nt, Mycobacterium bovis subsp bovis AF2122/97
ucaccacgcggcggucguu

SEQ ID NO: 1032119 - RNA, 14 nt, Mycobacterium bovis subsp bovis AF2122/97
ucaccacggccgcc

SEQ ID NO: 1032120 - RNA, 14 nt, Mycobacterium bovis subsp bovis AF2122/97
ucaccacggcggcg

SEQ ID NO: 1032121 - RNA, 22 nt, Mycobacterium bovis subsp bovis AF2122/97
ucaccacggcguugccgccggc

SEQ ID NO: 1032122 - RNA, 13 nt, Mycobacterium bovis subsp bovis AF2122/97
ucaccacgucguc

SEQ ID NO: 1032123 - RNA, 12 nt, Mycobacterium bovis subsp bovis AF2122/97
ucaccacgucgu

SEQ ID NO: 1032124 - RNA, 17 nt, Mycobacterium bovis subsp bovis AF2122/97
ucaccagcgcaucggcc

SEQ ID NO: 1032125 - RNA, 18 nt, Mycobacterium bovis subsp bovis AF2122/97
ucaccagcgcaucggcca

SEQ ID NO: 1032126 - RNA, 13 nt, Mycobacterium bovis subsp bovis AF2122/97
ucaccagcuccuc

SEQ ID NO: 1032127 - RNA, 13 nt, Mycobacterium bovis subsp bovis AF2122/97
ucaccagcugcga

SEQ ID NO: 1032128 - RNA, 16 nt, Mycobacterium bovis subsp bovis AF2122/97
ucaccagaaauggcgc

SEQ ID NO: 1032129 - RNA, 20 nt, Mycobacterium bovis subsp bovis AF2122/97
ucaccaggcgagccggcgcg

SEQ ID NO: 1032130 - RNA, 21 nt, Mycobacterium bovis subsp bovis AF2122/97
ucaccaggguguauggccacc

SEQ ID NO: 1032131 - RNA, 17 nt, Mycobacterium bovis subsp bovis AF2122/97
ucaccaggguuggcacc

SEQ ID NO: 1032132 - RNA, 14 nt, Mycobacterium bovis subsp bovis AF2122/97
ucacccacccgcac

SEQ ID NO: 1032133 - RNA, 19 nt, Mycobacterium bovis subsp bovis AF2122/97
ucacccaauucacgacgcc

SEQ ID NO: 1032134 - RNA, 20 nt, Mycobacterium bovis subsp bovis AF2122/97
ucaccauggcgccgcgccga

SEQ ID NO: 1032135 - RNA, 14 nt, Mycobacterium bovis subsp bovis AF2122/97
ucaccccggcggcc

SEQ ID NO: 1032136 - RNA, 21 nt, Mycobacterium bovis subsp bovis AF2122/97
ucaccccggcucggccaccga

SEQ ID NO: 1032137 - RNA, 12 nt, Mycobacterium bovis subsp bovis AF2122/97
ucaccccggugg

SEQ ID NO: 1032138 - RNA, 21 nt, Mycobacterium bovis subsp bovis AF2122/97
ucacccccgauagcgaccgcg

SEQ ID NO: 1032139 - RNA, 19 nt, Mycobacterium bovis subsp bovis AF2122/97
ucacccccuggacuucggg

SEQ ID NO: 1032140 - RNA, 16 nt, Mycobacterium bovis subsp bovis AF2122/97
ucacccagcucgcgca

SEQ ID NO: 1032141 - RNA, 18 nt, Mycobacterium bovis subsp bovis AF2122/97
ucacccagcucgcgcacc

SEQ ID NO: 1032142 - RNA, 21 nt, Mycobacterium bovis subsp bovis AF2122/97
ucacccagcugggucccgcug

SEQ ID NO: 1032143 - RNA, 22 nt, Mycobacterium bovis subsp bovis AF2122/97
ucacagcugcgcacgucgggcc

SEQ ID NO: 1032144 - RNA, 20 nt, Mycobacterium bovis subsp bovis AF2122/97
ucacagccaccagccgggca

SEQ ID NO: 1032145 - RNA, 13 nt, Mycobacterium bovis subsp bovis AF2122/97
ucacagcacagcg

SEQ ID NO: 1032146 - RNA, 14 nt, Mycobacterium bovis subsp bovis AF2122/97
ucacacucccaucc

SEQ ID NO: 1032147 - RNA, 17 nt, Mycobacterium bovis subsp bovis AF2122/97
ucacaugcaagccgaca

SEQ ID NO: 1032148 - RNA, 20 nt, Mycobacterium bovis subsp bovis AF2122/97
ucacaugcaagccgacaucg

SEQ ID NO: 1032149 - RNA, 14 nt, Mycobacterium bovis subsp bovis AF2122/97
ucacaugcgccgaa

SEQ ID NO: 1032150 - RNA, 14 nt, Mycobacterium bovis subsp bovis AF2122/97
ucaccaccguggcg

SEQ ID NO: 1032151 - RNA, 23 nt, Mycobacterium bovis subsp bovis AF2122/97
ucaccaccuggugcaaccgugcc

SEQ ID NO: 1032152 - RNA, 15 nt, Mycobacterium bovis subsp bovis AF2122/97
ucaccaccggcaccg

SEQ ID NO: 1032153 - RNA, 14 nt, Mycobacterium bovis subsp bovis AF2122/97
ucaccacccgcacu

SEQ ID NO: 1032154 - RNA, 22 nt, Mycobacterium bovis subsp bovis AF2122/97
ucaccacccgucggcccgcuca

SEQ ID NO: 1032155 - RNA, 12 nt, Mycobacterium bovis subsp bovis AF2122/97
ucaccaccggca

SEQ ID NO: 1032156 - RNA, 13 nt, Mycobacterium bovis subsp bovis AF2122/97
ucaccaccggcac

SEQ ID NO: 1032157 - RNA, 15 nt, Mycobacterium bovis subsp bovis AF2122/97
ucaccacccgaccgc

SEQ ID NO: 1032158 - RNA, 18 nt, Mycobacterium bovis subsp bovis AF2122/97
ucaccacccgaccgccau

SEQ ID NO: 1032159 - RNA, 15 nt, Mycobacterium bovis subsp bovis AF2122/97
ucaccacaccggcag

SEQ ID NO: 1032160 - RNA, 15 nt, Mycobacterium bovis subsp bovis AF2122/97
ucaccaaucugcggg

SEQ ID NO: 1032161 - RNA, 21 nt, Mycobacterium bovis subsp bovis AF2122/97
ucaccaagacaccggccugcg

SEQ ID NO: 1032162 - RNA, 15 nt, Mycobacterium bovis subsp bovis AF2122/97
ucaccaacgcgggaa

SEQ ID NO: 1032163 - RNA, 22 nt, Mycobacterium bovis subsp bovis AF2122/97
ucaccaaaaacccggugaccag

SEQ ID NO: 1032164 - RNA, 14 nt, Mycobacterium bovis subsp bovis AF2122/97
ucaaugucgaagac

SEQ ID NO: 1032165 - RNA, 12 nt, Mycobacterium bovis subsp bovis AF2122/97
ucaaugcugcgu

SEQ ID NO: 1032166 - RNA, 19 nt, Mycobacterium bovis subsp bovis AF2122/97
ucaaugcgcuggcgccgcc

SEQ ID NO: 1032167 - RNA, 17 nt, Mycobacterium bovis subsp bovis AF2122/97
ucaaugcggucaacgac

SEQ ID NO: 1032168 - RNA, 21 nt, Mycobacterium bovis subsp bovis AF2122/97
ucaaugcggucaacgacagcc

SEQ ID NO: 1032169 - RNA, 16 nt, Mycobacterium bovis subsp bovis AF2122/97
ucacacccacgucgag

SEQ ID NO: 1032170 - RNA, 17 nt, Mycobacterium bovis subsp bovis AF2122/97
ucacacccaucacccug

SEQ ID NO: 1032171 - RNA, 17 nt, Mycobacterium bovis subsp bovis AF2122/97
ucacacgguccgccacg

SEQ ID NO: 1032172 - RNA, 14 nt, Mycobacterium bovis subsp bovis AF2122/97
ucacacguccgcgc

SEQ ID NO: 1032173 - RNA, 18 nt, Mycobacterium bovis subsp bovis AF2122/97
ucacaagccccgcgcguu

SEQ ID NO: 1032174 - RNA, 21 nt, Mycobacterium bovis subsp bovis AF2122/97
ucacaagccccgcgcguucgg

SEQ ID NO: 1032175 - RNA, 14 nt, Mycobacterium bovis subsp bovis AF2122/97
ucagcgacggccgc

SEQ ID NO: 1032176 - RNA, 15 nt, Mycobacterium bovis subsp bovis AF2122/97
ucagcgaacggccag

SEQ ID NO: 1032177 - RNA, 17 nt, Mycobacterium bovis subsp bovis AF2122/97
ucagcgaacggccagga

SEQ ID NO: 1032178 - RNA, 14 nt, Mycobacterium bovis subsp bovis AF2122/97
ucagcgaaccaccg

SEQ ID NO: 1032179 - RNA, 15 nt, Mycobacterium bovis subsp bovis AF2122/97
ucagcgaccucacga

SEQ ID NO: 1032180 - RNA, 11 nt, Mycobacterium bovis subsp bovis AF2122/97
ucaggcgccgu

SEQ ID NO: 1032181 - RNA, 22 nt, Mycobacterium bovis subsp bovis AF2122/97
ucaggcgggagcggaauggcgc

SEQ ID NO: 1032182 - RNA, 23 nt, Mycobacterium bovis subsp bovis AF2122/97
ucagggucugcgccgccggcggc

SEQ ID NO: 1032183 - RNA, 22 nt, Mycobacterium bovis subsp bovis AF2122/97
ucaggggcgccuuaggcguccg

SEQ ID NO: 1032184 - RNA, 23 nt, Mycobacterium bovis subsp bovis AF2122/97
ucaggggcuacuaggcccagcac

SEQ ID NO: 1032185 - RNA, 20 nt, Mycobacterium bovis subsp bovis AF2122/97
ucaggguauccacgccgggc

SEQ ID NO: 1032186 - RNA, 17 nt, Mycobacterium bovis subsp bovis AF2122/97
ucagggucagcgccgcg

SEQ ID NO: 1032187 - RNA, 15 nt, Mycobacterium bovis subsp bovis AF2122/97
ucagggcuuagcgcg

SEQ ID NO: 1032188 - RNA, 22 nt, Mycobacterium bovis subsp bovis AF2122/97
ucauaccgggaggacaccagcu

SEQ ID NO: 1032189 - RNA, 16 nt, Mycobacterium bovis subsp bovis AF2122/97
ucauacucgacaccga

SEQ ID NO: 1032190 - RNA, 15 nt, Mycobacterium bovis subsp bovis AF2122/97
ucauacucgacaccg

SEQ ID NO: 1032191 - RNA, 14 nt, Mycobacterium bovis subsp bovis AF2122/97
ucauaggccggcgg

SEQ ID NO: 1032192 - RNA, 19 nt, Mycobacterium bovis subsp bovis AF2122/97
ucaguaauucggccaucgc

SEQ ID NO: 1032193 - RNA, 15 nt, Mycobacterium bovis subsp bovis AF2122/97
ucaguacgcugcggc

SEQ ID NO: 1032194 - RNA, 18 nt, Mycobacterium bovis subsp bovis AF2122/97
ucaguccgacaccggcgg

SEQ ID NO: 1032195 - RNA, 23 nt, Mycobacterium bovis subsp bovis AF2122/97
ucaguccgacaccggcggcaucg

SEQ ID NO: 1032196 - RNA, 24 nt, Mycobacterium bovis subsp bovis AF2122/97
ucagggugggcgacgucaucgccg

SEQ ID NO: 1032197 - RNA, 16 nt, Mycobacterium bovis subsp bovis AF2122/97
ucagguuggcggcugc

SEQ ID NO: 1032198 - RNA, 13 nt, Mycobacterium bovis subsp bovis AF2122/97
ucauccgaucgcc

SEQ ID NO: 1032199 - RNA, 16 nt, Mycobacterium bovis subsp bovis AF2122/97
ucauccccggccagcc

SEQ ID NO: 1032200 - RNA, 18 nt, Mycobacterium bovis subsp bovis AF2122/97
ucaucccuuucgcgccgc

SEQ ID NO: 1032201 - RNA, 19 nt, Mycobacterium bovis subsp bovis AF2122/97
ucaucccuuucgcgccgcg

SEQ ID NO: 1032202 - RNA, 17 nt, Mycobacterium bovis subsp bovis AF2122/97
ucauccgagcgguggug

SEQ ID NO: 1032203 - RNA, 19 nt, Mycobacterium bovis subsp bovis AF2122/97
ucauccuccugcgccgcag

SEQ ID NO: 1032204 - RNA, 23 nt, Mycobacterium bovis subsp bovis AF2122/97
ucaucccgauguaccccagcgcc

SEQ ID NO: 1032205 - RNA, 17 nt, Mycobacterium bovis subsp bovis AF2122/97
ucaucgaccuggccacg

SEQ ID NO: 1032206 - RNA, 15 nt, Mycobacterium bovis subsp bovis AF2122/97
ucaucgacggugauc

SEQ ID NO: 1032207 - RNA, 16 nt, Mycobacterium bovis subsp bovis AF2122/97
ucaucgacaaucgcac

SEQ ID NO: 1032208 - RNA, 19 nt, Mycobacterium bovis subsp bovis AF2122/97
ucauccuucgccggcgcca

SEQ ID NO: 1032209 - RNA, 20 nt, Mycobacterium bovis subsp bovis AF2122/97
ucauccuucgccggcgccag

SEQ ID NO: 1032210 - RNA, 15 nt, Mycobacterium bovis subsp bovis AF2122/97
ucaucgagcccgucc

SEQ ID NO: 1032211 - RNA, 18 nt, Mycobacterium bovis subsp bovis AF2122/97
ucaucgaucacacguccg

SEQ ID NO: 1032212 - RNA, 18 nt, Mycobacterium bovis subsp bovis AF2122/97
ucaucgauccucgcccgc

SEQ ID NO: 1032213 - RNA, 22 nt, Mycobacterium bovis subsp bovis AF2122/97
ucaucgccaaaaguacuggcgu

SEQ ID NO: 1032214 - RNA, 15 nt, Mycobacterium bovis subsp bovis AF2122/97
ucaucgccagcggca

SEQ ID NO: 1032215 - RNA, 23 nt, Mycobacterium bovis subsp bovis AF2122/97
ucaucgcccugggcgccggcguc

SEQ ID NO: 1032216 - RNA, 16 nt, Mycobacterium bovis subsp bovis AF2122/97
ucaucgccgacccgcc

SEQ ID NO: 1032217 - RNA, 17 nt, Mycobacterium bovis subsp bovis AF2122/97
ucauggccggucugcug

SEQ ID NO: 1032218 - RNA, 20 nt, Mycobacterium bovis subsp bovis AF2122/97
ucauggcgaaccgucagcgc

SEQ ID NO: 1032219 - RNA, 16 nt, Mycobacterium bovis subsp bovis AF2122/97
ucauggcgggugcggc

SEQ ID NO: 1032220 - RNA, 20 nt, Mycobacterium bovis subsp bovis AF2122/97
ucauggcccgaucgaccgcu

SEQ ID NO: 1032221 - RNA, 17 nt, Mycobacterium bovis subsp bovis AF2122/97
ucauguucucgaccgcg

SEQ ID NO: 1032222 - RNA, 16 nt, Mycobacterium bovis subsp bovis AF2122/97
ucauguucggccacca

SEQ ID NO: 1032223 - RNA, 14 nt, Mycobacterium bovis subsp bovis AF2122/97
ucaugcggcggcgc

SEQ ID NO: 1032224 - RNA, 21 nt, Mycobacterium bovis subsp bovis AF2122/97
ucaugcggcggcgcucgucga

SEQ ID NO: 1032225 - RNA, 20 nt, Mycobacterium bovis subsp bovis AF2122/97
ucaugcgauucugcguccug

SEQ ID NO: 1032226 - RNA, 13 nt, Mycobacterium bovis subsp bovis AF2122/97
ucaugaacaucgg

SEQ ID NO: 1032227 - RNA, 19 nt, Mycobacterium bovis subsp bovis AF2122/97
ucaucucccgaccgccgag

SEQ ID NO: 1032228 - RNA, 12 nt, Mycobacterium bovis subsp bovis AF2122/97
ucaucucgucgu

SEQ ID NO: 1032229 - RNA, 19 nt, Mycobacterium bovis subsp bovis AF2122/97
ucaucuguaaccuccucga

SEQ ID NO: 1032230 - RNA, 15 nt, Mycobacterium bovis subsp bovis AF2122/97
uccaccucgauggcg

SEQ ID NO: 1032231 - RNA, 14 nt, Mycobacterium bovis subsp bovis AF2122/97
uccacgacaaccgu

SEQ ID NO: 1032232 - RNA, 21 nt, Mycobacterium bovis subsp bovis AF2122/97
uccacgaugacgucgacaacg

SEQ ID NO: 1032233 - RNA, 14 nt, Mycobacterium bovis subsp bovis AF2122/97
uccacgaucggccc

SEQ ID NO: 1032234 - RNA, 21 nt, Mycobacterium bovis subsp bovis AF2122/97
uccacgauaucgaugcggcga

SEQ ID NO: 1032235 - RNA, 16 nt, Mycobacterium bovis subsp bovis AF2122/97
uccacgcacucgucgg

SEQ ID NO: 1032236 - RNA, 20 nt, Mycobacterium bovis subsp bovis AF2122/97
uccacccgauauucggccau

SEQ ID NO: 1032237 - RNA, 22 nt, Mycobacterium bovis subsp bovis AF2122/97
uccacccgccggccgucggccg

SEQ ID NO: 1032238 - RNA, 22 nt, Mycobacterium bovis subsp bovis AF2122/97
uccaccccugagcucccgccgg

SEQ ID NO: 1032239 - RNA, 21 nt, Mycobacterium bovis subsp bovis AF2122/97
uccagacgccacugccagccg

SEQ ID NO: 1032240 - RNA, 17 nt, Mycobacterium bovis subsp bovis AF2122/97
uccagaacgguggcgcg

SEQ ID NO: 1032241 - RNA, 15 nt, Mycobacterium bovis subsp bovis AF2122/97
uccagaacgcaucgg

SEQ ID NO: 1032242 - RNA, 18 nt, Mycobacterium bovis subsp bovis AF2122/97
uccaccaggacguggucg

SEQ ID NO: 1032243 - RNA, 13 nt, Mycobacterium bovis subsp bovis AF2122/97
uccaccagccggu

SEQ ID NO: 1032244 - RNA, 18 nt, Mycobacterium bovis subsp bovis AF2122/97
uccacccaagcucgguca

SEQ ID NO: 1032245 - RNA, 17 nt, Mycobacterium bovis subsp bovis AF2122/97
uccaagucacagcucac

SEQ ID NO: 1032246 - RNA, 20 nt, Mycobacterium bovis subsp bovis AF2122/97
uccaaguccuccacggcggg

SEQ ID NO: 1032247 - RNA, 22 nt, Mycobacterium bovis subsp bovis AF2122/97
uccaauccacgguugccggcgg

SEQ ID NO: 1032248 - RNA, 16 nt, Mycobacterium bovis subsp bovis AF2122/97
uccaauugcggccgcg

SEQ ID NO: 1032249 - RNA, 24 nt, Mycobacterium bovis subsp bovis AF2122/97
uccaauugcggccgcgcgcucgag

SEQ ID NO: 1032250 - RNA, 21 nt, Mycobacterium bovis subsp bovis AF2122/97
uccaauugggcgaugcggcgu

SEQ ID NO: 1032251 - RNA, 20 nt, Mycobacterium bovis subsp bovis AF2122/97
uccaagccagcguuggcggc

SEQ ID NO: 1032252 - RNA, 22 nt, Mycobacterium bovis subsp bovis AF2122/97
uccaaggcgcgcugggcgccgu

SEQ ID NO: 1032253 - RNA, 20 nt, Mycobacterium bovis subsp bovis AF2122/97
uccaaggcucagcagcgccg

SEQ ID NO: 1032254 - RNA, 22 nt, Mycobacterium bovis subsp bovis AF2122/97
uccagcccuguuugacugcgac

SEQ ID NO: 1032255 - RNA, 11 nt, Mycobacterium bovis subsp bovis AF2122/97
uccagccgacg

SEQ ID NO: 1032256 - RNA, 12 nt, Mycobacterium bovis subsp bovis AF2122/97
uccagccggcgc

SEQ ID NO: 1032257 - RNA, 17 nt, Mycobacterium bovis subsp bovis AF2122/97
uccagccggugccgccg

SEQ ID NO: 1032258 - RNA, 14 nt, Mycobacterium bovis subsp bovis AF2122/97
uccagccgucggcg

SEQ ID NO: 1032259 - RNA, 18 nt, Mycobacterium bovis subsp bovis AF2122/97
uccagcgaaccgacccgg

SEQ ID NO: 1032260 - RNA, 22 nt, Mycobacterium bovis subsp bovis AF2122/97
uccagcagcccgguggugcugu

SEQ ID NO: 1032261 - RNA, 16 nt, Mycobacterium bovis subsp bovis AF2122/97
uccagcagcgacgcug

SEQ ID NO: 1032262 - RNA, 16 nt, Mycobacterium bovis subsp bovis AF2122/97
uccagcagcgagucga

SEQ ID NO: 1032263 - RNA, 21 nt, Mycobacterium bovis subsp bovis AF2122/97
uccagcagcucgccggcacgc

SEQ ID NO: 1032264 - RNA, 22 nt, Mycobacterium bovis subsp bovis AF2122/97
uccagcagcucgccggcacgca

SEQ ID NO: 1032265 - RNA, 14 nt, Mycobacterium bovis subsp bovis AF2122/97
uccagcagcucggc

SEQ ID NO: 1032266 - RNA, 23 nt, Mycobacterium bovis subsp bovis AF2122/97
uccagcgcaucgagcccggacga

SEQ ID NO: 1032267 - RNA, 13 nt, Mycobacterium bovis subsp bovis AF2122/97
uccagcgcaucga

SEQ ID NO: 1032268 - RNA, 12 nt, Mycobacterium bovis subsp bovis AF2122/97
uccagcgcaccg

SEQ ID NO: 1032269 - RNA, 22 nt, Mycobacterium bovis subsp bovis AF2122/97
uccagcgcgcgccgcagcgcgu

SEQ ID NO: 1032270 - RNA, 23 nt, Mycobacterium bovis subsp bovis AF2122/97
uccagcgcgacguccaccagccg

SEQ ID NO: 1032271 - RNA, 19 nt, Mycobacterium bovis subsp bovis AF2122/97
uccagcgcgccacccagca

SEQ ID NO: 1032272 - RNA, 20 nt, Mycobacterium bovis subsp bovis AF2122/97
uccagcgccgcggcccgcuc

SEQ ID NO: 1032273 - RNA, 21 nt, Mycobacterium bovis subsp bovis AF2122/97
uccaggagagaucgucgaccc

SEQ ID NO: 1032274 - RNA, 22 nt, Mycobacterium bovis subsp bovis AF2122/97
uccaggcacuccagcggcgggg

SEQ ID NO: 1032275 - RNA, 22 nt, Mycobacterium bovis subsp bovis AF2122/97
uccaggaucgcguggcgcacca

SEQ ID NO: 1032276 - RNA, 13 nt, Mycobacterium bovis subsp bovis AF2122/97
uccaggccacccc

SEQ ID NO: 1032277 - RNA, 21 nt, Mycobacterium bovis subsp bovis AF2122/97
uccagguucuucuccaccacc

SEQ ID NO: 1032278 - RNA, 21 nt, Mycobacterium bovis subsp bovis AF2122/97
uccagguugaggugugccgac

SEQ ID NO: 1032279 - RNA, 13 nt, Mycobacterium bovis subsp bovis AF2122/97
uccagcucgggca

SEQ ID NO: 1032280 - RNA, 13 nt, Mycobacterium bovis subsp bovis AF2122/97
uccagcggcaccg

SEQ ID NO: 1032281 - RNA, 12 nt, Mycobacterium bovis subsp bovis AF2122/97
uccagugcugga

SEQ ID NO: 1032282 - RNA, 16 nt, Mycobacterium bovis subsp bovis AF2122/97
uccaguucaccgcgcu

SEQ ID NO: 1032283 - RNA, 16 nt, Mycobacterium bovis subsp bovis AF2122/97
uccgacaccggcggca

SEQ ID NO: 1032284 - RNA, 18 nt, Mycobacterium bovis subsp bovis AF2122/97
uccgacaugaaccggucg

SEQ ID NO: 1032285 - RNA, 21 nt, Mycobacterium bovis subsp bovis AF2122/97
uccgacaguccgcgccggcgg

SEQ ID NO: 1032286 - RNA, 14 nt, Mycobacterium bovis subsp bovis AF2122/97
uccgacccaacgac

SEQ ID NO: 1032287 - RNA, 21 nt, Mycobacterium bovis subsp bovis AF2122/97
uccgacgccugggcacggccg

SEQ ID NO: 1032288 - RNA, 15 nt, Mycobacterium bovis subsp bovis AF2122/97
uccgacgaccucgac

SEQ ID NO: 1032289 - RNA, 18 nt, Mycobacterium bovis subsp bovis AF2122/97
uccgaccucgccgcgcgu

SEQ ID NO: 1032290 - RNA, 14 nt, Mycobacterium bovis subsp bovis AF2122/97
uccgaucacccgca

SEQ ID NO: 1032291 - RNA, 15 nt, Mycobacterium bovis subsp bovis AF2122/97
uccgaucaccucggc

SEQ ID NO: 1032292 - RNA, 13 nt, Mycobacterium bovis subsp bovis AF2122/97
uccgaucgccgag

SEQ ID NO: 1032293 - RNA, 15 nt, Mycobacterium bovis subsp bovis AF2122/97
uccgaucgccgcgaa

SEQ ID NO: 1032294 - RNA, 14 nt, Mycobacterium bovis subsp bovis AF2122/97
uccgaucggcaauc

SEQ ID NO: 1032295 - RNA, 18 nt, Mycobacterium bovis subsp bovis AF2122/97
uccgaguugucgccggag

SEQ ID NO: 1032296 - RNA, 16 nt, Mycobacterium bovis subsp bovis AF2122/97
uccgauaaauggccga

SEQ ID NO: 1032297 - RNA, 17 nt, Mycobacterium bovis subsp bovis AF2122/97
uccgauaaauggccgau

SEQ ID NO: 1032298 - RNA, 20 nt, Mycobacterium bovis subsp bovis AF2122/97
uccgaugaacaucuggcgac

SEQ ID NO: 1032299 - RNA, 21 nt, Mycobacterium bovis subsp bovis AF2122/97
uccgaugaacaucuggcgacg

SEQ ID NO: 1032300 - RNA, 13 nt, Mycobacterium bovis subsp bovis AF2122/97
uccgaucggcgcg

SEQ ID NO: 1032301 - RNA, 17 nt, Mycobacterium bovis subsp bovis AF2122/97
uccgaucggcgcgccga

SEQ ID NO: 1032302 - RNA, 21 nt, Mycobacterium bovis subsp bovis AF2122/97
uccgauuccgaacuggucgac

SEQ ID NO: 1032303 - RNA, 14 nt, Mycobacterium bovis subsp bovis AF2122/97
ucccgggugcgacg

SEQ ID NO: 1032304 - RNA, 18 nt, Mycobacterium bovis subsp bovis AF2122/97
ucccgggugcgacgcgac

SEQ ID NO: 1032305 - RNA, 16 nt, Mycobacterium bovis subsp bovis AF2122/97
ucccgggccgccgcga

SEQ ID NO: 1032306 - RNA, 22 nt, Mycobacterium bovis subsp bovis AF2122/97
ucccgggcucugcugccagccg

SEQ ID NO: 1032307 - RNA, 22 nt, Mycobacterium bovis subsp bovis AF2122/97
ucccggggugccgaucgaugcc

SEQ ID NO: 1032308 - RNA, 21 nt, Mycobacterium bovis subsp bovis AF2122/97
ucccgggugcgacgcgaccgc

SEQ ID NO: 1032309 - RNA, 23 nt, Mycobacterium bovis subsp bovis AF2122/97
ucccggucuuuaauccagcgccg

SEQ ID NO: 1032310 - RNA, 15 nt, Mycobacterium bovis subsp bovis AF2122/97
ucccggugucgaugc

SEQ ID NO: 1032311 - RNA, 14 nt, Mycobacterium bovis subsp bovis AF2122/97
ucccgguccagccc

SEQ ID NO: 1032312 - RNA, 11 nt, Mycobacterium bovis subsp bovis AF2122/97
uccgacaccgg

SEQ ID NO: 1032313 - RNA, 14 nt, Mycobacterium bovis subsp bovis AF2122/97
uccgccgucgacca

SEQ ID NO: 1032314 - RNA, 16 nt, Mycobacterium bovis subsp bovis AF2122/97
uccgccgucgccaccg

SEQ ID NO: 1032315 - RNA, 17 nt, Mycobacterium bovis subsp bovis AF2122/97
uccgccgucgccgccgg

SEQ ID NO: 1032316 - RNA, 18 nt, Mycobacterium bovis subsp bovis AF2122/97
uccgccggugccgccguc

SEQ ID NO: 1032317 - RNA, 21 nt, Mycobacterium bovis subsp bovis AF2122/97
uccgccguaugccgccaaccg

SEQ ID NO: 1032318 - RNA, 20 nt, Mycobacterium bovis subsp bovis AF2122/97
uccgccgucaccccgauucg

SEQ ID NO: 1032319 - RNA, 13 nt, Mycobacterium bovis subsp bovis AF2122/97
uccgccggcgaca

SEQ ID NO: 1032320 - RNA, 21 nt, Mycobacterium bovis subsp bovis AF2122/97
uccgccgggccaggccgaugc

SEQ ID NO: 1032321 - RNA, 23 nt, Mycobacterium bovis subsp bovis AF2122/97
uccgccgggccaggccgaugccg

SEQ ID NO: 1032322 - RNA, 17 nt, Mycobacterium bovis subsp bovis AF2122/97
uccgccgggccccgggg

SEQ ID NO: 1032323 - RNA, 18 nt, Mycobacterium bovis subsp bovis AF2122/97
uccgcgccaguggccacc

SEQ ID NO: 1032324 - RNA, 15 nt, Mycobacterium bovis subsp bovis AF2122/97
uccgccguugccgau

SEQ ID NO: 1032325 - RNA, 16 nt, Mycobacterium bovis subsp bovis AF2122/97
uccgccguugccgccg

SEQ ID NO: 1032326 - RNA, 17 nt, Mycobacterium bovis subsp bovis AF2122/97
uccgccguugccgccgc

SEQ ID NO: 1032327 - RNA, 14 nt, Mycobacterium bovis subsp bovis AF2122/97
uccgccggccccac

SEQ ID NO: 1032328 - RNA, 22 nt, Mycobacterium bovis subsp bovis AF2122/97
uccgcgcaacuuccauuuucgc

SEQ ID NO: 1032329 - RNA, 14 nt, Mycobacterium bovis subsp bovis AF2122/97
uccgccacuggcgc

SEQ ID NO: 1032330 - RNA, 19 nt, Mycobacterium bovis subsp bovis AF2122/97
uccgccaggccgaccgcgc

SEQ ID NO: 1032331 - RNA, 14 nt, Mycobacterium bovis subsp bovis AF2122/97
uccgcccagcgagg

SEQ ID NO: 1032332 - RNA, 21 nt, Mycobacterium bovis subsp bovis AF2122/97
uccgccauugccguccggugg

SEQ ID NO: 1032333 - RNA, 17 nt, Mycobacterium bovis subsp bovis AF2122/97
uccgcaacaacgccgcg

SEQ ID NO: 1032334 - RNA, 22 nt, Mycobacterium bovis subsp bovis AF2122/97
uccgccaauccaccggugccgc

SEQ ID NO: 1032335 - RNA, 22 nt, Mycobacterium bovis subsp bovis AF2122/97
uccgcgccgcaccaucggcgag

SEQ ID NO: 1032336 - RNA, 16 nt, Mycobacterium bovis subsp bovis AF2122/97
uccgcgccgccccgcu

SEQ ID NO: 1032337 - RNA, 22 nt, Mycobacterium bovis subsp bovis AF2122/97
uccgcgccgacggccagcagga

SEQ ID NO: 1032338 - RNA, 12 nt, Mycobacterium bovis subsp bovis AF2122/97
uccgcgccgauc

SEQ ID NO: 1032339 - RNA, 15 nt, Mycobacterium bovis subsp bovis AF2122/97
uccgcgcucaaccgc

SEQ ID NO: 1032340 - RNA, 17 nt, Mycobacterium bovis subsp bovis AF2122/97
uccgcgcguccgucggc

SEQ ID NO: 1032341 - RNA, 15 nt, Mycobacterium bovis subsp bovis AF2122/97
uccgcgcgccggcgg

SEQ ID NO: 1032342 - RNA, 20 nt, Mycobacterium bovis subsp bovis AF2122/97
uccgcggcauuggcgucguc

SEQ ID NO: 1032343 - RNA, 14 nt, Mycobacterium bovis subsp bovis AF2122/97
uccgcggcgcagca

SEQ ID NO: 1032344 - RNA, 14 nt, Mycobacterium bovis subsp bovis AF2122/97
uccggagccccugu

SEQ ID NO: 1032345 - RNA, 16 nt, Mycobacterium bovis subsp bovis AF2122/97
uccggacccacccgca

SEQ ID NO: 1032346 - RNA, 17 nt, Mycobacterium bovis subsp bovis AF2122/97
uccggacccacccgcac

SEQ ID NO: 1032347 - RNA, 22 nt, Mycobacterium bovis subsp bovis AF2122/97
uccggacccacccgcaccgccg

SEQ ID NO: 1032348 - RNA, 19 nt, Mycobacterium bovis subsp bovis AF2122/97
uccgcucgguaccggucga

SEQ ID NO: 1032349 - RNA, 18 nt, Mycobacterium bovis subsp bovis AF2122/97
uccgcguggugcugaccg

SEQ ID NO: 1032350 - RNA, 17 nt, Mycobacterium bovis subsp bovis AF2122/97
uccgcgucuggacgcga

SEQ ID NO: 1032351 - RNA, 17 nt, Mycobacterium bovis subsp bovis AF2122/97
uccgcgucugcucgcga

SEQ ID NO: 1032352 - RNA, 18 nt, Mycobacterium bovis subsp bovis AF2122/97
uccgcgucggcggcgacc

SEQ ID NO: 1032353 - RNA, 22 nt, Mycobacterium bovis subsp bovis AF2122/97
uccgcgucggcggcgaccgcca

SEQ ID NO: 1032354 - RNA, 16 nt, Mycobacterium bovis subsp bovis AF2122/97
uccgcguagagcagca

SEQ ID NO: 1032355 - RNA, 19 nt, Mycobacterium bovis subsp bovis AF2122/97
uccggauucggacucgccg

SEQ ID NO: 1032356 - RNA, 15 nt, Mycobacterium bovis subsp bovis AF2122/97
uccggaugcgcaacc

SEQ ID NO: 1032357 - RNA, 22 nt, Mycobacterium bovis subsp bovis AF2122/97
uccggauggaacuggacaccgu

SEQ ID NO: 1032358 - RNA, 22 nt, Mycobacterium bovis subsp bovis AF2122/97
uccggauugaagucgucggcca

SEQ ID NO: 1032359 - RNA, 20 nt, Mycobacterium bovis subsp bovis AF2122/97
uccggaucggccuguccacc

SEQ ID NO: 1032360 - RNA, 20 nt, Mycobacterium bovis subsp bovis AF2122/97
uccggauaacccagcggcgc

SEQ ID NO: 1032361 - RNA, 17 nt, Mycobacterium bovis subsp bovis AF2122/97
uccggccgguccgggaa

SEQ ID NO: 1032362 - RNA, 14 nt, Mycobacterium bovis subsp bovis AF2122/97
uccggccgguuggc

SEQ ID NO: 1032363 - RNA, 20 nt, Mycobacterium bovis subsp bovis AF2122/97
uccggccgguuggccagcca

SEQ ID NO: 1032364 - RNA, 22 nt, Mycobacterium bovis subsp bovis AF2122/97
uccggccgguuggccagccaca

SEQ ID NO: 1032365 - RNA, 20 nt, Mycobacterium bovis subsp bovis AF2122/97
uccggccggccuagccgaug

SEQ ID NO: 1032366 - RNA, 15 nt, Mycobacterium bovis subsp bovis AF2122/97
uccggccggccagca

SEQ ID NO: 1032367 - RNA, 16 nt, Mycobacterium bovis subsp bovis AF2122/97
uccggccggccagcac

SEQ ID NO: 1032368 - RNA, 21 nt, Mycobacterium bovis subsp bovis AF2122/97
uccggccgcguugggguuggc

SEQ ID NO: 1032369 - RNA, 22 nt, Mycobacterium bovis subsp bovis AF2122/97
uccggcaagcacaccgccagcg

SEQ ID NO: 1032370 - RNA, 19 nt, Mycobacterium bovis subsp bovis AF2122/97
uccggcgaucaacgcgcac

SEQ ID NO: 1032371 - RNA, 23 nt, Mycobacterium bovis subsp bovis AF2122/97
uccggcgcacgaaaccgcagcgc

SEQ ID NO: 1032372 - RNA, 19 nt, Mycobacterium bovis subsp bovis AF2122/97
uccggcgacgaucucgccg

SEQ ID NO: 1032373 - RNA, 13 nt, Mycobacterium bovis subsp bovis AF2122/97
uccggcggcgacg

SEQ ID NO: 1032374 - RNA, 13 nt, Mycobacterium bovis subsp bovis AF2122/97
uccggcggcggcc

SEQ ID NO: 1032375 - RNA, 13 nt, Mycobacterium bovis subsp bovis AF2122/97
uccggcgcagcga

SEQ ID NO: 1032376 - RNA, 20 nt, Mycobacterium bovis subsp bovis AF2122/97
uccggcgcagcgaccgguaa

SEQ ID NO: 1032377 - RNA, 18 nt, Mycobacterium bovis subsp bovis AF2122/97
uccggcggugccgucgcc

SEQ ID NO: 1032378 - RNA, 12 nt, Mycobacterium bovis subsp bovis AF2122/97
uccggcgguggu

SEQ ID NO: 1032379 - RNA, 16 nt, Mycobacterium bovis subsp bovis AF2122/97
uccggcguacgccgua

SEQ ID NO: 1032380 - RNA, 15 nt, Mycobacterium bovis subsp bovis AF2122/97
uccggccgucgggca

SEQ ID NO: 1032381 - RNA, 18 nt, Mycobacterium bovis subsp bovis AF2122/97
uccggcggcuucgccgac

SEQ ID NO: 1032382 - RNA, 23 nt, Mycobacterium bovis subsp bovis AF2122/97
uccggcgggugccgagcuggcga

SEQ ID NO: 1032383 - RNA, 16 nt, Mycobacterium bovis subsp bovis AF2122/97
uccggcguggccccac

SEQ ID NO: 1032384 - RNA, 16 nt, Mycobacterium bovis subsp bovis AF2122/97
uccggcgugcagcacc

SEQ ID NO: 1032385 - RNA, 16 nt, Mycobacterium bovis subsp bovis AF2122/97
uccggcguucccgcca

SEQ ID NO: 1032386 - RNA, 19 nt, Mycobacterium bovis subsp bovis AF2122/97
uccccggcugccagcgccg

SEQ ID NO: 1032387 - RNA, 15 nt, Mycobacterium bovis subsp bovis AF2122/97
uccccggucgccgcg

SEQ ID NO: 1032388 - RNA, 17 nt, Mycobacterium bovis subsp bovis AF2122/97
uccccggcguccgaccg

SEQ ID NO: 1032389 - RNA, 17 nt, Mycobacterium bovis subsp bovis AF2122/97
uccccgguucugcgccc

SEQ ID NO: 1032390 - RNA, 23 nt, Mycobacterium bovis subsp bovis AF2122/97
uccccgucggggaaaacguaacg

SEQ ID NO: 1032391 - RNA, 19 nt, Mycobacterium bovis subsp bovis AF2122/97
uccccguccugccaguccg

SEQ ID NO: 1032392 - RNA, 16 nt, Mycobacterium bovis subsp bovis AF2122/97
uccccgguacgucgag

SEQ ID NO: 1032393 - RNA, 22 nt, Mycobacterium bovis subsp bovis AF2122/97
uccccgguagccccgucgaccu

SEQ ID NO: 1032394 - RNA, 14 nt, Mycobacterium bovis subsp bovis AF2122/97
uccccggccagccu

SEQ ID NO: 1032395 - RNA, 21 nt, Mycobacterium bovis subsp bovis AF2122/97
uccccggauuccucgucaccg

SEQ ID NO: 1032396 - RNA, 22 nt, Mycobacterium bovis subsp bovis AF2122/97
uccccgcccuugccgccagccc

SEQ ID NO: 1032397 - RNA, 14 nt, Mycobacterium bovis subsp bovis AF2122/97
uccccgccgacgcc

SEQ ID NO: 1032398 - RNA, 15 nt, Mycobacterium bovis subsp bovis AF2122/97
uccccgccgacgccg

SEQ ID NO: 1032399 - RNA, 16 nt, Mycobacterium bovis subsp bovis AF2122/97
uccccggauuccucgu

SEQ ID NO: 1032400 - RNA, 15 nt, Mycobacterium bovis subsp bovis AF2122/97
uccccgccggcgcca

SEQ ID NO: 1032401 - RNA, 19 nt, Mycobacterium bovis subsp bovis AF2122/97
uccccgccggcgccaccgu

SEQ ID NO: 1032402 - RNA, 14 nt, Mycobacterium bovis subsp bovis AF2122/97
uccccgcuuggcga

SEQ ID NO: 1032403 - RNA, 15 nt, Mycobacterium bovis subsp bovis AF2122/97
uccccagcgccaccg

SEQ ID NO: 1032404 - RNA, 22 nt, Mycobacterium bovis subsp bovis AF2122/97
uccccaugcagcgcgucgccga

SEQ ID NO: 1032405 - RNA, 19 nt, Mycobacterium bovis subsp bovis AF2122/97
uccccccguugccgccguu

SEQ ID NO: 1032406 - RNA, 20 nt, Mycobacterium bovis subsp bovis AF2122/97
ucccccgcuacgcgcgcucg

SEQ ID NO: 1032407 - RNA, 13 nt, Mycobacterium bovis subsp bovis AF2122/97
ucccccggcaccg

SEQ ID NO: 1032408 - RNA, 15 nt, Mycobacterium bovis subsp bovis AF2122/97
ucccccggcaccgcc

SEQ ID NO: 1032409 - RNA, 21 nt, Mycobacterium bovis subsp bovis AF2122/97
uccccgacaacgaaaccgacc

SEQ ID NO: 1032410 - RNA, 20 nt, Mycobacterium bovis subsp bovis AF2122/97
uccccgaccgccaccgccag

SEQ ID NO: 1032411 - RNA, 15 nt, Mycobacterium bovis subsp bovis AF2122/97
uccccgaccugcaag

SEQ ID NO: 1032412 - RNA, 21 nt, Mycobacterium bovis subsp bovis AF2122/97
uccccgacggacuccggccgg

SEQ ID NO: 1032413 - RNA, 21 nt, Mycobacterium bovis subsp bovis AF2122/97
uccccgaucugcuccucgguc

SEQ ID NO: 1032414 - RNA, 20 nt, Mycobacterium bovis subsp bovis AF2122/97
ucccgcggucgaucaggccg

SEQ ID NO: 1032415 - RNA, 18 nt, Mycobacterium bovis subsp bovis AF2122/97
ucccgcggacagcccgga

SEQ ID NO: 1032416 - RNA, 14 nt, Mycobacterium bovis subsp bovis AF2122/97
ucccgcgcgggcgg

SEQ ID NO: 1032417 - RNA, 19 nt, Mycobacterium bovis subsp bovis AF2122/97
ucccgauguaugacagguc

SEQ ID NO: 1032418 - RNA, 22 nt, Mycobacterium bovis subsp bovis AF2122/97
ucccgaugugaacgcacccgaa

SEQ ID NO: 1032419 - RNA, 22 nt, Mycobacterium bovis subsp bovis AF2122/97
ucccgcaaaaucgucagcgccg

SEQ ID NO: 1032420 - RNA, 18 nt, Mycobacterium bovis subsp bovis AF2122/97
ucccgauacggccggccg

SEQ ID NO: 1032421 - RNA, 14 nt, Mycobacterium bovis subsp bovis AF2122/97
ucccgaugcuggca

SEQ ID NO: 1032422 - RNA, 14 nt, Mycobacterium bovis subsp bovis AF2122/97
ucccgaugaccuug

SEQ ID NO: 1032423 - RNA, 17 nt, Mycobacterium bovis subsp bovis AF2122/97
ucccgaucgcgcuggga

SEQ ID NO: 1032424 - RNA, 18 nt, Mycobacterium bovis subsp bovis AF2122/97
ucccgaucccggccagcu

SEQ ID NO: 1032425 - RNA, 16 nt, Mycobacterium bovis subsp bovis AF2122/97
ucccgcucgcaggccg

SEQ ID NO: 1032426 - RNA, 15 nt, Mycobacterium bovis subsp bovis AF2122/97
ucccgcucgagcagc

SEQ ID NO: 1032427 - RNA, 20 nt, Mycobacterium bovis subsp bovis AF2122/97
ucccgcgugccacucgaugc

SEQ ID NO: 1032428 - RNA, 16 nt, Mycobacterium bovis subsp bovis AF2122/97
ucccggcacgaccacc

SEQ ID NO: 1032429 - RNA, 20 nt, Mycobacterium bovis subsp bovis AF2122/97
ucccggcacgaccaccggau

SEQ ID NO: 1032430 - RNA, 21 nt, Mycobacterium bovis subsp bovis AF2122/97
ucccgacaucgugauccccgc

SEQ ID NO: 1032431 - RNA, 18 nt, Mycobacterium bovis subsp bovis AF2122/97
ucccgaccaccucagcug

SEQ ID NO: 1032432 - RNA, 14 nt, Mycobacterium bovis subsp bovis AF2122/97
ucccgaccagcaga

SEQ ID NO: 1032433 - RNA, 18 nt, Mycobacterium bovis subsp bovis AF2122/97
ucccgaaccccgaccgcu

SEQ ID NO: 1032434 - RNA, 15 nt, Mycobacterium bovis subsp bovis AF2122/97
ucccgaaacgccggg

SEQ ID NO: 1032435 - RNA, 21 nt, Mycobacterium bovis subsp bovis AF2122/97
ucccgaacaauucacgcacca

SEQ ID NO: 1032436 - RNA, 14 nt, Mycobacterium bovis subsp bovis AF2122/97
ucccgagcccguca

SEQ ID NO: 1032437 - RNA, 21 nt, Mycobacterium bovis subsp bovis AF2122/97
ucccgagcucuaucgggaagc

SEQ ID NO: 1032438 - RNA, 12 nt, Mycobacterium bovis subsp bovis AF2122/97
ucccgaucaccc

SEQ ID NO: 1032439 - RNA, 13 nt, Mycobacterium bovis subsp bovis AF2122/97
ucccgaucccggc

SEQ ID NO: 1032440 - RNA, 14 nt, Mycobacterium bovis subsp bovis AF2122/97
uccccucggccgcc

SEQ ID NO: 1032441 - RNA, 14 nt, Mycobacterium bovis subsp bovis AF2122/97
uccccauugcgccc

SEQ ID NO: 1032442 - RNA, 20 nt, Mycobacterium bovis subsp bovis AF2122/97
ucccauuugccuugagccgc

SEQ ID NO: 1032443 - RNA, 14 nt, Mycobacterium bovis subsp bovis AF2122/97
uccccaagucgacg

SEQ ID NO: 1032444 - RNA, 20 nt, Mycobacterium bovis subsp bovis AF2122/97
ucccagggcucggcggcccg

SEQ ID NO: 1032445 - RNA, 19 nt, Mycobacterium bovis subsp bovis AF2122/97
ucccaggcguuuggcgugc

SEQ ID NO: 1032446 - RNA, 17 nt, Mycobacterium bovis subsp bovis AF2122/97
ucccaggacuccggccg

SEQ ID NO: 1032447 - RNA, 16 nt, Mycobacterium bovis subsp bovis AF2122/97
ucccagucgcggcgcg

SEQ ID NO: 1032448 - RNA, 15 nt, Mycobacterium bovis subsp bovis AF2122/97
ucccauaucgaucgg

SEQ ID NO: 1032449 - RNA, 16 nt, Mycobacterium bovis subsp bovis AF2122/97
ucccaugcugcgcaac

SEQ ID NO: 1032450 - RNA, 14 nt, Mycobacterium bovis subsp bovis AF2122/97
ucccagcccggccc

SEQ ID NO: 1032451 - RNA, 16 nt, Mycobacterium bovis subsp bovis AF2122/97
ucccagcacgguggcu

SEQ ID NO: 1032452 - RNA, 13 nt, Mycobacterium bovis subsp bovis AF2122/97
ucccaccaucgau

SEQ ID NO: 1032453 - RNA, 20 nt, Mycobacterium bovis subsp bovis AF2122/97
ucccacgccagcgcgaccaa

SEQ ID NO: 1032454 - RNA, 17 nt, Mycobacterium bovis subsp bovis AF2122/97
ucccacuggaggucguc

SEQ ID NO: 1032455 - RNA, 18 nt, Mycobacterium bovis subsp bovis AF2122/97
ucccacucgucgucgguc

SEQ ID NO: 1032456 - RNA, 14 nt, Mycobacterium bovis subsp bovis AF2122/97
ucccaacgcccggg

SEQ ID NO: 1032457 - RNA, 14 nt, Mycobacterium bovis subsp bovis AF2122/97
ucccaaccgcccgu

SEQ ID NO: 1032458 - RNA, 15 nt, Mycobacterium bovis subsp bovis AF2122/97
ucccaaccgcccgug

SEQ ID NO: 1032459 - RNA, 16 nt, Mycobacterium bovis subsp bovis AF2122/97
ucccaacacagccguc

SEQ ID NO: 1032460 - RNA, 17 nt, Mycobacterium bovis subsp bovis AF2122/97
ucccaacacagccgucg

SEQ ID NO: 1032461 - RNA, 15 nt, Mycobacterium bovis subsp bovis AF2122/97
ucccaacacggcgac

SEQ ID NO: 1032462 - RNA, 18 nt, Mycobacterium bovis subsp bovis AF2122/97
ucccaccaccaccgccgg

SEQ ID NO: 1032463 - RNA, 19 nt, Mycobacterium bovis subsp bovis AF2122/97
ucccaccaccgcucgucgu

SEQ ID NO: 1032464 - RNA, 21 nt, Mycobacterium bovis subsp bovis AF2122/97
ucccaccaccgcucgucgucc

SEQ ID NO: 1032465 - RNA, 20 nt, Mycobacterium bovis subsp bovis AF2122/97
ucccacaggcuuuuccggcg

SEQ ID NO: 1032466 - RNA, 16 nt, Mycobacterium bovis subsp bovis AF2122/97
uccauacagccgccga

SEQ ID NO: 1032467 - RNA, 14 nt, Mycobacterium bovis subsp bovis AF2122/97
ucggccauggcggc

SEQ ID NO: 1032468 - RNA, 16 nt, Mycobacterium bovis subsp bovis AF2122/97
ucggccauggcggcgc

SEQ ID NO: 1032469 - RNA, 16 nt, Mycobacterium bovis subsp bovis AF2122/97
ucggcccacacggucg

SEQ ID NO: 1032470 - RNA, 22 nt, Mycobacterium bovis subsp bovis AF2122/97
ucggccaugguguucggcagcg

SEQ ID NO: 1032471 - RNA, 20 nt, Mycobacterium bovis subsp bovis AF2122/97
ucggcccauaacagcuggcg

SEQ ID NO: 1032472 - RNA, 21 nt, Mycobacterium bovis subsp bovis AF2122/97
ucggcccauaacagcuggcgg

SEQ ID NO: 1032473 - RNA, 16 nt, Mycobacterium bovis subsp bovis AF2122/97
ucggcccagcgcgcca

SEQ ID NO: 1032474 - RNA, 22 nt, Mycobacterium bovis subsp bovis AF2122/97
ucggcccagguugccuuggcgg

SEQ ID NO: 1032475 - RNA, 18 nt, Mycobacterium bovis subsp bovis AF2122/97
ucggccccggccgcguca

SEQ ID NO: 1032476 - RNA, 13 nt, Mycobacterium bovis subsp bovis AF2122/97
ucggcccggcccg

SEQ ID NO: 1032477 - RNA, 14 nt, Mycobacterium bovis subsp bovis AF2122/97
ucggcccgcucacc

SEQ ID NO: 1032478 - RNA, 12 nt, Mycobacterium bovis subsp bovis AF2122/97
ucggccgaccgg

SEQ ID NO: 1032479 - RNA, 15 nt, Mycobacterium bovis subsp bovis AF2122/97
ucggccgaccgggcu

SEQ ID NO: 1032480 - RNA, 14 nt, Mycobacterium bovis subsp bovis AF2122/97
ucggcccuccaccg

SEQ ID NO: 1032481 - RNA, 15 nt, Mycobacterium bovis subsp bovis AF2122/97
ucggccgacaccgcc

SEQ ID NO: 1032482 - RNA, 20 nt, Mycobacterium bovis subsp bovis AF2122/97
ucggccauagcgccgcgccc

SEQ ID NO: 1032483 - RNA, 20 nt, Mycobacterium bovis subsp bovis AF2122/97
ucggccaucagaaccuccuc

SEQ ID NO: 1032484 - RNA, 15 nt, Mycobacterium bovis subsp bovis AF2122/97
ucggccaucugcucg

SEQ ID NO: 1032485 - RNA, 14 nt, Mycobacterium bovis subsp bovis AF2122/97
ucggccauccaccg

SEQ ID NO: 1032486 - RNA, 15 nt, Mycobacterium bovis subsp bovis AF2122/97
ucggccauccaccgc

SEQ ID NO: 1032487 - RNA, 13 nt, Mycobacterium bovis subsp bovis AF2122/97
ucggccagcaacu

SEQ ID NO: 1032488 - RNA, 22 nt, Mycobacterium bovis subsp bovis AF2122/97
ucggcauucgcaccaccugggc

SEQ ID NO: 1032489 - RNA, 17 nt, Mycobacterium bovis subsp bovis AF2122/97
ucggccagaucacgcac

SEQ ID NO: 1032490 - RNA, 14 nt, Mycobacterium bovis subsp bovis AF2122/97
ucggcaucgccgag

SEQ ID NO: 1032491 - RNA, 15 nt, Mycobacterium bovis subsp bovis AF2122/97
ucggcaucgccgcgg

SEQ ID NO: 1032492 - RNA, 15 nt, Mycobacterium bovis subsp bovis AF2122/97
ucggcaucggcgacg

SEQ ID NO: 1032493 - RNA, 18 nt, Mycobacterium bovis subsp bovis AF2122/97
ucggcauccaggcugucg

SEQ ID NO: 1032494 - RNA, 21 nt, Mycobacterium bovis subsp bovis AF2122/97
ucggcaugacgaaugcgggug

SEQ ID NO: 1032495 - RNA, 15 nt, Mycobacterium bovis subsp bovis AF2122/97
ucggcaugggccggc

SEQ ID NO: 1032496 - RNA, 17 nt, Mycobacterium bovis subsp bovis AF2122/97
ucggcauucaccgcgga

SEQ ID NO: 1032497 - RNA, 22 nt, Mycobacterium bovis subsp bovis AF2122/97
ucggcagaauccggucgaugac

SEQ ID NO: 1032498 - RNA, 18 nt, Mycobacterium bovis subsp bovis AF2122/97
ucggcaguugaacucgac

SEQ ID NO: 1032499 - RNA, 15 nt, Mycobacterium bovis subsp bovis AF2122/97
ucggcauccaggcug

SEQ ID NO: 1032500 - RNA, 19 nt, Mycobacterium bovis subsp bovis AF2122/97
ucggcagcagcggugcagc

SEQ ID NO: 1032501 - RNA, 16 nt, Mycobacterium bovis subsp bovis AF2122/97
ucggcagcagcgcaac

SEQ ID NO: 1032502 - RNA, 22 nt, Mycobacterium bovis subsp bovis AF2122/97
ucggcagcagcgcaacggccag

SEQ ID NO: 1032503 - RNA, 12 nt, Mycobacterium bovis subsp bovis AF2122/97
ucggcagcagcg

SEQ ID NO: 1032504 - RNA, 14 nt, Mycobacterium bovis subsp bovis AF2122/97
ucggaggcccgcca

SEQ ID NO: 1032505 - RNA, 19 nt, Mycobacterium bovis subsp bovis AF2122/97
ucggaggcccgccacaacg

SEQ ID NO: 1032506 - RNA, 17 nt, Mycobacterium bovis subsp bovis AF2122/97
ucggaggcgaccacguc

SEQ ID NO: 1032507 - RNA, 18 nt, Mycobacterium bovis subsp bovis AF2122/97
ucggagccgucgagcagc

SEQ ID NO: 1032508 - RNA, 16 nt, Mycobacterium bovis subsp bovis AF2122/97
ucggagcgcacgaacg

SEQ ID NO: 1032509 - RNA, 17 nt, Mycobacterium bovis subsp bovis AF2122/97
ucggagcgggcuccggc

SEQ ID NO: 1032510 - RNA, 17 nt, Mycobacterium bovis subsp bovis AF2122/97
ucggagcgggugcgggc

SEQ ID NO: 1032511 - RNA, 20 nt, Mycobacterium bovis subsp bovis AF2122/97
ucggaggugaccucgauggc

SEQ ID NO: 1032512 - RNA, 14 nt, Mycobacterium bovis subsp bovis AF2122/97
ucggagcugggcug

SEQ ID NO: 1032513 - RNA, 18 nt, Mycobacterium bovis subsp bovis AF2122/97
ucggaggcgaccacgucg

SEQ ID NO: 1032514 - RNA, 17 nt, Mycobacterium bovis subsp bovis AF2122/97
ucggcagacccgagcgc

SEQ ID NO: 1032515 - RNA, 16 nt, Mycobacterium bovis subsp bovis AF2122/97
ucggcacuuagcccga

SEQ ID NO: 1032516 - RNA, 19 nt, Mycobacterium bovis subsp bovis AF2122/97
ucggcacuagcgagccggc

SEQ ID NO: 1032517 - RNA, 17 nt, Mycobacterium bovis subsp bovis AF2122/97
ucggcaccgcggccgcg

SEQ ID NO: 1032518 - RNA, 14 nt, Mycobacterium bovis subsp bovis AF2122/97
ucggcacgacccgg

SEQ ID NO: 1032519 - RNA, 15 nt, Mycobacterium bovis subsp bovis AF2122/97
ucggcacgacccggg

SEQ ID NO: 1032520 - RNA, 17 nt, Mycobacterium bovis subsp bovis AF2122/97
ucggcacgacccgggaa

SEQ ID NO: 1032521 - RNA, 23 nt, Mycobacterium bovis subsp bovis AF2122/97
ucgcggagccgucgcaucagguc

SEQ ID NO: 1032522 - RNA, 15 nt, Mycobacterium bovis subsp bovis AF2122/97
ucgcggacccgcgcg

SEQ ID NO: 1032523 - RNA, 19 nt, Mycobacterium bovis subsp bovis AF2122/97
ucgcggacccgcgcgucgc

SEQ ID NO: 1032524 - RNA, 16 nt, Mycobacterium bovis subsp bovis AF2122/97
ucgcggacggugcggu

SEQ ID NO: 1032525 - RNA, 19 nt, Mycobacterium bovis subsp bovis AF2122/97
ucgcggacccgucggcgug

SEQ ID NO: 1032526 - RNA, 20 nt, Mycobacterium bovis subsp bovis AF2122/97
ucgcuacgucgaccgacggg

SEQ ID NO: 1032527 - RNA, 12 nt, Mycobacterium bovis subsp bovis AF2122/97
ucgcggacccgc

SEQ ID NO: 1032528 - RNA, 22 nt, Mycobacterium bovis subsp bovis AF2122/97
ucgcggacagguagucgccggu

SEQ ID NO: 1032529 - RNA, 19 nt, Mycobacterium bovis subsp bovis AF2122/97
ucgcggaacucgucgcugc

SEQ ID NO: 1032530 - RNA, 20 nt, Mycobacterium bovis subsp bovis AF2122/97
ucgcggaagcgggcgaugcc

SEQ ID NO: 1032531 - RNA, 15 nt, Mycobacterium bovis subsp bovis AF2122/97
ucgcgcuugcgccgc

SEQ ID NO: 1032532 - RNA, 15 nt, Mycobacterium bovis subsp bovis AF2122/97
ucgcgcuguccacga

SEQ ID NO: 1032533 - RNA, 12 nt, Mycobacterium bovis subsp bovis AF2122/97
ucgcgcuggcgc

SEQ ID NO: 1032534 - RNA, 23 nt, Mycobacterium bovis subsp bovis AF2122/97
ucgcgcuggcgcccuugccggcg

SEQ ID NO: 1032535 - RNA, 21 nt, Mycobacterium bovis subsp bovis AF2122/97
ucgcgcuggcgccggccagcc

SEQ ID NO: 1032536 - RNA, 12 nt, Mycobacterium bovis subsp bovis AF2122/97
ucgcgcugcggc

SEQ ID NO: 1032537 - RNA, 24 nt, Mycobacterium bovis subsp bovis AF2122/97
ucgcgcugcggcccacaccagcgc

SEQ ID NO: 1032538 - RNA, 15 nt, Mycobacterium bovis subsp bovis AF2122/97
ucgcucaccggcugg

SEQ ID NO: 1032539 - RNA, 18 nt, Mycobacterium bovis subsp bovis AF2122/97
ucgcucagggugucgaca

SEQ ID NO: 1032540 - RNA, 13 nt, Mycobacterium bovis subsp bovis AF2122/97
ucgcuaugcgccg

SEQ ID NO: 1032541 - RNA, 16 nt, Mycobacterium bovis subsp bovis AF2122/97
ucgcuaucgugcgccg

SEQ ID NO: 1032542 - RNA, 16 nt, Mycobacterium bovis subsp bovis AF2122/97
ucgcucaucgucaccu

SEQ ID NO: 1032543 - RNA, 17 nt, Mycobacterium bovis subsp bovis AF2122/97
ucgcugagcacggcgcg

SEQ ID NO: 1032544 - RNA, 19 nt, Mycobacterium bovis subsp bovis AF2122/97
ucgcugagcacggcgcggc

SEQ ID NO: 1032545 - RNA, 19 nt, Mycobacterium bovis subsp bovis AF2122/97
ucgcugaucuggggcacca

SEQ ID NO: 1032546 - RNA, 14 nt, Mycobacterium bovis subsp bovis AF2122/97
ucgcugauugcggu

SEQ ID NO: 1032547 - RNA, 15 nt, Mycobacterium bovis subsp bovis AF2122/97
ucgcugcaaccgccg

SEQ ID NO: 1032548 - RNA, 14 nt, Mycobacterium bovis subsp bovis AF2122/97
ucgcugccgccguc

SEQ ID NO: 1032549 - RNA, 14 nt, Mycobacterium bovis subsp bovis AF2122/97
ucgcugccgccgcc

SEQ ID NO: 1032550 - RNA, 12 nt, Mycobacterium bovis subsp bovis AF2122/97
ucgcugcagcag

SEQ ID NO: 1032551 - RNA, 17 nt, Mycobacterium bovis subsp bovis AF2122/97
ucgcugccgccaccgcu

SEQ ID NO: 1032552 - RNA, 17 nt, Mycobacterium bovis subsp bovis AF2122/97
ucgcugcgaugcugauc

SEQ ID NO: 1032553 - RNA, 20 nt, Mycobacterium bovis subsp bovis AF2122/97
ucgcugccuucaucggggcu

SEQ ID NO: 1032554 - RNA, 22 nt, Mycobacterium bovis subsp bovis AF2122/97
ucgcugcgacuggugccugccg

SEQ ID NO: 1032555 - RNA, 14 nt, Mycobacterium bovis subsp bovis AF2122/97
ucgcuggccgcgag

SEQ ID NO: 1032556 - RNA, 20 nt, Mycobacterium bovis subsp bovis AF2122/97
ucgcuggccggcaccgugaa

SEQ ID NO: 1032557 - RNA, 12 nt, Mycobacterium bovis subsp bovis AF2122/97
ucgcuggccagg

SEQ ID NO: 1032558 - RNA, 21 nt, Mycobacterium bovis subsp bovis AF2122/97
ucgcugcugcgaucgccgcgc

SEQ ID NO: 1032559 - RNA, 16 nt, Mycobacterium bovis subsp bovis AF2122/97
ucgcugcugcgaucgc

SEQ ID NO: 1032560 - RNA, 17 nt, Mycobacterium bovis subsp bovis AF2122/97
ucgcugcugcgaucgcc

SEQ ID NO: 1032561 - RNA, 21 nt, Mycobacterium bovis subsp bovis AF2122/97
ucggaccagcugccggcgacc

SEQ ID NO: 1032562 - RNA, 18 nt, Mycobacterium bovis subsp bovis AF2122/97
ucggacggccaucgccag

SEQ ID NO: 1032563 - RNA, 18 nt, Mycobacterium bovis subsp bovis AF2122/97
ucggaccuuccgggugaa

SEQ ID NO: 1032564 - RNA, 13 nt, Mycobacterium bovis subsp bovis AF2122/97
ucggacugcagcg

SEQ ID NO: 1032565 - RNA, 21 nt, Mycobacterium bovis subsp bovis AF2122/97
ucggacggccaucgccagccu

SEQ ID NO: 1032566 - RNA, 24 nt, Mycobacterium bovis subsp bovis AF2122/97
ucggacggcugagacagaccgggc

SEQ ID NO: 1032567 - RNA, 15 nt, Mycobacterium bovis subsp bovis AF2122/97
ucggacucgccgacg

SEQ ID NO: 1032568 - RNA, 22 nt, Mycobacterium bovis subsp bovis AF2122/97
ucggacucgccgacgucgacgc

SEQ ID NO: 1032569 - RNA, 14 nt, Mycobacterium bovis subsp bovis AF2122/97
ucggagacgucuuc

SEQ ID NO: 1032570 - RNA, 21 nt, Mycobacterium bovis subsp bovis AF2122/97
ucggagaacacgucgacaccg

SEQ ID NO: 1032571 - RNA, 18 nt, Mycobacterium bovis subsp bovis AF2122/97
ucggacagcagccggcgu

SEQ ID NO: 1032572 - RNA, 14 nt, Mycobacterium bovis subsp bovis AF2122/97
ucggacagcgucuc

SEQ ID NO: 1032573 - RNA, 21 nt, Mycobacterium bovis subsp bovis AF2122/97
ucggaccacaucuggucacgg

SEQ ID NO: 1032574 - RNA, 14 nt, Mycobacterium bovis subsp bovis AF2122/97
ucggacacguggcg

SEQ ID NO: 1032575 - RNA, 20 nt, Mycobacterium bovis subsp bovis AF2122/97
ucggaauggucccgggucca

SEQ ID NO: 1032576 - RNA, 23 nt, Mycobacterium bovis subsp bovis AF2122/97
ucggacaaggacugaccgucugc

SEQ ID NO: 1032577 - RNA, 22 nt, Mycobacterium bovis subsp bovis AF2122/97
ucggacacagcccacaggcggc

SEQ ID NO: 1032578 - RNA, 20 nt, Mycobacterium bovis subsp bovis AF2122/97
ucggacacgcuguacaagca

SEQ ID NO: 1032579 - RNA, 17 nt, Mycobacterium bovis subsp bovis AF2122/97
ucgggaacuucgccgaa

SEQ ID NO: 1032580 - RNA, 21 nt, Mycobacterium bovis subsp bovis AF2122/97
ucgggaacuucgccgaagcgc

SEQ ID NO: 1032581 - RNA, 19 nt, Mycobacterium bovis subsp bovis AF2122/97
ucgggaccaccgaccgcgu

SEQ ID NO: 1032582 - RNA, 23 nt, Mycobacterium bovis subsp bovis AF2122/97
ucgggacaaagccgaacgacagc

SEQ ID NO: 1032583 - RNA, 14 nt, Mycobacterium bovis subsp bovis AF2122/97
ucggcuuccuccuc

SEQ ID NO: 1032584 - RNA, 16 nt, Mycobacterium bovis subsp bovis AF2122/97
ucggcuuccuccucgg

SEQ ID NO: 1032585 - RNA, 20 nt, Mycobacterium bovis subsp bovis AF2122/97
ucggcuuccuccucggcgcg

SEQ ID NO: 1032586 - RNA, 16 nt, Mycobacterium bovis subsp bovis AF2122/97
ucggcuggcgugcugc

SEQ ID NO: 1032587 - RNA, 19 nt, Mycobacterium bovis subsp bovis AF2122/97
ucggcuggacggcgccggu

SEQ ID NO: 1032588 - RNA, 17 nt, Mycobacterium bovis subsp bovis AF2122/97
ucggcugcgcgcucggc

SEQ ID NO: 1032589 - RNA, 20 nt, Mycobacterium bovis subsp bovis AF2122/97
ucggcugcgcgcucggccag

SEQ ID NO: 1032590 - RNA, 14 nt, Mycobacterium bovis subsp bovis AF2122/97
ucgggagcugauca

SEQ ID NO: 1032591 - RNA, 24 nt, Mycobacterium bovis subsp bovis AF2122/97
ucgggagucuucggcgacaggccg

SEQ ID NO: 1032592 - RNA, 23 nt, Mycobacterium bovis subsp bovis AF2122/97
ucgggacuuccggggagcagaga

SEQ ID NO: 1032593 - RNA, 22 nt, Mycobacterium bovis subsp bovis AF2122/97
ucgggauccaugcgggugguga

SEQ ID NO: 1032594 - RNA, 17 nt, Mycobacterium bovis subsp bovis AF2122/97
ucgggaucugggcucgg

SEQ ID NO: 1032595 - RNA, 13 nt, Mycobacterium bovis subsp bovis AF2122/97
ucgggaucggcgg

SEQ ID NO: 1032596 - RNA, 16 nt, Mycobacterium bovis subsp bovis AF2122/97
ucgggauucggcagcg

SEQ ID NO: 1032597 - RNA, 18 nt, Mycobacterium bovis subsp bovis AF2122/97
ucgggauucgggcgccgc

SEQ ID NO: 1032598 - RNA, 20 nt, Mycobacterium bovis subsp bovis AF2122/97
ucgggauggacggcagccag

SEQ ID NO: 1032599 - RNA, 14 nt, Mycobacterium bovis subsp bovis AF2122/97
ucgggcacaccgac

SEQ ID NO: 1032600 - RNA, 23 nt, Mycobacterium bovis subsp bovis AF2122/97
ucgggcaacuucagcaacggcau

SEQ ID NO: 1032601 - RNA, 18 nt, Mycobacterium bovis subsp bovis AF2122/97
ucgggcacaccgacgccg

SEQ ID NO: 1032602 - RNA, 18 nt, Mycobacterium bovis subsp bovis AF2122/97
ucgggcaaccugccgggc

SEQ ID NO: 1032603 - RNA, 14 nt, Mycobacterium bovis subsp bovis AF2122/97
ucggcgcucgucgc

SEQ ID NO: 1032604 - RNA, 16 nt, Mycobacterium bovis subsp bovis AF2122/97
ucggcgcgguggggcg

SEQ ID NO: 1032605 - RNA, 21 nt, Mycobacterium bovis subsp bovis AF2122/97
ucggcgcgcggguugucggcg

SEQ ID NO: 1032606 - RNA, 14 nt, Mycobacterium bovis subsp bovis AF2122/97
ucggcgcgucgauc

SEQ ID NO: 1032607 - RNA, 20 nt, Mycobacterium bovis subsp bovis AF2122/97
ucggcggccgccgcguuucg

SEQ ID NO: 1032608 - RNA, 21 nt, Mycobacterium bovis subsp bovis AF2122/97
ucggcggcccggccgaacgcc

SEQ ID NO: 1032609 - RNA, 15 nt, Mycobacterium bovis subsp bovis AF2122/97
ucggcggccgagcgc

SEQ ID NO: 1032610 - RNA, 18 nt, Mycobacterium bovis subsp bovis AF2122/97
ucggcggccgagcgcacc

SEQ ID NO: 1032611 - RNA, 19 nt, Mycobacterium bovis subsp bovis AF2122/97
ucggcggccgcgugcucgc

SEQ ID NO: 1032612 - RNA, 22 nt, Mycobacterium bovis subsp bovis AF2122/97
ucggcggccgcgugcucgccgu

SEQ ID NO: 1032613 - RNA, 17 nt, Mycobacterium bovis subsp bovis AF2122/97
ucggcggccucggucug

SEQ ID NO: 1032614 - RNA, 14 nt, Mycobacterium bovis subsp bovis AF2122/97
ucggcggccguggc

SEQ ID NO: 1032615 - RNA, 20 nt, Mycobacterium bovis subsp bovis AF2122/97
ucggcggccgugucgggcgc

SEQ ID NO: 1032616 - RNA, 17 nt, Mycobacterium bovis subsp bovis AF2122/97
ucggcggcgaccgccag

SEQ ID NO: 1032617 - RNA, 18 nt, Mycobacterium bovis subsp bovis AF2122/97
ucggcggcgaccgccagc

SEQ ID NO: 1032618 - RNA, 20 nt, Mycobacterium bovis subsp bovis AF2122/97
ucggcggccuucuccccgau

SEQ ID NO: 1032619 - RNA, 20 nt, Mycobacterium bovis subsp bovis AF2122/97
ucggcugauuggcccaccgc

SEQ ID NO: 1032620 - RNA, 22 nt, Mycobacterium bovis subsp bovis AF2122/97
ucggcugccgcgcgcugccgcu

SEQ ID NO: 1032621 - RNA, 21 nt, Mycobacterium bovis subsp bovis AF2122/97
ucggcugcgacaggacgucgg

SEQ ID NO: 1032622 - RNA, 15 nt, Mycobacterium bovis subsp bovis AF2122/97
ucggcugcgcgcucg

SEQ ID NO: 1032623 - RNA, 12 nt, Mycobacterium bovis subsp bovis AF2122/97
ucggcuccgccg

SEQ ID NO: 1032624 - RNA, 14 nt, Mycobacterium bovis subsp bovis AF2122/97
ucggcuccgccgcg

SEQ ID NO: 1032625 - RNA, 16 nt, Mycobacterium bovis subsp bovis AF2122/97
ucggcgucguccgcgc

SEQ ID NO: 1032626 - RNA, 16 nt, Mycobacterium bovis subsp bovis AF2122/97
ucggcgucgucgacgg

SEQ ID NO: 1032627 - RNA, 19 nt, Mycobacterium bovis subsp bovis AF2122/97
ucggcgucguauucgaugc

SEQ ID NO: 1032628 - RNA, 16 nt, Mycobacterium bovis subsp bovis AF2122/97
ucggcgugcagcagcu

SEQ ID NO: 1032629 - RNA, 15 nt, Mycobacterium bovis subsp bovis AF2122/97
ucggcgugaucaccg

SEQ ID NO: 1032630 - RNA, 21 nt, Mycobacterium bovis subsp bovis AF2122/97
ucggcgucguggcuuccggug

SEQ ID NO: 1032631 - RNA, 20 nt, Mycobacterium bovis subsp bovis AF2122/97
ucggcgagcacgucacgcgc

SEQ ID NO: 1032632 - RNA, 13 nt, Mycobacterium bovis subsp bovis AF2122/97
ucggcgacgucgg

SEQ ID NO: 1032633 - RNA, 16 nt, Mycobacterium bovis subsp bovis AF2122/97
ucggcgacgucggcgg

SEQ ID NO: 1032634 - RNA, 20 nt, Mycobacterium bovis subsp bovis AF2122/97
ucggcgacugcgucggcggc

SEQ ID NO: 1032635 - RNA, 14 nt, Mycobacterium bovis subsp bovis AF2122/97
ucggcgacguccag

SEQ ID NO: 1032636 - RNA, 14 nt, Mycobacterium bovis subsp bovis AF2122/97
ucggcgacgccguc

SEQ ID NO: 1032637 - RNA, 18 nt, Mycobacterium bovis subsp bovis AF2122/97
ucggcgacgccgucuagc

SEQ ID NO: 1032638 - RNA, 12 nt, Mycobacterium bovis subsp bovis AF2122/97
ucggcgacgcgc

SEQ ID NO: 1032639 - RNA, 16 nt, Mycobacterium bovis subsp bovis AF2122/97
ucggcgacgcgccggu

SEQ ID NO: 1032640 - RNA, 16 nt, Mycobacterium bovis subsp bovis AF2122/97
ucggcgacggccagcg

SEQ ID NO: 1032641 - RNA, 13 nt, Mycobacterium bovis subsp bovis AF2122/97
ucggcgaccgcgc

SEQ ID NO: 1032642 - RNA, 21 nt, Mycobacterium bovis subsp bovis AF2122/97
ucggcgauccgacgaccucga

SEQ ID NO: 1032643 - RNA, 19 nt, Mycobacterium bovis subsp bovis AF2122/97
ucggcgaucaagccucuau

SEQ ID NO: 1032644 - RNA, 16 nt, Mycobacterium bovis subsp bovis AF2122/97
ucggcgaucucgucgc

SEQ ID NO: 1032645 - RNA, 15 nt, Mycobacterium bovis subsp bovis AF2122/97
ucggcgaucucgucg

SEQ ID NO: 1032646 - RNA, 21 nt, Mycobacterium bovis subsp bovis AF2122/97
ucggcgaugacaucaccgacc

SEQ ID NO: 1032647 - RNA, 19 nt, Mycobacterium bovis subsp bovis AF2122/97
ucggcgaugaucaccaguc

SEQ ID NO: 1032648 - RNA, 21 nt, Mycobacterium bovis subsp bovis AF2122/97
ucggcgaugaugcucgacaac

SEQ ID NO: 1032649 - RNA, 12 nt, Mycobacterium bovis subsp bovis AF2122/97
ucggccgcacug

SEQ ID NO: 1032650 - RNA, 22 nt, Mycobacterium bovis subsp bovis AF2122/97
ucggccgcacugggugcgucga

SEQ ID NO: 1032651 - RNA, 17 nt, Mycobacterium bovis subsp bovis AF2122/97
ucggccgcaucgcccaa

SEQ ID NO: 1032652 - RNA, 22 nt, Mycobacterium bovis subsp bovis AF2122/97
ucggccccgccgccggugcgga

SEQ ID NO: 1032653 - RNA, 19 nt, Mycobacterium bovis subsp bovis AF2122/97
ucggccugcugcugcagcg

SEQ ID NO: 1032654 - RNA, 18 nt, Mycobacterium bovis subsp bovis AF2122/97
ucggcgacgaugucgagc

SEQ ID NO: 1032655 - RNA, 19 nt, Mycobacterium bovis subsp bovis AF2122/97
ucggcgacgaugucgagcg

SEQ ID NO: 1032656 - RNA, 17 nt, Mycobacterium bovis subsp bovis AF2122/97
ucggcgaccgcgucguc

SEQ ID NO: 1032657 - RNA, 13 nt, Mycobacterium bovis subsp bovis AF2122/97
ucggcgaccggcc

SEQ ID NO: 1032658 - RNA, 16 nt, Mycobacterium bovis subsp bovis AF2122/97
ucggcgaccggccggc

SEQ ID NO: 1032659 - RNA, 19 nt, Mycobacterium bovis subsp bovis AF2122/97
ucggcgaccggccggccgc

SEQ ID NO: 1032660 - RNA, 20 nt, Mycobacterium bovis subsp bovis AF2122/97
ucggcgaccggccggccgcg

SEQ ID NO: 1032661 - RNA, 18 nt, Mycobacterium bovis subsp bovis AF2122/97
ucggcgaacccuccgcag

SEQ ID NO: 1032662 - RNA, 21 nt, Mycobacterium bovis subsp bovis AF2122/97
ucggcgaaaggccagucgugc

SEQ ID NO: 1032663 - RNA, 15 nt, Mycobacterium bovis subsp bovis AF2122/97
ucggccuguccaccg

SEQ ID NO: 1032664 - RNA, 19 nt, Mycobacterium bovis subsp bovis AF2122/97
ucggcgcaaucaacgucac

SEQ ID NO: 1032665 - RNA, 20 nt, Mycobacterium bovis subsp bovis AF2122/97
ucggcgccucggaccagacc

SEQ ID NO: 1032666 - RNA, 20 nt, Mycobacterium bovis subsp bovis AF2122/97
ucggcgccgucggagccggc

SEQ ID NO: 1032667 - RNA, 19 nt, Mycobacterium bovis subsp bovis AF2122/97
ucggcgccgucucgaucgc

SEQ ID NO: 1032668 - RNA, 22 nt, Mycobacterium bovis subsp bovis AF2122/97
ucggcgccgucucgaucgcggu

SEQ ID NO: 1032669 - RNA, 12 nt, Mycobacterium bovis subsp bovis AF2122/97
ucggcgcgcacc

SEQ ID NO: 1032670 - RNA, 15 nt, Mycobacterium bovis subsp bovis AF2122/97
ucggcgcgcaccucg

SEQ ID NO: 1032671 - RNA, 23 nt, Mycobacterium bovis subsp bovis AF2122/97
ucggcgccuggcggcgccgcaga

SEQ ID NO: 1032672 - RNA, 21 nt, Mycobacterium bovis subsp bovis AF2122/97
ucggcgcgccguugccggcca

SEQ ID NO: 1032673 - RNA, 21 nt, Mycobacterium bovis subsp bovis AF2122/97
ucggcgcgccggucgccgacg

SEQ ID NO: 1032674 - RNA, 14 nt, Mycobacterium bovis subsp bovis AF2122/97
ucggcgcagcuaac

SEQ ID NO: 1032675 - RNA, 20 nt, Mycobacterium bovis subsp bovis AF2122/97
ucggcgcagcuaacccgcca

SEQ ID NO: 1032676 - RNA, 16 nt, Mycobacterium bovis subsp bovis AF2122/97
ucggcgccgcgccguc

SEQ ID NO: 1032677 - RNA, 19 nt, Mycobacterium bovis subsp bovis AF2122/97
ucggcgccagaucgacgcc

SEQ ID NO: 1032678 - RNA, 23 nt, Mycobacterium bovis subsp bovis AF2122/97
ucggcgcagcacauccugcagcu

SEQ ID NO: 1032679 - RNA, 15 nt, Mycobacterium bovis subsp bovis AF2122/97
ucggcgcagccggug

SEQ ID NO: 1032680 - RNA, 17 nt, Mycobacterium bovis subsp bovis AF2122/97
ucggcgcagccggugag

SEQ ID NO: 1032681 - RNA, 17 nt, Mycobacterium bovis subsp bovis AF2122/97
ucggcgcacagcgagca

SEQ ID NO: 1032682 - RNA, 18 nt, Mycobacterium bovis subsp bovis AF2122/97
ucggcgaugcguccgccc

SEQ ID NO: 1032683 - RNA, 21 nt, Mycobacterium bovis subsp bovis AF2122/97
ucggcgaugaacgggaucgac

SEQ ID NO: 1032684 - RNA, 21 nt, Mycobacterium bovis subsp bovis AF2122/97
ucggcgaugcgcaccagcacc

SEQ ID NO: 1032685 - RNA, 16 nt, Mycobacterium bovis subsp bovis AF2122/97
ucggcgaugcguccgc

SEQ ID NO: 1032686 - RNA, 17 nt, Mycobacterium bovis subsp bovis AF2122/97
ucggcgaugcugagccg

SEQ ID NO: 1032687 - RNA, 16 nt, Mycobacterium bovis subsp bovis AF2122/97
ucggcgaugucgaagc

SEQ ID NO: 1032688 - RNA, 16 nt, Mycobacterium bovis subsp bovis AF2122/97
ucggugcggucaucgc

SEQ ID NO: 1032689 - RNA, 16 nt, Mycobacterium bovis subsp bovis AF2122/97
ucggugcgggcgccgc

SEQ ID NO: 1032690 - RNA, 15 nt, Mycobacterium bovis subsp bovis AF2122/97
ucggugcgcuggcgg

SEQ ID NO: 1032691 - RNA, 17 nt, Mycobacterium bovis subsp bovis AF2122/97
ucggugcgccagaucac

SEQ ID NO: 1032692 - RNA, 22 nt, Mycobacterium bovis subsp bovis AF2122/97
ucggugcggaacaccgcccggc

SEQ ID NO: 1032693 - RNA, 22 nt, Mycobacterium bovis subsp bovis AF2122/97
ucgguggcgaugcgauaggccc

SEQ ID NO: 1032694 - RNA, 16 nt, Mycobacterium bovis subsp bovis AF2122/97
ucgguggccggcagcc

SEQ ID NO: 1032695 - RNA, 18 nt, Mycobacterium bovis subsp bovis AF2122/97
ucgguguggacugggcca

SEQ ID NO: 1032696 - RNA, 17 nt, Mycobacterium bovis subsp bovis AF2122/97
ucgguguggcccaacac

SEQ ID NO: 1032697 - RNA, 14 nt, Mycobacterium bovis subsp bovis AF2122/97
ucgguguggccgug

SEQ ID NO: 1032698 - RNA, 18 nt, Mycobacterium bovis subsp bovis AF2122/97
ucggugugcgcgccaggc

SEQ ID NO: 1032699 - RNA, 14 nt, Mycobacterium bovis subsp bovis AF2122/97
ucggugugcggcgc

SEQ ID NO: 1032700 - RNA, 18 nt, Mycobacterium bovis subsp bovis AF2122/97
ucggugugcggcgcaugc

SEQ ID NO: 1032701 - RNA, 17 nt, Mycobacterium bovis subsp bovis AF2122/97
ucgguguuccgccgcgc

SEQ ID NO: 1032702 - RNA, 22 nt, Mycobacterium bovis subsp bovis AF2122/97
ucgguguuuaugguugugcggc

SEQ ID NO: 1032703 - RNA, 18 nt, Mycobacterium bovis subsp bovis AF2122/97
ucgguguuuggccgccga

SEQ ID NO: 1032704 - RNA, 15 nt, Mycobacterium bovis subsp bovis AF2122/97
ucggugugcaucgcc

SEQ ID NO: 1032705 - RNA, 22 nt, Mycobacterium bovis subsp bovis AF2122/97
ucgguggaagaguuggggcaca

SEQ ID NO: 1032706 - RNA, 20 nt, Mycobacterium bovis subsp bovis AF2122/97
ucggugucuuccuccucgac

SEQ ID NO: 1032707 - RNA, 12 nt, Mycobacterium bovis subsp bovis AF2122/97
ucggucggccaa

SEQ ID NO: 1032708 - RNA, 18 nt, Mycobacterium bovis subsp bovis AF2122/97
ucggucgccaccgccggc

SEQ ID NO: 1032709 - RNA, 16 nt, Mycobacterium bovis subsp bovis AF2122/97
ucggucgcgcgacggc

SEQ ID NO: 1032710 - RNA, 23 nt, Mycobacterium bovis subsp bovis AF2122/97
ucggucgcgcgacggccgggaca

SEQ ID NO: 1032711 - RNA, 21 nt, Mycobacterium bovis subsp bovis AF2122/97
ucgguccagccgguccagacc

SEQ ID NO: 1032712 - RNA, 17 nt, Mycobacterium bovis subsp bovis AF2122/97
ucggucguugccgcggu

SEQ ID NO: 1032713 - RNA, 16 nt, Mycobacterium bovis subsp bovis AF2122/97
ucggucucgaccgcgc

SEQ ID NO: 1032714 - RNA, 18 nt, Mycobacterium bovis subsp bovis AF2122/97
ucggucgguaacggcggu

SEQ ID NO: 1032715 - RNA, 23 nt, Mycobacterium bovis subsp bovis AF2122/97
ucggucgguaacggcggugcggg

SEQ ID NO: 1032716 - RNA, 13 nt, Mycobacterium bovis subsp bovis AF2122/97
ucggucucgaucc

SEQ ID NO: 1032717 - RNA, 13 nt, Mycobacterium bovis subsp bovis AF2122/97
ucggugcgcgcgg

SEQ ID NO: 1032718 - RNA, 16 nt, Mycobacterium bovis subsp bovis AF2122/97
ucgguccggcgaacug

SEQ ID NO: 1032719 - RNA, 16 nt, Mycobacterium bovis subsp bovis AF2122/97
ucggucgaguagccgu

SEQ ID NO: 1032720 - RNA, 12 nt, Mycobacterium bovis subsp bovis AF2122/97
ucggucgccacc

SEQ ID NO: 1032721 - RNA, 14 nt, Mycobacterium bovis subsp bovis AF2122/97
ucggucgccaccgc

SEQ ID NO: 1032722 - RNA, 17 nt, Mycobacterium bovis subsp bovis AF2122/97
ucggucagggugggcuc

SEQ ID NO: 1032723 - RNA, 18 nt, Mycobacterium bovis subsp bovis AF2122/97
ucgguaucgagggcagcc

SEQ ID NO: 1032724 - RNA, 21 nt, Mycobacterium bovis subsp bovis AF2122/97
ucggucagugggacgggcgcg

SEQ ID NO: 1032725 - RNA, 14 nt, Mycobacterium bovis subsp bovis AF2122/97
ucggucaguuccuc

SEQ ID NO: 1032726 - RNA, 19 nt, Mycobacterium bovis subsp bovis AF2122/97
ucggucagggugggcucgu

SEQ ID NO: 1032727 - RNA, 16 nt, Mycobacterium bovis subsp bovis AF2122/97
ucgucagccaccgcau

SEQ ID NO: 1032728 - RNA, 23 nt, Mycobacterium bovis subsp bovis AF2122/97
ucgucacugccaccucuaccggu

SEQ ID NO: 1032729 - RNA, 18 nt, Mycobacterium bovis subsp bovis AF2122/97
ucgucaccguuggccgcg

SEQ ID NO: 1032730 - RNA, 17 nt, Mycobacterium bovis subsp bovis AF2122/97
ucgucaccgaugcgccg

SEQ ID NO: 1032731 - RNA, 17 nt, Mycobacterium bovis subsp bovis AF2122/97
ucgucaccgcgaccagc

SEQ ID NO: 1032732 - RNA, 15 nt, Mycobacterium bovis subsp bovis AF2122/97
ucgucaccggucagc

SEQ ID NO: 1032733 - RNA, 20 nt, Mycobacterium bovis subsp bovis AF2122/97
ucgucacgccccucacgugg

SEQ ID NO: 1032734 - RNA, 22 nt, Mycobacterium bovis subsp bovis AF2122/97
ucguagucucgacaaagcggcu

SEQ ID NO: 1032735 - RNA, 17 nt, Mycobacterium bovis subsp bovis AF2122/97
ucguaucccgcaaaccg

SEQ ID NO: 1032736 - RNA, 18 nt, Mycobacterium bovis subsp bovis AF2122/97
ucguaugauucacgcucg

SEQ ID NO: 1032737 - RNA, 15 nt, Mycobacterium bovis subsp bovis AF2122/97
ucguauucggccgcg

SEQ ID NO: 1032738 - RNA, 17 nt, Mycobacterium bovis subsp bovis AF2122/97
ucguauucggccgcgag

SEQ ID NO: 1032739 - RNA, 14 nt, Mycobacterium bovis subsp bovis AF2122/97
ucgucaacgacgac

SEQ ID NO: 1032740 - RNA, 13 nt, Mycobacterium bovis subsp bovis AF2122/97
ucgucaccacgag

SEQ ID NO: 1032741 - RNA, 17 nt, Mycobacterium bovis subsp bovis AF2122/97
ucgucaaccugcgcauc

SEQ ID NO: 1032742 - RNA, 17 nt, Mycobacterium bovis subsp bovis AF2122/97
ucgguugcccccagggc

SEQ ID NO: 1032743 - RNA, 23 nt, Mycobacterium bovis subsp bovis AF2122/97
ucguagcaccggucccugcgccg

SEQ ID NO: 1032744 - RNA, 12 nt, Mycobacterium bovis subsp bovis AF2122/97
ucgguuggcagc

SEQ ID NO: 1032745 - RNA, 15 nt, Mycobacterium bovis subsp bovis AF2122/97
ucgguuggcucgggc

SEQ ID NO: 1032746 - RNA, 17 nt, Mycobacterium bovis subsp bovis AF2122/97
ucgguucguagcgggca

SEQ ID NO: 1032747 - RNA, 15 nt, Mycobacterium bovis subsp bovis AF2122/97
ucgguugaggacgag

SEQ ID NO: 1032748 - RNA, 15 nt, Mycobacterium bovis subsp bovis AF2122/97
ucgguugaucggcca

SEQ ID NO: 1032749 - RNA, 19 nt, Mycobacterium bovis subsp bovis AF2122/97
ucgguugcacccgcgcgga

SEQ ID NO: 1032750 - RNA, 18 nt, Mycobacterium bovis subsp bovis AF2122/97
ucgguugccacgccgccg

SEQ ID NO: 1032751 - RNA, 13 nt, Mycobacterium bovis subsp bovis AF2122/97
ucguaggcgauga

SEQ ID NO: 1032752 - RNA, 13 nt, Mycobacterium bovis subsp bovis AF2122/97
ucguaggccgcau

SEQ ID NO: 1032753 - RNA, 16 nt, Mycobacterium bovis subsp bovis AF2122/97
ucguagguggccggcu

SEQ ID NO: 1032754 - RNA, 15 nt, Mycobacterium bovis subsp bovis AF2122/97
ucguagggaugcggc

SEQ ID NO: 1032755 - RNA, 16 nt, Mycobacterium bovis subsp bovis AF2122/97
ucguaggacaccaccg

SEQ ID NO: 1032756 - RNA, 16 nt, Mycobacterium bovis subsp bovis AF2122/97
ucguaggacucggcgg

SEQ ID NO: 1032757 - RNA, 13 nt, Mycobacterium bovis subsp bovis AF2122/97
ucguagccgccgu

SEQ ID NO: 1032758 - RNA, 13 nt, Mycobacterium bovis subsp bovis AF2122/97
ucgggccguccuc

SEQ ID NO: 1032759 - RNA, 12 nt, Mycobacterium bovis subsp bovis AF2122/97
ucgggccgcaac

SEQ ID NO: 1032760 - RNA, 17 nt, Mycobacterium bovis subsp bovis AF2122/97
ucgggccgccgagcucg

SEQ ID NO: 1032761 - RNA, 23 nt, Mycobacterium bovis subsp bovis AF2122/97
ucgggccgaucucuccggcggcg

SEQ ID NO: 1032762 - RNA, 16 nt, Mycobacterium bovis subsp bovis AF2122/97
ucgggcccagcagcgc

SEQ ID NO: 1032763 - RNA, 17 nt, Mycobacterium bovis subsp bovis AF2122/97
ucgggccggagccggug

SEQ ID NO: 1032764 - RNA, 14 nt, Mycobacterium bovis subsp bovis AF2122/97
ucgggccggccgcc

SEQ ID NO: 1032765 - RNA, 14 nt, Mycobacterium bovis subsp bovis AF2122/97
ucgggccggcgcgg

SEQ ID NO: 1032766 - RNA, 23 nt, Mycobacterium bovis subsp bovis AF2122/97
ucgggcgaucaacccuagggcgg

SEQ ID NO: 1032767 - RNA, 21 nt, Mycobacterium bovis subsp bovis AF2122/97
ucgggcgagcucgucgagcgc

SEQ ID NO: 1032768 - RNA, 19 nt, Mycobacterium bovis subsp bovis AF2122/97
ucgggccuagccgaagcgc

SEQ ID NO: 1032769 - RNA, 22 nt, Mycobacterium bovis subsp bovis AF2122/97
ucgggcgagaucuuuucaccac

SEQ ID NO: 1032770 - RNA, 21 nt, Mycobacterium bovis subsp bovis AF2122/97
ucgggcgcgaggacgcugauc

SEQ ID NO: 1032771 - RNA, 15 nt, Mycobacterium bovis subsp bovis AF2122/97
ucgggcgcggggcgg

SEQ ID NO: 1032772 - RNA, 19 nt, Mycobacterium bovis subsp bovis AF2122/97
ucgggcgcggggcggccug

SEQ ID NO: 1032773 - RNA, 20 nt, Mycobacterium bovis subsp bovis AF2122/97
ucgggcgcgcucguggucga

SEQ ID NO: 1032774 - RNA, 18 nt, Mycobacterium bovis subsp bovis AF2122/97
ucgggcgcugaugcgcug

SEQ ID NO: 1032775 - RNA, 22 nt, Mycobacterium bovis subsp bovis AF2122/97
ucgggcggauacaugguccggc

SEQ ID NO: 1032776 - RNA, 19 nt, Mycobacterium bovis subsp bovis AF2122/97
ucgggcguacauucgggcg

SEQ ID NO: 1032777 - RNA, 23 nt, Mycobacterium bovis subsp bovis AF2122/97
ucgggcgucagcaguucggcgau

SEQ ID NO: 1032778 - RNA, 13 nt, Mycobacterium bovis subsp bovis AF2122/97
ucgggcaccgcgc

SEQ ID NO: 1032779 - RNA, 21 nt, Mycobacterium bovis subsp bovis AF2122/97
ucgggcaccuggucggccgca

SEQ ID NO: 1032780 - RNA, 15 nt, Mycobacterium bovis subsp bovis AF2122/97
ucgggcaggccgucg

SEQ ID NO: 1032781 - RNA, 16 nt, Mycobacterium bovis subsp bovis AF2122/97
ucgggcaggccgucga

SEQ ID NO: 1032782 - RNA, 19 nt, Mycobacterium bovis subsp bovis AF2122/97
ucgggcagcacccgcgcca

SEQ ID NO: 1032783 - RNA, 20 nt, Mycobacterium bovis subsp bovis AF2122/97
ucgggcagcuucaacaccgg

SEQ ID NO: 1032784 - RNA, 21 nt, Mycobacterium bovis subsp bovis AF2122/97
ucgggcagcggcaucggccag

SEQ ID NO: 1032785 - RNA, 14 nt, Mycobacterium bovis subsp bovis AF2122/97
ucgggcagcgucac

SEQ ID NO: 1032786 - RNA, 13 nt, Mycobacterium bovis subsp bovis AF2122/97
ucgggccacagca

SEQ ID NO: 1032787 - RNA, 15 nt, Mycobacterium bovis subsp bovis AF2122/97
ucgggccgacgggcg

SEQ ID NO: 1032788 - RNA, 15 nt, Mycobacterium bovis subsp bovis AF2122/97
ucgggcccgaugucg

SEQ ID NO: 1032789 - RNA, 15 nt, Mycobacterium bovis subsp bovis AF2122/97
ucgggccacagcaac

SEQ ID NO: 1032790 - RNA, 16 nt, Mycobacterium bovis subsp bovis AF2122/97
ucgggggcggucgcgu

SEQ ID NO: 1032791 - RNA, 14 nt, Mycobacterium bovis subsp bovis AF2122/97
ucgggggcguccuc

SEQ ID NO: 1032792 - RNA, 19 nt, Mycobacterium bovis subsp bovis AF2122/97
ucgggggcuuaugcgucug

SEQ ID NO: 1032793 - RNA, 20 nt, Mycobacterium bovis subsp bovis AF2122/97
ucgggggauuucgcgucugc

SEQ ID NO: 1032794 - RNA, 14 nt, Mycobacterium bovis subsp bovis AF2122/97
ucgggggcgccggc

SEQ ID NO: 1032795 - RNA, 19 nt, Mycobacterium bovis subsp bovis AF2122/97
ucgggggauuucgcgucug

SEQ ID NO: 1032796 - RNA, 16 nt, Mycobacterium bovis subsp bovis AF2122/97
ucggggcgucguucgc

SEQ ID NO: 1032797 - RNA, 15 nt, Mycobacterium bovis subsp bovis AF2122/97
ucggggccgucgggg

SEQ ID NO: 1032798 - RNA, 18 nt, Mycobacterium bovis subsp bovis AF2122/97
ucggggcccccgccggac

SEQ ID NO: 1032799 - RNA, 17 nt, Mycobacterium bovis subsp bovis AF2122/97
ucggggccccgcggcgc

SEQ ID NO: 1032800 - RNA, 20 nt, Mycobacterium bovis subsp bovis AF2122/97
ucggggccccgcggcgccgc

SEQ ID NO: 1032801 - RNA, 13 nt, Mycobacterium bovis subsp bovis AF2122/97
ucggggcgaugag

SEQ ID NO: 1032802 - RNA, 20 nt, Mycobacterium bovis subsp bovis AF2122/97
ucggggcaccacgccagccc

SEQ ID NO: 1032803 - RNA, 15 nt, Mycobacterium bovis subsp bovis AF2122/97
ucgggcuucggccag

SEQ ID NO: 1032804 - RNA, 14 nt, Mycobacterium bovis subsp bovis AF2122/97
ucggggaccacgcc

SEQ ID NO: 1032805 - RNA, 18 nt, Mycobacterium bovis subsp bovis AF2122/97
ucggggaccacgccgacg

SEQ ID NO: 1032806 - RNA, 15 nt, Mycobacterium bovis subsp bovis AF2122/97
ucggggagcugcggc

SEQ ID NO: 1032807 - RNA, 18 nt, Mycobacterium bovis subsp bovis AF2122/97
ucgggcgugaucccgccc

SEQ ID NO: 1032808 - RNA, 19 nt, Mycobacterium bovis subsp bovis AF2122/97
ucgggcgugaucccgccca

SEQ ID NO: 1032809 - RNA, 13 nt, Mycobacterium bovis subsp bovis AF2122/97
ucgggcuggucgg

SEQ ID NO: 1032810 - RNA, 20 nt, Mycobacterium bovis subsp bovis AF2122/97
ucgggcugucaggcucacac

SEQ ID NO: 1032811 - RNA, 19 nt, Mycobacterium bovis subsp bovis AF2122/97
ucggggucguugaggccgg

SEQ ID NO: 1032812 - RNA, 19 nt, Mycobacterium bovis subsp bovis AF2122/97
ucgggguaguugaggccgu

SEQ ID NO: 1032813 - RNA, 17 nt, Mycobacterium bovis subsp bovis AF2122/97
ucgggguaaccggcgga

SEQ ID NO: 1032814 - RNA, 21 nt, Mycobacterium bovis subsp bovis AF2122/97
ucggggggcaggucgagcgcc

SEQ ID NO: 1032815 - RNA, 21 nt, Mycobacterium bovis subsp bovis AF2122/97
ucgggugguacagggugugcg

SEQ ID NO: 1032816 - RNA, 20 nt, Mycobacterium bovis subsp bovis AF2122/97
ucgggggcuuaugcgucugc

SEQ ID NO: 1032817 - RNA, 21 nt, Mycobacterium bovis subsp bovis AF2122/97
ucgggguaauacgcggggccg

SEQ ID NO: 1032818 - RNA, 19 nt, Mycobacterium bovis subsp bovis AF2122/97
ucggguggaucuucaccuc

SEQ ID NO: 1032819 - RNA, 12 nt, Mycobacterium bovis subsp bovis AF2122/97
ucggguucguca

SEQ ID NO: 1032820 - RNA, 15 nt, Mycobacterium bovis subsp bovis AF2122/97
ucggguugcgacgaa

SEQ ID NO: 1032821 - RNA, 13 nt, Mycobacterium bovis subsp bovis AF2122/97
ucggguugcgcga

SEQ ID NO: 1032822 - RNA, 21 nt, Mycobacterium bovis subsp bovis AF2122/97
ucggguugguuggcucgcugg

SEQ ID NO: 1032823 - RNA, 22 nt, Mycobacterium bovis subsp bovis AF2122/97
ucggguucgucagucaacucac

SEQ ID NO: 1032824 - RNA, 17 nt, Mycobacterium bovis subsp bovis AF2122/97
ucggguggugcgcuggc

SEQ ID NO: 1032825 - RNA, 14 nt, Mycobacterium bovis subsp bovis AF2122/97
ucgguaccgcccag

SEQ ID NO: 1032826 - RNA, 19 nt, Mycobacterium bovis subsp bovis AF2122/97
ucggguuucgaucuucucg

SEQ ID NO: 1032827 - RNA, 18 nt, Mycobacterium bovis subsp bovis AF2122/97
ucgguagucgaugcugac

SEQ ID NO: 1032828 - RNA, 15 nt, Mycobacterium bovis subsp bovis AF2122/97
ucgucggcgacggcc

SEQ ID NO: 1032829 - RNA, 20 nt, Mycobacterium bovis subsp bovis AF2122/97
ucgucggcgacggccagcgc

SEQ ID NO: 1032830 - RNA, 11 nt, Mycobacterium bovis subsp bovis AF2122/97
ucgucggcgcc

SEQ ID NO: 1032831 - RNA, 18 nt, Mycobacterium bovis subsp bovis AF2122/97
ucgucgaccaggccacug

SEQ ID NO: 1032832 - RNA, 20 nt, Mycobacterium bovis subsp bovis AF2122/97
ucgucggccgacaccgccac

SEQ ID NO: 1032833 - RNA, 16 nt, Mycobacterium bovis subsp bovis AF2122/97
ucgucggccugcgccg

SEQ ID NO: 1032834 - RNA, 20 nt, Mycobacterium bovis subsp bovis AF2122/97
ucgucggccugcgccggcgc

SEQ ID NO: 1032835 - RNA, 13 nt, Mycobacterium bovis subsp bovis AF2122/97
ucgucgacgauca

SEQ ID NO: 1032836 - RNA, 15 nt, Mycobacterium bovis subsp bovis AF2122/97
ucgucgacgaugucg

SEQ ID NO: 1032837 - RNA, 17 nt, Mycobacterium bovis subsp bovis AF2122/97
ucgucgacaguucaacg

SEQ ID NO: 1032838 - RNA, 20 nt, Mycobacterium bovis subsp bovis AF2122/97
ucgucgacaguuuucaccgc

SEQ ID NO: 1032839 - RNA, 13 nt, Mycobacterium bovis subsp bovis AF2122/97
ucgucgaccaggc

SEQ ID NO: 1032840 - RNA, 18 nt, Mycobacterium bovis subsp bovis AF2122/97
ucgucgggaucggcgucc

SEQ ID NO: 1032841 - RNA, 13 nt, Mycobacterium bovis subsp bovis AF2122/97
ucgucgggcaugc

SEQ ID NO: 1032842 - RNA, 13 nt, Mycobacterium bovis subsp bovis AF2122/97
ucgucggcgucga

SEQ ID NO: 1032843 - RNA, 20 nt, Mycobacterium bovis subsp bovis AF2122/97
ucgucggcuuuggacagguc

SEQ ID NO: 1032844 - RNA, 20 nt, Mycobacterium bovis subsp bovis AF2122/97
ucgucgaagaccucaacccc

SEQ ID NO: 1032845 - RNA, 19 nt, Mycobacterium bovis subsp bovis AF2122/97
ucgucgaaccggaugcggu

SEQ ID NO: 1032846 - RNA, 23 nt, Mycobacterium bovis subsp bovis AF2122/97
ucgucgaaguuggcgaagcccga

SEQ ID NO: 1032847 - RNA, 19 nt, Mycobacterium bovis subsp bovis AF2122/97
ucgucgaagggaucacgac

SEQ ID NO: 1032848 - RNA, 22 nt, Mycobacterium bovis subsp bovis AF2122/97
ucgucgaagggaucacgaccgc

SEQ ID NO: 1032849 - RNA, 22 nt, Mycobacterium bovis subsp bovis AF2122/97
ucgucgaaguagccgacgucgc

SEQ ID NO: 1032850 - RNA, 15 nt, Mycobacterium bovis subsp bovis AF2122/97
ucgucgacacgguga

SEQ ID NO: 1032851 - RNA, 17 nt, Mycobacterium bovis subsp bovis AF2122/97
ucgucgaccacgacguu

SEQ ID NO: 1032852 - RNA, 15 nt, Mycobacterium bovis subsp bovis AF2122/97
ucgucauacagcgcc

SEQ ID NO: 1032853 - RNA, 15 nt, Mycobacterium bovis subsp bovis AF2122/97
ucguccaagccggcc

SEQ ID NO: 1032854 - RNA, 16 nt, Mycobacterium bovis subsp bovis AF2122/97
ucguccaagccggcca

SEQ ID NO: 1032855 - RNA, 18 nt, Mycobacterium bovis subsp bovis AF2122/97
ucguccaagccggccacg

SEQ ID NO: 1032856 - RNA, 21 nt, Mycobacterium bovis subsp bovis AF2122/97
ucguccaccgcgaugccccac

SEQ ID NO: 1032857 - RNA, 19 nt, Mycobacterium bovis subsp bovis AF2122/97
ucguccaccccgauccgcc

SEQ ID NO: 1032858 - RNA, 16 nt, Mycobacterium bovis subsp bovis AF2122/97
ucguccaccgccgaca

SEQ ID NO: 1032859 - RNA, 17 nt, Mycobacterium bovis subsp bovis AF2122/97
ucguccaccgccgacau

SEQ ID NO: 1032860 - RNA, 15 nt, Mycobacterium bovis subsp bovis AF2122/97
ucgucgugcgggcgg

SEQ ID NO: 1032861 - RNA, 18 nt, Mycobacterium bovis subsp bovis AF2122/97
ucgucguggagcucacgu

SEQ ID NO: 1032862 - RNA, 20 nt, Mycobacterium bovis subsp bovis AF2122/97
ucgucgucucgaugcauggc

SEQ ID NO: 1032863 - RNA, 20 nt, Mycobacterium bovis subsp bovis AF2122/97
ucgucguucaaugucguugc

SEQ ID NO: 1032864 - RNA, 22 nt, Mycobacterium bovis subsp bovis AF2122/97
ucgucguugugugccagcgugg

SEQ ID NO: 1032865 - RNA, 18 nt, Mycobacterium bovis subsp bovis AF2122/97
ucgucugucucggugccu

SEQ ID NO: 1032866 - RNA, 20 nt, Mycobacterium bovis subsp bovis AF2122/97
ucgucuugcguccauccgca

SEQ ID NO: 1032867 - RNA, 16 nt, Mycobacterium bovis subsp bovis AF2122/97
ucgugaacacgucgcg

SEQ ID NO: 1032868 - RNA, 15 nt, Mycobacterium bovis subsp bovis AF2122/97
ucgugacgaucagcg

SEQ ID NO: 1032869 - RNA, 13 nt, Mycobacterium bovis subsp bovis AF2122/97
ucgugaccgaccg

SEQ ID NO: 1032870 - RNA, 15 nt, Mycobacterium bovis subsp bovis AF2122/97
ucgugaccgaccgcc

SEQ ID NO: 1032871 - RNA, 17 nt, Mycobacterium bovis subsp bovis AF2122/97
ucgugaggaaccccggu

SEQ ID NO: 1032872 - RNA, 13 nt, Mycobacterium bovis subsp bovis AF2122/97
ucgugcgccgacg

SEQ ID NO: 1032873 - RNA, 23 nt, Mycobacterium bovis subsp bovis AF2122/97
ucgugcgcuuggucgaccgccga

SEQ ID NO: 1032874 - RNA, 12 nt, Mycobacterium bovis subsp bovis AF2122/97
ucgugccggcgu

SEQ ID NO: 1032875 - RNA, 13 nt, Mycobacterium bovis subsp bovis AF2122/97
ucgugccggggcu

SEQ ID NO: 1032876 - RNA, 15 nt, Mycobacterium bovis subsp bovis AF2122/97
ucgugccucggacaa

SEQ ID NO: 1032877 - RNA, 23 nt, Mycobacterium bovis subsp bovis AF2122/97
ucgugccucggacaaagccgucg

SEQ ID NO: 1032878 - RNA, 19 nt, Mycobacterium bovis subsp bovis AF2122/97
ucgugcgauucacacucgg

SEQ ID NO: 1032879 - RNA, 16 nt, Mycobacterium bovis subsp bovis AF2122/97
ucgugcgugcggcgaa

SEQ ID NO: 1032880 - RNA, 14 nt, Mycobacterium bovis subsp bovis AF2122/97
ucgugcccgggacc

SEQ ID NO: 1032881 - RNA, 15 nt, Mycobacterium bovis subsp bovis AF2122/97
ucgugccgccgcaug

SEQ ID NO: 1032882 - RNA, 17 nt, Mycobacterium bovis subsp bovis AF2122/97
ucgugaucagcaggacg

SEQ ID NO: 1032883 - RNA, 18 nt, Mycobacterium bovis subsp bovis AF2122/97
ucgugccacuuccacggc

SEQ ID NO: 1032884 - RNA, 22 nt, Mycobacterium bovis subsp bovis AF2122/97
ucgugccagcagcaaucagccg

SEQ ID NO: 1032885 - RNA, 22 nt, Mycobacterium bovis subsp bovis AF2122/97
ucgugcagcacuuccaagccga

SEQ ID NO: 1032886 - RNA, 16 nt, Mycobacterium bovis subsp bovis AF2122/97
ucgugcacgcacagcc

SEQ ID NO: 1032887 - RNA, 16 nt, Mycobacterium bovis subsp bovis AF2122/97
ucgugcaggaccagca

SEQ ID NO: 1032888 - RNA, 16 nt, Mycobacterium bovis subsp bovis AF2122/97
ucgugcaccgcgaccg

SEQ ID NO: 1032889 - RNA, 20 nt, Mycobacterium bovis subsp bovis AF2122/97
ucgugcaccgcgaccgcgca

SEQ ID NO: 1032890 - RNA, 22 nt, Mycobacterium bovis subsp bovis AF2122/97
ucgugcaaugcuuccagcauca

SEQ ID NO: 1032891 - RNA, 14 nt, Mycobacterium bovis subsp bovis AF2122/97
ucgugaugucaacg

SEQ ID NO: 1032892 - RNA, 12 nt, Mycobacterium bovis subsp bovis AF2122/97
ucguggcgucgu

SEQ ID NO: 1032893 - RNA, 14 nt, Mycobacterium bovis subsp bovis AF2122/97
ucgugggcgacgag

SEQ ID NO: 1032894 - RNA, 14 nt, Mycobacterium bovis subsp bovis AF2122/97
ucgugggucaacgu

SEQ ID NO: 1032895 - RNA, 16 nt, Mycobacterium bovis subsp bovis AF2122/97
ucgugggaaccaccag

SEQ ID NO: 1032896 - RNA, 14 nt, Mycobacterium bovis subsp bovis AF2122/97
ucguggcuuccggu

SEQ ID NO: 1032897 - RNA, 15 nt, Mycobacterium bovis subsp bovis AF2122/97
ucguugcgcggucuc

SEQ ID NO: 1032898 - RNA, 21 nt, Mycobacterium bovis subsp bovis AF2122/97
ucguuggccaugccacaacgc

SEQ ID NO: 1032899 - RNA, 12 nt, Mycobacterium bovis subsp bovis AF2122/97
ucguggguccgu

SEQ ID NO: 1032900 - RNA, 21 nt, Mycobacterium bovis subsp bovis AF2122/97
ucguggauccagccaugcggu

SEQ ID NO: 1032901 - RNA, 15 nt, Mycobacterium bovis subsp bovis AF2122/97
ucguggagccggccg

SEQ ID NO: 1032902 - RNA, 17 nt, Mycobacterium bovis subsp bovis AF2122/97
ucguggagccggccgug

SEQ ID NO: 1032903 - RNA, 22 nt, Mycobacterium bovis subsp bovis AF2122/97
ucguggagcucacgugcugccg

SEQ ID NO: 1032904 - RNA, 14 nt, Mycobacterium bovis subsp bovis AF2122/97
ucguggcgcgccgc

SEQ ID NO: 1032905 - RNA, 18 nt, Mycobacterium bovis subsp bovis AF2122/97
ucguggcgacggcgucga

SEQ ID NO: 1032906 - RNA, 21 nt, Mycobacterium bovis subsp bovis AF2122/97
ucguggcgacggcgucgauga

SEQ ID NO: 1032907 - RNA, 22 nt, Mycobacterium bovis subsp bovis AF2122/97
ucguggcgacggcgucgaugac

SEQ ID NO: 1032908 - RNA, 19 nt, Mycobacterium bovis subsp bovis AF2122/97
ucgugcguugccgucgaga

SEQ ID NO: 1032909 - RNA, 22 nt, Mycobacterium bovis subsp bovis AF2122/97
ucgugcguugucggcuggacgg

SEQ ID NO: 1032910 - RNA, 22 nt, Mycobacterium bovis subsp bovis AF2122/97
ucguggaacuccguccgccgua

SEQ ID NO: 1032911 - RNA, 13 nt, Mycobacterium bovis subsp bovis AF2122/97
ucguugugccggu

SEQ ID NO: 1032912 - RNA, 20 nt, Mycobacterium bovis subsp bovis AF2122/97
ucguugugccggucgaugac

SEQ ID NO: 1032913 - RNA, 19 nt, Mycobacterium bovis subsp bovis AF2122/97
ucguugcuggcggccagca

SEQ ID NO: 1032914 - RNA, 22 nt, Mycobacterium bovis subsp bovis AF2122/97
ucguuguagccgaaucccgcga

SEQ ID NO: 1032915 - RNA, 23 nt, Mycobacterium bovis subsp bovis AF2122/97
ucguuguaugcguuacgccgcga

SEQ ID NO: 1032916 - RNA, 21 nt, Mycobacterium bovis subsp bovis AF2122/97
ucuccaccgucgccgccgguc

SEQ ID NO: 1032917 - RNA, 13 nt, Mycobacterium bovis subsp bovis AF2122/97
ucuccaccaggug

SEQ ID NO: 1032918 - RNA, 13 nt, Mycobacterium bovis subsp bovis AF2122/97
ucuccaccccguc

SEQ ID NO: 1032919 - RNA, 23 nt, Mycobacterium bovis subsp bovis AF2122/97
ucuccacccgccggccgucggcc

SEQ ID NO: 1032920 - RNA, 19 nt, Mycobacterium bovis subsp bovis AF2122/97
ucuccagauccacgccgac

SEQ ID NO: 1032921 - RNA, 18 nt, Mycobacterium bovis subsp bovis AF2122/97
ucucauccuccugcgccg

SEQ ID NO: 1032922 - RNA, 20 nt, Mycobacterium bovis subsp bovis AF2122/97
ucuagaugcggaacgccgag

SEQ ID NO: 1032923 - RNA, 18 nt, Mycobacterium bovis subsp bovis AF2122/97
ucuagcaaagccagcgca

SEQ ID NO: 1032924 - RNA, 24 nt, Mycobacterium bovis subsp bovis AF2122/97
ucuagguucaguuccaccgcgcag

SEQ ID NO: 1032925 - RNA, 12 nt, Mycobacterium bovis subsp bovis AF2122/97
ucgcgccgcgag

SEQ ID NO: 1032926 - RNA, 13 nt, Mycobacterium bovis subsp bovis AF2122/97
ucgcgccgguggu

SEQ ID NO: 1032927 - RNA, 15 nt, Mycobacterium bovis subsp bovis AF2122/97
ucgcgccggugguca

SEQ ID NO: 1032928 - RNA, 15 nt, Mycobacterium bovis subsp bovis AF2122/97
ucgcgccgucggcga

SEQ ID NO: 1032929 - RNA, 18 nt, Mycobacterium bovis subsp bovis AF2122/97
ucgcgccugcccggguga

SEQ ID NO: 1032930 - RNA, 21 nt, Mycobacterium bovis subsp bovis AF2122/97
ucgcgccugugcgcaaggccg

SEQ ID NO: 1032931 - RNA, 15 nt, Mycobacterium bovis subsp bovis AF2122/97
ucgcgcugccggccg

SEQ ID NO: 1032932 - RNA, 17 nt, Mycobacterium bovis subsp bovis AF2122/97
ucgcgcugccggccgcg

SEQ ID NO: 1032933 - RNA, 18 nt, Mycobacterium bovis subsp bovis AF2122/97
ucgcgcugaagguggcga

SEQ ID NO: 1032934 - RNA, 24 nt, Mycobacterium bovis subsp bovis AF2122/97
ucgcgcucgacaaagccacgcaga

SEQ ID NO: 1032935 - RNA, 20 nt, Mycobacterium bovis subsp bovis AF2122/97
ucgcgccuuugagcccgcga

SEQ ID NO: 1032936 - RNA, 22 nt, Mycobacterium bovis subsp bovis AF2122/97
ucgcgcucauguucucgaccgc

SEQ ID NO: 1032937 - RNA, 14 nt, Mycobacterium bovis subsp bovis AF2122/97
ucgcgcgcaccggg

SEQ ID NO: 1032938 - RNA, 20 nt, Mycobacterium bovis subsp bovis AF2122/97
ucgcgcucgcucacgccguc

SEQ ID NO: 1032939 - RNA, 14 nt, Mycobacterium bovis subsp bovis AF2122/97
ucgcgcaucaacgg

SEQ ID NO: 1032940 - RNA, 22 nt, Mycobacterium bovis subsp bovis AF2122/97
ucgcgcaggaagcccacgaucg

SEQ ID NO: 1032941 - RNA, 13 nt, Mycobacterium bovis subsp bovis AF2122/97
ucgcgcaggaagc

SEQ ID NO: 1032942 - RNA, 22 nt, Mycobacterium bovis subsp bovis AF2122/97
ucgcgcacgcccugaagggccg

SEQ ID NO: 1032943 - RNA, 18 nt, Mycobacterium bovis subsp bovis AF2122/97
ucgcgcagcgcgaucgcg

SEQ ID NO: 1032944 - RNA, 15 nt, Mycobacterium bovis subsp bovis AF2122/97
ucgcgcagcgucauc

SEQ ID NO: 1032945 - RNA, 19 nt, Mycobacterium bovis subsp bovis AF2122/97
ucgcgcagcgucaucgcgu

SEQ ID NO: 1032946 - RNA, 23 nt, Mycobacterium bovis subsp bovis AF2122/97
ucgcgcaaaugccugcuggucgg

SEQ ID NO: 1032947 - RNA, 15 nt, Mycobacterium bovis subsp bovis AF2122/97
ucgcgcaaccagccc

SEQ ID NO: 1032948 - RNA, 14 nt, Mycobacterium bovis subsp bovis AF2122/97
ucgcgaauccuggc

SEQ ID NO: 1032949 - RNA, 17 nt, Mycobacterium bovis subsp bovis AF2122/97
ucgcgaauccuggcggg

SEQ ID NO: 1032950 - RNA, 14 nt, Mycobacterium bovis subsp bovis AF2122/97
ucgcgaagccgguu

SEQ ID NO: 1032951 - RNA, 23 nt, Mycobacterium bovis subsp bovis AF2122/97
ucgcgaagccgguucgcccagca

SEQ ID NO: 1032952 - RNA, 21 nt, Mycobacterium bovis subsp bovis AF2122/97
ucgcgaagaacgacgccaccg

SEQ ID NO: 1032953 - RNA, 20 nt, Mycobacterium bovis subsp bovis AF2122/97
ucgcgaagaacgacgccacc

SEQ ID NO: 1032954 - RNA, 23 nt, Mycobacterium bovis subsp bovis AF2122/97
ucgcgaacaucgccagcgccggc

SEQ ID NO: 1032955 - RNA, 21 nt, Mycobacterium bovis subsp bovis AF2122/97
ucgcgcaaggcgccgcagggc

SEQ ID NO: 1032956 - RNA, 15 nt, Mycobacterium bovis subsp bovis AF2122/97
ucgcgcacccagccc

SEQ ID NO: 1032957 - RNA, 20 nt, Mycobacterium bovis subsp bovis AF2122/97
ucgcgcacggcccgagccgc

SEQ ID NO: 1032958 - RNA, 17 nt, Mycobacterium bovis subsp bovis AF2122/97
ucgcgcagcgcgaucgc

SEQ ID NO: 1032959 - RNA, 19 nt, Mycobacterium bovis subsp bovis AF2122/97
ucgcgcaccugaucgguca

SEQ ID NO: 1032960 - RNA, 14 nt, Mycobacterium bovis subsp bovis AF2122/97
ucgcgcacgcccug

SEQ ID NO: 1032961 - RNA, 12 nt, Mycobacterium bovis subsp bovis AF2122/97
ucgccugggcuu

SEQ ID NO: 1032962 - RNA, 21 nt, Mycobacterium bovis subsp bovis AF2122/97
ucgccuggaagaucacgcguc

SEQ ID NO: 1032963 - RNA, 22 nt, Mycobacterium bovis subsp bovis AF2122/97
ucgccuggaagaucacgcgucg

SEQ ID NO: 1032964 - RNA, 16 nt, Mycobacterium bovis subsp bovis AF2122/97
ucgccucaccggcgcg

SEQ ID NO: 1032965 - RNA, 18 nt, Mycobacterium bovis subsp bovis AF2122/97
ucgccugcccccgcgcgc

SEQ ID NO: 1032966 - RNA, 13 nt, Mycobacterium bovis subsp bovis AF2122/97
ucgccugccgacg

SEQ ID NO: 1032967 - RNA, 13 nt, Mycobacterium bovis subsp bovis AF2122/97
ucgcgaacucggg

SEQ ID NO: 1032968 - RNA, 14 nt, Mycobacterium bovis subsp bovis AF2122/97
ucgcgaacaucgcc

SEQ ID NO: 1032969 - RNA, 16 nt, Mycobacterium bovis subsp bovis AF2122/97
ucgcgaacaucgccag

SEQ ID NO: 1032970 - RNA, 14 nt, Mycobacterium bovis subsp bovis AF2122/97
ucgcgaaaccgccg

SEQ ID NO: 1032971 - RNA, 16 nt, Mycobacterium bovis subsp bovis AF2122/97
ucgcgaaacaccagac

SEQ ID NO: 1032972 - RNA, 19 nt, Mycobacterium bovis subsp bovis AF2122/97
ucgcgaaacagcacgcccg

SEQ ID NO: 1032973 - RNA, 19 nt, Mycobacterium bovis subsp bovis AF2122/97
ucgccuucguaaccacgac

SEQ ID NO: 1032974 - RNA, 15 nt, Mycobacterium bovis subsp bovis AF2122/97
ucgccgcccgugccg

SEQ ID NO: 1032975 - RNA, 22 nt, Mycobacterium bovis subsp bovis AF2122/97
ucgccgcccgugccgcccucac

SEQ ID NO: 1032976 - RNA, 11 nt, Mycobacterium bovis subsp bovis AF2122/97
ucgccgcccgg

SEQ ID NO: 1032977 - RNA, 23 nt, Mycobacterium bovis subsp bovis AF2122/97
ucgccgccaccagggcacguucg

SEQ ID NO: 1032978 - RNA, 21 nt, Mycobacterium bovis subsp bovis AF2122/97
ucgccgcccgcagggccgccg

SEQ ID NO: 1032979 - RNA, 18 nt, Mycobacterium bovis subsp bovis AF2122/97
ucgccgcccuggccgccg

SEQ ID NO: 1032980 - RNA, 20 nt, Mycobacterium bovis subsp bovis AF2122/97
ucgccgcccuggccgccggc

SEQ ID NO: 1032981 - RNA, 16 nt, Mycobacterium bovis subsp bovis AF2122/97
ucgccgccggcgccgc

SEQ ID NO: 1032982 - RNA, 21 nt, Mycobacterium bovis subsp bovis AF2122/97
ucgccgccggcgccgccggug

SEQ ID NO: 1032983 - RNA, 13 nt, Mycobacterium bovis subsp bovis AF2122/97
ucgccgccgggca

SEQ ID NO: 1032984 - RNA, 14 nt, Mycobacterium bovis subsp bovis AF2122/97
ucgccgccgggcag

SEQ ID NO: 1032985 - RNA, 23 nt, Mycobacterium bovis subsp bovis AF2122/97
ucgccggcacgcagccaaugccg

SEQ ID NO: 1032986 - RNA, 15 nt, Mycobacterium bovis subsp bovis AF2122/97
ucgccggcacgguga

SEQ ID NO: 1032987 - RNA, 13 nt, Mycobacterium bovis subsp bovis AF2122/97
ucgccgccgcgcg

SEQ ID NO: 1032988 - RNA, 17 nt, Mycobacterium bovis subsp bovis AF2122/97
ucgccgccgcgcguucg

SEQ ID NO: 1032989 - RNA, 22 nt, Mycobacterium bovis subsp bovis AF2122/97
ucgccgccgcgcguucggcgcu

SEQ ID NO: 1032990 - RNA, 21 nt, Mycobacterium bovis subsp bovis AF2122/97
ucgccgccgcgggcgccgguu

SEQ ID NO: 1032991 - RNA, 17 nt, Mycobacterium bovis subsp bovis AF2122/97
ucgccgccgcuaccgcc

SEQ ID NO: 1032992 - RNA, 17 nt, Mycobacterium bovis subsp bovis AF2122/97
ucgccggccaacugggc

SEQ ID NO: 1032993 - RNA, 14 nt, Mycobacterium bovis subsp bovis AF2122/97
ucgccggccacccg

SEQ ID NO: 1032994 - RNA, 18 nt, Mycobacterium bovis subsp bovis AF2122/97
ucgccggcauacaccgug

SEQ ID NO: 1032995 - RNA, 14 nt, Mycobacterium bovis subsp bovis AF2122/97
ucgccggccaccag

SEQ ID NO: 1032996 - RNA, 12 nt, Mycobacterium bovis subsp bovis AF2122/97
ucgccggccgcg

SEQ ID NO: 1032997 - RNA, 15 nt, Mycobacterium bovis subsp bovis AF2122/97
ucgccggccacccgc

SEQ ID NO: 1032998 - RNA, 13 nt, Mycobacterium bovis subsp bovis AF2122/97
ucgccggccccgc

SEQ ID NO: 1032999 - RNA, 17 nt, Mycobacterium bovis subsp bovis AF2122/97
ucgccggccccgccggc

SEQ ID NO: 1033000 - RNA, 20 nt, Mycobacterium bovis subsp bovis AF2122/97
ucgccggccccgccggcgcc

SEQ ID NO: 1033001 - RNA, 13 nt, Mycobacterium bovis subsp bovis AF2122/97
ucgccggccguca

SEQ ID NO: 1033002 - RNA, 15 nt, Mycobacterium bovis subsp bovis AF2122/97
ucgccggccugcucg

SEQ ID NO: 1033003 - RNA, 18 nt, Mycobacterium bovis subsp bovis AF2122/97
ucgccggcgaagaccgcc

SEQ ID NO: 1033004 - RNA, 19 nt, Mycobacterium bovis subsp bovis AF2122/97
ucgccggcgaagaccgccg

SEQ ID NO: 1033005 - RNA, 20 nt, Mycobacterium bovis subsp bovis AF2122/97
ucgccgggcaguuuggcggc

SEQ ID NO: 1033006 - RNA, 21 nt, Mycobacterium bovis subsp bovis AF2122/97
ucgccgggccacguccugccc

SEQ ID NO: 1033007 - RNA, 18 nt, Mycobacterium bovis subsp bovis AF2122/97
ucgccgggcuuggccgcg

SEQ ID NO: 1033008 - RNA, 21 nt, Mycobacterium bovis subsp bovis AF2122/97
ucgccgggcuuggccgcgccg

SEQ ID NO: 1033009 - RNA, 19 nt, Mycobacterium bovis subsp bovis AF2122/97
ucgccgggcugcaaaucgu

SEQ ID NO: 1033010 - RNA, 15 nt, Mycobacterium bovis subsp bovis AF2122/97
ucgccgggucagccc

SEQ ID NO: 1033011 - RNA, 17 nt, Mycobacterium bovis subsp bovis AF2122/97
ucgccggggacgccgcg

SEQ ID NO: 1033012 - RNA, 21 nt, Mycobacterium bovis subsp bovis AF2122/97
ucgccggggacgccgcggcgc

SEQ ID NO: 1033013 - RNA, 14 nt, Mycobacterium bovis subsp bovis AF2122/97
ucgccuccugccgc

SEQ ID NO: 1033014 - RNA, 20 nt, Mycobacterium bovis subsp bovis AF2122/97
ucgccucggcguaggcgaug

SEQ ID NO: 1033015 - RNA, 17 nt, Mycobacterium bovis subsp bovis AF2122/97
ucgccucggcguaggcg

SEQ ID NO: 1033016 - RNA, 15 nt, Mycobacterium bovis subsp bovis AF2122/97
ucgccugcacgcccg

SEQ ID NO: 1033017 - RNA, 16 nt, Mycobacterium bovis subsp bovis AF2122/97
ucgccugagcgccgcg

SEQ ID NO: 1033018 - RNA, 15 nt, Mycobacterium bovis subsp bovis AF2122/97
ucgccgucggugccg

SEQ ID NO: 1033019 - RNA, 18 nt, Mycobacterium bovis subsp bovis AF2122/97
ucgccgucggugccgccg

SEQ ID NO: 1033020 - RNA, 19 nt, Mycobacterium bovis subsp bovis AF2122/97
ucgccgucggugccgccgc

SEQ ID NO: 1033021 - RNA, 20 nt, Mycobacterium bovis subsp bovis AF2122/97
ucgccgucggugccgccgcc

SEQ ID NO: 1033022 - RNA, 20 nt, Mycobacterium bovis subsp bovis AF2122/97
ucgccgucguacucgaccgc

SEQ ID NO: 1033023 - RNA, 14 nt, Mycobacterium bovis subsp bovis AF2122/97
ucgccgucggcgac

SEQ ID NO: 1033024 - RNA, 11 nt, Mycobacterium bovis subsp bovis AF2122/97
ucgccggugac

SEQ ID NO: 1033025 - RNA, 21 nt, Mycobacterium bovis subsp bovis AF2122/97
ucgccgguaggcggccagcgc

SEQ ID NO: 1033026 - RNA, 23 nt, Mycobacterium bovis subsp bovis AF2122/97
ucgccgguaggcggccagcgcgc

SEQ ID NO: 1033027 - RNA, 19 nt, Mycobacterium bovis subsp bovis AF2122/97
ucgccggucaggccgccgc

SEQ ID NO: 1033028 - RNA, 20 nt, Mycobacterium bovis subsp bovis AF2122/97
ucgccggucaggccgccgcg

SEQ ID NO: 1033029 - RNA, 23 nt, Mycobacterium bovis subsp bovis AF2122/97
ucgccggucaggccgccgcggcg

SEQ ID NO: 1033030 - RNA, 15 nt, Mycobacterium bovis subsp bovis AF2122/97
ucgccggucaggcuc

SEQ ID NO: 1033031 - RNA, 18 nt, Mycobacterium bovis subsp bovis AF2122/97
ucgccgucgucgaucgac

SEQ ID NO: 1033032 - RNA, 16 nt, Mycobacterium bovis subsp bovis AF2122/97
ucgccgucgugccacc

SEQ ID NO: 1033033 - RNA, 14 nt, Mycobacterium bovis subsp bovis AF2122/97
ucgccgugaccagg

SEQ ID NO: 1033034 - RNA, 15 nt, Mycobacterium bovis subsp bovis AF2122/97
ucgccgugcgccgug

SEQ ID NO: 1033035 - RNA, 23 nt, Mycobacterium bovis subsp bovis AF2122/97
ucgccgugcgccgugcgaucguc

SEQ ID NO: 1033036 - RNA, 13 nt, Mycobacterium bovis subsp bovis AF2122/97
ucgccguggugga

SEQ ID NO: 1033037 - RNA, 15 nt, Mycobacterium bovis subsp bovis AF2122/97
ucgccaggcccugaa

SEQ ID NO: 1033038 - RNA, 23 nt, Mycobacterium bovis subsp bovis AF2122/97
ucgccaggccuaggccgaggccg

SEQ ID NO: 1033039 - RNA, 21 nt, Mycobacterium bovis subsp bovis AF2122/97
ucgccagccugugcugccaac

SEQ ID NO: 1033040 - RNA, 22 nt, Mycobacterium bovis subsp bovis AF2122/97
ucgccagccugugcugccaacg

SEQ ID NO: 1033041 - RNA, 16 nt, Mycobacterium bovis subsp bovis AF2122/97
ucgccagccggccgcg

SEQ ID NO: 1033042 - RNA, 17 nt, Mycobacterium bovis subsp bovis AF2122/97
ucgccccgaggaugccg

SEQ ID NO: 1033043 - RNA, 18 nt, Mycobacterium bovis subsp bovis AF2122/97
ucgccccgaggaugccga

SEQ ID NO: 1033044 - RNA, 22 nt, Mycobacterium bovis subsp bovis AF2122/97
ucgccccgaggaugccgaaccg

SEQ ID NO: 1033045 - RNA, 16 nt, Mycobacterium bovis subsp bovis AF2122/97
ucgccccgaugaccgc

SEQ ID NO: 1033046 - RNA, 18 nt, Mycobacterium bovis subsp bovis AF2122/97
ucgccccguucacgcucg

SEQ ID NO: 1033047 - RNA, 19 nt, Mycobacterium bovis subsp bovis AF2122/97
ucgccccguuucggucgac

SEQ ID NO: 1033048 - RNA, 16 nt, Mycobacterium bovis subsp bovis AF2122/97
ucgccccugcacagca

SEQ ID NO: 1033049 - RNA, 14 nt, Mycobacterium bovis subsp bovis AF2122/97
ucgccagucgauuc

SEQ ID NO: 1033050 - RNA, 15 nt, Mycobacterium bovis subsp bovis AF2122/97
ucgcccauuggccag

SEQ ID NO: 1033051 - RNA, 16 nt, Mycobacterium bovis subsp bovis AF2122/97
ucgccgcacgccggca

SEQ ID NO: 1033052 - RNA, 20 nt, Mycobacterium bovis subsp bovis AF2122/97
ucgccgaguaccggccagcc

SEQ ID NO: 1033053 - RNA, 21 nt, Mycobacterium bovis subsp bovis AF2122/97
ucgccgcaacaugggugaugc

SEQ ID NO: 1033054 - RNA, 13 nt, Mycobacterium bovis subsp bovis AF2122/97
ucgccgaggucga

SEQ ID NO: 1033055 - RNA, 22 nt, Mycobacterium bovis subsp bovis AF2122/97
ucgccgaggucgaaccgccggc

SEQ ID NO: 1033056 - RNA, 18 nt, Mycobacterium bovis subsp bovis AF2122/97
ucgccgaguaccggccag

SEQ ID NO: 1033057 - RNA, 19 nt, Mycobacterium bovis subsp bovis AF2122/97
ucgccgaggcagcgucguc

SEQ ID NO: 1033058 - RNA, 21 nt, Mycobacterium bovis subsp bovis AF2122/97
ucgccgaggcagcgucgucga

SEQ ID NO: 1033059 - RNA, 19 nt, Mycobacterium bovis subsp bovis AF2122/97
ucgccgaggccuaccaggc

SEQ ID NO: 1033060 - RNA, 18 nt, Mycobacterium bovis subsp bovis AF2122/97
ucgccgccauugccgccg

SEQ ID NO: 1033061 - RNA, 20 nt, Mycobacterium bovis subsp bovis AF2122/97
ucgccgccauugccgccggu

SEQ ID NO: 1033062 - RNA, 16 nt, Mycobacterium bovis subsp bovis AF2122/97
ucgccgccauuggcuu

SEQ ID NO: 1033063 - RNA, 13 nt, Mycobacterium bovis subsp bovis AF2122/97
ucgccgccagcgc

SEQ ID NO: 1033064 - RNA, 20 nt, Mycobacterium bovis subsp bovis AF2122/97
ucgccgagcggaucgucguc

SEQ ID NO: 1033065 - RNA, 14 nt, Mycobacterium bovis subsp bovis AF2122/97
ucgcccgggccgcg

SEQ ID NO: 1033066 - RNA, 21 nt, Mycobacterium bovis subsp bovis AF2122/97
ucgcccgggcgggauccaccc

SEQ ID NO: 1033067 - RNA, 16 nt, Mycobacterium bovis subsp bovis AF2122/97
ucgccgacgucgacgc

SEQ ID NO: 1033068 - RNA, 17 nt, Mycobacterium bovis subsp bovis AF2122/97
ucgccgacgucgacgcc

SEQ ID NO: 1033069 - RNA, 13 nt, Mycobacterium bovis subsp bovis AF2122/97
ucgccgacgucca

SEQ ID NO: 1033070 - RNA, 17 nt, Mycobacterium bovis subsp bovis AF2122/97
ucgccgagaacgauguc

SEQ ID NO: 1033071 - RNA, 20 nt, Mycobacterium bovis subsp bovis AF2122/97
ucgcccggguggcgucgauc

SEQ ID NO: 1033072 - RNA, 14 nt, Mycobacterium bovis subsp bovis AF2122/97
ucgccgagaccggc

SEQ ID NO: 1033073 - RNA, 21 nt, Mycobacterium bovis subsp bovis AF2122/97
ucgcccucguaauccacgccg

SEQ ID NO: 1033074 - RNA, 23 nt, Mycobacterium bovis subsp bovis AF2122/97
ucgcccucccgggcccgcugggc

SEQ ID NO: 1033075 - RNA, 11 nt, Mycobacterium bovis subsp bovis AF2122/97
ucgccaccgca

SEQ ID NO: 1033076 - RNA, 22 nt, Mycobacterium bovis subsp bovis AF2122/97
ucgccaccgccggcagcaucgg

SEQ ID NO: 1033077 - RNA, 22 nt, Mycobacterium bovis subsp bovis AF2122/97
ucgccacccgacaugcgccgag

SEQ ID NO: 1033078 - RNA, 14 nt, Mycobacterium bovis subsp bovis AF2122/97
ucgccaccgcggcg

SEQ ID NO: 1033079 - RNA, 18 nt, Mycobacterium bovis subsp bovis AF2122/97
ucgccaccggcgccaccg

SEQ ID NO: 1033080 - RNA, 21 nt, Mycobacterium bovis subsp bovis AF2122/97
ucgccaccggcgccaccggcg

SEQ ID NO: 1033081 - RNA, 22 nt, Mycobacterium bovis subsp bovis AF2122/97
ucgccaccggcgccaccggcgc

SEQ ID NO: 1033082 - RNA, 23 nt, Mycobacterium bovis subsp bovis AF2122/97
ucgccaccaucaccgccuuugcc

SEQ ID NO: 1033083 - RNA, 17 nt, Mycobacterium bovis subsp bovis AF2122/97
ucgccaccaccggaacg

SEQ ID NO: 1033084 - RNA, 22 nt, Mycobacterium bovis subsp bovis AF2122/97
ucgccacauuucaccaccgugg

SEQ ID NO: 1033085 - RNA, 13 nt, Mycobacterium bovis subsp bovis AF2122/97
ucgccaccacccc

SEQ ID NO: 1033086 - RNA, 22 nt, Mycobacterium bovis subsp bovis AF2122/97
ucgccacacccaaaccggcccg

SEQ ID NO: 1033087 - RNA, 14 nt, Mycobacterium bovis subsp bovis AF2122/97
ucgccacacccgcg

SEQ ID NO: 1033088 - RNA, 17 nt, Mycobacterium bovis subsp bovis AF2122/97
ucgccaaucugcgcgag

SEQ ID NO: 1033089 - RNA, 14 nt, Mycobacterium bovis subsp bovis AF2122/97
ucgccaaugcccag

SEQ ID NO: 1033090 - RNA, 19 nt, Mycobacterium bovis subsp bovis AF2122/97
ucgccaagugcagggcugc

SEQ ID NO: 1033091 - RNA, 19 nt, Mycobacterium bovis subsp bovis AF2122/97
ucgccaagcccaggcgauc

SEQ ID NO: 1033092 - RNA, 23 nt, Mycobacterium bovis subsp bovis AF2122/97
ucgccaaacccaugucggcgcgc

SEQ ID NO: 1033093 - RNA, 18 nt, Mycobacterium bovis subsp bovis AF2122/97
ucgccaacgccagcacca

SEQ ID NO: 1033094 - RNA, 11 nt, Mycobacterium bovis subsp bovis AF2122/97
ucgccaacccg

SEQ ID NO: 1033095 - RNA, 18 nt, Mycobacterium bovis subsp bovis AF2122/97
ucgcauccacuuccgggc

SEQ ID NO: 1033096 - RNA, 22 nt, Mycobacterium bovis subsp bovis AF2122/97
ucgcaucggcggggcccacacg

SEQ ID NO: 1033097 - RNA, 15 nt, Mycobacterium bovis subsp bovis AF2122/97
ucgcauggucgacga

SEQ ID NO: 1033098 - RNA, 19 nt, Mycobacterium bovis subsp bovis AF2122/97
ucgcaugucggacacgugg

SEQ ID NO: 1033099 - RNA, 19 nt, Mycobacterium bovis subsp bovis AF2122/97
ucgcauucggcgagccgcg

SEQ ID NO: 1033100 - RNA, 13 nt, Mycobacterium bovis subsp bovis AF2122/97
ucgcagucgauga

SEQ ID NO: 1033101 - RNA, 20 nt, Mycobacterium bovis subsp bovis AF2122/97
ucgcaguccgguuacgcucg

SEQ ID NO: 1033102 - RNA, 21 nt, Mycobacterium bovis subsp bovis AF2122/97
ucgcaguccgguuacgcucgc

SEQ ID NO: 1033103 - RNA, 20 nt, Mycobacterium bovis subsp bovis AF2122/97
ucgcaggcucagcugguggc

SEQ ID NO: 1033104 - RNA, 15 nt, Mycobacterium bovis subsp bovis AF2122/97
ucgcaggaucggcgg

SEQ ID NO: 1033105 - RNA, 21 nt, Mycobacterium bovis subsp bovis AF2122/97
ucgcaguacuugguugcgacg

SEQ ID NO: 1033106 - RNA, 18 nt, Mycobacterium bovis subsp bovis AF2122/97
ucgcaguccgguuacgcu

SEQ ID NO: 1033107 - RNA, 20 nt, Mycobacterium bovis subsp bovis AF2122/97
ucgcagugagcagccggacc

SEQ ID NO: 1033108 - RNA, 20 nt, Mycobacterium bovis subsp bovis AF2122/97
ucgcaguggcguuacgcucg

SEQ ID NO: 1033109 - RNA, 21 nt, Mycobacterium bovis subsp bovis AF2122/97
ucgcagcgcacacuaccgccg

SEQ ID NO: 1033110 - RNA, 13 nt, Mycobacterium bovis subsp bovis AF2122/97
ucgcagcgacacg

SEQ ID NO: 1033111 - RNA, 21 nt, Mycobacterium bovis subsp bovis AF2122/97
ucgcagcgaggagcccggucc

SEQ ID NO: 1033112 - RNA, 12 nt, Mycobacterium bovis subsp bovis AF2122/97
ucgcagcgcaca

SEQ ID NO: 1033113 - RNA, 20 nt, Mycobacterium bovis subsp bovis AF2122/97
ucgcacagccgcuuggcgcg

SEQ ID NO: 1033114 - RNA, 21 nt, Mycobacterium bovis subsp bovis AF2122/97
ucgcagaaaccauucggcgag

SEQ ID NO: 1033115 - RNA, 21 nt, Mycobacterium bovis subsp bovis AF2122/97
ucgcacuggucaacacgacug

SEQ ID NO: 1033116 - RNA, 19 nt, Mycobacterium bovis subsp bovis AF2122/97
ucgcacucauagaacucgc

SEQ ID NO: 1033117 - RNA, 18 nt, Mycobacterium bovis subsp bovis AF2122/97
ucgcacugcgccggccgg

SEQ ID NO: 1033118 - RNA, 17 nt, Mycobacterium bovis subsp bovis AF2122/97
ucgcagcaucacguccg

SEQ ID NO: 1033119 - RNA, 20 nt, Mycobacterium bovis subsp bovis AF2122/97
ucgcagcauguccgcagcgg

SEQ ID NO: 1033120 - RNA, 19 nt, Mycobacterium bovis subsp bovis AF2122/97
ucgcagcauguggccgccg

SEQ ID NO: 1033121 - RNA, 16 nt, Mycobacterium bovis subsp bovis AF2122/97
ucgcagcaacaccucg

SEQ ID NO: 1033122 - RNA, 16 nt, Mycobacterium bovis subsp bovis AF2122/97
ucgcagcaacggcggc

SEQ ID NO: 1033123 - RNA, 17 nt, Mycobacterium bovis subsp bovis AF2122/97
ucgcagcaacggcggcg

SEQ ID NO: 1033124 - RNA, 19 nt, Mycobacterium bovis subsp bovis AF2122/97
ucgcagccaggcacguccg

SEQ ID NO: 1033125 - RNA, 15 nt, Mycobacterium bovis subsp bovis AF2122/97
ucgcagccgcaccgg

SEQ ID NO: 1033126 - RNA, 19 nt, Mycobacterium bovis subsp bovis AF2122/97
ucgagguggcgcacaucgc

SEQ ID NO: 1033127 - RNA, 14 nt, Mycobacterium bovis subsp bovis AF2122/97
ucgaggucagcucc

SEQ ID NO: 1033128 - RNA, 16 nt, Mycobacterium bovis subsp bovis AF2122/97
ucgaggucagugggcg

SEQ ID NO: 1033129 - RNA, 23 nt, Mycobacterium bovis subsp bovis AF2122/97
ucgagguucucccgcgcuuggcu

SEQ ID NO: 1033130 - RNA, 17 nt, Mycobacterium bovis subsp bovis AF2122/97
ucgagguucccgcauug

SEQ ID NO: 1033131 - RNA, 20 nt, Mycobacterium bovis subsp bovis AF2122/97
ucgagguggcgggcgaugcg

SEQ ID NO: 1033132 - RNA, 17 nt, Mycobacterium bovis subsp bovis AF2122/97
ucgagguggcugcgccg

SEQ ID NO: 1033133 - RNA, 15 nt, Mycobacterium bovis subsp bovis AF2122/97
ucgagguggcgggcg

SEQ ID NO: 1033134 - RNA, 18 nt, Mycobacterium bovis subsp bovis AF2122/97
ucgaggcgaagcggugag

SEQ ID NO: 1033135 - RNA, 14 nt, Mycobacterium bovis subsp bovis AF2122/97
ucgaggcggcgguc

SEQ ID NO: 1033136 - RNA, 15 nt, Mycobacterium bovis subsp bovis AF2122/97
ucgagggcaacggca

SEQ ID NO: 1033137 - RNA, 14 nt, Mycobacterium bovis subsp bovis AF2122/97
ucgagggcaucggg

SEQ ID NO: 1033138 - RNA, 22 nt, Mycobacterium bovis subsp bovis AF2122/97
ucgagggcaucgggccuagccg

SEQ ID NO: 1033139 - RNA, 15 nt, Mycobacterium bovis subsp bovis AF2122/97
ucgagcugcuggcgc

SEQ ID NO: 1033140 - RNA, 16 nt, Mycobacterium bovis subsp bovis AF2122/97
ucgagcugcuggcgcg

SEQ ID NO: 1033141 - RNA, 19 nt, Mycobacterium bovis subsp bovis AF2122/97
ucgagcgucugcgaucccg

SEQ ID NO: 1033142 - RNA, 13 nt, Mycobacterium bovis subsp bovis AF2122/97
ucgagcgguggcg

SEQ ID NO: 1033143 - RNA, 22 nt, Mycobacterium bovis subsp bovis AF2122/97
ucgagcgguggcgucgucggcg

SEQ ID NO: 1033144 - RNA, 18 nt, Mycobacterium bovis subsp bovis AF2122/97
ucgagcgguugccauccg

SEQ ID NO: 1033145 - RNA, 19 nt, Mycobacterium bovis subsp bovis AF2122/97
ucgagcgaacccuucgcgg

SEQ ID NO: 1033146 - RNA, 21 nt, Mycobacterium bovis subsp bovis AF2122/97
ucgagcgcgccuucacgcugg

SEQ ID NO: 1033147 - RNA, 20 nt, Mycobacterium bovis subsp bovis AF2122/97
ucgagcgcuucgucgccgaa

SEQ ID NO: 1033148 - RNA, 20 nt, Mycobacterium bovis subsp bovis AF2122/97
ucgagcuugccgucgcugac

SEQ ID NO: 1033149 - RNA, 17 nt, Mycobacterium bovis subsp bovis AF2122/97
ucgaggaccaccacuag

SEQ ID NO: 1033150 - RNA, 21 nt, Mycobacterium bovis subsp bovis AF2122/97
ucgaggaccaccuggucgcgu

SEQ ID NO: 1033151 - RNA, 14 nt, Mycobacterium bovis subsp bovis AF2122/97
ucgaggaacucgga

SEQ ID NO: 1033152 - RNA, 14 nt, Mycobacterium bovis subsp bovis AF2122/97
ucgagcucggcgau

SEQ ID NO: 1033153 - RNA, 17 nt, Mycobacterium bovis subsp bovis AF2122/97
ucgagcuucaucccgga

SEQ ID NO: 1033154 - RNA, 20 nt, Mycobacterium bovis subsp bovis AF2122/97
ucgaggcaggccucggcgcc

SEQ ID NO: 1033155 - RNA, 20 nt, Mycobacterium bovis subsp bovis AF2122/97
ucgagcaguggccgccgggc

SEQ ID NO: 1033156 - RNA, 19 nt, Mycobacterium bovis subsp bovis AF2122/97
ucgagcaguuccagcucgc

SEQ ID NO: 1033157 - RNA, 20 nt, Mycobacterium bovis subsp bovis AF2122/97
ucgagccgcacaaacgggcg

SEQ ID NO: 1033158 - RNA, 19 nt, Mycobacterium bovis subsp bovis AF2122/97
ucgagccggacccggugca

SEQ ID NO: 1033159 - RNA, 14 nt, Mycobacterium bovis subsp bovis AF2122/97
ucgagccgcguucg

SEQ ID NO: 1033160 - RNA, 24 nt, Mycobacterium bovis subsp bovis AF2122/97
ucgagccgcggcaacaccaccucg

SEQ ID NO: 1033161 - RNA, 14 nt, Mycobacterium bovis subsp bovis AF2122/97
ucgagccggcggcc

SEQ ID NO: 1033162 - RNA, 18 nt, Mycobacterium bovis subsp bovis AF2122/97
ucgagccggauucggcug

SEQ ID NO: 1033163 - RNA, 14 nt, Mycobacterium bovis subsp bovis AF2122/97
ucgagccacaugac

SEQ ID NO: 1033164 - RNA, 20 nt, Mycobacterium bovis subsp bovis AF2122/97
ucgagccgugccucgaggac

SEQ ID NO: 1033165 - RNA, 17 nt, Mycobacterium bovis subsp bovis AF2122/97
ucgagcgcgaucgggcc

SEQ ID NO: 1033166 - RNA, 18 nt, Mycobacterium bovis subsp bovis AF2122/97
ucgagcgcgaucgggccg

SEQ ID NO: 1033167 - RNA, 22 nt, Mycobacterium bovis subsp bovis AF2122/97
ucgagcgcgaucgggccggcgc

SEQ ID NO: 1033168 - RNA, 23 nt, Mycobacterium bovis subsp bovis AF2122/97
ucgagcgcgaucgggccggcgcg

SEQ ID NO: 1033169 - RNA, 14 nt, Mycobacterium bovis subsp bovis AF2122/97
ucgagcgccggccg

SEQ ID NO: 1033170 - RNA, 15 nt, Mycobacterium bovis subsp bovis AF2122/97
ucgagcgccggccgc

SEQ ID NO: 1033171 - RNA, 16 nt, Mycobacterium bovis subsp bovis AF2122/97
ucgagcacccgcaaug

SEQ ID NO: 1033172 - RNA, 22 nt, Mycobacterium bovis subsp bovis AF2122/97
ucgagcaccgacaccggccgcg

SEQ ID NO: 1033173 - RNA, 16 nt, Mycobacterium bovis subsp bovis AF2122/97
ucgagcaccgacaccg

SEQ ID NO: 1033174 - RNA, 15 nt, Mycobacterium bovis subsp bovis AF2122/97
ucgagcaccggcugc

SEQ ID NO: 1033175 - RNA, 12 nt, Mycobacterium bovis subsp bovis AF2122/97
ucgagcacgucg

SEQ ID NO: 1033176 - RNA, 15 nt, Mycobacterium bovis subsp bovis AF2122/97
ucgagcacgucgggg

SEQ ID NO: 1033177 - RNA, 14 nt, Mycobacterium bovis subsp bovis AF2122/97
ucgagcaccucggc

SEQ ID NO: 1033178 - RNA, 17 nt, Mycobacterium bovis subsp bovis AF2122/97
ucgagcaccucggccuc

SEQ ID NO: 1033179 - RNA, 16 nt, Mycobacterium bovis subsp bovis AF2122/97
ucgagcaccugccgau

SEQ ID NO: 1033180 - RNA, 19 nt, Mycobacterium bovis subsp bovis AF2122/97
ucgagcacgaugucgaugc

SEQ ID NO: 1033181 - RNA, 20 nt, Mycobacterium bovis subsp bovis AF2122/97
ucgagcacgccaacguugcg

SEQ ID NO: 1033182 - RNA, 13 nt, Mycobacterium bovis subsp bovis AF2122/97
ucgagcaggcugg

SEQ ID NO: 1033183 - RNA, 23 nt, Mycobacterium bovis subsp bovis AF2122/97
ucgagcaggcuggcguugggcgg

SEQ ID NO: 1033184 - RNA, 20 nt, Mycobacterium bovis subsp bovis AF2122/97
ucgagcagugccucggcgau

SEQ ID NO: 1033185 - RNA, 22 nt, Mycobacterium bovis subsp bovis AF2122/97
ucgagcagugccucggcgaugg

SEQ ID NO: 1033186 - RNA, 16 nt, Mycobacterium bovis subsp bovis AF2122/97
ucgagcagccgagcuc

SEQ ID NO: 1033187 - RNA, 19 nt, Mycobacterium bovis subsp bovis AF2122/97
ucgagcaggcccaacgcga

SEQ ID NO: 1033188 - RNA, 13 nt, Mycobacterium bovis subsp bovis AF2122/97
ucgagcagcgcgc

SEQ ID NO: 1033189 - RNA, 19 nt, Mycobacterium bovis subsp bovis AF2122/97
ucgagcagcgcgccguucg

SEQ ID NO: 1033190 - RNA, 15 nt, Mycobacterium bovis subsp bovis AF2122/97
ucgagcagcgccacc

SEQ ID NO: 1033191 - RNA, 15 nt, Mycobacterium bovis subsp bovis AF2122/97
ucgacggugccgucg

SEQ ID NO: 1033192 - RNA, 18 nt, Mycobacterium bovis subsp bovis AF2122/97
ucgacggugccgucugcg

SEQ ID NO: 1033193 - RNA, 16 nt, Mycobacterium bovis subsp bovis AF2122/97
ucgacgggucggcgcc

SEQ ID NO: 1033194 - RNA, 17 nt, Mycobacterium bovis subsp bovis AF2122/97
ucgacgggucggcgccg

SEQ ID NO: 1033195 - RNA, 13 nt, Mycobacterium bovis subsp bovis AF2122/97
ucgacggcgucga

SEQ ID NO: 1033196 - RNA, 18 nt, Mycobacterium bovis subsp bovis AF2122/97
ucgacggcuccgauuccg

SEQ ID NO: 1033197 - RNA, 17 nt, Mycobacterium bovis subsp bovis AF2122/97
ucgacgggagcgacguc

SEQ ID NO: 1033198 - RNA, 17 nt, Mycobacterium bovis subsp bovis AF2122/97
ucgacgggcacgcggcg

SEQ ID NO: 1033199 - RNA, 18 nt, Mycobacterium bovis subsp bovis AF2122/97
ucgacguaggacugccag

SEQ ID NO: 1033200 - RNA, 20 nt, Mycobacterium bovis subsp bovis AF2122/97
ucgacggugucuugggcguc

SEQ ID NO: 1033201 - RNA, 16 nt, Mycobacterium bovis subsp bovis AF2122/97
ucgacggccucgucga

SEQ ID NO: 1033202 - RNA, 17 nt, Mycobacterium bovis subsp bovis AF2122/97
ucgacggccucgucgau

SEQ ID NO: 1033203 - RNA, 14 nt, Mycobacterium bovis subsp bovis AF2122/97
ucgacggccacggu

SEQ ID NO: 1033204 - RNA, 19 nt, Mycobacterium bovis subsp bovis AF2122/97
ucgacggccaucgugcggc

SEQ ID NO: 1033205 - RNA, 17 nt, Mycobacterium bovis subsp bovis AF2122/97
ucgacggcgccgcccac

SEQ ID NO: 1033206 - RNA, 21 nt, Mycobacterium bovis subsp bovis AF2122/97
ucgacgcuguggcucgacgau

SEQ ID NO: 1033207 - RNA, 21 nt, Mycobacterium bovis subsp bovis AF2122/97
ucgacggcggccgcgauggcg

SEQ ID NO: 1033208 - RNA, 20 nt, Mycobacterium bovis subsp bovis AF2122/97
ucgacgcgguccucgagccg

SEQ ID NO: 1033209 - RNA, 17 nt, Mycobacterium bovis subsp bovis AF2122/97
ucgacgcgucgccggcc

SEQ ID NO: 1033210 - RNA, 23 nt, Mycobacterium bovis subsp bovis AF2122/97
ucgacgcgucguggucggcgacc

SEQ ID NO: 1033211 - RNA, 14 nt, Mycobacterium bovis subsp bovis AF2122/97
ucgacgcuguggcu

SEQ ID NO: 1033212 - RNA, 14 nt, Mycobacterium bovis subsp bovis AF2122/97
uccggguuggccac

SEQ ID NO: 1033213 - RNA, 15 nt, Mycobacterium bovis subsp bovis AF2122/97
uccggguuggccacc

SEQ ID NO: 1033214 - RNA, 15 nt, Mycobacterium bovis subsp bovis AF2122/97
uccggguuggcgacg

SEQ ID NO: 1033215 - RNA, 16 nt, Mycobacterium bovis subsp bovis AF2122/97
uccgggugcagaucgc

SEQ ID NO: 1033216 - RNA, 15 nt, Mycobacterium bovis subsp bovis AF2122/97
ucgacgcggccggcc

SEQ ID NO: 1033217 - RNA, 16 nt, Mycobacterium bovis subsp bovis AF2122/97
uccgggucaccagcgc

SEQ ID NO: 1033218 - RNA, 16 nt, Mycobacterium bovis subsp bovis AF2122/97
uccgggccuaucccga

SEQ ID NO: 1033219 - RNA, 17 nt, Mycobacterium bovis subsp bovis AF2122/97
uccggcucaccgauccc

SEQ ID NO: 1033220 - RNA, 22 nt, Mycobacterium bovis subsp bovis AF2122/97
uccgggccgcggccacaucgcc

SEQ ID NO: 1033221 - RNA, 18 nt, Mycobacterium bovis subsp bovis AF2122/97
uccgggcucggcgucgcc

SEQ ID NO: 1033222 - RNA, 21 nt, Mycobacterium bovis subsp bovis AF2122/97
ucgacuggccguuucggcgcc

SEQ ID NO: 1033223 - RNA, 12 nt, Mycobacterium bovis subsp bovis AF2122/97
ucgacugggacg

SEQ ID NO: 1033224 - RNA, 16 nt, Mycobacterium bovis subsp bovis AF2122/97
ucgacugggacgacgc

SEQ ID NO: 1033225 - RNA, 16 nt, Mycobacterium bovis subsp bovis AF2122/97
ucgacucguggcgcca

SEQ ID NO: 1033226 - RNA, 12 nt, Mycobacterium bovis subsp bovis AF2122/97
ucgacugaucga

SEQ ID NO: 1033227 - RNA, 16 nt, Mycobacterium bovis subsp bovis AF2122/97
ucgacugaucgccacc

SEQ ID NO: 1033228 - RNA, 20 nt, Mycobacterium bovis subsp bovis AF2122/97
ucgacugaucgccacccggu

SEQ ID NO: 1033229 - RNA, 18 nt, Mycobacterium bovis subsp bovis AF2122/97
ucgacguucgggucgagc

SEQ ID NO: 1033230 - RNA, 16 nt, Mycobacterium bovis subsp bovis AF2122/97
ucgacguucgguggcg

SEQ ID NO: 1033231 - RNA, 17 nt, Mycobacterium bovis subsp bovis AF2122/97
ucgacguucgguggcga

SEQ ID NO: 1033232 - RNA, 16 nt, Mycobacterium bovis subsp bovis AF2122/97
ucgacguugaucgcca

SEQ ID NO: 1033233 - RNA, 17 nt, Mycobacterium bovis subsp bovis AF2122/97
ucgacguugaucgccau

SEQ ID NO: 1033234 - RNA, 22 nt, Mycobacterium bovis subsp bovis AF2122/97
ucgacguuggcgugcaccgcau

SEQ ID NO: 1033235 - RNA, 20 nt, Mycobacterium bovis subsp bovis AF2122/97
ucgacgucggcaucggcggc

SEQ ID NO: 1033236 - RNA, 16 nt, Mycobacterium bovis subsp bovis AF2122/97
ucgacgucggcgagca

SEQ ID NO: 1033237 - RNA, 21 nt, Mycobacterium bovis subsp bovis AF2122/97
ucgacgucgauuucggcgacc

SEQ ID NO: 1033238 - RNA, 20 nt, Mycobacterium bovis subsp bovis AF2122/97
ucgacgucgggcauggcggc

SEQ ID NO: 1033239 - RNA, 20 nt, Mycobacterium bovis subsp bovis AF2122/97
ucgacgucgguaagcgccaa

SEQ ID NO: 1033240 - RNA, 15 nt, Mycobacterium bovis subsp bovis AF2122/97
ucgacggucacggug

SEQ ID NO: 1033241 - RNA, 17 nt, Mycobacterium bovis subsp bovis AF2122/97
ucgacggucacgguggu

SEQ ID NO: 1033242 - RNA, 11 nt, Mycobacterium bovis subsp bovis AF2122/97
ucgacggugac

SEQ ID NO: 1033243 - RNA, 19 nt, Mycobacterium bovis subsp bovis AF2122/97
ucgacguauuggcgcagca

SEQ ID NO: 1033244 - RNA, 14 nt, Mycobacterium bovis subsp bovis AF2122/97
ucgacgucgacggc

SEQ ID NO: 1033245 - RNA, 18 nt, Mycobacterium bovis subsp bovis AF2122/97
ucgagaucagucugggcg

SEQ ID NO: 1033246 - RNA, 18 nt, Mycobacterium bovis subsp bovis AF2122/97
ucgagauagucggccggc

SEQ ID NO: 1033247 - RNA, 22 nt, Mycobacterium bovis subsp bovis AF2122/97
ucgagagccccgaccagcagac

SEQ ID NO: 1033248 - RNA, 22 nt, Mycobacterium bovis subsp bovis AF2122/97
ucgagcacaccgaggucgccaa

SEQ ID NO: 1033249 - RNA, 19 nt, Mycobacterium bovis subsp bovis AF2122/97
ucgagcaccccgacguucg

SEQ ID NO: 1033250 - RNA, 16 nt, Mycobacterium bovis subsp bovis AF2122/97
ucgagauccucgucga

SEQ ID NO: 1033251 - RNA, 18 nt, Mycobacterium bovis subsp bovis AF2122/97
ucgagaucgccguugccg

SEQ ID NO: 1033252 - RNA, 19 nt, Mycobacterium bovis subsp bovis AF2122/97
ucgacuugugacggucguc

SEQ ID NO: 1033253 - RNA, 20 nt, Mycobacterium bovis subsp bovis AF2122/97
ucgacuucgacgacacguug

SEQ ID NO: 1033254 - RNA, 20 nt, Mycobacterium bovis subsp bovis AF2122/97
ucgauggccacccgguggcg

SEQ ID NO: 1033255 - RNA, 22 nt, Mycobacterium bovis subsp bovis AF2122/97
ucgauggcgcacugguugggcg

SEQ ID NO: 1033256 - RNA, 17 nt, Mycobacterium bovis subsp bovis AF2122/97
ucgauggggacggcggc

SEQ ID NO: 1033257 - RNA, 19 nt, Mycobacterium bovis subsp bovis AF2122/97
ucgauggguagcgagucga

SEQ ID NO: 1033258 - RNA, 21 nt, Mycobacterium bovis subsp bovis AF2122/97
ucgaugucggcgaaccacggc

SEQ ID NO: 1033259 - RNA, 14 nt, Mycobacterium bovis subsp bovis AF2122/97
ucgaugucgccgcu

SEQ ID NO: 1033260 - RNA, 18 nt, Mycobacterium bovis subsp bovis AF2122/97
ucgauguccaaugcaccg

SEQ ID NO: 1033261 - RNA, 13 nt, Mycobacterium bovis subsp bovis AF2122/97
ucgauggugcggc

SEQ ID NO: 1033262 - RNA, 17 nt, Mycobacterium bovis subsp bovis AF2122/97
ucgauguccacgccgug

SEQ ID NO: 1033263 - RNA, 18 nt, Mycobacterium bovis subsp bovis AF2122/97
ucgauguggcgcuccggc

SEQ ID NO: 1033264 - RNA, 14 nt, Mycobacterium bovis subsp bovis AF2122/97
ucgauuagcccacc

SEQ ID NO: 1033265 - RNA, 16 nt, Mycobacterium bovis subsp bovis AF2122/97
ucgaugaugccggaca

SEQ ID NO: 1033266 - RNA, 21 nt, Mycobacterium bovis subsp bovis AF2122/97
ucgaugaugccggacagcucg

SEQ ID NO: 1033267 - RNA, 21 nt, Mycobacterium bovis subsp bovis AF2122/97
ucgaugauggcuccggccgcg

SEQ ID NO: 1033268 - RNA, 22 nt, Mycobacterium bovis subsp bovis AF2122/97
ucgaugccacaucccacggugg

SEQ ID NO: 1033269 - RNA, 15 nt, Mycobacterium bovis subsp bovis AF2122/97
ucgaugccgcgcagc

SEQ ID NO: 1033270 - RNA, 19 nt, Mycobacterium bovis subsp bovis AF2122/97
ucgaugccguuguggacca

SEQ ID NO: 1033271 - RNA, 17 nt, Mycobacterium bovis subsp bovis AF2122/97
ucgaugccggcuggcgg

SEQ ID NO: 1033272 - RNA, 23 nt, Mycobacterium bovis subsp bovis AF2122/97
ucgaugcuuucguauucggccgc

SEQ ID NO: 1033273 - RNA, 18 nt, Mycobacterium bovis subsp bovis AF2122/97
ucgauggaaaacgccaug

SEQ ID NO: 1033274 - RNA, 21 nt, Mycobacterium bovis subsp bovis AF2122/97
ucgauggaaaacgccaugccg

SEQ ID NO: 1033275 - RNA, 21 nt, Mycobacterium bovis subsp bovis AF2122/97
ucgaugcugaacacgcagccg

SEQ ID NO: 1033276 - RNA, 16 nt, Mycobacterium bovis subsp bovis AF2122/97
ucgaugcugccagcca

SEQ ID NO: 1033277 - RNA, 15 nt, Mycobacterium bovis subsp bovis AF2122/97
ucgaugccgggugug

SEQ ID NO: 1033278 - RNA, 22 nt, Mycobacterium bovis subsp bovis AF2122/97
ucgaugccuucguagcggccgc

SEQ ID NO: 1033279 - RNA, 21 nt, Mycobacterium bovis subsp bovis AF2122/97
ucgaugcgcagcccgucggug

SEQ ID NO: 1033280 - RNA, 20 nt, Mycobacterium bovis subsp bovis AF2122/97
ucgaugcgacgaaccucggc

SEQ ID NO: 1033281 - RNA, 16 nt, Mycobacterium bovis subsp bovis AF2122/97
ucgcaccggagucggc

SEQ ID NO: 1033282 - RNA, 22 nt, Mycobacterium bovis subsp bovis AF2122/97
ucgcaccgcgccguggacgauc

SEQ ID NO: 1033283 - RNA, 18 nt, Mycobacterium bovis subsp bovis AF2122/97
ucgcacccgcucggcgcg

SEQ ID NO: 1033284 - RNA, 17 nt, Mycobacterium bovis subsp bovis AF2122/97
ucgcacgacgcgacacg

SEQ ID NO: 1033285 - RNA, 20 nt, Mycobacterium bovis subsp bovis AF2122/97
ucgcacgacgcgacacgccg

SEQ ID NO: 1033286 - RNA, 22 nt, Mycobacterium bovis subsp bovis AF2122/97
ucgcacggaaggcccggcgcgg

SEQ ID NO: 1033287 - RNA, 17 nt, Mycobacterium bovis subsp bovis AF2122/97
ucgcacggaugaugccg

SEQ ID NO: 1033288 - RNA, 21 nt, Mycobacterium bovis subsp bovis AF2122/97
ucgcacgagccaacaagucga

SEQ ID NO: 1033289 - RNA, 16 nt, Mycobacterium bovis subsp bovis AF2122/97
ucgcacgggccaccag

SEQ ID NO: 1033290 - RNA, 18 nt, Mycobacterium bovis subsp bovis AF2122/97
ucgcacgggccaccagcg

SEQ ID NO: 1033291 - RNA, 20 nt, Mycobacterium bovis subsp bovis AF2122/97
ucgcacgggccaccagcguc

SEQ ID NO: 1033292 - RNA, 12 nt, Mycobacterium bovis subsp bovis AF2122/97
ucgcacgugggc

SEQ ID NO: 1033293 - RNA, 18 nt, Mycobacterium bovis subsp bovis AF2122/97
ucgcaccaccugggcggc

SEQ ID NO: 1033294 - RNA, 20 nt, Mycobacterium bovis subsp bovis AF2122/97
ucgcacccagggcguuggcg

SEQ ID NO: 1033295 - RNA, 13 nt, Mycobacterium bovis subsp bovis AF2122/97
ucgcacccgcucg

SEQ ID NO: 1033296 - RNA, 13 nt, Mycobacterium bovis subsp bovis AF2122/97
ucgcacccguucg

SEQ ID NO: 1033297 - RNA, 21 nt, Mycobacterium bovis subsp bovis AF2122/97
ucgcacccguucgugagcggc

SEQ ID NO: 1033298 - RNA, 15 nt, Mycobacterium bovis subsp bovis AF2122/97
ucgcacaauggcggc

SEQ ID NO: 1033299 - RNA, 21 nt, Mycobacterium bovis subsp bovis AF2122/97
ucgcacaauggcggcgccguc

SEQ ID NO: 1033300 - RNA, 16 nt, Mycobacterium bovis subsp bovis AF2122/97
ucgcacaccaacaccg

SEQ ID NO: 1033301 - RNA, 23 nt, Mycobacterium bovis subsp bovis AF2122/97
ucgcacaccuccucgaccguggc

SEQ ID NO: 1033302 - RNA, 13 nt, Mycobacterium bovis subsp bovis AF2122/97
ucgcaaccgccgc

SEQ ID NO: 1033303 - RNA, 14 nt, Mycobacterium bovis subsp bovis AF2122/97
ucgcaacgcaucga

SEQ ID NO: 1033304 - RNA, 23 nt, Mycobacterium bovis subsp bovis AF2122/97
ucgcaagcgcggcgaagccgggu

SEQ ID NO: 1033305 - RNA, 12 nt, Mycobacterium bovis subsp bovis AF2122/97
ucgcaaccggcg

SEQ ID NO: 1033306 - RNA, 23 nt, Mycobacterium bovis subsp bovis AF2122/97
ucgcaauugcucguagcccaggu

SEQ ID NO: 1033307 - RNA, 18 nt, Mycobacterium bovis subsp bovis AF2122/97
ucgcaaucguuggccaug

SEQ ID NO: 1033308 - RNA, 17 nt, Mycobacterium bovis subsp bovis AF2122/97
ucgcaaugggcucacac

SEQ ID NO: 1033309 - RNA, 16 nt, Mycobacterium bovis subsp bovis AF2122/97
ucgcaauauccggccg

SEQ ID NO: 1033310 - RNA, 15 nt, Mycobacterium bovis subsp bovis AF2122/97
ucgcaagcugggcgu

SEQ ID NO: 1033311 - RNA, 19 nt, Mycobacterium bovis subsp bovis AF2122/97
ucgcaaggcccgcaccgcu

SEQ ID NO: 1033312 - RNA, 16 nt, Mycobacterium bovis subsp bovis AF2122/97
ucgcaauaugccacag

SEQ ID NO: 1033313 - RNA, 19 nt, Mycobacterium bovis subsp bovis AF2122/97
ucgcaaacaagaucagacc

SEQ ID NO: 1033314 - RNA, 16 nt, Mycobacterium bovis subsp bovis AF2122/97
ucgcaaaggccccggu

SEQ ID NO: 1033315 - RNA, 14 nt, Mycobacterium bovis subsp bovis AF2122/97
ucgaucauggcggc

SEQ ID NO: 1033316 - RNA, 17 nt, Mycobacterium bovis subsp bovis AF2122/97
ucgaucgcuugccccgc

SEQ ID NO: 1033317 - RNA, 23 nt, Mycobacterium bovis subsp bovis AF2122/97
ucgaucgccgcgauggcggucca

SEQ ID NO: 1033318 - RNA, 14 nt, Mycobacterium bovis subsp bovis AF2122/97
ucgaucgucgacgc

SEQ ID NO: 1033319 - RNA, 22 nt, Mycobacterium bovis subsp bovis AF2122/97
ucgaucgagcaggccgcccagc

SEQ ID NO: 1033320 - RNA, 18 nt, Mycobacterium bovis subsp bovis AF2122/97
ucgauccucgcccgcacc

SEQ ID NO: 1033321 - RNA, 19 nt, Mycobacterium bovis subsp bovis AF2122/97
ucgauccucgcccgcacca

SEQ ID NO: 1033322 - RNA, 16 nt, Mycobacterium bovis subsp bovis AF2122/97
ucgaucgccacgacag

SEQ ID NO: 1033323 - RNA, 15 nt, Mycobacterium bovis subsp bovis AF2122/97
ucgaucaucgaccug

SEQ ID NO: 1033324 - RNA, 20 nt, Mycobacterium bovis subsp bovis AF2122/97
ucgaugacgccgucagcggc

SEQ ID NO: 1033325 - RNA, 19 nt, Mycobacterium bovis subsp bovis AF2122/97
ucgaugaucucgccccagu

SEQ ID NO: 1033326 - RNA, 14 nt, Mycobacterium bovis subsp bovis AF2122/97
ucgaugaucugcuu

SEQ ID NO: 1033327 - RNA, 19 nt, Mycobacterium bovis subsp bovis AF2122/97
ucgaugaccuuugagucga

SEQ ID NO: 1033328 - RNA, 15 nt, Mycobacterium bovis subsp bovis AF2122/97
ucgaugacgacgccg

SEQ ID NO: 1033329 - RNA, 21 nt, Mycobacterium bovis subsp bovis AF2122/97
ucgaugacccauacgaacuca

SEQ ID NO: 1033330 - RNA, 22 nt, Mycobacterium bovis subsp bovis AF2122/97
ucgaugaagcgucguugcucgg

SEQ ID NO: 1033331 - RNA, 15 nt, Mycobacterium bovis subsp bovis AF2122/97
ucgaucucgcgaacc

SEQ ID NO: 1033332 - RNA, 14 nt, Mycobacterium bovis subsp bovis AF2122/97
ucgaucucggcgca

SEQ ID NO: 1033333 - RNA, 13 nt, Mycobacterium bovis subsp bovis AF2122/97
ucgaucuggcgga

SEQ ID NO: 1033334 - RNA, 20 nt, Mycobacterium bovis subsp bovis AF2122/97
ucgaucugcccggugaucca

SEQ ID NO: 1033335 - RNA, 22 nt, Mycobacterium bovis subsp bovis AF2122/97
ucgaucuggcuacgggccgcgg

SEQ ID NO: 1033336 - RNA, 15 nt, Mycobacterium bovis subsp bovis AF2122/97
ucgaucuucuccucg

SEQ ID NO: 1033337 - RNA, 17 nt, Mycobacterium bovis subsp bovis AF2122/97
ucgaucugucgcgccgg

SEQ ID NO: 1033338 - RNA, 14 nt, Mycobacterium bovis subsp bovis AF2122/97
ucgaucagccgggu

SEQ ID NO: 1033339 - RNA, 14 nt, Mycobacterium bovis subsp bovis AF2122/97
ucgaucagccgcau

SEQ ID NO: 1033340 - RNA, 16 nt, Mycobacterium bovis subsp bovis AF2122/97
ucgaucacggccgucg

SEQ ID NO: 1033341 - RNA, 21 nt, Mycobacterium bovis subsp bovis AF2122/97
ucgaucagcaacucggccacg

SEQ ID NO: 1033342 - RNA, 15 nt, Mycobacterium bovis subsp bovis AF2122/97
ucgaucacggcggcc

SEQ ID NO: 1033343 - RNA, 18 nt, Mycobacterium bovis subsp bovis AF2122/97
ucgaucacggcggccccg

SEQ ID NO: 1033344 - RNA, 19 nt, Mycobacterium bovis subsp bovis AF2122/97
ucgaucacggcggccccgg

SEQ ID NO: 1033345 - RNA, 12 nt, Mycobacterium bovis subsp bovis AF2122/97
ucgaucacgucg

SEQ ID NO: 1033346 - RNA, 16 nt, Mycobacterium bovis subsp bovis AF2122/97
ucgaucacguggucca

SEQ ID NO: 1033347 - RNA, 21 nt, Mycobacterium bovis subsp bovis AF2122/97
ucgaucacguggugcggccgg

SEQ ID NO: 1033348 - RNA, 16 nt, Mycobacterium bovis subsp bovis AF2122/97
ucgauagcggcggcgg

SEQ ID NO: 1033349 - RNA, 19 nt, Mycobacterium bovis subsp bovis AF2122/97
ucgaucaacaggucuaccc

SEQ ID NO: 1033350 - RNA, 16 nt, Mycobacterium bovis subsp bovis AF2122/97
ucgauauagccgccgg

SEQ ID NO: 1033351 - RNA, 13 nt, Mycobacterium bovis subsp bovis AF2122/97
ucgauaccggcgu

SEQ ID NO: 1033352 - RNA, 17 nt, Mycobacterium bovis subsp bovis AF2122/97
ucgaucacacguccgcg

SEQ ID NO: 1033353 - RNA, 15 nt, Mycobacterium bovis subsp bovis AF2122/97
ucgaguuccggccgg

SEQ ID NO: 1033354 - RNA, 15 nt, Mycobacterium bovis subsp bovis AF2122/97
ucgaguucggccgcg

SEQ ID NO: 1033355 - RNA, 15 nt, Mycobacterium bovis subsp bovis AF2122/97
ucgaguuuggccagu

SEQ ID NO: 1033356 - RNA, 20 nt, Mycobacterium bovis subsp bovis AF2122/97
ucgaguagugcaggugcccg

SEQ ID NO: 1033357 - RNA, 13 nt, Mycobacterium bovis subsp bovis AF2122/97
ucgagucgccgag

SEQ ID NO: 1033358 - RNA, 18 nt, Mycobacterium bovis subsp bovis AF2122/97
ucgaguugcucggccgau

SEQ ID NO: 1033359 - RNA, 14 nt, Mycobacterium bovis subsp bovis AF2122/97
ucgaguccgacggg

SEQ ID NO: 1033360 - RNA, 16 nt, Mycobacterium bovis subsp bovis AF2122/97
ucgaguuccgcaucgg

SEQ ID NO: 1033361 - RNA, 15 nt, Mycobacterium bovis subsp bovis AF2122/97
ucgagugccgccacc

SEQ ID NO: 1033362 - RNA, 17 nt, Mycobacterium bovis subsp bovis AF2122/97
ucgagugccgccaccgc

SEQ ID NO: 1033363 - RNA, 17 nt, Mycobacterium bovis subsp bovis AF2122/97
ucgagugccucgaccug

SEQ ID NO: 1033364 - RNA, 13 nt, Mycobacterium bovis subsp bovis AF2122/97
ucgagugcgacgg

SEQ ID NO: 1033365 - RNA, 14 nt, Mycobacterium bovis subsp bovis AF2122/97
ucgagugcgacggc

SEQ ID NO: 1033366 - RNA, 23 nt, Mycobacterium bovis subsp bovis AF2122/97
ucgagugcggacuucgccgcccg

SEQ ID NO: 1033367 - RNA, 16 nt, Mycobacterium bovis subsp bovis AF2122/97
ucgagugcggucgaga

SEQ ID NO: 1033368 - RNA, 15 nt, Mycobacterium bovis subsp bovis AF2122/97
ucgagugggugaggc

SEQ ID NO: 1033369 - RNA, 16 nt, Mycobacterium bovis subsp bovis AF2122/97
ugccgccggugccacc

SEQ ID NO: 1033370 - RNA, 18 nt, Mycobacterium bovis subsp bovis AF2122/97
ugccgccggugccgccau

SEQ ID NO: 1033371 - RNA, 18 nt, Mycobacterium bovis subsp bovis AF2122/97
ugccgccgguuccgccgg

SEQ ID NO: 1033372 - RNA, 14 nt, Mycobacterium bovis subsp bovis AF2122/97
ugccgccggugccg

SEQ ID NO: 1033373 - RNA, 18 nt, Mycobacterium bovis subsp bovis AF2122/97
ugccgccguuaccgccgc

SEQ ID NO: 1033374 - RNA, 18 nt, Mycobacterium bovis subsp bovis AF2122/97
ugccgccguucccaccac

SEQ ID NO: 1033375 - RNA, 18 nt, Mycobacterium bovis subsp bovis AF2122/97
ugccgccguugccgccau

SEQ ID NO: 1033376 - RNA, 19 nt, Mycobacterium bovis subsp bovis AF2122/97
ugccgccguugccgccauu

SEQ ID NO: 1033377 - RNA, 19 nt, Mycobacterium bovis subsp bovis AF2122/97
ugccgccguugccgccgaa

SEQ ID NO: 1033378 - RNA, 19 nt, Mycobacterium bovis subsp bovis AF2122/97
ugccgccguccccgccgac

SEQ ID NO: 1033379 - RNA, 15 nt, Mycobacterium bovis subsp bovis AF2122/97
ugccgccgucgauga

SEQ ID NO: 1033380 - RNA, 16 nt, Mycobacterium bovis subsp bovis AF2122/97
ugccgccgucgccacg

SEQ ID NO: 1033381 - RNA, 17 nt, Mycobacterium bovis subsp bovis AF2122/97
ugccgccgucgccgcca

SEQ ID NO: 1033382 - RNA, 20 nt, Mycobacterium bovis subsp bovis AF2122/97
ugccgccgucgccgccguug

SEQ ID NO: 1033383 - RNA, 15 nt, Mycobacterium bovis subsp bovis AF2122/97
ugccgccgucguugc

SEQ ID NO: 1033384 - RNA, 21 nt, Mycobacterium bovis subsp bovis AF2122/97
ugccgccgucguugcccgacc

SEQ ID NO: 1033385 - RNA, 22 nt, Mycobacterium bovis subsp bovis AF2122/97
ugccgccguugccgucgucgcc

SEQ ID NO: 1033386 - RNA, 23 nt, Mycobacterium bovis subsp bovis AF2122/97
ugccgcugaagccaaaugcgcug

SEQ ID NO: 1033387 - RNA, 19 nt, Mycobacterium bovis subsp bovis AF2122/97
ugccgcucggcaaccugcg

SEQ ID NO: 1033388 - RNA, 16 nt, Mycobacterium bovis subsp bovis AF2122/97
ugccgcucucggcgau

SEQ ID NO: 1033389 - RNA, 18 nt, Mycobacterium bovis subsp bovis AF2122/97
ugccggacgccaugcccg

SEQ ID NO: 1033390 - RNA, 19 nt, Mycobacterium bovis subsp bovis AF2122/97
ugccggaggaucgcugguu

SEQ ID NO: 1033391 - RNA, 17 nt, Mycobacterium bovis subsp bovis AF2122/97
ugccggagacacccgcc

SEQ ID NO: 1033392 - RNA, 20 nt, Mycobacterium bovis subsp bovis AF2122/97
ugccggagacaccgcaacgc

SEQ ID NO: 1033393 - RNA, 13 nt, Mycobacterium bovis subsp bovis AF2122/97
ugccggagacguc

SEQ ID NO: 1033394 - RNA, 18 nt, Mycobacterium bovis subsp bovis AF2122/97
ugccgcugcauccgcagc

SEQ ID NO: 1033395 - RNA, 18 nt, Mycobacterium bovis subsp bovis AF2122/97
ugccggcgagggccacgg

SEQ ID NO: 1033396 - RNA, 18 nt, Mycobacterium bovis subsp bovis AF2122/97
ugccggcgagggcgcgga

SEQ ID NO: 1033397 - RNA, 21 nt, Mycobacterium bovis subsp bovis AF2122/97
ugccggcgccuuggucgccgc

SEQ ID NO: 1033398 - RNA, 19 nt, Mycobacterium bovis subsp bovis AF2122/97
ugccggcggaucugaucgg

SEQ ID NO: 1033399 - RNA, 11 nt, Mycobacterium bovis subsp bovis AF2122/97
ugccggcgacc

SEQ ID NO: 1033400 - RNA, 21 nt, Mycobacterium bovis subsp bovis AF2122/97
ugccggcgaacucgcgccgag

SEQ ID NO: 1033401 - RNA, 20 nt, Mycobacterium bovis subsp bovis AF2122/97
ugccggcgaccaaggccgac

SEQ ID NO: 1033402 - RNA, 21 nt, Mycobacterium bovis subsp bovis AF2122/97
ugccggcgacgcuaccgccgg

SEQ ID NO: 1033403 - RNA, 22 nt, Mycobacterium bovis subsp bovis AF2122/97
ugccggcgacgcuaccgccgga

SEQ ID NO: 1033404 - RNA, 23 nt, Mycobacterium bovis subsp bovis AF2122/97
ugccggccagacucgcggucgac

SEQ ID NO: 1033405 - RNA, 20 nt, Mycobacterium bovis subsp bovis AF2122/97
ugccggccaacuucugcacg

SEQ ID NO: 1033406 - RNA, 20 nt, Mycobacterium bovis subsp bovis AF2122/97
ugccggccaaggugguuguc

SEQ ID NO: 1033407 - RNA, 13 nt, Mycobacterium bovis subsp bovis AF2122/97
ugccggccaccag

SEQ ID NO: 1033408 - RNA, 19 nt, Mycobacterium bovis subsp bovis AF2122/97
ugccggccaccagccuggc

SEQ ID NO: 1033409 - RNA, 12 nt, Mycobacterium bovis subsp bovis AF2122/97
ugccggcccgca

SEQ ID NO: 1033410 - RNA, 22 nt, Mycobacterium bovis subsp bovis AF2122/97
ugccggccgcguaaaccggcug

SEQ ID NO: 1033411 - RNA, 23 nt, Mycobacterium bovis subsp bovis AF2122/97
ugccggcacgccgaccgguggca

SEQ ID NO: 1033412 - RNA, 18 nt, Mycobacterium bovis subsp bovis AF2122/97
ugccggcagcggcgcgcu

SEQ ID NO: 1033413 - RNA, 13 nt, Mycobacterium bovis subsp bovis AF2122/97
ugccggcagcggu

SEQ ID NO: 1033414 - RNA, 15 nt, Mycobacterium bovis subsp bovis AF2122/97
ugccggaucgggacc

SEQ ID NO: 1033415 - RNA, 21 nt, Mycobacterium bovis subsp bovis AF2122/97
ugccggacgccaugcccgcac

SEQ ID NO: 1033416 - RNA, 18 nt, Mycobacterium bovis subsp bovis AF2122/97
ugccggaguugucgacgg

SEQ ID NO: 1033417 - RNA, 15 nt, Mycobacterium bovis subsp bovis AF2122/97
ugcccgacgagucgc

SEQ ID NO: 1033418 - RNA, 16 nt, Mycobacterium bovis subsp bovis AF2122/97
ugcccgacccgccgau

SEQ ID NO: 1033419 - RNA, 16 nt, Mycobacterium bovis subsp bovis AF2122/97
ugcccggcaaccugga

SEQ ID NO: 1033420 - RNA, 14 nt, Mycobacterium bovis subsp bovis AF2122/97
ugcccggcacggug

SEQ ID NO: 1033421 - RNA, 12 nt, Mycobacterium bovis subsp bovis AF2122/97
ugcccggccgcc

SEQ ID NO: 1033422 - RNA, 23 nt, Mycobacterium bovis subsp bovis AF2122/97
ugcccggcgccguagugcgcauc

SEQ ID NO: 1033423 - RNA, 22 nt, Mycobacterium bovis subsp bovis AF2122/97
ugcccggcuccuccccggcccg

SEQ ID NO: 1033424 - RNA, 21 nt, Mycobacterium bovis subsp bovis AF2122/97
ugccgacgaacgaaccgccgc

SEQ ID NO: 1033425 - RNA, 17 nt, Mycobacterium bovis subsp bovis AF2122/97
ugccgagcgaccguccc

SEQ ID NO: 1033426 - RNA, 18 nt, Mycobacterium bovis subsp bovis AF2122/97
ugccgagcuucagcgcgc

SEQ ID NO: 1033427 - RNA, 14 nt, Mycobacterium bovis subsp bovis AF2122/97
ugccgagcacgacg

SEQ ID NO: 1033428 - RNA, 15 nt, Mycobacterium bovis subsp bovis AF2122/97
ugccgagcacgacga

SEQ ID NO: 1033429 - RNA, 22 nt, Mycobacterium bovis subsp bovis AF2122/97
ugccgagcacgacgacgucggg

SEQ ID NO: 1033430 - RNA, 17 nt, Mycobacterium bovis subsp bovis AF2122/97
ugccgagcacucggcca

SEQ ID NO: 1033431 - RNA, 14 nt, Mycobacterium bovis subsp bovis AF2122/97
ugccgagcccaggu

SEQ ID NO: 1033432 - RNA, 21 nt, Mycobacterium bovis subsp bovis AF2122/97
ugccgacgaucgacgccgcca

SEQ ID NO: 1033433 - RNA, 23 nt, Mycobacterium bovis subsp bovis AF2122/97
ugccgacgccccgaucggccacc

SEQ ID NO: 1033434 - RNA, 19 nt, Mycobacterium bovis subsp bovis AF2122/97
ugccgacgcucacgcugcu

SEQ ID NO: 1033435 - RNA, 17 nt, Mycobacterium bovis subsp bovis AF2122/97
ugccgacggcaucaacg

SEQ ID NO: 1033436 - RNA, 14 nt, Mycobacterium bovis subsp bovis AF2122/97
ugccgacucagguc

SEQ ID NO: 1033437 - RNA, 19 nt, Mycobacterium bovis subsp bovis AF2122/97
ugccgagaagugggcggua

SEQ ID NO: 1033438 - RNA, 14 nt, Mycobacterium bovis subsp bovis AF2122/97
ugccgacucaucgg

SEQ ID NO: 1033439 - RNA, 17 nt, Mycobacterium bovis subsp bovis AF2122/97
ugccgacggugaugggg

SEQ ID NO: 1033440 - RNA, 15 nt, Mycobacterium bovis subsp bovis AF2122/97
ugccgacggcgccga

SEQ ID NO: 1033441 - RNA, 17 nt, Mycobacterium bovis subsp bovis AF2122/97
ugccgcagcauccccgc

SEQ ID NO: 1033442 - RNA, 21 nt, Mycobacterium bovis subsp bovis AF2122/97
ugccgcacgauggccgucgau

SEQ ID NO: 1033443 - RNA, 22 nt, Mycobacterium bovis subsp bovis AF2122/97
ugccgcacgauggccgucgauc

SEQ ID NO: 1033444 - RNA, 18 nt, Mycobacterium bovis subsp bovis AF2122/97
ugccgcacguucggcgau

SEQ ID NO: 1033445 - RNA, 20 nt, Mycobacterium bovis subsp bovis AF2122/97
ugccgcacguucggcgauga

SEQ ID NO: 1033446 - RNA, 20 nt, Mycobacterium bovis subsp bovis AF2122/97
ugccgcacugggcgaugacg

SEQ ID NO: 1033447 - RNA, 17 nt, Mycobacterium bovis subsp bovis AF2122/97
ugccgagguugcggacg

SEQ ID NO: 1033448 - RNA, 13 nt, Mycobacterium bovis subsp bovis AF2122/97
ugccgaucagcug

SEQ ID NO: 1033449 - RNA, 16 nt, Mycobacterium bovis subsp bovis AF2122/97
ugccgaucagcccggc

SEQ ID NO: 1033450 - RNA, 18 nt, Mycobacterium bovis subsp bovis AF2122/97
ugccgcccacgcugccca

SEQ ID NO: 1033451 - RNA, 22 nt, Mycobacterium bovis subsp bovis AF2122/97
ugccgcagcggcggcaacccug

SEQ ID NO: 1033452 - RNA, 20 nt, Mycobacterium bovis subsp bovis AF2122/97
ugccgcccccauaacugcgg

SEQ ID NO: 1033453 - RNA, 15 nt, Mycobacterium bovis subsp bovis AF2122/97
ugccgcccucaccgc

SEQ ID NO: 1033454 - RNA, 15 nt, Mycobacterium bovis subsp bovis AF2122/97
ugccgcccgcgccgc

SEQ ID NO: 1033455 - RNA, 18 nt, Mycobacterium bovis subsp bovis AF2122/97
ugccgcccgcgccgccgg

SEQ ID NO: 1033456 - RNA, 16 nt, Mycobacterium bovis subsp bovis AF2122/97
ugccgcccgcuccgcc

SEQ ID NO: 1033457 - RNA, 16 nt, Mycobacterium bovis subsp bovis AF2122/97
ugccgcccgagccggu

SEQ ID NO: 1033458 - RNA, 18 nt, Mycobacterium bovis subsp bovis AF2122/97
ugccgcccuggacgucgg

SEQ ID NO: 1033459 - RNA, 23 nt, Mycobacterium bovis subsp bovis AF2122/97
ugccgcccuggacgucggcgaua

SEQ ID NO: 1033460 - RNA, 19 nt, Mycobacterium bovis subsp bovis AF2122/97
ugccgcccuugauguccgc

SEQ ID NO: 1033461 - RNA, 19 nt, Mycobacterium bovis subsp bovis AF2122/97
ugccgcccuugccgcccgc

SEQ ID NO: 1033462 - RNA, 22 nt, Mycobacterium bovis subsp bovis AF2122/97
ugccgcccuugccgcccgcucc

SEQ ID NO: 1033463 - RNA, 19 nt, Mycobacterium bovis subsp bovis AF2122/97
ugccgccggcgccgccgau

SEQ ID NO: 1033464 - RNA, 17 nt, Mycobacterium bovis subsp bovis AF2122/97
ugccgccggcuccaccc

SEQ ID NO: 1033465 - RNA, 20 nt, Mycobacterium bovis subsp bovis AF2122/97
ugccgccgacaccaccggcg

SEQ ID NO: 1033466 - RNA, 21 nt, Mycobacterium bovis subsp bovis AF2122/97
ugccgccgacaccaccggcgc

SEQ ID NO: 1033467 - RNA, 14 nt, Mycobacterium bovis subsp bovis AF2122/97
ugccagccauggcc

SEQ ID NO: 1033468 - RNA, 12 nt, Mycobacterium bovis subsp bovis AF2122/97
ugccagccgguc

SEQ ID NO: 1033469 - RNA, 19 nt, Mycobacterium bovis subsp bovis AF2122/97
ugccagcagcagcgccgcg

SEQ ID NO: 1033470 - RNA, 18 nt, Mycobacterium bovis subsp bovis AF2122/97
ugccagcaccacgucgac

SEQ ID NO: 1033471 - RNA, 17 nt, Mycobacterium bovis subsp bovis AF2122/97
ugccagaucggucggcc

SEQ ID NO: 1033472 - RNA, 18 nt, Mycobacterium bovis subsp bovis AF2122/97
ugccagaucggucggcca

SEQ ID NO: 1033473 - RNA, 14 nt, Mycobacterium bovis subsp bovis AF2122/97
ugccagaucagcac

SEQ ID NO: 1033474 - RNA, 21 nt, Mycobacterium bovis subsp bovis AF2122/97
ugccaccuuggucuucgccgu

SEQ ID NO: 1033475 - RNA, 16 nt, Mycobacterium bovis subsp bovis AF2122/97
ugccacgaucggcggg

SEQ ID NO: 1033476 - RNA, 18 nt, Mycobacterium bovis subsp bovis AF2122/97
ugccacgcucggugcugc

SEQ ID NO: 1033477 - RNA, 15 nt, Mycobacterium bovis subsp bovis AF2122/97
ugcccacgcgcagaa

SEQ ID NO: 1033478 - RNA, 18 nt, Mycobacterium bovis subsp bovis AF2122/97
ugcccacggcgaccacgc

SEQ ID NO: 1033479 - RNA, 18 nt, Mycobacterium bovis subsp bovis AF2122/97
ugcccagaaaaccgccgc

SEQ ID NO: 1033480 - RNA, 17 nt, Mycobacterium bovis subsp bovis AF2122/97
ugccccgcaucgcccaa

SEQ ID NO: 1033481 - RNA, 13 nt, Mycobacterium bovis subsp bovis AF2122/97
ugcccccggcgcg

SEQ ID NO: 1033482 - RNA, 16 nt, Mycobacterium bovis subsp bovis AF2122/97
ugccccgaccgccgug

SEQ ID NO: 1033483 - RNA, 19 nt, Mycobacterium bovis subsp bovis AF2122/97
ugccccgaccgccguggcc

SEQ ID NO: 1033484 - RNA, 17 nt, Mycobacterium bovis subsp bovis AF2122/97
ugccccgggcccagguu

SEQ ID NO: 1033485 - RNA, 20 nt, Mycobacterium bovis subsp bovis AF2122/97
ugcccgaccacaccgggaug

SEQ ID NO: 1033486 - RNA, 20 nt, Mycobacterium bovis subsp bovis AF2122/97
ugcccgacccgccgacgccg

SEQ ID NO: 1033487 - RNA, 21 nt, Mycobacterium bovis subsp bovis AF2122/97
ugcccgaaccaccaccggcaa

SEQ ID NO: 1033488 - RNA, 14 nt, Mycobacterium bovis subsp bovis AF2122/97
ugcccccgccggcc

SEQ ID NO: 1033489 - RNA, 20 nt, Mycobacterium bovis subsp bovis AF2122/97
ugccccacccgcggcgccgu

SEQ ID NO: 1033490 - RNA, 21 nt, Mycobacterium bovis subsp bovis AF2122/97
ugcccagcgcuuugaugccga

SEQ ID NO: 1033491 - RNA, 22 nt, Mycobacterium bovis subsp bovis AF2122/97
ugcccaggaaggcgacgccgaa

SEQ ID NO: 1033492 - RNA, 17 nt, Mycobacterium bovis subsp bovis AF2122/97
ugcccagcgguugccgu

SEQ ID NO: 1033493 - RNA, 12 nt, Mycobacterium bovis subsp bovis AF2122/97
ugcccagcgugg

SEQ ID NO: 1033494 - RNA, 14 nt, Mycobacterium bovis subsp bovis AF2122/97
ugcccauccggccg

SEQ ID NO: 1033495 - RNA, 16 nt, Mycobacterium bovis subsp bovis AF2122/97
ugcccaucggugaucg

SEQ ID NO: 1033496 - RNA, 19 nt, Mycobacterium bovis subsp bovis AF2122/97
ugcccaucuccaacaggaa

SEQ ID NO: 1033497 - RNA, 22 nt, Mycobacterium bovis subsp bovis AF2122/97
ugcccaugaugcucgaugauca

SEQ ID NO: 1033498 - RNA, 16 nt, Mycobacterium bovis subsp bovis AF2122/97
ugcccaugauggccgc

SEQ ID NO: 1033499 - RNA, 16 nt, Mycobacterium bovis subsp bovis AF2122/97
ugcccaggugcgucca

SEQ ID NO: 1033500 - RNA, 18 nt, Mycobacterium bovis subsp bovis AF2122/97
ugcccauagccggugguc

SEQ ID NO: 1033501 - RNA, 13 nt, Mycobacterium bovis subsp bovis AF2122/97
ugcaccgucagcc

SEQ ID NO: 1033502 - RNA, 18 nt, Mycobacterium bovis subsp bovis AF2122/97
ugcaccggccgaaggcgc

SEQ ID NO: 1033503 - RNA, 18 nt, Mycobacterium bovis subsp bovis AF2122/97
ugcaccuucuccaccgaa

SEQ ID NO: 1033504 - RNA, 17 nt, Mycobacterium bovis subsp bovis AF2122/97
ugcacgagugcggcgac

SEQ ID NO: 1033505 - RNA, 21 nt, Mycobacterium bovis subsp bovis AF2122/97
ugcacgcacagcccgaugccg

SEQ ID NO: 1033506 - RNA, 23 nt, Mycobacterium bovis subsp bovis AF2122/97
ugcacgcacagcccgaugccgug

SEQ ID NO: 1033507 - RNA, 20 nt, Mycobacterium bovis subsp bovis AF2122/97
ugcacgcaccacaauccacg

SEQ ID NO: 1033508 - RNA, 14 nt, Mycobacterium bovis subsp bovis AF2122/97
ugcacgcccaggcg

SEQ ID NO: 1033509 - RNA, 15 nt, Mycobacterium bovis subsp bovis AF2122/97
ugcacgcccggcgug

SEQ ID NO: 1033510 - RNA, 22 nt, Mycobacterium bovis subsp bovis AF2122/97
ugcaguacuagcagcgggcugc

SEQ ID NO: 1033511 - RNA, 19 nt, Mycobacterium bovis subsp bovis AF2122/97
ugcaguaacuucaccggcu

SEQ ID NO: 1033512 - RNA, 15 nt, Mycobacterium bovis subsp bovis AF2122/97
ugcaguccgaugccg

SEQ ID NO: 1033513 - RNA, 23 nt, Mycobacterium bovis subsp bovis AF2122/97
ugcagucgauuucggcggcgagg

SEQ ID NO: 1033514 - RNA, 12 nt, Mycobacterium bovis subsp bovis AF2122/97
ugcaggugcugg

SEQ ID NO: 1033515 - RNA, 17 nt, Mycobacterium bovis subsp bovis AF2122/97
ugcagguggccgucgcc

SEQ ID NO: 1033516 - RNA, 16 nt, Mycobacterium bovis subsp bovis AF2122/97
ugcacgccggcgcugg

SEQ ID NO: 1033517 - RNA, 15 nt, Mycobacterium bovis subsp bovis AF2122/97
ugcauaccgccgggc

SEQ ID NO: 1033518 - RNA, 18 nt, Mycobacterium bovis subsp bovis AF2122/97
ugcagugccucggcggcg

SEQ ID NO: 1033519 - RNA, 19 nt, Mycobacterium bovis subsp bovis AF2122/97
ugcagugcgacccgggcgu

SEQ ID NO: 1033520 - RNA, 14 nt, Mycobacterium bovis subsp bovis AF2122/97
ugcaguggcgacga

SEQ ID NO: 1033521 - RNA, 18 nt, Mycobacterium bovis subsp bovis AF2122/97
ugcagucggugcggugca

SEQ ID NO: 1033522 - RNA, 13 nt, Mycobacterium bovis subsp bovis AF2122/97
ugccaccggccgg

SEQ ID NO: 1033523 - RNA, 19 nt, Mycobacterium bovis subsp bovis AF2122/97
ugccaccggccggcgcagu

SEQ ID NO: 1033524 - RNA, 18 nt, Mycobacterium bovis subsp bovis AF2122/97
ugccaccagugagcccgc

SEQ ID NO: 1033525 - RNA, 15 nt, Mycobacterium bovis subsp bovis AF2122/97
ugccacccaucgcac

SEQ ID NO: 1033526 - RNA, 14 nt, Mycobacterium bovis subsp bovis AF2122/97
ugccacgccgccgg

SEQ ID NO: 1033527 - RNA, 17 nt, Mycobacterium bovis subsp bovis AF2122/97
ugccacgccugagccac

SEQ ID NO: 1033528 - RNA, 20 nt, Mycobacterium bovis subsp bovis AF2122/97
ugccacgccugagccaccaa

SEQ ID NO: 1033529 - RNA, 19 nt, Mycobacterium bovis subsp bovis AF2122/97
ugccacgcgugacucggcc

SEQ ID NO: 1033530 - RNA, 21 nt, Mycobacterium bovis subsp bovis AF2122/97
ugccacgcguuccuccagcag

SEQ ID NO: 1033531 - RNA, 18 nt, Mycobacterium bovis subsp bovis AF2122/97
ugccaccgcggccgcggu

SEQ ID NO: 1033532 - RNA, 13 nt, Mycobacterium bovis subsp bovis AF2122/97
ugccacccuugcc

SEQ ID NO: 1033533 - RNA, 21 nt, Mycobacterium bovis subsp bovis AF2122/97
ugccacccuugccgccggugg

SEQ ID NO: 1033534 - RNA, 15 nt, Mycobacterium bovis subsp bovis AF2122/97
ugccaccucggcgcg

SEQ ID NO: 1033535 - RNA, 19 nt, Mycobacterium bovis subsp bovis AF2122/97
ugccaccacgcaugcgcgc

SEQ ID NO: 1033536 - RNA, 14 nt, Mycobacterium bovis subsp bovis AF2122/97
ugccaccacgcucc

SEQ ID NO: 1033537 - RNA, 18 nt, Mycobacterium bovis subsp bovis AF2122/97
ugcaugccggcuagcucg

SEQ ID NO: 1033538 - RNA, 14 nt, Mycobacterium bovis subsp bovis AF2122/97
ugcaugccgggaag

SEQ ID NO: 1033539 - RNA, 15 nt, Mycobacterium bovis subsp bovis AF2122/97
ugcaugaacugcucg

SEQ ID NO: 1033540 - RNA, 17 nt, Mycobacterium bovis subsp bovis AF2122/97
ugcauccuccucgucga

SEQ ID NO: 1033541 - RNA, 18 nt, Mycobacterium bovis subsp bovis AF2122/97
ugcauccuccucgucgac

SEQ ID NO: 1033542 - RNA, 18 nt, Mycobacterium bovis subsp bovis AF2122/97
ugcaucggugcagcccgc

SEQ ID NO: 1033543 - RNA, 16 nt, Mycobacterium bovis subsp bovis AF2122/97
ugcauccagcugcugc

SEQ ID NO: 1033544 - RNA, 22 nt, Mycobacterium bovis subsp bovis AF2122/97
ugcauaggcgcggucaccgcgu

SEQ ID NO: 1033545 - RNA, 18 nt, Mycobacterium bovis subsp bovis AF2122/97
ugcgccgccggcggcggu

SEQ ID NO: 1033546 - RNA, 12 nt, Mycobacterium bovis subsp bovis AF2122/97
ugcgccgcaugc

SEQ ID NO: 1033547 - RNA, 12 nt, Mycobacterium bovis subsp bovis AF2122/97
ugcgccgggcgu

SEQ ID NO: 1033548 - RNA, 20 nt, Mycobacterium bovis subsp bovis AF2122/97
ugcgccgggcguccgccggc

SEQ ID NO: 1033549 - RNA, 21 nt, Mycobacterium bovis subsp bovis AF2122/97
ugcgccgguaacuguccgccc

SEQ ID NO: 1033550 - RNA, 21 nt, Mycobacterium bovis subsp bovis AF2122/97
ugcgccgggugaggcggugac

SEQ ID NO: 1033551 - RNA, 13 nt, Mycobacterium bovis subsp bovis AF2122/97
ugcgccaggcggc

SEQ ID NO: 1033552 - RNA, 23 nt, Mycobacterium bovis subsp bovis AF2122/97
ugcgccaguaggcuucgaccgug

SEQ ID NO: 1033553 - RNA, 20 nt, Mycobacterium bovis subsp bovis AF2122/97
ugcgccauaacaccggguag

SEQ ID NO: 1033554 - RNA, 21 nt, Mycobacterium bovis subsp bovis AF2122/97
ugcgccagcgguggaccaccg

SEQ ID NO: 1033555 - RNA, 13 nt, Mycobacterium bovis subsp bovis AF2122/97
ugcgccgccaacu

SEQ ID NO: 1033556 - RNA, 16 nt, Mycobacterium bovis subsp bovis AF2122/97
ugcgccgccagcgccg

SEQ ID NO: 1033557 - RNA, 16 nt, Mycobacterium bovis subsp bovis AF2122/97
ugcgccgcccgcgcca

SEQ ID NO: 1033558 - RNA, 19 nt, Mycobacterium bovis subsp bovis AF2122/97
ugcgccgcccgcgccaccg

SEQ ID NO: 1033559 - RNA, 17 nt, Mycobacterium bovis subsp bovis AF2122/97
ugcgccgcacggcgacg

SEQ ID NO: 1033560 - RNA, 15 nt, Mycobacterium bovis subsp bovis AF2122/97
ugcgccgcacgccga

SEQ ID NO: 1033561 - RNA, 17 nt, Mycobacterium bovis subsp bovis AF2122/97
ugcgccucuuccuggcg

SEQ ID NO: 1033562 - RNA, 17 nt, Mycobacterium bovis subsp bovis AF2122/97
ugcgccggugccggcca

SEQ ID NO: 1033563 - RNA, 19 nt, Mycobacterium bovis subsp bovis AF2122/97
ugcgcgccugcgccacccg

SEQ ID NO: 1033564 - RNA, 20 nt, Mycobacterium bovis subsp bovis AF2122/97
ugcgcgccugcgccacccgc

SEQ ID NO: 1033565 - RNA, 22 nt, Mycobacterium bovis subsp bovis AF2122/97
ugcgccuucgccagcggcgcga

SEQ ID NO: 1033566 - RNA, 14 nt, Mycobacterium bovis subsp bovis AF2122/97
ugcgcgcggccgcg

SEQ ID NO: 1033567 - RNA, 15 nt, Mycobacterium bovis subsp bovis AF2122/97
ugcgcgcggcgcgau

SEQ ID NO: 1033568 - RNA, 14 nt, Mycobacterium bovis subsp bovis AF2122/97
ugcgcgcggcggcc

SEQ ID NO: 1033569 - RNA, 15 nt, Mycobacterium bovis subsp bovis AF2122/97
ugcgcggcaucccgc

SEQ ID NO: 1033570 - RNA, 19 nt, Mycobacterium bovis subsp bovis AF2122/97
ugcgcggaguacuccagcc

SEQ ID NO: 1033571 - RNA, 21 nt, Mycobacterium bovis subsp bovis AF2122/97
ugcgcggaguacuccagccgc

SEQ ID NO: 1033572 - RNA, 19 nt, Mycobacterium bovis subsp bovis AF2122/97
ugcgcggucucgagucggu

SEQ ID NO: 1033573 - RNA, 18 nt, Mycobacterium bovis subsp bovis AF2122/97
ugcgcggugacgagccac

SEQ ID NO: 1033574 - RNA, 21 nt, Mycobacterium bovis subsp bovis AF2122/97
ugcgcggugacgagccaccac

SEQ ID NO: 1033575 - RNA, 19 nt, Mycobacterium bovis subsp bovis AF2122/97
ugcgcggugaugguuaccg

SEQ ID NO: 1033576 - RNA, 17 nt, Mycobacterium bovis subsp bovis AF2122/97
ugcgcgguagcucgucg

SEQ ID NO: 1033577 - RNA, 18 nt, Mycobacterium bovis subsp bovis AF2122/97
ugcgcgggugguucaccu

SEQ ID NO: 1033578 - RNA, 16 nt, Mycobacterium bovis subsp bovis AF2122/97
ugcgcgucagccgcac

SEQ ID NO: 1033579 - RNA, 22 nt, Mycobacterium bovis subsp bovis AF2122/97
ugcgcgucagccgcaccccgcc

SEQ ID NO: 1033580 - RNA, 17 nt, Mycobacterium bovis subsp bovis AF2122/97
ugcgcgucaggccagcg

SEQ ID NO: 1033581 - RNA, 23 nt, Mycobacterium bovis subsp bovis AF2122/97
ugcgcgucaggccagcgcucacc

SEQ ID NO: 1033582 - RNA, 12 nt, Mycobacterium bovis subsp bovis AF2122/97
ugcgcggugcgc

SEQ ID NO: 1033583 - RNA, 20 nt, Mycobacterium bovis subsp bovis AF2122/97
ugcgcgguugugacggugaa

SEQ ID NO: 1033584 - RNA, 17 nt, Mycobacterium bovis subsp bovis AF2122/97
ugcggcccaaccggucg

SEQ ID NO: 1033585 - RNA, 12 nt, Mycobacterium bovis subsp bovis AF2122/97
ugcggcccacac

SEQ ID NO: 1033586 - RNA, 20 nt, Mycobacterium bovis subsp bovis AF2122/97
ugcggcccaugaucucggcg

SEQ ID NO: 1033587 - RNA, 22 nt, Mycobacterium bovis subsp bovis AF2122/97
ugcggcccaugaucucggcgaa

SEQ ID NO: 1033588 - RNA, 15 nt, Mycobacterium bovis subsp bovis AF2122/97
ugcggcggcaucggu

SEQ ID NO: 1033589 - RNA, 20 nt, Mycobacterium bovis subsp bovis AF2122/97
ugcggcggcgcucgucgauc

SEQ ID NO: 1033590 - RNA, 23 nt, Mycobacterium bovis subsp bovis AF2122/97
ugcggcggcgcucgucgaucucc

SEQ ID NO: 1033591 - RNA, 13 nt, Mycobacterium bovis subsp bovis AF2122/97
ugcggcggcugcc

SEQ ID NO: 1033592 - RNA, 16 nt, Mycobacterium bovis subsp bovis AF2122/97
ugcggcggcugccggu

SEQ ID NO: 1033593 - RNA, 18 nt, Mycobacterium bovis subsp bovis AF2122/97
ugcggccccgucgccgau

SEQ ID NO: 1033594 - RNA, 21 nt, Mycobacterium bovis subsp bovis AF2122/97
ugcggcguuaucgucggcuug

SEQ ID NO: 1033595 - RNA, 13 nt, Mycobacterium bovis subsp bovis AF2122/97
ugcggcucgccgg

SEQ ID NO: 1033596 - RNA, 19 nt, Mycobacterium bovis subsp bovis AF2122/97
ugcgggccugcacgccggc

SEQ ID NO: 1033597 - RNA, 23 nt, Mycobacterium bovis subsp bovis AF2122/97
ugcggcguuggugcagucggugc

SEQ ID NO: 1033598 - RNA, 18 nt, Mycobacterium bovis subsp bovis AF2122/97
ugcggcguuguggcgugu

SEQ ID NO: 1033599 - RNA, 22 nt, Mycobacterium bovis subsp bovis AF2122/97
ugcggcgucguugaggaagccc

SEQ ID NO: 1033600 - RNA, 20 nt, Mycobacterium bovis subsp bovis AF2122/97
ugcggcgucgaacugccgga

SEQ ID NO: 1033601 - RNA, 23 nt, Mycobacterium bovis subsp bovis AF2122/97
ugcggccaugaaaaucggcaaga

SEQ ID NO: 1033602 - RNA, 12 nt, Mycobacterium bovis subsp bovis AF2122/97
ugcggccagcgc

SEQ ID NO: 1033603 - RNA, 20 nt, Mycobacterium bovis subsp bovis AF2122/97
ugcggccaaugacgucggac

SEQ ID NO: 1033604 - RNA, 15 nt, Mycobacterium bovis subsp bovis AF2122/97
ugcggccacgguggc

SEQ ID NO: 1033605 - RNA, 21 nt, Mycobacterium bovis subsp bovis AF2122/97
ugcggauagugguugcggccg

SEQ ID NO: 1033606 - RNA, 13 nt, Mycobacterium bovis subsp bovis AF2122/97
ugcggcauggcag

SEQ ID NO: 1033607 - RNA, 15 nt, Mycobacterium bovis subsp bovis AF2122/97
ugcggcaggugcggu

SEQ ID NO: 1033608 - RNA, 16 nt, Mycobacterium bovis subsp bovis AF2122/97
ugcggcagcuggcgca

SEQ ID NO: 1033609 - RNA, 21 nt, Mycobacterium bovis subsp bovis AF2122/97
ugcggcaguaccccucgcaca

SEQ ID NO: 1033610 - RNA, 14 nt, Mycobacterium bovis subsp bovis AF2122/97
ugcggcagcccccg

SEQ ID NO: 1033611 - RNA, 15 nt, Mycobacterium bovis subsp bovis AF2122/97
ugcggcagcgguggc

SEQ ID NO: 1033612 - RNA, 16 nt, Mycobacterium bovis subsp bovis AF2122/97
ugcggcagcgguggcu

SEQ ID NO: 1033613 - RNA, 16 nt, Mycobacterium bovis subsp bovis AF2122/97
ugcggcagcacccggg

SEQ ID NO: 1033614 - RNA, 16 nt, Mycobacterium bovis subsp bovis AF2122/97
ugcggcacucccuggg

SEQ ID NO: 1033615 - RNA, 20 nt, Mycobacterium bovis subsp bovis AF2122/97
ugcggaucgcgcugcgggaa

SEQ ID NO: 1033616 - RNA, 15 nt, Mycobacterium bovis subsp bovis AF2122/97
ugcggaucggcggac

SEQ ID NO: 1033617 - RNA, 19 nt, Mycobacterium bovis subsp bovis AF2122/97
ugcggauagcaacggugcu

SEQ ID NO: 1033618 - RNA, 17 nt, Mycobacterium bovis subsp bovis AF2122/97
ugcggauacagccgccg

SEQ ID NO: 1033619 - RNA, 22 nt, Mycobacterium bovis subsp bovis AF2122/97
ugcggauacuguucugcuggcu

SEQ ID NO: 1033620 - RNA, 19 nt, Mycobacterium bovis subsp bovis AF2122/97
ugcggauguccuugcgguc

SEQ ID NO: 1033621 - RNA, 15 nt, Mycobacterium bovis subsp bovis AF2122/97
ugcggauuaagucgg

SEQ ID NO: 1033622 - RNA, 19 nt, Mycobacterium bovis subsp bovis AF2122/97
ugcggauuaagucggcggc

SEQ ID NO: 1033623 - RNA, 16 nt, Mycobacterium bovis subsp bovis AF2122/97
ugcggcacgaucgcca

SEQ ID NO: 1033624 - RNA, 13 nt, Mycobacterium bovis subsp bovis AF2122/97
ugcggcaacggcu

SEQ ID NO: 1033625 - RNA, 23 nt, Mycobacterium bovis subsp bovis AF2122/97
ugcggauuucgugucgcugcggc

SEQ ID NO: 1033626 - RNA, 17 nt, Mycobacterium bovis subsp bovis AF2122/97
ugcgcguucgaccucga

SEQ ID NO: 1033627 - RNA, 18 nt, Mycobacterium bovis subsp bovis AF2122/97
ugcgcguucgaccucgac

SEQ ID NO: 1033628 - RNA, 13 nt, Mycobacterium bovis subsp bovis AF2122/97
ugcgcguugaccg

SEQ ID NO: 1033629 - RNA, 24 nt, Mycobacterium bovis subsp bovis AF2122/97
ugcgcgucggugucgaugcugaac

SEQ ID NO: 1033630 - RNA, 16 nt, Mycobacterium bovis subsp bovis AF2122/97
ugcgcggugcgcguga

SEQ ID NO: 1033631 - RNA, 18 nt, Mycobacterium bovis subsp bovis AF2122/97
ugcgcgugcccgugguga

SEQ ID NO: 1033632 - RNA, 16 nt, Mycobacterium bovis subsp bovis AF2122/97
ugcgcguuggucauca

SEQ ID NO: 1033633 - RNA, 20 nt, Mycobacterium bovis subsp bovis AF2122/97
ugcgcucguugguucagcuc

SEQ ID NO: 1033634 - RNA, 14 nt, Mycobacterium bovis subsp bovis AF2122/97
ugcggacugacguc

SEQ ID NO: 1033635 - RNA, 21 nt, Mycobacterium bovis subsp bovis AF2122/97
ugcgcucguugguucagcucg

SEQ ID NO: 1033636 - RNA, 13 nt, Mycobacterium bovis subsp bovis AF2122/97
ugcggagccgccg

SEQ ID NO: 1033637 - RNA, 14 nt, Mycobacterium bovis subsp bovis AF2122/97
ugcggagccgccgc

SEQ ID NO: 1033638 - RNA, 16 nt, Mycobacterium bovis subsp bovis AF2122/97
ugcggaggcgaccccg

SEQ ID NO: 1033639 - RNA, 18 nt, Mycobacterium bovis subsp bovis AF2122/97
ugcggaggcgggugcggc

SEQ ID NO: 1033640 - RNA, 12 nt, Mycobacterium bovis subsp bovis AF2122/97
ugcgccagcgag

SEQ ID NO: 1033641 - RNA, 23 nt, Mycobacterium bovis subsp bovis AF2122/97
ugcgccagcgggcuguaggcgau

SEQ ID NO: 1033642 - RNA, 21 nt, Mycobacterium bovis subsp bovis AF2122/97
ugcgcauggacaacagcuugg

SEQ ID NO: 1033643 - RNA, 13 nt, Mycobacterium bovis subsp bovis AF2122/97
ugcgcaucgccga

SEQ ID NO: 1033644 - RNA, 15 nt, Mycobacterium bovis subsp bovis AF2122/97
ugcgcaucgccggua

SEQ ID NO: 1033645 - RNA, 20 nt, Mycobacterium bovis subsp bovis AF2122/97
ugcgaucugaaacagucgac

SEQ ID NO: 1033646 - RNA, 12 nt, Mycobacterium bovis subsp bovis AF2122/97
ugcgaucggcac

SEQ ID NO: 1033647 - RNA, 17 nt, Mycobacterium bovis subsp bovis AF2122/97
ugcgaucggccgccgaa

SEQ ID NO: 1033648 - RNA, 22 nt, Mycobacterium bovis subsp bovis AF2122/97
ugcgaucgucaacgacgacgac

SEQ ID NO: 1033649 - RNA, 14 nt, Mycobacterium bovis subsp bovis AF2122/97
ugcgaucgucacgc

SEQ ID NO: 1033650 - RNA, 17 nt, Mycobacterium bovis subsp bovis AF2122/97
ugcgauccugaccagcc

SEQ ID NO: 1033651 - RNA, 13 nt, Mycobacterium bovis subsp bovis AF2122/97
ugcgaucgacgau

SEQ ID NO: 1033652 - RNA, 13 nt, Mycobacterium bovis subsp bovis AF2122/97
ugcgaucgccgcu

SEQ ID NO: 1033653 - RNA, 19 nt, Mycobacterium bovis subsp bovis AF2122/97
ugcgauuccgcgucugcuc

SEQ ID NO: 1033654 - RNA, 20 nt, Mycobacterium bovis subsp bovis AF2122/97
ugcgauuccgcgucugcucg

SEQ ID NO: 1033655 - RNA, 15 nt, Mycobacterium bovis subsp bovis AF2122/97
ugcgaugcacaaccg

SEQ ID NO: 1033656 - RNA, 15 nt, Mycobacterium bovis subsp bovis AF2122/97
ugcgaugcgcgccga

SEQ ID NO: 1033657 - RNA, 19 nt, Mycobacterium bovis subsp bovis AF2122/97
ugcgcaaauaggacugcgc

SEQ ID NO: 1033658 - RNA, 20 nt, Mycobacterium bovis subsp bovis AF2122/97
ugcgauucugcgucugcucg

SEQ ID NO: 1033659 - RNA, 19 nt, Mycobacterium bovis subsp bovis AF2122/97
ugcgauucugugucugcuc

SEQ ID NO: 1033660 - RNA, 20 nt, Mycobacterium bovis subsp bovis AF2122/97
ugcgauucugugucugcucg

SEQ ID NO: 1033661 - RNA, 17 nt, Mycobacterium bovis subsp bovis AF2122/97
ugcgcagggccuggaag

SEQ ID NO: 1033662 - RNA, 19 nt, Mycobacterium bovis subsp bovis AF2122/97
ugcgcagcuuggccagcca

SEQ ID NO: 1033663 - RNA, 14 nt, Mycobacterium bovis subsp bovis AF2122/97
ugcgacagaugccg

SEQ ID NO: 1033664 - RNA, 13 nt, Mycobacterium bovis subsp bovis AF2122/97
ugcgacaucgguc

SEQ ID NO: 1033665 - RNA, 20 nt, Mycobacterium bovis subsp bovis AF2122/97
ugcgacaggacgucggcgaa

SEQ ID NO: 1033666 - RNA, 22 nt, Mycobacterium bovis subsp bovis AF2122/97
ugcgaaucggcccgugccacag

SEQ ID NO: 1033667 - RNA, 15 nt, Mycobacterium bovis subsp bovis AF2122/97
ugcgaaucuccgcgc

SEQ ID NO: 1033668 - RNA, 12 nt, Mycobacterium bovis subsp bovis AF2122/97
ugccuggcccgu

SEQ ID NO: 1033669 - RNA, 13 nt, Mycobacterium bovis subsp bovis AF2122/97
ugccuggcccguc

SEQ ID NO: 1033670 - RNA, 16 nt, Mycobacterium bovis subsp bovis AF2122/97
ugcgacgcgaccgcga

SEQ ID NO: 1033671 - RNA, 22 nt, Mycobacterium bovis subsp bovis AF2122/97
ugcgacgcgaccgcgauggugg

SEQ ID NO: 1033672 - RNA, 18 nt, Mycobacterium bovis subsp bovis AF2122/97
ugcgacgaaccucggcgg

SEQ ID NO: 1033673 - RNA, 14 nt, Mycobacterium bovis subsp bovis AF2122/97
ugcgaccccggcug

SEQ ID NO: 1033674 - RNA, 19 nt, Mycobacterium bovis subsp bovis AF2122/97
ugcgaccauccgaguuguc

SEQ ID NO: 1033675 - RNA, 21 nt, Mycobacterium bovis subsp bovis AF2122/97
ugcgaccaucuuaacgucggc

SEQ ID NO: 1033676 - RNA, 17 nt, Mycobacterium bovis subsp bovis AF2122/97
ugcgaccacaucaugcc

SEQ ID NO: 1033677 - RNA, 22 nt, Mycobacterium bovis subsp bovis AF2122/97
ugcgacccgggccgcggcggcc

SEQ ID NO: 1033678 - RNA, 15 nt, Mycobacterium bovis subsp bovis AF2122/97
ugcgagaacgucgag

SEQ ID NO: 1033679 - RNA, 17 nt, Mycobacterium bovis subsp bovis AF2122/97
ugcgacgacggcgccgu

SEQ ID NO: 1033680 - RNA, 18 nt, Mycobacterium bovis subsp bovis AF2122/97
ugcgacuggugccugccg

SEQ ID NO: 1033681 - RNA, 18 nt, Mycobacterium bovis subsp bovis AF2122/97
ugcgagaucgcggcgacc

SEQ ID NO: 1033682 - RNA, 22 nt, Mycobacterium bovis subsp bovis AF2122/97
ugcgacuaagggcacuccaccg

SEQ ID NO: 1033683 - RNA, 21 nt, Mycobacterium bovis subsp bovis AF2122/97
ugcgacguaaagggcgucgua

SEQ ID NO: 1033684 - RNA, 20 nt, Mycobacterium bovis subsp bovis AF2122/97
ugcgacguugguugcguccg

SEQ ID NO: 1033685 - RNA, 20 nt, Mycobacterium bovis subsp bovis AF2122/97
ugcgacucugcgucugcuca

SEQ ID NO: 1033686 - RNA, 18 nt, Mycobacterium bovis subsp bovis AF2122/97
ugcgacucugcgucugcu

SEQ ID NO: 1033687 - RNA, 17 nt, Mycobacterium bovis subsp bovis AF2122/97
ugccggcgguggccgac

SEQ ID NO: 1033688 - RNA, 15 nt, Mycobacterium bovis subsp bovis AF2122/97
ugccggcgugcgcga

SEQ ID NO: 1033689 - RNA, 22 nt, Mycobacterium bovis subsp bovis AF2122/97
ugccggcguaggcaggaucgcc

SEQ ID NO: 1033690 - RNA, 18 nt, Mycobacterium bovis subsp bovis AF2122/97
ugccggcggugacggcgg

SEQ ID NO: 1033691 - RNA, 20 nt, Mycobacterium bovis subsp bovis AF2122/97
ugccggcggugacggcggca

SEQ ID NO: 1033692 - RNA, 22 nt, Mycobacterium bovis subsp bovis AF2122/97
ugccggcggaucugaucggcgc

SEQ ID NO: 1033693 - RNA, 18 nt, Mycobacterium bovis subsp bovis AF2122/97
ugccggcuagcucggcgg

SEQ ID NO: 1033694 - RNA, 23 nt, Mycobacterium bovis subsp bovis AF2122/97
ugccgggaacgagguagcgcgca

SEQ ID NO: 1033695 - RNA, 13 nt, Mycobacterium bovis subsp bovis AF2122/97
ugccggcuuggcc

SEQ ID NO: 1033696 - RNA, 22 nt, Mycobacterium bovis subsp bovis AF2122/97
ugccggcguuagcguagcccga

SEQ ID NO: 1033697 - RNA, 17 nt, Mycobacterium bovis subsp bovis AF2122/97
ugccggcguugccgccg

SEQ ID NO: 1033698 - RNA, 15 nt, Mycobacterium bovis subsp bovis AF2122/97
ugccgggaucgccgu

SEQ ID NO: 1033699 - RNA, 14 nt, Mycobacterium bovis subsp bovis AF2122/97
ugccgggaugccgc

SEQ ID NO: 1033700 - RNA, 13 nt, Mycobacterium bovis subsp bovis AF2122/97
ugccgggaccggu

SEQ ID NO: 1033701 - RNA, 14 nt, Mycobacterium bovis subsp bovis AF2122/97
ugccgggaccggug

SEQ ID NO: 1033702 - RNA, 14 nt, Mycobacterium bovis subsp bovis AF2122/97
ugccgggagacgcu

SEQ ID NO: 1033703 - RNA, 23 nt, Mycobacterium bovis subsp bovis AF2122/97
ugccgggcccagcaggucgucgg

SEQ ID NO: 1033704 - RNA, 22 nt, Mycobacterium bovis subsp bovis AF2122/97
ugccgggcaccaccacaccgga

SEQ ID NO: 1033705 - RNA, 15 nt, Mycobacterium bovis subsp bovis AF2122/97
ugccgggccgccgag

SEQ ID NO: 1033706 - RNA, 14 nt, Mycobacterium bovis subsp bovis AF2122/97
ugccgggccgcgcg

SEQ ID NO: 1033707 - RNA, 21 nt, Mycobacterium bovis subsp bovis AF2122/97
ugccgggguggcgcgccaaca

SEQ ID NO: 1033708 - RNA, 13 nt, Mycobacterium bovis subsp bovis AF2122/97
ugccgggccgccg

SEQ ID NO: 1033709 - RNA, 13 nt, Mycobacterium bovis subsp bovis AF2122/97
ugccggggcccca

SEQ ID NO: 1033710 - RNA, 21 nt, Mycobacterium bovis subsp bovis AF2122/97
ugccgguagcacagcagcaac

SEQ ID NO: 1033711 - RNA, 20 nt, Mycobacterium bovis subsp bovis AF2122/97
ugccggucacgucgaucucc

SEQ ID NO: 1033712 - RNA, 13 nt, Mycobacterium bovis subsp bovis AF2122/97
ugccggucgauga

SEQ ID NO: 1033713 - RNA, 13 nt, Mycobacterium bovis subsp bovis AF2122/97
ugccggucgaugu

SEQ ID NO: 1033714 - RNA, 13 nt, Mycobacterium bovis subsp bovis AF2122/97
ugccggugcgcua

SEQ ID NO: 1033715 - RNA, 17 nt, Mycobacterium bovis subsp bovis AF2122/97
ugccgguguguccagcg

SEQ ID NO: 1033716 - RNA, 24 nt, Mycobacterium bovis subsp bovis AF2122/97
ugccgguguguccagcggaucguc

SEQ ID NO: 1033717 - RNA, 20 nt, Mycobacterium bovis subsp bovis AF2122/97
ugccgguguaggccucggca

SEQ ID NO: 1033718 - RNA, 19 nt, Mycobacterium bovis subsp bovis AF2122/97
ugccggucgcauggucgac

SEQ ID NO: 1033719 - RNA, 21 nt, Mycobacterium bovis subsp bovis AF2122/97
ugccgggcgcuggacggcggg

SEQ ID NO: 1033720 - RNA, 15 nt, Mycobacterium bovis subsp bovis AF2122/97
ugccggucggcgucg

SEQ ID NO: 1033721 - RNA, 19 nt, Mycobacterium bovis subsp bovis AF2122/97
ugccggugauggccgacca

SEQ ID NO: 1033722 - RNA, 23 nt, Mycobacterium bovis subsp bovis AF2122/97
ugccggugauggccgaccagccg

SEQ ID NO: 1033723 - RNA, 16 nt, Mycobacterium bovis subsp bovis AF2122/97
ugccggugauguccgc

SEQ ID NO: 1033724 - RNA, 14 nt, Mycobacterium bovis subsp bovis AF2122/97
ugccggugcagguc

SEQ ID NO: 1033725 - RNA, 18 nt, Mycobacterium bovis subsp bovis AF2122/97
ugccggugcaggucgucc

SEQ ID NO: 1033726 - RNA, 15 nt, Mycobacterium bovis subsp bovis AF2122/97
ugccgucgaguccag

SEQ ID NO: 1033727 - RNA, 13 nt, Mycobacterium bovis subsp bovis AF2122/97
ugccgucgccggu

SEQ ID NO: 1033728 - RNA, 14 nt, Mycobacterium bovis subsp bovis AF2122/97
ugccgucgccgguc

SEQ ID NO: 1033729 - RNA, 15 nt, Mycobacterium bovis subsp bovis AF2122/97
ugccgucgcugacgc

SEQ ID NO: 1033730 - RNA, 22 nt, Mycobacterium bovis subsp bovis AF2122/97
ugccgucggccucggcggucgc

SEQ ID NO: 1033731 - RNA, 15 nt, Mycobacterium bovis subsp bovis AF2122/97
ugccgucgcugcccc

SEQ ID NO: 1033732 - RNA, 23 nt, Mycobacterium bovis subsp bovis AF2122/97
ugccgucggugauggagccggug

SEQ ID NO: 1033733 - RNA, 15 nt, Mycobacterium bovis subsp bovis AF2122/97
ugccgucggugccgc

SEQ ID NO: 1033734 - RNA, 13 nt, Mycobacterium bovis subsp bovis AF2122/97
ugccguacagccc

SEQ ID NO: 1033735 - RNA, 23 nt, Mycobacterium bovis subsp bovis AF2122/97
ugccgguugcggcugcguuggcu

SEQ ID NO: 1033736 - RNA, 20 nt, Mycobacterium bovis subsp bovis AF2122/97
ugccgguguugccgccggug

SEQ ID NO: 1033737 - RNA, 23 nt, Mycobacterium bovis subsp bovis AF2122/97
ugccgguugccaccugugcgaac

SEQ ID NO: 1033738 - RNA, 16 nt, Mycobacterium bovis subsp bovis AF2122/97
ugccgguugcggcugc

SEQ ID NO: 1033739 - RNA, 18 nt, Mycobacterium bovis subsp bovis AF2122/97
ugccgguugcggcugcgu

SEQ ID NO: 1033740 - RNA, 17 nt, Mycobacterium bovis subsp bovis AF2122/97
ugccugccacccggcca

SEQ ID NO: 1033741 - RNA, 19 nt, Mycobacterium bovis subsp bovis AF2122/97
ugccugaguuuaugcccgg

SEQ ID NO: 1033742 - RNA, 14 nt, Mycobacterium bovis subsp bovis AF2122/97
ugccuccgacacca

SEQ ID NO: 1033743 - RNA, 20 nt, Mycobacterium bovis subsp bovis AF2122/97
ugccucgaggacggcguaga

SEQ ID NO: 1033744 - RNA, 17 nt, Mycobacterium bovis subsp bovis AF2122/97
ugccucgauuguggcca

SEQ ID NO: 1033745 - RNA, 19 nt, Mycobacterium bovis subsp bovis AF2122/97
ugccucgcagccaacgcug

SEQ ID NO: 1033746 - RNA, 18 nt, Mycobacterium bovis subsp bovis AF2122/97
ugccgucggugccgcgga

SEQ ID NO: 1033747 - RNA, 11 nt, Mycobacterium bovis subsp bovis AF2122/97
ugccucgucgc

SEQ ID NO: 1033748 - RNA, 17 nt, Mycobacterium bovis subsp bovis AF2122/97
ugacgaucgcggcgggc

SEQ ID NO: 1033749 - RNA, 13 nt, Mycobacterium bovis subsp bovis AF2122/97
ugacgaucgcggc

SEQ ID NO: 1033750 - RNA, 16 nt, Mycobacterium bovis subsp bovis AF2122/97
ugacgaugccgccgaa

SEQ ID NO: 1033751 - RNA, 12 nt, Mycobacterium bovis subsp bovis AF2122/97
ugacgaacaugc

SEQ ID NO: 1033752 - RNA, 20 nt, Mycobacterium bovis subsp bovis AF2122/97
ugacgaucaggccgucgccg

SEQ ID NO: 1033753 - RNA, 14 nt, Mycobacterium bovis subsp bovis AF2122/97
ugacgaucggcggc

SEQ ID NO: 1033754 - RNA, 15 nt, Mycobacterium bovis subsp bovis AF2122/97
ugacgaucggcggcg

SEQ ID NO: 1033755 - RNA, 16 nt, Mycobacterium bovis subsp bovis AF2122/97
ugacgaucguagccgu

SEQ ID NO: 1033756 - RNA, 15 nt, Mycobacterium bovis subsp bovis AF2122/97
ugacgauugccacca

SEQ ID NO: 1033757 - RNA, 22 nt, Mycobacterium bovis subsp bovis AF2122/97
ugacgauucgagcaacugcucg

SEQ ID NO: 1033758 - RNA, 21 nt, Mycobacterium bovis subsp bovis AF2122/97
ugacgaugaccgcgcggcccg

SEQ ID NO: 1033759 - RNA, 19 nt, Mycobacterium bovis subsp bovis AF2122/97
ugacgauggccgccgcgag

SEQ ID NO: 1033760 - RNA, 11 nt, Mycobacterium bovis subsp bovis AF2122/97
ugacgccaacg

SEQ ID NO: 1033761 - RNA, 15 nt, Mycobacterium bovis subsp bovis AF2122/97
ugacgcacagcagca

SEQ ID NO: 1033762 - RNA, 22 nt, Mycobacterium bovis subsp bovis AF2122/97
ugacgcacgacugugcgccgca

SEQ ID NO: 1033763 - RNA, 19 nt, Mycobacterium bovis subsp bovis AF2122/97
ugacgccacgaccgccgau

SEQ ID NO: 1033764 - RNA, 15 nt, Mycobacterium bovis subsp bovis AF2122/97
ugacgccaucgaucg

SEQ ID NO: 1033765 - RNA, 16 nt, Mycobacterium bovis subsp bovis AF2122/97
ugacgccgguccccgc

SEQ ID NO: 1033766 - RNA, 21 nt, Mycobacterium bovis subsp bovis AF2122/97
ugacgccgccagcaccucggc

SEQ ID NO: 1033767 - RNA, 15 nt, Mycobacterium bovis subsp bovis AF2122/97
ugacgccggcgggug

SEQ ID NO: 1033768 - RNA, 17 nt, Mycobacterium bovis subsp bovis AF2122/97
ugacgcgacgagccgca

SEQ ID NO: 1033769 - RNA, 14 nt, Mycobacterium bovis subsp bovis AF2122/97
ugacgccgucggcg

SEQ ID NO: 1033770 - RNA, 16 nt, Mycobacterium bovis subsp bovis AF2122/97
ugacgccgucggcgcg

SEQ ID NO: 1033771 - RNA, 16 nt, Mycobacterium bovis subsp bovis AF2122/97
ugacgccucgacaccc

SEQ ID NO: 1033772 - RNA, 12 nt, Mycobacterium bovis subsp bovis AF2122/97
ugacgcgcucgc

SEQ ID NO: 1033773 - RNA, 14 nt, Mycobacterium bovis subsp bovis AF2122/97
ugacgcggacgaac

SEQ ID NO: 1033774 - RNA, 21 nt, Mycobacterium bovis subsp bovis AF2122/97
ugacgcggccacauaccacca

SEQ ID NO: 1033775 - RNA, 12 nt, Mycobacterium bovis subsp bovis AF2122/97
ugacgcggccgg

SEQ ID NO: 1033776 - RNA, 18 nt, Mycobacterium bovis subsp bovis AF2122/97
ugacgcgucagcggcgag

SEQ ID NO: 1033777 - RNA, 19 nt, Mycobacterium bovis subsp bovis AF2122/97
ugacgcgucagcggcgagc

SEQ ID NO: 1033778 - RNA, 18 nt, Mycobacterium bovis subsp bovis AF2122/97
ugacggcagaccaugguc

SEQ ID NO: 1033779 - RNA, 16 nt, Mycobacterium bovis subsp bovis AF2122/97
ugacgcuaacgucgau

SEQ ID NO: 1033780 - RNA, 22 nt, Mycobacterium bovis subsp bovis AF2122/97
ugacgcucggucgccaccgccg

SEQ ID NO: 1033781 - RNA, 23 nt, Mycobacterium bovis subsp bovis AF2122/97
ugacgcguucaacaccgccgacc

SEQ ID NO: 1033782 - RNA, 21 nt, Mycobacterium bovis subsp bovis AF2122/97
ugacggcggguuuucucgccg

SEQ ID NO: 1033783 - RNA, 22 nt, Mycobacterium bovis subsp bovis AF2122/97
ugacggcggguuuucucgccgu

SEQ ID NO: 1033784 - RNA, 17 nt, Mycobacterium bovis subsp bovis AF2122/97
ugacggcggcugucggc

SEQ ID NO: 1033785 - RNA, 12 nt, Mycobacterium bovis subsp bovis AF2122/97
ugacggcggggc

SEQ ID NO: 1033786 - RNA, 21 nt, Mycobacterium bovis subsp bovis AF2122/97
ugacggcuuccaacucggcgg

SEQ ID NO: 1033787 - RNA, 22 nt, Mycobacterium bovis subsp bovis AF2122/97
ugacggcuuccaacucggcggc

SEQ ID NO: 1033788 - RNA, 23 nt, Mycobacterium bovis subsp bovis AF2122/97
ugacggcuuccaacucggcggcc

SEQ ID NO: 1033789 - RNA, 21 nt, Mycobacterium bovis subsp bovis AF2122/97
ugacggcuucggcagccgcau

SEQ ID NO: 1033790 - RNA, 20 nt, Mycobacterium bovis subsp bovis AF2122/97
ugacgggaaacuccgcggcg

SEQ ID NO: 1033791 - RNA, 22 nt, Mycobacterium bovis subsp bovis AF2122/97
ugacgggaaacuccgcggcgcg

SEQ ID NO: 1033792 - RNA, 24 nt, Mycobacterium bovis subsp bovis AF2122/97
ugacgggaaacuccgcggcgcgca

SEQ ID NO: 1033793 - RNA, 21 nt, Mycobacterium bovis subsp bovis AF2122/97
ugacgggcagaggcuggcgca

SEQ ID NO: 1033794 - RNA, 20 nt, Mycobacterium bovis subsp bovis AF2122/97
ugacgggguugaccgccacc

SEQ ID NO: 1033795 - RNA, 19 nt, Mycobacterium bovis subsp bovis AF2122/97
ugacgggguugaccgccac

SEQ ID NO: 1033796 - RNA, 19 nt, Mycobacterium bovis subsp bovis AF2122/97
ugacggucagccgcggggc

SEQ ID NO: 1033797 - RNA, 16 nt, Mycobacterium bovis subsp bovis AF2122/97
ugacgguccccagguc

SEQ ID NO: 1033798 - RNA, 13 nt, Mycobacterium bovis subsp bovis AF2122/97
ugacggugccgac

SEQ ID NO: 1033799 - RNA, 14 nt, Mycobacterium bovis subsp bovis AF2122/97
ugacggugccgacc

SEQ ID NO: 1033800 - RNA, 17 nt, Mycobacterium bovis subsp bovis AF2122/97
ugacggugccgaccgcg

SEQ ID NO: 1033801 - RNA, 15 nt, Mycobacterium bovis subsp bovis AF2122/97
ugacgguguuggugu

SEQ ID NO: 1033802 - RNA, 18 nt, Mycobacterium bovis subsp bovis AF2122/97
ugacgguggggauggcgc

SEQ ID NO: 1033803 - RNA, 21 nt, Mycobacterium bovis subsp bovis AF2122/97
ugacgguggggucgccgucga

SEQ ID NO: 1033804 - RNA, 15 nt, Mycobacterium bovis subsp bovis AF2122/97
ugagcgugagcgccg

SEQ ID NO: 1033805 - RNA, 19 nt, Mycobacterium bovis subsp bovis AF2122/97
ugagcgugagcgccgcggc

SEQ ID NO: 1033806 - RNA, 18 nt, Mycobacterium bovis subsp bovis AF2122/97
ugagcgugccgcagcggc

SEQ ID NO: 1033807 - RNA, 18 nt, Mycobacterium bovis subsp bovis AF2122/97
ugagcuacucacggugau

SEQ ID NO: 1033808 - RNA, 23 nt, Mycobacterium bovis subsp bovis AF2122/97
ugagcguaggccagcgaguccuc

SEQ ID NO: 1033809 - RNA, 19 nt, Mycobacterium bovis subsp bovis AF2122/97
ugagcgggcaagucgccca

SEQ ID NO: 1033810 - RNA, 22 nt, Mycobacterium bovis subsp bovis AF2122/97
ugagcgggcgggccugcgcgau

SEQ ID NO: 1033811 - RNA, 15 nt, Mycobacterium bovis subsp bovis AF2122/97
ugagcgucgcugacc

SEQ ID NO: 1033812 - RNA, 14 nt, Mycobacterium bovis subsp bovis AF2122/97
ugagcggccucggg

SEQ ID NO: 1033813 - RNA, 15 nt, Mycobacterium bovis subsp bovis AF2122/97
ugagcgcgcgcggug

SEQ ID NO: 1033814 - RNA, 19 nt, Mycobacterium bovis subsp bovis AF2122/97
ugagcggacucgagucugc

SEQ ID NO: 1033815 - RNA, 22 nt, Mycobacterium bovis subsp bovis AF2122/97
ugagcgcagcuugaucccaucc

SEQ ID NO: 1033816 - RNA, 16 nt, Mycobacterium bovis subsp bovis AF2122/97
ugagcgccacgccgag

SEQ ID NO: 1033817 - RNA, 19 nt, Mycobacterium bovis subsp bovis AF2122/97
ugagcgcgcccaaccuggg

SEQ ID NO: 1033818 - RNA, 14 nt, Mycobacterium bovis subsp bovis AF2122/97
ugagcgccgcggcg

SEQ ID NO: 1033819 - RNA, 15 nt, Mycobacterium bovis subsp bovis AF2122/97
ugagcuucucgucgg

SEQ ID NO: 1033820 - RNA, 21 nt, Mycobacterium bovis subsp bovis AF2122/97
ugagcucggcugcucgacggc

SEQ ID NO: 1033821 - RNA, 15 nt, Mycobacterium bovis subsp bovis AF2122/97
ugagcucccgcaaca

SEQ ID NO: 1033822 - RNA, 23 nt, Mycobacterium bovis subsp bovis AF2122/97
ugagcucgaugucagcggccgcg

SEQ ID NO: 1033823 - RNA, 19 nt, Mycobacterium bovis subsp bovis AF2122/97
ugagcugcucgccggccaa

SEQ ID NO: 1033824 - RNA, 12 nt, Mycobacterium bovis subsp bovis AF2122/97
ugagcuggcggu

SEQ ID NO: 1033825 - RNA, 23 nt, Mycobacterium bovis subsp bovis AF2122/97
ugagguacuucauauaccgcucg

SEQ ID NO: 1033826 - RNA, 14 nt, Mycobacterium bovis subsp bovis AF2122/97
ugagguaucccggu

SEQ ID NO: 1033827 - RNA, 22 nt, Mycobacterium bovis subsp bovis AF2122/97
ugagguaggacucacgcagcgc

SEQ ID NO: 1033828 - RNA, 16 nt, Mycobacterium bovis subsp bovis AF2122/97
ugagggcucgguggcg

SEQ ID NO: 1033829 - RNA, 20 nt, Mycobacterium bovis subsp bovis AF2122/97
ugagguaggggcaggccauc

SEQ ID NO: 1033830 - RNA, 15 nt, Mycobacterium bovis subsp bovis AF2122/97
ugaggcggcgacgac

SEQ ID NO: 1033831 - RNA, 22 nt, Mycobacterium bovis subsp bovis AF2122/97
ugagcaccugggcgcgcuggcg

SEQ ID NO: 1033832 - RNA, 22 nt, Mycobacterium bovis subsp bovis AF2122/97
ugagcagauggguacccgauca

SEQ ID NO: 1033833 - RNA, 22 nt, Mycobacterium bovis subsp bovis AF2122/97
ugagcagcaagaccgcgccaac

SEQ ID NO: 1033834 - RNA, 20 nt, Mycobacterium bovis subsp bovis AF2122/97
ugagcagcuugguggcgugg

SEQ ID NO: 1033835 - RNA, 16 nt, Mycobacterium bovis subsp bovis AF2122/97
ugagcgagcgcgcgua

SEQ ID NO: 1033836 - RNA, 15 nt, Mycobacterium bovis subsp bovis AF2122/97
ugagccaccccgggu

SEQ ID NO: 1033837 - RNA, 15 nt, Mycobacterium bovis subsp bovis AF2122/97
ugagcaugucgucgu

SEQ ID NO: 1033838 - RNA, 22 nt, Mycobacterium bovis subsp bovis AF2122/97
ugacuccugcggcaccgcugag

SEQ ID NO: 1033839 - RNA, 23 nt, Mycobacterium bovis subsp bovis AF2122/97
ugacucggcaccuggauccacca

SEQ ID NO: 1033840 - RNA, 21 nt, Mycobacterium bovis subsp bovis AF2122/97
ugacucggccgcaccagcauu

SEQ ID NO: 1033841 - RNA, 20 nt, Mycobacterium bovis subsp bovis AF2122/97
ugacucgggcacgggugacg

SEQ ID NO: 1033842 - RNA, 13 nt, Mycobacterium bovis subsp bovis AF2122/97
ugacguagacggu

SEQ ID NO: 1033843 - RNA, 19 nt, Mycobacterium bovis subsp bovis AF2122/97
ugacguaggcggcggcccg

SEQ ID NO: 1033844 - RNA, 22 nt, Mycobacterium bovis subsp bovis AF2122/97
ugacguagaagucgaucgccga

SEQ ID NO: 1033845 - RNA, 23 nt, Mycobacterium bovis subsp bovis AF2122/97
ugacguagaagucgaucgccgag

SEQ ID NO: 1033846 - RNA, 19 nt, Mycobacterium bovis subsp bovis AF2122/97
ugacguagugcaccgccug

SEQ ID NO: 1033847 - RNA, 12 nt, Mycobacterium bovis subsp bovis AF2122/97
ugacggugguga

SEQ ID NO: 1033848 - RNA, 16 nt, Mycobacterium bovis subsp bovis AF2122/97
ugacguccaacagcgc

SEQ ID NO: 1033849 - RNA, 17 nt, Mycobacterium bovis subsp bovis AF2122/97
ugacucugcguccacca

SEQ ID NO: 1033850 - RNA, 19 nt, Mycobacterium bovis subsp bovis AF2122/97
ugacugcgaccgguucggc

SEQ ID NO: 1033851 - RNA, 15 nt, Mycobacterium bovis subsp bovis AF2122/97
ugcaaaagccgcgau

SEQ ID NO: 1033852 - RNA, 15 nt, Mycobacterium bovis subsp bovis AF2122/97
ugauucgcugcgccg

SEQ ID NO: 1033853 - RNA, 14 nt, Mycobacterium bovis subsp bovis AF2122/97
ugauucggccgccg

SEQ ID NO: 1033854 - RNA, 18 nt, Mycobacterium bovis subsp bovis AF2122/97
ugaugcggaugucgucga

SEQ ID NO: 1033855 - RNA, 13 nt, Mycobacterium bovis subsp bovis AF2122/97
ugaugcggccgcg

SEQ ID NO: 1033856 - RNA, 16 nt, Mycobacterium bovis subsp bovis AF2122/97
ugaugcggccgcggau

SEQ ID NO: 1033857 - RNA, 12 nt, Mycobacterium bovis subsp bovis AF2122/97
ugaugcggccgg

SEQ ID NO: 1033858 - RNA, 16 nt, Mycobacterium bovis subsp bovis AF2122/97
ugaugcgcucggccug

SEQ ID NO: 1033859 - RNA, 16 nt, Mycobacterium bovis subsp bovis AF2122/97
ugaugcgggcucggcu

SEQ ID NO: 1033860 - RNA, 18 nt, Mycobacterium bovis subsp bovis AF2122/97
ugaugcguucggccgggc

SEQ ID NO: 1033861 - RNA, 21 nt, Mycobacterium bovis subsp bovis AF2122/97
ugaugcguugauacgcgucga

SEQ ID NO: 1033862 - RNA, 14 nt, Mycobacterium bovis subsp bovis AF2122/97
ugaugcucgaugcg

SEQ ID NO: 1033863 - RNA, 16 nt, Mycobacterium bovis subsp bovis AF2122/97
ugauggagccggugac

SEQ ID NO: 1033864 - RNA, 13 nt, Mycobacterium bovis subsp bovis AF2122/97
ugcaaugcuggcg

SEQ ID NO: 1033865 - RNA, 14 nt, Mycobacterium bovis subsp bovis AF2122/97
ugcaagacgccgau

SEQ ID NO: 1033866 - RNA, 14 nt, Mycobacterium bovis subsp bovis AF2122/97
ugcacccagccgug

SEQ ID NO: 1033867 - RNA, 22 nt, Mycobacterium bovis subsp bovis AF2122/97
ugcacaggucagcgcugccacc

SEQ ID NO: 1033868 - RNA, 16 nt, Mycobacterium bovis subsp bovis AF2122/97
ugcacccgcaccggug

SEQ ID NO: 1033869 - RNA, 12 nt, Mycobacterium bovis subsp bovis AF2122/97
ugcacccgccag

SEQ ID NO: 1033870 - RNA, 14 nt, Mycobacterium bovis subsp bovis AF2122/97
ugcaccgcgaccgc

SEQ ID NO: 1033871 - RNA, 17 nt, Mycobacterium bovis subsp bovis AF2122/97
ugcacacucaacccgcc

SEQ ID NO: 1033872 - RNA, 17 nt, Mycobacterium bovis subsp bovis AF2122/97
ugcacagcagcgguuga

SEQ ID NO: 1033873 - RNA, 13 nt, Mycobacterium bovis subsp bovis AF2122/97
ugcacaccggcac

SEQ ID NO: 1033874 - RNA, 12 nt, Mycobacterium bovis subsp bovis AF2122/97
ugcacaccaccg

SEQ ID NO: 1033875 - RNA, 21 nt, Mycobacterium bovis subsp bovis AF2122/97
ugcaauugcgcggccauggca

SEQ ID NO: 1033876 - RNA, 12 nt, Mycobacterium bovis subsp bovis AF2122/97
ugaucggcgccc

SEQ ID NO: 1033877 - RNA, 18 nt, Mycobacterium bovis subsp bovis AF2122/97
ugaucggcgcggccguag

SEQ ID NO: 1033878 - RNA, 18 nt, Mycobacterium bovis subsp bovis AF2122/97
ugaucggcggcaaccgcc

SEQ ID NO: 1033879 - RNA, 19 nt, Mycobacterium bovis subsp bovis AF2122/97
ugaucggcgaggucccggc

SEQ ID NO: 1033880 - RNA, 12 nt, Mycobacterium bovis subsp bovis AF2122/97
ugaucgcaucga

SEQ ID NO: 1033881 - RNA, 16 nt, Mycobacterium bovis subsp bovis AF2122/97
ugaucgaucgcggcgc

SEQ ID NO: 1033882 - RNA, 14 nt, Mycobacterium bovis subsp bovis AF2122/97
ugaucgagcgccag

SEQ ID NO: 1033883 - RNA, 20 nt, Mycobacterium bovis subsp bovis AF2122/97
ugaucgaggcggcggucgag

SEQ ID NO: 1033884 - RNA, 12 nt, Mycobacterium bovis subsp bovis AF2122/97
ugaucgccgagg

SEQ ID NO: 1033885 - RNA, 21 nt, Mycobacterium bovis subsp bovis AF2122/97
ugaucgcccgguucagcgcug

SEQ ID NO: 1033886 - RNA, 12 nt, Mycobacterium bovis subsp bovis AF2122/97
ugaucuuggccc

SEQ ID NO: 1033887 - RNA, 18 nt, Mycobacterium bovis subsp bovis AF2122/97
ugaucuuggcccgggccc

SEQ ID NO: 1033888 - RNA, 13 nt, Mycobacterium bovis subsp bovis AF2122/97
ugaucucggcgag

SEQ ID NO: 1033889 - RNA, 14 nt, Mycobacterium bovis subsp bovis AF2122/97
ugaucucggcgagc

SEQ ID NO: 1033890 - RNA, 21 nt, Mycobacterium bovis subsp bovis AF2122/97
ugaucugguauucaugcccgu

SEQ ID NO: 1033891 - RNA, 15 nt, Mycobacterium bovis subsp bovis AF2122/97
ugaucuggugcgcgg

SEQ ID NO: 1033892 - RNA, 17 nt, Mycobacterium bovis subsp bovis AF2122/97
ugaucugucagcgcggc

SEQ ID NO: 1033893 - RNA, 23 nt, Mycobacterium bovis subsp bovis AF2122/97
ugaucugcuugccaccgccgccg

SEQ ID NO: 1033894 - RNA, 22 nt, Mycobacterium bovis subsp bovis AF2122/97
ugaucuggcguucagcggccag

SEQ ID NO: 1033895 - RNA, 20 nt, Mycobacterium bovis subsp bovis AF2122/97
ugaucugggcugcggccgcg

SEQ ID NO: 1033896 - RNA, 17 nt, Mycobacterium bovis subsp bovis AF2122/97
ugaugaaacgccgucgc

SEQ ID NO: 1033897 - RNA, 17 nt, Mycobacterium bovis subsp bovis AF2122/97
ugaugaaacgcgccguc

SEQ ID NO: 1033898 - RNA, 19 nt, Mycobacterium bovis subsp bovis AF2122/97
ugaugaaacgcgccgucuc

SEQ ID NO: 1033899 - RNA, 14 nt, Mycobacterium bovis subsp bovis AF2122/97
ugaucggcguccuu

SEQ ID NO: 1033900 - RNA, 16 nt, Mycobacterium bovis subsp bovis AF2122/97
ugaucguggcgaccac

SEQ ID NO: 1033901 - RNA, 21 nt, Mycobacterium bovis subsp bovis AF2122/97
ugaucguggcgaccacgauga

SEQ ID NO: 1033902 - RNA, 23 nt, Mycobacterium bovis subsp bovis AF2122/97
ugaucucacccagcucgcgcacc

SEQ ID NO: 1033903 - RNA, 17 nt, Mycobacterium bovis subsp bovis AF2122/97
ugaucucgccggugagc

SEQ ID NO: 1033904 - RNA, 13 nt, Mycobacterium bovis subsp bovis AF2122/97
ugaucucggcgaa

SEQ ID NO: 1033905 - RNA, 14 nt, Mycobacterium bovis subsp bovis AF2122/97
ugaucugagcgcgg

SEQ ID NO: 1033906 - RNA, 16 nt, Mycobacterium bovis subsp bovis AF2122/97
ugauccgccgacagcc

SEQ ID NO: 1033907 - RNA, 18 nt, Mycobacterium bovis subsp bovis AF2122/97
ugauccacccgacgacgu

SEQ ID NO: 1033908 - RNA, 13 nt, Mycobacterium bovis subsp bovis AF2122/97
ugaucccggccag

SEQ ID NO: 1033909 - RNA, 17 nt, Mycobacterium bovis subsp bovis AF2122/97
ugaucccgaugcuggca

SEQ ID NO: 1033910 - RNA, 18 nt, Mycobacterium bovis subsp bovis AF2122/97
ugaucccgccaccgaaca

SEQ ID NO: 1033911 - RNA, 12 nt, Mycobacterium bovis subsp bovis AF2122/97
ugauccagucga

SEQ ID NO: 1033912 - RNA, 13 nt, Mycobacterium bovis subsp bovis AF2122/97
ugauccggucgua

SEQ ID NO: 1033913 - RNA, 15 nt, Mycobacterium bovis subsp bovis AF2122/97
ugaucgacgaccguc

SEQ ID NO: 1033914 - RNA, 14 nt, Mycobacterium bovis subsp bovis AF2122/97
ugaucgacggccag

SEQ ID NO: 1033915 - RNA, 21 nt, Mycobacterium bovis subsp bovis AF2122/97
ugaucgacggccagcccagca

SEQ ID NO: 1033916 - RNA, 18 nt, Mycobacterium bovis subsp bovis AF2122/97
ugaucgacuucggcgucg

SEQ ID NO: 1033917 - RNA, 19 nt, Mycobacterium bovis subsp bovis AF2122/97
ugaggucuacuucggcgcc

SEQ ID NO: 1033918 - RNA, 20 nt, Mycobacterium bovis subsp bovis AF2122/97
ugaggucuacuucggcgccg

SEQ ID NO: 1033919 - RNA, 14 nt, Mycobacterium bovis subsp bovis AF2122/97
ugaguggacggccg

SEQ ID NO: 1033920 - RNA, 16 nt, Mycobacterium bovis subsp bovis AF2122/97
ugaguggacggccgug

SEQ ID NO: 1033921 - RNA, 15 nt, Mycobacterium bovis subsp bovis AF2122/97
ugaguggaugcgccg

SEQ ID NO: 1033922 - RNA, 22 nt, Mycobacterium bovis subsp bovis AF2122/97
ugaguggcucgcucugcgcggc

SEQ ID NO: 1033923 - RNA, 19 nt, Mycobacterium bovis subsp bovis AF2122/97
ugaguguguuugaguugcc

SEQ ID NO: 1033924 - RNA, 17 nt, Mycobacterium bovis subsp bovis AF2122/97
ugaggucaccggcgacc

SEQ ID NO: 1033925 - RNA, 20 nt, Mycobacterium bovis subsp bovis AF2122/97
ugaggucaucgggcagcggc

SEQ ID NO: 1033926 - RNA, 23 nt, Mycobacterium bovis subsp bovis AF2122/97
ugaggucauuggcgaucaaugcg

SEQ ID NO: 1033927 - RNA, 14 nt, Mycobacterium bovis subsp bovis AF2122/97
ugaguucgcgcauc

SEQ ID NO: 1033928 - RNA, 13 nt, Mycobacterium bovis subsp bovis AF2122/97
ugaguucggcggc

SEQ ID NO: 1033929 - RNA, 14 nt, Mycobacterium bovis subsp bovis AF2122/97
ugaguuucggcgca

SEQ ID NO: 1033930 - RNA, 19 nt, Mycobacterium bovis subsp bovis AF2122/97
ugaccgggucgaugacgcc

SEQ ID NO: 1033931 - RNA, 21 nt, Mycobacterium bovis subsp bovis AF2122/97
ugaccgggucgaugacgccgu

SEQ ID NO: 1033932 - RNA, 15 nt, Mycobacterium bovis subsp bovis AF2122/97
ugaccgggagucggu

SEQ ID NO: 1033933 - RNA, 22 nt, Mycobacterium bovis subsp bovis AF2122/97
ugaccgggagucgguaucggca

SEQ ID NO: 1033934 - RNA, 19 nt, Mycobacterium bovis subsp bovis AF2122/97
ugaccguauagccgacgcc

SEQ ID NO: 1033935 - RNA, 23 nt, Mycobacterium bovis subsp bovis AF2122/97
ugaccgguucccgggcagccgca

SEQ ID NO: 1033936 - RNA, 18 nt, Mycobacterium bovis subsp bovis AF2122/97
ugaccgucagcccgaacc

SEQ ID NO: 1033937 - RNA, 15 nt, Mycobacterium bovis subsp bovis AF2122/97
ugaccguccaccgac

SEQ ID NO: 1033938 - RNA, 16 nt, Mycobacterium bovis subsp bovis AF2122/97
ugaccgggucgccgau

SEQ ID NO: 1033939 - RNA, 22 nt, Mycobacterium bovis subsp bovis AF2122/97
ugaccgggucgaugacgccguc

SEQ ID NO: 1033940 - RNA, 15 nt, Mycobacterium bovis subsp bovis AF2122/97
ugaccgcgccggaca

SEQ ID NO: 1033941 - RNA, 15 nt, Mycobacterium bovis subsp bovis AF2122/97
ugaccgccagcagca

SEQ ID NO: 1033942 - RNA, 15 nt, Mycobacterium bovis subsp bovis AF2122/97
ugaccgcguccacgg

SEQ ID NO: 1033943 - RNA, 14 nt, Mycobacterium bovis subsp bovis AF2122/97
ugaccgcggugacu

SEQ ID NO: 1033944 - RNA, 19 nt, Mycobacterium bovis subsp bovis AF2122/97
ugaccgcggugacucggcc

SEQ ID NO: 1033945 - RNA, 14 nt, Mycobacterium bovis subsp bovis AF2122/97
ugaccgcgaugauc

SEQ ID NO: 1033946 - RNA, 15 nt, Mycobacterium bovis subsp bovis AF2122/97
ugaccggcaaccgcc

SEQ ID NO: 1033947 - RNA, 20 nt, Mycobacterium bovis subsp bovis AF2122/97
ugaccggcaaccgccgugug

SEQ ID NO: 1033948 - RNA, 17 nt, Mycobacterium bovis subsp bovis AF2122/97
ugaccggcaaugccacg

SEQ ID NO: 1033949 - RNA, 22 nt, Mycobacterium bovis subsp bovis AF2122/97
ugaccgcuaccagcugggcgac

SEQ ID NO: 1033950 - RNA, 15 nt, Mycobacterium bovis subsp bovis AF2122/97
ugaccgcugccgacg

SEQ ID NO: 1033951 - RNA, 15 nt, Mycobacterium bovis subsp bovis AF2122/97
ugaccgcuggugugu

SEQ ID NO: 1033952 - RNA, 14 nt, Mycobacterium bovis subsp bovis AF2122/97
ugaccgccgcgccg

SEQ ID NO: 1033953 - RNA, 15 nt, Mycobacterium bovis subsp bovis AF2122/97
ugaccgccgcgccgg

SEQ ID NO: 1033954 - RNA, 18 nt, Mycobacterium bovis subsp bovis AF2122/97
ugaccgccgcgccggcac

SEQ ID NO: 1033955 - RNA, 23 nt, Mycobacterium bovis subsp bovis AF2122/97
ugaccgccgcgccggcacgggcg

SEQ ID NO: 1033956 - RNA, 14 nt, Mycobacterium bovis subsp bovis AF2122/97
ugaccgccgccgga

SEQ ID NO: 1033957 - RNA, 19 nt, Mycobacterium bovis subsp bovis AF2122/97
ugaccgccugcuggccgcg

SEQ ID NO: 1033958 - RNA, 21 nt, Mycobacterium bovis subsp bovis AF2122/97
ugaccgccugcuggccgcggc

SEQ ID NO: 1033959 - RNA, 15 nt, Mycobacterium bovis subsp bovis AF2122/97
ugaccgccgaugccc

SEQ ID NO: 1033960 - RNA, 20 nt, Mycobacterium bovis subsp bovis AF2122/97
ugaccgccgaugcccgacac

SEQ ID NO: 1033961 - RNA, 19 nt, Mycobacterium bovis subsp bovis AF2122/97
ugaccgccaucgccaacac

SEQ ID NO: 1033962 - RNA, 13 nt, Mycobacterium bovis subsp bovis AF2122/97
ugaccgccagcag

SEQ ID NO: 1033963 - RNA, 14 nt, Mycobacterium bovis subsp bovis AF2122/97
ugaccgcaguccca

SEQ ID NO: 1033964 - RNA, 18 nt, Mycobacterium bovis subsp bovis AF2122/97
ugaccgcaucgucgagcc

SEQ ID NO: 1033965 - RNA, 17 nt, Mycobacterium bovis subsp bovis AF2122/97
ugaccgccaucgccaac

SEQ ID NO: 1033966 - RNA, 14 nt, Mycobacterium bovis subsp bovis AF2122/97
ugaccgacgccguc

SEQ ID NO: 1033967 - RNA, 16 nt, Mycobacterium bovis subsp bovis AF2122/97
ugaccgacgccgucga

SEQ ID NO: 1033968 - RNA, 19 nt, Mycobacterium bovis subsp bovis AF2122/97
ugaccgacgccgucgagca

SEQ ID NO: 1033969 - RNA, 13 nt, Mycobacterium bovis subsp bovis AF2122/97
ugaccgacgccgu

SEQ ID NO: 1033970 - RNA, 15 nt, Mycobacterium bovis subsp bovis AF2122/97
ugaccgaccacgcga

SEQ ID NO: 1033971 - RNA, 21 nt, Mycobacterium bovis subsp bovis AF2122/97
ugaccgcaaccgguaucgccg

SEQ ID NO: 1033972 - RNA, 16 nt, Mycobacterium bovis subsp bovis AF2122/97
ugaccgcaccggccgc

SEQ ID NO: 1033973 - RNA, 17 nt, Mycobacterium bovis subsp bovis AF2122/97
ugaccgcaccggccgcu

SEQ ID NO: 1033974 - RNA, 18 nt, Mycobacterium bovis subsp bovis AF2122/97
ugacgacaaacggcgacc

SEQ ID NO: 1033975 - RNA, 16 nt, Mycobacterium bovis subsp bovis AF2122/97
ugacgaccagccccgc

SEQ ID NO: 1033976 - RNA, 21 nt, Mycobacterium bovis subsp bovis AF2122/97
ugacgaccagccccgcugguc

SEQ ID NO: 1033977 - RNA, 18 nt, Mycobacterium bovis subsp bovis AF2122/97
ugacgaccgaucggcgcg

SEQ ID NO: 1033978 - RNA, 15 nt, Mycobacterium bovis subsp bovis AF2122/97
ugacgacggugaccg

SEQ ID NO: 1033979 - RNA, 12 nt, Mycobacterium bovis subsp bovis AF2122/97
ugacgacggcau

SEQ ID NO: 1033980 - RNA, 19 nt, Mycobacterium bovis subsp bovis AF2122/97
ugacgacgcgacacgccga

SEQ ID NO: 1033981 - RNA, 19 nt, Mycobacterium bovis subsp bovis AF2122/97
ugacgaggcgagcggccag

SEQ ID NO: 1033982 - RNA, 12 nt, Mycobacterium bovis subsp bovis AF2122/97
ugacgacugggc

SEQ ID NO: 1033983 - RNA, 13 nt, Mycobacterium bovis subsp bovis AF2122/97
ugacgacugggcg

SEQ ID NO: 1033984 - RNA, 20 nt, Mycobacterium bovis subsp bovis AF2122/97
ugacgagacgacgaccggcu

SEQ ID NO: 1033985 - RNA, 18 nt, Mycobacterium bovis subsp bovis AF2122/97
ugaccuuguugaccacca

SEQ ID NO: 1033986 - RNA, 12 nt, Mycobacterium bovis subsp bovis AF2122/97
ugaccuugcccu

SEQ ID NO: 1033987 - RNA, 14 nt, Mycobacterium bovis subsp bovis AF2122/97
ugacgaaucgccua

SEQ ID NO: 1033988 - RNA, 21 nt, Mycobacterium bovis subsp bovis AF2122/97
ugacgaaucgccuaccggccu

SEQ ID NO: 1033989 - RNA, 22 nt, Mycobacterium bovis subsp bovis AF2122/97
ugacgaaugggucuuugcccgc

SEQ ID NO: 1033990 - RNA, 21 nt, Mycobacterium bovis subsp bovis AF2122/97
ugaccucuucgggcagcgcgu

SEQ ID NO: 1033991 - RNA, 17 nt, Mycobacterium bovis subsp bovis AF2122/97
ugaccugauccggccgg

SEQ ID NO: 1033992 - RNA, 17 nt, Mycobacterium bovis subsp bovis AF2122/97
ugaccugcuggcgcacg

SEQ ID NO: 1033993 - RNA, 17 nt, Mycobacterium bovis subsp bovis AF2122/97
ugaccuguugaacggcc

SEQ ID NO: 1033994 - RNA, 15 nt, Mycobacterium bovis subsp bovis AF2122/97
ugaccuucaccugga

SEQ ID NO: 1033995 - RNA, 15 nt, Mycobacterium bovis subsp bovis AF2122/97
ugaccuucucgucgg

SEQ ID NO: 1033996 - RNA, 20 nt, Mycobacterium bovis subsp bovis AF2122/97
ugaccuauuugcgaccccgc

SEQ ID NO: 1033997 - RNA, 18 nt, Mycobacterium bovis subsp bovis AF2122/97
ugaccucauguccgccgu

SEQ ID NO: 1033998 - RNA, 14 nt, Mycobacterium bovis subsp bovis AF2122/97
ugaccucgucggcg

SEQ ID NO: 1033999 - RNA, 15 nt, Mycobacterium bovis subsp bovis AF2122/97
ugaccguggcgccgg

SEQ ID NO: 1034000 - RNA, 19 nt, Mycobacterium bovis subsp bovis AF2122/97
ugaccaggugcccgccccg

SEQ ID NO: 1034001 - RNA, 19 nt, Mycobacterium bovis subsp bovis AF2122/97
ugaccaggcggacgccgcg

SEQ ID NO: 1034002 - RNA, 12 nt, Mycobacterium bovis subsp bovis AF2122/97
ugaccacgucgg

SEQ ID NO: 1034003 - RNA, 12 nt, Mycobacterium bovis subsp bovis AF2122/97
ugaccacgcugc

SEQ ID NO: 1034004 - RNA, 14 nt, Mycobacterium bovis subsp bovis AF2122/97
ugaccacgucggac

SEQ ID NO: 1034005 - RNA, 21 nt, Mycobacterium bovis subsp bovis AF2122/97
ugaccagcacaccgcccgcac

SEQ ID NO: 1034006 - RNA, 22 nt, Mycobacterium bovis subsp bovis AF2122/97
ugacccauacgaacucaccgcc

SEQ ID NO: 1034007 - RNA, 17 nt, Mycobacterium bovis subsp bovis AF2122/97
ugacccaucucgucguc

SEQ ID NO: 1034008 - RNA, 18 nt, Mycobacterium bovis subsp bovis AF2122/97
ugacccauucucggccgg

SEQ ID NO: 1034009 - RNA, 18 nt, Mycobacterium bovis subsp bovis AF2122/97
ugaccccguaggcgccga

SEQ ID NO: 1034010 - RNA, 19 nt, Mycobacterium bovis subsp bovis AF2122/97
ugaccccguaggcgccgaa

SEQ ID NO: 1034011 - RNA, 16 nt, Mycobacterium bovis subsp bovis AF2122/97
ugaccaugaccgggcu

SEQ ID NO: 1034012 - RNA, 23 nt, Mycobacterium bovis subsp bovis AF2122/97
ugacccagaccggcucgucgggc

SEQ ID NO: 1034013 - RNA, 21 nt, Mycobacterium bovis subsp bovis AF2122/97
ugacccaccgccccggcggcg

SEQ ID NO: 1034014 - RNA, 20 nt, Mycobacterium bovis subsp bovis AF2122/97
ugacccguucagcgacggcc

SEQ ID NO: 1034015 - RNA, 18 nt, Mycobacterium bovis subsp bovis AF2122/97
ugaccgaacgcacgucga

SEQ ID NO: 1034016 - RNA, 18 nt, Mycobacterium bovis subsp bovis AF2122/97
ugacccuugugccccgag

SEQ ID NO: 1034017 - RNA, 18 nt, Mycobacterium bovis subsp bovis AF2122/97
ugacccggauaucgacca

SEQ ID NO: 1034018 - RNA, 19 nt, Mycobacterium bovis subsp bovis AF2122/97
ugacccccagcagggugug

SEQ ID NO: 1034019 - RNA, 13 nt, Mycobacterium bovis subsp bovis AF2122/97
ugaccccccgacc

SEQ ID NO: 1034020 - RNA, 13 nt, Mycobacterium bovis subsp bovis AF2122/97
ugacccgcgggug

SEQ ID NO: 1034021 - RNA, 15 nt, Mycobacterium bovis subsp bovis AF2122/97
ugacagggcggcaac

SEQ ID NO: 1034022 - RNA, 14 nt, Mycobacterium bovis subsp bovis AF2122/97
ugacagcuuucuug

SEQ ID NO: 1034023 - RNA, 21 nt, Mycobacterium bovis subsp bovis AF2122/97
ugacagacaucgcgacgaucg

SEQ ID NO: 1034024 - RNA, 19 nt, Mycobacterium bovis subsp bovis AF2122/97
ugacaccggggacgucgac

SEQ ID NO: 1034025 - RNA, 20 nt, Mycobacterium bovis subsp bovis AF2122/97
ugacacugccuuaaccgagc

SEQ ID NO: 1034026 - RNA, 17 nt, Mycobacterium bovis subsp bovis AF2122/97
ugacacuggggugcugc

SEQ ID NO: 1034027 - RNA, 17 nt, Mycobacterium bovis subsp bovis AF2122/97
ugacaccgaggucggcc

SEQ ID NO: 1034028 - RNA, 22 nt, Mycobacterium bovis subsp bovis AF2122/97
ugacaccgauccggccgccgau

SEQ ID NO: 1034029 - RNA, 15 nt, Mycobacterium bovis subsp bovis AF2122/97
ugacaccggccacca

SEQ ID NO: 1034030 - RNA, 16 nt, Mycobacterium bovis subsp bovis AF2122/97
ugacaccggccaccag

SEQ ID NO: 1034031 - RNA, 18 nt, Mycobacterium bovis subsp bovis AF2122/97
ugacaccggccaccagcc

SEQ ID NO: 1034032 - RNA, 22 nt, Mycobacterium bovis subsp bovis AF2122/97
ugacaccggccaccagcccgau

SEQ ID NO: 1034033 - RNA, 18 nt, Mycobacterium bovis subsp bovis AF2122/97
ugacaccggggacgucga

SEQ ID NO: 1034034 - RNA, 16 nt, Mycobacterium bovis subsp bovis AF2122/97
ugacacaacaccggcg

SEQ ID NO: 1034035 - RNA, 15 nt, Mycobacterium bovis subsp bovis AF2122/97
ugacacccgggccac

SEQ ID NO: 1034036 - RNA, 13 nt, Mycobacterium bovis subsp bovis AF2122/97
ugaccaacccucg

SEQ ID NO: 1034037 - RNA, 22 nt, Mycobacterium bovis subsp bovis AF2122/97
ugaccaauccacugaucaaggc

SEQ ID NO: 1034038 - RNA, 20 nt, Mycobacterium bovis subsp bovis AF2122/97
ugaccacaaccgugagcacc

SEQ ID NO: 1034039 - RNA, 20 nt, Mycobacterium bovis subsp bovis AF2122/97
ugacauagaccucgccggug

SEQ ID NO: 1034040 - RNA, 14 nt, Mycobacterium bovis subsp bovis AF2122/97
ugacaucggccaag

SEQ ID NO: 1034041 - RNA, 19 nt, Mycobacterium bovis subsp bovis AF2122/97
ugacaucgucgccagggcc

SEQ ID NO: 1034042 - RNA, 15 nt, Mycobacterium bovis subsp bovis AF2122/97
ugacauugaggucca

SEQ ID NO: 1034043 - RNA, 16 nt, Mycobacterium bovis subsp bovis AF2122/97
ugacauuuccaccacg

SEQ ID NO: 1034044 - RNA, 18 nt, Mycobacterium bovis subsp bovis AF2122/97
ucuccauguuggcgaaug

SEQ ID NO: 1034045 - RNA, 16 nt, Mycobacterium bovis subsp bovis AF2122/97
ucuccagcucgaacag

SEQ ID NO: 1034046 - RNA, 19 nt, Mycobacterium bovis subsp bovis AF2122/97
ucuccagacguuccaucac

SEQ ID NO: 1034047 - RNA, 16 nt, Mycobacterium bovis subsp bovis AF2122/97
ucuccaguagccggug

SEQ ID NO: 1034048 - RNA, 16 nt, Mycobacterium bovis subsp bovis AF2122/97
ucucccgaccgccgag

SEQ ID NO: 1034049 - RNA, 13 nt, Mycobacterium bovis subsp bovis AF2122/97
ucucccggccgca

SEQ ID NO: 1034050 - RNA, 20 nt, Mycobacterium bovis subsp bovis AF2122/97
ucucccagaggucgagcgcc

SEQ ID NO: 1034051 - RNA, 14 nt, Mycobacterium bovis subsp bovis AF2122/97
ucucccuugccgcc

SEQ ID NO: 1034052 - RNA, 17 nt, Mycobacterium bovis subsp bovis AF2122/97
ucucccauacgccggcc

SEQ ID NO: 1034053 - RNA, 20 nt, Mycobacterium bovis subsp bovis AF2122/97
ugaaagcuaccgaucgccaa

SEQ ID NO: 1034054 - RNA, 15 nt, Mycobacterium bovis subsp bovis AF2122/97
ucuuugcccgccacg

SEQ ID NO: 1034055 - RNA, 22 nt, Mycobacterium bovis subsp bovis AF2122/97
ugaaccgggucacuccggcggc

SEQ ID NO: 1034056 - RNA, 23 nt, Mycobacterium bovis subsp bovis AF2122/97
ugaaccggccgcgacgacacgcc

SEQ ID NO: 1034057 - RNA, 17 nt, Mycobacterium bovis subsp bovis AF2122/97
ugaaccagcugagccgu

SEQ ID NO: 1034058 - RNA, 16 nt, Mycobacterium bovis subsp bovis AF2122/97
ugaacuucccacccgg

SEQ ID NO: 1034059 - RNA, 18 nt, Mycobacterium bovis subsp bovis AF2122/97
ugaacgagaugccgcgau

SEQ ID NO: 1034060 - RNA, 13 nt, Mycobacterium bovis subsp bovis AF2122/97
ugaacgaucggac

SEQ ID NO: 1034061 - RNA, 23 nt, Mycobacterium bovis subsp bovis AF2122/97
ugaacgacccgcuggcucaucga

SEQ ID NO: 1034062 - RNA, 18 nt, Mycobacterium bovis subsp bovis AF2122/97
ugaacgcaagcagcgcga

SEQ ID NO: 1034063 - RNA, 20 nt, Mycobacterium bovis subsp bovis AF2122/97
ugaaccaccacuucggcgcc

SEQ ID NO: 1034064 - RNA, 22 nt, Mycobacterium bovis subsp bovis AF2122/97
ugaaggcaaacaccagcccggc

SEQ ID NO: 1034065 - RNA, 22 nt, Mycobacterium bovis subsp bovis AF2122/97
ugaaggccgguagcgcgggugg

SEQ ID NO: 1034066 - RNA, 15 nt, Mycobacterium bovis subsp bovis AF2122/97
ugaagcuuguccaga

SEQ ID NO: 1034067 - RNA, 13 nt, Mycobacterium bovis subsp bovis AF2122/97
ugaagaagccggu

SEQ ID NO: 1034068 - RNA, 19 nt, Mycobacterium bovis subsp bovis AF2122/97
ugaagaagccgguguugau

SEQ ID NO: 1034069 - RNA, 18 nt, Mycobacterium bovis subsp bovis AF2122/97
ugaagaauuucggcgccu

SEQ ID NO: 1034070 - RNA, 17 nt, Mycobacterium bovis subsp bovis AF2122/97
ugaagacaccggcgucg

SEQ ID NO: 1034071 - RNA, 19 nt, Mycobacterium bovis subsp bovis AF2122/97
ugaagaccaccgcccacag

SEQ ID NO: 1034072 - RNA, 16 nt, Mycobacterium bovis subsp bovis AF2122/97
ugaagaacuggcugcu

SEQ ID NO: 1034073 - RNA, 19 nt, Mycobacterium bovis subsp bovis AF2122/97
ugaaguucgggcaacggca

SEQ ID NO: 1034074 - RNA, 18 nt, Mycobacterium bovis subsp bovis AF2122/97
ugaagucuuucgcuucgc

SEQ ID NO: 1034075 - RNA, 19 nt, Mycobacterium bovis subsp bovis AF2122/97
ugaagugaaaguucaugcc

SEQ ID NO: 1034076 - RNA, 19 nt, Mycobacterium bovis subsp bovis AF2122/97
ugaagggauccggaagccc

SEQ ID NO: 1034077 - RNA, 12 nt, Mycobacterium bovis subsp bovis AF2122/97
ugaaggcgccgg

SEQ ID NO: 1034078 - RNA, 13 nt, Mycobacterium bovis subsp bovis AF2122/97
ugaaggcgccggu

SEQ ID NO: 1034079 - RNA, 23 nt, Mycobacterium bovis subsp bovis AF2122/97
ugaaguccgagacgucggcguag

SEQ ID NO: 1034080 - RNA, 13 nt, Mycobacterium bovis subsp bovis AF2122/97
ugaaggugccggc

SEQ ID NO: 1034081 - RNA, 20 nt, Mycobacterium bovis subsp bovis AF2122/97
ugaauucgccgaacgguugc

SEQ ID NO: 1034082 - RNA, 18 nt, Mycobacterium bovis subsp bovis AF2122/97
ugacaagcgauuuggcgu

SEQ ID NO: 1034083 - RNA, 19 nt, Mycobacterium bovis subsp bovis AF2122/97
ugacaagcggcccgcugug

SEQ ID NO: 1034084 - RNA, 19 nt, Mycobacterium bovis subsp bovis AF2122/97
ugacaaaccugcaugccca

SEQ ID NO: 1034085 - RNA, 19 nt, Mycobacterium bovis subsp bovis AF2122/97
ugacaacggccacaugcca

SEQ ID NO: 1034086 - RNA, 21 nt, Mycobacterium bovis subsp bovis AF2122/97
ugaaucgacugaucgccaccc

SEQ ID NO: 1034087 - RNA, 19 nt, Mycobacterium bovis subsp bovis AF2122/97
ugaaucggaccgaccggcu

SEQ ID NO: 1034088 - RNA, 16 nt, Mycobacterium bovis subsp bovis AF2122/97
ugaaucgguucggcca

SEQ ID NO: 1034089 - RNA, 16 nt, Mycobacterium bovis subsp bovis AF2122/97
gcggccggcacgaccg

SEQ ID NO: 1034090 - RNA, 18 nt, Mycobacterium bovis subsp bovis AF2122/97
gcggccggccgcucaccc

SEQ ID NO: 1034091 - RNA, 14 nt, Mycobacterium bovis subsp bovis AF2122/97
gcggccggccgucc

SEQ ID NO: 1034092 - RNA, 14 nt, Mycobacterium bovis subsp bovis AF2122/97
gcggccggcgucgg

SEQ ID NO: 1034093 - RNA, 17 nt, Mycobacterium bovis subsp bovis AF2122/97
gcggccgcgcgcucgag

SEQ ID NO: 1034094 - RNA, 22 nt, Mycobacterium bovis subsp bovis AF2122/97
gcggccggcgugccagcacacg

SEQ ID NO: 1034095 - RNA, 17 nt, Mycobacterium bovis subsp bovis AF2122/97
gcggccgggcguccucg

SEQ ID NO: 1034096 - RNA, 13 nt, Mycobacterium bovis subsp bovis AF2122/97
gcggccgggacca

SEQ ID NO: 1034097 - RNA, 14 nt, Mycobacterium bovis subsp bovis AF2122/97
gcggccgggcggcc

SEQ ID NO: 1034098 - RNA, 20 nt, Mycobacterium bovis subsp bovis AF2122/97
gcggccgggcggccaggcgc

SEQ ID NO: 1034099 - RNA, 21 nt, Mycobacterium bovis subsp bovis AF2122/97
gcggccgggucgcgcuggcgc

SEQ ID NO: 1034100 - RNA, 16 nt, Mycobacterium bovis subsp bovis AF2122/97
gcggccgggucgguga

SEQ ID NO: 1034101 - RNA, 20 nt, Mycobacterium bovis subsp bovis AF2122/97
gcggccggguggcccggcga

SEQ ID NO: 1034102 - RNA, 23 nt, Mycobacterium bovis subsp bovis AF2122/97
gcggccggguucgcgucugacau

SEQ ID NO: 1034103 - RNA, 22 nt, Mycobacterium bovis subsp bovis AF2122/97
gcggccgguacacguccagugg

SEQ ID NO: 1034104 - RNA, 23 nt, Mycobacterium bovis subsp bovis AF2122/97
gcggccguagugcacgucggcgg

SEQ ID NO: 1034105 - RNA, 13 nt, Mycobacterium bovis subsp bovis AF2122/97
gcggccgucaccg

SEQ ID NO: 1034106 - RNA, 16 nt, Mycobacterium bovis subsp bovis AF2122/97
gcggccgucaccgguc

SEQ ID NO: 1034107 - RNA, 17 nt, Mycobacterium bovis subsp bovis AF2122/97
gcggccgucgaugguca

SEQ ID NO: 1034108 - RNA, 17 nt, Mycobacterium bovis subsp bovis AF2122/97
gcggccuaggacgccgc

SEQ ID NO: 1034109 - RNA, 23 nt, Mycobacterium bovis subsp bovis AF2122/97
gcggccuaacgaguaggcggcuc

SEQ ID NO: 1034110 - RNA, 17 nt, Mycobacterium bovis subsp bovis AF2122/97
gcggccuagggcggcgg

SEQ ID NO: 1034111 - RNA, 20 nt, Mycobacterium bovis subsp bovis AF2122/97
gcggccucccgggccgccgc

SEQ ID NO: 1034112 - RNA, 21 nt, Mycobacterium bovis subsp bovis AF2122/97
gcggccucccgggccgccgcg

SEQ ID NO: 1034113 - RNA, 17 nt, Mycobacterium bovis subsp bovis AF2122/97
gcggccuccagcacccg

SEQ ID NO: 1034114 - RNA, 20 nt, Mycobacterium bovis subsp bovis AF2122/97
gcggccuccaccacgucggg

SEQ ID NO: 1034115 - RNA, 14 nt, Mycobacterium bovis subsp bovis AF2122/97
gcggccuccgggcc

SEQ ID NO: 1034116 - RNA, 15 nt, Mycobacterium bovis subsp bovis AF2122/97
gcggccucgcugcuc

SEQ ID NO: 1034117 - RNA, 16 nt, Mycobacterium bovis subsp bovis AF2122/97
gcggccucgccggcgc

SEQ ID NO: 1034118 - RNA, 18 nt, Mycobacterium bovis subsp bovis AF2122/97
gcggccucgcugcucagc

SEQ ID NO: 1034119 - RNA, 15 nt, Mycobacterium bovis subsp bovis AF2122/97
gcggccuggcacccg

SEQ ID NO: 1034120 - RNA, 16 nt, Mycobacterium bovis subsp bovis AF2122/97
gcggccuggcacccgg

SEQ ID NO: 1034121 - RNA, 21 nt, Mycobacterium bovis subsp bovis AF2122/97
gcggccugggccagccgcuca

SEQ ID NO: 1034122 - RNA, 16 nt, Mycobacterium bovis subsp bovis AF2122/97
gcggccuggucggcca

SEQ ID NO: 1034123 - RNA, 18 nt, Mycobacterium bovis subsp bovis AF2122/97
gcggccuggucggccagg

SEQ ID NO: 1034124 - RNA, 17 nt, Mycobacterium bovis subsp bovis AF2122/97
gcggccuguugacccau

SEQ ID NO: 1034125 - RNA, 19 nt, Mycobacterium bovis subsp bovis AF2122/97
gcggccucguuguagccga

SEQ ID NO: 1034126 - RNA, 13 nt, Mycobacterium bovis subsp bovis AF2122/97
gcggccucggucu

SEQ ID NO: 1034127 - RNA, 17 nt, Mycobacterium bovis subsp bovis AF2122/97
gcggccugaccggcucg

SEQ ID NO: 1034128 - RNA, 18 nt, Mycobacterium bovis subsp bovis AF2122/97
gcggccgagggauugccg

SEQ ID NO: 1034129 - RNA, 17 nt, Mycobacterium bovis subsp bovis AF2122/97
gcggccgcaagccgcga

SEQ ID NO: 1034130 - RNA, 16 nt, Mycobacterium bovis subsp bovis AF2122/97
gcggccgaggucaccc

SEQ ID NO: 1034131 - RNA, 17 nt, Mycobacterium bovis subsp bovis AF2122/97
gcggccgcagcggccag

SEQ ID NO: 1034132 - RNA, 21 nt, Mycobacterium bovis subsp bovis AF2122/97
gcggccgcagcggccagccca

SEQ ID NO: 1034133 - RNA, 12 nt, Mycobacterium bovis subsp bovis AF2122/97
gcggccgccgcg

SEQ ID NO: 1034134 - RNA, 11 nt, Mycobacterium bovis subsp bovis AF2122/97
gcggccgccgc

SEQ ID NO: 1034135 - RNA, 11 nt, Mycobacterium bovis subsp bovis AF2122/97
gcggccgccga

SEQ ID NO: 1034136 - RNA, 23 nt, Mycobacterium bovis subsp bovis AF2122/97
gcggccgccguccccgccgucgc

SEQ ID NO: 1034137 - RNA, 13 nt, Mycobacterium bovis subsp bovis AF2122/97
gcggccgccgagu

SEQ ID NO: 1034138 - RNA, 16 nt, Mycobacterium bovis subsp bovis AF2122/97
gcggccgcgaccagcg

SEQ ID NO: 1034139 - RNA, 18 nt, Mycobacterium bovis subsp bovis AF2122/97
gcggccgcgaccagcgcc

SEQ ID NO: 1034140 - RNA, 16 nt, Mycobacterium bovis subsp bovis AF2122/97
gcggccgcgcgcucga

SEQ ID NO: 1034141 - RNA, 13 nt, Mycobacterium bovis subsp bovis AF2122/97
gcggccgcggcga

SEQ ID NO: 1034142 - RNA, 24 nt, Mycobacterium bovis subsp bovis AF2122/97
gcggccgcggucgauguccgcagc

SEQ ID NO: 1034143 - RNA, 13 nt, Mycobacterium bovis subsp bovis AF2122/97
gcggccgcgguga

SEQ ID NO: 1034144 - RNA, 14 nt, Mycobacterium bovis subsp bovis AF2122/97
gcggccgcuccacc

SEQ ID NO: 1034145 - RNA, 19 nt, Mycobacterium bovis subsp bovis AF2122/97
gcggccgcuugagcgaguu

SEQ ID NO: 1034146 - RNA, 18 nt, Mycobacterium bovis subsp bovis AF2122/97
gcggcccgaucaccagcc

SEQ ID NO: 1034147 - RNA, 17 nt, Mycobacterium bovis subsp bovis AF2122/97
gcggcccuucaccagcc

SEQ ID NO: 1034148 - RNA, 18 nt, Mycobacterium bovis subsp bovis AF2122/97
gcggcccuucaccagcca

SEQ ID NO: 1034149 - RNA, 16 nt, Mycobacterium bovis subsp bovis AF2122/97
gcggccgagcgcaccg

SEQ ID NO: 1034150 - RNA, 19 nt, Mycobacterium bovis subsp bovis AF2122/97
gcggccgaccgcgacccgg

SEQ ID NO: 1034151 - RNA, 19 nt, Mycobacterium bovis subsp bovis AF2122/97
gcggccgaaacuucgcccg

SEQ ID NO: 1034152 - RNA, 13 nt, Mycobacterium bovis subsp bovis AF2122/97
gcggcccgcucca

SEQ ID NO: 1034153 - RNA, 22 nt, Mycobacterium bovis subsp bovis AF2122/97
gcggcccggucuacgccaccga

SEQ ID NO: 1034154 - RNA, 18 nt, Mycobacterium bovis subsp bovis AF2122/97
gcggcccgggcucggcga

SEQ ID NO: 1034155 - RNA, 22 nt, Mycobacterium bovis subsp bovis AF2122/97
gcggcccgcucgaaagcgucga

SEQ ID NO: 1034156 - RNA, 14 nt, Mycobacterium bovis subsp bovis AF2122/97
gcggcccgcucggg

SEQ ID NO: 1034157 - RNA, 21 nt, Mycobacterium bovis subsp bovis AF2122/97
gcggcccggguuggccgaaca

SEQ ID NO: 1034158 - RNA, 16 nt, Mycobacterium bovis subsp bovis AF2122/97
gcggcccgucaccgcg

SEQ ID NO: 1034159 - RNA, 20 nt, Mycobacterium bovis subsp bovis AF2122/97
gcggcccgcgaucgggccga

SEQ ID NO: 1034160 - RNA, 16 nt, Mycobacterium bovis subsp bovis AF2122/97
gcggaaauggcgucgc

SEQ ID NO: 1034161 - RNA, 14 nt, Mycobacterium bovis subsp bovis AF2122/97
gcggaacaccagca

SEQ ID NO: 1034162 - RNA, 19 nt, Mycobacterium bovis subsp bovis AF2122/97
gcggaacaccagcaggcgg

SEQ ID NO: 1034163 - RNA, 20 nt, Mycobacterium bovis subsp bovis AF2122/97
gcggaacaccagcaggcggc

SEQ ID NO: 1034164 - RNA, 21 nt, Mycobacterium bovis subsp bovis AF2122/97
gcggaacaccgaggcgaccgg

SEQ ID NO: 1034165 - RNA, 14 nt, Mycobacterium bovis subsp bovis AF2122/97
gcggaacaccgccc

SEQ ID NO: 1034166 - RNA, 19 nt, Mycobacterium bovis subsp bovis AF2122/97
gcgcuuuggcguucgguga

SEQ ID NO: 1034167 - RNA, 17 nt, Mycobacterium bovis subsp bovis AF2122/97
gcgcuuugaugccgaug

SEQ ID NO: 1034168 - RNA, 22 nt, Mycobacterium bovis subsp bovis AF2122/97
gcgcuuugaugccgaugucgau

SEQ ID NO: 1034169 - RNA, 15 nt, Mycobacterium bovis subsp bovis AF2122/97
gcgcuuuggucgucg

SEQ ID NO: 1034170 - RNA, 20 nt, Mycobacterium bovis subsp bovis AF2122/97
gcggaaaacccagaucggcg

SEQ ID NO: 1034171 - RNA, 24 nt, Mycobacterium bovis subsp bovis AF2122/97
gcggaaaccgcugggggcggucgc

SEQ ID NO: 1034172 - RNA, 20 nt, Mycobacterium bovis subsp bovis AF2122/97
gcggaaaccaucgccagccg

SEQ ID NO: 1034173 - RNA, 13 nt, Mycobacterium bovis subsp bovis AF2122/97
gcggaaacccggc

SEQ ID NO: 1034174 - RNA, 17 nt, Mycobacterium bovis subsp bovis AF2122/97
gcggaaacccggccgcc

SEQ ID NO: 1034175 - RNA, 18 nt, Mycobacterium bovis subsp bovis AF2122/97
gcggaaacccggccgccg

SEQ ID NO: 1034176 - RNA, 19 nt, Mycobacterium bovis subsp bovis AF2122/97
gcggaaacccggccgccga

SEQ ID NO: 1034177 - RNA, 21 nt, Mycobacterium bovis subsp bovis AF2122/97
gcggaaacccggccgccgaga

SEQ ID NO: 1034178 - RNA, 20 nt, Mycobacterium bovis subsp bovis AF2122/97
gcggcauccugcacgacccg

SEQ ID NO: 1034179 - RNA, 16 nt, Mycobacterium bovis subsp bovis AF2122/97
gcggcaucccgccaca

SEQ ID NO: 1034180 - RNA, 18 nt, Mycobacterium bovis subsp bovis AF2122/97
gcggcaucccgccacacc

SEQ ID NO: 1034181 - RNA, 17 nt, Mycobacterium bovis subsp bovis AF2122/97
gcggcaucgcgggcggc

SEQ ID NO: 1034182 - RNA, 18 nt, Mycobacterium bovis subsp bovis AF2122/97
gcggcaucgcgggcggcg

SEQ ID NO: 1034183 - RNA, 19 nt, Mycobacterium bovis subsp bovis AF2122/97
gcggcaucgcgggcggcgc

SEQ ID NO: 1034184 - RNA, 21 nt, Mycobacterium bovis subsp bovis AF2122/97
gcggcaucgcgggcggcgcug

SEQ ID NO: 1034185 - RNA, 17 nt, Mycobacterium bovis subsp bovis AF2122/97
gcggcaucgaguucggc

SEQ ID NO: 1034186 - RNA, 15 nt, Mycobacterium bovis subsp bovis AF2122/97
gcggcaucgacgcgg

SEQ ID NO: 1034187 - RNA, 19 nt, Mycobacterium bovis subsp bovis AF2122/97
gcggcauccugcacgaccc

SEQ ID NO: 1034188 - RNA, 18 nt, Mycobacterium bovis subsp bovis AF2122/97
gcggcauacauccaggcu

SEQ ID NO: 1034189 - RNA, 15 nt, Mycobacterium bovis subsp bovis AF2122/97
gcggcauagccgaac

SEQ ID NO: 1034190 - RNA, 22 nt, Mycobacterium bovis subsp bovis AF2122/97
gcggcaucgggguuggugaacg

SEQ ID NO: 1034191 - RNA, 18 nt, Mycobacterium bovis subsp bovis AF2122/97
gcggcaucggucaccgcg

SEQ ID NO: 1034192 - RNA, 22 nt, Mycobacterium bovis subsp bovis AF2122/97
gcggcaugaagcaguuggccga

SEQ ID NO: 1034193 - RNA, 22 nt, Mycobacterium bovis subsp bovis AF2122/97
gcggcaugcaaugcuggcggcg

SEQ ID NO: 1034194 - RNA, 15 nt, Mycobacterium bovis subsp bovis AF2122/97
gcggcaugcucaccg

SEQ ID NO: 1034195 - RNA, 18 nt, Mycobacterium bovis subsp bovis AF2122/97
gcggcauggcauggcgaa

SEQ ID NO: 1034196 - RNA, 22 nt, Mycobacterium bovis subsp bovis AF2122/97
gcggccaacgaacgugccccgg

SEQ ID NO: 1034197 - RNA, 16 nt, Mycobacterium bovis subsp bovis AF2122/97
gcggccaacgacgacc

SEQ ID NO: 1034198 - RNA, 19 nt, Mycobacterium bovis subsp bovis AF2122/97
gcggccaacgacgacccgu

SEQ ID NO: 1034199 - RNA, 18 nt, Mycobacterium bovis subsp bovis AF2122/97
gcggccaacagcacccgg

SEQ ID NO: 1034200 - RNA, 14 nt, Mycobacterium bovis subsp bovis AF2122/97
gcggcauugccagc

SEQ ID NO: 1034201 - RNA, 22 nt, Mycobacterium bovis subsp bovis AF2122/97
gcggcauguauuucgugccggc

SEQ ID NO: 1034202 - RNA, 23 nt, Mycobacterium bovis subsp bovis AF2122/97
gcggcauguauuucgugccggcg

SEQ ID NO: 1034203 - RNA, 17 nt, Mycobacterium bovis subsp bovis AF2122/97
gcggcaugggcccugca

SEQ ID NO: 1034204 - RNA, 23 nt, Mycobacterium bovis subsp bovis AF2122/97
gcggcauucucgagcacccgcaa

SEQ ID NO: 1034205 - RNA, 14 nt, Mycobacterium bovis subsp bovis AF2122/97
gcggccaccagauc

SEQ ID NO: 1034206 - RNA, 15 nt, Mycobacterium bovis subsp bovis AF2122/97
gcggccaccaccgcc

SEQ ID NO: 1034207 - RNA, 13 nt, Mycobacterium bovis subsp bovis AF2122/97
gcggccaccagcg

SEQ ID NO: 1034208 - RNA, 15 nt, Mycobacterium bovis subsp bovis AF2122/97
gcggccaccgaggcg

SEQ ID NO: 1034209 - RNA, 13 nt, Mycobacterium bovis subsp bovis AF2122/97
gcggccaccgccg

SEQ ID NO: 1034210 - RNA, 14 nt, Mycobacterium bovis subsp bovis AF2122/97
gcggccaccgccgc

SEQ ID NO: 1034211 - RNA, 13 nt, Mycobacterium bovis subsp bovis AF2122/97
gcggccaccacca

SEQ ID NO: 1034212 - RNA, 16 nt, Mycobacterium bovis subsp bovis AF2122/97
gcggccaccaccgccg

SEQ ID NO: 1034213 - RNA, 18 nt, Mycobacterium bovis subsp bovis AF2122/97
gcggccaccaccgccgcc

SEQ ID NO: 1034214 - RNA, 19 nt, Mycobacterium bovis subsp bovis AF2122/97
gcggccaccaccgccgccg

SEQ ID NO: 1034215 - RNA, 19 nt, Mycobacterium bovis subsp bovis AF2122/97
gcggccacauaccaccacg

SEQ ID NO: 1034216 - RNA, 20 nt, Mycobacterium bovis subsp bovis AF2122/97
gcggccaauggccgcggcac

SEQ ID NO: 1034217 - RNA, 21 nt, Mycobacterium bovis subsp bovis AF2122/97
gcggccaauggugggcgagcu

SEQ ID NO: 1034218 - RNA, 15 nt, Mycobacterium bovis subsp bovis AF2122/97
gcggccacaaccucg

SEQ ID NO: 1034219 - RNA, 21 nt, Mycobacterium bovis subsp bovis AF2122/97
gcggccaccagaucgcacacc

SEQ ID NO: 1034220 - RNA, 20 nt, Mycobacterium bovis subsp bovis AF2122/97
gcggccaccgccgccgccga

SEQ ID NO: 1034221 - RNA, 13 nt, Mycobacterium bovis subsp bovis AF2122/97
gcggccacgccga

SEQ ID NO: 1034222 - RNA, 15 nt, Mycobacterium bovis subsp bovis AF2122/97
gcggccacgccgauc

SEQ ID NO: 1034223 - RNA, 16 nt, Mycobacterium bovis subsp bovis AF2122/97
gcggccacgguggcgc

SEQ ID NO: 1034224 - RNA, 17 nt, Mycobacterium bovis subsp bovis AF2122/97
gcggccacucgcccgau

SEQ ID NO: 1034225 - RNA, 22 nt, Mycobacterium bovis subsp bovis AF2122/97
gcggccacuuggaugcgacccg

SEQ ID NO: 1034226 - RNA, 12 nt, Mycobacterium bovis subsp bovis AF2122/97
gcggccagcgag

SEQ ID NO: 1034227 - RNA, 17 nt, Mycobacterium bovis subsp bovis AF2122/97
gcggccagcaucgcggu

SEQ ID NO: 1034228 - RNA, 18 nt, Mycobacterium bovis subsp bovis AF2122/97
gcggccagcacgucguug

SEQ ID NO: 1034229 - RNA, 23 nt, Mycobacterium bovis subsp bovis AF2122/97
gcggccagcagcaacgacccgaa

SEQ ID NO: 1034230 - RNA, 24 nt, Mycobacterium bovis subsp bovis AF2122/97
gcggccagagccgcgcgccgguug

SEQ ID NO: 1034231 - RNA, 17 nt, Mycobacterium bovis subsp bovis AF2122/97
gcggccaccgucagcgc

SEQ ID NO: 1034232 - RNA, 18 nt, Mycobacterium bovis subsp bovis AF2122/97
gcggccagauagguucca

SEQ ID NO: 1034233 - RNA, 15 nt, Mycobacterium bovis subsp bovis AF2122/97
gcggccagcugcagc

SEQ ID NO: 1034234 - RNA, 16 nt, Mycobacterium bovis subsp bovis AF2122/97
gcggccagcucggcca

SEQ ID NO: 1034235 - RNA, 18 nt, Mycobacterium bovis subsp bovis AF2122/97
gcggccagcucggccagc

SEQ ID NO: 1034236 - RNA, 13 nt, Mycobacterium bovis subsp bovis AF2122/97
gcggccaggcgcg

SEQ ID NO: 1034237 - RNA, 15 nt, Mycobacterium bovis subsp bovis AF2122/97
gcggccagcgcgcgc

SEQ ID NO: 1034238 - RNA, 14 nt, Mycobacterium bovis subsp bovis AF2122/97
gcggccagccgcuc

SEQ ID NO: 1034239 - RNA, 19 nt, Mycobacterium bovis subsp bovis AF2122/97
gcggccagcgcaccgccga

SEQ ID NO: 1034240 - RNA, 20 nt, Mycobacterium bovis subsp bovis AF2122/97
gcggccagcaucgcgguggu

SEQ ID NO: 1034241 - RNA, 21 nt, Mycobacterium bovis subsp bovis AF2122/97
gcggccagcaucggguggcga

SEQ ID NO: 1034242 - RNA, 17 nt, Mycobacterium bovis subsp bovis AF2122/97
gcggccagcgcggcgcg

SEQ ID NO: 1034243 - RNA, 16 nt, Mycobacterium bovis subsp bovis AF2122/97
gcggcccacaccagcg

SEQ ID NO: 1034244 - RNA, 20 nt, Mycobacterium bovis subsp bovis AF2122/97
gcggcccaucgaccgaggca

SEQ ID NO: 1034245 - RNA, 21 nt, Mycobacterium bovis subsp bovis AF2122/97
gcggcccgaggcucgggccgc

SEQ ID NO: 1034246 - RNA, 19 nt, Mycobacterium bovis subsp bovis AF2122/97
gcggcccgagaagcguugc

SEQ ID NO: 1034247 - RNA, 19 nt, Mycobacterium bovis subsp bovis AF2122/97
gcggccccgacacagcggc

SEQ ID NO: 1034248 - RNA, 15 nt, Mycobacterium bovis subsp bovis AF2122/97
gcggccccgccguug

SEQ ID NO: 1034249 - RNA, 23 nt, Mycobacterium bovis subsp bovis AF2122/97
gcggccccgccguugccgccgac

SEQ ID NO: 1034250 - RNA, 13 nt, Mycobacterium bovis subsp bovis AF2122/97
gcggccccgcgcc

SEQ ID NO: 1034251 - RNA, 15 nt, Mycobacterium bovis subsp bovis AF2122/97
gcggccccgcgccac

SEQ ID NO: 1034252 - RNA, 15 nt, Mycobacterium bovis subsp bovis AF2122/97
gcggccauggcacug

SEQ ID NO: 1034253 - RNA, 19 nt, Mycobacterium bovis subsp bovis AF2122/97
gcggccauggcagcgcgcu

SEQ ID NO: 1034254 - RNA, 20 nt, Mycobacterium bovis subsp bovis AF2122/97
gcggccaugucagcggccug

SEQ ID NO: 1034255 - RNA, 14 nt, Mycobacterium bovis subsp bovis AF2122/97
gcggcccaccggcc

SEQ ID NO: 1034256 - RNA, 15 nt, Mycobacterium bovis subsp bovis AF2122/97
gcggcccaccggcca

SEQ ID NO: 1034257 - RNA, 15 nt, Mycobacterium bovis subsp bovis AF2122/97
gcggcccaaccgguc

SEQ ID NO: 1034258 - RNA, 21 nt, Mycobacterium bovis subsp bovis AF2122/97
gcggccauuagcagcacccgg

SEQ ID NO: 1034259 - RNA, 18 nt, Mycobacterium bovis subsp bovis AF2122/97
gcggccauucggucagcc

SEQ ID NO: 1034260 - RNA, 13 nt, Mycobacterium bovis subsp bovis AF2122/97
gcggccaggucgc

SEQ ID NO: 1034261 - RNA, 22 nt, Mycobacterium bovis subsp bovis AF2122/97
gcggccaggugcaggcuucugg

SEQ ID NO: 1034262 - RNA, 15 nt, Mycobacterium bovis subsp bovis AF2122/97
gcggccaguacgucg

SEQ ID NO: 1034263 - RNA, 16 nt, Mycobacterium bovis subsp bovis AF2122/97
gcggccaguacgucga

SEQ ID NO: 1034264 - RNA, 15 nt, Mycobacterium bovis subsp bovis AF2122/97
gcggccaucgccgac

SEQ ID NO: 1034265 - RNA, 16 nt, Mycobacterium bovis subsp bovis AF2122/97
gcggccaucgccgaca

SEQ ID NO: 1034266 - RNA, 17 nt, Mycobacterium bovis subsp bovis AF2122/97
gcggccauaucgcccac

SEQ ID NO: 1034267 - RNA, 19 nt, Mycobacterium bovis subsp bovis AF2122/97
gcggccauccggcggcggc

SEQ ID NO: 1034268 - RNA, 17 nt, Mycobacterium bovis subsp bovis AF2122/97
gcggcgcggccgcagcc

SEQ ID NO: 1034269 - RNA, 21 nt, Mycobacterium bovis subsp bovis AF2122/97
gcggcgcggccgcagccagca

SEQ ID NO: 1034270 - RNA, 12 nt, Mycobacterium bovis subsp bovis AF2122/97
gcggcgcggcga

SEQ ID NO: 1034271 - RNA, 13 nt, Mycobacterium bovis subsp bovis AF2122/97
gcggcgcggcgac

SEQ ID NO: 1034272 - RNA, 14 nt, Mycobacterium bovis subsp bovis AF2122/97
gcggcgcgucgcgg

SEQ ID NO: 1034273 - RNA, 13 nt, Mycobacterium bovis subsp bovis AF2122/97
gcggcgcgguuuc

SEQ ID NO: 1034274 - RNA, 17 nt, Mycobacterium bovis subsp bovis AF2122/97
gcggcgcgggucggcga

SEQ ID NO: 1034275 - RNA, 13 nt, Mycobacterium bovis subsp bovis AF2122/97
gcggcgcggucga

SEQ ID NO: 1034276 - RNA, 19 nt, Mycobacterium bovis subsp bovis AF2122/97
gcggcgcguuagaaaucga

SEQ ID NO: 1034277 - RNA, 17 nt, Mycobacterium bovis subsp bovis AF2122/97
gcggcggcaacgguggc

SEQ ID NO: 1034278 - RNA, 23 nt, Mycobacterium bovis subsp bovis AF2122/97
gcggcggcaacgguggcaacgga

SEQ ID NO: 1034279 - RNA, 16 nt, Mycobacterium bovis subsp bovis AF2122/97
gcggcggcacgcucgc

SEQ ID NO: 1034280 - RNA, 20 nt, Mycobacterium bovis subsp bovis AF2122/97
gcggcggcauagugcgacug

SEQ ID NO: 1034281 - RNA, 23 nt, Mycobacterium bovis subsp bovis AF2122/97
gcggcggcagcggcgaucaggcg

SEQ ID NO: 1034282 - RNA, 21 nt, Mycobacterium bovis subsp bovis AF2122/97
gcggcgcccggcggaucccga

SEQ ID NO: 1034283 - RNA, 16 nt, Mycobacterium bovis subsp bovis AF2122/97
gcggcgcgccgaucga

SEQ ID NO: 1034284 - RNA, 23 nt, Mycobacterium bovis subsp bovis AF2122/97
gcggcgcgcugaaaugccgucgu

SEQ ID NO: 1034285 - RNA, 16 nt, Mycobacterium bovis subsp bovis AF2122/97
gcggcgcgcugcacgg

SEQ ID NO: 1034286 - RNA, 17 nt, Mycobacterium bovis subsp bovis AF2122/97
gcggcgcggcaaaccug

SEQ ID NO: 1034287 - RNA, 13 nt, Mycobacterium bovis subsp bovis AF2122/97
gcggcgcccagga

SEQ ID NO: 1034288 - RNA, 21 nt, Mycobacterium bovis subsp bovis AF2122/97
gcggcgcagcacggcggccac

SEQ ID NO: 1034289 - RNA, 23 nt, Mycobacterium bovis subsp bovis AF2122/97
gcggcgccaguauggccgccacc

SEQ ID NO: 1034290 - RNA, 18 nt, Mycobacterium bovis subsp bovis AF2122/97
gcggcgccauagccgcga

SEQ ID NO: 1034291 - RNA, 15 nt, Mycobacterium bovis subsp bovis AF2122/97
gcggcgcccgccacc

SEQ ID NO: 1034292 - RNA, 16 nt, Mycobacterium bovis subsp bovis AF2122/97
gcggcgcccgccaccg

SEQ ID NO: 1034293 - RNA, 23 nt, Mycobacterium bovis subsp bovis AF2122/97
gcggcgcccaucgcgacggcccg

SEQ ID NO: 1034294 - RNA, 16 nt, Mycobacterium bovis subsp bovis AF2122/97
gcggcgcagcacggcg

SEQ ID NO: 1034295 - RNA, 11 nt, Mycobacterium bovis subsp bovis AF2122/97
gcggcgcagcg

SEQ ID NO: 1034296 - RNA, 14 nt, Mycobacterium bovis subsp bovis AF2122/97
gcggcgcagcaccg

SEQ ID NO: 1034297 - RNA, 20 nt, Mycobacterium bovis subsp bovis AF2122/97
gcggcgcagcaccgucggca

SEQ ID NO: 1034298 - RNA, 16 nt, Mycobacterium bovis subsp bovis AF2122/97
gcggccuuggcgacgu

SEQ ID NO: 1034299 - RNA, 18 nt, Mycobacterium bovis subsp bovis AF2122/97
gcggccuuggcgacgucg

SEQ ID NO: 1034300 - RNA, 15 nt, Mycobacterium bovis subsp bovis AF2122/97
gcggccuugcgggcu

SEQ ID NO: 1034301 - RNA, 20 nt, Mycobacterium bovis subsp bovis AF2122/97
gcggccuugcgggcucucgg

SEQ ID NO: 1034302 - RNA, 19 nt, Mycobacterium bovis subsp bovis AF2122/97
gcggccuuuuccgggucgu

SEQ ID NO: 1034303 - RNA, 20 nt, Mycobacterium bovis subsp bovis AF2122/97
gcggccuugccgggccgcgc

SEQ ID NO: 1034304 - RNA, 20 nt, Mycobacterium bovis subsp bovis AF2122/97
gcggccuuggcgacgucgcg

SEQ ID NO: 1034305 - RNA, 21 nt, Mycobacterium bovis subsp bovis AF2122/97
gcggccuuggcgacgucgcgg

SEQ ID NO: 1034306 - RNA, 16 nt, Mycobacterium bovis subsp bovis AF2122/97
gcggccuugcucagca

SEQ ID NO: 1034307 - RNA, 22 nt, Mycobacterium bovis subsp bovis AF2122/97
gcggcgaaaaccaucgcuugcg

SEQ ID NO: 1034308 - RNA, 21 nt, Mycobacterium bovis subsp bovis AF2122/97
gcggcgauucccgcgaagcgg

SEQ ID NO: 1034309 - RNA, 19 nt, Mycobacterium bovis subsp bovis AF2122/97
gcggcgcacaacccgucga

SEQ ID NO: 1034310 - RNA, 14 nt, Mycobacterium bovis subsp bovis AF2122/97
gcggcguucgaugc

SEQ ID NO: 1034311 - RNA, 16 nt, Mycobacterium bovis subsp bovis AF2122/97
gcggcguuccccgaga

SEQ ID NO: 1034312 - RNA, 20 nt, Mycobacterium bovis subsp bovis AF2122/97
gcggcguuccgggccgauca

SEQ ID NO: 1034313 - RNA, 21 nt, Mycobacterium bovis subsp bovis AF2122/97
gcggcguuaccaccgucaccg

SEQ ID NO: 1034314 - RNA, 17 nt, Mycobacterium bovis subsp bovis AF2122/97
gcggcguguacgucgau

SEQ ID NO: 1034315 - RNA, 18 nt, Mycobacterium bovis subsp bovis AF2122/97
gcggcguguacgucgauc

SEQ ID NO: 1034316 - RNA, 20 nt, Mycobacterium bovis subsp bovis AF2122/97
gcggcgugaagugagcucgg

SEQ ID NO: 1034317 - RNA, 17 nt, Mycobacterium bovis subsp bovis AF2122/97
gcggcggguagauccgc

SEQ ID NO: 1034318 - RNA, 17 nt, Mycobacterium bovis subsp bovis AF2122/97
gcggcgggucccgccac

SEQ ID NO: 1034319 - RNA, 17 nt, Mycobacterium bovis subsp bovis AF2122/97
gcggcggguccucgcgg

SEQ ID NO: 1034320 - RNA, 16 nt, Mycobacterium bovis subsp bovis AF2122/97
gcggcgguaccggaau

SEQ ID NO: 1034321 - RNA, 20 nt, Mycobacterium bovis subsp bovis AF2122/97
gcggcgggggcggcggcugu

SEQ ID NO: 1034322 - RNA, 18 nt, Mycobacterium bovis subsp bovis AF2122/97
gcggcgucaaaugugcga

SEQ ID NO: 1034323 - RNA, 15 nt, Mycobacterium bovis subsp bovis AF2122/97
gcggcguccagcagc

SEQ ID NO: 1034324 - RNA, 13 nt, Mycobacterium bovis subsp bovis AF2122/97
gcggcggcgucgg

SEQ ID NO: 1034325 - RNA, 13 nt, Mycobacterium bovis subsp bovis AF2122/97
gcggcggcggagg

SEQ ID NO: 1034326 - RNA, 13 nt, Mycobacterium bovis subsp bovis AF2122/97
gcggcggcggcaa

SEQ ID NO: 1034327 - RNA, 14 nt, Mycobacterium bovis subsp bovis AF2122/97
gcggcggcggcacg

SEQ ID NO: 1034328 - RNA, 15 nt, Mycobacterium bovis subsp bovis AF2122/97
gcggcggcguccacc

SEQ ID NO: 1034329 - RNA, 20 nt, Mycobacterium bovis subsp bovis AF2122/97
gcggcggcuuuggccgccgu

SEQ ID NO: 1034330 - RNA, 16 nt, Mycobacterium bovis subsp bovis AF2122/97
gcggcgggcaccguga

SEQ ID NO: 1034331 - RNA, 21 nt, Mycobacterium bovis subsp bovis AF2122/97
gcggcgggcaccgugauggcg

SEQ ID NO: 1034332 - RNA, 16 nt, Mycobacterium bovis subsp bovis AF2122/97
gcggcgggcucgcuuc

SEQ ID NO: 1034333 - RNA, 16 nt, Mycobacterium bovis subsp bovis AF2122/97
gcggcggcccaucgac

SEQ ID NO: 1034334 - RNA, 18 nt, Mycobacterium bovis subsp bovis AF2122/97
gcggcggcccaucgaccg

SEQ ID NO: 1034335 - RNA, 19 nt, Mycobacterium bovis subsp bovis AF2122/97
gcggcggcccaucgaccga

SEQ ID NO: 1034336 - RNA, 16 nt, Mycobacterium bovis subsp bovis AF2122/97
gcggcggccccgcgcc

SEQ ID NO: 1034337 - RNA, 20 nt, Mycobacterium bovis subsp bovis AF2122/97
gcggcggccccgcgccaccu

SEQ ID NO: 1034338 - RNA, 16 nt, Mycobacterium bovis subsp bovis AF2122/97
gcggcggccugggcca

SEQ ID NO: 1034339 - RNA, 14 nt, Mycobacterium bovis subsp bovis AF2122/97
gcggcggcagcacc

SEQ ID NO: 1034340 - RNA, 17 nt, Mycobacterium bovis subsp bovis AF2122/97
gcggcggccuccaccac

SEQ ID NO: 1034341 - RNA, 15 nt, Mycobacterium bovis subsp bovis AF2122/97
gcggcggcgaacucg

SEQ ID NO: 1034342 - RNA, 19 nt, Mycobacterium bovis subsp bovis AF2122/97
gcggcggcgauccggucgg

SEQ ID NO: 1034343 - RNA, 15 nt, Mycobacterium bovis subsp bovis AF2122/97
gcggcggcgcucggc

SEQ ID NO: 1034344 - RNA, 14 nt, Mycobacterium bovis subsp bovis AF2122/97
gcggcggcgcucgu

SEQ ID NO: 1034345 - RNA, 17 nt, Mycobacterium bovis subsp bovis AF2122/97
gcggcggcgcucgucga

SEQ ID NO: 1034346 - RNA, 14 nt, Mycobacterium bovis subsp bovis AF2122/97
gcggcuccgcccgg

SEQ ID NO: 1034347 - RNA, 12 nt, Mycobacterium bovis subsp bovis AF2122/97
gcggcguucggc

SEQ ID NO: 1034348 - RNA, 16 nt, Mycobacterium bovis subsp bovis AF2122/97
gcggcguugugaccgc

SEQ ID NO: 1034349 - RNA, 21 nt, Mycobacterium bovis subsp bovis AF2122/97
gcggcguuguggcguguggcu

SEQ ID NO: 1034350 - RNA, 16 nt, Mycobacterium bovis subsp bovis AF2122/97
gcggcguugagcuggc

SEQ ID NO: 1034351 - RNA, 17 nt, Mycobacterium bovis subsp bovis AF2122/97
gcggcguugagcuggcg

SEQ ID NO: 1034352 - RNA, 21 nt, Mycobacterium bovis subsp bovis AF2122/97
gcggcguugagcuggcgguug

SEQ ID NO: 1034353 - RNA, 16 nt, Mycobacterium bovis subsp bovis AF2122/97
gcggcucgcguaggug

SEQ ID NO: 1034354 - RNA, 14 nt, Mycobacterium bovis subsp bovis AF2122/97
gcggcucguugcgg

SEQ ID NO: 1034355 - RNA, 18 nt, Mycobacterium bovis subsp bovis AF2122/97
gcggcucuagaucgccga

SEQ ID NO: 1034356 - RNA, 18 nt, Mycobacterium bovis subsp bovis AF2122/97
gcggcuuggccaucacgg

SEQ ID NO: 1034357 - RNA, 20 nt, Mycobacterium bovis subsp bovis AF2122/97
gcggcuuggccaucacggcg

SEQ ID NO: 1034358 - RNA, 13 nt, Mycobacterium bovis subsp bovis AF2122/97
gcggcuuggccgc

SEQ ID NO: 1034359 - RNA, 16 nt, Mycobacterium bovis subsp bovis AF2122/97
gcggcuuggccgcccc

SEQ ID NO: 1034360 - RNA, 20 nt, Mycobacterium bovis subsp bovis AF2122/97
gcggcuugggcuugcgccgg

SEQ ID NO: 1034361 - RNA, 16 nt, Mycobacterium bovis subsp bovis AF2122/97
gcgggaagaacaucac

SEQ ID NO: 1034362 - RNA, 15 nt, Mycobacterium bovis subsp bovis AF2122/97
gcgggaagucccgag

SEQ ID NO: 1034363 - RNA, 16 nt, Mycobacterium bovis subsp bovis AF2122/97
gcggcuucguggcggc

SEQ ID NO: 1034364 - RNA, 19 nt, Mycobacterium bovis subsp bovis AF2122/97
gcggcuugaucagccgcca

SEQ ID NO: 1034365 - RNA, 22 nt, Mycobacterium bovis subsp bovis AF2122/97
gcggcuucgcuuuugaaccggg

SEQ ID NO: 1034366 - RNA, 17 nt, Mycobacterium bovis subsp bovis AF2122/97
gcggcuucggcagaccg

SEQ ID NO: 1034367 - RNA, 18 nt, Mycobacterium bovis subsp bovis AF2122/97
gcggcuucaguccggccc

SEQ ID NO: 1034368 - RNA, 20 nt, Mycobacterium bovis subsp bovis AF2122/97
gcggcuaacgaagccagauc

SEQ ID NO: 1034369 - RNA, 21 nt, Mycobacterium bovis subsp bovis AF2122/97
gcggcuuccucgagcgaaccg

SEQ ID NO: 1034370 - RNA, 18 nt, Mycobacterium bovis subsp bovis AF2122/97
gcgggcagcguguaaccg

SEQ ID NO: 1034371 - RNA, 23 nt, Mycobacterium bovis subsp bovis AF2122/97
gcgggaguucggggugcgcccag

SEQ ID NO: 1034372 - RNA, 20 nt, Mycobacterium bovis subsp bovis AF2122/97
gcgggagguacccccagcac

SEQ ID NO: 1034373 - RNA, 17 nt, Mycobacterium bovis subsp bovis AF2122/97
gcgggcagauggugaag

SEQ ID NO: 1034374 - RNA, 19 nt, Mycobacterium bovis subsp bovis AF2122/97
gcgggcaguagcuguggcc

SEQ ID NO: 1034375 - RNA, 22 nt, Mycobacterium bovis subsp bovis AF2122/97
gcgggcaguagcuguggcccgc

SEQ ID NO: 1034376 - RNA, 12 nt, Mycobacterium bovis subsp bovis AF2122/97
gcgggcagggcc

SEQ ID NO: 1034377 - RNA, 18 nt, Mycobacterium bovis subsp bovis AF2122/97
gcgggcaguggcagcccg

SEQ ID NO: 1034378 - RNA, 17 nt, Mycobacterium bovis subsp bovis AF2122/97
gcgggcaguugacccau

SEQ ID NO: 1034379 - RNA, 21 nt, Mycobacterium bovis subsp bovis AF2122/97
gcgggcaguugacccaugccg

SEQ ID NO: 1034380 - RNA, 19 nt, Mycobacterium bovis subsp bovis AF2122/97
gcgggcauaacccgcaccg

SEQ ID NO: 1034381 - RNA, 12 nt, Mycobacterium bovis subsp bovis AF2122/97
gcgggcaucgcg

SEQ ID NO: 1034382 - RNA, 19 nt, Mycobacterium bovis subsp bovis AF2122/97
gcgggccaaagccgucagc

SEQ ID NO: 1034383 - RNA, 17 nt, Mycobacterium bovis subsp bovis AF2122/97
gcgggccaacucggcga

SEQ ID NO: 1034384 - RNA, 16 nt, Mycobacterium bovis subsp bovis AF2122/97
gcgggcaugauguuga

SEQ ID NO: 1034385 - RNA, 16 nt, Mycobacterium bovis subsp bovis AF2122/97
gcgggcccgccggccc

SEQ ID NO: 1034386 - RNA, 22 nt, Mycobacterium bovis subsp bovis AF2122/97
gcgggacugcagcgcggugguc

SEQ ID NO: 1034387 - RNA, 17 nt, Mycobacterium bovis subsp bovis AF2122/97
gcgggacugacccugau

SEQ ID NO: 1034388 - RNA, 14 nt, Mycobacterium bovis subsp bovis AF2122/97
gcgggacugcggaa

SEQ ID NO: 1034389 - RNA, 22 nt, Mycobacterium bovis subsp bovis AF2122/97
gcgggacugcggaagccaccga

SEQ ID NO: 1034390 - RNA, 13 nt, Mycobacterium bovis subsp bovis AF2122/97
gcgggacuggcug

SEQ ID NO: 1034391 - RNA, 20 nt, Mycobacterium bovis subsp bovis AF2122/97
gcgggacuggcugaucggcg

SEQ ID NO: 1034392 - RNA, 21 nt, Mycobacterium bovis subsp bovis AF2122/97
gcgggagacguaaccgcuggc

SEQ ID NO: 1034393 - RNA, 19 nt, Mycobacterium bovis subsp bovis AF2122/97
gcgggagaaaacggcggcg

SEQ ID NO: 1034394 - RNA, 20 nt, Mycobacterium bovis subsp bovis AF2122/97
gcgggagaaaacggcggcgc

SEQ ID NO: 1034395 - RNA, 21 nt, Mycobacterium bovis subsp bovis AF2122/97
gcgggagcaccgaccagggcc

SEQ ID NO: 1034396 - RNA, 22 nt, Mycobacterium bovis subsp bovis AF2122/97
gcgggacccgugagcucgucga

SEQ ID NO: 1034397 - RNA, 18 nt, Mycobacterium bovis subsp bovis AF2122/97
gcgggacgcgacucggcg

SEQ ID NO: 1034398 - RNA, 21 nt, Mycobacterium bovis subsp bovis AF2122/97
gcgggacauccagugcggugg

SEQ ID NO: 1034399 - RNA, 17 nt, Mycobacterium bovis subsp bovis AF2122/97
gcgggacaaccgggcgg

SEQ ID NO: 1034400 - RNA, 14 nt, Mycobacterium bovis subsp bovis AF2122/97
gcgggacaccaccg

SEQ ID NO: 1034401 - RNA, 17 nt, Mycobacterium bovis subsp bovis AF2122/97
gcgggcggcaucgccga

SEQ ID NO: 1034402 - RNA, 14 nt, Mycobacterium bovis subsp bovis AF2122/97
gcgggcggcaagcu

SEQ ID NO: 1034403 - RNA, 19 nt, Mycobacterium bovis subsp bovis AF2122/97
gcgggcggcaucgccgagg

SEQ ID NO: 1034404 - RNA, 21 nt, Mycobacterium bovis subsp bovis AF2122/97
gcgggcgccuuccaggcgggc

SEQ ID NO: 1034405 - RNA, 15 nt, Mycobacterium bovis subsp bovis AF2122/97
gcgggcggcgcuggc

SEQ ID NO: 1034406 - RNA, 12 nt, Mycobacterium bovis subsp bovis AF2122/97
gcgggcgggaac

SEQ ID NO: 1034407 - RNA, 20 nt, Mycobacterium bovis subsp bovis AF2122/97
gcgggcgggaaccccggcca

SEQ ID NO: 1034408 - RNA, 19 nt, Mycobacterium bovis subsp bovis AF2122/97
gcgggcggugggcagcagc

SEQ ID NO: 1034409 - RNA, 14 nt, Mycobacterium bovis subsp bovis AF2122/97
gcgggcguccacgc

SEQ ID NO: 1034410 - RNA, 13 nt, Mycobacterium bovis subsp bovis AF2122/97
gcgggcgucccgc

SEQ ID NO: 1034411 - RNA, 15 nt, Mycobacterium bovis subsp bovis AF2122/97
gcgggcugcgcuacc

SEQ ID NO: 1034412 - RNA, 20 nt, Mycobacterium bovis subsp bovis AF2122/97
gcgggcugcgcuacccagcg

SEQ ID NO: 1034413 - RNA, 18 nt, Mycobacterium bovis subsp bovis AF2122/97
gcgggcugcagccgacag

SEQ ID NO: 1034414 - RNA, 20 nt, Mycobacterium bovis subsp bovis AF2122/97
gcgggcgccuuggucgccgc

SEQ ID NO: 1034415 - RNA, 15 nt, Mycobacterium bovis subsp bovis AF2122/97
gcgggcgcgggcgcc

SEQ ID NO: 1034416 - RNA, 21 nt, Mycobacterium bovis subsp bovis AF2122/97
gcgggcgccuuggucgccgcc

SEQ ID NO: 1034417 - RNA, 19 nt, Mycobacterium bovis subsp bovis AF2122/97
gcgggcgaucuuggcgaca

SEQ ID NO: 1034418 - RNA, 21 nt, Mycobacterium bovis subsp bovis AF2122/97
gcgggcgaugacccggaaucc

SEQ ID NO: 1034419 - RNA, 15 nt, Mycobacterium bovis subsp bovis AF2122/97
gcgggcgaugagcgc

SEQ ID NO: 1034420 - RNA, 22 nt, Mycobacterium bovis subsp bovis AF2122/97
gcgggcgaugagcgcgaucucc

SEQ ID NO: 1034421 - RNA, 17 nt, Mycobacterium bovis subsp bovis AF2122/97
gcgggcgaugcgggccg

SEQ ID NO: 1034422 - RNA, 21 nt, Mycobacterium bovis subsp bovis AF2122/97
gcgggcgauuucggcgccggc

SEQ ID NO: 1034423 - RNA, 22 nt, Mycobacterium bovis subsp bovis AF2122/97
gcgggcgauuucggcgccggcg

SEQ ID NO: 1034424 - RNA, 15 nt, Mycobacterium bovis subsp bovis AF2122/97
gcgggcccgcgcggc

SEQ ID NO: 1034425 - RNA, 17 nt, Mycobacterium bovis subsp bovis AF2122/97
gcgggcccgcgcggcgg

SEQ ID NO: 1034426 - RNA, 17 nt, Mycobacterium bovis subsp bovis AF2122/97
gcgggccgaagccccga

SEQ ID NO: 1034427 - RNA, 21 nt, Mycobacterium bovis subsp bovis AF2122/97
gcgggccgaccagagcuucgc

SEQ ID NO: 1034428 - RNA, 16 nt, Mycobacterium bovis subsp bovis AF2122/97
gcgggccgaggccguc

SEQ ID NO: 1034429 - RNA, 17 nt, Mycobacterium bovis subsp bovis AF2122/97
gcgggccgaggccgucg

SEQ ID NO: 1034430 - RNA, 17 nt, Mycobacterium bovis subsp bovis AF2122/97
gcgggcccgcaggucgg

SEQ ID NO: 1034431 - RNA, 11 nt, Mycobacterium bovis subsp bovis AF2122/97
gcgggccaccg

SEQ ID NO: 1034432 - RNA, 14 nt, Mycobacterium bovis subsp bovis AF2122/97
gcgggccgagauca

SEQ ID NO: 1034433 - RNA, 15 nt, Mycobacterium bovis subsp bovis AF2122/97
gcgggccgacgcagg

SEQ ID NO: 1034434 - RNA, 12 nt, Mycobacterium bovis subsp bovis AF2122/97
gcgggccgccgc

SEQ ID NO: 1034435 - RNA, 21 nt, Mycobacterium bovis subsp bovis AF2122/97
gcgggccgccaggcggccggg

SEQ ID NO: 1034436 - RNA, 14 nt, Mycobacterium bovis subsp bovis AF2122/97
gcgggccgcgucga

SEQ ID NO: 1034437 - RNA, 16 nt, Mycobacterium bovis subsp bovis AF2122/97
gcgggccgcgucgaac

SEQ ID NO: 1034438 - RNA, 13 nt, Mycobacterium bovis subsp bovis AF2122/97
gcgggccggcgac

SEQ ID NO: 1034439 - RNA, 16 nt, Mycobacterium bovis subsp bovis AF2122/97
gcgggccggaugacgc

SEQ ID NO: 1034440 - RNA, 14 nt, Mycobacterium bovis subsp bovis AF2122/97
gcgggccggcaucg

SEQ ID NO: 1034441 - RNA, 13 nt, Mycobacterium bovis subsp bovis AF2122/97
gcgggccggucgu

SEQ ID NO: 1034442 - RNA, 17 nt, Mycobacterium bovis subsp bovis AF2122/97
gcgggccuccugcuggc

SEQ ID NO: 1034443 - RNA, 14 nt, Mycobacterium bovis subsp bovis AF2122/97
gcgggccucggcga

SEQ ID NO: 1034444 - RNA, 15 nt, Mycobacterium bovis subsp bovis AF2122/97
gcgggccucggcgac

SEQ ID NO: 1034445 - RNA, 18 nt, Mycobacterium bovis subsp bovis AF2122/97
gcgggccucggcgaccau

SEQ ID NO: 1034446 - RNA, 16 nt, Mycobacterium bovis subsp bovis AF2122/97
gcgggccugcccggga

SEQ ID NO: 1034447 - RNA, 18 nt, Mycobacterium bovis subsp bovis AF2122/97
gcgggccugcacgccggc

SEQ ID NO: 1034448 - RNA, 20 nt, Mycobacterium bovis subsp bovis AF2122/97
gcgggccugcacgccggcgc

SEQ ID NO: 1034449 - RNA, 13 nt, Mycobacterium bovis subsp bovis AF2122/97
gcgggcgacccgu

SEQ ID NO: 1034450 - RNA, 13 nt, Mycobacterium bovis subsp bovis AF2122/97
gcgggcgaccacc

SEQ ID NO: 1034451 - RNA, 15 nt, Mycobacterium bovis subsp bovis AF2122/97
gcgggcgaccaccgc

SEQ ID NO: 1034452 - RNA, 22 nt, Mycobacterium bovis subsp bovis AF2122/97
gcgggcgaucgcggcgagcacc

SEQ ID NO: 1034453 - RNA, 12 nt, Mycobacterium bovis subsp bovis AF2122/97
gcgggcgaucgg

SEQ ID NO: 1034454 - RNA, 15 nt, Mycobacterium bovis subsp bovis AF2122/97
gcgggcgaucggcau

SEQ ID NO: 1034455 - RNA, 12 nt, Mycobacterium bovis subsp bovis AF2122/97
gcgucugcucgc

SEQ ID NO: 1034456 - RNA, 23 nt, Mycobacterium bovis subsp bovis AF2122/97
gcgucugcucaccagcggucagc

SEQ ID NO: 1034457 - RNA, 16 nt, Mycobacterium bovis subsp bovis AF2122/97
gcgucugcgguggccu

SEQ ID NO: 1034458 - RNA, 14 nt, Mycobacterium bovis subsp bovis AF2122/97
gcgucugcgauccc

SEQ ID NO: 1034459 - RNA, 21 nt, Mycobacterium bovis subsp bovis AF2122/97
gcgucugcgaucccgaucgcg

SEQ ID NO: 1034460 - RNA, 17 nt, Mycobacterium bovis subsp bovis AF2122/97
gcgucguucggagcccu

SEQ ID NO: 1034461 - RNA, 22 nt, Mycobacterium bovis subsp bovis AF2122/97
gcgucguucggagcccugaccg

SEQ ID NO: 1034462 - RNA, 22 nt, Mycobacterium bovis subsp bovis AF2122/97
gcgucguugucgucgccggcgg

SEQ ID NO: 1034463 - RNA, 22 nt, Mycobacterium bovis subsp bovis AF2122/97
gcgucugcucgcgcagggaucg

SEQ ID NO: 1034464 - RNA, 18 nt, Mycobacterium bovis subsp bovis AF2122/97
gcgucugcucggcggugc

SEQ ID NO: 1034465 - RNA, 14 nt, Mycobacterium bovis subsp bovis AF2122/97
gcgucugcugaccg

SEQ ID NO: 1034466 - RNA, 18 nt, Mycobacterium bovis subsp bovis AF2122/97
gcgucugcucggcgcagc

SEQ ID NO: 1034467 - RNA, 19 nt, Mycobacterium bovis subsp bovis AF2122/97
gcgucugcucggcgcagcu

SEQ ID NO: 1034468 - RNA, 21 nt, Mycobacterium bovis subsp bovis AF2122/97
gcgucugcucgccgggcagcu

SEQ ID NO: 1034469 - RNA, 17 nt, Mycobacterium bovis subsp bovis AF2122/97
gcgucugcucgccagcg

SEQ ID NO: 1034470 - RNA, 20 nt, Mycobacterium bovis subsp bovis AF2122/97
gcgucuggucagccgcggcg

SEQ ID NO: 1034471 - RNA, 19 nt, Mycobacterium bovis subsp bovis AF2122/97
gcgugaccagggccugagu

SEQ ID NO: 1034472 - RNA, 19 nt, Mycobacterium bovis subsp bovis AF2122/97
gcgugaacugagggcggaa

SEQ ID NO: 1034473 - RNA, 14 nt, Mycobacterium bovis subsp bovis AF2122/97
gcgugaacugaggg

SEQ ID NO: 1034474 - RNA, 16 nt, Mycobacterium bovis subsp bovis AF2122/97
gcgucuugcaucagcg

SEQ ID NO: 1034475 - RNA, 18 nt, Mycobacterium bovis subsp bovis AF2122/97
gcgucuuccucggccacc

SEQ ID NO: 1034476 - RNA, 20 nt, Mycobacterium bovis subsp bovis AF2122/97
gcgucuuccucggccacccg

SEQ ID NO: 1034477 - RNA, 21 nt, Mycobacterium bovis subsp bovis AF2122/97
gcgucuucagguccaccgcug

SEQ ID NO: 1034478 - RNA, 23 nt, Mycobacterium bovis subsp bovis AF2122/97
gcgugccgcaccgccugcucggc

SEQ ID NO: 1034479 - RNA, 13 nt, Mycobacterium bovis subsp bovis AF2122/97
gcgugccgccgca

SEQ ID NO: 1034480 - RNA, 16 nt, Mycobacterium bovis subsp bovis AF2122/97
gcgugccgcccgccuc

SEQ ID NO: 1034481 - RNA, 23 nt, Mycobacterium bovis subsp bovis AF2122/97
gcgugccgcccgccucugucuuc

SEQ ID NO: 1034482 - RNA, 19 nt, Mycobacterium bovis subsp bovis AF2122/97
gcgugccggcagcgguggc

SEQ ID NO: 1034483 - RNA, 23 nt, Mycobacterium bovis subsp bovis AF2122/97
gcgugccggggauaucacgacgc

SEQ ID NO: 1034484 - RNA, 13 nt, Mycobacterium bovis subsp bovis AF2122/97
gcgugcgaugcag

SEQ ID NO: 1034485 - RNA, 15 nt, Mycobacterium bovis subsp bovis AF2122/97
gcgugcgaugcagcg

SEQ ID NO: 1034486 - RNA, 18 nt, Mycobacterium bovis subsp bovis AF2122/97
gcgugcgaugcagcgcgc

SEQ ID NO: 1034487 - RNA, 19 nt, Mycobacterium bovis subsp bovis AF2122/97
gcgugcgaugcagcgcgcc

SEQ ID NO: 1034488 - RNA, 20 nt, Mycobacterium bovis subsp bovis AF2122/97
gcgugcgcacggcgccgacc

SEQ ID NO: 1034489 - RNA, 12 nt, Mycobacterium bovis subsp bovis AF2122/97
gcgugcgcuggc

SEQ ID NO: 1034490 - RNA, 21 nt, Mycobacterium bovis subsp bovis AF2122/97
gcgugcgcuggcugacaccga

SEQ ID NO: 1034491 - RNA, 16 nt, Mycobacterium bovis subsp bovis AF2122/97
gcgugaccgacugcgg

SEQ ID NO: 1034492 - RNA, 18 nt, Mycobacterium bovis subsp bovis AF2122/97
gcgugacucggccgacga

SEQ ID NO: 1034493 - RNA, 16 nt, Mycobacterium bovis subsp bovis AF2122/97
gcgugacugguggcgc

SEQ ID NO: 1034494 - RNA, 19 nt, Mycobacterium bovis subsp bovis AF2122/97
gcgugacugguggcgccaa

SEQ ID NO: 1034495 - RNA, 20 nt, Mycobacterium bovis subsp bovis AF2122/97
gcgugagccaugccgcucgg

SEQ ID NO: 1034496 - RNA, 14 nt, Mycobacterium bovis subsp bovis AF2122/97
gcgugagcgccgcg

SEQ ID NO: 1034497 - RNA, 21 nt, Mycobacterium bovis subsp bovis AF2122/97
gcgugagcgccgcggcgacgu

SEQ ID NO: 1034498 - RNA, 21 nt, Mycobacterium bovis subsp bovis AF2122/97
gcgugagcuaugcuggcagcu

SEQ ID NO: 1034499 - RNA, 22 nt, Mycobacterium bovis subsp bovis AF2122/97
gcgugccgaacagggaggucgc

SEQ ID NO: 1034500 - RNA, 18 nt, Mycobacterium bovis subsp bovis AF2122/97
gcgugaugcgggcucggc

SEQ ID NO: 1034501 - RNA, 17 nt, Mycobacterium bovis subsp bovis AF2122/97
gcgugauggcggcgcac

SEQ ID NO: 1034502 - RNA, 16 nt, Mycobacterium bovis subsp bovis AF2122/97
gcgugaucuggccacg

SEQ ID NO: 1034503 - RNA, 16 nt, Mycobacterium bovis subsp bovis AF2122/97
gcgugaucuggccgaa

SEQ ID NO: 1034504 - RNA, 14 nt, Mycobacterium bovis subsp bovis AF2122/97
gcgugaucccgccc

SEQ ID NO: 1034505 - RNA, 12 nt, Mycobacterium bovis subsp bovis AF2122/97
gcgugaucccgc

SEQ ID NO: 1034506 - RNA, 18 nt, Mycobacterium bovis subsp bovis AF2122/97
gcgucguauucgaugccg

SEQ ID NO: 1034507 - RNA, 15 nt, Mycobacterium bovis subsp bovis AF2122/97
gcgucguggucggcg

SEQ ID NO: 1034508 - RNA, 17 nt, Mycobacterium bovis subsp bovis AF2122/97
gcgucgugguggccacg

SEQ ID NO: 1034509 - RNA, 22 nt, Mycobacterium bovis subsp bovis AF2122/97
gcgucgugguggcuauuccgac

SEQ ID NO: 1034510 - RNA, 23 nt, Mycobacterium bovis subsp bovis AF2122/97
gcgucgguugauugugcccagua

SEQ ID NO: 1034511 - RNA, 18 nt, Mycobacterium bovis subsp bovis AF2122/97
gcgucguaggagccguca

SEQ ID NO: 1034512 - RNA, 16 nt, Mycobacterium bovis subsp bovis AF2122/97
gcgucguggucggcga

SEQ ID NO: 1034513 - RNA, 22 nt, Mycobacterium bovis subsp bovis AF2122/97
gcgucguucgagaccccgacga

SEQ ID NO: 1034514 - RNA, 17 nt, Mycobacterium bovis subsp bovis AF2122/97
gcgucguaaccgucgcc

SEQ ID NO: 1034515 - RNA, 24 nt, Mycobacterium bovis subsp bovis AF2122/97
gcgucguaaccgucgccugccgac

SEQ ID NO: 1034516 - RNA, 17 nt, Mycobacterium bovis subsp bovis AF2122/97
gcgucguagucgucggc

SEQ ID NO: 1034517 - RNA, 15 nt, Mycobacterium bovis subsp bovis AF2122/97
gcgucguagccacgc

SEQ ID NO: 1034518 - RNA, 16 nt, Mycobacterium bovis subsp bovis AF2122/97
gcgucguagcgcucgu

SEQ ID NO: 1034519 - RNA, 19 nt, Mycobacterium bovis subsp bovis AF2122/97
gcgucggucggguggaucu

SEQ ID NO: 1034520 - RNA, 20 nt, Mycobacterium bovis subsp bovis AF2122/97
gcgucggugggucucggcgu

SEQ ID NO: 1034521 - RNA, 14 nt, Mycobacterium bovis subsp bovis AF2122/97
gcgucgguggcaac

SEQ ID NO: 1034522 - RNA, 23 nt, Mycobacterium bovis subsp bovis AF2122/97
gcgucgguggcaacgggucggca

SEQ ID NO: 1034523 - RNA, 15 nt, Mycobacterium bovis subsp bovis AF2122/97
gcgucgggcucggcg

SEQ ID NO: 1034524 - RNA, 14 nt, Mycobacterium bovis subsp bovis AF2122/97
gcgucgggaugcgc

SEQ ID NO: 1034525 - RNA, 11 nt, Mycobacterium bovis subsp bovis AF2122/97
gcgucggcgaa

SEQ ID NO: 1034526 - RNA, 15 nt, Mycobacterium bovis subsp bovis AF2122/97
gcgucggugccacca

SEQ ID NO: 1034527 - RNA, 17 nt, Mycobacterium bovis subsp bovis AF2122/97
gcgucggugccaccacg

SEQ ID NO: 1034528 - RNA, 20 nt, Mycobacterium bovis subsp bovis AF2122/97
gcgucggugaaugccgucgc

SEQ ID NO: 1034529 - RNA, 16 nt, Mycobacterium bovis subsp bovis AF2122/97
gcgucggugaccuucg

SEQ ID NO: 1034530 - RNA, 18 nt, Mycobacterium bovis subsp bovis AF2122/97
gcgucgggguggcggucc

SEQ ID NO: 1034531 - RNA, 17 nt, Mycobacterium bovis subsp bovis AF2122/97
gcgucgccgccguugcc

SEQ ID NO: 1034532 - RNA, 23 nt, Mycobacterium bovis subsp bovis AF2122/97
gcgucgccgccguugccgccggc

SEQ ID NO: 1034533 - RNA, 13 nt, Mycobacterium bovis subsp bovis AF2122/97
gcgucccggcggu

SEQ ID NO: 1034534 - RNA, 14 nt, Mycobacterium bovis subsp bovis AF2122/97
gcgucgccgccauu

SEQ ID NO: 1034535 - RNA, 13 nt, Mycobacterium bovis subsp bovis AF2122/97
gcgucgccggccc

SEQ ID NO: 1034536 - RNA, 17 nt, Mycobacterium bovis subsp bovis AF2122/97
gcgucgccggccccgcc

SEQ ID NO: 1034537 - RNA, 22 nt, Mycobacterium bovis subsp bovis AF2122/97
gcgucgccggccccgccggcgc

SEQ ID NO: 1034538 - RNA, 20 nt, Mycobacterium bovis subsp bovis AF2122/97
gcgucgcgaaauagcugcgg

SEQ ID NO: 1034539 - RNA, 17 nt, Mycobacterium bovis subsp bovis AF2122/97
gcgucgcgaguugagaa

SEQ ID NO: 1034540 - RNA, 15 nt, Mycobacterium bovis subsp bovis AF2122/97
gcgucggccaccgcc

SEQ ID NO: 1034541 - RNA, 13 nt, Mycobacterium bovis subsp bovis AF2122/97
gcgucggccagga

SEQ ID NO: 1034542 - RNA, 13 nt, Mycobacterium bovis subsp bovis AF2122/97
gcgucggccggca

SEQ ID NO: 1034543 - RNA, 19 nt, Mycobacterium bovis subsp bovis AF2122/97
gcgucggcccgcggucgcg

SEQ ID NO: 1034544 - RNA, 16 nt, Mycobacterium bovis subsp bovis AF2122/97
gcguccgaaccaccug

SEQ ID NO: 1034545 - RNA, 14 nt, Mycobacterium bovis subsp bovis AF2122/97
gcgucgccgacgcc

SEQ ID NO: 1034546 - RNA, 14 nt, Mycobacterium bovis subsp bovis AF2122/97
gcguccgacaacga

SEQ ID NO: 1034547 - RNA, 14 nt, Mycobacterium bovis subsp bovis AF2122/97
gcguccccagcgcc

SEQ ID NO: 1034548 - RNA, 18 nt, Mycobacterium bovis subsp bovis AF2122/97
gcguccccagcgccaccg

SEQ ID NO: 1034549 - RNA, 15 nt, Mycobacterium bovis subsp bovis AF2122/97
gcgucccgccgcacc

SEQ ID NO: 1034550 - RNA, 19 nt, Mycobacterium bovis subsp bovis AF2122/97
gcguccaguccgaucaccc

SEQ ID NO: 1034551 - RNA, 15 nt, Mycobacterium bovis subsp bovis AF2122/97
gcguccauccgcagc

SEQ ID NO: 1034552 - RNA, 16 nt, Mycobacterium bovis subsp bovis AF2122/97
gcguccaucgccaccg

SEQ ID NO: 1034553 - RNA, 15 nt, Mycobacterium bovis subsp bovis AF2122/97
gcguccaucgcgcgc

SEQ ID NO: 1034554 - RNA, 21 nt, Mycobacterium bovis subsp bovis AF2122/97
gcguccaucgcgcgccgaccg

SEQ ID NO: 1034555 - RNA, 19 nt, Mycobacterium bovis subsp bovis AF2122/97
gcguccaucucggaccaca

SEQ ID NO: 1034556 - RNA, 18 nt, Mycobacterium bovis subsp bovis AF2122/97
gcgucccaaucgggaucg

SEQ ID NO: 1034557 - RNA, 19 nt, Mycobacterium bovis subsp bovis AF2122/97
gcguccauggucgcgccac

SEQ ID NO: 1034558 - RNA, 16 nt, Mycobacterium bovis subsp bovis AF2122/97
gcguucaacaccgccg

SEQ ID NO: 1034559 - RNA, 13 nt, Mycobacterium bovis subsp bovis AF2122/97
gcguucgaccucg

SEQ ID NO: 1034560 - RNA, 15 nt, Mycobacterium bovis subsp bovis AF2122/97
gcguucgaccucgac

SEQ ID NO: 1034561 - RNA, 20 nt, Mycobacterium bovis subsp bovis AF2122/97
gcguucgacucgaccgcgac

SEQ ID NO: 1034562 - RNA, 23 nt, Mycobacterium bovis subsp bovis AF2122/97
gcguucgagagccccgaccagca

SEQ ID NO: 1034563 - RNA, 15 nt, Mycobacterium bovis subsp bovis AF2122/97
gcguuccggacggga

SEQ ID NO: 1034564 - RNA, 23 nt, Mycobacterium bovis subsp bovis AF2122/97
gcguuccugaucgagcgccagcg

SEQ ID NO: 1034565 - RNA, 20 nt, Mycobacterium bovis subsp bovis AF2122/97
gcguuccgggccgaucaccc

SEQ ID NO: 1034566 - RNA, 18 nt, Mycobacterium bovis subsp bovis AF2122/97
gcguucuccggcaccggu

SEQ ID NO: 1034567 - RNA, 14 nt, Mycobacterium bovis subsp bovis AF2122/97
gcguucugcgcccg

SEQ ID NO: 1034568 - RNA, 13 nt, Mycobacterium bovis subsp bovis AF2122/97
gcguucgccgccc

SEQ ID NO: 1034569 - RNA, 23 nt, Mycobacterium bovis subsp bovis AF2122/97
gcguucgccggaauacaccagcg

SEQ ID NO: 1034570 - RNA, 18 nt, Mycobacterium bovis subsp bovis AF2122/97
gcguucgagugcggucga

SEQ ID NO: 1034571 - RNA, 12 nt, Mycobacterium bovis subsp bovis AF2122/97
gcguugaccgcg

SEQ ID NO: 1034572 - RNA, 14 nt, Mycobacterium bovis subsp bovis AF2122/97
gcguugaccgcggu

SEQ ID NO: 1034573 - RNA, 16 nt, Mycobacterium bovis subsp bovis AF2122/97
gcguugacggucagcc

SEQ ID NO: 1034574 - RNA, 14 nt, Mycobacterium bovis subsp bovis AF2122/97
gcguugagcgcagc

SEQ ID NO: 1034575 - RNA, 20 nt, Mycobacterium bovis subsp bovis AF2122/97
gcguugacucugcguccacc

SEQ ID NO: 1034576 - RNA, 14 nt, Mycobacterium bovis subsp bovis AF2122/97
gcguugaaggcgcc

SEQ ID NO: 1034577 - RNA, 20 nt, Mycobacterium bovis subsp bovis AF2122/97
gcguugaaggcgccgguguu

SEQ ID NO: 1034578 - RNA, 23 nt, Mycobacterium bovis subsp bovis AF2122/97
gcgugucguugccagggcgggcg

SEQ ID NO: 1034579 - RNA, 14 nt, Mycobacterium bovis subsp bovis AF2122/97
gcgugucuggcgaa

SEQ ID NO: 1034580 - RNA, 21 nt, Mycobacterium bovis subsp bovis AF2122/97
gcgugucuguacaacgacacg

SEQ ID NO: 1034581 - RNA, 17 nt, Mycobacterium bovis subsp bovis AF2122/97
gcgugucuugucgcgca

SEQ ID NO: 1034582 - RNA, 13 nt, Mycobacterium bovis subsp bovis AF2122/97
gcgugucgucgcg

SEQ ID NO: 1034583 - RNA, 17 nt, Mycobacterium bovis subsp bovis AF2122/97
gcgugucgcgucgugcg

SEQ ID NO: 1034584 - RNA, 20 nt, Mycobacterium bovis subsp bovis AF2122/97
gcgugucgggaacgaguacg

SEQ ID NO: 1034585 - RNA, 13 nt, Mycobacterium bovis subsp bovis AF2122/97
gcgugucgccgau

SEQ ID NO: 1034586 - RNA, 14 nt, Mycobacterium bovis subsp bovis AF2122/97
gcgugucgacuccg

SEQ ID NO: 1034587 - RNA, 23 nt, Mycobacterium bovis subsp bovis AF2122/97
gcguggccaauccggcggcgacg

SEQ ID NO: 1034588 - RNA, 12 nt, Mycobacterium bovis subsp bovis AF2122/97
gcgugucgccgc

SEQ ID NO: 1034589 - RNA, 14 nt, Mycobacterium bovis subsp bovis AF2122/97
gcgugucgccgcca

SEQ ID NO: 1034590 - RNA, 17 nt, Mycobacterium bovis subsp bovis AF2122/97
gcgugucgccgccacca

SEQ ID NO: 1034591 - RNA, 18 nt, Mycobacterium bovis subsp bovis AF2122/97
gcgugucgccgccaccag

SEQ ID NO: 1034592 - RNA, 14 nt, Mycobacterium bovis subsp bovis AF2122/97
gcgugucgaugcgg

SEQ ID NO: 1034593 - RNA, 17 nt, Mycobacterium bovis subsp bovis AF2122/97
gcguuagggccgccauc

SEQ ID NO: 1034594 - RNA, 20 nt, Mycobacterium bovis subsp bovis AF2122/97
gcguguggagcucgcggcgc

SEQ ID NO: 1034595 - RNA, 14 nt, Mycobacterium bovis subsp bovis AF2122/97
gcguguggcagaug

SEQ ID NO: 1034596 - RNA, 12 nt, Mycobacterium bovis subsp bovis AF2122/97
gcguguggcgca

SEQ ID NO: 1034597 - RNA, 19 nt, Mycobacterium bovis subsp bovis AF2122/97
gcguggcagugcaggcggc

SEQ ID NO: 1034598 - RNA, 22 nt, Mycobacterium bovis subsp bovis AF2122/97
gcguggcagugcaggcggccgc

SEQ ID NO: 1034599 - RNA, 24 nt, Mycobacterium bovis subsp bovis AF2122/97
gcguggccaacucuucagcaagcc

SEQ ID NO: 1034600 - RNA, 16 nt, Mycobacterium bovis subsp bovis AF2122/97
gcguggccaauccggc

SEQ ID NO: 1034601 - RNA, 21 nt, Mycobacterium bovis subsp bovis AF2122/97
gcguggaucuuggccagcagc

SEQ ID NO: 1034602 - RNA, 23 nt, Mycobacterium bovis subsp bovis AF2122/97
gcguggaucuuggccagcagcgc

SEQ ID NO: 1034603 - RNA, 19 nt, Mycobacterium bovis subsp bovis AF2122/97
gcguggcaguacaccggcg

SEQ ID NO: 1034604 - RNA, 17 nt, Mycobacterium bovis subsp bovis AF2122/97
gcgugcggucgauccgg

SEQ ID NO: 1034605 - RNA, 13 nt, Mycobacterium bovis subsp bovis AF2122/97
gcgugcggcugcc

SEQ ID NO: 1034606 - RNA, 13 nt, Mycobacterium bovis subsp bovis AF2122/97
gcgugcggcggcc

SEQ ID NO: 1034607 - RNA, 23 nt, Mycobacterium bovis subsp bovis AF2122/97
gcgugcggcguuaucgucggcuu

SEQ ID NO: 1034608 - RNA, 13 nt, Mycobacterium bovis subsp bovis AF2122/97
gcgugcggcgaag

SEQ ID NO: 1034609 - RNA, 16 nt, Mycobacterium bovis subsp bovis AF2122/97
gcgugcggacugacgu

SEQ ID NO: 1034610 - RNA, 12 nt, Mycobacterium bovis subsp bovis AF2122/97
gcgugcggucgu

SEQ ID NO: 1034611 - RNA, 19 nt, Mycobacterium bovis subsp bovis AF2122/97
gcguggaagccgacgacca

SEQ ID NO: 1034612 - RNA, 14 nt, Mycobacterium bovis subsp bovis AF2122/97
gcguggacgcccgc

SEQ ID NO: 1034613 - RNA, 18 nt, Mycobacterium bovis subsp bovis AF2122/97
gcguuguugaccagcacg

SEQ ID NO: 1034614 - RNA, 20 nt, Mycobacterium bovis subsp bovis AF2122/97
gcguuuauaccucgccgccc

SEQ ID NO: 1034615 - RNA, 22 nt, Mycobacterium bovis subsp bovis AF2122/97
gcguuuauaccucgccgcccug

SEQ ID NO: 1034616 - RNA, 16 nt, Mycobacterium bovis subsp bovis AF2122/97
gcguugugaccgccga

SEQ ID NO: 1034617 - RNA, 16 nt, Mycobacterium bovis subsp bovis AF2122/97
gcguuguugggcgagg

SEQ ID NO: 1034618 - RNA, 23 nt, Mycobacterium bovis subsp bovis AF2122/97
gcguuguugucgcauuucgacga

SEQ ID NO: 1034619 - RNA, 13 nt, Mycobacterium bovis subsp bovis AF2122/97
gcguuguccacca

SEQ ID NO: 1034620 - RNA, 16 nt, Mycobacterium bovis subsp bovis AF2122/97
gcguuguugaccagca

SEQ ID NO: 1034621 - RNA, 14 nt, Mycobacterium bovis subsp bovis AF2122/97
gcguugucgcccac

SEQ ID NO: 1034622 - RNA, 22 nt, Mycobacterium bovis subsp bovis AF2122/97
gcguuguguuccguugcgucgc

SEQ ID NO: 1034623 - RNA, 21 nt, Mycobacterium bovis subsp bovis AF2122/97
gcguuguuaucgaagcccgag

SEQ ID NO: 1034624 - RNA, 14 nt, Mycobacterium bovis subsp bovis AF2122/97
gcguuggaugaagu

SEQ ID NO: 1034625 - RNA, 13 nt, Mycobacterium bovis subsp bovis AF2122/97
gcguuggcgacga

SEQ ID NO: 1034626 - RNA, 17 nt, Mycobacterium bovis subsp bovis AF2122/97
gcguuggcgaucucgac

SEQ ID NO: 1034627 - RNA, 15 nt, Mycobacterium bovis subsp bovis AF2122/97
gcguuggccagcagg

SEQ ID NO: 1034628 - RNA, 21 nt, Mycobacterium bovis subsp bovis AF2122/97
gcguuggcggcuucgccccga

SEQ ID NO: 1034629 - RNA, 17 nt, Mycobacterium bovis subsp bovis AF2122/97
gcguugcugaugucgcc

SEQ ID NO: 1034630 - RNA, 17 nt, Mycobacterium bovis subsp bovis AF2122/97
gcguuggacaauucgac

SEQ ID NO: 1034631 - RNA, 15 nt, Mycobacterium bovis subsp bovis AF2122/97
gcguugggaccagug

SEQ ID NO: 1034632 - RNA, 19 nt, Mycobacterium bovis subsp bovis AF2122/97
gcguugggaccagugcggu

SEQ ID NO: 1034633 - RNA, 20 nt, Mycobacterium bovis subsp bovis AF2122/97
gcguugggaucgcgcagcgc

SEQ ID NO: 1034634 - RNA, 22 nt, Mycobacterium bovis subsp bovis AF2122/97
gcguugggcgggauggccgccg

SEQ ID NO: 1034635 - RNA, 16 nt, Mycobacterium bovis subsp bovis AF2122/97
gcguuggucaucaccc

SEQ ID NO: 1034636 - RNA, 17 nt, Mycobacterium bovis subsp bovis AF2122/97
gcguugcggcaacagcg

SEQ ID NO: 1034637 - RNA, 13 nt, Mycobacterium bovis subsp bovis AF2122/97
gcguugcuggucg

SEQ ID NO: 1034638 - RNA, 14 nt, Mycobacterium bovis subsp bovis AF2122/97
gcguugcuggucgc

SEQ ID NO: 1034639 - RNA, 21 nt, Mycobacterium bovis subsp bovis AF2122/97
gcguugccgccguugccgcca

SEQ ID NO: 1034640 - RNA, 16 nt, Mycobacterium bovis subsp bovis AF2122/97
gcuaacgucgaucucg

SEQ ID NO: 1034641 - RNA, 14 nt, Mycobacterium bovis subsp bovis AF2122/97
gcuaaccuuggcga

SEQ ID NO: 1034642 - RNA, 14 nt, Mycobacterium bovis subsp bovis AF2122/97
gcuaacgcaccugc

SEQ ID NO: 1034643 - RNA, 19 nt, Mycobacterium bovis subsp bovis AF2122/97
gcuaacgcaccugcgcgcg

SEQ ID NO: 1034644 - RNA, 20 nt, Mycobacterium bovis subsp bovis AF2122/97
gcuaaccacggugugcuacc

SEQ ID NO: 1034645 - RNA, 12 nt, Mycobacterium bovis subsp bovis AF2122/97
gcuaacacccga

SEQ ID NO: 1034646 - RNA, 20 nt, Mycobacterium bovis subsp bovis AF2122/97
gcuaacacccgagcaacggc

SEQ ID NO: 1034647 - RNA, 15 nt, Mycobacterium bovis subsp bovis AF2122/97
gcuaacaccgcaggc

SEQ ID NO: 1034648 - RNA, 17 nt, Mycobacterium bovis subsp bovis AF2122/97
gcuaaaaaccgcugccg

SEQ ID NO: 1034649 - RNA, 20 nt, Mycobacterium bovis subsp bovis AF2122/97
gcguuuuccgggcuguucgc

SEQ ID NO: 1034650 - RNA, 21 nt, Mycobacterium bovis subsp bovis AF2122/97
gcguuuucaauuucacugcga

SEQ ID NO: 1034651 - RNA, 15 nt, Mycobacterium bovis subsp bovis AF2122/97
gcguuuggacgggcg

SEQ ID NO: 1034652 - RNA, 15 nt, Mycobacterium bovis subsp bovis AF2122/97
gcguuuggcagagcc

SEQ ID NO: 1034653 - RNA, 22 nt, Mycobacterium bovis subsp bovis AF2122/97
gcguuugagaacaacgggaucc

SEQ ID NO: 1034654 - RNA, 22 nt, Mycobacterium bovis subsp bovis AF2122/97
gcguuugcacuguucgcgguga

SEQ ID NO: 1034655 - RNA, 19 nt, Mycobacterium bovis subsp bovis AF2122/97
gcgucagccgcaccccgcc

SEQ ID NO: 1034656 - RNA, 16 nt, Mycobacterium bovis subsp bovis AF2122/97
gcgucaccucaccgaa

SEQ ID NO: 1034657 - RNA, 13 nt, Mycobacterium bovis subsp bovis AF2122/97
gcgucagcaguuc

SEQ ID NO: 1034658 - RNA, 18 nt, Mycobacterium bovis subsp bovis AF2122/97
gcgucaggccagagucgc

SEQ ID NO: 1034659 - RNA, 15 nt, Mycobacterium bovis subsp bovis AF2122/97
gcgucagcggcgagc

SEQ ID NO: 1034660 - RNA, 15 nt, Mycobacterium bovis subsp bovis AF2122/97
gcgucaggccagcgc

SEQ ID NO: 1034661 - RNA, 20 nt, Mycobacterium bovis subsp bovis AF2122/97
gcgucaggccagcgcucacc

SEQ ID NO: 1034662 - RNA, 18 nt, Mycobacterium bovis subsp bovis AF2122/97
gcgucagauccggccguu

SEQ ID NO: 1034663 - RNA, 15 nt, Mycobacterium bovis subsp bovis AF2122/97
gcgucacccugucgc

SEQ ID NO: 1034664 - RNA, 20 nt, Mycobacterium bovis subsp bovis AF2122/97
gcgucacccugucgcgcacc

SEQ ID NO: 1034665 - RNA, 15 nt, Mycobacterium bovis subsp bovis AF2122/97
gcgucaccgcgggug

SEQ ID NO: 1034666 - RNA, 14 nt, Mycobacterium bovis subsp bovis AF2122/97
gcgucacaccagcg

SEQ ID NO: 1034667 - RNA, 13 nt, Mycobacterium bovis subsp bovis AF2122/97
gcgucacauccga

SEQ ID NO: 1034668 - RNA, 22 nt, Mycobacterium bovis subsp bovis AF2122/97
gcgucaccccggucccgccgac

SEQ ID NO: 1034669 - RNA, 19 nt, Mycobacterium bovis subsp bovis AF2122/97
gcgucaaguccgagucggc

SEQ ID NO: 1034670 - RNA, 21 nt, Mycobacterium bovis subsp bovis AF2122/97
gcgucacaccagcgggcaucg

SEQ ID NO: 1034671 - RNA, 16 nt, Mycobacterium bovis subsp bovis AF2122/97
gcgucaggugcgcgac

SEQ ID NO: 1034672 - RNA, 20 nt, Mycobacterium bovis subsp bovis AF2122/97
gcgucaggugcgcgaccagg

SEQ ID NO: 1034673 - RNA, 20 nt, Mycobacterium bovis subsp bovis AF2122/97
gcgucaggcccucggguguc

SEQ ID NO: 1034674 - RNA, 20 nt, Mycobacterium bovis subsp bovis AF2122/97
gcgucaucgcgggugaucuc

SEQ ID NO: 1034675 - RNA, 19 nt, Mycobacterium bovis subsp bovis AF2122/97
gcgucaugaugucgacauc

SEQ ID NO: 1034676 - RNA, 20 nt, Mycobacterium bovis subsp bovis AF2122/97
gcgucaugaugucgacaucg

SEQ ID NO: 1034677 - RNA, 13 nt, Mycobacterium bovis subsp bovis AF2122/97
gcgucaugcccag

SEQ ID NO: 1034678 - RNA, 15 nt, Mycobacterium bovis subsp bovis AF2122/97
gcguccagcgcggcc

SEQ ID NO: 1034679 - RNA, 23 nt, Mycobacterium bovis subsp bovis AF2122/97
gcguccaggcgagugaacucguc

SEQ ID NO: 1034680 - RNA, 23 nt, Mycobacterium bovis subsp bovis AF2122/97
gcguccaucagagacagcagcgu

SEQ ID NO: 1034681 - RNA, 15 nt, Mycobacterium bovis subsp bovis AF2122/97
gcguccagcuggcau

SEQ ID NO: 1034682 - RNA, 14 nt, Mycobacterium bovis subsp bovis AF2122/97
gcguccacgggauc

SEQ ID NO: 1034683 - RNA, 13 nt, Mycobacterium bovis subsp bovis AF2122/97
gcguccagccgcc

SEQ ID NO: 1034684 - RNA, 21 nt, Mycobacterium bovis subsp bovis AF2122/97
gcguccagaccguagcggccg

SEQ ID NO: 1034685 - RNA, 22 nt, Mycobacterium bovis subsp bovis AF2122/97
gcguccagaccguagcggccgg

SEQ ID NO: 1034686 - RNA, 18 nt, Mycobacterium bovis subsp bovis AF2122/97
gcguccagcaaaugcggc

SEQ ID NO: 1034687 - RNA, 23 nt, Mycobacterium bovis subsp bovis AF2122/97
gcguccagaagaagaugaucgcg

SEQ ID NO: 1034688 - RNA, 19 nt, Mycobacterium bovis subsp bovis AF2122/97
gcguccacgcugaccaacg

SEQ ID NO: 1034689 - RNA, 21 nt, Mycobacterium bovis subsp bovis AF2122/97
gcguccaacccaggguggcga

SEQ ID NO: 1034690 - RNA, 17 nt, Mycobacterium bovis subsp bovis AF2122/97
gcguccaaggcgcgcug

SEQ ID NO: 1034691 - RNA, 22 nt, Mycobacterium bovis subsp bovis AF2122/97
gcguacccguuaugcgccgccc

SEQ ID NO: 1034692 - RNA, 13 nt, Mycobacterium bovis subsp bovis AF2122/97
gcguacccaacgg

SEQ ID NO: 1034693 - RNA, 22 nt, Mycobacterium bovis subsp bovis AF2122/97
gcguacgccggacccggucgcc

SEQ ID NO: 1034694 - RNA, 13 nt, Mycobacterium bovis subsp bovis AF2122/97
gcguacagcaccg

SEQ ID NO: 1034695 - RNA, 18 nt, Mycobacterium bovis subsp bovis AF2122/97
gcguacucggcauccagg

SEQ ID NO: 1034696 - RNA, 16 nt, Mycobacterium bovis subsp bovis AF2122/97
gcguagagcagcagcg

SEQ ID NO: 1034697 - RNA, 23 nt, Mycobacterium bovis subsp bovis AF2122/97
gcguagaccccaaucgaccgccc

SEQ ID NO: 1034698 - RNA, 21 nt, Mycobacterium bovis subsp bovis AF2122/97
gcguagagccgaucaccgccg

SEQ ID NO: 1034699 - RNA, 15 nt, Mycobacterium bovis subsp bovis AF2122/97
gcguagcaggucgac

SEQ ID NO: 1034700 - RNA, 17 nt, Mycobacterium bovis subsp bovis AF2122/97
gcguagcccaugccgau

SEQ ID NO: 1034701 - RNA, 17 nt, Mycobacterium bovis subsp bovis AF2122/97
gcguagcgaccucgccg

SEQ ID NO: 1034702 - RNA, 22 nt, Mycobacterium bovis subsp bovis AF2122/97
gcguagcgaccucgccgcggcg

SEQ ID NO: 1034703 - RNA, 23 nt, Mycobacterium bovis subsp bovis AF2122/97
gcgucaacgcuguugucguccaa

SEQ ID NO: 1034704 - RNA, 17 nt, Mycobacterium bovis subsp bovis AF2122/97
gcgucaaccgaucgguc

SEQ ID NO: 1034705 - RNA, 18 nt, Mycobacterium bovis subsp bovis AF2122/97
gcgucaaccacggccgcc

SEQ ID NO: 1034706 - RNA, 20 nt, Mycobacterium bovis subsp bovis AF2122/97
gcgucaaccacggccgccgc

SEQ ID NO: 1034707 - RNA, 15 nt, Mycobacterium bovis subsp bovis AF2122/97
gcguauugcggccug

SEQ ID NO: 1034708 - RNA, 20 nt, Mycobacterium bovis subsp bovis AF2122/97
gcguaucccgugugcggaca

SEQ ID NO: 1034709 - RNA, 17 nt, Mycobacterium bovis subsp bovis AF2122/97
gcguaucgggcccccug

SEQ ID NO: 1034710 - RNA, 16 nt, Mycobacterium bovis subsp bovis AF2122/97
gcguagggccagcgcc

SEQ ID NO: 1034711 - RNA, 16 nt, Mycobacterium bovis subsp bovis AF2122/97
gcguagguggccagcg

SEQ ID NO: 1034712 - RNA, 17 nt, Mycobacterium bovis subsp bovis AF2122/97
gcguagguggccagcgc

SEQ ID NO: 1034713 - RNA, 21 nt, Mycobacterium bovis subsp bovis AF2122/97
gcguagguggccagcgcggcg

SEQ ID NO: 1034714 - RNA, 22 nt, Mycobacterium bovis subsp bovis AF2122/97
gcguagguggccagcgcggcga

SEQ ID NO: 1034715 - RNA, 15 nt, Mycobacterium bovis subsp bovis AF2122/97
gcguagggccagcgc

SEQ ID NO: 1034716 - RNA, 18 nt, Mycobacterium bovis subsp bovis AF2122/97
gcguaggccuugcucagc

SEQ ID NO: 1034717 - RNA, 13 nt, Mycobacterium bovis subsp bovis AF2122/97
gcguaggcgaugg

SEQ ID NO: 1034718 - RNA, 20 nt, Mycobacterium bovis subsp bovis AF2122/97
gcguaguuaugccaaaccga

SEQ ID NO: 1034719 - RNA, 20 nt, Mycobacterium bovis subsp bovis AF2122/97
gcguaguccgcauccgcgac

SEQ ID NO: 1034720 - RNA, 23 nt, Mycobacterium bovis subsp bovis AF2122/97
gcguauagcaugccgcggcggaa

SEQ ID NO: 1034721 - RNA, 16 nt, Mycobacterium bovis subsp bovis AF2122/97
gcggucggucaccaug

SEQ ID NO: 1034722 - RNA, 21 nt, Mycobacterium bovis subsp bovis AF2122/97
gcggucggucaccauggcgcc

SEQ ID NO: 1034723 - RNA, 14 nt, Mycobacterium bovis subsp bovis AF2122/97
gcggucgggcccgg

SEQ ID NO: 1034724 - RNA, 15 nt, Mycobacterium bovis subsp bovis AF2122/97
gcggucgggcccggc

SEQ ID NO: 1034725 - RNA, 22 nt, Mycobacterium bovis subsp bovis AF2122/97
gcggucgugaucagcaggacga

SEQ ID NO: 1034726 - RNA, 13 nt, Mycobacterium bovis subsp bovis AF2122/97
gcggucugcgcgu

SEQ ID NO: 1034727 - RNA, 17 nt, Mycobacterium bovis subsp bovis AF2122/97
gcggucugcgcgucgcg

SEQ ID NO: 1034728 - RNA, 12 nt, Mycobacterium bovis subsp bovis AF2122/97
gcggucugcucc

SEQ ID NO: 1034729 - RNA, 14 nt, Mycobacterium bovis subsp bovis AF2122/97
gcggucucggugcc

SEQ ID NO: 1034730 - RNA, 21 nt, Mycobacterium bovis subsp bovis AF2122/97
gcggucucggugccgagcacu

SEQ ID NO: 1034731 - RNA, 17 nt, Mycobacterium bovis subsp bovis AF2122/97
gcggucugcagugcagc

SEQ ID NO: 1034732 - RNA, 22 nt, Mycobacterium bovis subsp bovis AF2122/97
gcggucucacucaucggugugc

SEQ ID NO: 1034733 - RNA, 18 nt, Mycobacterium bovis subsp bovis AF2122/97
gcggucucagugcucgcc

SEQ ID NO: 1034734 - RNA, 22 nt, Mycobacterium bovis subsp bovis AF2122/97
gcggucguugauuucggcggcg

SEQ ID NO: 1034735 - RNA, 19 nt, Mycobacterium bovis subsp bovis AF2122/97
gcggucguugccgaccgau

SEQ ID NO: 1034736 - RNA, 16 nt, Mycobacterium bovis subsp bovis AF2122/97
gcggucuccgcccgcg

SEQ ID NO: 1034737 - RNA, 19 nt, Mycobacterium bovis subsp bovis AF2122/97
gcggucuccgcccgcgggc

SEQ ID NO: 1034738 - RNA, 13 nt, Mycobacterium bovis subsp bovis AF2122/97
gcggucggcggcc

SEQ ID NO: 1034739 - RNA, 16 nt, Mycobacterium bovis subsp bovis AF2122/97
gcggucggcggccgcc

SEQ ID NO: 1034740 - RNA, 16 nt, Mycobacterium bovis subsp bovis AF2122/97
gcggucggccugcggc

SEQ ID NO: 1034741 - RNA, 20 nt, Mycobacterium bovis subsp bovis AF2122/97
gcggucggcgaccaccagcg

SEQ ID NO: 1034742 - RNA, 14 nt, Mycobacterium bovis subsp bovis AF2122/97
gcggucggccacca

SEQ ID NO: 1034743 - RNA, 15 nt, Mycobacterium bovis subsp bovis AF2122/97
gcggucggcgacgua

SEQ ID NO: 1034744 - RNA, 17 nt, Mycobacterium bovis subsp bovis AF2122/97
gcggucggcgacguaga

SEQ ID NO: 1034745 - RNA, 12 nt, Mycobacterium bovis subsp bovis AF2122/97
gcggucgagcag

SEQ ID NO: 1034746 - RNA, 16 nt, Mycobacterium bovis subsp bovis AF2122/97
gcggucgagccaccca

SEQ ID NO: 1034747 - RNA, 20 nt, Mycobacterium bovis subsp bovis AF2122/97
gcggucgagccacccaccga

SEQ ID NO: 1034748 - RNA, 13 nt, Mycobacterium bovis subsp bovis AF2122/97
gcggucgagcucg

SEQ ID NO: 1034749 - RNA, 24 nt, Mycobacterium bovis subsp bovis AF2122/97
gcgguccugguguagccgagcacg

SEQ ID NO: 1034750 - RNA, 18 nt, Mycobacterium bovis subsp bovis AF2122/97
gcgguccgcugccaucgg

SEQ ID NO: 1034751 - RNA, 19 nt, Mycobacterium bovis subsp bovis AF2122/97
gcgguccgcugccaucggc

SEQ ID NO: 1034752 - RNA, 22 nt, Mycobacterium bovis subsp bovis AF2122/97
gcgguccggaaauuccggcgcg

SEQ ID NO: 1034753 - RNA, 15 nt, Mycobacterium bovis subsp bovis AF2122/97
gcgguccucgaucgg

SEQ ID NO: 1034754 - RNA, 18 nt, Mycobacterium bovis subsp bovis AF2122/97
gcgguccucgaucggugg

SEQ ID NO: 1034755 - RNA, 13 nt, Mycobacterium bovis subsp bovis AF2122/97
gcggucgacgugu

SEQ ID NO: 1034756 - RNA, 18 nt, Mycobacterium bovis subsp bovis AF2122/97
gcgguccaaucgccgggu

SEQ ID NO: 1034757 - RNA, 14 nt, Mycobacterium bovis subsp bovis AF2122/97
gcgguccggcuucg

SEQ ID NO: 1034758 - RNA, 13 nt, Mycobacterium bovis subsp bovis AF2122/97
gcgggcugguucg

SEQ ID NO: 1034759 - RNA, 15 nt, Mycobacterium bovis subsp bovis AF2122/97
gcgggcuguaggcga

SEQ ID NO: 1034760 - RNA, 16 nt, Mycobacterium bovis subsp bovis AF2122/97
gcgggcuugagcgccg

SEQ ID NO: 1034761 - RNA, 19 nt, Mycobacterium bovis subsp bovis AF2122/97
gcgggcuugagcgccgaug

SEQ ID NO: 1034762 - RNA, 19 nt, Mycobacterium bovis subsp bovis AF2122/97
gcggucagauucggcgaug

SEQ ID NO: 1034763 - RNA, 19 nt, Mycobacterium bovis subsp bovis AF2122/97
gcggucagcagcgccguca

SEQ ID NO: 1034764 - RNA, 16 nt, Mycobacterium bovis subsp bovis AF2122/97
gcggucagcagcgccg

SEQ ID NO: 1034765 - RNA, 23 nt, Mycobacterium bovis subsp bovis AF2122/97
gcggggaaucacccacucgccga

SEQ ID NO: 1034766 - RNA, 20 nt, Mycobacterium bovis subsp bovis AF2122/97
gcgggcuuggggucccgccg

SEQ ID NO: 1034767 - RNA, 23 nt, Mycobacterium bovis subsp bovis AF2122/97
gcggucaccccggcucggccacc

SEQ ID NO: 1034768 - RNA, 18 nt, Mycobacterium bovis subsp bovis AF2122/97
gcggucaccgacgcagaa

SEQ ID NO: 1034769 - RNA, 13 nt, Mycobacterium bovis subsp bovis AF2122/97
gcggucaccgcgu

SEQ ID NO: 1034770 - RNA, 17 nt, Mycobacterium bovis subsp bovis AF2122/97
gcggucaccaccgaccc

SEQ ID NO: 1034771 - RNA, 21 nt, Mycobacterium bovis subsp bovis AF2122/97
gcggucaccaccguggcgccc

SEQ ID NO: 1034772 - RNA, 18 nt, Mycobacterium bovis subsp bovis AF2122/97
gcggucaccacgcggcgg

SEQ ID NO: 1034773 - RNA, 21 nt, Mycobacterium bovis subsp bovis AF2122/97
gcggucaccacgcggcggucg

SEQ ID NO: 1034774 - RNA, 18 nt, Mycobacterium bovis subsp bovis AF2122/97
gcgguccaacagcgccag

SEQ ID NO: 1034775 - RNA, 16 nt, Mycobacterium bovis subsp bovis AF2122/97
gcggucauggcgacgg

SEQ ID NO: 1034776 - RNA, 14 nt, Mycobacterium bovis subsp bovis AF2122/97
gcgguccgccgccu

SEQ ID NO: 1034777 - RNA, 17 nt, Mycobacterium bovis subsp bovis AF2122/97
gcggucaucgccucggc

SEQ ID NO: 1034778 - RNA, 24 nt, Mycobacterium bovis subsp bovis AF2122/97
gcggucagcucggcagcaucuccg

SEQ ID NO: 1034779 - RNA, 19 nt, Mycobacterium bovis subsp bovis AF2122/97
gcggucagguugcgccaua

SEQ ID NO: 1034780 - RNA, 14 nt, Mycobacterium bovis subsp bovis AF2122/97
gcggucagccggcc

SEQ ID NO: 1034781 - RNA, 21 nt, Mycobacterium bovis subsp bovis AF2122/97
gcggucaggauuucugcgauc

SEQ ID NO: 1034782 - RNA, 13 nt, Mycobacterium bovis subsp bovis AF2122/97
gcggucagcucgg

SEQ ID NO: 1034783 - RNA, 19 nt, Mycobacterium bovis subsp bovis AF2122/97
gcggucagcucggcagcau

SEQ ID NO: 1034784 - RNA, 13 nt, Mycobacterium bovis subsp bovis AF2122/97
gcggucagcggcc

SEQ ID NO: 1034785 - RNA, 19 nt, Mycobacterium bovis subsp bovis AF2122/97
gcggugcggaucagaggac

SEQ ID NO: 1034786 - RNA, 17 nt, Mycobacterium bovis subsp bovis AF2122/97
gcggugcggcaacagcg

SEQ ID NO: 1034787 - RNA, 21 nt, Mycobacterium bovis subsp bovis AF2122/97
gcggugcucuucggcaccacc

SEQ ID NO: 1034788 - RNA, 19 nt, Mycobacterium bovis subsp bovis AF2122/97
gcggugcggcaacagcgcc

SEQ ID NO: 1034789 - RNA, 16 nt, Mycobacterium bovis subsp bovis AF2122/97
gcgguggaaccuggcg

SEQ ID NO: 1034790 - RNA, 13 nt, Mycobacterium bovis subsp bovis AF2122/97
gcgguggucgcga

SEQ ID NO: 1034791 - RNA, 18 nt, Mycobacterium bovis subsp bovis AF2122/97
gcggucugcuccaggcgc

SEQ ID NO: 1034792 - RNA, 19 nt, Mycobacterium bovis subsp bovis AF2122/97
gcggucugcuccaggcgcg

SEQ ID NO: 1034793 - RNA, 21 nt, Mycobacterium bovis subsp bovis AF2122/97
gcggucugcuccaggcgcgcc

SEQ ID NO: 1034794 - RNA, 23 nt, Mycobacterium bovis subsp bovis AF2122/97
gcggucugcuccaggcgcgccgc

SEQ ID NO: 1034795 - RNA, 16 nt, Mycobacterium bovis subsp bovis AF2122/97
gcggugaggugaccaa

SEQ ID NO: 1034796 - RNA, 16 nt, Mycobacterium bovis subsp bovis AF2122/97
gcggugaguccgcuga

SEQ ID NO: 1034797 - RNA, 16 nt, Mycobacterium bovis subsp bovis AF2122/97
gcggugccgucgccgc

SEQ ID NO: 1034798 - RNA, 21 nt, Mycobacterium bovis subsp bovis AF2122/97
gcggugcgcagcuuggccagc

SEQ ID NO: 1034799 - RNA, 22 nt, Mycobacterium bovis subsp bovis AF2122/97
gcggugcaggauucggcggucg

SEQ ID NO: 1034800 - RNA, 12 nt, Mycobacterium bovis subsp bovis AF2122/97
gcggugcgcacc

SEQ ID NO: 1034801 - RNA, 21 nt, Mycobacterium bovis subsp bovis AF2122/97
gcggugcgcaccaccgagccg

SEQ ID NO: 1034802 - RNA, 19 nt, Mycobacterium bovis subsp bovis AF2122/97
gcggugauggacugaucgc

SEQ ID NO: 1034803 - RNA, 14 nt, Mycobacterium bovis subsp bovis AF2122/97
gcggugcacaccgu

SEQ ID NO: 1034804 - RNA, 14 nt, Mycobacterium bovis subsp bovis AF2122/97
gcggugcacacuga

SEQ ID NO: 1034805 - RNA, 17 nt, Mycobacterium bovis subsp bovis AF2122/97
gcgguggugucgcucgc

SEQ ID NO: 1034806 - RNA, 17 nt, Mycobacterium bovis subsp bovis AF2122/97
gcgguggugccgcggcc

SEQ ID NO: 1034807 - RNA, 21 nt, Mycobacterium bovis subsp bovis AF2122/97
gcgguggugcgcaaucgacac

SEQ ID NO: 1034808 - RNA, 19 nt, Mycobacterium bovis subsp bovis AF2122/97
gcgguggugagugcgucuc

SEQ ID NO: 1034809 - RNA, 20 nt, Mycobacterium bovis subsp bovis AF2122/97
gcgguggccagaucgaacgc

SEQ ID NO: 1034810 - RNA, 13 nt, Mycobacterium bovis subsp bovis AF2122/97
gcgguggccgaca

SEQ ID NO: 1034811 - RNA, 16 nt, Mycobacterium bovis subsp bovis AF2122/97
gcgguggucggcgcgc

SEQ ID NO: 1034812 - RNA, 18 nt, Mycobacterium bovis subsp bovis AF2122/97
gcgguggucggcgcgccg

SEQ ID NO: 1034813 - RNA, 18 nt, Mycobacterium bovis subsp bovis AF2122/97
gcgguggccucccacggc

SEQ ID NO: 1034814 - RNA, 21 nt, Mycobacterium bovis subsp bovis AF2122/97
gcgguggccucccacggcgcg

SEQ ID NO: 1034815 - RNA, 16 nt, Mycobacterium bovis subsp bovis AF2122/97
gcgguggccgucgggu

SEQ ID NO: 1034816 - RNA, 14 nt, Mycobacterium bovis subsp bovis AF2122/97
gcgguggccggcga

SEQ ID NO: 1034817 - RNA, 15 nt, Mycobacterium bovis subsp bovis AF2122/97
gcgguguaacccgga

SEQ ID NO: 1034818 - RNA, 21 nt, Mycobacterium bovis subsp bovis AF2122/97
gcgguguagaagcgggcgucg

SEQ ID NO: 1034819 - RNA, 13 nt, Mycobacterium bovis subsp bovis AF2122/97
gcgguugaugcgg

SEQ ID NO: 1034820 - RNA, 16 nt, Mycobacterium bovis subsp bovis AF2122/97
gcgguugaugcggccg

SEQ ID NO: 1034821 - RNA, 17 nt, Mycobacterium bovis subsp bovis AF2122/97
gcgguugaugcggccgc

SEQ ID NO: 1034822 - RNA, 22 nt, Mycobacterium bovis subsp bovis AF2122/97
gcgguugcaaaccgcugcgcga

SEQ ID NO: 1034823 - RNA, 21 nt, Mycobacterium bovis subsp bovis AF2122/97
gcgguugcauaccgccgggcc

SEQ ID NO: 1034824 - RNA, 22 nt, Mycobacterium bovis subsp bovis AF2122/97
gcgguugcauccauccugccuu

SEQ ID NO: 1034825 - RNA, 13 nt, Mycobacterium bovis subsp bovis AF2122/97
gcggugucggcgc

SEQ ID NO: 1034826 - RNA, 14 nt, Mycobacterium bovis subsp bovis AF2122/97
gcggugucggcgcc

SEQ ID NO: 1034827 - RNA, 16 nt, Mycobacterium bovis subsp bovis AF2122/97
gcgguguagccggcgc

SEQ ID NO: 1034828 - RNA, 17 nt, Mycobacterium bovis subsp bovis AF2122/97
gcgguguagccggcgcc

SEQ ID NO: 1034829 - RNA, 19 nt, Mycobacterium bovis subsp bovis AF2122/97
gcgguguagccggcgccgc

SEQ ID NO: 1034830 - RNA, 19 nt, Mycobacterium bovis subsp bovis AF2122/97
gcgguguagggcggcguug

SEQ ID NO: 1034831 - RNA, 19 nt, Mycobacterium bovis subsp bovis AF2122/97
gcgguuggaucggcggccg

SEQ ID NO: 1034832 - RNA, 17 nt, Mycobacterium bovis subsp bovis AF2122/97
gcgguuguccggucgcc

SEQ ID NO: 1034833 - RNA, 16 nt, Mycobacterium bovis subsp bovis AF2122/97
gcgguuguccuccgac

SEQ ID NO: 1034834 - RNA, 15 nt, Mycobacterium bovis subsp bovis AF2122/97
gcgguugggcgaaau

SEQ ID NO: 1034835 - RNA, 17 nt, Mycobacterium bovis subsp bovis AF2122/97
gcgguugcccgagcggc

SEQ ID NO: 1034836 - RNA, 16 nt, Mycobacterium bovis subsp bovis AF2122/97
gcgguugccuucuugg

SEQ ID NO: 1034837 - RNA, 24 nt, Mycobacterium bovis subsp bovis AF2122/97
gcguaacuguggaaggugaucacg

SEQ ID NO: 1034838 - RNA, 16 nt, Mycobacterium bovis subsp bovis AF2122/97
gcgguuguccggucgc

SEQ ID NO: 1034839 - RNA, 20 nt, Mycobacterium bovis subsp bovis AF2122/97
gcguaauccgagcgcggcgg

SEQ ID NO: 1034840 - RNA, 21 nt, Mycobacterium bovis subsp bovis AF2122/97
gcguaauccgagcgcggcggc

SEQ ID NO: 1034841 - RNA, 22 nt, Mycobacterium bovis subsp bovis AF2122/97
gcguaauuuggcuugcgccgaa

SEQ ID NO: 1034842 - RNA, 23 nt, Mycobacterium bovis subsp bovis AF2122/97
gcguaauuuggcuugcgccgaaa

SEQ ID NO: 1034843 - RNA, 17 nt, Mycobacterium bovis subsp bovis AF2122/97
gcguacaaaccgucggg

SEQ ID NO: 1034844 - RNA, 17 nt, Mycobacterium bovis subsp bovis AF2122/97
gcuggcugggaaagcau

SEQ ID NO: 1034845 - RNA, 16 nt, Mycobacterium bovis subsp bovis AF2122/97
gcugggaaaucccgac

SEQ ID NO: 1034846 - RNA, 18 nt, Mycobacterium bovis subsp bovis AF2122/97
gcugggacccgagcagug

SEQ ID NO: 1034847 - RNA, 18 nt, Mycobacterium bovis subsp bovis AF2122/97
gcugggacgggcgcgucg

SEQ ID NO: 1034848 - RNA, 20 nt, Mycobacterium bovis subsp bovis AF2122/97
gcugggacgggcgcgucggc

SEQ ID NO: 1034849 - RNA, 21 nt, Mycobacterium bovis subsp bovis AF2122/97
gcuggcuguggcugaacaccg

SEQ ID NO: 1034850 - RNA, 20 nt, Mycobacterium bovis subsp bovis AF2122/97
gcugggaaaucccgaccacc

SEQ ID NO: 1034851 - RNA, 20 nt, Mycobacterium bovis subsp bovis AF2122/97
gcugggaagcucgguccaau

SEQ ID NO: 1034852 - RNA, 14 nt, Mycobacterium bovis subsp bovis AF2122/97
gcugggcaucaccg

SEQ ID NO: 1034853 - RNA, 22 nt, Mycobacterium bovis subsp bovis AF2122/97
gcugggcaucaccgacgcgucg

SEQ ID NO: 1034854 - RNA, 24 nt, Mycobacterium bovis subsp bovis AF2122/97
gcugggcaucaccgacgcgucggc

SEQ ID NO: 1034855 - RNA, 17 nt, Mycobacterium bovis subsp bovis AF2122/97
gcugggaggcgcggucg

SEQ ID NO: 1034856 - RNA, 17 nt, Mycobacterium bovis subsp bovis AF2122/97
gcugggagggaccaccc

SEQ ID NO: 1034857 - RNA, 21 nt, Mycobacterium bovis subsp bovis AF2122/97
gcugggauagcgcgguuggcu

SEQ ID NO: 1034858 - RNA, 13 nt, Mycobacterium bovis subsp bovis AF2122/97
gcugggucgccgu

SEQ ID NO: 1034859 - RNA, 16 nt, Mycobacterium bovis subsp bovis AF2122/97
gcugggucccgcuggc

SEQ ID NO: 1034860 - RNA, 12 nt, Mycobacterium bovis subsp bovis AF2122/97
gcugggugacca

SEQ ID NO: 1034861 - RNA, 14 nt, Mycobacterium bovis subsp bovis AF2122/97
gcugggugaccagg

SEQ ID NO: 1034862 - RNA, 15 nt, Mycobacterium bovis subsp bovis AF2122/97
gcugggugccgcagc

SEQ ID NO: 1034863 - RNA, 16 nt, Mycobacterium bovis subsp bovis AF2122/97
gcuggucaccaucacc

SEQ ID NO: 1034864 - RNA, 17 nt, Mycobacterium bovis subsp bovis AF2122/97
gcuggucaccaucaccg

SEQ ID NO: 1034865 - RNA, 21 nt, Mycobacterium bovis subsp bovis AF2122/97
gcuggucaagaaaggcaaccg

SEQ ID NO: 1034866 - RNA, 19 nt, Mycobacterium bovis subsp bovis AF2122/97
gcugguauagccggcgcag

SEQ ID NO: 1034867 - RNA, 22 nt, Mycobacterium bovis subsp bovis AF2122/97
gcugguauagcucacgguggcc

SEQ ID NO: 1034868 - RNA, 16 nt, Mycobacterium bovis subsp bovis AF2122/97
gcugguaucgagcacc

SEQ ID NO: 1034869 - RNA, 12 nt, Mycobacterium bovis subsp bovis AF2122/97
gcugguagcugc

SEQ ID NO: 1034870 - RNA, 15 nt, Mycobacterium bovis subsp bovis AF2122/97
gcugguaggucaccg

SEQ ID NO: 1034871 - RNA, 21 nt, Mycobacterium bovis subsp bovis AF2122/97
gcugguaggucaccggucacc

SEQ ID NO: 1034872 - RNA, 14 nt, Mycobacterium bovis subsp bovis AF2122/97
gcugcugcgcggug

SEQ ID NO: 1034873 - RNA, 16 nt, Mycobacterium bovis subsp bovis AF2122/97
gcugcugccguggcgg

SEQ ID NO: 1034874 - RNA, 17 nt, Mycobacterium bovis subsp bovis AF2122/97
gcugcugccguggcggc

SEQ ID NO: 1034875 - RNA, 15 nt, Mycobacterium bovis subsp bovis AF2122/97
gcugcugcgaucgcc

SEQ ID NO: 1034876 - RNA, 15 nt, Mycobacterium bovis subsp bovis AF2122/97
gcugcugccgcaccg

SEQ ID NO: 1034877 - RNA, 14 nt, Mycobacterium bovis subsp bovis AF2122/97
gcugcugccgcacc

SEQ ID NO: 1034878 - RNA, 13 nt, Mycobacterium bovis subsp bovis AF2122/97
gcugcugcagcaa

SEQ ID NO: 1034879 - RNA, 19 nt, Mycobacterium bovis subsp bovis AF2122/97
gcuggcgcugaugcuggcc

SEQ ID NO: 1034880 - RNA, 21 nt, Mycobacterium bovis subsp bovis AF2122/97
gcuggcgcugaugcuggccau

SEQ ID NO: 1034881 - RNA, 13 nt, Mycobacterium bovis subsp bovis AF2122/97
gcugcugcgcgag

SEQ ID NO: 1034882 - RNA, 18 nt, Mycobacterium bovis subsp bovis AF2122/97
gcuggcggccucgccggc

SEQ ID NO: 1034883 - RNA, 13 nt, Mycobacterium bovis subsp bovis AF2122/97
gcuggcggcgacc

SEQ ID NO: 1034884 - RNA, 16 nt, Mycobacterium bovis subsp bovis AF2122/97
gcuggcggccagcauc

SEQ ID NO: 1034885 - RNA, 18 nt, Mycobacterium bovis subsp bovis AF2122/97
gcuggcggccagcaucgg

SEQ ID NO: 1034886 - RNA, 17 nt, Mycobacterium bovis subsp bovis AF2122/97
gcuggcguucccgcucg

SEQ ID NO: 1034887 - RNA, 18 nt, Mycobacterium bovis subsp bovis AF2122/97
gcuggcguucccgcucgg

SEQ ID NO: 1034888 - RNA, 23 nt, Mycobacterium bovis subsp bovis AF2122/97
gcuggcguucccgcucggcuagu

SEQ ID NO: 1034889 - RNA, 12 nt, Mycobacterium bovis subsp bovis AF2122/97
gcuggcggcgcg

SEQ ID NO: 1034890 - RNA, 15 nt, Mycobacterium bovis subsp bovis AF2122/97
gcuggcggcgcgaca

SEQ ID NO: 1034891 - RNA, 14 nt, Mycobacterium bovis subsp bovis AF2122/97
gcuggcggcgcagc

SEQ ID NO: 1034892 - RNA, 22 nt, Mycobacterium bovis subsp bovis AF2122/97
gcuggcguuguugacgaucacc

SEQ ID NO: 1034893 - RNA, 17 nt, Mycobacterium bovis subsp bovis AF2122/97
gcuggcugacaccgauc

SEQ ID NO: 1034894 - RNA, 23 nt, Mycobacterium bovis subsp bovis AF2122/97
gcuggcugaccgaauggccgccg

SEQ ID NO: 1034895 - RNA, 16 nt, Mycobacterium bovis subsp bovis AF2122/97
gcuggcgcuuugggcu

SEQ ID NO: 1034896 - RNA, 15 nt, Mycobacterium bovis subsp bovis AF2122/97
gcuggcuacccaccg

SEQ ID NO: 1034897 - RNA, 18 nt, Mycobacterium bovis subsp bovis AF2122/97
gcugucgcaacgcaucga

SEQ ID NO: 1034898 - RNA, 22 nt, Mycobacterium bovis subsp bovis AF2122/97
gcugucgcccucgaucgccacg

SEQ ID NO: 1034899 - RNA, 14 nt, Mycobacterium bovis subsp bovis AF2122/97
gcugugcucgacga

SEQ ID NO: 1034900 - RNA, 18 nt, Mycobacterium bovis subsp bovis AF2122/97
gcugugcucacgagcaaa

SEQ ID NO: 1034901 - RNA, 17 nt, Mycobacterium bovis subsp bovis AF2122/97
gcuguggaucgacaccg

SEQ ID NO: 1034902 - RNA, 20 nt, Mycobacterium bovis subsp bovis AF2122/97
gcuguggccgccguaacucu

SEQ ID NO: 1034903 - RNA, 13 nt, Mycobacterium bovis subsp bovis AF2122/97
gcuguggcccgcg

SEQ ID NO: 1034904 - RNA, 19 nt, Mycobacterium bovis subsp bovis AF2122/97
gcuguggcccgucauacuc

SEQ ID NO: 1034905 - RNA, 22 nt, Mycobacterium bovis subsp bovis AF2122/97
gcugucccuauugaucuggcaa

SEQ ID NO: 1034906 - RNA, 17 nt, Mycobacterium bovis subsp bovis AF2122/97
gcuguccgaaccgacgu

SEQ ID NO: 1034907 - RNA, 20 nt, Mycobacterium bovis subsp bovis AF2122/97
gcuguccgaccucgccgcgc

SEQ ID NO: 1034908 - RNA, 15 nt, Mycobacterium bovis subsp bovis AF2122/97
gcugucgacgucggc

SEQ ID NO: 1034909 - RNA, 17 nt, Mycobacterium bovis subsp bovis AF2122/97
gcugucgagccggugcc

SEQ ID NO: 1034910 - RNA, 21 nt, Mycobacterium bovis subsp bovis AF2122/97
gcuguucggccaacccgggcc

SEQ ID NO: 1034911 - RNA, 19 nt, Mycobacterium bovis subsp bovis AF2122/97
gcuguucggucuugccggc

SEQ ID NO: 1034912 - RNA, 15 nt, Mycobacterium bovis subsp bovis AF2122/97
gcuguugaagccgcc

SEQ ID NO: 1034913 - RNA, 15 nt, Mycobacterium bovis subsp bovis AF2122/97
gcuguggcucgacga

SEQ ID NO: 1034914 - RNA, 21 nt, Mycobacterium bovis subsp bovis AF2122/97
gcugugcuucguugucggcgg

SEQ ID NO: 1034915 - RNA, 19 nt, Mycobacterium bovis subsp bovis AF2122/97
gcuguggcucgacgaugcg

SEQ ID NO: 1034916 - RNA, 17 nt, Mycobacterium bovis subsp bovis AF2122/97
gcuguggucgcugcugc

SEQ ID NO: 1034917 - RNA, 19 nt, Mycobacterium bovis subsp bovis AF2122/97
gcuguggucgcugcugccg

SEQ ID NO: 1034918 - RNA, 15 nt, Mycobacterium bovis subsp bovis AF2122/97
gcuguggucggugcc

SEQ ID NO: 1034919 - RNA, 20 nt, Mycobacterium bovis subsp bovis AF2122/97
gcuguggucggugccagcac

SEQ ID NO: 1034920 - RNA, 15 nt, Mycobacterium bovis subsp bovis AF2122/97
gcuggugugcgggug

SEQ ID NO: 1034921 - RNA, 17 nt, Mycobacterium bovis subsp bovis AF2122/97
gcuggugugcgggugug

SEQ ID NO: 1034922 - RNA, 17 nt, Mycobacterium bovis subsp bovis AF2122/97
gcugguguccagccagg

SEQ ID NO: 1034923 - RNA, 20 nt, Mycobacterium bovis subsp bovis AF2122/97
gcugguggcggucaccacgc

SEQ ID NO: 1034924 - RNA, 13 nt, Mycobacterium bovis subsp bovis AF2122/97
gcuggugggacgc

SEQ ID NO: 1034925 - RNA, 21 nt, Mycobacterium bovis subsp bovis AF2122/97
gcugguugccuuugcggcggg

SEQ ID NO: 1034926 - RNA, 18 nt, Mycobacterium bovis subsp bovis AF2122/97
gcuggucagguaucgggg

SEQ ID NO: 1034927 - RNA, 14 nt, Mycobacterium bovis subsp bovis AF2122/97
gcuggucagcggcg

SEQ ID NO: 1034928 - RNA, 14 nt, Mycobacterium bovis subsp bovis AF2122/97
gcugguccagccgg

SEQ ID NO: 1034929 - RNA, 14 nt, Mycobacterium bovis subsp bovis AF2122/97
gcuggucccacacc

SEQ ID NO: 1034930 - RNA, 18 nt, Mycobacterium bovis subsp bovis AF2122/97
gcugguggcggcgacacg

SEQ ID NO: 1034931 - RNA, 18 nt, Mycobacterium bovis subsp bovis AF2122/97
gcuguaccuccaggaucg

SEQ ID NO: 1034932 - RNA, 17 nt, Mycobacterium bovis subsp bovis AF2122/97
gcuguacccgaccagca

SEQ ID NO: 1034933 - RNA, 16 nt, Mycobacterium bovis subsp bovis AF2122/97
gcuguacccgaccagc

SEQ ID NO: 1034934 - RNA, 15 nt, Mycobacterium bovis subsp bovis AF2122/97
gcuguacaacgccgu

SEQ ID NO: 1034935 - RNA, 20 nt, Mycobacterium bovis subsp bovis AF2122/97
gcuguacaacgccgucgucg

SEQ ID NO: 1034936 - RNA, 14 nt, Mycobacterium bovis subsp bovis AF2122/97
gcugguuggcgccg

SEQ ID NO: 1034937 - RNA, 15 nt, Mycobacterium bovis subsp bovis AF2122/97
gcugguuggcgccga

SEQ ID NO: 1034938 - RNA, 22 nt, Mycobacterium bovis subsp bovis AF2122/97
gcugguuucggccgcauccccg

SEQ ID NO: 1034939 - RNA, 23 nt, Mycobacterium bovis subsp bovis AF2122/97
gcuguaacacccggccgccgaaa

SEQ ID NO: 1034940 - RNA, 18 nt, Mycobacterium bovis subsp bovis AF2122/97
gcuguacauacucugcga

SEQ ID NO: 1034941 - RNA, 16 nt, Mycobacterium bovis subsp bovis AF2122/97
gcuguacucgcggcgc

SEQ ID NO: 1034942 - RNA, 15 nt, Mycobacterium bovis subsp bovis AF2122/97
gcuguacugcggugc

SEQ ID NO: 1034943 - RNA, 15 nt, Mycobacterium bovis subsp bovis AF2122/97
gcugucccgcgggcc

SEQ ID NO: 1034944 - RNA, 18 nt, Mycobacterium bovis subsp bovis AF2122/97
gcugucccgcgggccagc

SEQ ID NO: 1034945 - RNA, 10 nt, Mycobacterium bovis subsp bovis AF2122/97
gcuuccgcgc

SEQ ID NO: 1034946 - RNA, 19 nt, Mycobacterium bovis subsp bovis AF2122/97
gcuuccauaacgacucgcg

SEQ ID NO: 1034947 - RNA, 15 nt, Mycobacterium bovis subsp bovis AF2122/97
gcuuccucgcgagcu

SEQ ID NO: 1034948 - RNA, 17 nt, Mycobacterium bovis subsp bovis AF2122/97
gcuuccuccgacgcgau

SEQ ID NO: 1034949 - RNA, 23 nt, Mycobacterium bovis subsp bovis AF2122/97
gcuuccgggacuaccacccgcag

SEQ ID NO: 1034950 - RNA, 20 nt, Mycobacterium bovis subsp bovis AF2122/97
gcuuccguggcccaacccgg

SEQ ID NO: 1034951 - RNA, 21 nt, Mycobacterium bovis subsp bovis AF2122/97
gcuuccggccauugcgggcuc

SEQ ID NO: 1034952 - RNA, 16 nt, Mycobacterium bovis subsp bovis AF2122/97
gcuucgaagcgaucgc

SEQ ID NO: 1034953 - RNA, 17 nt, Mycobacterium bovis subsp bovis AF2122/97
gcuucgaagcgaucgcc

SEQ ID NO: 1034954 - RNA, 12 nt, Mycobacterium bovis subsp bovis AF2122/97
gcuucgaccgcc

SEQ ID NO: 1034955 - RNA, 17 nt, Mycobacterium bovis subsp bovis AF2122/97
gcuucgacggcggccaa

SEQ ID NO: 1034956 - RNA, 20 nt, Mycobacterium bovis subsp bovis AF2122/97
gcuucgcccagagccgcugc

SEQ ID NO: 1034957 - RNA, 12 nt, Mycobacterium bovis subsp bovis AF2122/97
gcuucggcgucc

SEQ ID NO: 1034958 - RNA, 14 nt, Mycobacterium bovis subsp bovis AF2122/97
gcuucggcggucgc

SEQ ID NO: 1034959 - RNA, 20 nt, Mycobacterium bovis subsp bovis AF2122/97
gcuucgagguggcugcgccg

SEQ ID NO: 1034960 - RNA, 16 nt, Mycobacterium bovis subsp bovis AF2122/97
gcuucggcggucgccg

SEQ ID NO: 1034961 - RNA, 16 nt, Mycobacterium bovis subsp bovis AF2122/97
gcuucggugacccggg

SEQ ID NO: 1034962 - RNA, 17 nt, Mycobacterium bovis subsp bovis AF2122/97
gcuucguccaccgcgau

SEQ ID NO: 1034963 - RNA, 23 nt, Mycobacterium bovis subsp bovis AF2122/97
gcuucguccagcgaucccgguga

SEQ ID NO: 1034964 - RNA, 12 nt, Mycobacterium bovis subsp bovis AF2122/97
gcuucggcggcc

SEQ ID NO: 1034965 - RNA, 11 nt, Mycobacterium bovis subsp bovis AF2122/97
gcuucggcgag

SEQ ID NO: 1034966 - RNA, 15 nt, Mycobacterium bovis subsp bovis AF2122/97
gcuucggcgaacccu

SEQ ID NO: 1034967 - RNA, 20 nt, Mycobacterium bovis subsp bovis AF2122/97
gcuucggcagaccggcaucg

SEQ ID NO: 1034968 - RNA, 19 nt, Mycobacterium bovis subsp bovis AF2122/97
gcuucggcggucagcggcu

SEQ ID NO: 1034969 - RNA, 21 nt, Mycobacterium bovis subsp bovis AF2122/97
gcuucgcuuuugaaccggguc

SEQ ID NO: 1034970 - RNA, 22 nt, Mycobacterium bovis subsp bovis AF2122/97
gcuucggagaccgccucgucga

SEQ ID NO: 1034971 - RNA, 15 nt, Mycobacterium bovis subsp bovis AF2122/97
gcuucgucggccagc

SEQ ID NO: 1034972 - RNA, 21 nt, Mycobacterium bovis subsp bovis AF2122/97
gcuucguggcggcgcgcgcug

SEQ ID NO: 1034973 - RNA, 14 nt, Mycobacterium bovis subsp bovis AF2122/97
gcuuagcgcgggcc

SEQ ID NO: 1034974 - RNA, 18 nt, Mycobacterium bovis subsp bovis AF2122/97
gcuuagcgcgggccuggc

SEQ ID NO: 1034975 - RNA, 20 nt, Mycobacterium bovis subsp bovis AF2122/97
gcuuagcugccgucggugcc

SEQ ID NO: 1034976 - RNA, 15 nt, Mycobacterium bovis subsp bovis AF2122/97
gcuuaugcacgacgg

SEQ ID NO: 1034977 - RNA, 21 nt, Mycobacterium bovis subsp bovis AF2122/97
gcuuaugcgucugcucgccgg

SEQ ID NO: 1034978 - RNA, 20 nt, Mycobacterium bovis subsp bovis AF2122/97
gcuuauguguccgcucgccg

SEQ ID NO: 1034979 - RNA, 19 nt, Mycobacterium bovis subsp bovis AF2122/97
gcuuaugcgucugcucgcc

SEQ ID NO: 1034980 - RNA, 20 nt, Mycobacterium bovis subsp bovis AF2122/97
gcuuaugcgucugcucgccg

SEQ ID NO: 1034981 - RNA, 13 nt, Mycobacterium bovis subsp bovis AF2122/97
gcuuagcaaucgg

SEQ ID NO: 1034982 - RNA, 22 nt, Mycobacterium bovis subsp bovis AF2122/97
gcuguugacccguacccacgac

SEQ ID NO: 1034983 - RNA, 15 nt, Mycobacterium bovis subsp bovis AF2122/97
gcuguugacgccacg

SEQ ID NO: 1034984 - RNA, 19 nt, Mycobacterium bovis subsp bovis AF2122/97
gcuguugacgccacgacgc

SEQ ID NO: 1034985 - RNA, 15 nt, Mycobacterium bovis subsp bovis AF2122/97
gcuuaccggcgggcg

SEQ ID NO: 1034986 - RNA, 22 nt, Mycobacterium bovis subsp bovis AF2122/97
gcuuaaggcccuggccgcgccg

SEQ ID NO: 1034987 - RNA, 18 nt, Mycobacterium bovis subsp bovis AF2122/97
gcuucacccaaccccgcc

SEQ ID NO: 1034988 - RNA, 14 nt, Mycobacterium bovis subsp bovis AF2122/97
gcuucagcacgcgg

SEQ ID NO: 1034989 - RNA, 21 nt, Mycobacterium bovis subsp bovis AF2122/97
gcuucagcacgguguacgccc

SEQ ID NO: 1034990 - RNA, 24 nt, Mycobacterium bovis subsp bovis AF2122/97
gcuucacagccaccagccgggcaa

SEQ ID NO: 1034991 - RNA, 18 nt, Mycobacterium bovis subsp bovis AF2122/97
gcuucaacaccggcaucg

SEQ ID NO: 1034992 - RNA, 13 nt, Mycobacterium bovis subsp bovis AF2122/97
gcuucaacccggg

SEQ ID NO: 1034993 - RNA, 16 nt, Mycobacterium bovis subsp bovis AF2122/97
gcuuccagggcgacgg

SEQ ID NO: 1034994 - RNA, 20 nt, Mycobacterium bovis subsp bovis AF2122/97
gcuucauagguucgguaguc

SEQ ID NO: 1034995 - RNA, 16 nt, Mycobacterium bovis subsp bovis AF2122/97
gcuuccaacaccaacg

SEQ ID NO: 1034996 - RNA, 19 nt, Mycobacterium bovis subsp bovis AF2122/97
gcuuccaacucggcggcca

SEQ ID NO: 1034997 - RNA, 16 nt, Mycobacterium bovis subsp bovis AF2122/97
gcuucaggcaucaccg

SEQ ID NO: 1034998 - RNA, 17 nt, Mycobacterium bovis subsp bovis AF2122/97
ggacgggaugcuugguc

SEQ ID NO: 1034999 - RNA, 22 nt, Mycobacterium bovis subsp bovis AF2122/97
ggacggcuugagccgcagcacc

SEQ ID NO: 1035000 - RNA, 17 nt, Mycobacterium bovis subsp bovis AF2122/97
ggacgggcgcgucggcg

SEQ ID NO: 1035001 - RNA, 13 nt, Mycobacterium bovis subsp bovis AF2122/97
ggacgggucggca

SEQ ID NO: 1035002 - RNA, 20 nt, Mycobacterium bovis subsp bovis AF2122/97
ggacgggggcuguccaccga

SEQ ID NO: 1035003 - RNA, 19 nt, Mycobacterium bovis subsp bovis AF2122/97
ggacgggggcuguccaccg

SEQ ID NO: 1035004 - RNA, 22 nt, Mycobacterium bovis subsp bovis AF2122/97
ggacggucauccggccgucggc

SEQ ID NO: 1035005 - RNA, 13 nt, Mycobacterium bovis subsp bovis AF2122/97
ggacggucgccag

SEQ ID NO: 1035006 - RNA, 12 nt, Mycobacterium bovis subsp bovis AF2122/97
ggacggucgcca

SEQ ID NO: 1035007 - RNA, 19 nt, Mycobacterium bovis subsp bovis AF2122/97
ggacgguugguccgccguc

SEQ ID NO: 1035008 - RNA, 20 nt, Mycobacterium bovis subsp bovis AF2122/97
ggacgucaccgucaguucgg

SEQ ID NO: 1035009 - RNA, 21 nt, Mycobacterium bovis subsp bovis AF2122/97
ggacgguguacaggucgccgg

SEQ ID NO: 1035010 - RNA, 20 nt, Mycobacterium bovis subsp bovis AF2122/97
ggacguacugucgucgcccu

SEQ ID NO: 1035011 - RNA, 21 nt, Mycobacterium bovis subsp bovis AF2122/97
ggacguaggcaccccggugcc

SEQ ID NO: 1035012 - RNA, 15 nt, Mycobacterium bovis subsp bovis AF2122/97
ggacgucggcgaauc

SEQ ID NO: 1035013 - RNA, 18 nt, Mycobacterium bovis subsp bovis AF2122/97
ggacgucgugaccggcgg

SEQ ID NO: 1035014 - RNA, 20 nt, Mycobacterium bovis subsp bovis AF2122/97
ggacgugaccagaucgacgc

SEQ ID NO: 1035015 - RNA, 13 nt, Mycobacterium bovis subsp bovis AF2122/97
ggacggcaccggc

SEQ ID NO: 1035016 - RNA, 19 nt, Mycobacterium bovis subsp bovis AF2122/97
ggacggcagccaccagcga

SEQ ID NO: 1035017 - RNA, 17 nt, Mycobacterium bovis subsp bovis AF2122/97
ggacggcagccgggcgg

SEQ ID NO: 1035018 - RNA, 21 nt, Mycobacterium bovis subsp bovis AF2122/97
ggacggagcccaaaaccgcga

SEQ ID NO: 1035019 - RNA, 16 nt, Mycobacterium bovis subsp bovis AF2122/97
ggacggccaucgccag

SEQ ID NO: 1035020 - RNA, 16 nt, Mycobacterium bovis subsp bovis AF2122/97
ggacggauaguucacc

SEQ ID NO: 1035021 - RNA, 17 nt, Mycobacterium bovis subsp bovis AF2122/97
ggacggccaacagggcg

SEQ ID NO: 1035022 - RNA, 13 nt, Mycobacterium bovis subsp bovis AF2122/97
ggacggcaggcgg

SEQ ID NO: 1035023 - RNA, 14 nt, Mycobacterium bovis subsp bovis AF2122/97
ggacggcaggcggc

SEQ ID NO: 1035024 - RNA, 14 nt, Mycobacterium bovis subsp bovis AF2122/97
ggacggcgggccgc

SEQ ID NO: 1035025 - RNA, 16 nt, Mycobacterium bovis subsp bovis AF2122/97
ggacggcgggccgcgc

SEQ ID NO: 1035026 - RNA, 16 nt, Mycobacterium bovis subsp bovis AF2122/97
ggacggcguagacguc

SEQ ID NO: 1035027 - RNA, 22 nt, Mycobacterium bovis subsp bovis AF2122/97
ggacgggaguugaucuccacgg

SEQ ID NO: 1035028 - RNA, 15 nt, Mycobacterium bovis subsp bovis AF2122/97
ggacggcgcgagccg

SEQ ID NO: 1035029 - RNA, 18 nt, Mycobacterium bovis subsp bovis AF2122/97
ggacggcuaccaccgcac

SEQ ID NO: 1035030 - RNA, 22 nt, Mycobacterium bovis subsp bovis AF2122/97
ggacgcugauugcgaccgcgcc

SEQ ID NO: 1035031 - RNA, 12 nt, Mycobacterium bovis subsp bovis AF2122/97
ggacgcugccgc

SEQ ID NO: 1035032 - RNA, 15 nt, Mycobacterium bovis subsp bovis AF2122/97
ggacgcugccggugu

SEQ ID NO: 1035033 - RNA, 14 nt, Mycobacterium bovis subsp bovis AF2122/97
ggacgcgccggcgu

SEQ ID NO: 1035034 - RNA, 21 nt, Mycobacterium bovis subsp bovis AF2122/97
ggacgcgcauuucaccggggc

SEQ ID NO: 1035035 - RNA, 12 nt, Mycobacterium bovis subsp bovis AF2122/97
ggacgcgggccg

SEQ ID NO: 1035036 - RNA, 16 nt, Mycobacterium bovis subsp bovis AF2122/97
ggacgcgcagcaucgg

SEQ ID NO: 1035037 - RNA, 18 nt, Mycobacterium bovis subsp bovis AF2122/97
ggacgcgcagcaucggcg

SEQ ID NO: 1035038 - RNA, 17 nt, Mycobacterium bovis subsp bovis AF2122/97
ggacuaccgccggcggc

SEQ ID NO: 1035039 - RNA, 20 nt, Mycobacterium bovis subsp bovis AF2122/97
ggacguuugagaccccaacc

SEQ ID NO: 1035040 - RNA, 15 nt, Mycobacterium bovis subsp bovis AF2122/97
ggacucacgcagcgc

SEQ ID NO: 1035041 - RNA, 20 nt, Mycobacterium bovis subsp bovis AF2122/97
ggacgugguguaucgacggc

SEQ ID NO: 1035042 - RNA, 22 nt, Mycobacterium bovis subsp bovis AF2122/97
ggacgugguguaucgacggcgg

SEQ ID NO: 1035043 - RNA, 11 nt, Mycobacterium bovis subsp bovis AF2122/97
ggacgugcagc

SEQ ID NO: 1035044 - RNA, 19 nt, Mycobacterium bovis subsp bovis AF2122/97
ggacguuguccaccgccac

SEQ ID NO: 1035045 - RNA, 14 nt, Mycobacterium bovis subsp bovis AF2122/97
ggacuaccacccgc

SEQ ID NO: 1035046 - RNA, 14 nt, Mycobacterium bovis subsp bovis AF2122/97
ggacucaucggcgu

SEQ ID NO: 1035047 - RNA, 14 nt, Mycobacterium bovis subsp bovis AF2122/97
ggacuccggccgca

SEQ ID NO: 1035048 - RNA, 17 nt, Mycobacterium bovis subsp bovis AF2122/97
ggacuccggucagcgcg

SEQ ID NO: 1035049 - RNA, 23 nt, Mycobacterium bovis subsp bovis AF2122/97
ggacucugccacccagcacgcgc

SEQ ID NO: 1035050 - RNA, 14 nt, Mycobacterium bovis subsp bovis AF2122/97
ggacugcagcgcgg

SEQ ID NO: 1035051 - RNA, 16 nt, Mycobacterium bovis subsp bovis AF2122/97
ggacugcagcgcggug

SEQ ID NO: 1035052 - RNA, 20 nt, Mycobacterium bovis subsp bovis AF2122/97
ggacucggcggaagaccgga

SEQ ID NO: 1035053 - RNA, 16 nt, Mycobacterium bovis subsp bovis AF2122/97
ggagaaggcgaccaag

SEQ ID NO: 1035054 - RNA, 22 nt, Mycobacterium bovis subsp bovis AF2122/97
ggagacacccgccaggccgcgc

SEQ ID NO: 1035055 - RNA, 19 nt, Mycobacterium bovis subsp bovis AF2122/97
ggagaccgcggccggccgu

SEQ ID NO: 1035056 - RNA, 20 nt, Mycobacterium bovis subsp bovis AF2122/97
ggacugggccaggucggcga

SEQ ID NO: 1035057 - RNA, 18 nt, Mycobacterium bovis subsp bovis AF2122/97
ggacuggcaccgccagcc

SEQ ID NO: 1035058 - RNA, 23 nt, Mycobacterium bovis subsp bovis AF2122/97
ggacugcggaacaccagcaggcg

SEQ ID NO: 1035059 - RNA, 21 nt, Mycobacterium bovis subsp bovis AF2122/97
ggacugcggucuggacaucgg

SEQ ID NO: 1035060 - RNA, 22 nt, Mycobacterium bovis subsp bovis AF2122/97
ggacuucggugagcagggcggc

SEQ ID NO: 1035061 - RNA, 19 nt, Mycobacterium bovis subsp bovis AF2122/97
ggagaaaacggcggcgccg

SEQ ID NO: 1035062 - RNA, 17 nt, Mycobacterium bovis subsp bovis AF2122/97
ggacuugauaucggcgg

SEQ ID NO: 1035063 - RNA, 14 nt, Mycobacterium bovis subsp bovis AF2122/97
ggacuuuccggcgc

SEQ ID NO: 1035064 - RNA, 15 nt, Mycobacterium bovis subsp bovis AF2122/97
ggacuuuccggcgca

SEQ ID NO: 1035065 - RNA, 16 nt, Mycobacterium bovis subsp bovis AF2122/97
ggacuuuccggcgcag

SEQ ID NO: 1035066 - RNA, 13 nt, Mycobacterium bovis subsp bovis AF2122/97
ggacccagcggcg

SEQ ID NO: 1035067 - RNA, 16 nt, Mycobacterium bovis subsp bovis AF2122/97
ggaccauuaccguggg

SEQ ID NO: 1035068 - RNA, 14 nt, Mycobacterium bovis subsp bovis AF2122/97
ggacccacccgcac

SEQ ID NO: 1035069 - RNA, 15 nt, Mycobacterium bovis subsp bovis AF2122/97
ggacccacccgcacc

SEQ ID NO: 1035070 - RNA, 19 nt, Mycobacterium bovis subsp bovis AF2122/97
ggacccacccgcaccgccg

SEQ ID NO: 1035071 - RNA, 22 nt, Mycobacterium bovis subsp bovis AF2122/97
ggacccacccgcaccgccggca

SEQ ID NO: 1035072 - RNA, 16 nt, Mycobacterium bovis subsp bovis AF2122/97
ggacccgcagcugcgg

SEQ ID NO: 1035073 - RNA, 12 nt, Mycobacterium bovis subsp bovis AF2122/97
ggacccgccagg

SEQ ID NO: 1035074 - RNA, 18 nt, Mycobacterium bovis subsp bovis AF2122/97
ggaccccgcugcgacguu

SEQ ID NO: 1035075 - RNA, 24 nt, Mycobacterium bovis subsp bovis AF2122/97
ggacccagccagcuggacuccggu

SEQ ID NO: 1035076 - RNA, 21 nt, Mycobacterium bovis subsp bovis AF2122/97
ggaccgcggugacccggaagc

SEQ ID NO: 1035077 - RNA, 22 nt, Mycobacterium bovis subsp bovis AF2122/97
ggaccgcucgaugucccgagcc

SEQ ID NO: 1035078 - RNA, 14 nt, Mycobacterium bovis subsp bovis AF2122/97
ggaccgcucgucgc

SEQ ID NO: 1035079 - RNA, 17 nt, Mycobacterium bovis subsp bovis AF2122/97
ggaccgcggucauggcg

SEQ ID NO: 1035080 - RNA, 20 nt, Mycobacterium bovis subsp bovis AF2122/97
ggaccgcucgucgccggugg

SEQ ID NO: 1035081 - RNA, 15 nt, Mycobacterium bovis subsp bovis AF2122/97
ggacgcacgauccgc

SEQ ID NO: 1035082 - RNA, 18 nt, Mycobacterium bovis subsp bovis AF2122/97
ggacgcacgauccgcacc

SEQ ID NO: 1035083 - RNA, 12 nt, Mycobacterium bovis subsp bovis AF2122/97
ggacgccacgga

SEQ ID NO: 1035084 - RNA, 20 nt, Mycobacterium bovis subsp bovis AF2122/97
ggacgccccgucuggcauga

SEQ ID NO: 1035085 - RNA, 21 nt, Mycobacterium bovis subsp bovis AF2122/97
ggacgcccgcccgcacgacga

SEQ ID NO: 1035086 - RNA, 19 nt, Mycobacterium bovis subsp bovis AF2122/97
ggaccgggucgggcaccgc

SEQ ID NO: 1035087 - RNA, 12 nt, Mycobacterium bovis subsp bovis AF2122/97
ggaccggcaggc

SEQ ID NO: 1035088 - RNA, 11 nt, Mycobacterium bovis subsp bovis AF2122/97
ggaccggucga

SEQ ID NO: 1035089 - RNA, 17 nt, Mycobacterium bovis subsp bovis AF2122/97
ggacgauacgcgcaccg

SEQ ID NO: 1035090 - RNA, 16 nt, Mycobacterium bovis subsp bovis AF2122/97
ggacgauaccgggcua

SEQ ID NO: 1035091 - RNA, 16 nt, Mycobacterium bovis subsp bovis AF2122/97
ggacgauacgcgcacc

SEQ ID NO: 1035092 - RNA, 15 nt, Mycobacterium bovis subsp bovis AF2122/97
ggacgaugaugauca

SEQ ID NO: 1035093 - RNA, 20 nt, Mycobacterium bovis subsp bovis AF2122/97
ggaccagcgccggaccgucu

SEQ ID NO: 1035094 - RNA, 13 nt, Mycobacterium bovis subsp bovis AF2122/97
ggacauccggcgc

SEQ ID NO: 1035095 - RNA, 22 nt, Mycobacterium bovis subsp bovis AF2122/97
ggacauccgggccgagcgcacc

SEQ ID NO: 1035096 - RNA, 16 nt, Mycobacterium bovis subsp bovis AF2122/97
ggacauccagugcggu

SEQ ID NO: 1035097 - RNA, 15 nt, Mycobacterium bovis subsp bovis AF2122/97
ggacaguuccccggg

SEQ ID NO: 1035098 - RNA, 14 nt, Mycobacterium bovis subsp bovis AF2122/97
ggacauaccggccc

SEQ ID NO: 1035099 - RNA, 17 nt, Mycobacterium bovis subsp bovis AF2122/97
ggaccaggccaacggcg

SEQ ID NO: 1035100 - RNA, 16 nt, Mycobacterium bovis subsp bovis AF2122/97
ggaccaggccgcgcgc

SEQ ID NO: 1035101 - RNA, 17 nt, Mycobacterium bovis subsp bovis AF2122/97
ggaccauagucgccguc

SEQ ID NO: 1035102 - RNA, 19 nt, Mycobacterium bovis subsp bovis AF2122/97
ggaccauagucgccgucgu

SEQ ID NO: 1035103 - RNA, 18 nt, Mycobacterium bovis subsp bovis AF2122/97
ggaccaucagcgucgacg

SEQ ID NO: 1035104 - RNA, 19 nt, Mycobacterium bovis subsp bovis AF2122/97
ggaccaucagcgucgacgu

SEQ ID NO: 1035105 - RNA, 17 nt, Mycobacterium bovis subsp bovis AF2122/97
ggaccaucgacaacgcc

SEQ ID NO: 1035106 - RNA, 17 nt, Mycobacterium bovis subsp bovis AF2122/97
ggaccaucgccaggccc

SEQ ID NO: 1035107 - RNA, 15 nt, Mycobacterium bovis subsp bovis AF2122/97
ggacagggcggcgag

SEQ ID NO: 1035108 - RNA, 14 nt, Mycobacterium bovis subsp bovis AF2122/97
ggacagggugcgcu

SEQ ID NO: 1035109 - RNA, 21 nt, Mycobacterium bovis subsp bovis AF2122/97
ggacaggucgcccaacaccgc

SEQ ID NO: 1035110 - RNA, 18 nt, Mycobacterium bovis subsp bovis AF2122/97
ggacagguaacgcgguuc

SEQ ID NO: 1035111 - RNA, 20 nt, Mycobacterium bovis subsp bovis AF2122/97
ggacaggucggggcgucguu

SEQ ID NO: 1035112 - RNA, 18 nt, Mycobacterium bovis subsp bovis AF2122/97
ggaauuccccaccgucgu

SEQ ID NO: 1035113 - RNA, 11 nt, Mycobacterium bovis subsp bovis AF2122/97
ggaaugucgaa

SEQ ID NO: 1035114 - RNA, 19 nt, Mycobacterium bovis subsp bovis AF2122/97
ggaaugucgaaacccacgu

SEQ ID NO: 1035115 - RNA, 17 nt, Mycobacterium bovis subsp bovis AF2122/97
ggaauucgaucuggcgg

SEQ ID NO: 1035116 - RNA, 22 nt, Mycobacterium bovis subsp bovis AF2122/97
ggacaaaaucagcagcccccgc

SEQ ID NO: 1035117 - RNA, 24 nt, Mycobacterium bovis subsp bovis AF2122/97
ggacaaagacgccgucggcgccgg

SEQ ID NO: 1035118 - RNA, 16 nt, Mycobacterium bovis subsp bovis AF2122/97
ggacaaagccgucgcg

SEQ ID NO: 1035119 - RNA, 21 nt, Mycobacterium bovis subsp bovis AF2122/97
ggacaaagccgucgcgacguc

SEQ ID NO: 1035120 - RNA, 12 nt, Mycobacterium bovis subsp bovis AF2122/97
ggaaugccgcgg

SEQ ID NO: 1035121 - RNA, 16 nt, Mycobacterium bovis subsp bovis AF2122/97
ggaaugccgucgccgg

SEQ ID NO: 1035122 - RNA, 15 nt, Mycobacterium bovis subsp bovis AF2122/97
ggaaugggaccgggc

SEQ ID NO: 1035123 - RNA, 17 nt, Mycobacterium bovis subsp bovis AF2122/97
ggaaugggcgccacagc

SEQ ID NO: 1035124 - RNA, 14 nt, Mycobacterium bovis subsp bovis AF2122/97
ggaaugcuggggcc

SEQ ID NO: 1035125 - RNA, 14 nt, Mycobacterium bovis subsp bovis AF2122/97
ggaaugaucggcgu

SEQ ID NO: 1035126 - RNA, 17 nt, Mycobacterium bovis subsp bovis AF2122/97
ggaagauguugccgccg

SEQ ID NO: 1035127 - RNA, 14 nt, Mycobacterium bovis subsp bovis AF2122/97
ggaagaucucggcc

SEQ ID NO: 1035128 - RNA, 23 nt, Mycobacterium bovis subsp bovis AF2122/97
ggaagaucaccucccgcggcacc

SEQ ID NO: 1035129 - RNA, 20 nt, Mycobacterium bovis subsp bovis AF2122/97
ggaacuugccggugcgcacc

SEQ ID NO: 1035130 - RNA, 12 nt, Mycobacterium bovis subsp bovis AF2122/97
ggaagccgccgg

SEQ ID NO: 1035131 - RNA, 11 nt, Mycobacterium bovis subsp bovis AF2122/97
ggaagccgcac

SEQ ID NO: 1035132 - RNA, 23 nt, Mycobacterium bovis subsp bovis AF2122/97
ggaagccgaccuucucggcguac

SEQ ID NO: 1035133 - RNA, 21 nt, Mycobacterium bovis subsp bovis AF2122/97
ggaagcccgaugcgccaccgg

SEQ ID NO: 1035134 - RNA, 21 nt, Mycobacterium bovis subsp bovis AF2122/97
ggaagccgaccuucucggcgu

SEQ ID NO: 1035135 - RNA, 15 nt, Mycobacterium bovis subsp bovis AF2122/97
ggaagcagacuccgg

SEQ ID NO: 1035136 - RNA, 17 nt, Mycobacterium bovis subsp bovis AF2122/97
ggaagcccacgaucgcg

SEQ ID NO: 1035137 - RNA, 20 nt, Mycobacterium bovis subsp bovis AF2122/97
ggaagcgccaaacccggcgg

SEQ ID NO: 1035138 - RNA, 16 nt, Mycobacterium bovis subsp bovis AF2122/97
ggaagcgccggccgau

SEQ ID NO: 1035139 - RNA, 17 nt, Mycobacterium bovis subsp bovis AF2122/97
ggaagcgggcgaugccg

SEQ ID NO: 1035140 - RNA, 19 nt, Mycobacterium bovis subsp bovis AF2122/97
ggaagcggcggcaaccccg

SEQ ID NO: 1035141 - RNA, 18 nt, Mycobacterium bovis subsp bovis AF2122/97
ggaagcgggauugccgag

SEQ ID NO: 1035142 - RNA, 16 nt, Mycobacterium bovis subsp bovis AF2122/97
ggaagccgacgaccag

SEQ ID NO: 1035143 - RNA, 13 nt, Mycobacterium bovis subsp bovis AF2122/97
ggaagucgggccg

SEQ ID NO: 1035144 - RNA, 12 nt, Mycobacterium bovis subsp bovis AF2122/97
ggaagugcggug

SEQ ID NO: 1035145 - RNA, 16 nt, Mycobacterium bovis subsp bovis AF2122/97
ggaagugcggugagau

SEQ ID NO: 1035146 - RNA, 20 nt, Mycobacterium bovis subsp bovis AF2122/97
ggaagugcggugagauggcg

SEQ ID NO: 1035147 - RNA, 17 nt, Mycobacterium bovis subsp bovis AF2122/97
ggaauacgcgccgccgg

SEQ ID NO: 1035148 - RNA, 13 nt, Mycobacterium bovis subsp bovis AF2122/97
ggaaccaccagca

SEQ ID NO: 1035149 - RNA, 19 nt, Mycobacterium bovis subsp bovis AF2122/97
ggaaccaccagcacggcga

SEQ ID NO: 1035150 - RNA, 22 nt, Mycobacterium bovis subsp bovis AF2122/97
ggaaccaccaguaccaccggca

SEQ ID NO: 1035151 - RNA, 23 nt, Mycobacterium bovis subsp bovis AF2122/97
ggaaccagcguaucggccggcag

SEQ ID NO: 1035152 - RNA, 15 nt, Mycobacterium bovis subsp bovis AF2122/97
ggaaccacggcgcag

SEQ ID NO: 1035153 - RNA, 21 nt, Mycobacterium bovis subsp bovis AF2122/97
ggaacccccagcugcagggcg

SEQ ID NO: 1035154 - RNA, 17 nt, Mycobacterium bovis subsp bovis AF2122/97
ggaaccccgagcugcca

SEQ ID NO: 1035155 - RNA, 21 nt, Mycobacterium bovis subsp bovis AF2122/97
ggaacccacaguggcucgcgg

SEQ ID NO: 1035156 - RNA, 16 nt, Mycobacterium bovis subsp bovis AF2122/97
ggaacuggaccggugc

SEQ ID NO: 1035157 - RNA, 16 nt, Mycobacterium bovis subsp bovis AF2122/97
ggaaccccggccacug

SEQ ID NO: 1035158 - RNA, 19 nt, Mycobacterium bovis subsp bovis AF2122/97
ggaacccgaaucccacagc

SEQ ID NO: 1035159 - RNA, 19 nt, Mycobacterium bovis subsp bovis AF2122/97
ggaacaucgucaucgacga

SEQ ID NO: 1035160 - RNA, 15 nt, Mycobacterium bovis subsp bovis AF2122/97
ggaacagcuucgcgc

SEQ ID NO: 1035161 - RNA, 15 nt, Mycobacterium bovis subsp bovis AF2122/97
ggaacaccagcaggc

SEQ ID NO: 1035162 - RNA, 17 nt, Mycobacterium bovis subsp bovis AF2122/97
ggaacaccagcaggcgg

SEQ ID NO: 1035163 - RNA, 19 nt, Mycobacterium bovis subsp bovis AF2122/97
ggaacacgaugcgcggugc

SEQ ID NO: 1035164 - RNA, 21 nt, Mycobacterium bovis subsp bovis AF2122/97
ggaacaccaccaggcugucgu

SEQ ID NO: 1035165 - RNA, 18 nt, Mycobacterium bovis subsp bovis AF2122/97
ggaacaacgcgcaaccag

SEQ ID NO: 1035166 - RNA, 17 nt, Mycobacterium bovis subsp bovis AF2122/97
ggaaauuucaguucggc

SEQ ID NO: 1035167 - RNA, 19 nt, Mycobacterium bovis subsp bovis AF2122/97
ggaaauuccggcgcggccg

SEQ ID NO: 1035168 - RNA, 22 nt, Mycobacterium bovis subsp bovis AF2122/97
ggaaauggcgucgccggcaccg

SEQ ID NO: 1035169 - RNA, 23 nt, Mycobacterium bovis subsp bovis AF2122/97
ggaaaugaccuccuggcaaccga

SEQ ID NO: 1035170 - RNA, 17 nt, Mycobacterium bovis subsp bovis AF2122/97
ggaaaucggacgacucg

SEQ ID NO: 1035171 - RNA, 15 nt, Mycobacterium bovis subsp bovis AF2122/97
ggaaagcagcagcgg

SEQ ID NO: 1035172 - RNA, 18 nt, Mycobacterium bovis subsp bovis AF2122/97
ggaaagcagcagcggcgg

SEQ ID NO: 1035173 - RNA, 12 nt, Mycobacterium bovis subsp bovis AF2122/97
ggaaacgccagg

SEQ ID NO: 1035174 - RNA, 17 nt, Mycobacterium bovis subsp bovis AF2122/97
ggaaagcccgcucggau

SEQ ID NO: 1035175 - RNA, 14 nt, Mycobacterium bovis subsp bovis AF2122/97
ggaaagggccgccg

SEQ ID NO: 1035176 - RNA, 17 nt, Mycobacterium bovis subsp bovis AF2122/97
ggaaaggcgccggucgc

SEQ ID NO: 1035177 - RNA, 19 nt, Mycobacterium bovis subsp bovis AF2122/97
ggaaagcucuugcacucgg

SEQ ID NO: 1035178 - RNA, 16 nt, Mycobacterium bovis subsp bovis AF2122/97
ggaaacccggccagcu

SEQ ID NO: 1035179 - RNA, 17 nt, Mycobacterium bovis subsp bovis AF2122/97
ggaaacccggccgccga

SEQ ID NO: 1035180 - RNA, 13 nt, Mycobacterium bovis subsp bovis AF2122/97
ggaaaccgccccg

SEQ ID NO: 1035181 - RNA, 12 nt, Mycobacterium bovis subsp bovis AF2122/97
ggaaacccgccg

SEQ ID NO: 1035182 - RNA, 20 nt, Mycobacterium bovis subsp bovis AF2122/97
ggaaaaugauagcggcgcag

SEQ ID NO: 1035183 - RNA, 21 nt, Mycobacterium bovis subsp bovis AF2122/97
ggaaacaucguucugacggcu

SEQ ID NO: 1035184 - RNA, 13 nt, Mycobacterium bovis subsp bovis AF2122/97
gcuuuggccgccg

SEQ ID NO: 1035185 - RNA, 17 nt, Mycobacterium bovis subsp bovis AF2122/97
gcuuugacgcccucggc

SEQ ID NO: 1035186 - RNA, 19 nt, Mycobacterium bovis subsp bovis AF2122/97
gcuuugcacagcggcaucg

SEQ ID NO: 1035187 - RNA, 17 nt, Mycobacterium bovis subsp bovis AF2122/97
gcuucuuccgcgcgccg

SEQ ID NO: 1035188 - RNA, 21 nt, Mycobacterium bovis subsp bovis AF2122/97
gcuucuuaccgcgggccgcca

SEQ ID NO: 1035189 - RNA, 16 nt, Mycobacterium bovis subsp bovis AF2122/97
gcuugucgggcaccgg

SEQ ID NO: 1035190 - RNA, 17 nt, Mycobacterium bovis subsp bovis AF2122/97
gcuugaacagcugaucc

SEQ ID NO: 1035191 - RNA, 15 nt, Mycobacterium bovis subsp bovis AF2122/97
gcuugacaucgguca

SEQ ID NO: 1035192 - RNA, 18 nt, Mycobacterium bovis subsp bovis AF2122/97
gcuugucgccccaugcgg

SEQ ID NO: 1035193 - RNA, 16 nt, Mycobacterium bovis subsp bovis AF2122/97
gcuuguugcgcgacgc

SEQ ID NO: 1035194 - RNA, 14 nt, Mycobacterium bovis subsp bovis AF2122/97
gcuugugggcgacg

SEQ ID NO: 1035195 - RNA, 15 nt, Mycobacterium bovis subsp bovis AF2122/97
gcuugugggcgacgg

SEQ ID NO: 1035196 - RNA, 20 nt, Mycobacterium bovis subsp bovis AF2122/97
gcuuucggaaaaccgcaccg

SEQ ID NO: 1035197 - RNA, 17 nt, Mycobacterium bovis subsp bovis AF2122/97
gcuuucgcgucugcucg

SEQ ID NO: 1035198 - RNA, 17 nt, Mycobacterium bovis subsp bovis AF2122/97
gcuuugaauugcgcgcc

SEQ ID NO: 1035199 - RNA, 16 nt, Mycobacterium bovis subsp bovis AF2122/97
gcuuucccgucggcgg

SEQ ID NO: 1035200 - RNA, 20 nt, Mycobacterium bovis subsp bovis AF2122/97
gcuuguugaccucacgggcg

SEQ ID NO: 1035201 - RNA, 14 nt, Mycobacterium bovis subsp bovis AF2122/97
gcugcuagugcggg

SEQ ID NO: 1035202 - RNA, 23 nt, Mycobacterium bovis subsp bovis AF2122/97
gcugcgugucaaagaauucguuc

SEQ ID NO: 1035203 - RNA, 21 nt, Mycobacterium bovis subsp bovis AF2122/97
gcugcguugggaucccagcgc

SEQ ID NO: 1035204 - RNA, 16 nt, Mycobacterium bovis subsp bovis AF2122/97
gcugcucacgcagcag

SEQ ID NO: 1035205 - RNA, 13 nt, Mycobacterium bovis subsp bovis AF2122/97
gcugcggcgcugg

SEQ ID NO: 1035206 - RNA, 18 nt, Mycobacterium bovis subsp bovis AF2122/97
gcugcggcgcuggccagc

SEQ ID NO: 1035207 - RNA, 13 nt, Mycobacterium bovis subsp bovis AF2122/97
gcugcggcgguau

SEQ ID NO: 1035208 - RNA, 16 nt, Mycobacterium bovis subsp bovis AF2122/97
gcugcguggcgaacca

SEQ ID NO: 1035209 - RNA, 21 nt, Mycobacterium bovis subsp bovis AF2122/97
gcugcggacaagucggcaccg

SEQ ID NO: 1035210 - RNA, 18 nt, Mycobacterium bovis subsp bovis AF2122/97
gcugcggccgcgagguga

SEQ ID NO: 1035211 - RNA, 12 nt, Mycobacterium bovis subsp bovis AF2122/97
gcugcggcaccg

SEQ ID NO: 1035212 - RNA, 15 nt, Mycobacterium bovis subsp bovis AF2122/97
gcugcggcccacacc

SEQ ID NO: 1035213 - RNA, 21 nt, Mycobacterium bovis subsp bovis AF2122/97
gcugcggcccacaccagcgca

SEQ ID NO: 1035214 - RNA, 17 nt, Mycobacterium bovis subsp bovis AF2122/97
gcugcggcagcgcggcc

SEQ ID NO: 1035215 - RNA, 15 nt, Mycobacterium bovis subsp bovis AF2122/97
gcugcgcuucgaccg

SEQ ID NO: 1035216 - RNA, 21 nt, Mycobacterium bovis subsp bovis AF2122/97
gcugcgcuucgaccgaguacc

SEQ ID NO: 1035217 - RNA, 17 nt, Mycobacterium bovis subsp bovis AF2122/97
gcugcggauccaccacg

SEQ ID NO: 1035218 - RNA, 20 nt, Mycobacterium bovis subsp bovis AF2122/97
gcugcggauccaccacgcug

SEQ ID NO: 1035219 - RNA, 22 nt, Mycobacterium bovis subsp bovis AF2122/97
gcugcggauccaccacgcuggc

SEQ ID NO: 1035220 - RNA, 17 nt, Mycobacterium bovis subsp bovis AF2122/97
gcugcggaugcgcggcg

SEQ ID NO: 1035221 - RNA, 13 nt, Mycobacterium bovis subsp bovis AF2122/97
gcugcgcgauggc

SEQ ID NO: 1035222 - RNA, 18 nt, Mycobacterium bovis subsp bovis AF2122/97
gcugcgcgaaucgcgucg

SEQ ID NO: 1035223 - RNA, 19 nt, Mycobacterium bovis subsp bovis AF2122/97
gcugcgcgaaucgcgucga

SEQ ID NO: 1035224 - RNA, 14 nt, Mycobacterium bovis subsp bovis AF2122/97
gcugcgcgcccacc

SEQ ID NO: 1035225 - RNA, 12 nt, Mycobacterium bovis subsp bovis AF2122/97
gcugcgcgcucg

SEQ ID NO: 1035226 - RNA, 13 nt, Mycobacterium bovis subsp bovis AF2122/97
gcugcgcgcucgg

SEQ ID NO: 1035227 - RNA, 21 nt, Mycobacterium bovis subsp bovis AF2122/97
gcugcgcgcucggccagcauc

SEQ ID NO: 1035228 - RNA, 17 nt, Mycobacterium bovis subsp bovis AF2122/97
gcugcgcgccguucacc

SEQ ID NO: 1035229 - RNA, 15 nt, Mycobacterium bovis subsp bovis AF2122/97
gcugcgccgaacacc

SEQ ID NO: 1035230 - RNA, 16 nt, Mycobacterium bovis subsp bovis AF2122/97
gcugcgccgaacacca

SEQ ID NO: 1035231 - RNA, 20 nt, Mycobacterium bovis subsp bovis AF2122/97
gcugcgccgaacaccacacc

SEQ ID NO: 1035232 - RNA, 16 nt, Mycobacterium bovis subsp bovis AF2122/97
gcugcgcaucgccacc

SEQ ID NO: 1035233 - RNA, 20 nt, Mycobacterium bovis subsp bovis AF2122/97
gcugcgcaccaaggccguga

SEQ ID NO: 1035234 - RNA, 22 nt, Mycobacterium bovis subsp bovis AF2122/97
gcugcgcagaaucgccugcgac

SEQ ID NO: 1035235 - RNA, 18 nt, Mycobacterium bovis subsp bovis AF2122/97
gcugccgcaugcgcuccg

SEQ ID NO: 1035236 - RNA, 19 nt, Mycobacterium bovis subsp bovis AF2122/97
gcugccgcccaugccggga

SEQ ID NO: 1035237 - RNA, 17 nt, Mycobacterium bovis subsp bovis AF2122/97
gcugccgccgagcuggc

SEQ ID NO: 1035238 - RNA, 20 nt, Mycobacterium bovis subsp bovis AF2122/97
gcugccgccgaucgacaccc

SEQ ID NO: 1035239 - RNA, 13 nt, Mycobacterium bovis subsp bovis AF2122/97
gcugccgcacacg

SEQ ID NO: 1035240 - RNA, 15 nt, Mycobacterium bovis subsp bovis AF2122/97
gcugccgcacccccu

SEQ ID NO: 1035241 - RNA, 15 nt, Mycobacterium bovis subsp bovis AF2122/97
gcugccgcaucggca

SEQ ID NO: 1035242 - RNA, 13 nt, Mycobacterium bovis subsp bovis AF2122/97
gcugcccagcguc

SEQ ID NO: 1035243 - RNA, 16 nt, Mycobacterium bovis subsp bovis AF2122/97
gcugcccaucacaccc

SEQ ID NO: 1035244 - RNA, 15 nt, Mycobacterium bovis subsp bovis AF2122/97
gcugcccaucccggc

SEQ ID NO: 1035245 - RNA, 17 nt, Mycobacterium bovis subsp bovis AF2122/97
gcugccgccgccggcgg

SEQ ID NO: 1035246 - RNA, 14 nt, Mycobacterium bovis subsp bovis AF2122/97
gcugccgccgccgg

SEQ ID NO: 1035247 - RNA, 18 nt, Mycobacterium bovis subsp bovis AF2122/97
gcugccgccgccgccggc

SEQ ID NO: 1035248 - RNA, 19 nt, Mycobacterium bovis subsp bovis AF2122/97
gcugccgccgccgccggcg

SEQ ID NO: 1035249 - RNA, 20 nt, Mycobacterium bovis subsp bovis AF2122/97
gcugccgccgccgccggcgc

SEQ ID NO: 1035250 - RNA, 13 nt, Mycobacterium bovis subsp bovis AF2122/97
gcugccgccgccg

SEQ ID NO: 1035251 - RNA, 14 nt, Mycobacterium bovis subsp bovis AF2122/97
gcugccgccgucgc

SEQ ID NO: 1035252 - RNA, 15 nt, Mycobacterium bovis subsp bovis AF2122/97
gcugccgccgucgcc

SEQ ID NO: 1035253 - RNA, 13 nt, Mycobacterium bovis subsp bovis AF2122/97
gcugccgccggug

SEQ ID NO: 1035254 - RNA, 17 nt, Mycobacterium bovis subsp bovis AF2122/97
gcugccgccggugccgc

SEQ ID NO: 1035255 - RNA, 15 nt, Mycobacterium bovis subsp bovis AF2122/97
gcugcagcgaugcgg

SEQ ID NO: 1035256 - RNA, 23 nt, Mycobacterium bovis subsp bovis AF2122/97
gcugcagcauggcuccgaagucc

SEQ ID NO: 1035257 - RNA, 23 nt, Mycobacterium bovis subsp bovis AF2122/97
gcugcagcgucaagggcuggguc

SEQ ID NO: 1035258 - RNA, 21 nt, Mycobacterium bovis subsp bovis AF2122/97
gcugcccacggagggcaggag

SEQ ID NO: 1035259 - RNA, 17 nt, Mycobacterium bovis subsp bovis AF2122/97
gcugccauugccgaugg

SEQ ID NO: 1035260 - RNA, 23 nt, Mycobacterium bovis subsp bovis AF2122/97
gcugccauugccugggcgaccgg

SEQ ID NO: 1035261 - RNA, 18 nt, Mycobacterium bovis subsp bovis AF2122/97
gcugcccaaaagcgcggc

SEQ ID NO: 1035262 - RNA, 22 nt, Mycobacterium bovis subsp bovis AF2122/97
gcugccaguucuuggcgaccuu

SEQ ID NO: 1035263 - RNA, 15 nt, Mycobacterium bovis subsp bovis AF2122/97
gcugccaucgccuug

SEQ ID NO: 1035264 - RNA, 20 nt, Mycobacterium bovis subsp bovis AF2122/97
gcugccaucggcaccagcgc

SEQ ID NO: 1035265 - RNA, 13 nt, Mycobacterium bovis subsp bovis AF2122/97
gcugccaggccgc

SEQ ID NO: 1035266 - RNA, 15 nt, Mycobacterium bovis subsp bovis AF2122/97
gcugcgagucgucgc

SEQ ID NO: 1035267 - RNA, 14 nt, Mycobacterium bovis subsp bovis AF2122/97
gcugcgaucgccgc

SEQ ID NO: 1035268 - RNA, 22 nt, Mycobacterium bovis subsp bovis AF2122/97
gcugcgaucgccgcgcuggucg

SEQ ID NO: 1035269 - RNA, 22 nt, Mycobacterium bovis subsp bovis AF2122/97
gcugcgcaacaccaucagcgac

SEQ ID NO: 1035270 - RNA, 19 nt, Mycobacterium bovis subsp bovis AF2122/97
gcugcgacaggacgucggc

SEQ ID NO: 1035271 - RNA, 22 nt, Mycobacterium bovis subsp bovis AF2122/97
gcugcgacaggacgucggcgaa

SEQ ID NO: 1035272 - RNA, 14 nt, Mycobacterium bovis subsp bovis AF2122/97
gcugcgacuggccg

SEQ ID NO: 1035273 - RNA, 12 nt, Mycobacterium bovis subsp bovis AF2122/97
gcugcgacuggu

SEQ ID NO: 1035274 - RNA, 14 nt, Mycobacterium bovis subsp bovis AF2122/97
gcugcgagagcacc

SEQ ID NO: 1035275 - RNA, 16 nt, Mycobacterium bovis subsp bovis AF2122/97
gcugcgagagcaccga

SEQ ID NO: 1035276 - RNA, 20 nt, Mycobacterium bovis subsp bovis AF2122/97
gcugcgagaucgcggcgacc

SEQ ID NO: 1035277 - RNA, 18 nt, Mycobacterium bovis subsp bovis AF2122/97
gcugcgacaaaucggcgg

SEQ ID NO: 1035278 - RNA, 20 nt, Mycobacterium bovis subsp bovis AF2122/97
gcugcgaagccgagcaucag

SEQ ID NO: 1035279 - RNA, 17 nt, Mycobacterium bovis subsp bovis AF2122/97
gcugcgaaagccacucg

SEQ ID NO: 1035280 - RNA, 19 nt, Mycobacterium bovis subsp bovis AF2122/97
gcugccuucuuugccggcg

SEQ ID NO: 1035281 - RNA, 20 nt, Mycobacterium bovis subsp bovis AF2122/97
gcugccuucuuugccggcgc

SEQ ID NO: 1035282 - RNA, 18 nt, Mycobacterium bovis subsp bovis AF2122/97
gcugccuggccgggaccg

SEQ ID NO: 1035283 - RNA, 13 nt, Mycobacterium bovis subsp bovis AF2122/97
gcugccggcgccg

SEQ ID NO: 1035284 - RNA, 14 nt, Mycobacterium bovis subsp bovis AF2122/97
gcugccggcgccgc

SEQ ID NO: 1035285 - RNA, 15 nt, Mycobacterium bovis subsp bovis AF2122/97
gcugccggcgccgcc

SEQ ID NO: 1035286 - RNA, 16 nt, Mycobacterium bovis subsp bovis AF2122/97
gcugccggcgccgcca

SEQ ID NO: 1035287 - RNA, 19 nt, Mycobacterium bovis subsp bovis AF2122/97
gcugccggcgccgccacug

SEQ ID NO: 1035288 - RNA, 16 nt, Mycobacterium bovis subsp bovis AF2122/97
gcugccgccguugccg

SEQ ID NO: 1035289 - RNA, 23 nt, Mycobacterium bovis subsp bovis AF2122/97
gcugccgccguugccgucgucgc

SEQ ID NO: 1035290 - RNA, 16 nt, Mycobacterium bovis subsp bovis AF2122/97
gcugccgguagcacag

SEQ ID NO: 1035291 - RNA, 21 nt, Mycobacterium bovis subsp bovis AF2122/97
gcugccgguagcacagcagca

SEQ ID NO: 1035292 - RNA, 16 nt, Mycobacterium bovis subsp bovis AF2122/97
gcugccgucgcugccc

SEQ ID NO: 1035293 - RNA, 11 nt, Mycobacterium bovis subsp bovis AF2122/97
gcugccguuga

SEQ ID NO: 1035294 - RNA, 14 nt, Mycobacterium bovis subsp bovis AF2122/97
gcugccguugauuc

SEQ ID NO: 1035295 - RNA, 23 nt, Mycobacterium bovis subsp bovis AF2122/97
gcugccguugauucggccgccga

SEQ ID NO: 1035296 - RNA, 23 nt, Mycobacterium bovis subsp bovis AF2122/97
gcugaccugggguguagccagcg

SEQ ID NO: 1035297 - RNA, 19 nt, Mycobacterium bovis subsp bovis AF2122/97
gcugaccguuucgaucucg

SEQ ID NO: 1035298 - RNA, 20 nt, Mycobacterium bovis subsp bovis AF2122/97
gcugacgacgagggccagca

SEQ ID NO: 1035299 - RNA, 23 nt, Mycobacterium bovis subsp bovis AF2122/97
gcugaccuucaggcccugccgac

SEQ ID NO: 1035300 - RNA, 20 nt, Mycobacterium bovis subsp bovis AF2122/97
gcugaccggaucugacggcg

SEQ ID NO: 1035301 - RNA, 22 nt, Mycobacterium bovis subsp bovis AF2122/97
gcugaccggaucugacggcgcc

SEQ ID NO: 1035302 - RNA, 16 nt, Mycobacterium bovis subsp bovis AF2122/97
gcugaccgguccccgg

SEQ ID NO: 1035303 - RNA, 19 nt, Mycobacterium bovis subsp bovis AF2122/97
gcugaccggggcgcccggc

SEQ ID NO: 1035304 - RNA, 21 nt, Mycobacterium bovis subsp bovis AF2122/97
gcugaccggggcgcccggcca

SEQ ID NO: 1035305 - RNA, 23 nt, Mycobacterium bovis subsp bovis AF2122/97
gcugaccggggucggccugcggc

SEQ ID NO: 1035306 - RNA, 19 nt, Mycobacterium bovis subsp bovis AF2122/97
gcugaccgaauggccgccg

SEQ ID NO: 1035307 - RNA, 14 nt, Mycobacterium bovis subsp bovis AF2122/97
gcugaccgcaacgc

SEQ ID NO: 1035308 - RNA, 13 nt, Mycobacterium bovis subsp bovis AF2122/97
gcugaccgccacc

SEQ ID NO: 1035309 - RNA, 14 nt, Mycobacterium bovis subsp bovis AF2122/97
gcugaccgcgccgg

SEQ ID NO: 1035310 - RNA, 17 nt, Mycobacterium bovis subsp bovis AF2122/97
gcugaccgcguagacca

SEQ ID NO: 1035311 - RNA, 20 nt, Mycobacterium bovis subsp bovis AF2122/97
gcugaccgcguagaccagug

SEQ ID NO: 1035312 - RNA, 22 nt, Mycobacterium bovis subsp bovis AF2122/97
gcugaccgcguagaccagugac

SEQ ID NO: 1035313 - RNA, 21 nt, Mycobacterium bovis subsp bovis AF2122/97
gcugaccgcuaccagcugggc

SEQ ID NO: 1035314 - RNA, 16 nt, Mycobacterium bovis subsp bovis AF2122/97
gcugagcccgccgcga

SEQ ID NO: 1035315 - RNA, 20 nt, Mycobacterium bovis subsp bovis AF2122/97
gcugagcccgccgcgaccac

SEQ ID NO: 1035316 - RNA, 18 nt, Mycobacterium bovis subsp bovis AF2122/97
gcugagcccugcgccucg

SEQ ID NO: 1035317 - RNA, 23 nt, Mycobacterium bovis subsp bovis AF2122/97
gcugagccgcaucuggccggcgg

SEQ ID NO: 1035318 - RNA, 12 nt, Mycobacterium bovis subsp bovis AF2122/97
gcugaggcggcg

SEQ ID NO: 1035319 - RNA, 13 nt, Mycobacterium bovis subsp bovis AF2122/97
gcugaggcggcga

SEQ ID NO: 1035320 - RNA, 13 nt, Mycobacterium bovis subsp bovis AF2122/97
gcugacgaugcgg

SEQ ID NO: 1035321 - RNA, 16 nt, Mycobacterium bovis subsp bovis AF2122/97
gcugacuccugcggca

SEQ ID NO: 1035322 - RNA, 21 nt, Mycobacterium bovis subsp bovis AF2122/97
gcugagacgguguugcucgcc

SEQ ID NO: 1035323 - RNA, 23 nt, Mycobacterium bovis subsp bovis AF2122/97
gcugagacagaccgggcccggcg

SEQ ID NO: 1035324 - RNA, 17 nt, Mycobacterium bovis subsp bovis AF2122/97
gcugagcacggcgcggc

SEQ ID NO: 1035325 - RNA, 19 nt, Mycobacterium bovis subsp bovis AF2122/97
gcugagcacggcgcggcgg

SEQ ID NO: 1035326 - RNA, 16 nt, Mycobacterium bovis subsp bovis AF2122/97
gcugagcagcgcggcc

SEQ ID NO: 1035327 - RNA, 15 nt, Mycobacterium bovis subsp bovis AF2122/97
gcugaucugccgccg

SEQ ID NO: 1035328 - RNA, 16 nt, Mycobacterium bovis subsp bovis AF2122/97
gcugaucugccgccgc

SEQ ID NO: 1035329 - RNA, 17 nt, Mycobacterium bovis subsp bovis AF2122/97
gcugaucugccgccgcg

SEQ ID NO: 1035330 - RNA, 20 nt, Mycobacterium bovis subsp bovis AF2122/97
gcugaucugccgccgcggcc

SEQ ID NO: 1035331 - RNA, 18 nt, Mycobacterium bovis subsp bovis AF2122/97
gcugaugaaacgccgucg

SEQ ID NO: 1035332 - RNA, 16 nt, Mycobacterium bovis subsp bovis AF2122/97
gcugaugccuggucgc

SEQ ID NO: 1035333 - RNA, 18 nt, Mycobacterium bovis subsp bovis AF2122/97
gcugaugggucaggccga

SEQ ID NO: 1035334 - RNA, 19 nt, Mycobacterium bovis subsp bovis AF2122/97
gcugaugcgguagucgccg

SEQ ID NO: 1035335 - RNA, 20 nt, Mycobacterium bovis subsp bovis AF2122/97
gcugaugcgguagucgccga

SEQ ID NO: 1035336 - RNA, 15 nt, Mycobacterium bovis subsp bovis AF2122/97
gcugauagcggucgg

SEQ ID NO: 1035337 - RNA, 20 nt, Mycobacterium bovis subsp bovis AF2122/97
gcugauagcggucggucacc

SEQ ID NO: 1035338 - RNA, 18 nt, Mycobacterium bovis subsp bovis AF2122/97
gcugaucaccgucguacu

SEQ ID NO: 1035339 - RNA, 22 nt, Mycobacterium bovis subsp bovis AF2122/97
gcugaucaccguugcguuggcg

SEQ ID NO: 1035340 - RNA, 19 nt, Mycobacterium bovis subsp bovis AF2122/97
gcugauaguggcgcgcggc

SEQ ID NO: 1035341 - RNA, 22 nt, Mycobacterium bovis subsp bovis AF2122/97
gcugauaguggcgcgcggcgcc

SEQ ID NO: 1035342 - RNA, 17 nt, Mycobacterium bovis subsp bovis AF2122/97
gcugcagcagcgcaguc

SEQ ID NO: 1035343 - RNA, 14 nt, Mycobacterium bovis subsp bovis AF2122/97
gcugcaccgauucg

SEQ ID NO: 1035344 - RNA, 18 nt, Mycobacterium bovis subsp bovis AF2122/97
gcugcaccaagucguaau

SEQ ID NO: 1035345 - RNA, 20 nt, Mycobacterium bovis subsp bovis AF2122/97
gcugcaacggagcgagcuca

SEQ ID NO: 1035346 - RNA, 20 nt, Mycobacterium bovis subsp bovis AF2122/97
gcugaugggucaggccgacg

SEQ ID NO: 1035347 - RNA, 14 nt, Mycobacterium bovis subsp bovis AF2122/97
gcugauggugccga

SEQ ID NO: 1035348 - RNA, 18 nt, Mycobacterium bovis subsp bovis AF2122/97
gcugauguacccggcgac

SEQ ID NO: 1035349 - RNA, 14 nt, Mycobacterium bovis subsp bovis AF2122/97
gcugaugucgccgg

SEQ ID NO: 1035350 - RNA, 18 nt, Mycobacterium bovis subsp bovis AF2122/97
gcugaugucgccgguguc

SEQ ID NO: 1035351 - RNA, 17 nt, Mycobacterium bovis subsp bovis AF2122/97
gcugcaaugacuggacc

SEQ ID NO: 1035352 - RNA, 15 nt, Mycobacterium bovis subsp bovis AF2122/97
gcugaacacgaaucc

SEQ ID NO: 1035353 - RNA, 12 nt, Mycobacterium bovis subsp bovis AF2122/97
gcugaacaccgc

SEQ ID NO: 1035354 - RNA, 18 nt, Mycobacterium bovis subsp bovis AF2122/97
gcugaacaccgcgggcag

SEQ ID NO: 1035355 - RNA, 15 nt, Mycobacterium bovis subsp bovis AF2122/97
gcugaacaccgguga

SEQ ID NO: 1035356 - RNA, 13 nt, Mycobacterium bovis subsp bovis AF2122/97
gcucuccgucgcg

SEQ ID NO: 1035357 - RNA, 17 nt, Mycobacterium bovis subsp bovis AF2122/97
gcucucgaguccaggca

SEQ ID NO: 1035358 - RNA, 22 nt, Mycobacterium bovis subsp bovis AF2122/97
gcucucgcagcauguccgcagc

SEQ ID NO: 1035359 - RNA, 14 nt, Mycobacterium bovis subsp bovis AF2122/97
gcugaaaucggugg

SEQ ID NO: 1035360 - RNA, 18 nt, Mycobacterium bovis subsp bovis AF2122/97
gcugaaaucgguggccac

SEQ ID NO: 1035361 - RNA, 22 nt, Mycobacterium bovis subsp bovis AF2122/97
gcugaaaucgguggccaccacc

SEQ ID NO: 1035362 - RNA, 14 nt, Mycobacterium bovis subsp bovis AF2122/97
gcugaaccgcuggg

SEQ ID NO: 1035363 - RNA, 19 nt, Mycobacterium bovis subsp bovis AF2122/97
gcugacccgggccgggccg

SEQ ID NO: 1035364 - RNA, 22 nt, Mycobacterium bovis subsp bovis AF2122/97
gcugaccaugaccgggcuggcc

SEQ ID NO: 1035365 - RNA, 15 nt, Mycobacterium bovis subsp bovis AF2122/97
gcugaccccgccggc

SEQ ID NO: 1035366 - RNA, 18 nt, Mycobacterium bovis subsp bovis AF2122/97
gcugaccccggcagcgcc

SEQ ID NO: 1035367 - RNA, 19 nt, Mycobacterium bovis subsp bovis AF2122/97
gcugaccccggcagcgccc

SEQ ID NO: 1035368 - RNA, 13 nt, Mycobacterium bovis subsp bovis AF2122/97
gcugaccgagcug

SEQ ID NO: 1035369 - RNA, 19 nt, Mycobacterium bovis subsp bovis AF2122/97
gcugaccgagcugauccgg

SEQ ID NO: 1035370 - RNA, 17 nt, Mycobacterium bovis subsp bovis AF2122/97
gcugacauuuccaccac

SEQ ID NO: 1035371 - RNA, 14 nt, Mycobacterium bovis subsp bovis AF2122/97
gcugaccaacccaa

SEQ ID NO: 1035372 - RNA, 17 nt, Mycobacterium bovis subsp bovis AF2122/97
gcugaccaacggggcag

SEQ ID NO: 1035373 - RNA, 14 nt, Mycobacterium bovis subsp bovis AF2122/97
gcugacacgacgaa

SEQ ID NO: 1035374 - RNA, 16 nt, Mycobacterium bovis subsp bovis AF2122/97
gcugaauuucgaugag

SEQ ID NO: 1035375 - RNA, 14 nt, Mycobacterium bovis subsp bovis AF2122/97
gcugacacccgcca

SEQ ID NO: 1035376 - RNA, 21 nt, Mycobacterium bovis subsp bovis AF2122/97
gcugacaccgauccggccgcc

SEQ ID NO: 1035377 - RNA, 19 nt, Mycobacterium bovis subsp bovis AF2122/97
gcucgugagccccagcgac

SEQ ID NO: 1035378 - RNA, 17 nt, Mycobacterium bovis subsp bovis AF2122/97
gcucgucuuggcggcgg

SEQ ID NO: 1035379 - RNA, 17 nt, Mycobacterium bovis subsp bovis AF2122/97
gcucgucuugggccggg

SEQ ID NO: 1035380 - RNA, 15 nt, Mycobacterium bovis subsp bovis AF2122/97
gcucgucggucaccg

SEQ ID NO: 1035381 - RNA, 19 nt, Mycobacterium bovis subsp bovis AF2122/97
gcucgucguccggccacgg

SEQ ID NO: 1035382 - RNA, 15 nt, Mycobacterium bovis subsp bovis AF2122/97
gcucgucgucggcgu

SEQ ID NO: 1035383 - RNA, 14 nt, Mycobacterium bovis subsp bovis AF2122/97
gcucggcgcggugg

SEQ ID NO: 1035384 - RNA, 16 nt, Mycobacterium bovis subsp bovis AF2122/97
gcucggcgcgccgguc

SEQ ID NO: 1035385 - RNA, 21 nt, Mycobacterium bovis subsp bovis AF2122/97
gcucggcgcgccggucgccga

SEQ ID NO: 1035386 - RNA, 14 nt, Mycobacterium bovis subsp bovis AF2122/97
gcucgucggucacc

SEQ ID NO: 1035387 - RNA, 12 nt, Mycobacterium bovis subsp bovis AF2122/97
gcucggcgccgu

SEQ ID NO: 1035388 - RNA, 20 nt, Mycobacterium bovis subsp bovis AF2122/97
gcucggcgcagcuaacccgc

SEQ ID NO: 1035389 - RNA, 23 nt, Mycobacterium bovis subsp bovis AF2122/97
gcucggcgcagcuaacccgccac

SEQ ID NO: 1035390 - RNA, 21 nt, Mycobacterium bovis subsp bovis AF2122/97
gcucggcgccacggugucgcg

SEQ ID NO: 1035391 - RNA, 23 nt, Mycobacterium bovis subsp bovis AF2122/97
gcucggcgccacggugucgcgau

SEQ ID NO: 1035392 - RNA, 15 nt, Mycobacterium bovis subsp bovis AF2122/97
gcucggcgcccagcu

SEQ ID NO: 1035393 - RNA, 21 nt, Mycobacterium bovis subsp bovis AF2122/97
gcucguggucgacgugaucgc

SEQ ID NO: 1035394 - RNA, 14 nt, Mycobacterium bovis subsp bovis AF2122/97
gcucguugcgggcg

SEQ ID NO: 1035395 - RNA, 19 nt, Mycobacterium bovis subsp bovis AF2122/97
gcucguugcgggcgggaac

SEQ ID NO: 1035396 - RNA, 15 nt, Mycobacterium bovis subsp bovis AF2122/97
gcucguugcuggcgg

SEQ ID NO: 1035397 - RNA, 15 nt, Mycobacterium bovis subsp bovis AF2122/97
gcucguguccgccgu

SEQ ID NO: 1035398 - RNA, 16 nt, Mycobacterium bovis subsp bovis AF2122/97
gcucguuacgccgagc

SEQ ID NO: 1035399 - RNA, 16 nt, Mycobacterium bovis subsp bovis AF2122/97
gcucucacgagcggcg

SEQ ID NO: 1035400 - RNA, 19 nt, Mycobacterium bovis subsp bovis AF2122/97
gcucucauagcgacggcgc

SEQ ID NO: 1035401 - RNA, 18 nt, Mycobacterium bovis subsp bovis AF2122/97
gcucguuugcgagcaggg

SEQ ID NO: 1035402 - RNA, 16 nt, Mycobacterium bovis subsp bovis AF2122/97
gcucuacucgcggccg

SEQ ID NO: 1035403 - RNA, 19 nt, Mycobacterium bovis subsp bovis AF2122/97
gcucuacucgcggccggcg

SEQ ID NO: 1035404 - RNA, 23 nt, Mycobacterium bovis subsp bovis AF2122/97
gcucgccgugguggaugagccgg

SEQ ID NO: 1035405 - RNA, 17 nt, Mycobacterium bovis subsp bovis AF2122/97
gcucgccgugaccaggu

SEQ ID NO: 1035406 - RNA, 20 nt, Mycobacterium bovis subsp bovis AF2122/97
gcucgccguaagcaccagcc

SEQ ID NO: 1035407 - RNA, 21 nt, Mycobacterium bovis subsp bovis AF2122/97
gcucgccguaagcaccagcca

SEQ ID NO: 1035408 - RNA, 16 nt, Mycobacterium bovis subsp bovis AF2122/97
gcucgccucgauggcg

SEQ ID NO: 1035409 - RNA, 14 nt, Mycobacterium bovis subsp bovis AF2122/97
gcucgcgaagccgg

SEQ ID NO: 1035410 - RNA, 21 nt, Mycobacterium bovis subsp bovis AF2122/97
gcucgcgcacccagcccagcc

SEQ ID NO: 1035411 - RNA, 14 nt, Mycobacterium bovis subsp bovis AF2122/97
gcucgcgaggcucg

SEQ ID NO: 1035412 - RNA, 14 nt, Mycobacterium bovis subsp bovis AF2122/97
gcucgcgcaaggcg

SEQ ID NO: 1035413 - RNA, 18 nt, Mycobacterium bovis subsp bovis AF2122/97
gcucgcgcaaggcgccgc

SEQ ID NO: 1035414 - RNA, 21 nt, Mycobacterium bovis subsp bovis AF2122/97
gcucgcgcaaggcgccgcagg

SEQ ID NO: 1035415 - RNA, 13 nt, Mycobacterium bovis subsp bovis AF2122/97
gcucgcggcgcag

SEQ ID NO: 1035416 - RNA, 16 nt, Mycobacterium bovis subsp bovis AF2122/97
gcucgcggcggcgcug

SEQ ID NO: 1035417 - RNA, 17 nt, Mycobacterium bovis subsp bovis AF2122/97
gcucgcggcggcgcugg

SEQ ID NO: 1035418 - RNA, 13 nt, Mycobacterium bovis subsp bovis AF2122/97
gcucgcggguacc

SEQ ID NO: 1035419 - RNA, 21 nt, Mycobacterium bovis subsp bovis AF2122/97
gcucgcgguaguuaacccagg

SEQ ID NO: 1035420 - RNA, 20 nt, Mycobacterium bovis subsp bovis AF2122/97
gcucgcgcucguuagcggcg

SEQ ID NO: 1035421 - RNA, 21 nt, Mycobacterium bovis subsp bovis AF2122/97
gcucgcgcucgcucacgccgu

SEQ ID NO: 1035422 - RNA, 19 nt, Mycobacterium bovis subsp bovis AF2122/97
gcucgcgcgcugggcgcgc

SEQ ID NO: 1035423 - RNA, 12 nt, Mycobacterium bovis subsp bovis AF2122/97
gcucgcgcgcug

SEQ ID NO: 1035424 - RNA, 21 nt, Mycobacterium bovis subsp bovis AF2122/97
gcucgcgccggugaggcgacc

SEQ ID NO: 1035425 - RNA, 20 nt, Mycobacterium bovis subsp bovis AF2122/97
gcucgcgccaggucggugac

SEQ ID NO: 1035426 - RNA, 15 nt, Mycobacterium bovis subsp bovis AF2122/97
gcucgcucaccggcg

SEQ ID NO: 1035427 - RNA, 20 nt, Mycobacterium bovis subsp bovis AF2122/97
gcucgcucaccggcuggugc

SEQ ID NO: 1035428 - RNA, 19 nt, Mycobacterium bovis subsp bovis AF2122/97
gcucgcugaucaggucuuc

SEQ ID NO: 1035429 - RNA, 16 nt, Mycobacterium bovis subsp bovis AF2122/97
gcucgcugcaccagcu

SEQ ID NO: 1035430 - RNA, 17 nt, Mycobacterium bovis subsp bovis AF2122/97
gcucgcucugcgcggcu

SEQ ID NO: 1035431 - RNA, 14 nt, Mycobacterium bovis subsp bovis AF2122/97
gcucgcugcgcgcc

SEQ ID NO: 1035432 - RNA, 14 nt, Mycobacterium bovis subsp bovis AF2122/97
gcucgcugacggca

SEQ ID NO: 1035433 - RNA, 15 nt, Mycobacterium bovis subsp bovis AF2122/97
gcucgcugcagcagg

SEQ ID NO: 1035434 - RNA, 19 nt, Mycobacterium bovis subsp bovis AF2122/97
gcucgcgguuuuggucgcg

SEQ ID NO: 1035435 - RNA, 21 nt, Mycobacterium bovis subsp bovis AF2122/97
gcucgcgguuuuggucgcgau

SEQ ID NO: 1035436 - RNA, 23 nt, Mycobacterium bovis subsp bovis AF2122/97
gcucgcgguuuuggucgcgauga

SEQ ID NO: 1035437 - RNA, 14 nt, Mycobacterium bovis subsp bovis AF2122/97
gcucgcgggccgcg

SEQ ID NO: 1035438 - RNA, 15 nt, Mycobacterium bovis subsp bovis AF2122/97
gcucgcguggccgcc

SEQ ID NO: 1035439 - RNA, 19 nt, Mycobacterium bovis subsp bovis AF2122/97
gcucgcguggccgccggcg

SEQ ID NO: 1035440 - RNA, 14 nt, Mycobacterium bovis subsp bovis AF2122/97
gcucggcgaguucg

SEQ ID NO: 1035441 - RNA, 10 nt, Mycobacterium bovis subsp bovis AF2122/97
gcucggcgau

SEQ ID NO: 1035442 - RNA, 13 nt, Mycobacterium bovis subsp bovis AF2122/97
gcucggcccagcg

SEQ ID NO: 1035443 - RNA, 14 nt, Mycobacterium bovis subsp bovis AF2122/97
gcucggcccagcgc

SEQ ID NO: 1035444 - RNA, 20 nt, Mycobacterium bovis subsp bovis AF2122/97
gcucggcccagcgcgccagc

SEQ ID NO: 1035445 - RNA, 13 nt, Mycobacterium bovis subsp bovis AF2122/97
gcucggcccccga

SEQ ID NO: 1035446 - RNA, 15 nt, Mycobacterium bovis subsp bovis AF2122/97
gcucggcccccgaga

SEQ ID NO: 1035447 - RNA, 13 nt, Mycobacterium bovis subsp bovis AF2122/97
gcucggccccgcc

SEQ ID NO: 1035448 - RNA, 17 nt, Mycobacterium bovis subsp bovis AF2122/97
gcucggccccgccgccg

SEQ ID NO: 1035449 - RNA, 21 nt, Mycobacterium bovis subsp bovis AF2122/97
gcucggccccgccgccggugc

SEQ ID NO: 1035450 - RNA, 23 nt, Mycobacterium bovis subsp bovis AF2122/97
gcucggccccgccgccggugcgg

SEQ ID NO: 1035451 - RNA, 20 nt, Mycobacterium bovis subsp bovis AF2122/97
gcucggccagcacgccgccg

SEQ ID NO: 1035452 - RNA, 17 nt, Mycobacterium bovis subsp bovis AF2122/97
gcucggaaaccgccccg

SEQ ID NO: 1035453 - RNA, 23 nt, Mycobacterium bovis subsp bovis AF2122/97
gcucggaaaccgccccgugggcc

SEQ ID NO: 1035454 - RNA, 20 nt, Mycobacterium bovis subsp bovis AF2122/97
gcucgcuucaggcaccggau

SEQ ID NO: 1035455 - RNA, 22 nt, Mycobacterium bovis subsp bovis AF2122/97
gcucggccagaaagaucgguug

SEQ ID NO: 1035456 - RNA, 17 nt, Mycobacterium bovis subsp bovis AF2122/97
gcucggccagcacgccg

SEQ ID NO: 1035457 - RNA, 19 nt, Mycobacterium bovis subsp bovis AF2122/97
gcucggccagcacgccgcc

SEQ ID NO: 1035458 - RNA, 15 nt, Mycobacterium bovis subsp bovis AF2122/97
gcucgcccgcggccg

SEQ ID NO: 1035459 - RNA, 15 nt, Mycobacterium bovis subsp bovis AF2122/97
gcucgccgaggaaau

SEQ ID NO: 1035460 - RNA, 14 nt, Mycobacterium bovis subsp bovis AF2122/97
gcucgccgaccagc

SEQ ID NO: 1035461 - RNA, 14 nt, Mycobacterium bovis subsp bovis AF2122/97
gcucgcccgccgcc

SEQ ID NO: 1035462 - RNA, 18 nt, Mycobacterium bovis subsp bovis AF2122/97
gcucgccgauaucugcca

SEQ ID NO: 1035463 - RNA, 13 nt, Mycobacterium bovis subsp bovis AF2122/97
gcucgccagccgg

SEQ ID NO: 1035464 - RNA, 19 nt, Mycobacterium bovis subsp bovis AF2122/97
gcucgccagccggccucag

SEQ ID NO: 1035465 - RNA, 21 nt, Mycobacterium bovis subsp bovis AF2122/97
gcucgccaggcaagccagcac

SEQ ID NO: 1035466 - RNA, 16 nt, Mycobacterium bovis subsp bovis AF2122/97
gcucgccaggccuagg

SEQ ID NO: 1035467 - RNA, 22 nt, Mycobacterium bovis subsp bovis AF2122/97
gcucgcccaggaagccgagacc

SEQ ID NO: 1035468 - RNA, 12 nt, Mycobacterium bovis subsp bovis AF2122/97
gcucgcauucgg

SEQ ID NO: 1035469 - RNA, 14 nt, Mycobacterium bovis subsp bovis AF2122/97
gcucgccgggcagc

SEQ ID NO: 1035470 - RNA, 13 nt, Mycobacterium bovis subsp bovis AF2122/97
gcucgccggcgac

SEQ ID NO: 1035471 - RNA, 14 nt, Mycobacterium bovis subsp bovis AF2122/97
gcucgccggcgacc

SEQ ID NO: 1035472 - RNA, 14 nt, Mycobacterium bovis subsp bovis AF2122/97
gcucgccggcgaac

SEQ ID NO: 1035473 - RNA, 17 nt, Mycobacterium bovis subsp bovis AF2122/97
gcucgccggcggcccgc

SEQ ID NO: 1035474 - RNA, 13 nt, Mycobacterium bovis subsp bovis AF2122/97
gcucgccggcacc

SEQ ID NO: 1035475 - RNA, 14 nt, Mycobacterium bovis subsp bovis AF2122/97
gcucgccggcaccg

SEQ ID NO: 1035476 - RNA, 13 nt, Mycobacterium bovis subsp bovis AF2122/97
gcucgccggcgaa

SEQ ID NO: 1035477 - RNA, 14 nt, Mycobacterium bovis subsp bovis AF2122/97
gcucgccgaugcug

SEQ ID NO: 1035478 - RNA, 14 nt, Mycobacterium bovis subsp bovis AF2122/97
gcucgaggaccacc

SEQ ID NO: 1035479 - RNA, 15 nt, Mycobacterium bovis subsp bovis AF2122/97
gcucgagcgguggcg

SEQ ID NO: 1035480 - RNA, 21 nt, Mycobacterium bovis subsp bovis AF2122/97
gcucgagcuacgacgaguggu

SEQ ID NO: 1035481 - RNA, 17 nt, Mycobacterium bovis subsp bovis AF2122/97
gcucgagguggucucgg

SEQ ID NO: 1035482 - RNA, 14 nt, Mycobacterium bovis subsp bovis AF2122/97
gcucgagucgcagc

SEQ ID NO: 1035483 - RNA, 18 nt, Mycobacterium bovis subsp bovis AF2122/97
gcucgagucgcagcacgg

SEQ ID NO: 1035484 - RNA, 21 nt, Mycobacterium bovis subsp bovis AF2122/97
gcucgauaucguuggcgacca

SEQ ID NO: 1035485 - RNA, 22 nt, Mycobacterium bovis subsp bovis AF2122/97
gcucgauaucguuggcgaccac

SEQ ID NO: 1035486 - RNA, 24 nt, Mycobacterium bovis subsp bovis AF2122/97
gcucgauaucguuggcgaccaccg

SEQ ID NO: 1035487 - RNA, 14 nt, Mycobacterium bovis subsp bovis AF2122/97
gcucgauccgcaac

SEQ ID NO: 1035488 - RNA, 22 nt, Mycobacterium bovis subsp bovis AF2122/97
gcucgauccgcaacaacgccgc

SEQ ID NO: 1035489 - RNA, 16 nt, Mycobacterium bovis subsp bovis AF2122/97
gcucgaucacgccggc

SEQ ID NO: 1035490 - RNA, 20 nt, Mycobacterium bovis subsp bovis AF2122/97
gcucgaucacgccggccucg

SEQ ID NO: 1035491 - RNA, 23 nt, Mycobacterium bovis subsp bovis AF2122/97
gcucgaucacgccggccucgccg

SEQ ID NO: 1035492 - RNA, 16 nt, Mycobacterium bovis subsp bovis AF2122/97
gcucgaucacggcggg

SEQ ID NO: 1035493 - RNA, 16 nt, Mycobacterium bovis subsp bovis AF2122/97
gcucgaucacuagcgc

SEQ ID NO: 1035494 - RNA, 18 nt, Mycobacterium bovis subsp bovis AF2122/97
gcucgaucugucgcgccg

SEQ ID NO: 1035495 - RNA, 14 nt, Mycobacterium bovis subsp bovis AF2122/97
gcucgaucugucgc

SEQ ID NO: 1035496 - RNA, 20 nt, Mycobacterium bovis subsp bovis AF2122/97
gcucgaucugcccggugauc

SEQ ID NO: 1035497 - RNA, 18 nt, Mycobacterium bovis subsp bovis AF2122/97
gcucgaucggcagccagg

SEQ ID NO: 1035498 - RNA, 17 nt, Mycobacterium bovis subsp bovis AF2122/97
gcucgauggcggccacc

SEQ ID NO: 1035499 - RNA, 20 nt, Mycobacterium bovis subsp bovis AF2122/97
gcucgauggcggccaccagc

SEQ ID NO: 1035500 - RNA, 20 nt, Mycobacterium bovis subsp bovis AF2122/97
gcucgaugcgaucgacgauc

SEQ ID NO: 1035501 - RNA, 23 nt, Mycobacterium bovis subsp bovis AF2122/97
gcucgaugguguuauuccacucg

SEQ ID NO: 1035502 - RNA, 17 nt, Mycobacterium bovis subsp bovis AF2122/97
gcucgcacagcaccacg

SEQ ID NO: 1035503 - RNA, 12 nt, Mycobacterium bovis subsp bovis AF2122/97
gcucgcacagcc

SEQ ID NO: 1035504 - RNA, 17 nt, Mycobacterium bovis subsp bovis AF2122/97
gcucgaugucagcggcc

SEQ ID NO: 1035505 - RNA, 17 nt, Mycobacterium bovis subsp bovis AF2122/97
gcucgcaggccggcggc

SEQ ID NO: 1035506 - RNA, 18 nt, Mycobacterium bovis subsp bovis AF2122/97
gcucgcaggccggcggcg

SEQ ID NO: 1035507 - RNA, 20 nt, Mycobacterium bovis subsp bovis AF2122/97
gcucgcaggccggcggcggu

SEQ ID NO: 1035508 - RNA, 17 nt, Mycobacterium bovis subsp bovis AF2122/97
gcucgcacccgcucggc

SEQ ID NO: 1035509 - RNA, 20 nt, Mycobacterium bovis subsp bovis AF2122/97
gcucgcacccgcucggcgcg

SEQ ID NO: 1035510 - RNA, 23 nt, Mycobacterium bovis subsp bovis AF2122/97
gcucgcacccgcucggcgcgcgg

SEQ ID NO: 1035511 - RNA, 13 nt, Mycobacterium bovis subsp bovis AF2122/97
gcucgcaccgccc

SEQ ID NO: 1035512 - RNA, 14 nt, Mycobacterium bovis subsp bovis AF2122/97
gcuccucggccagc

SEQ ID NO: 1035513 - RNA, 20 nt, Mycobacterium bovis subsp bovis AF2122/97
gcuccuuggcccagcgguag

SEQ ID NO: 1035514 - RNA, 16 nt, Mycobacterium bovis subsp bovis AF2122/97
gcucgaaacgcccuug

SEQ ID NO: 1035515 - RNA, 23 nt, Mycobacterium bovis subsp bovis AF2122/97
gcucgaaacggauuggucgaccg

SEQ ID NO: 1035516 - RNA, 19 nt, Mycobacterium bovis subsp bovis AF2122/97
gcuccuuggcccagcggua

SEQ ID NO: 1035517 - RNA, 16 nt, Mycobacterium bovis subsp bovis AF2122/97
gcuccugcguccagau

SEQ ID NO: 1035518 - RNA, 15 nt, Mycobacterium bovis subsp bovis AF2122/97
gcuccuccggcacca

SEQ ID NO: 1035519 - RNA, 15 nt, Mycobacterium bovis subsp bovis AF2122/97
gcuccucgcgguagu

SEQ ID NO: 1035520 - RNA, 14 nt, Mycobacterium bovis subsp bovis AF2122/97
gcuccucgcgcucg

SEQ ID NO: 1035521 - RNA, 23 nt, Mycobacterium bovis subsp bovis AF2122/97
gcuccguuguccagcgcgacguc

SEQ ID NO: 1035522 - RNA, 16 nt, Mycobacterium bovis subsp bovis AF2122/97
gcuccuccccggcccg

SEQ ID NO: 1035523 - RNA, 21 nt, Mycobacterium bovis subsp bovis AF2122/97
gcuccucauagagcggcacca

SEQ ID NO: 1035524 - RNA, 15 nt, Mycobacterium bovis subsp bovis AF2122/97
gcuccuccaccaacu

SEQ ID NO: 1035525 - RNA, 22 nt, Mycobacterium bovis subsp bovis AF2122/97
gcuccggucggguuucgucgcg

SEQ ID NO: 1035526 - RNA, 17 nt, Mycobacterium bovis subsp bovis AF2122/97
gcuccgggaauggcgac

SEQ ID NO: 1035527 - RNA, 13 nt, Mycobacterium bovis subsp bovis AF2122/97
gcuccgguuggcg

SEQ ID NO: 1035528 - RNA, 19 nt, Mycobacterium bovis subsp bovis AF2122/97
gcuccgguuggcgcgggcg

SEQ ID NO: 1035529 - RNA, 20 nt, Mycobacterium bovis subsp bovis AF2122/97
gcuccgguuggcgcgggcga

SEQ ID NO: 1035530 - RNA, 15 nt, Mycobacterium bovis subsp bovis AF2122/97
gcuccgucgcggccg

SEQ ID NO: 1035531 - RNA, 21 nt, Mycobacterium bovis subsp bovis AF2122/97
gcuccguggugcuagcgccgc

SEQ ID NO: 1035532 - RNA, 17 nt, Mycobacterium bovis subsp bovis AF2122/97
gcucgacgagcacgccg

SEQ ID NO: 1035533 - RNA, 14 nt, Mycobacterium bovis subsp bovis AF2122/97
gcucgaccugaggc

SEQ ID NO: 1035534 - RNA, 18 nt, Mycobacterium bovis subsp bovis AF2122/97
gcucgaccugaggcaccu

SEQ ID NO: 1035535 - RNA, 20 nt, Mycobacterium bovis subsp bovis AF2122/97
gcucgaccugaggcaccucg

SEQ ID NO: 1035536 - RNA, 20 nt, Mycobacterium bovis subsp bovis AF2122/97
gcucgacgacgggcgccaac

SEQ ID NO: 1035537 - RNA, 21 nt, Mycobacterium bovis subsp bovis AF2122/97
gcucgacgacgggcgccaacg

SEQ ID NO: 1035538 - RNA, 19 nt, Mycobacterium bovis subsp bovis AF2122/97
gcucgacgaagaucgcgug

SEQ ID NO: 1035539 - RNA, 17 nt, Mycobacterium bovis subsp bovis AF2122/97
gcucgacgaggccacgg

SEQ ID NO: 1035540 - RNA, 17 nt, Mycobacterium bovis subsp bovis AF2122/97
gcucgacgaucugcagc

SEQ ID NO: 1035541 - RNA, 20 nt, Mycobacterium bovis subsp bovis AF2122/97
gcucgacgaucugcagcacu

SEQ ID NO: 1035542 - RNA, 14 nt, Mycobacterium bovis subsp bovis AF2122/97
gcucgacgcccgcc

SEQ ID NO: 1035543 - RNA, 17 nt, Mycobacterium bovis subsp bovis AF2122/97
gcucgacgcccgccacc

SEQ ID NO: 1035544 - RNA, 18 nt, Mycobacterium bovis subsp bovis AF2122/97
gcucgacgcccgccaccg

SEQ ID NO: 1035545 - RNA, 19 nt, Mycobacterium bovis subsp bovis AF2122/97
gcucgacguauuggcgcag

SEQ ID NO: 1035546 - RNA, 19 nt, Mycobacterium bovis subsp bovis AF2122/97
gcucgacggcuccgauucc

SEQ ID NO: 1035547 - RNA, 13 nt, Mycobacterium bovis subsp bovis AF2122/97
gcucgagccgccc

SEQ ID NO: 1035548 - RNA, 21 nt, Mycobacterium bovis subsp bovis AF2122/97
gcucgagcaccucggccucgu

SEQ ID NO: 1035549 - RNA, 17 nt, Mycobacterium bovis subsp bovis AF2122/97
gcucgagcagcgcgccg

SEQ ID NO: 1035550 - RNA, 19 nt, Mycobacterium bovis subsp bovis AF2122/97
gcucgagcaagaucaccuu

SEQ ID NO: 1035551 - RNA, 20 nt, Mycobacterium bovis subsp bovis AF2122/97
gcucgagagcaugguccagc

SEQ ID NO: 1035552 - RNA, 22 nt, Mycobacterium bovis subsp bovis AF2122/97
gcucgagagcaugguccagcac

SEQ ID NO: 1035553 - RNA, 12 nt, Mycobacterium bovis subsp bovis AF2122/97
gcucgaccagga

SEQ ID NO: 1035554 - RNA, 18 nt, Mycobacterium bovis subsp bovis AF2122/97
gcucgaccagacgcugcc

SEQ ID NO: 1035555 - RNA, 21 nt, Mycobacterium bovis subsp bovis AF2122/97
gcucgaccagacgcugcccaa

SEQ ID NO: 1035556 - RNA, 23 nt, Mycobacterium bovis subsp bovis AF2122/97
gcucgaccaggaacggcucggcc

SEQ ID NO: 1035557 - RNA, 17 nt, Mycobacterium bovis subsp bovis AF2122/97
gcucgaccagacgcugc

SEQ ID NO: 1035558 - RNA, 17 nt, Mycobacterium bovis subsp bovis AF2122/97
gcucgacaaccacggca

SEQ ID NO: 1035559 - RNA, 18 nt, Mycobacterium bovis subsp bovis AF2122/97
gcucgaaaucgcacagcg

SEQ ID NO: 1035560 - RNA, 21 nt, Mycobacterium bovis subsp bovis AF2122/97
gcucgaaaucgcacagcgcag

SEQ ID NO: 1035561 - RNA, 16 nt, Mycobacterium bovis subsp bovis AF2122/97
gcucgaauacaccuug

SEQ ID NO: 1035562 - RNA, 15 nt, Mycobacterium bovis subsp bovis AF2122/97
gcucgaaucgucacg

SEQ ID NO: 1035563 - RNA, 21 nt, Mycobacterium bovis subsp bovis AF2122/97
gcucccgguugggguggcggu

SEQ ID NO: 1035564 - RNA, 16 nt, Mycobacterium bovis subsp bovis AF2122/97
gcucccgucucgacag

SEQ ID NO: 1035565 - RNA, 23 nt, Mycobacterium bovis subsp bovis AF2122/97
gcucccgucucgacaguggcgac

SEQ ID NO: 1035566 - RNA, 17 nt, Mycobacterium bovis subsp bovis AF2122/97
gcucccgugcuggcgcc

SEQ ID NO: 1035567 - RNA, 15 nt, Mycobacterium bovis subsp bovis AF2122/97
gcucccggccgccga

SEQ ID NO: 1035568 - RNA, 23 nt, Mycobacterium bovis subsp bovis AF2122/97
gcuccccggauuccucgucaccg

SEQ ID NO: 1035569 - RNA, 20 nt, Mycobacterium bovis subsp bovis AF2122/97
gcuccccggauuccucguca

SEQ ID NO: 1035570 - RNA, 23 nt, Mycobacterium bovis subsp bovis AF2122/97
gcuccgauuccgaacuggucgac

SEQ ID NO: 1035571 - RNA, 21 nt, Mycobacterium bovis subsp bovis AF2122/97
gcuccgccagaauugccggcg

SEQ ID NO: 1035572 - RNA, 16 nt, Mycobacterium bovis subsp bovis AF2122/97
gcuccgaucucuggug

SEQ ID NO: 1035573 - RNA, 15 nt, Mycobacterium bovis subsp bovis AF2122/97
gcuccgaccgguggc

SEQ ID NO: 1035574 - RNA, 16 nt, Mycobacterium bovis subsp bovis AF2122/97
gcuccgaaguccacgc

SEQ ID NO: 1035575 - RNA, 20 nt, Mycobacterium bovis subsp bovis AF2122/97
gcucccuaaugucugaccgg

SEQ ID NO: 1035576 - RNA, 18 nt, Mycobacterium bovis subsp bovis AF2122/97
gcucccugggcgucgacc

SEQ ID NO: 1035577 - RNA, 20 nt, Mycobacterium bovis subsp bovis AF2122/97
gcucccugggcgucgaccac

SEQ ID NO: 1035578 - RNA, 14 nt, Mycobacterium bovis subsp bovis AF2122/97
gcuccggcucgaca

SEQ ID NO: 1035579 - RNA, 16 nt, Mycobacterium bovis subsp bovis AF2122/97
gcuccggccgcguugg

SEQ ID NO: 1035580 - RNA, 13 nt, Mycobacterium bovis subsp bovis AF2122/97
gcuccggccggcc

SEQ ID NO: 1035581 - RNA, 14 nt, Mycobacterium bovis subsp bovis AF2122/97
gcuccggccggcca

SEQ ID NO: 1035582 - RNA, 21 nt, Mycobacterium bovis subsp bovis AF2122/97
gcuccggccggccagcacccg

SEQ ID NO: 1035583 - RNA, 15 nt, Mycobacterium bovis subsp bovis AF2122/97
gcuccgcggcgcagc

SEQ ID NO: 1035584 - RNA, 13 nt, Mycobacterium bovis subsp bovis AF2122/97
gcuccgccgcggg

SEQ ID NO: 1035585 - RNA, 17 nt, Mycobacterium bovis subsp bovis AF2122/97
gcuccgccggguuggcg

SEQ ID NO: 1035586 - RNA, 14 nt, Mycobacterium bovis subsp bovis AF2122/97
gcuccgccgucgcc

SEQ ID NO: 1035587 - RNA, 15 nt, Mycobacterium bovis subsp bovis AF2122/97
gcuccgccgucgccg

SEQ ID NO: 1035588 - RNA, 18 nt, Mycobacterium bovis subsp bovis AF2122/97
gcuccgccgucgccgccg

SEQ ID NO: 1035589 - RNA, 19 nt, Mycobacterium bovis subsp bovis AF2122/97
gcuccgccguugacgccgu

SEQ ID NO: 1035590 - RNA, 19 nt, Mycobacterium bovis subsp bovis AF2122/97
gcuccgccguugccgccgc

SEQ ID NO: 1035591 - RNA, 15 nt, Mycobacterium bovis subsp bovis AF2122/97
gcuccgccugccgcu

SEQ ID NO: 1035592 - RNA, 19 nt, Mycobacterium bovis subsp bovis AF2122/97
gcuccgccugccgcugguc

SEQ ID NO: 1035593 - RNA, 15 nt, Mycobacterium bovis subsp bovis AF2122/97
gcucccacggcaccc

SEQ ID NO: 1035594 - RNA, 12 nt, Mycobacterium bovis subsp bovis AF2122/97
gcucccacggca

SEQ ID NO: 1035595 - RNA, 20 nt, Mycobacterium bovis subsp bovis AF2122/97
gcuccccagcgaaucacccg

SEQ ID NO: 1035596 - RNA, 16 nt, Mycobacterium bovis subsp bovis AF2122/97
gcucccccgcuacgcg

SEQ ID NO: 1035597 - RNA, 17 nt, Mycobacterium bovis subsp bovis AF2122/97
gcuaccagcucacggcg

SEQ ID NO: 1035598 - RNA, 18 nt, Mycobacterium bovis subsp bovis AF2122/97
gcuaccaccgcaccugcg

SEQ ID NO: 1035599 - RNA, 21 nt, Mycobacterium bovis subsp bovis AF2122/97
gcuaccaacgcaacacgggcg

SEQ ID NO: 1035600 - RNA, 15 nt, Mycobacterium bovis subsp bovis AF2122/97
gcuacaucggcggcg

SEQ ID NO: 1035601 - RNA, 18 nt, Mycobacterium bovis subsp bovis AF2122/97
gcuacaucggcggcgucg

SEQ ID NO: 1035602 - RNA, 23 nt, Mycobacterium bovis subsp bovis AF2122/97
gcuacaucggcggcgucgacguc

SEQ ID NO: 1035603 - RNA, 17 nt, Mycobacterium bovis subsp bovis AF2122/97
gcuaauugcggccgccg

SEQ ID NO: 1035604 - RNA, 19 nt, Mycobacterium bovis subsp bovis AF2122/97
gcuaauugcggccgccggg

SEQ ID NO: 1035605 - RNA, 20 nt, Mycobacterium bovis subsp bovis AF2122/97
gcuaauggauccagcccgac

SEQ ID NO: 1035606 - RNA, 16 nt, Mycobacterium bovis subsp bovis AF2122/97
gcuaauagcucgccgg

SEQ ID NO: 1035607 - RNA, 18 nt, Mycobacterium bovis subsp bovis AF2122/97
gcuaauagcucgccggcg

SEQ ID NO: 1035608 - RNA, 23 nt, Mycobacterium bovis subsp bovis AF2122/97
gcuaaguccccgcuuggcgagcc

SEQ ID NO: 1035609 - RNA, 23 nt, Mycobacterium bovis subsp bovis AF2122/97
gcgcccaauccaccgauucggcg

SEQ ID NO: 1035610 - RNA, 22 nt, Mycobacterium bovis subsp bovis AF2122/97
gcgcccaccgaaaccggucagc

SEQ ID NO: 1035611 - RNA, 16 nt, Mycobacterium bovis subsp bovis AF2122/97
gcgcccaccguagacg

SEQ ID NO: 1035612 - RNA, 14 nt, Mycobacterium bovis subsp bovis AF2122/97
gcgcccaccgaaac

SEQ ID NO: 1035613 - RNA, 13 nt, Mycobacterium bovis subsp bovis AF2122/97
gcgcccacaucgu

SEQ ID NO: 1035614 - RNA, 21 nt, Mycobacterium bovis subsp bovis AF2122/97
gcgcccaccaugaucacaccg

SEQ ID NO: 1035615 - RNA, 17 nt, Mycobacterium bovis subsp bovis AF2122/97
gcgcccaccccggccgc

SEQ ID NO: 1035616 - RNA, 18 nt, Mycobacterium bovis subsp bovis AF2122/97
gcgcccaccccggccgca

SEQ ID NO: 1035617 - RNA, 12 nt, Mycobacterium bovis subsp bovis AF2122/97
gcgcccagcacg

SEQ ID NO: 1035618 - RNA, 13 nt, Mycobacterium bovis subsp bovis AF2122/97
gcgcccagcacgu

SEQ ID NO: 1035619 - RNA, 12 nt, Mycobacterium bovis subsp bovis AF2122/97
gcgccauuucga

SEQ ID NO: 1035620 - RNA, 16 nt, Mycobacterium bovis subsp bovis AF2122/97
gcgccauuucgagggc

SEQ ID NO: 1035621 - RNA, 21 nt, Mycobacterium bovis subsp bovis AF2122/97
gcgccauuucgagggcaacgg

SEQ ID NO: 1035622 - RNA, 20 nt, Mycobacterium bovis subsp bovis AF2122/97
gcgccauugcgggaacguca

SEQ ID NO: 1035623 - RNA, 17 nt, Mycobacterium bovis subsp bovis AF2122/97
gcgccauuggcgccgcc

SEQ ID NO: 1035624 - RNA, 18 nt, Mycobacterium bovis subsp bovis AF2122/97
gcgccauuggcgccgccg

SEQ ID NO: 1035625 - RNA, 20 nt, Mycobacterium bovis subsp bovis AF2122/97
gcgccauuggcgccgccgau

SEQ ID NO: 1035626 - RNA, 16 nt, Mycobacterium bovis subsp bovis AF2122/97
gcgccauuggcguccc

SEQ ID NO: 1035627 - RNA, 19 nt, Mycobacterium bovis subsp bovis AF2122/97
gcgccauagccgcgacccg

SEQ ID NO: 1035628 - RNA, 16 nt, Mycobacterium bovis subsp bovis AF2122/97
gcgccauucccggugg

SEQ ID NO: 1035629 - RNA, 17 nt, Mycobacterium bovis subsp bovis AF2122/97
gcgccauucgccccacc

SEQ ID NO: 1035630 - RNA, 20 nt, Mycobacterium bovis subsp bovis AF2122/97
gcgccaguguggugcggcgc

SEQ ID NO: 1035631 - RNA, 21 nt, Mycobacterium bovis subsp bovis AF2122/97
gcgccaguguggugcggcgcg

SEQ ID NO: 1035632 - RNA, 22 nt, Mycobacterium bovis subsp bovis AF2122/97
gcgccaguguggugcggcgcga

SEQ ID NO: 1035633 - RNA, 22 nt, Mycobacterium bovis subsp bovis AF2122/97
gcgccaguagcacguugacguc

SEQ ID NO: 1035634 - RNA, 16 nt, Mycobacterium bovis subsp bovis AF2122/97
gcgccaguggccacca

SEQ ID NO: 1035635 - RNA, 18 nt, Mycobacterium bovis subsp bovis AF2122/97
gcgccaguggccaccauc

SEQ ID NO: 1035636 - RNA, 18 nt, Mycobacterium bovis subsp bovis AF2122/97
gcgccaguucgcggcugc

SEQ ID NO: 1035637 - RNA, 19 nt, Mycobacterium bovis subsp bovis AF2122/97
gcgccaguggccaccauca

SEQ ID NO: 1035638 - RNA, 23 nt, Mycobacterium bovis subsp bovis AF2122/97
gcgcccauugacguagaccgucg

SEQ ID NO: 1035639 - RNA, 22 nt, Mycobacterium bovis subsp bovis AF2122/97
gcgccccagggggcgugccgcc

SEQ ID NO: 1035640 - RNA, 14 nt, Mycobacterium bovis subsp bovis AF2122/97
gcgcccgagccggu

SEQ ID NO: 1035641 - RNA, 12 nt, Mycobacterium bovis subsp bovis AF2122/97
gcgcccgagccg

SEQ ID NO: 1035642 - RNA, 14 nt, Mycobacterium bovis subsp bovis AF2122/97
gcgcccccgccauu

SEQ ID NO: 1035643 - RNA, 14 nt, Mycobacterium bovis subsp bovis AF2122/97
gcgcccccagcagc

SEQ ID NO: 1035644 - RNA, 15 nt, Mycobacterium bovis subsp bovis AF2122/97
gcgcccgaagccggg

SEQ ID NO: 1035645 - RNA, 20 nt, Mycobacterium bovis subsp bovis AF2122/97
gcgcccgaagccgggcccca

SEQ ID NO: 1035646 - RNA, 15 nt, Mycobacterium bovis subsp bovis AF2122/97
gcgcccgaaugcgac

SEQ ID NO: 1035647 - RNA, 21 nt, Mycobacterium bovis subsp bovis AF2122/97
gcgcccgacgaacagcggucc

SEQ ID NO: 1035648 - RNA, 16 nt, Mycobacterium bovis subsp bovis AF2122/97
gcgccccaccgcgccg

SEQ ID NO: 1035649 - RNA, 21 nt, Mycobacterium bovis subsp bovis AF2122/97
gcgcccgacggaguucgacgu

SEQ ID NO: 1035650 - RNA, 22 nt, Mycobacterium bovis subsp bovis AF2122/97
gcgcccaucgcgacggcccgau

SEQ ID NO: 1035651 - RNA, 16 nt, Mycobacterium bovis subsp bovis AF2122/97
gcgcccauggccacca

SEQ ID NO: 1035652 - RNA, 19 nt, Mycobacterium bovis subsp bovis AF2122/97
gcgcccaggccgaucagcg

SEQ ID NO: 1035653 - RNA, 12 nt, Mycobacterium bovis subsp bovis AF2122/97
gcgcccagcgcc

SEQ ID NO: 1035654 - RNA, 12 nt, Mycobacterium bovis subsp bovis AF2122/97
gcgcccagcgac

SEQ ID NO: 1035655 - RNA, 14 nt, Mycobacterium bovis subsp bovis AF2122/97
gcgcccagcgaccc

SEQ ID NO: 1035656 - RNA, 14 nt, Mycobacterium bovis subsp bovis AF2122/97
gcgcaucugcucgg

SEQ ID NO: 1035657 - RNA, 18 nt, Mycobacterium bovis subsp bovis AF2122/97
gcgcaucggccagcagcg

SEQ ID NO: 1035658 - RNA, 12 nt, Mycobacterium bovis subsp bovis AF2122/97
gcgcaucgccgc

SEQ ID NO: 1035659 - RNA, 20 nt, Mycobacterium bovis subsp bovis AF2122/97
gcgcaucggccagcagcgac

SEQ ID NO: 1035660 - RNA, 22 nt, Mycobacterium bovis subsp bovis AF2122/97
gcgcaucuuggugccauucgac

SEQ ID NO: 1035661 - RNA, 13 nt, Mycobacterium bovis subsp bovis AF2122/97
gcgcaucugucgc

SEQ ID NO: 1035662 - RNA, 21 nt, Mycobacterium bovis subsp bovis AF2122/97
gcgcaucugucgcgcggcaau

SEQ ID NO: 1035663 - RNA, 14 nt, Mycobacterium bovis subsp bovis AF2122/97
gcgccacgucgacg

SEQ ID NO: 1035664 - RNA, 20 nt, Mycobacterium bovis subsp bovis AF2122/97
gcgccacggcagcgcccaga

SEQ ID NO: 1035665 - RNA, 13 nt, Mycobacterium bovis subsp bovis AF2122/97
gcgccagaucacc

SEQ ID NO: 1035666 - RNA, 14 nt, Mycobacterium bovis subsp bovis AF2122/97
gcgccagaucaccg

SEQ ID NO: 1035667 - RNA, 17 nt, Mycobacterium bovis subsp bovis AF2122/97
gcgccagaucaccgucg

SEQ ID NO: 1035668 - RNA, 18 nt, Mycobacterium bovis subsp bovis AF2122/97
gcgccagaucaccgucga

SEQ ID NO: 1035669 - RNA, 15 nt, Mycobacterium bovis subsp bovis AF2122/97
gcgccagaucgacgc

SEQ ID NO: 1035670 - RNA, 17 nt, Mycobacterium bovis subsp bovis AF2122/97
gcgccacuugaugccgc

SEQ ID NO: 1035671 - RNA, 22 nt, Mycobacterium bovis subsp bovis AF2122/97
gcgcaucgucgaaagccuggaa

SEQ ID NO: 1035672 - RNA, 16 nt, Mycobacterium bovis subsp bovis AF2122/97
gcgccacugcuuccgg

SEQ ID NO: 1035673 - RNA, 20 nt, Mycobacterium bovis subsp bovis AF2122/97
gcgccacugaccgcgaucgc

SEQ ID NO: 1035674 - RNA, 22 nt, Mycobacterium bovis subsp bovis AF2122/97
gcgccagcgagcauaccgccgc

SEQ ID NO: 1035675 - RNA, 14 nt, Mycobacterium bovis subsp bovis AF2122/97
gcgccagcgagcgc

SEQ ID NO: 1035676 - RNA, 15 nt, Mycobacterium bovis subsp bovis AF2122/97
gcgccagcgccgcca

SEQ ID NO: 1035677 - RNA, 12 nt, Mycobacterium bovis subsp bovis AF2122/97
gcgccaggccgu

SEQ ID NO: 1035678 - RNA, 14 nt, Mycobacterium bovis subsp bovis AF2122/97
gcgccaggccguug

SEQ ID NO: 1035679 - RNA, 17 nt, Mycobacterium bovis subsp bovis AF2122/97
gcgccaggccgcacagc

SEQ ID NO: 1035680 - RNA, 17 nt, Mycobacterium bovis subsp bovis AF2122/97
gcgccaguauggccgcc

SEQ ID NO: 1035681 - RNA, 20 nt, Mycobacterium bovis subsp bovis AF2122/97
gcgccaguauggccgccacc

SEQ ID NO: 1035682 - RNA, 21 nt, Mycobacterium bovis subsp bovis AF2122/97
gcgccaguaacgcccacaaug

SEQ ID NO: 1035683 - RNA, 15 nt, Mycobacterium bovis subsp bovis AF2122/97
gcgccaggcaccacg

SEQ ID NO: 1035684 - RNA, 17 nt, Mycobacterium bovis subsp bovis AF2122/97
gcgccgcguggcuggcg

SEQ ID NO: 1035685 - RNA, 21 nt, Mycobacterium bovis subsp bovis AF2122/97
gcgccgcguggcuggcggcga

SEQ ID NO: 1035686 - RNA, 20 nt, Mycobacterium bovis subsp bovis AF2122/97
gcgccgcggcuacaucggcg

SEQ ID NO: 1035687 - RNA, 24 nt, Mycobacterium bovis subsp bovis AF2122/97
gcgccgcguggcuggcggcgaccg

SEQ ID NO: 1035688 - RNA, 16 nt, Mycobacterium bovis subsp bovis AF2122/97
gcgccgcuaggugacg

SEQ ID NO: 1035689 - RNA, 22 nt, Mycobacterium bovis subsp bovis AF2122/97
gcgccgcuaggugacgccgcca

SEQ ID NO: 1035690 - RNA, 12 nt, Mycobacterium bovis subsp bovis AF2122/97
gcgccgcggcgg

SEQ ID NO: 1035691 - RNA, 15 nt, Mycobacterium bovis subsp bovis AF2122/97
gcgccgcggcgacgu

SEQ ID NO: 1035692 - RNA, 12 nt, Mycobacterium bovis subsp bovis AF2122/97
gcgccgcggcua

SEQ ID NO: 1035693 - RNA, 23 nt, Mycobacterium bovis subsp bovis AF2122/97
gcgccgcggcugggggauaccgc

SEQ ID NO: 1035694 - RNA, 13 nt, Mycobacterium bovis subsp bovis AF2122/97
gcgccgcggcccg

SEQ ID NO: 1035695 - RNA, 18 nt, Mycobacterium bovis subsp bovis AF2122/97
gcgccgcggcccgcucca

SEQ ID NO: 1035696 - RNA, 14 nt, Mycobacterium bovis subsp bovis AF2122/97
gcgccgcgccgccu

SEQ ID NO: 1035697 - RNA, 14 nt, Mycobacterium bovis subsp bovis AF2122/97
gcgccgcgcgcauu

SEQ ID NO: 1035698 - RNA, 18 nt, Mycobacterium bovis subsp bovis AF2122/97
gcgccgcauucgcgacaa

SEQ ID NO: 1035699 - RNA, 14 nt, Mycobacterium bovis subsp bovis AF2122/97
gcgccgcauucgcg

SEQ ID NO: 1035700 - RNA, 14 nt, Mycobacterium bovis subsp bovis AF2122/97
gcgccgccaacucc

SEQ ID NO: 1035701 - RNA, 20 nt, Mycobacterium bovis subsp bovis AF2122/97
gcgccgccaacuccucagcc

SEQ ID NO: 1035702 - RNA, 14 nt, Mycobacterium bovis subsp bovis AF2122/97
gcgccgccacagca

SEQ ID NO: 1035703 - RNA, 13 nt, Mycobacterium bovis subsp bovis AF2122/97
gcgccgccggcgc

SEQ ID NO: 1035704 - RNA, 14 nt, Mycobacterium bovis subsp bovis AF2122/97
gcgccgccggcgcc

SEQ ID NO: 1035705 - RNA, 15 nt, Mycobacterium bovis subsp bovis AF2122/97
gcgccgccggcgccg

SEQ ID NO: 1035706 - RNA, 22 nt, Mycobacterium bovis subsp bovis AF2122/97
gcgccgccggcucgccggcgac

SEQ ID NO: 1035707 - RNA, 21 nt, Mycobacterium bovis subsp bovis AF2122/97
gcgccgccguuaccgccggcg

SEQ ID NO: 1035708 - RNA, 23 nt, Mycobacterium bovis subsp bovis AF2122/97
gcgccgccguuaccgccggcgcc

SEQ ID NO: 1035709 - RNA, 17 nt, Mycobacterium bovis subsp bovis AF2122/97
gcgccgccguucccgcc

SEQ ID NO: 1035710 - RNA, 21 nt, Mycobacterium bovis subsp bovis AF2122/97
gcgccgccgucguacaccucg

SEQ ID NO: 1035711 - RNA, 14 nt, Mycobacterium bovis subsp bovis AF2122/97
gcgccgcgcaucgc

SEQ ID NO: 1035712 - RNA, 16 nt, Mycobacterium bovis subsp bovis AF2122/97
gcgccgcgcagcgagg

SEQ ID NO: 1035713 - RNA, 16 nt, Mycobacterium bovis subsp bovis AF2122/97
gcgccgcgcccaccau

SEQ ID NO: 1035714 - RNA, 17 nt, Mycobacterium bovis subsp bovis AF2122/97
gcgccgcgcccaccaug

SEQ ID NO: 1035715 - RNA, 13 nt, Mycobacterium bovis subsp bovis AF2122/97
gcgccgcgcccac

SEQ ID NO: 1035716 - RNA, 14 nt, Mycobacterium bovis subsp bovis AF2122/97
gcgccgcgcccacc

SEQ ID NO: 1035717 - RNA, 17 nt, Mycobacterium bovis subsp bovis AF2122/97
gcgccgcgacgaugccu

SEQ ID NO: 1035718 - RNA, 22 nt, Mycobacterium bovis subsp bovis AF2122/97
gcgccgccuggacgccgccgga

SEQ ID NO: 1035719 - RNA, 20 nt, Mycobacterium bovis subsp bovis AF2122/97
gcgccgcgacaaaucggucg

SEQ ID NO: 1035720 - RNA, 22 nt, Mycobacterium bovis subsp bovis AF2122/97
gcgccgcauucgcgacaacucg

SEQ ID NO: 1035721 - RNA, 16 nt, Mycobacterium bovis subsp bovis AF2122/97
gcgccgcgaggcaccg

SEQ ID NO: 1035722 - RNA, 14 nt, Mycobacterium bovis subsp bovis AF2122/97
gcgccgacccgcgc

SEQ ID NO: 1035723 - RNA, 17 nt, Mycobacterium bovis subsp bovis AF2122/97
gcgccgacccgcgcgcc

SEQ ID NO: 1035724 - RNA, 16 nt, Mycobacterium bovis subsp bovis AF2122/97
gcgccgagauccacgc

SEQ ID NO: 1035725 - RNA, 16 nt, Mycobacterium bovis subsp bovis AF2122/97
gcgccgagagcaccgc

SEQ ID NO: 1035726 - RNA, 13 nt, Mycobacterium bovis subsp bovis AF2122/97
gcgccgaccgacg

SEQ ID NO: 1035727 - RNA, 17 nt, Mycobacterium bovis subsp bovis AF2122/97
gcgccgaccgacgucgc

SEQ ID NO: 1035728 - RNA, 15 nt, Mycobacterium bovis subsp bovis AF2122/97
gcgccgaccucaucg

SEQ ID NO: 1035729 - RNA, 20 nt, Mycobacterium bovis subsp bovis AF2122/97
gcgccgaccucaucggcacc

SEQ ID NO: 1035730 - RNA, 17 nt, Mycobacterium bovis subsp bovis AF2122/97
gcgccgagauccacgcc

SEQ ID NO: 1035731 - RNA, 19 nt, Mycobacterium bovis subsp bovis AF2122/97
gcgccgagauccacgccag

SEQ ID NO: 1035732 - RNA, 21 nt, Mycobacterium bovis subsp bovis AF2122/97
gcgccgagaucgacaucguug

SEQ ID NO: 1035733 - RNA, 18 nt, Mycobacterium bovis subsp bovis AF2122/97
gcgccgagccagcacccg

SEQ ID NO: 1035734 - RNA, 20 nt, Mycobacterium bovis subsp bovis AF2122/97
gcgccgagccagcacccgca

SEQ ID NO: 1035735 - RNA, 13 nt, Mycobacterium bovis subsp bovis AF2122/97
gcgccgagcccgg

SEQ ID NO: 1035736 - RNA, 16 nt, Mycobacterium bovis subsp bovis AF2122/97
gcgccgagcccgggcc

SEQ ID NO: 1035737 - RNA, 15 nt, Mycobacterium bovis subsp bovis AF2122/97
gcgccgagcucggcg

SEQ ID NO: 1035738 - RNA, 17 nt, Mycobacterium bovis subsp bovis AF2122/97
gcgccgagcucggcgcc

SEQ ID NO: 1035739 - RNA, 17 nt, Mycobacterium bovis subsp bovis AF2122/97
gcgccgaugccggccaa

SEQ ID NO: 1035740 - RNA, 20 nt, Mycobacterium bovis subsp bovis AF2122/97
gcgccgauguggccggcgau

SEQ ID NO: 1035741 - RNA, 18 nt, Mycobacterium bovis subsp bovis AF2122/97
gcgccgauguggccggcg

SEQ ID NO: 1035742 - RNA, 14 nt, Mycobacterium bovis subsp bovis AF2122/97
gcgccgaugucguc

SEQ ID NO: 1035743 - RNA, 16 nt, Mycobacterium bovis subsp bovis AF2122/97
gcgccgcaugccaccg

SEQ ID NO: 1035744 - RNA, 17 nt, Mycobacterium bovis subsp bovis AF2122/97
gcgccgcaugccaccga

SEQ ID NO: 1035745 - RNA, 13 nt, Mycobacterium bovis subsp bovis AF2122/97
gcgccgcaggguc

SEQ ID NO: 1035746 - RNA, 22 nt, Mycobacterium bovis subsp bovis AF2122/97
gcgccgcaucauagacagggcc

SEQ ID NO: 1035747 - RNA, 15 nt, Mycobacterium bovis subsp bovis AF2122/97
gcgccgcauccagcc

SEQ ID NO: 1035748 - RNA, 19 nt, Mycobacterium bovis subsp bovis AF2122/97
gcgccgauuccaccgccga

SEQ ID NO: 1035749 - RNA, 20 nt, Mycobacterium bovis subsp bovis AF2122/97
gcgccgauuccaccgccgac

SEQ ID NO: 1035750 - RNA, 23 nt, Mycobacterium bovis subsp bovis AF2122/97
gcgccgauuccaccgccgacgcc

SEQ ID NO: 1035751 - RNA, 17 nt, Mycobacterium bovis subsp bovis AF2122/97
gcgccgaauuggcccgg

SEQ ID NO: 1035752 - RNA, 12 nt, Mycobacterium bovis subsp bovis AF2122/97
gcgccgacaccg

SEQ ID NO: 1035753 - RNA, 14 nt, Mycobacterium bovis subsp bovis AF2122/97
gcgccgacagccga

SEQ ID NO: 1035754 - RNA, 15 nt, Mycobacterium bovis subsp bovis AF2122/97
gcgccgacagccgau

SEQ ID NO: 1035755 - RNA, 15 nt, Mycobacterium bovis subsp bovis AF2122/97
gcgccgaaugccacc

SEQ ID NO: 1035756 - RNA, 19 nt, Mycobacterium bovis subsp bovis AF2122/97
gcgccgaaguagccgaccg

SEQ ID NO: 1035757 - RNA, 18 nt, Mycobacterium bovis subsp bovis AF2122/97
gcgccgaaugccaccucg

SEQ ID NO: 1035758 - RNA, 16 nt, Mycobacterium bovis subsp bovis AF2122/97
gcgccgaauggcggug

SEQ ID NO: 1035759 - RNA, 22 nt, Mycobacterium bovis subsp bovis AF2122/97
gcgccgaauucauccgggcucg

SEQ ID NO: 1035760 - RNA, 18 nt, Mycobacterium bovis subsp bovis AF2122/97
gcgccgacagccgauccg

SEQ ID NO: 1035761 - RNA, 23 nt, Mycobacterium bovis subsp bovis AF2122/97
gcgccgacagccgauccgaucgc

SEQ ID NO: 1035762 - RNA, 16 nt, Mycobacterium bovis subsp bovis AF2122/97
gcgccgaacgcuccag

SEQ ID NO: 1035763 - RNA, 20 nt, Mycobacterium bovis subsp bovis AF2122/97
gcgccgaacucaacgacacc

SEQ ID NO: 1035764 - RNA, 22 nt, Mycobacterium bovis subsp bovis AF2122/97
gcgccgaacgcaacgccgaugg

SEQ ID NO: 1035765 - RNA, 14 nt, Mycobacterium bovis subsp bovis AF2122/97
gcgccgaacgccag

SEQ ID NO: 1035766 - RNA, 15 nt, Mycobacterium bovis subsp bovis AF2122/97
gcgccgaaggccgcc

SEQ ID NO: 1035767 - RNA, 12 nt, Mycobacterium bovis subsp bovis AF2122/97
gcgcccgcucgg

SEQ ID NO: 1035768 - RNA, 12 nt, Mycobacterium bovis subsp bovis AF2122/97
gcgcccgauccg

SEQ ID NO: 1035769 - RNA, 16 nt, Mycobacterium bovis subsp bovis AF2122/97
gcgcccgcucggccgc

SEQ ID NO: 1035770 - RNA, 20 nt, Mycobacterium bovis subsp bovis AF2122/97
gcgcccggauguccgccgac

SEQ ID NO: 1035771 - RNA, 21 nt, Mycobacterium bovis subsp bovis AF2122/97
gcgcccggauguccgccgacg

SEQ ID NO: 1035772 - RNA, 19 nt, Mycobacterium bovis subsp bovis AF2122/97
gcgcccggauguccgccga

SEQ ID NO: 1035773 - RNA, 14 nt, Mycobacterium bovis subsp bovis AF2122/97
gcgccgaacccggu

SEQ ID NO: 1035774 - RNA, 12 nt, Mycobacterium bovis subsp bovis AF2122/97
gcgcccggccac

SEQ ID NO: 1035775 - RNA, 20 nt, Mycobacterium bovis subsp bovis AF2122/97
gcgcccggccacuccaguac

SEQ ID NO: 1035776 - RNA, 13 nt, Mycobacterium bovis subsp bovis AF2122/97
gcgcccgcaccac

SEQ ID NO: 1035777 - RNA, 14 nt, Mycobacterium bovis subsp bovis AF2122/97
gcgcccgcaccacc

SEQ ID NO: 1035778 - RNA, 13 nt, Mycobacterium bovis subsp bovis AF2122/97
gcgcccgcgugac

SEQ ID NO: 1035779 - RNA, 16 nt, Mycobacterium bovis subsp bovis AF2122/97
gcgcccgcgugacgcu

SEQ ID NO: 1035780 - RNA, 22 nt, Mycobacterium bovis subsp bovis AF2122/97
gcgcaucaccacccgaccgcca

SEQ ID NO: 1035781 - RNA, 22 nt, Mycobacterium bovis subsp bovis AF2122/97
gcgcaucagcuuuugcaccgga

SEQ ID NO: 1035782 - RNA, 16 nt, Mycobacterium bovis subsp bovis AF2122/97
gcgcauccaauaucgc

SEQ ID NO: 1035783 - RNA, 17 nt, Mycobacterium bovis subsp bovis AF2122/97
gcgcaucaucgcccacc

SEQ ID NO: 1035784 - RNA, 13 nt, Mycobacterium bovis subsp bovis AF2122/97
gcgcaucaacgga

SEQ ID NO: 1035785 - RNA, 16 nt, Mycobacterium bovis subsp bovis AF2122/97
gcgcaguuuggcggcg

SEQ ID NO: 1035786 - RNA, 17 nt, Mycobacterium bovis subsp bovis AF2122/97
gcgcaguuuggcggcgc

SEQ ID NO: 1035787 - RNA, 15 nt, Mycobacterium bovis subsp bovis AF2122/97
gcgcaguucgucgug

SEQ ID NO: 1035788 - RNA, 18 nt, Mycobacterium bovis subsp bovis AF2122/97
gcgcaguuggcaccagcc

SEQ ID NO: 1035789 - RNA, 16 nt, Mycobacterium bovis subsp bovis AF2122/97
gcgcauaggcgaucgu

SEQ ID NO: 1035790 - RNA, 19 nt, Mycobacterium bovis subsp bovis AF2122/97
gcgcauaggcuuccggcgc

SEQ ID NO: 1035791 - RNA, 20 nt, Mycobacterium bovis subsp bovis AF2122/97
gcgcauaggcuuccggcgcg

SEQ ID NO: 1035792 - RNA, 17 nt, Mycobacterium bovis subsp bovis AF2122/97
gcgcauagggccaccgc

SEQ ID NO: 1035793 - RNA, 21 nt, Mycobacterium bovis subsp bovis AF2122/97
gcgcauagggccaccgccgcc

SEQ ID NO: 1035794 - RNA, 23 nt, Mycobacterium bovis subsp bovis AF2122/97
gcgcauagggccaccgccgccug

SEQ ID NO: 1035795 - RNA, 13 nt, Mycobacterium bovis subsp bovis AF2122/97
gcgcaucggccag

SEQ ID NO: 1035796 - RNA, 14 nt, Mycobacterium bovis subsp bovis AF2122/97
gcgcaucggccagc

SEQ ID NO: 1035797 - RNA, 17 nt, Mycobacterium bovis subsp bovis AF2122/97
gcgcaucggccagcagc

SEQ ID NO: 1035798 - RNA, 15 nt, Mycobacterium bovis subsp bovis AF2122/97
gcgcaucgccaccau

SEQ ID NO: 1035799 - RNA, 14 nt, Mycobacterium bovis subsp bovis AF2122/97
gcgcaucgccgaca

SEQ ID NO: 1035800 - RNA, 17 nt, Mycobacterium bovis subsp bovis AF2122/97
gcgcaucgccgacagcg

SEQ ID NO: 1035801 - RNA, 21 nt, Mycobacterium bovis subsp bovis AF2122/97
gcgcaucgcacgggccaccag

SEQ ID NO: 1035802 - RNA, 19 nt, Mycobacterium bovis subsp bovis AF2122/97
gcgcauccgucguacacgc

SEQ ID NO: 1035803 - RNA, 15 nt, Mycobacterium bovis subsp bovis AF2122/97
gcgcagggaucgcag

SEQ ID NO: 1035804 - RNA, 18 nt, Mycobacterium bovis subsp bovis AF2122/97
gcgcaggcuuccagccac

SEQ ID NO: 1035805 - RNA, 13 nt, Mycobacterium bovis subsp bovis AF2122/97
gcgcagggcgaca

SEQ ID NO: 1035806 - RNA, 14 nt, Mycobacterium bovis subsp bovis AF2122/97
gcgcagggcgucgg

SEQ ID NO: 1035807 - RNA, 16 nt, Mycobacterium bovis subsp bovis AF2122/97
gcgcagggcgucggcg

SEQ ID NO: 1035808 - RNA, 18 nt, Mycobacterium bovis subsp bovis AF2122/97
gcgcagggcgucggcgaa

SEQ ID NO: 1035809 - RNA, 22 nt, Mycobacterium bovis subsp bovis AF2122/97
gcgcagguagccaucggugcgc

SEQ ID NO: 1035810 - RNA, 21 nt, Mycobacterium bovis subsp bovis AF2122/97
gcgcagucugauuccacauca

SEQ ID NO: 1035811 - RNA, 19 nt, Mycobacterium bovis subsp bovis AF2122/97
gcgcaguagccgaccagga

SEQ ID NO: 1035812 - RNA, 21 nt, Mycobacterium bovis subsp bovis AF2122/97
gcgcaguagccgaccaggacc

SEQ ID NO: 1035813 - RNA, 14 nt, Mycobacterium bovis subsp bovis AF2122/97
gcgcaggggcggcg

SEQ ID NO: 1035814 - RNA, 17 nt, Mycobacterium bovis subsp bovis AF2122/97
gcgcaguuggcaccagc

SEQ ID NO: 1035815 - RNA, 13 nt, Mycobacterium bovis subsp bovis AF2122/97
gcgcaggugcugg

SEQ ID NO: 1035816 - RNA, 20 nt, Mycobacterium bovis subsp bovis AF2122/97
gcgcaguaacgucgucgcgu

SEQ ID NO: 1035817 - RNA, 23 nt, Mycobacterium bovis subsp bovis AF2122/97
gcgcaguaacgucgucgcgucgc

SEQ ID NO: 1035818 - RNA, 18 nt, Mycobacterium bovis subsp bovis AF2122/97
gcgcaguagccgaccagg

SEQ ID NO: 1035819 - RNA, 14 nt, Mycobacterium bovis subsp bovis AF2122/97
gcgcagcgcgaucg

SEQ ID NO: 1035820 - RNA, 15 nt, Mycobacterium bovis subsp bovis AF2122/97
gcgcagcgcgaucgc

SEQ ID NO: 1035821 - RNA, 16 nt, Mycobacterium bovis subsp bovis AF2122/97
gcgcagcgcgaucgcg

SEQ ID NO: 1035822 - RNA, 21 nt, Mycobacterium bovis subsp bovis AF2122/97
gcgcagcgccugcggcagcac

SEQ ID NO: 1035823 - RNA, 14 nt, Mycobacterium bovis subsp bovis AF2122/97
gcgcagcggacgga

SEQ ID NO: 1035824 - RNA, 22 nt, Mycobacterium bovis subsp bovis AF2122/97
gcgcagcgcgaugucgccggcg

SEQ ID NO: 1035825 - RNA, 13 nt, Mycobacterium bovis subsp bovis AF2122/97
gcgcagcgccgcc

SEQ ID NO: 1035826 - RNA, 15 nt, Mycobacterium bovis subsp bovis AF2122/97
gcgcagccuggucgc

SEQ ID NO: 1035827 - RNA, 14 nt, Mycobacterium bovis subsp bovis AF2122/97
gcgcagcgccagcg

SEQ ID NO: 1035828 - RNA, 14 nt, Mycobacterium bovis subsp bovis AF2122/97
gcgcagcgccaucg

SEQ ID NO: 1035829 - RNA, 17 nt, Mycobacterium bovis subsp bovis AF2122/97
gcgcagccgggccaacc

SEQ ID NO: 1035830 - RNA, 13 nt, Mycobacterium bovis subsp bovis AF2122/97
gcgcagccgccgc

SEQ ID NO: 1035831 - RNA, 14 nt, Mycobacterium bovis subsp bovis AF2122/97
gcgcagccgccgcg

SEQ ID NO: 1035832 - RNA, 16 nt, Mycobacterium bovis subsp bovis AF2122/97
gcgcagccgccgcgcc

SEQ ID NO: 1035833 - RNA, 21 nt, Mycobacterium bovis subsp bovis AF2122/97
gcgcagccaggugucgucgau

SEQ ID NO: 1035834 - RNA, 13 nt, Mycobacterium bovis subsp bovis AF2122/97
gcgcaggccgccg

SEQ ID NO: 1035835 - RNA, 15 nt, Mycobacterium bovis subsp bovis AF2122/97
gcgcaggccgccgcc

SEQ ID NO: 1035836 - RNA, 16 nt, Mycobacterium bovis subsp bovis AF2122/97
gcgcaggccgccgcca

SEQ ID NO: 1035837 - RNA, 16 nt, Mycobacterium bovis subsp bovis AF2122/97
gcgcagcuccaccgug

SEQ ID NO: 1035838 - RNA, 22 nt, Mycobacterium bovis subsp bovis AF2122/97
gcgcaggagcgcgaugaccucg

SEQ ID NO: 1035839 - RNA, 16 nt, Mycobacterium bovis subsp bovis AF2122/97
gcgcagcuuggacacc

SEQ ID NO: 1035840 - RNA, 17 nt, Mycobacterium bovis subsp bovis AF2122/97
gcgcagcgguccgccgc

SEQ ID NO: 1035841 - RNA, 14 nt, Mycobacterium bovis subsp bovis AF2122/97
gcgcagcgugcgau

SEQ ID NO: 1035842 - RNA, 20 nt, Mycobacterium bovis subsp bovis AF2122/97
gcgcagcguguugcguucgg

SEQ ID NO: 1035843 - RNA, 23 nt, Mycobacterium bovis subsp bovis AF2122/97
gcgcagcuacuaccugcccguaa

SEQ ID NO: 1035844 - RNA, 22 nt, Mycobacterium bovis subsp bovis AF2122/97
gcgcaggaagcccacgaucgcg

SEQ ID NO: 1035845 - RNA, 14 nt, Mycobacterium bovis subsp bovis AF2122/97
gcgcagcugccgca

SEQ ID NO: 1035846 - RNA, 16 nt, Mycobacterium bovis subsp bovis AF2122/97
gcgcaccaucgcggcc

SEQ ID NO: 1035847 - RNA, 13 nt, Mycobacterium bovis subsp bovis AF2122/97
gcgcacccggucg

SEQ ID NO: 1035848 - RNA, 15 nt, Mycobacterium bovis subsp bovis AF2122/97
gcgcacccggucggc

SEQ ID NO: 1035849 - RNA, 15 nt, Mycobacterium bovis subsp bovis AF2122/97
gcgcaccccggcaua

SEQ ID NO: 1035850 - RNA, 17 nt, Mycobacterium bovis subsp bovis AF2122/97
gcgcacccgcgggucgu

SEQ ID NO: 1035851 - RNA, 22 nt, Mycobacterium bovis subsp bovis AF2122/97
gcgcacccgcgggucguccggc

SEQ ID NO: 1035852 - RNA, 16 nt, Mycobacterium bovis subsp bovis AF2122/97
gcgcacccggucggcg

SEQ ID NO: 1035853 - RNA, 20 nt, Mycobacterium bovis subsp bovis AF2122/97
gcgcacccggucggcggcau

SEQ ID NO: 1035854 - RNA, 18 nt, Mycobacterium bovis subsp bovis AF2122/97
gcgcacccugcgugcggc

SEQ ID NO: 1035855 - RNA, 17 nt, Mycobacterium bovis subsp bovis AF2122/97
gcgcaccgaccgcaccg

SEQ ID NO: 1035856 - RNA, 17 nt, Mycobacterium bovis subsp bovis AF2122/97
gcgcacccguccgccgc

SEQ ID NO: 1035857 - RNA, 17 nt, Mycobacterium bovis subsp bovis AF2122/97
gcgauauaggacgccgc

SEQ ID NO: 1035858 - RNA, 22 nt, Mycobacterium bovis subsp bovis AF2122/97
gcgauauccacaauccgcucgg

SEQ ID NO: 1035859 - RNA, 23 nt, Mycobacterium bovis subsp bovis AF2122/97
gcgauauccacaauccgcucggu

SEQ ID NO: 1035860 - RNA, 15 nt, Mycobacterium bovis subsp bovis AF2122/97
gcgauaucgcacaug

SEQ ID NO: 1035861 - RNA, 22 nt, Mycobacterium bovis subsp bovis AF2122/97
gcgauaucggcggcuuggccgc

SEQ ID NO: 1035862 - RNA, 13 nt, Mycobacterium bovis subsp bovis AF2122/97
gcgauaucgcaca

SEQ ID NO: 1035863 - RNA, 15 nt, Mycobacterium bovis subsp bovis AF2122/97
gcgaucaccaccgga

SEQ ID NO: 1035864 - RNA, 18 nt, Mycobacterium bovis subsp bovis AF2122/97
gcgaucacccccuggacu

SEQ ID NO: 1035865 - RNA, 15 nt, Mycobacterium bovis subsp bovis AF2122/97
gcgcaccaguccagc

SEQ ID NO: 1035866 - RNA, 16 nt, Mycobacterium bovis subsp bovis AF2122/97
gcgaucaacgcgcacc

SEQ ID NO: 1035867 - RNA, 15 nt, Mycobacterium bovis subsp bovis AF2122/97
gcgaucaacggaucg

SEQ ID NO: 1035868 - RNA, 17 nt, Mycobacterium bovis subsp bovis AF2122/97
gcgaucaacucgggcag

SEQ ID NO: 1035869 - RNA, 19 nt, Mycobacterium bovis subsp bovis AF2122/97
gcgaucaaccgcugucacc

SEQ ID NO: 1035870 - RNA, 17 nt, Mycobacterium bovis subsp bovis AF2122/97
gcgcaccgcgggaucgg

SEQ ID NO: 1035871 - RNA, 19 nt, Mycobacterium bovis subsp bovis AF2122/97
gcgcaccggcgucggcgcg

SEQ ID NO: 1035872 - RNA, 20 nt, Mycobacterium bovis subsp bovis AF2122/97
gcgcaccggcgucggcgcgg

SEQ ID NO: 1035873 - RNA, 22 nt, Mycobacterium bovis subsp bovis AF2122/97
gcgcaccggcgucggcgcggcc

SEQ ID NO: 1035874 - RNA, 23 nt, Mycobacterium bovis subsp bovis AF2122/97
gcgcaccggguugagccgccgcg

SEQ ID NO: 1035875 - RNA, 14 nt, Mycobacterium bovis subsp bovis AF2122/97
gcgcaccggcuggc

SEQ ID NO: 1035876 - RNA, 20 nt, Mycobacterium bovis subsp bovis AF2122/97
gcgcaccggcuggcccagcg

SEQ ID NO: 1035877 - RNA, 22 nt, Mycobacterium bovis subsp bovis AF2122/97
gcgcaccggaucgccgucgcga

SEQ ID NO: 1035878 - RNA, 12 nt, Mycobacterium bovis subsp bovis AF2122/97
gcgcaccgucgc

SEQ ID NO: 1035879 - RNA, 15 nt, Mycobacterium bovis subsp bovis AF2122/97
gcgcaccguggcgga

SEQ ID NO: 1035880 - RNA, 19 nt, Mycobacterium bovis subsp bovis AF2122/97
gcgcaccuggcgcgcgcaa

SEQ ID NO: 1035881 - RNA, 15 nt, Mycobacterium bovis subsp bovis AF2122/97
gcgcaccggucaacg

SEQ ID NO: 1035882 - RNA, 15 nt, Mycobacterium bovis subsp bovis AF2122/97
gcgcaccuugaccgu

SEQ ID NO: 1035883 - RNA, 18 nt, Mycobacterium bovis subsp bovis AF2122/97
gcgcaccuugaccgucgc

SEQ ID NO: 1035884 - RNA, 18 nt, Mycobacterium bovis subsp bovis AF2122/97
gcgcaccugaaggcggcg

SEQ ID NO: 1035885 - RNA, 18 nt, Mycobacterium bovis subsp bovis AF2122/97
gcgcaccugggucgacga

SEQ ID NO: 1035886 - RNA, 18 nt, Mycobacterium bovis subsp bovis AF2122/97
gcgcacgauagccaccga

SEQ ID NO: 1035887 - RNA, 18 nt, Mycobacterium bovis subsp bovis AF2122/97
gcgcacgauuucgagcgc

SEQ ID NO: 1035888 - RNA, 14 nt, Mycobacterium bovis subsp bovis AF2122/97
gcgcacgcagccga

SEQ ID NO: 1035889 - RNA, 21 nt, Mycobacterium bovis subsp bovis AF2122/97
gcgcacgcgugccgcaaccgg

SEQ ID NO: 1035890 - RNA, 17 nt, Mycobacterium bovis subsp bovis AF2122/97
gcgcacgccaccgggac

SEQ ID NO: 1035891 - RNA, 14 nt, Mycobacterium bovis subsp bovis AF2122/97
gcgcagcaucggcg

SEQ ID NO: 1035892 - RNA, 15 nt, Mycobacterium bovis subsp bovis AF2122/97
gcgcagcagugccgu

SEQ ID NO: 1035893 - RNA, 18 nt, Mycobacterium bovis subsp bovis AF2122/97
gcgcagcaucuccgccgg

SEQ ID NO: 1035894 - RNA, 21 nt, Mycobacterium bovis subsp bovis AF2122/97
gcgcagcaucuccgccggucc

SEQ ID NO: 1035895 - RNA, 15 nt, Mycobacterium bovis subsp bovis AF2122/97
gcgcagcaucggcga

SEQ ID NO: 1035896 - RNA, 19 nt, Mycobacterium bovis subsp bovis AF2122/97
gcgcagcaguuggucgcgg

SEQ ID NO: 1035897 - RNA, 19 nt, Mycobacterium bovis subsp bovis AF2122/97
gcgcagcaucgucgccacg

SEQ ID NO: 1035898 - RNA, 22 nt, Mycobacterium bovis subsp bovis AF2122/97
gcgcagcaucucgucgaucucg

SEQ ID NO: 1035899 - RNA, 12 nt, Mycobacterium bovis subsp bovis AF2122/97
gcgcagcagcgg

SEQ ID NO: 1035900 - RNA, 14 nt, Mycobacterium bovis subsp bovis AF2122/97
gcgcagcagcggca

SEQ ID NO: 1035901 - RNA, 11 nt, Mycobacterium bovis subsp bovis AF2122/97
gcgcagcagcg

SEQ ID NO: 1035902 - RNA, 17 nt, Mycobacterium bovis subsp bovis AF2122/97
gcgcagcaacucgacgu

SEQ ID NO: 1035903 - RNA, 23 nt, Mycobacterium bovis subsp bovis AF2122/97
gcgcagcaccgucggcaccagca

SEQ ID NO: 1035904 - RNA, 22 nt, Mycobacterium bovis subsp bovis AF2122/97
gcgcagcaccgucggcaccagc

SEQ ID NO: 1035905 - RNA, 18 nt, Mycobacterium bovis subsp bovis AF2122/97
gcgcagcacugcggcagc

SEQ ID NO: 1035906 - RNA, 13 nt, Mycobacterium bovis subsp bovis AF2122/97
gcgcagcaccagg

SEQ ID NO: 1035907 - RNA, 16 nt, Mycobacterium bovis subsp bovis AF2122/97
gcgcagaucguccacc

SEQ ID NO: 1035908 - RNA, 17 nt, Mycobacterium bovis subsp bovis AF2122/97
gcgcagaucguccaccg

SEQ ID NO: 1035909 - RNA, 23 nt, Mycobacterium bovis subsp bovis AF2122/97
gcgcagauuccucuucaggcccu

SEQ ID NO: 1035910 - RNA, 22 nt, Mycobacterium bovis subsp bovis AF2122/97
gcgcagauggcauugcgcccac

SEQ ID NO: 1035911 - RNA, 21 nt, Mycobacterium bovis subsp bovis AF2122/97
gcgcagauuugcuccagcgac

SEQ ID NO: 1035912 - RNA, 15 nt, Mycobacterium bovis subsp bovis AF2122/97
gcgcacggcgucggc

SEQ ID NO: 1035913 - RNA, 19 nt, Mycobacterium bovis subsp bovis AF2122/97
gcgcacggcgucggccacc

SEQ ID NO: 1035914 - RNA, 22 nt, Mycobacterium bovis subsp bovis AF2122/97
gcgcacggcgucggccaccgcc

SEQ ID NO: 1035915 - RNA, 14 nt, Mycobacterium bovis subsp bovis AF2122/97
gcgcacggcuggcg

SEQ ID NO: 1035916 - RNA, 21 nt, Mycobacterium bovis subsp bovis AF2122/97
gcgcacgguccacgguggcgc

SEQ ID NO: 1035917 - RNA, 16 nt, Mycobacterium bovis subsp bovis AF2122/97
gcgcacucccggcucg

SEQ ID NO: 1035918 - RNA, 22 nt, Mycobacterium bovis subsp bovis AF2122/97
gcgcacuacucgaacaaccccg

SEQ ID NO: 1035919 - RNA, 12 nt, Mycobacterium bovis subsp bovis AF2122/97
gcgcacgucggg

SEQ ID NO: 1035920 - RNA, 21 nt, Mycobacterium bovis subsp bovis AF2122/97
gcgcacucgaagaugucguca

SEQ ID NO: 1035921 - RNA, 22 nt, Mycobacterium bovis subsp bovis AF2122/97
gcgcacucgaagaugucgucac

SEQ ID NO: 1035922 - RNA, 17 nt, Mycobacterium bovis subsp bovis AF2122/97
gcgcacucuagccgggu

SEQ ID NO: 1035923 - RNA, 23 nt, Mycobacterium bovis subsp bovis AF2122/97
gcgcacucuuuccuuccgcgaug

SEQ ID NO: 1035924 - RNA, 23 nt, Mycobacterium bovis subsp bovis AF2122/97
gcgcacuggggaggccaacccug

SEQ ID NO: 1035925 - RNA, 17 nt, Mycobacterium bovis subsp bovis AF2122/97
gcgcagagucaacgucg

SEQ ID NO: 1035926 - RNA, 14 nt, Mycobacterium bovis subsp bovis AF2122/97
gcgcagaugagcgc

SEQ ID NO: 1035927 - RNA, 18 nt, Mycobacterium bovis subsp bovis AF2122/97
gcgcagaugagcgcggcg

SEQ ID NO: 1035928 - RNA, 21 nt, Mycobacterium bovis subsp bovis AF2122/97
gcgcagaugagcgcggcgaca

SEQ ID NO: 1035929 - RNA, 21 nt, Mycobacterium bovis subsp bovis AF2122/97
gcgcagauauuccucgucggu

SEQ ID NO: 1035930 - RNA, 16 nt, Mycobacterium bovis subsp bovis AF2122/97
gcgcagaaacgccgag

SEQ ID NO: 1035931 - RNA, 18 nt, Mycobacterium bovis subsp bovis AF2122/97
gcgcagaaagucgcgcgc

SEQ ID NO: 1035932 - RNA, 22 nt, Mycobacterium bovis subsp bovis AF2122/97
gcgcagaaagucgcgcgcgaac

SEQ ID NO: 1035933 - RNA, 14 nt, Mycobacterium bovis subsp bovis AF2122/97
gcgcagaacgaucg

SEQ ID NO: 1035934 - RNA, 23 nt, Mycobacterium bovis subsp bovis AF2122/97
gcgcagaacgaucgcgcuggcgc

SEQ ID NO: 1035935 - RNA, 17 nt, Mycobacterium bovis subsp bovis AF2122/97
gcgcagaacaccaccgc

SEQ ID NO: 1035936 - RNA, 18 nt, Mycobacterium bovis subsp bovis AF2122/97
gcgcagaacaccaccgcc

SEQ ID NO: 1035937 - RNA, 15 nt, Mycobacterium bovis subsp bovis AF2122/97
gcgcagacacgaccc

SEQ ID NO: 1035938 - RNA, 16 nt, Mycobacterium bovis subsp bovis AF2122/97
gcgcagacucgccacc

SEQ ID NO: 1035939 - RNA, 18 nt, Mycobacterium bovis subsp bovis AF2122/97
gcgcagacucgccaccgc

SEQ ID NO: 1035940 - RNA, 21 nt, Mycobacterium bovis subsp bovis AF2122/97
gcgccuccagcaccacggcgc

SEQ ID NO: 1035941 - RNA, 14 nt, Mycobacterium bovis subsp bovis AF2122/97
gcgccuccgcucgg

SEQ ID NO: 1035942 - RNA, 15 nt, Mycobacterium bovis subsp bovis AF2122/97
gcgccuccggcaccu

SEQ ID NO: 1035943 - RNA, 18 nt, Mycobacterium bovis subsp bovis AF2122/97
gcgccucggaccagaccc

SEQ ID NO: 1035944 - RNA, 15 nt, Mycobacterium bovis subsp bovis AF2122/97
gcgccucgccggcca

SEQ ID NO: 1035945 - RNA, 19 nt, Mycobacterium bovis subsp bovis AF2122/97
gcgccucgccggccacccg

SEQ ID NO: 1035946 - RNA, 24 nt, Mycobacterium bovis subsp bovis AF2122/97
gcgccucgccggccacccgcgcga

SEQ ID NO: 1035947 - RNA, 16 nt, Mycobacterium bovis subsp bovis AF2122/97
gcgccuucacgcuggc

SEQ ID NO: 1035948 - RNA, 15 nt, Mycobacterium bovis subsp bovis AF2122/97
gcgccucggcaucgc

SEQ ID NO: 1035949 - RNA, 20 nt, Mycobacterium bovis subsp bovis AF2122/97
gcgccucggcaucgccgcgg

SEQ ID NO: 1035950 - RNA, 15 nt, Mycobacterium bovis subsp bovis AF2122/97
gcgccuacaccggcg

SEQ ID NO: 1035951 - RNA, 20 nt, Mycobacterium bovis subsp bovis AF2122/97
gcgccucaucggacagcgcc

SEQ ID NO: 1035952 - RNA, 15 nt, Mycobacterium bovis subsp bovis AF2122/97
gcgccguugccaccg

SEQ ID NO: 1035953 - RNA, 16 nt, Mycobacterium bovis subsp bovis AF2122/97
gcgccguugccaccgu

SEQ ID NO: 1035954 - RNA, 16 nt, Mycobacterium bovis subsp bovis AF2122/97
gcgccguugcccccgu

SEQ ID NO: 1035955 - RNA, 13 nt, Mycobacterium bovis subsp bovis AF2122/97
gcgccguugccgc

SEQ ID NO: 1035956 - RNA, 14 nt, Mycobacterium bovis subsp bovis AF2122/97
gcgccguugccgcc

SEQ ID NO: 1035957 - RNA, 18 nt, Mycobacterium bovis subsp bovis AF2122/97
gcgccguugccgccacgc

SEQ ID NO: 1035958 - RNA, 21 nt, Mycobacterium bovis subsp bovis AF2122/97
gcgccguugccgcccacgcug

SEQ ID NO: 1035959 - RNA, 17 nt, Mycobacterium bovis subsp bovis AF2122/97
gcgccguugccgccguc

SEQ ID NO: 1035960 - RNA, 22 nt, Mycobacterium bovis subsp bovis AF2122/97
gcgccguugccgccgucgccgc

SEQ ID NO: 1035961 - RNA, 19 nt, Mycobacterium bovis subsp bovis AF2122/97
gcgccuaaccccggcucga

SEQ ID NO: 1035962 - RNA, 13 nt, Mycobacterium bovis subsp bovis AF2122/97
gcgccguuggcgc

SEQ ID NO: 1035963 - RNA, 20 nt, Mycobacterium bovis subsp bovis AF2122/97
gcgccguugucggcggugaa

SEQ ID NO: 1035964 - RNA, 15 nt, Mycobacterium bovis subsp bovis AF2122/97
gcgccguugccggcg

SEQ ID NO: 1035965 - RNA, 14 nt, Mycobacterium bovis subsp bovis AF2122/97
gcgccguggcgucg

SEQ ID NO: 1035966 - RNA, 15 nt, Mycobacterium bovis subsp bovis AF2122/97
gcgccguggcgucgg

SEQ ID NO: 1035967 - RNA, 17 nt, Mycobacterium bovis subsp bovis AF2122/97
gcgccggagaucgucgc

SEQ ID NO: 1035968 - RNA, 16 nt, Mycobacterium bovis subsp bovis AF2122/97
gcgccggagccaacgg

SEQ ID NO: 1035969 - RNA, 16 nt, Mycobacterium bovis subsp bovis AF2122/97
gcgccggagccgccca

SEQ ID NO: 1035970 - RNA, 16 nt, Mycobacterium bovis subsp bovis AF2122/97
gcgccggaggcggcgc

SEQ ID NO: 1035971 - RNA, 24 nt, Mycobacterium bovis subsp bovis AF2122/97
gcgccggaguugaagaagcccgac

SEQ ID NO: 1035972 - RNA, 18 nt, Mycobacterium bovis subsp bovis AF2122/97
gcgccguucugaucugcg

SEQ ID NO: 1035973 - RNA, 21 nt, Mycobacterium bovis subsp bovis AF2122/97
gcgccguucgccuggucaccg

SEQ ID NO: 1035974 - RNA, 22 nt, Mycobacterium bovis subsp bovis AF2122/97
gcgccguucgccuggucaccga

SEQ ID NO: 1035975 - RNA, 13 nt, Mycobacterium bovis subsp bovis AF2122/97
gcgccguucgcuc

SEQ ID NO: 1035976 - RNA, 12 nt, Mycobacterium bovis subsp bovis AF2122/97
gcgccgugucac

SEQ ID NO: 1035977 - RNA, 15 nt, Mycobacterium bovis subsp bovis AF2122/97
gcgccguggcaucgc

SEQ ID NO: 1035978 - RNA, 20 nt, Mycobacterium bovis subsp bovis AF2122/97
gcgccguuaccgccguugcc

SEQ ID NO: 1035979 - RNA, 17 nt, Mycobacterium bovis subsp bovis AF2122/97
gcgccggaacgagcggc

SEQ ID NO: 1035980 - RNA, 20 nt, Mycobacterium bovis subsp bovis AF2122/97
gcgccggaacgagcggccgc

SEQ ID NO: 1035981 - RNA, 15 nt, Mycobacterium bovis subsp bovis AF2122/97
gcgccggaccagcuc

SEQ ID NO: 1035982 - RNA, 19 nt, Mycobacterium bovis subsp bovis AF2122/97
gcgccuucgccagcggcgc

SEQ ID NO: 1035983 - RNA, 12 nt, Mycobacterium bovis subsp bovis AF2122/97
gcgccuugacgc

SEQ ID NO: 1035984 - RNA, 20 nt, Mycobacterium bovis subsp bovis AF2122/97
gcgccuugauggucuccacc

SEQ ID NO: 1035985 - RNA, 15 nt, Mycobacterium bovis subsp bovis AF2122/97
gcgccuugaccagca

SEQ ID NO: 1035986 - RNA, 21 nt, Mycobacterium bovis subsp bovis AF2122/97
gcgccuugcgggccuggugga

SEQ ID NO: 1035987 - RNA, 15 nt, Mycobacterium bovis subsp bovis AF2122/97
gcgccuuggucgccg

SEQ ID NO: 1035988 - RNA, 16 nt, Mycobacterium bovis subsp bovis AF2122/97
gcgccuuggucgccgc

SEQ ID NO: 1035989 - RNA, 17 nt, Mycobacterium bovis subsp bovis AF2122/97
gcgccuuggucgccgcu

SEQ ID NO: 1035990 - RNA, 21 nt, Mycobacterium bovis subsp bovis AF2122/97
gcgccuuggucgccggcgucg

SEQ ID NO: 1035991 - RNA, 22 nt, Mycobacterium bovis subsp bovis AF2122/97
gcgccuuggucgccggcgucga

SEQ ID NO: 1035992 - RNA, 13 nt, Mycobacterium bovis subsp bovis AF2122/97
gcgccuugguccg

SEQ ID NO: 1035993 - RNA, 15 nt, Mycobacterium bovis subsp bovis AF2122/97
gcgccuuggcacccu

SEQ ID NO: 1035994 - RNA, 23 nt, Mycobacterium bovis subsp bovis AF2122/97
gcgccuuggcacccuccgccggu

SEQ ID NO: 1035995 - RNA, 22 nt, Mycobacterium bovis subsp bovis AF2122/97
gcgcgaccaggaaguagaugag

SEQ ID NO: 1035996 - RNA, 12 nt, Mycobacterium bovis subsp bovis AF2122/97
gcgcgaccaccc

SEQ ID NO: 1035997 - RNA, 19 nt, Mycobacterium bovis subsp bovis AF2122/97
gcgcgaccacccgccgcag

SEQ ID NO: 1035998 - RNA, 14 nt, Mycobacterium bovis subsp bovis AF2122/97
gcgcgaccagaauc

SEQ ID NO: 1035999 - RNA, 11 nt, Mycobacterium bovis subsp bovis AF2122/97
gcgcgaccgaa

SEQ ID NO: 1036000 - RNA, 15 nt, Mycobacterium bovis subsp bovis AF2122/97
gcgcgaccgaccagc

SEQ ID NO: 1036001 - RNA, 18 nt, Mycobacterium bovis subsp bovis AF2122/97
gcgcgaccucgcuggccg

SEQ ID NO: 1036002 - RNA, 19 nt, Mycobacterium bovis subsp bovis AF2122/97
gcgcgaccucgcuggccgc

SEQ ID NO: 1036003 - RNA, 14 nt, Mycobacterium bovis subsp bovis AF2122/97
gcgcgaccgucagg

SEQ ID NO: 1036004 - RNA, 16 nt, Mycobacterium bovis subsp bovis AF2122/97
gcgcgaccgaccagcc

SEQ ID NO: 1036005 - RNA, 14 nt, Mycobacterium bovis subsp bovis AF2122/97
gcgcgacgccgcgg

SEQ ID NO: 1036006 - RNA, 18 nt, Mycobacterium bovis subsp bovis AF2122/97
gcgcgacgccguccucgc

SEQ ID NO: 1036007 - RNA, 13 nt, Mycobacterium bovis subsp bovis AF2122/97
gcgcgacggcaac

SEQ ID NO: 1036008 - RNA, 14 nt, Mycobacterium bovis subsp bovis AF2122/97
gcgcgacggcaacg

SEQ ID NO: 1036009 - RNA, 14 nt, Mycobacterium bovis subsp bovis AF2122/97
gcgcgacggccggg

SEQ ID NO: 1036010 - RNA, 18 nt, Mycobacterium bovis subsp bovis AF2122/97
gcgcgacguagacgacgu

SEQ ID NO: 1036011 - RNA, 22 nt, Mycobacterium bovis subsp bovis AF2122/97
gcgcgacguagacgacgucggc

SEQ ID NO: 1036012 - RNA, 15 nt, Mycobacterium bovis subsp bovis AF2122/97
gcgcgacguccacca

SEQ ID NO: 1036013 - RNA, 14 nt, Mycobacterium bovis subsp bovis AF2122/97
gcgcgacguccacc

SEQ ID NO: 1036014 - RNA, 16 nt, Mycobacterium bovis subsp bovis AF2122/97
gcgcgagaucagccgg

SEQ ID NO: 1036015 - RNA, 15 nt, Mycobacterium bovis subsp bovis AF2122/97
gcgcgagagccucca

SEQ ID NO: 1036016 - RNA, 13 nt, Mycobacterium bovis subsp bovis AF2122/97
gcgcgagcagacg

SEQ ID NO: 1036017 - RNA, 15 nt, Mycobacterium bovis subsp bovis AF2122/97
gcgcgagcagacgca

SEQ ID NO: 1036018 - RNA, 17 nt, Mycobacterium bovis subsp bovis AF2122/97
gcgcgagcagacgcaga

SEQ ID NO: 1036019 - RNA, 14 nt, Mycobacterium bovis subsp bovis AF2122/97
gcgcgagccgcucc

SEQ ID NO: 1036020 - RNA, 15 nt, Mycobacterium bovis subsp bovis AF2122/97
gcgcgagcccgaacc

SEQ ID NO: 1036021 - RNA, 16 nt, Mycobacterium bovis subsp bovis AF2122/97
gcgcgagcccgaacca

SEQ ID NO: 1036022 - RNA, 15 nt, Mycobacterium bovis subsp bovis AF2122/97
gcgcgagccgcacga

SEQ ID NO: 1036023 - RNA, 21 nt, Mycobacterium bovis subsp bovis AF2122/97
gcgcgacuuucugcgcguggg

SEQ ID NO: 1036024 - RNA, 15 nt, Mycobacterium bovis subsp bovis AF2122/97
gcgcgcaacguacgc

SEQ ID NO: 1036025 - RNA, 18 nt, Mycobacterium bovis subsp bovis AF2122/97
gcgcgcaauccugcggga

SEQ ID NO: 1036026 - RNA, 16 nt, Mycobacterium bovis subsp bovis AF2122/97
gcgcgcacggcgucgg

SEQ ID NO: 1036027 - RNA, 13 nt, Mycobacterium bovis subsp bovis AF2122/97
gcgcgcacggcgu

SEQ ID NO: 1036028 - RNA, 17 nt, Mycobacterium bovis subsp bovis AF2122/97
gcgcgcaggccgccgcc

SEQ ID NO: 1036029 - RNA, 23 nt, Mycobacterium bovis subsp bovis AF2122/97
gcgcgcaccggguugagccgccg

SEQ ID NO: 1036030 - RNA, 12 nt, Mycobacterium bovis subsp bovis AF2122/97
gcgcgcaccccg

SEQ ID NO: 1036031 - RNA, 16 nt, Mycobacterium bovis subsp bovis AF2122/97
gcgcgcacgccaccgg

SEQ ID NO: 1036032 - RNA, 15 nt, Mycobacterium bovis subsp bovis AF2122/97
gcgcgccgcacccgg

SEQ ID NO: 1036033 - RNA, 16 nt, Mycobacterium bovis subsp bovis AF2122/97
gcgcgccgcagcgcgu

SEQ ID NO: 1036034 - RNA, 14 nt, Mycobacterium bovis subsp bovis AF2122/97
gcgcgccgcgacga

SEQ ID NO: 1036035 - RNA, 16 nt, Mycobacterium bovis subsp bovis AF2122/97
gcgcgccgaccagaac

SEQ ID NO: 1036036 - RNA, 20 nt, Mycobacterium bovis subsp bovis AF2122/97
gcgcgccgaucacggugggc

SEQ ID NO: 1036037 - RNA, 14 nt, Mycobacterium bovis subsp bovis AF2122/97
gcgcgccgagcccg

SEQ ID NO: 1036038 - RNA, 15 nt, Mycobacterium bovis subsp bovis AF2122/97
gcgcgccgaccaccg

SEQ ID NO: 1036039 - RNA, 16 nt, Mycobacterium bovis subsp bovis AF2122/97
gcgcgccgaccaccgc

SEQ ID NO: 1036040 - RNA, 18 nt, Mycobacterium bovis subsp bovis AF2122/97
gcgcgccaaguggcgcuc

SEQ ID NO: 1036041 - RNA, 12 nt, Mycobacterium bovis subsp bovis AF2122/97
gcgcgccaaucg

SEQ ID NO: 1036042 - RNA, 20 nt, Mycobacterium bovis subsp bovis AF2122/97
gcgcgcccggaucucggcgu

SEQ ID NO: 1036043 - RNA, 20 nt, Mycobacterium bovis subsp bovis AF2122/97
gcgcgcauaccuacccgaga

SEQ ID NO: 1036044 - RNA, 15 nt, Mycobacterium bovis subsp bovis AF2122/97
gcgcgcagggcgucg

SEQ ID NO: 1036045 - RNA, 20 nt, Mycobacterium bovis subsp bovis AF2122/97
gcgcgcauuuuucgccagcu

SEQ ID NO: 1036046 - RNA, 13 nt, Mycobacterium bovis subsp bovis AF2122/97
gcgcgccaacacc

SEQ ID NO: 1036047 - RNA, 18 nt, Mycobacterium bovis subsp bovis AF2122/97
gcgcgccaaacaccccgg

SEQ ID NO: 1036048 - RNA, 14 nt, Mycobacterium bovis subsp bovis AF2122/97
gcgcgccgucgggu

SEQ ID NO: 1036049 - RNA, 13 nt, Mycobacterium bovis subsp bovis AF2122/97
gcgcgccgucggg

SEQ ID NO: 1036050 - RNA, 13 nt, Mycobacterium bovis subsp bovis AF2122/97
gcgcgccguucgc

SEQ ID NO: 1036051 - RNA, 21 nt, Mycobacterium bovis subsp bovis AF2122/97
gcgcgccguugccgcccacgc

SEQ ID NO: 1036052 - RNA, 19 nt, Mycobacterium bovis subsp bovis AF2122/97
gcgcgccuaugggccugcg

SEQ ID NO: 1036053 - RNA, 20 nt, Mycobacterium bovis subsp bovis AF2122/97
gcgcgccuaugggccugcga

SEQ ID NO: 1036054 - RNA, 16 nt, Mycobacterium bovis subsp bovis AF2122/97
gcgcgccucgcccagc

SEQ ID NO: 1036055 - RNA, 16 nt, Mycobacterium bovis subsp bovis AF2122/97
gcgcgccugugccacc

SEQ ID NO: 1036056 - RNA, 16 nt, Mycobacterium bovis subsp bovis AF2122/97
gcgcgcgaacacccga

SEQ ID NO: 1036057 - RNA, 21 nt, Mycobacterium bovis subsp bovis AF2122/97
gcgcgcgaagaucggcgcuag

SEQ ID NO: 1036058 - RNA, 14 nt, Mycobacterium bovis subsp bovis AF2122/97
gcgcgccgcgcucg

SEQ ID NO: 1036059 - RNA, 13 nt, Mycobacterium bovis subsp bovis AF2122/97
gcgcgccggcguc

SEQ ID NO: 1036060 - RNA, 14 nt, Mycobacterium bovis subsp bovis AF2122/97
gcgcgccggcugcc

SEQ ID NO: 1036061 - RNA, 15 nt, Mycobacterium bovis subsp bovis AF2122/97
gcgcgccggcugcca

SEQ ID NO: 1036062 - RNA, 14 nt, Mycobacterium bovis subsp bovis AF2122/97
gcgcgccggucgcc

SEQ ID NO: 1036063 - RNA, 18 nt, Mycobacterium bovis subsp bovis AF2122/97
gcgcgccggucgccgacg

SEQ ID NO: 1036064 - RNA, 12 nt, Mycobacterium bovis subsp bovis AF2122/97
gcgcgccggcgg

SEQ ID NO: 1036065 - RNA, 15 nt, Mycobacterium bovis subsp bovis AF2122/97
gcgcgccggcgguag

SEQ ID NO: 1036066 - RNA, 13 nt, Mycobacterium bovis subsp bovis AF2122/97
gcgcgcugccgcu

SEQ ID NO: 1036067 - RNA, 12 nt, Mycobacterium bovis subsp bovis AF2122/97
gcgcgcugcgga

SEQ ID NO: 1036068 - RNA, 12 nt, Mycobacterium bovis subsp bovis AF2122/97
gcgcgcuggcca

SEQ ID NO: 1036069 - RNA, 15 nt, Mycobacterium bovis subsp bovis AF2122/97
gcgcgcuggccagcc

SEQ ID NO: 1036070 - RNA, 15 nt, Mycobacterium bovis subsp bovis AF2122/97
gcgcgcuggcgggcg

SEQ ID NO: 1036071 - RNA, 14 nt, Mycobacterium bovis subsp bovis AF2122/97
gcgcgcugggcccg

SEQ ID NO: 1036072 - RNA, 16 nt, Mycobacterium bovis subsp bovis AF2122/97
gcgcgcugggcgcgcu

SEQ ID NO: 1036073 - RNA, 22 nt, Mycobacterium bovis subsp bovis AF2122/97
gcgcgcuucaugagccgcugcg

SEQ ID NO: 1036074 - RNA, 16 nt, Mycobacterium bovis subsp bovis AF2122/97
gcgcggaacgcgucgc

SEQ ID NO: 1036075 - RNA, 20 nt, Mycobacterium bovis subsp bovis AF2122/97
gcgcggaacgcgucgccgac

SEQ ID NO: 1036076 - RNA, 15 nt, Mycobacterium bovis subsp bovis AF2122/97
gcgcgcugagcucga

SEQ ID NO: 1036077 - RNA, 18 nt, Mycobacterium bovis subsp bovis AF2122/97
gcgcgcugagcucgaugu

SEQ ID NO: 1036078 - RNA, 19 nt, Mycobacterium bovis subsp bovis AF2122/97
gcgcgcucguggucgacgu

SEQ ID NO: 1036079 - RNA, 16 nt, Mycobacterium bovis subsp bovis AF2122/97
gcgcgcucgcccagga

SEQ ID NO: 1036080 - RNA, 14 nt, Mycobacterium bovis subsp bovis AF2122/97
gcgcgcucgcggcu

SEQ ID NO: 1036081 - RNA, 16 nt, Mycobacterium bovis subsp bovis AF2122/97
gcgcgcucgcucaccg

SEQ ID NO: 1036082 - RNA, 15 nt, Mycobacterium bovis subsp bovis AF2122/97
gcgcgcucggccagc

SEQ ID NO: 1036083 - RNA, 21 nt, Mycobacterium bovis subsp bovis AF2122/97
gcgcgcuaggugcaacaggcg

SEQ ID NO: 1036084 - RNA, 22 nt, Mycobacterium bovis subsp bovis AF2122/97
gcgcgcuaggugcaacaggcgc

SEQ ID NO: 1036085 - RNA, 18 nt, Mycobacterium bovis subsp bovis AF2122/97
gcgcgcuacgcggccgag

SEQ ID NO: 1036086 - RNA, 13 nt, Mycobacterium bovis subsp bovis AF2122/97
gcgcgcucaacgg

SEQ ID NO: 1036087 - RNA, 18 nt, Mycobacterium bovis subsp bovis AF2122/97
gcgcgcucaacggcgaaa

SEQ ID NO: 1036088 - RNA, 15 nt, Mycobacterium bovis subsp bovis AF2122/97
gcgcgcucaucgacc

SEQ ID NO: 1036089 - RNA, 16 nt, Mycobacterium bovis subsp bovis AF2122/97
gcgcgcucaucgaccg

SEQ ID NO: 1036090 - RNA, 13 nt, Mycobacterium bovis subsp bovis AF2122/97
gcgcgccugcgcc

SEQ ID NO: 1036091 - RNA, 20 nt, Mycobacterium bovis subsp bovis AF2122/97
gcgcgcgaccauacccgcgc

SEQ ID NO: 1036092 - RNA, 12 nt, Mycobacterium bovis subsp bovis AF2122/97
gcgcgcgauggc

SEQ ID NO: 1036093 - RNA, 12 nt, Mycobacterium bovis subsp bovis AF2122/97
gcgcgcgcccga

SEQ ID NO: 1036094 - RNA, 12 nt, Mycobacterium bovis subsp bovis AF2122/97
gcgcgcgcccgg

SEQ ID NO: 1036095 - RNA, 20 nt, Mycobacterium bovis subsp bovis AF2122/97
gcgcgcggguuacccgcagc

SEQ ID NO: 1036096 - RNA, 21 nt, Mycobacterium bovis subsp bovis AF2122/97
gcgcgcggguuacccgcagcg

SEQ ID NO: 1036097 - RNA, 13 nt, Mycobacterium bovis subsp bovis AF2122/97
gcgcgcggccgcg

SEQ ID NO: 1036098 - RNA, 14 nt, Mycobacterium bovis subsp bovis AF2122/97
gcgcgcggccgcgc

SEQ ID NO: 1036099 - RNA, 12 nt, Mycobacterium bovis subsp bovis AF2122/97
gcgcgcggcgac

SEQ ID NO: 1036100 - RNA, 14 nt, Mycobacterium bovis subsp bovis AF2122/97
gcgcgcggcgacca

SEQ ID NO: 1036101 - RNA, 15 nt, Mycobacterium bovis subsp bovis AF2122/97
gcgcgcggcgaccau

SEQ ID NO: 1036102 - RNA, 22 nt, Mycobacterium bovis subsp bovis AF2122/97
gcgcggaccguguuguuagccc

SEQ ID NO: 1036103 - RNA, 15 nt, Mycobacterium bovis subsp bovis AF2122/97
gcgcggacccagcac

SEQ ID NO: 1036104 - RNA, 15 nt, Mycobacterium bovis subsp bovis AF2122/97
gcgcggagaccccgc

SEQ ID NO: 1036105 - RNA, 14 nt, Mycobacterium bovis subsp bovis AF2122/97
gcgcggagagccug

SEQ ID NO: 1036106 - RNA, 19 nt, Mycobacterium bovis subsp bovis AF2122/97
gcgcggaucaacaggccgg

SEQ ID NO: 1036107 - RNA, 19 nt, Mycobacterium bovis subsp bovis AF2122/97
gcgcggagugcccagggcc

SEQ ID NO: 1036108 - RNA, 15 nt, Mycobacterium bovis subsp bovis AF2122/97
gcgcggauggccucg

SEQ ID NO: 1036109 - RNA, 21 nt, Mycobacterium bovis subsp bovis AF2122/97
gcgcggauggguacgacaccg

SEQ ID NO: 1036110 - RNA, 22 nt, Mycobacterium bovis subsp bovis AF2122/97
gcgcggauggguacgacaccgc

SEQ ID NO: 1036111 - RNA, 18 nt, Mycobacterium bovis subsp bovis AF2122/97
gcgcggcaaaguuggccg

SEQ ID NO: 1036112 - RNA, 19 nt, Mycobacterium bovis subsp bovis AF2122/97
gcgcggcaaaguuggccgc

SEQ ID NO: 1036113 - RNA, 14 nt, Mycobacterium bovis subsp bovis AF2122/97
gcgcggcaagcucg

SEQ ID NO: 1036114 - RNA, 22 nt, Mycobacterium bovis subsp bovis AF2122/97
gcgcggcaagcucguccggugc

SEQ ID NO: 1036115 - RNA, 19 nt, Mycobacterium bovis subsp bovis AF2122/97
gcgcgggauguaccccggc

SEQ ID NO: 1036116 - RNA, 14 nt, Mycobacterium bovis subsp bovis AF2122/97
gcgcggcuugggca

SEQ ID NO: 1036117 - RNA, 19 nt, Mycobacterium bovis subsp bovis AF2122/97
gcgcggcuuguaccgcaau

SEQ ID NO: 1036118 - RNA, 22 nt, Mycobacterium bovis subsp bovis AF2122/97
gcgcggcugugcccgaucagcc

SEQ ID NO: 1036119 - RNA, 14 nt, Mycobacterium bovis subsp bovis AF2122/97
gcgcggcaccagca

SEQ ID NO: 1036120 - RNA, 21 nt, Mycobacterium bovis subsp bovis AF2122/97
gcgcggcaccagcaccgucgg

SEQ ID NO: 1036121 - RNA, 17 nt, Mycobacterium bovis subsp bovis AF2122/97
gcgcggcacccggucgg

SEQ ID NO: 1036122 - RNA, 11 nt, Mycobacterium bovis subsp bovis AF2122/97
gcgcggcaccg

SEQ ID NO: 1036123 - RNA, 21 nt, Mycobacterium bovis subsp bovis AF2122/97
gcgcggcaccgauggcgcacc

SEQ ID NO: 1036124 - RNA, 14 nt, Mycobacterium bovis subsp bovis AF2122/97
gcgcgggccgccgc

SEQ ID NO: 1036125 - RNA, 13 nt, Mycobacterium bovis subsp bovis AF2122/97
gcgcgggccggcg

SEQ ID NO: 1036126 - RNA, 15 nt, Mycobacterium bovis subsp bovis AF2122/97
gcgcgggccaccacg

SEQ ID NO: 1036127 - RNA, 19 nt, Mycobacterium bovis subsp bovis AF2122/97
gcgcggggugcgcgcgacc

SEQ ID NO: 1036128 - RNA, 16 nt, Mycobacterium bovis subsp bovis AF2122/97
gcgcgggguggcggcg

SEQ ID NO: 1036129 - RNA, 15 nt, Mycobacterium bovis subsp bovis AF2122/97
gcgcgggucgcggcu

SEQ ID NO: 1036130 - RNA, 14 nt, Mycobacterium bovis subsp bovis AF2122/97
gcgcgggucggcga

SEQ ID NO: 1036131 - RNA, 17 nt, Mycobacterium bovis subsp bovis AF2122/97
gcgcggguccagccacc

SEQ ID NO: 1036132 - RNA, 18 nt, Mycobacterium bovis subsp bovis AF2122/97
gcgcggguccagccaccg

SEQ ID NO: 1036133 - RNA, 14 nt, Mycobacterium bovis subsp bovis AF2122/97
gcgcgggugcucgg

SEQ ID NO: 1036134 - RNA, 19 nt, Mycobacterium bovis subsp bovis AF2122/97
gcgcggguggcagcggcga

SEQ ID NO: 1036135 - RNA, 15 nt, Mycobacterium bovis subsp bovis AF2122/97
gcgcggguggcucgg

SEQ ID NO: 1036136 - RNA, 23 nt, Mycobacterium bovis subsp bovis AF2122/97
gcgcgggugguucaccucggcga

SEQ ID NO: 1036137 - RNA, 19 nt, Mycobacterium bovis subsp bovis AF2122/97
gcgcgggugaccaggcggc

SEQ ID NO: 1036138 - RNA, 20 nt, Mycobacterium bovis subsp bovis AF2122/97
gcgcgggugaccaggcggcg

SEQ ID NO: 1036139 - RNA, 19 nt, Mycobacterium bovis subsp bovis AF2122/97
gcgcgggugcaaccggauu

SEQ ID NO: 1036140 - RNA, 19 nt, Mycobacterium bovis subsp bovis AF2122/97
gcgcggguugucggcgacc

SEQ ID NO: 1036141 - RNA, 14 nt, Mycobacterium bovis subsp bovis AF2122/97
gcgcggugaccggg

SEQ ID NO: 1036142 - RNA, 16 nt, Mycobacterium bovis subsp bovis AF2122/97
gcgcggugaccggguu

SEQ ID NO: 1036143 - RNA, 14 nt, Mycobacterium bovis subsp bovis AF2122/97
gcgcggugacgagc

SEQ ID NO: 1036144 - RNA, 18 nt, Mycobacterium bovis subsp bovis AF2122/97
gcgcggugacgagccacc

SEQ ID NO: 1036145 - RNA, 12 nt, Mycobacterium bovis subsp bovis AF2122/97
gcgcggugccgc

SEQ ID NO: 1036146 - RNA, 18 nt, Mycobacterium bovis subsp bovis AF2122/97
gcgcggugaugguuaccg

SEQ ID NO: 1036147 - RNA, 15 nt, Mycobacterium bovis subsp bovis AF2122/97
gcgcggugccgccac

SEQ ID NO: 1036148 - RNA, 16 nt, Mycobacterium bovis subsp bovis AF2122/97
gcgcggugccgccacc

SEQ ID NO: 1036149 - RNA, 18 nt, Mycobacterium bovis subsp bovis AF2122/97
gcgcggugccgccaccgg

SEQ ID NO: 1036150 - RNA, 18 nt, Mycobacterium bovis subsp bovis AF2122/97
gcgcgguggcggucgcca

SEQ ID NO: 1036151 - RNA, 15 nt, Mycobacterium bovis subsp bovis AF2122/97
gcgcguagcggggga

SEQ ID NO: 1036152 - RNA, 19 nt, Mycobacterium bovis subsp bovis AF2122/97
gcgcguagcgggggagcga

SEQ ID NO: 1036153 - RNA, 14 nt, Mycobacterium bovis subsp bovis AF2122/97
gcgcguacccgauc

SEQ ID NO: 1036154 - RNA, 20 nt, Mycobacterium bovis subsp bovis AF2122/97
gcgcguacccgaucagcgac

SEQ ID NO: 1036155 - RNA, 14 nt, Mycobacterium bovis subsp bovis AF2122/97
gcgcgucggcaccg

SEQ ID NO: 1036156 - RNA, 21 nt, Mycobacterium bovis subsp bovis AF2122/97
gcgcgucgucgcgcugaacgc

SEQ ID NO: 1036157 - RNA, 14 nt, Mycobacterium bovis subsp bovis AF2122/97
gcgcgucggcguug

SEQ ID NO: 1036158 - RNA, 20 nt, Mycobacterium bovis subsp bovis AF2122/97
gcgcgucguugccgggguag

SEQ ID NO: 1036159 - RNA, 13 nt, Mycobacterium bovis subsp bovis AF2122/97
gcgcgucgagcag

SEQ ID NO: 1036160 - RNA, 13 nt, Mycobacterium bovis subsp bovis AF2122/97
gcgcgucgagcga

SEQ ID NO: 1036161 - RNA, 14 nt, Mycobacterium bovis subsp bovis AF2122/97
gcgcgucgagcgac

SEQ ID NO: 1036162 - RNA, 21 nt, Mycobacterium bovis subsp bovis AF2122/97
gcgcguaguaaugcucgacgu

SEQ ID NO: 1036163 - RNA, 19 nt, Mycobacterium bovis subsp bovis AF2122/97
gcgcguagcucagcgguag

SEQ ID NO: 1036164 - RNA, 17 nt, Mycobacterium bovis subsp bovis AF2122/97
gcgcguaggcccaacga

SEQ ID NO: 1036165 - RNA, 15 nt, Mycobacterium bovis subsp bovis AF2122/97
gcgcguccgucggcg

SEQ ID NO: 1036166 - RNA, 21 nt, Mycobacterium bovis subsp bovis AF2122/97
gcgcguccgggcagccgcgcc

SEQ ID NO: 1036167 - RNA, 18 nt, Mycobacterium bovis subsp bovis AF2122/97
gcgcguaguccgcauccg

SEQ ID NO: 1036168 - RNA, 18 nt, Mycobacterium bovis subsp bovis AF2122/97
gcgcguccccagcgccac

SEQ ID NO: 1036169 - RNA, 16 nt, Mycobacterium bovis subsp bovis AF2122/97
gcgcucaccggcgucg

SEQ ID NO: 1036170 - RNA, 21 nt, Mycobacterium bovis subsp bovis AF2122/97
gcgcucaccggggccgucggc

SEQ ID NO: 1036171 - RNA, 16 nt, Mycobacterium bovis subsp bovis AF2122/97
gcgcucacccgccgcg

SEQ ID NO: 1036172 - RNA, 18 nt, Mycobacterium bovis subsp bovis AF2122/97
gcgcucaccgacgcugac

SEQ ID NO: 1036173 - RNA, 21 nt, Mycobacterium bovis subsp bovis AF2122/97
gcgcucaaugcggucaacgac

SEQ ID NO: 1036174 - RNA, 13 nt, Mycobacterium bovis subsp bovis AF2122/97
gcgcuccagcacc

SEQ ID NO: 1036175 - RNA, 18 nt, Mycobacterium bovis subsp bovis AF2122/97
gcgcuccagcacccgcgc

SEQ ID NO: 1036176 - RNA, 23 nt, Mycobacterium bovis subsp bovis AF2122/97
gcgcuccagcacccgcgcgacgc

SEQ ID NO: 1036177 - RNA, 15 nt, Mycobacterium bovis subsp bovis AF2122/97
gcgcucagcgcggcc

SEQ ID NO: 1036178 - RNA, 16 nt, Mycobacterium bovis subsp bovis AF2122/97
gcgcgugcccguggug

SEQ ID NO: 1036179 - RNA, 16 nt, Mycobacterium bovis subsp bovis AF2122/97
gcgcguugcuggucgc

SEQ ID NO: 1036180 - RNA, 19 nt, Mycobacterium bovis subsp bovis AF2122/97
gcgcguugcuggucgccgu

SEQ ID NO: 1036181 - RNA, 22 nt, Mycobacterium bovis subsp bovis AF2122/97
gcgcguugcuggucgccgucga

SEQ ID NO: 1036182 - RNA, 21 nt, Mycobacterium bovis subsp bovis AF2122/97
gcgcguugggaccagugcggu

SEQ ID NO: 1036183 - RNA, 22 nt, Mycobacterium bovis subsp bovis AF2122/97
gcgcguuuagucuccggcgucg

SEQ ID NO: 1036184 - RNA, 18 nt, Mycobacterium bovis subsp bovis AF2122/97
gcgcgugacgaccagccc

SEQ ID NO: 1036185 - RNA, 12 nt, Mycobacterium bovis subsp bovis AF2122/97
gcgcgugacgau

SEQ ID NO: 1036186 - RNA, 16 nt, Mycobacterium bovis subsp bovis AF2122/97
gcgcgugacgaccagc

SEQ ID NO: 1036187 - RNA, 16 nt, Mycobacterium bovis subsp bovis AF2122/97
gcgcgugacagugacc

SEQ ID NO: 1036188 - RNA, 16 nt, Mycobacterium bovis subsp bovis AF2122/97
gcgcgucucgagcgcg

SEQ ID NO: 1036189 - RNA, 15 nt, Mycobacterium bovis subsp bovis AF2122/97
gcgcucacugcagcg

SEQ ID NO: 1036190 - RNA, 17 nt, Mycobacterium bovis subsp bovis AF2122/97
gcgcucccguacgccgg

SEQ ID NO: 1036191 - RNA, 20 nt, Mycobacterium bovis subsp bovis AF2122/97
gcgcucccguacgccggcgg

SEQ ID NO: 1036192 - RNA, 22 nt, Mycobacterium bovis subsp bovis AF2122/97
gcgcucggugccgcccaggagc

SEQ ID NO: 1036193 - RNA, 14 nt, Mycobacterium bovis subsp bovis AF2122/97
gcgcucggucucca

SEQ ID NO: 1036194 - RNA, 21 nt, Mycobacterium bovis subsp bovis AF2122/97
gcgcucggucuccaccaccga

SEQ ID NO: 1036195 - RNA, 12 nt, Mycobacterium bovis subsp bovis AF2122/97
gcgcuccggcgc

SEQ ID NO: 1036196 - RNA, 22 nt, Mycobacterium bovis subsp bovis AF2122/97
gcgcucgucuaccccgagccuu

SEQ ID NO: 1036197 - RNA, 22 nt, Mycobacterium bovis subsp bovis AF2122/97
gcgcucguggucgacgugaucg

SEQ ID NO: 1036198 - RNA, 23 nt, Mycobacterium bovis subsp bovis AF2122/97
gcgcucguggucgacgugaucgc

SEQ ID NO: 1036199 - RNA, 13 nt, Mycobacterium bovis subsp bovis AF2122/97
gcgcucgucgcgg

SEQ ID NO: 1036200 - RNA, 15 nt, Mycobacterium bovis subsp bovis AF2122/97
gcgcucgucgcggcc

SEQ ID NO: 1036201 - RNA, 17 nt, Mycobacterium bovis subsp bovis AF2122/97
gcgcucgucgcggcccg

SEQ ID NO: 1036202 - RNA, 14 nt, Mycobacterium bovis subsp bovis AF2122/97
gcgcugaucgcgcg

SEQ ID NO: 1036203 - RNA, 16 nt, Mycobacterium bovis subsp bovis AF2122/97
gcgcugaugcgcuggg

SEQ ID NO: 1036204 - RNA, 15 nt, Mycobacterium bovis subsp bovis AF2122/97
gcgcugaucgcgcgc

SEQ ID NO: 1036205 - RNA, 19 nt, Mycobacterium bovis subsp bovis AF2122/97
gcgcugaucgcgcgcaccg

SEQ ID NO: 1036206 - RNA, 18 nt, Mycobacterium bovis subsp bovis AF2122/97
gcgcugagcgacugcagc

SEQ ID NO: 1036207 - RNA, 14 nt, Mycobacterium bovis subsp bovis AF2122/97
gcgcugagcgacug

SEQ ID NO: 1036208 - RNA, 18 nt, Mycobacterium bovis subsp bovis AF2122/97
gcgcugagguggcggugc

SEQ ID NO: 1036209 - RNA, 13 nt, Mycobacterium bovis subsp bovis AF2122/97
gcgcugcgcaccg

SEQ ID NO: 1036210 - RNA, 14 nt, Mycobacterium bovis subsp bovis AF2122/97
gcgcuggacggcgg

SEQ ID NO: 1036211 - RNA, 16 nt, Mycobacterium bovis subsp bovis AF2122/97
gcgcugcgcgcgaucc

SEQ ID NO: 1036212 - RNA, 14 nt, Mycobacterium bovis subsp bovis AF2122/97
gcgcugccggccgc

SEQ ID NO: 1036213 - RNA, 15 nt, Mycobacterium bovis subsp bovis AF2122/97
gcgcugccggccgcg

SEQ ID NO: 1036214 - RNA, 19 nt, Mycobacterium bovis subsp bovis AF2122/97
gcgcugcaccgggucaacg

SEQ ID NO: 1036215 - RNA, 20 nt, Mycobacterium bovis subsp bovis AF2122/97
gcgcugggguccgcgucggc

SEQ ID NO: 1036216 - RNA, 21 nt, Mycobacterium bovis subsp bovis AF2122/97
gcgcugggguccgcgucggcg

SEQ ID NO: 1036217 - RNA, 18 nt, Mycobacterium bovis subsp bovis AF2122/97
gcgcugggugaugagcgc

SEQ ID NO: 1036218 - RNA, 20 nt, Mycobacterium bovis subsp bovis AF2122/97
gcgcugggucgugucgccac

SEQ ID NO: 1036219 - RNA, 13 nt, Mycobacterium bovis subsp bovis AF2122/97
gcgcuggccgucg

SEQ ID NO: 1036220 - RNA, 14 nt, Mycobacterium bovis subsp bovis AF2122/97
gcgcuggccgucga

SEQ ID NO: 1036221 - RNA, 17 nt, Mycobacterium bovis subsp bovis AF2122/97
gcgcuggaggccaccac

SEQ ID NO: 1036222 - RNA, 21 nt, Mycobacterium bovis subsp bovis AF2122/97
gcgcuggaugugggcgcucgc

SEQ ID NO: 1036223 - RNA, 16 nt, Mycobacterium bovis subsp bovis AF2122/97
gcgcuggcaggccggg

SEQ ID NO: 1036224 - RNA, 19 nt, Mycobacterium bovis subsp bovis AF2122/97
gcgcuggaucucguuggug

SEQ ID NO: 1036225 - RNA, 21 nt, Mycobacterium bovis subsp bovis AF2122/97
gcgcuugggcacuucggcgaa

SEQ ID NO: 1036226 - RNA, 14 nt, Mycobacterium bovis subsp bovis AF2122/97
gcgcuugcgaucgc

SEQ ID NO: 1036227 - RNA, 23 nt, Mycobacterium bovis subsp bovis AF2122/97
gcgcuugcgaucgccgcuaacgc

SEQ ID NO: 1036228 - RNA, 17 nt, Mycobacterium bovis subsp bovis AF2122/97
gcgcuugaugccggcca

SEQ ID NO: 1036229 - RNA, 14 nt, Mycobacterium bovis subsp bovis AF2122/97
gcgcuuucgagugc

SEQ ID NO: 1036230 - RNA, 20 nt, Mycobacterium bovis subsp bovis AF2122/97
gcgcuugguccugcggucgc

SEQ ID NO: 1036231 - RNA, 19 nt, Mycobacterium bovis subsp bovis AF2122/97
gcgcuuggucgaccgccga

SEQ ID NO: 1036232 - RNA, 14 nt, Mycobacterium bovis subsp bovis AF2122/97
gcgcuucgaccgag

SEQ ID NO: 1036233 - RNA, 12 nt, Mycobacterium bovis subsp bovis AF2122/97
gcgcuucggcca

SEQ ID NO: 1036234 - RNA, 20 nt, Mycobacterium bovis subsp bovis AF2122/97
gcgcuugaagguucgaucgc

SEQ ID NO: 1036235 - RNA, 22 nt, Mycobacterium bovis subsp bovis AF2122/97
gcgcuugaagguucgaucgcgg

SEQ ID NO: 1036236 - RNA, 14 nt, Mycobacterium bovis subsp bovis AF2122/97
gcgcuugacccgcg

SEQ ID NO: 1036237 - RNA, 22 nt, Mycobacterium bovis subsp bovis AF2122/97
gcgcuucugcuacccgagccgg

SEQ ID NO: 1036238 - RNA, 16 nt, Mycobacterium bovis subsp bovis AF2122/97
gcgcuucggcggucgc

SEQ ID NO: 1036239 - RNA, 16 nt, Mycobacterium bovis subsp bovis AF2122/97
gcgcugguuggccugc

SEQ ID NO: 1036240 - RNA, 17 nt, Mycobacterium bovis subsp bovis AF2122/97
gcgcugguuggccugcc

SEQ ID NO: 1036241 - RNA, 13 nt, Mycobacterium bovis subsp bovis AF2122/97
gcgcuggucagcc

SEQ ID NO: 1036242 - RNA, 15 nt, Mycobacterium bovis subsp bovis AF2122/97
gcgcugguggcggcg

SEQ ID NO: 1036243 - RNA, 23 nt, Mycobacterium bovis subsp bovis AF2122/97
gcgcuggugauucgcagccgauc

SEQ ID NO: 1036244 - RNA, 21 nt, Mycobacterium bovis subsp bovis AF2122/97
gcgcuguccacgaugacgucg

SEQ ID NO: 1036245 - RNA, 14 nt, Mycobacterium bovis subsp bovis AF2122/97
gcgcuguccacgau

SEQ ID NO: 1036246 - RNA, 13 nt, Mycobacterium bovis subsp bovis AF2122/97
gcgcugucguacc

SEQ ID NO: 1036247 - RNA, 18 nt, Mycobacterium bovis subsp bovis AF2122/97
gcgcugucguaccgcgga

SEQ ID NO: 1036248 - RNA, 15 nt, Mycobacterium bovis subsp bovis AF2122/97
gcgcuguucggcacg

SEQ ID NO: 1036249 - RNA, 23 nt, Mycobacterium bovis subsp bovis AF2122/97
gcgcuguugcuggcgcccccgcc

SEQ ID NO: 1036250 - RNA, 21 nt, Mycobacterium bovis subsp bovis AF2122/97
gcgcuucacgggccguccagg

SEQ ID NO: 1036251 - RNA, 16 nt, Mycobacterium bovis subsp bovis AF2122/97
gcgcuucacagccacc

SEQ ID NO: 1036252 - RNA, 18 nt, Mycobacterium bovis subsp bovis AF2122/97
gcgcuucacagccaccag

SEQ ID NO: 1036253 - RNA, 22 nt, Mycobacterium bovis subsp bovis AF2122/97
gcgcuucacagccaccagccgg

SEQ ID NO: 1036254 - RNA, 19 nt, Mycobacterium bovis subsp bovis AF2122/97
gccggccccgcccgcgcgg

SEQ ID NO: 1036255 - RNA, 16 nt, Mycobacterium bovis subsp bovis AF2122/97
gccggccccgccagcg

SEQ ID NO: 1036256 - RNA, 20 nt, Mycobacterium bovis subsp bovis AF2122/97
gccggccccgccagcgccgc

SEQ ID NO: 1036257 - RNA, 23 nt, Mycobacterium bovis subsp bovis AF2122/97
gccggccccgccgucaccgccgu

SEQ ID NO: 1036258 - RNA, 19 nt, Mycobacterium bovis subsp bovis AF2122/97
gccggccccgccgucgccg

SEQ ID NO: 1036259 - RNA, 23 nt, Mycobacterium bovis subsp bovis AF2122/97
gccggccccgccgucgccgccgg

SEQ ID NO: 1036260 - RNA, 19 nt, Mycobacterium bovis subsp bovis AF2122/97
gccggccccgccgcuaccg

SEQ ID NO: 1036261 - RNA, 19 nt, Mycobacterium bovis subsp bovis AF2122/97
gccggccccgccggcgccg

SEQ ID NO: 1036262 - RNA, 18 nt, Mycobacterium bovis subsp bovis AF2122/97
gccggccccgccgucacc

SEQ ID NO: 1036263 - RNA, 22 nt, Mycobacterium bovis subsp bovis AF2122/97
gccggccccgccgucacccccg

SEQ ID NO: 1036264 - RNA, 21 nt, Mycobacterium bovis subsp bovis AF2122/97
gccggcaucuccaccgucgcc

SEQ ID NO: 1036265 - RNA, 20 nt, Mycobacterium bovis subsp bovis AF2122/97
gccggccccaccgguaccgc

SEQ ID NO: 1036266 - RNA, 20 nt, Mycobacterium bovis subsp bovis AF2122/97
gccggccccaccggugccgc

SEQ ID NO: 1036267 - RNA, 14 nt, Mycobacterium bovis subsp bovis AF2122/97
gccgggauugccgc

SEQ ID NO: 1036268 - RNA, 20 nt, Mycobacterium bovis subsp bovis AF2122/97
gccgggcaaccagcagcagg

SEQ ID NO: 1036269 - RNA, 16 nt, Mycobacterium bovis subsp bovis AF2122/97
gccgggcaaccagcag

SEQ ID NO: 1036270 - RNA, 16 nt, Mycobacterium bovis subsp bovis AF2122/97
gccgggauugccgcca

SEQ ID NO: 1036271 - RNA, 17 nt, Mycobacterium bovis subsp bovis AF2122/97
gccgggauugccgccac

SEQ ID NO: 1036272 - RNA, 19 nt, Mycobacterium bovis subsp bovis AF2122/97
gccgggauugccgccaccu

SEQ ID NO: 1036273 - RNA, 19 nt, Mycobacterium bovis subsp bovis AF2122/97
gccgggauugccgucggug

SEQ ID NO: 1036274 - RNA, 20 nt, Mycobacterium bovis subsp bovis AF2122/97
gccgggaugguuucgacucg

SEQ ID NO: 1036275 - RNA, 18 nt, Mycobacterium bovis subsp bovis AF2122/97
gccgggcagucaggccua

SEQ ID NO: 1036276 - RNA, 18 nt, Mycobacterium bovis subsp bovis AF2122/97
gccgggcaguuuggcggc

SEQ ID NO: 1036277 - RNA, 17 nt, Mycobacterium bovis subsp bovis AF2122/97
gccgggcagugcgcggc

SEQ ID NO: 1036278 - RNA, 12 nt, Mycobacterium bovis subsp bovis AF2122/97
gccgggcaucgg

SEQ ID NO: 1036279 - RNA, 18 nt, Mycobacterium bovis subsp bovis AF2122/97
gccgggccaaccggucgu

SEQ ID NO: 1036280 - RNA, 13 nt, Mycobacterium bovis subsp bovis AF2122/97
gccgggcacgggc

SEQ ID NO: 1036281 - RNA, 17 nt, Mycobacterium bovis subsp bovis AF2122/97
gccgggcaaggccaccg

SEQ ID NO: 1036282 - RNA, 22 nt, Mycobacterium bovis subsp bovis AF2122/97
gccgggcaacgcgaaccggcca

SEQ ID NO: 1036283 - RNA, 23 nt, Mycobacterium bovis subsp bovis AF2122/97
gccgggcaacgcgaaccggccau

SEQ ID NO: 1036284 - RNA, 15 nt, Mycobacterium bovis subsp bovis AF2122/97
gccgggcaaggcccg

SEQ ID NO: 1036285 - RNA, 23 nt, Mycobacterium bovis subsp bovis AF2122/97
gccgggcaauacguagucgccga

SEQ ID NO: 1036286 - RNA, 14 nt, Mycobacterium bovis subsp bovis AF2122/97
gccgggcaccaccc

SEQ ID NO: 1036287 - RNA, 12 nt, Mycobacterium bovis subsp bovis AF2122/97
gccgggcccagc

SEQ ID NO: 1036288 - RNA, 14 nt, Mycobacterium bovis subsp bovis AF2122/97
gccgggcccgacgu

SEQ ID NO: 1036289 - RNA, 12 nt, Mycobacterium bovis subsp bovis AF2122/97
gccgggccaggc

SEQ ID NO: 1036290 - RNA, 15 nt, Mycobacterium bovis subsp bovis AF2122/97
gccgggcaguguggu

SEQ ID NO: 1036291 - RNA, 22 nt, Mycobacterium bovis subsp bovis AF2122/97
gccgggccaggccgaugccgac

SEQ ID NO: 1036292 - RNA, 13 nt, Mycobacterium bovis subsp bovis AF2122/97
gccgggccacggc

SEQ ID NO: 1036293 - RNA, 12 nt, Mycobacterium bovis subsp bovis AF2122/97
gccgggccgccg

SEQ ID NO: 1036294 - RNA, 13 nt, Mycobacterium bovis subsp bovis AF2122/97
gccgggccgccga

SEQ ID NO: 1036295 - RNA, 14 nt, Mycobacterium bovis subsp bovis AF2122/97
gccgggccgccgag

SEQ ID NO: 1036296 - RNA, 17 nt, Mycobacterium bovis subsp bovis AF2122/97
gccgggccgccgagcgg

SEQ ID NO: 1036297 - RNA, 16 nt, Mycobacterium bovis subsp bovis AF2122/97
gccgggcccgucggac

SEQ ID NO: 1036298 - RNA, 12 nt, Mycobacterium bovis subsp bovis AF2122/97
gccgggccgcgc

SEQ ID NO: 1036299 - RNA, 16 nt, Mycobacterium bovis subsp bovis AF2122/97
gccgggccguguccgc

SEQ ID NO: 1036300 - RNA, 16 nt, Mycobacterium bovis subsp bovis AF2122/97
gccgggccugcaccac

SEQ ID NO: 1036301 - RNA, 23 nt, Mycobacterium bovis subsp bovis AF2122/97
gccgggccugcaccacggcggcc

SEQ ID NO: 1036302 - RNA, 12 nt, Mycobacterium bovis subsp bovis AF2122/97
gccgggcggcca

SEQ ID NO: 1036303 - RNA, 14 nt, Mycobacterium bovis subsp bovis AF2122/97
gccgggcggcgcga

SEQ ID NO: 1036304 - RNA, 17 nt, Mycobacterium bovis subsp bovis AF2122/97
gccgggcguccucgucg

SEQ ID NO: 1036305 - RNA, 16 nt, Mycobacterium bovis subsp bovis AF2122/97
gccgggcggcagcggc

SEQ ID NO: 1036306 - RNA, 22 nt, Mycobacterium bovis subsp bovis AF2122/97
gccgggcgcccuuaagccggcg

SEQ ID NO: 1036307 - RNA, 21 nt, Mycobacterium bovis subsp bovis AF2122/97
gccgggcgcccuuaagccggc

SEQ ID NO: 1036308 - RNA, 16 nt, Mycobacterium bovis subsp bovis AF2122/97
gccgggcgaugcuggg

SEQ ID NO: 1036309 - RNA, 13 nt, Mycobacterium bovis subsp bovis AF2122/97
gccgggcgcaagc

SEQ ID NO: 1036310 - RNA, 20 nt, Mycobacterium bovis subsp bovis AF2122/97
gccgggcgcaagcagcccgg

SEQ ID NO: 1036311 - RNA, 22 nt, Mycobacterium bovis subsp bovis AF2122/97
gccggggccacccgcagaccgg

SEQ ID NO: 1036312 - RNA, 16 nt, Mycobacterium bovis subsp bovis AF2122/97
gccggggcugccgccg

SEQ ID NO: 1036313 - RNA, 17 nt, Mycobacterium bovis subsp bovis AF2122/97
gccggggcugccgccgu

SEQ ID NO: 1036314 - RNA, 14 nt, Mycobacterium bovis subsp bovis AF2122/97
gccgggggcgccgc

SEQ ID NO: 1036315 - RNA, 16 nt, Mycobacterium bovis subsp bovis AF2122/97
gccgggggcgccgccg

SEQ ID NO: 1036316 - RNA, 14 nt, Mycobacterium bovis subsp bovis AF2122/97
gccggggcgcaggu

SEQ ID NO: 1036317 - RNA, 18 nt, Mycobacterium bovis subsp bovis AF2122/97
gccggggcagcucaccuu

SEQ ID NO: 1036318 - RNA, 17 nt, Mycobacterium bovis subsp bovis AF2122/97
gccggggacgccgcggc

SEQ ID NO: 1036319 - RNA, 18 nt, Mycobacterium bovis subsp bovis AF2122/97
gccggggacgccgcggcg

SEQ ID NO: 1036320 - RNA, 23 nt, Mycobacterium bovis subsp bovis AF2122/97
gccggggaguggaaacccgccga

SEQ ID NO: 1036321 - RNA, 22 nt, Mycobacterium bovis subsp bovis AF2122/97
gccggggauaucacgacgccga

SEQ ID NO: 1036322 - RNA, 15 nt, Mycobacterium bovis subsp bovis AF2122/97
gccggggccgcuggc

SEQ ID NO: 1036323 - RNA, 13 nt, Mycobacterium bovis subsp bovis AF2122/97
gccggggccgccg

SEQ ID NO: 1036324 - RNA, 19 nt, Mycobacterium bovis subsp bovis AF2122/97
gccggggcgaacggcaccg

SEQ ID NO: 1036325 - RNA, 18 nt, Mycobacterium bovis subsp bovis AF2122/97
gccgggcuggccgacucg

SEQ ID NO: 1036326 - RNA, 21 nt, Mycobacterium bovis subsp bovis AF2122/97
gccgggcuguucggccauggc

SEQ ID NO: 1036327 - RNA, 18 nt, Mycobacterium bovis subsp bovis AF2122/97
gccgggcuucagcacgcg

SEQ ID NO: 1036328 - RNA, 17 nt, Mycobacterium bovis subsp bovis AF2122/97
gccgggcuuggccgcgc

SEQ ID NO: 1036329 - RNA, 18 nt, Mycobacterium bovis subsp bovis AF2122/97
gccgggcuuggccgcgcc

SEQ ID NO: 1036330 - RNA, 22 nt, Mycobacterium bovis subsp bovis AF2122/97
gccggggaacuuaccgaggcca

SEQ ID NO: 1036331 - RNA, 19 nt, Mycobacterium bovis subsp bovis AF2122/97
gccgggcugaggcggcgac

SEQ ID NO: 1036332 - RNA, 16 nt, Mycobacterium bovis subsp bovis AF2122/97
gccgggcuccucuggu

SEQ ID NO: 1036333 - RNA, 14 nt, Mycobacterium bovis subsp bovis AF2122/97
gccgggcucgucga

SEQ ID NO: 1036334 - RNA, 24 nt, Mycobacterium bovis subsp bovis AF2122/97
gccgggcucuaucagacgauucgg

SEQ ID NO: 1036335 - RNA, 12 nt, Mycobacterium bovis subsp bovis AF2122/97
gccgggcuggcc

SEQ ID NO: 1036336 - RNA, 19 nt, Mycobacterium bovis subsp bovis AF2122/97
gccgggucgaucaccgaca

SEQ ID NO: 1036337 - RNA, 22 nt, Mycobacterium bovis subsp bovis AF2122/97
gccgggucgaucaccgacaccg

SEQ ID NO: 1036338 - RNA, 15 nt, Mycobacterium bovis subsp bovis AF2122/97
gccgggucgaugggu

SEQ ID NO: 1036339 - RNA, 16 nt, Mycobacterium bovis subsp bovis AF2122/97
gccgggucgcgggaug

SEQ ID NO: 1036340 - RNA, 20 nt, Mycobacterium bovis subsp bovis AF2122/97
gccgggucgucuuccaggag

SEQ ID NO: 1036341 - RNA, 22 nt, Mycobacterium bovis subsp bovis AF2122/97
gccgggucguacaacacgggca

SEQ ID NO: 1036342 - RNA, 15 nt, Mycobacterium bovis subsp bovis AF2122/97
gccgggucuguuggu

SEQ ID NO: 1036343 - RNA, 16 nt, Mycobacterium bovis subsp bovis AF2122/97
gccgggucuguuggug

SEQ ID NO: 1036344 - RNA, 19 nt, Mycobacterium bovis subsp bovis AF2122/97
gccggguggcccggcgaaa

SEQ ID NO: 1036345 - RNA, 23 nt, Mycobacterium bovis subsp bovis AF2122/97
gccggguggccacgaauccgauc

SEQ ID NO: 1036346 - RNA, 19 nt, Mycobacterium bovis subsp bovis AF2122/97
gccggguggccacgcccag

SEQ ID NO: 1036347 - RNA, 19 nt, Mycobacterium bovis subsp bovis AF2122/97
gccgggugcgagcgacacc

SEQ ID NO: 1036348 - RNA, 16 nt, Mycobacterium bovis subsp bovis AF2122/97
gccgggugcgugcgcg

SEQ ID NO: 1036349 - RNA, 14 nt, Mycobacterium bovis subsp bovis AF2122/97
gccgggugccgcca

SEQ ID NO: 1036350 - RNA, 22 nt, Mycobacterium bovis subsp bovis AF2122/97
gccgggugcaacggcguuggcg

SEQ ID NO: 1036351 - RNA, 16 nt, Mycobacterium bovis subsp bovis AF2122/97
gccgggugaguucggc

SEQ ID NO: 1036352 - RNA, 17 nt, Mycobacterium bovis subsp bovis AF2122/97
gccgggugaguucggcg

SEQ ID NO: 1036353 - RNA, 20 nt, Mycobacterium bovis subsp bovis AF2122/97
gccgggugaguucggcguag

SEQ ID NO: 1036354 - RNA, 22 nt, Mycobacterium bovis subsp bovis AF2122/97
gccgggucuuccggugcgccga

SEQ ID NO: 1036355 - RNA, 14 nt, Mycobacterium bovis subsp bovis AF2122/97
gccgggucucggug

SEQ ID NO: 1036356 - RNA, 20 nt, Mycobacterium bovis subsp bovis AF2122/97
gccgggucucggugcggcug

SEQ ID NO: 1036357 - RNA, 13 nt, Mycobacterium bovis subsp bovis AF2122/97
gccggggugugcg

SEQ ID NO: 1036358 - RNA, 18 nt, Mycobacterium bovis subsp bovis AF2122/97
gccgggguucaccgucga

SEQ ID NO: 1036359 - RNA, 15 nt, Mycobacterium bovis subsp bovis AF2122/97
gccggggugccggcg

SEQ ID NO: 1036360 - RNA, 16 nt, Mycobacterium bovis subsp bovis AF2122/97
gccggggugccggcga

SEQ ID NO: 1036361 - RNA, 15 nt, Mycobacterium bovis subsp bovis AF2122/97
gccggguccgccggg

SEQ ID NO: 1036362 - RNA, 22 nt, Mycobacterium bovis subsp bovis AF2122/97
gccggguccggaaccgguaucg

SEQ ID NO: 1036363 - RNA, 16 nt, Mycobacterium bovis subsp bovis AF2122/97
gccgggucacgugggc

SEQ ID NO: 1036364 - RNA, 17 nt, Mycobacterium bovis subsp bovis AF2122/97
gccgggucagcccggcg

SEQ ID NO: 1036365 - RNA, 19 nt, Mycobacterium bovis subsp bovis AF2122/97
gccgggucaccgauucggc

SEQ ID NO: 1036366 - RNA, 23 nt, Mycobacterium bovis subsp bovis AF2122/97
gccgggucaccgauucggccagc

SEQ ID NO: 1036367 - RNA, 20 nt, Mycobacterium bovis subsp bovis AF2122/97
gccggguuaucggcagcagg

SEQ ID NO: 1036368 - RNA, 20 nt, Mycobacterium bovis subsp bovis AF2122/97
gccggguuccagcggcaccg

SEQ ID NO: 1036369 - RNA, 22 nt, Mycobacterium bovis subsp bovis AF2122/97
gccggguuccagcggcaccgcg

SEQ ID NO: 1036370 - RNA, 17 nt, Mycobacterium bovis subsp bovis AF2122/97
gccggguuggccggcgc

SEQ ID NO: 1036371 - RNA, 13 nt, Mycobacterium bovis subsp bovis AF2122/97
gccggguuggcgc

SEQ ID NO: 1036372 - RNA, 14 nt, Mycobacterium bovis subsp bovis AF2122/97
gccgggugcgcacc

SEQ ID NO: 1036373 - RNA, 12 nt, Mycobacterium bovis subsp bovis AF2122/97
gccggguucgcg

SEQ ID NO: 1036374 - RNA, 16 nt, Mycobacterium bovis subsp bovis AF2122/97
gccggguuggucuucg

SEQ ID NO: 1036375 - RNA, 17 nt, Mycobacterium bovis subsp bovis AF2122/97
gccggguuggcgccggc

SEQ ID NO: 1036376 - RNA, 12 nt, Mycobacterium bovis subsp bovis AF2122/97
gccggguuuggu

SEQ ID NO: 1036377 - RNA, 18 nt, Mycobacterium bovis subsp bovis AF2122/97
gccgguaaccgcgucgac

SEQ ID NO: 1036378 - RNA, 22 nt, Mycobacterium bovis subsp bovis AF2122/97
gccgguaacgaacagcgucaac

SEQ ID NO: 1036379 - RNA, 14 nt, Mycobacterium bovis subsp bovis AF2122/97
gccgguaccggcga

SEQ ID NO: 1036380 - RNA, 16 nt, Mycobacterium bovis subsp bovis AF2122/97
gccgguaccggcgauc

SEQ ID NO: 1036381 - RNA, 22 nt, Mycobacterium bovis subsp bovis AF2122/97
gccgguaguagcugaccaucgu

SEQ ID NO: 1036382 - RNA, 16 nt, Mycobacterium bovis subsp bovis AF2122/97
gccgguagcgcgggug

SEQ ID NO: 1036383 - RNA, 17 nt, Mycobacterium bovis subsp bovis AF2122/97
gccgguaggcggccagc

SEQ ID NO: 1036384 - RNA, 22 nt, Mycobacterium bovis subsp bovis AF2122/97
gccgguaccgggacgaaucccg

SEQ ID NO: 1036385 - RNA, 20 nt, Mycobacterium bovis subsp bovis AF2122/97
gccgguagaucuucggccgc

SEQ ID NO: 1036386 - RNA, 22 nt, Mycobacterium bovis subsp bovis AF2122/97
gccgguagaucuucggccgcac

SEQ ID NO: 1036387 - RNA, 20 nt, Mycobacterium bovis subsp bovis AF2122/97
gccgguagcacagcagcaac

SEQ ID NO: 1036388 - RNA, 19 nt, Mycobacterium bovis subsp bovis AF2122/97
gccggucacgacguccgau

SEQ ID NO: 1036389 - RNA, 17 nt, Mycobacterium bovis subsp bovis AF2122/97
gccgguauuucggcgac

SEQ ID NO: 1036390 - RNA, 15 nt, Mycobacterium bovis subsp bovis AF2122/97
gccggucacguccgc

SEQ ID NO: 1036391 - RNA, 21 nt, Mycobacterium bovis subsp bovis AF2122/97
gccggucacguccgcggggga

SEQ ID NO: 1036392 - RNA, 13 nt, Mycobacterium bovis subsp bovis AF2122/97
gccggucacgucg

SEQ ID NO: 1036393 - RNA, 19 nt, Mycobacterium bovis subsp bovis AF2122/97
gccggucagcaauacggcg

SEQ ID NO: 1036394 - RNA, 22 nt, Mycobacterium bovis subsp bovis AF2122/97
gccggucagcaauacggcggcg

SEQ ID NO: 1036395 - RNA, 19 nt, Mycobacterium bovis subsp bovis AF2122/97
gccgguaugcgccaucucg

SEQ ID NO: 1036396 - RNA, 21 nt, Mycobacterium bovis subsp bovis AF2122/97
gccgguaugcgccaucucgac

SEQ ID NO: 1036397 - RNA, 23 nt, Mycobacterium bovis subsp bovis AF2122/97
gccgguaugcgccaucucgacgg

SEQ ID NO: 1036398 - RNA, 15 nt, Mycobacterium bovis subsp bovis AF2122/97
gccgguaugccgaac

SEQ ID NO: 1036399 - RNA, 18 nt, Mycobacterium bovis subsp bovis AF2122/97
gccggucaccucgccggc

SEQ ID NO: 1036400 - RNA, 19 nt, Mycobacterium bovis subsp bovis AF2122/97
gccggucaccucgccggcg

SEQ ID NO: 1036401 - RNA, 21 nt, Mycobacterium bovis subsp bovis AF2122/97
gccggucaccucgccggcggg

SEQ ID NO: 1036402 - RNA, 16 nt, Mycobacterium bovis subsp bovis AF2122/97
gccgguccucgucggc

SEQ ID NO: 1036403 - RNA, 14 nt, Mycobacterium bovis subsp bovis AF2122/97
gccggucccgcgug

SEQ ID NO: 1036404 - RNA, 18 nt, Mycobacterium bovis subsp bovis AF2122/97
gccggucccggacgugcc

SEQ ID NO: 1036405 - RNA, 18 nt, Mycobacterium bovis subsp bovis AF2122/97
gccggucccccgcccaca

SEQ ID NO: 1036406 - RNA, 19 nt, Mycobacterium bovis subsp bovis AF2122/97
gccgguccccgccggcggg

SEQ ID NO: 1036407 - RNA, 22 nt, Mycobacterium bovis subsp bovis AF2122/97
gccggucgaugucggcgaacca

SEQ ID NO: 1036408 - RNA, 20 nt, Mycobacterium bovis subsp bovis AF2122/97
gccggucgaugucggcgaac

SEQ ID NO: 1036409 - RNA, 14 nt, Mycobacterium bovis subsp bovis AF2122/97
gccggucgaugacc

SEQ ID NO: 1036410 - RNA, 12 nt, Mycobacterium bovis subsp bovis AF2122/97
gccggucgccga

SEQ ID NO: 1036411 - RNA, 13 nt, Mycobacterium bovis subsp bovis AF2122/97
gccggucgccgac

SEQ ID NO: 1036412 - RNA, 16 nt, Mycobacterium bovis subsp bovis AF2122/97
gccggucgccgacggc

SEQ ID NO: 1036413 - RNA, 24 nt, Mycobacterium bovis subsp bovis AF2122/97
gccggucgucaguaauucggccau

SEQ ID NO: 1036414 - RNA, 16 nt, Mycobacterium bovis subsp bovis AF2122/97
gccgguccggggcaac

SEQ ID NO: 1036415 - RNA, 18 nt, Mycobacterium bovis subsp bovis AF2122/97
gccgguccccucggugcc

SEQ ID NO: 1036416 - RNA, 20 nt, Mycobacterium bovis subsp bovis AF2122/97
gccgguccccccguugccgc

SEQ ID NO: 1036417 - RNA, 14 nt, Mycobacterium bovis subsp bovis AF2122/97
gccgguccagcagc

SEQ ID NO: 1036418 - RNA, 19 nt, Mycobacterium bovis subsp bovis AF2122/97
gccgguccagcagcucggc

SEQ ID NO: 1036419 - RNA, 20 nt, Mycobacterium bovis subsp bovis AF2122/97
gccgguccagacccagcucg

SEQ ID NO: 1036420 - RNA, 21 nt, Mycobacterium bovis subsp bovis AF2122/97
gccgguccagacccagcucgu

SEQ ID NO: 1036421 - RNA, 19 nt, Mycobacterium bovis subsp bovis AF2122/97
gccggucagcgugcaggua

SEQ ID NO: 1036422 - RNA, 19 nt, Mycobacterium bovis subsp bovis AF2122/97
gccggucaggcaguccacc

SEQ ID NO: 1036423 - RNA, 17 nt, Mycobacterium bovis subsp bovis AF2122/97
gccggucaggccgccgc

SEQ ID NO: 1036424 - RNA, 13 nt, Mycobacterium bovis subsp bovis AF2122/97
gccggucauacca

SEQ ID NO: 1036425 - RNA, 22 nt, Mycobacterium bovis subsp bovis AF2122/97
gccggucauccgggcgaccacc

SEQ ID NO: 1036426 - RNA, 22 nt, Mycobacterium bovis subsp bovis AF2122/97
gccggucaucccaagcguccgc

SEQ ID NO: 1036427 - RNA, 23 nt, Mycobacterium bovis subsp bovis AF2122/97
gccggugccgccaucgccgccgg

SEQ ID NO: 1036428 - RNA, 11 nt, Mycobacterium bovis subsp bovis AF2122/97
gccggugcgcc

SEQ ID NO: 1036429 - RNA, 16 nt, Mycobacterium bovis subsp bovis AF2122/97
gccggugcgcaccagc

SEQ ID NO: 1036430 - RNA, 17 nt, Mycobacterium bovis subsp bovis AF2122/97
gccggugcgcaccagca

SEQ ID NO: 1036431 - RNA, 22 nt, Mycobacterium bovis subsp bovis AF2122/97
gccggugcgcaccagcacaccc

SEQ ID NO: 1036432 - RNA, 13 nt, Mycobacterium bovis subsp bovis AF2122/97
gccggugcggcgg

SEQ ID NO: 1036433 - RNA, 18 nt, Mycobacterium bovis subsp bovis AF2122/97
gccggugcggcgggcucg

SEQ ID NO: 1036434 - RNA, 14 nt, Mycobacterium bovis subsp bovis AF2122/97
gccggugcggccaa

SEQ ID NO: 1036435 - RNA, 16 nt, Mycobacterium bovis subsp bovis AF2122/97
gccggugcggccaaug

SEQ ID NO: 1036436 - RNA, 15 nt, Mycobacterium bovis subsp bovis AF2122/97
gccggugcgcuggau

SEQ ID NO: 1036437 - RNA, 12 nt, Mycobacterium bovis subsp bovis AF2122/97
gccggugcguca

SEQ ID NO: 1036438 - RNA, 12 nt, Mycobacterium bovis subsp bovis AF2122/97
gccggugcggug

SEQ ID NO: 1036439 - RNA, 19 nt, Mycobacterium bovis subsp bovis AF2122/97
gccggugcgucacagccgg

SEQ ID NO: 1036440 - RNA, 23 nt, Mycobacterium bovis subsp bovis AF2122/97
gccggugcuccucggcaggccga

SEQ ID NO: 1036441 - RNA, 13 nt, Mycobacterium bovis subsp bovis AF2122/97
gccggugcugcgg

SEQ ID NO: 1036442 - RNA, 14 nt, Mycobacterium bovis subsp bovis AF2122/97
gccgguggccgcgc

SEQ ID NO: 1036443 - RNA, 22 nt, Mycobacterium bovis subsp bovis AF2122/97
gccgguggcauucguugaugau

SEQ ID NO: 1036444 - RNA, 16 nt, Mycobacterium bovis subsp bovis AF2122/97
gccgguggccagcacg

SEQ ID NO: 1036445 - RNA, 13 nt, Mycobacterium bovis subsp bovis AF2122/97
gccgguggcaccc

SEQ ID NO: 1036446 - RNA, 21 nt, Mycobacterium bovis subsp bovis AF2122/97
gccgguggcggcggcggcaac

SEQ ID NO: 1036447 - RNA, 20 nt, Mycobacterium bovis subsp bovis AF2122/97
gccgguggcagagccgccgu

SEQ ID NO: 1036448 - RNA, 17 nt, Mycobacterium bovis subsp bovis AF2122/97
gccgguggcccgccggc

SEQ ID NO: 1036449 - RNA, 23 nt, Mycobacterium bovis subsp bovis AF2122/97
gccgguggcgccggggccgccga

SEQ ID NO: 1036450 - RNA, 21 nt, Mycobacterium bovis subsp bovis AF2122/97
gccgguggucugcgcggugcc

SEQ ID NO: 1036451 - RNA, 23 nt, Mycobacterium bovis subsp bovis AF2122/97
gccggugggugacguaggcgcug

SEQ ID NO: 1036452 - RNA, 18 nt, Mycobacterium bovis subsp bovis AF2122/97
gccggugguaacggcggc

SEQ ID NO: 1036453 - RNA, 19 nt, Mycobacterium bovis subsp bovis AF2122/97
gccggugguaacggcggcc

SEQ ID NO: 1036454 - RNA, 17 nt, Mycobacterium bovis subsp bovis AF2122/97
gccggugguaccggcgg

SEQ ID NO: 1036455 - RNA, 18 nt, Mycobacterium bovis subsp bovis AF2122/97
gccggugguaccggcggc

SEQ ID NO: 1036456 - RNA, 19 nt, Mycobacterium bovis subsp bovis AF2122/97
gccggugguaccggcggcg

SEQ ID NO: 1036457 - RNA, 22 nt, Mycobacterium bovis subsp bovis AF2122/97
gccgguggggauagccgcgucg

SEQ ID NO: 1036458 - RNA, 14 nt, Mycobacterium bovis subsp bovis AF2122/97
gccgguggugacgg

SEQ ID NO: 1036459 - RNA, 17 nt, Mycobacterium bovis subsp bovis AF2122/97
gccgguggugacggcgg

SEQ ID NO: 1036460 - RNA, 16 nt, Mycobacterium bovis subsp bovis AF2122/97
gccgguggugccggcg

SEQ ID NO: 1036461 - RNA, 20 nt, Mycobacterium bovis subsp bovis AF2122/97
gccgguggugccggcgccgc

SEQ ID NO: 1036462 - RNA, 17 nt, Mycobacterium bovis subsp bovis AF2122/97
gccgguguccuuggccg

SEQ ID NO: 1036463 - RNA, 20 nt, Mycobacterium bovis subsp bovis AF2122/97
gccgguguccuuggccgcca

SEQ ID NO: 1036464 - RNA, 12 nt, Mycobacterium bovis subsp bovis AF2122/97
gccggugccgac

SEQ ID NO: 1036465 - RNA, 13 nt, Mycobacterium bovis subsp bovis AF2122/97
gccggugccgccg

SEQ ID NO: 1036466 - RNA, 14 nt, Mycobacterium bovis subsp bovis AF2122/97
gccggugccgccga

SEQ ID NO: 1036467 - RNA, 14 nt, Mycobacterium bovis subsp bovis AF2122/97
gccggugccgccgc

SEQ ID NO: 1036468 - RNA, 16 nt, Mycobacterium bovis subsp bovis AF2122/97
gccggugccgccgcgg

SEQ ID NO: 1036469 - RNA, 17 nt, Mycobacterium bovis subsp bovis AF2122/97
gccggugccgccgcggc

SEQ ID NO: 1036470 - RNA, 20 nt, Mycobacterium bovis subsp bovis AF2122/97
gccggugccgccgcggccac

SEQ ID NO: 1036471 - RNA, 14 nt, Mycobacterium bovis subsp bovis AF2122/97
gccggugccgccau

SEQ ID NO: 1036472 - RNA, 16 nt, Mycobacterium bovis subsp bovis AF2122/97
gccggugccgccaucg

SEQ ID NO: 1036473 - RNA, 17 nt, Mycobacterium bovis subsp bovis AF2122/97
gccggugccgccaucgc

SEQ ID NO: 1036474 - RNA, 15 nt, Mycobacterium bovis subsp bovis AF2122/97
gccggugccgccggu

SEQ ID NO: 1036475 - RNA, 18 nt, Mycobacterium bovis subsp bovis AF2122/97
gccggugccgccggugcc

SEQ ID NO: 1036476 - RNA, 16 nt, Mycobacterium bovis subsp bovis AF2122/97
gccggugccgccguuc

SEQ ID NO: 1036477 - RNA, 16 nt, Mycobacterium bovis subsp bovis AF2122/97
gccggugccgcgguag

SEQ ID NO: 1036478 - RNA, 16 nt, Mycobacterium bovis subsp bovis AF2122/97
gccggugccggccaga

SEQ ID NO: 1036479 - RNA, 17 nt, Mycobacterium bovis subsp bovis AF2122/97
gccggugccggccaucg

SEQ ID NO: 1036480 - RNA, 14 nt, Mycobacterium bovis subsp bovis AF2122/97
gccggugccggcgu

SEQ ID NO: 1036481 - RNA, 20 nt, Mycobacterium bovis subsp bovis AF2122/97
gccggugccggcguugccgc

SEQ ID NO: 1036482 - RNA, 16 nt, Mycobacterium bovis subsp bovis AF2122/97
gccggugccgggcacc

SEQ ID NO: 1036483 - RNA, 23 nt, Mycobacterium bovis subsp bovis AF2122/97
gccggugccacccuugccgccgg

SEQ ID NO: 1036484 - RNA, 15 nt, Mycobacterium bovis subsp bovis AF2122/97
gccggugccaccgac

SEQ ID NO: 1036485 - RNA, 22 nt, Mycobacterium bovis subsp bovis AF2122/97
gccggugccaccggcuggugcc

SEQ ID NO: 1036486 - RNA, 13 nt, Mycobacterium bovis subsp bovis AF2122/97
gccggugccaccc

SEQ ID NO: 1036487 - RNA, 12 nt, Mycobacterium bovis subsp bovis AF2122/97
gccggugccgau

SEQ ID NO: 1036488 - RNA, 23 nt, Mycobacterium bovis subsp bovis AF2122/97
gccggugauggccgaccagccga

SEQ ID NO: 1036489 - RNA, 17 nt, Mycobacterium bovis subsp bovis AF2122/97
gccggugauccggucgu

SEQ ID NO: 1036490 - RNA, 19 nt, Mycobacterium bovis subsp bovis AF2122/97
gccggugaucggcggcaac

SEQ ID NO: 1036491 - RNA, 21 nt, Mycobacterium bovis subsp bovis AF2122/97
gccggugaucggcggcaaccg

SEQ ID NO: 1036492 - RNA, 19 nt, Mycobacterium bovis subsp bovis AF2122/97
gccggugaacggcagcacg

SEQ ID NO: 1036493 - RNA, 17 nt, Mycobacterium bovis subsp bovis AF2122/97
gccggugaacgucacgu

SEQ ID NO: 1036494 - RNA, 22 nt, Mycobacterium bovis subsp bovis AF2122/97
gccggugacgacgucgccgccg

SEQ ID NO: 1036495 - RNA, 19 nt, Mycobacterium bovis subsp bovis AF2122/97
gccggugacgaugaccgcg

SEQ ID NO: 1036496 - RNA, 23 nt, Mycobacterium bovis subsp bovis AF2122/97
gccggugacgaugaccgcgcggc

SEQ ID NO: 1036497 - RNA, 14 nt, Mycobacterium bovis subsp bovis AF2122/97
gccggugacggugu

SEQ ID NO: 1036498 - RNA, 15 nt, Mycobacterium bovis subsp bovis AF2122/97
gccggugacggggcu

SEQ ID NO: 1036499 - RNA, 22 nt, Mycobacterium bovis subsp bovis AF2122/97
gccggugacggggcugaccgcc

SEQ ID NO: 1036500 - RNA, 21 nt, Mycobacterium bovis subsp bovis AF2122/97
gccggugacgggguugaccgc

SEQ ID NO: 1036501 - RNA, 14 nt, Mycobacterium bovis subsp bovis AF2122/97
gccggucuuggaca

SEQ ID NO: 1036502 - RNA, 19 nt, Mycobacterium bovis subsp bovis AF2122/97
gccggucuuggacagcagc

SEQ ID NO: 1036503 - RNA, 16 nt, Mycobacterium bovis subsp bovis AF2122/97
gccucgaccgccagcc

SEQ ID NO: 1036504 - RNA, 22 nt, Mycobacterium bovis subsp bovis AF2122/97
gccucgaccgccagcccgguga

SEQ ID NO: 1036505 - RNA, 23 nt, Mycobacterium bovis subsp bovis AF2122/97
gccucgaccgccagccgcgagcc

SEQ ID NO: 1036506 - RNA, 14 nt, Mycobacterium bovis subsp bovis AF2122/97
gccucgaggaccac

SEQ ID NO: 1036507 - RNA, 16 nt, Mycobacterium bovis subsp bovis AF2122/97
gccucgaggaccacca

SEQ ID NO: 1036508 - RNA, 21 nt, Mycobacterium bovis subsp bovis AF2122/97
gccucgagguauucgcgcagc

SEQ ID NO: 1036509 - RNA, 19 nt, Mycobacterium bovis subsp bovis AF2122/97
gccucgacacccagccgca

SEQ ID NO: 1036510 - RNA, 21 nt, Mycobacterium bovis subsp bovis AF2122/97
gccucgaccaccugcugcacg

SEQ ID NO: 1036511 - RNA, 22 nt, Mycobacterium bovis subsp bovis AF2122/97
gccucgaacgccgcccgcuggg

SEQ ID NO: 1036512 - RNA, 20 nt, Mycobacterium bovis subsp bovis AF2122/97
gccuccucgacgucggcgag

SEQ ID NO: 1036513 - RNA, 22 nt, Mycobacterium bovis subsp bovis AF2122/97
gccuccucgugcaggaccagca

SEQ ID NO: 1036514 - RNA, 15 nt, Mycobacterium bovis subsp bovis AF2122/97
gccucaccgacgucg

SEQ ID NO: 1036515 - RNA, 17 nt, Mycobacterium bovis subsp bovis AF2122/97
gccucaccgacgucgcc

SEQ ID NO: 1036516 - RNA, 15 nt, Mycobacterium bovis subsp bovis AF2122/97
gccucaccacgucga

SEQ ID NO: 1036517 - RNA, 19 nt, Mycobacterium bovis subsp bovis AF2122/97
gccuccgccgaggccgccg

SEQ ID NO: 1036518 - RNA, 23 nt, Mycobacterium bovis subsp bovis AF2122/97
gccucagccaccgggcgugcggc

SEQ ID NO: 1036519 - RNA, 20 nt, Mycobacterium bovis subsp bovis AF2122/97
gccucagaccggaaacagca

SEQ ID NO: 1036520 - RNA, 10 nt, Mycobacterium bovis subsp bovis AF2122/97
gccuccggca

SEQ ID NO: 1036521 - RNA, 13 nt, Mycobacterium bovis subsp bovis AF2122/97
gccuccggcaccu

SEQ ID NO: 1036522 - RNA, 17 nt, Mycobacterium bovis subsp bovis AF2122/97
gccuccggcaccuccag

SEQ ID NO: 1036523 - RNA, 21 nt, Mycobacterium bovis subsp bovis AF2122/97
gccuccgcugccgcccgcgcc

SEQ ID NO: 1036524 - RNA, 19 nt, Mycobacterium bovis subsp bovis AF2122/97
gccucgccugagcgcucga

SEQ ID NO: 1036525 - RNA, 19 nt, Mycobacterium bovis subsp bovis AF2122/97
gccucgccugcacgcccgg

SEQ ID NO: 1036526 - RNA, 16 nt, Mycobacterium bovis subsp bovis AF2122/97
gccucgcugcucagca

SEQ ID NO: 1036527 - RNA, 22 nt, Mycobacterium bovis subsp bovis AF2122/97
gccucgcgacgaguugcgaacc

SEQ ID NO: 1036528 - RNA, 23 nt, Mycobacterium bovis subsp bovis AF2122/97
gccucgcggaugagcucggccau

SEQ ID NO: 1036529 - RNA, 17 nt, Mycobacterium bovis subsp bovis AF2122/97
gccucgcgggcagggcc

SEQ ID NO: 1036530 - RNA, 17 nt, Mycobacterium bovis subsp bovis AF2122/97
gccucgaucagcgccgg

SEQ ID NO: 1036531 - RNA, 15 nt, Mycobacterium bovis subsp bovis AF2122/97
gccucgauggcggug

SEQ ID NO: 1036532 - RNA, 18 nt, Mycobacterium bovis subsp bovis AF2122/97
gccucgauggcgguggcg

SEQ ID NO: 1036533 - RNA, 19 nt, Mycobacterium bovis subsp bovis AF2122/97
gccucgaugucgcggucgc

SEQ ID NO: 1036534 - RNA, 15 nt, Mycobacterium bovis subsp bovis AF2122/97
gccucgauguccgau

SEQ ID NO: 1036535 - RNA, 19 nt, Mycobacterium bovis subsp bovis AF2122/97
gccucgauuguggccagcg

SEQ ID NO: 1036536 - RNA, 14 nt, Mycobacterium bovis subsp bovis AF2122/97
gccucgccggccac

SEQ ID NO: 1036537 - RNA, 15 nt, Mycobacterium bovis subsp bovis AF2122/97
gccucgccggccacc

SEQ ID NO: 1036538 - RNA, 16 nt, Mycobacterium bovis subsp bovis AF2122/97
gccucgccggccaccc

SEQ ID NO: 1036539 - RNA, 19 nt, Mycobacterium bovis subsp bovis AF2122/97
gccguugcgucugcucggc

SEQ ID NO: 1036540 - RNA, 19 nt, Mycobacterium bovis subsp bovis AF2122/97
gccguugcuauucgccagc

SEQ ID NO: 1036541 - RNA, 21 nt, Mycobacterium bovis subsp bovis AF2122/97
gccguugcuauucgccagcgc

SEQ ID NO: 1036542 - RNA, 16 nt, Mycobacterium bovis subsp bovis AF2122/97
gccguuggagccgcca

SEQ ID NO: 1036543 - RNA, 20 nt, Mycobacterium bovis subsp bovis AF2122/97
gccguugggccgcgcccugu

SEQ ID NO: 1036544 - RNA, 14 nt, Mycobacterium bovis subsp bovis AF2122/97
gccguuggugccgc

SEQ ID NO: 1036545 - RNA, 17 nt, Mycobacterium bovis subsp bovis AF2122/97
gccguugggccaccggc

SEQ ID NO: 1036546 - RNA, 19 nt, Mycobacterium bovis subsp bovis AF2122/97
gccguugggccaccggcgc

SEQ ID NO: 1036547 - RNA, 22 nt, Mycobacterium bovis subsp bovis AF2122/97
gccguugggccaccggcgccgu

SEQ ID NO: 1036548 - RNA, 23 nt, Mycobacterium bovis subsp bovis AF2122/97
gccguugucgaccuccucgacca

SEQ ID NO: 1036549 - RNA, 19 nt, Mycobacterium bovis subsp bovis AF2122/97
gccguuguagacggcggca

SEQ ID NO: 1036550 - RNA, 22 nt, Mycobacterium bovis subsp bovis AF2122/97
gccguuguagacggcggcaucg

SEQ ID NO: 1036551 - RNA, 14 nt, Mycobacterium bovis subsp bovis AF2122/97
gccguugucggcgg

SEQ ID NO: 1036552 - RNA, 17 nt, Mycobacterium bovis subsp bovis AF2122/97
gccguugucggcgguga

SEQ ID NO: 1036553 - RNA, 13 nt, Mycobacterium bovis subsp bovis AF2122/97
gccuagcgagcgc

SEQ ID NO: 1036554 - RNA, 22 nt, Mycobacterium bovis subsp bovis AF2122/97
gccuagcgccacuugaugccgc

SEQ ID NO: 1036555 - RNA, 12 nt, Mycobacterium bovis subsp bovis AF2122/97
gccuagcgcggc

SEQ ID NO: 1036556 - RNA, 22 nt, Mycobacterium bovis subsp bovis AF2122/97
gccuagcacgaagcuggcgugc

SEQ ID NO: 1036557 - RNA, 23 nt, Mycobacterium bovis subsp bovis AF2122/97
gccuagggaaaggcgccggucgc

SEQ ID NO: 1036558 - RNA, 19 nt, Mycobacterium bovis subsp bovis AF2122/97
gccuagguagucggccucc

SEQ ID NO: 1036559 - RNA, 18 nt, Mycobacterium bovis subsp bovis AF2122/97
gccuagguucgcccagcc

SEQ ID NO: 1036560 - RNA, 17 nt, Mycobacterium bovis subsp bovis AF2122/97
gccuagugguucgaacc

SEQ ID NO: 1036561 - RNA, 13 nt, Mycobacterium bovis subsp bovis AF2122/97
gccuagccgcagc

SEQ ID NO: 1036562 - RNA, 19 nt, Mycobacterium bovis subsp bovis AF2122/97
gccuagccgcggcaccgcc

SEQ ID NO: 1036563 - RNA, 15 nt, Mycobacterium bovis subsp bovis AF2122/97
gccuagccgcuccgc

SEQ ID NO: 1036564 - RNA, 20 nt, Mycobacterium bovis subsp bovis AF2122/97
gccuaguccuggcucggcau

SEQ ID NO: 1036565 - RNA, 19 nt, Mycobacterium bovis subsp bovis AF2122/97
gccuaugcugcccggcaac

SEQ ID NO: 1036566 - RNA, 15 nt, Mycobacterium bovis subsp bovis AF2122/97
gccucaacacccggc

SEQ ID NO: 1036567 - RNA, 18 nt, Mycobacterium bovis subsp bovis AF2122/97
gccuaugcugcccggcaa

SEQ ID NO: 1036568 - RNA, 12 nt, Mycobacterium bovis subsp bovis AF2122/97
gccgugccguac

SEQ ID NO: 1036569 - RNA, 16 nt, Mycobacterium bovis subsp bovis AF2122/97
gccgugcgccgugcga

SEQ ID NO: 1036570 - RNA, 18 nt, Mycobacterium bovis subsp bovis AF2122/97
gccgugcgccgugcgauc

SEQ ID NO: 1036571 - RNA, 20 nt, Mycobacterium bovis subsp bovis AF2122/97
gccgugccucgaggacggcg

SEQ ID NO: 1036572 - RNA, 14 nt, Mycobacterium bovis subsp bovis AF2122/97
gccgugcgaucacc

SEQ ID NO: 1036573 - RNA, 22 nt, Mycobacterium bovis subsp bovis AF2122/97
gccgugcgaucgucaacgacga

SEQ ID NO: 1036574 - RNA, 23 nt, Mycobacterium bovis subsp bovis AF2122/97
gccgugcggcggcugccgguuuc

SEQ ID NO: 1036575 - RNA, 14 nt, Mycobacterium bovis subsp bovis AF2122/97
gccgugcggucgcg

SEQ ID NO: 1036576 - RNA, 23 nt, Mycobacterium bovis subsp bovis AF2122/97
gccgugcuacccauucggcggcg

SEQ ID NO: 1036577 - RNA, 15 nt, Mycobacterium bovis subsp bovis AF2122/97
gccgugcucaccggc

SEQ ID NO: 1036578 - RNA, 18 nt, Mycobacterium bovis subsp bovis AF2122/97
gccgugcucaccggcgcc

SEQ ID NO: 1036579 - RNA, 19 nt, Mycobacterium bovis subsp bovis AF2122/97
gccgugcucacggcaggcg

SEQ ID NO: 1036580 - RNA, 20 nt, Mycobacterium bovis subsp bovis AF2122/97
gccgugcucacggcaggcgg

SEQ ID NO: 1036581 - RNA, 23 nt, Mycobacterium bovis subsp bovis AF2122/97
gccgugcucacggcaggcgguga

SEQ ID NO: 1036582 - RNA, 21 nt, Mycobacterium bovis subsp bovis AF2122/97
gccgugcugaacuccgccgcg

SEQ ID NO: 1036583 - RNA, 20 nt, Mycobacterium bovis subsp bovis AF2122/97
gccguucugaucugcgcaac

SEQ ID NO: 1036584 - RNA, 19 nt, Mycobacterium bovis subsp bovis AF2122/97
gccguucugucccggcgcg

SEQ ID NO: 1036585 - RNA, 14 nt, Mycobacterium bovis subsp bovis AF2122/97
gccguugcccacgu

SEQ ID NO: 1036586 - RNA, 16 nt, Mycobacterium bovis subsp bovis AF2122/97
gccguugccgaucacc

SEQ ID NO: 1036587 - RNA, 20 nt, Mycobacterium bovis subsp bovis AF2122/97
gccguugccgaucaccacgg

SEQ ID NO: 1036588 - RNA, 19 nt, Mycobacterium bovis subsp bovis AF2122/97
gccguugccgaucgcuccg

SEQ ID NO: 1036589 - RNA, 16 nt, Mycobacterium bovis subsp bovis AF2122/97
gccguugccaagcagc

SEQ ID NO: 1036590 - RNA, 13 nt, Mycobacterium bovis subsp bovis AF2122/97
gccguugccaccg

SEQ ID NO: 1036591 - RNA, 18 nt, Mycobacterium bovis subsp bovis AF2122/97
gccguugccaccggugcc

SEQ ID NO: 1036592 - RNA, 20 nt, Mycobacterium bovis subsp bovis AF2122/97
gccguugccaccguugccgc

SEQ ID NO: 1036593 - RNA, 23 nt, Mycobacterium bovis subsp bovis AF2122/97
gccguugccaccguugccgccgu

SEQ ID NO: 1036594 - RNA, 13 nt, Mycobacterium bovis subsp bovis AF2122/97
gccguugccgcca

SEQ ID NO: 1036595 - RNA, 15 nt, Mycobacterium bovis subsp bovis AF2122/97
gccguugccgccauu

SEQ ID NO: 1036596 - RNA, 15 nt, Mycobacterium bovis subsp bovis AF2122/97
gccguugccgccgaa

SEQ ID NO: 1036597 - RNA, 18 nt, Mycobacterium bovis subsp bovis AF2122/97
gccguugccgccgacgcc

SEQ ID NO: 1036598 - RNA, 23 nt, Mycobacterium bovis subsp bovis AF2122/97
gccguugccgccgacgccgccgg

SEQ ID NO: 1036599 - RNA, 15 nt, Mycobacterium bovis subsp bovis AF2122/97
gccguugccgccgcc

SEQ ID NO: 1036600 - RNA, 16 nt, Mycobacterium bovis subsp bovis AF2122/97
gccguugccgccgccu

SEQ ID NO: 1036601 - RNA, 16 nt, Mycobacterium bovis subsp bovis AF2122/97
gccguugccgccgucg

SEQ ID NO: 1036602 - RNA, 14 nt, Mycobacterium bovis subsp bovis AF2122/97
gccguugccgccgu

SEQ ID NO: 1036603 - RNA, 14 nt, Mycobacterium bovis subsp bovis AF2122/97
gccguugccgccgg

SEQ ID NO: 1036604 - RNA, 18 nt, Mycobacterium bovis subsp bovis AF2122/97
gccguugccgccggcgcc

SEQ ID NO: 1036605 - RNA, 15 nt, Mycobacterium bovis subsp bovis AF2122/97
gccguugccgccggu

SEQ ID NO: 1036606 - RNA, 14 nt, Mycobacterium bovis subsp bovis AF2122/97
gccguugccggcga

SEQ ID NO: 1036607 - RNA, 14 nt, Mycobacterium bovis subsp bovis AF2122/97
gccguugccguaca

SEQ ID NO: 1036608 - RNA, 20 nt, Mycobacterium bovis subsp bovis AF2122/97
gccguugccguacagcccgg

SEQ ID NO: 1036609 - RNA, 20 nt, Mycobacterium bovis subsp bovis AF2122/97
gccguugcgaucgcgugcgg

SEQ ID NO: 1036610 - RNA, 14 nt, Mycobacterium bovis subsp bovis AF2122/97
gccguugacggugu

SEQ ID NO: 1036611 - RNA, 20 nt, Mycobacterium bovis subsp bovis AF2122/97
gccguugcacggccgggacg

SEQ ID NO: 1036612 - RNA, 17 nt, Mycobacterium bovis subsp bovis AF2122/97
gccguugauucggccgc

SEQ ID NO: 1036613 - RNA, 20 nt, Mycobacterium bovis subsp bovis AF2122/97
gccguugaucgcaaacccgu

SEQ ID NO: 1036614 - RNA, 15 nt, Mycobacterium bovis subsp bovis AF2122/97
gccguugaguccggc

SEQ ID NO: 1036615 - RNA, 20 nt, Mycobacterium bovis subsp bovis AF2122/97
gccguccucggucagcucgu

SEQ ID NO: 1036616 - RNA, 12 nt, Mycobacterium bovis subsp bovis AF2122/97
gccguccggcgc

SEQ ID NO: 1036617 - RNA, 15 nt, Mycobacterium bovis subsp bovis AF2122/97
gccguccggcgccca

SEQ ID NO: 1036618 - RNA, 12 nt, Mycobacterium bovis subsp bovis AF2122/97
gccgucgauccc

SEQ ID NO: 1036619 - RNA, 22 nt, Mycobacterium bovis subsp bovis AF2122/97
gccgucgaucccggucggugug

SEQ ID NO: 1036620 - RNA, 17 nt, Mycobacterium bovis subsp bovis AF2122/97
gccgucgaugaccagca

SEQ ID NO: 1036621 - RNA, 18 nt, Mycobacterium bovis subsp bovis AF2122/97
gccgucgaguccaggccg

SEQ ID NO: 1036622 - RNA, 23 nt, Mycobacterium bovis subsp bovis AF2122/97
gccgucgaagacgaacgugucgg

SEQ ID NO: 1036623 - RNA, 19 nt, Mycobacterium bovis subsp bovis AF2122/97
gccgucgaaccaguccucg

SEQ ID NO: 1036624 - RNA, 14 nt, Mycobacterium bovis subsp bovis AF2122/97
gccguccggcuugg

SEQ ID NO: 1036625 - RNA, 18 nt, Mycobacterium bovis subsp bovis AF2122/97
gccguccggcuuggcggc

SEQ ID NO: 1036626 - RNA, 18 nt, Mycobacterium bovis subsp bovis AF2122/97
gccguccgggcggccucc

SEQ ID NO: 1036627 - RNA, 20 nt, Mycobacterium bovis subsp bovis AF2122/97
gccguccgguggaccgccga

SEQ ID NO: 1036628 - RNA, 18 nt, Mycobacterium bovis subsp bovis AF2122/97
gccguccaggacggaucg

SEQ ID NO: 1036629 - RNA, 20 nt, Mycobacterium bovis subsp bovis AF2122/97
gccguccaccgauacccccg

SEQ ID NO: 1036630 - RNA, 19 nt, Mycobacterium bovis subsp bovis AF2122/97
gccguccaggacggaucgu

SEQ ID NO: 1036631 - RNA, 18 nt, Mycobacterium bovis subsp bovis AF2122/97
gccguccaauuccgcaga

SEQ ID NO: 1036632 - RNA, 20 nt, Mycobacterium bovis subsp bovis AF2122/97
gccguccaauuccgcagaga

SEQ ID NO: 1036633 - RNA, 13 nt, Mycobacterium bovis subsp bovis AF2122/97
gccguccagcgcc

SEQ ID NO: 1036634 - RNA, 16 nt, Mycobacterium bovis subsp bovis AF2122/97
gccguccagcgccgcg

SEQ ID NO: 1036635 - RNA, 19 nt, Mycobacterium bovis subsp bovis AF2122/97
gccguccagcgccgcggcc

SEQ ID NO: 1036636 - RNA, 15 nt, Mycobacterium bovis subsp bovis AF2122/97
gccgucaccgaucga

SEQ ID NO: 1036637 - RNA, 11 nt, Mycobacterium bovis subsp bovis AF2122/97
gccgucaccgc

SEQ ID NO: 1036638 - RNA, 14 nt, Mycobacterium bovis subsp bovis AF2122/97
gccgucaccgccgu

SEQ ID NO: 1036639 - RNA, 16 nt, Mycobacterium bovis subsp bovis AF2122/97
gccgucaccgccguug

SEQ ID NO: 1036640 - RNA, 13 nt, Mycobacterium bovis subsp bovis AF2122/97
gccgucaccgccc

SEQ ID NO: 1036641 - RNA, 13 nt, Mycobacterium bovis subsp bovis AF2122/97
gccgucaccgcga

SEQ ID NO: 1036642 - RNA, 18 nt, Mycobacterium bovis subsp bovis AF2122/97
gccgucacgcacgccgcg

SEQ ID NO: 1036643 - RNA, 14 nt, Mycobacterium bovis subsp bovis AF2122/97
gccgucaccgcgac

SEQ ID NO: 1036644 - RNA, 15 nt, Mycobacterium bovis subsp bovis AF2122/97
gccgucaccgcgacc

SEQ ID NO: 1036645 - RNA, 21 nt, Mycobacterium bovis subsp bovis AF2122/97
gccgucaccgucauugccacc

SEQ ID NO: 1036646 - RNA, 14 nt, Mycobacterium bovis subsp bovis AF2122/97
gccgucacgccgga

SEQ ID NO: 1036647 - RNA, 16 nt, Mycobacterium bovis subsp bovis AF2122/97
gccgucagaacaccgg

SEQ ID NO: 1036648 - RNA, 17 nt, Mycobacterium bovis subsp bovis AF2122/97
gccgucagaacaccggc

SEQ ID NO: 1036649 - RNA, 17 nt, Mycobacterium bovis subsp bovis AF2122/97
gccgucagccaggugcc

SEQ ID NO: 1036650 - RNA, 21 nt, Mycobacterium bovis subsp bovis AF2122/97
gccgucagccaggugcccaag

SEQ ID NO: 1036651 - RNA, 14 nt, Mycobacterium bovis subsp bovis AF2122/97
gccgucagccguuc

SEQ ID NO: 1036652 - RNA, 21 nt, Mycobacterium bovis subsp bovis AF2122/97
gccgucagcggccaagucacc

SEQ ID NO: 1036653 - RNA, 13 nt, Mycobacterium bovis subsp bovis AF2122/97
gccgucagcggcg

SEQ ID NO: 1036654 - RNA, 18 nt, Mycobacterium bovis subsp bovis AF2122/97
gccgucagcggcggccac

SEQ ID NO: 1036655 - RNA, 13 nt, Mycobacterium bovis subsp bovis AF2122/97
gccgucagcguca

SEQ ID NO: 1036656 - RNA, 14 nt, Mycobacterium bovis subsp bovis AF2122/97
gccguccacgccga

SEQ ID NO: 1036657 - RNA, 24 nt, Mycobacterium bovis subsp bovis AF2122/97
gccguaucggggcaccacgccagc

SEQ ID NO: 1036658 - RNA, 17 nt, Mycobacterium bovis subsp bovis AF2122/97
gccguaucgucgagcac

SEQ ID NO: 1036659 - RNA, 18 nt, Mycobacterium bovis subsp bovis AF2122/97
gccguaucggacgggaug

SEQ ID NO: 1036660 - RNA, 23 nt, Mycobacterium bovis subsp bovis AF2122/97
gccgucaacgccucugcucagcc

SEQ ID NO: 1036661 - RNA, 23 nt, Mycobacterium bovis subsp bovis AF2122/97
gccgucaagauugaacgaguagc

SEQ ID NO: 1036662 - RNA, 23 nt, Mycobacterium bovis subsp bovis AF2122/97
gccgucaaccagggugccggcgg

SEQ ID NO: 1036663 - RNA, 14 nt, Mycobacterium bovis subsp bovis AF2122/97
gccgucaauggaac

SEQ ID NO: 1036664 - RNA, 23 nt, Mycobacterium bovis subsp bovis AF2122/97
gccgucacccccgauagcgaccg

SEQ ID NO: 1036665 - RNA, 17 nt, Mycobacterium bovis subsp bovis AF2122/97
gccgguguugccgccgg

SEQ ID NO: 1036666 - RNA, 21 nt, Mycobacterium bovis subsp bovis AF2122/97
gccgguguugccgccggugcc

SEQ ID NO: 1036667 - RNA, 22 nt, Mycobacterium bovis subsp bovis AF2122/97
gccgguguguccagcggaucgu

SEQ ID NO: 1036668 - RNA, 15 nt, Mycobacterium bovis subsp bovis AF2122/97
gccgguguugccgaa

SEQ ID NO: 1036669 - RNA, 16 nt, Mycobacterium bovis subsp bovis AF2122/97
gccggugugcggcgua

SEQ ID NO: 1036670 - RNA, 14 nt, Mycobacterium bovis subsp bovis AF2122/97
gccgguuacccgga

SEQ ID NO: 1036671 - RNA, 21 nt, Mycobacterium bovis subsp bovis AF2122/97
gccgguuacccggaccgucgu

SEQ ID NO: 1036672 - RNA, 22 nt, Mycobacterium bovis subsp bovis AF2122/97
gccgguguugccgaagcccgag

SEQ ID NO: 1036673 - RNA, 22 nt, Mycobacterium bovis subsp bovis AF2122/97
gccgguguuuccgaaacccgcc

SEQ ID NO: 1036674 - RNA, 14 nt, Mycobacterium bovis subsp bovis AF2122/97
gccgucgaugguca

SEQ ID NO: 1036675 - RNA, 21 nt, Mycobacterium bovis subsp bovis AF2122/97
gccgucgauguggcgcuccgg

SEQ ID NO: 1036676 - RNA, 20 nt, Mycobacterium bovis subsp bovis AF2122/97
gccgucgauguugcccagca

SEQ ID NO: 1036677 - RNA, 12 nt, Mycobacterium bovis subsp bovis AF2122/97
gccgucgccacc

SEQ ID NO: 1036678 - RNA, 23 nt, Mycobacterium bovis subsp bovis AF2122/97
gccgucgccaccgguaccgauca

SEQ ID NO: 1036679 - RNA, 13 nt, Mycobacterium bovis subsp bovis AF2122/97
gccgucgccaccg

SEQ ID NO: 1036680 - RNA, 19 nt, Mycobacterium bovis subsp bovis AF2122/97
gccgucgccacgcccagcg

SEQ ID NO: 1036681 - RNA, 23 nt, Mycobacterium bovis subsp bovis AF2122/97
gccgucgccacgcccagcgcccg

SEQ ID NO: 1036682 - RNA, 15 nt, Mycobacterium bovis subsp bovis AF2122/97
gccgucgcggucaac

SEQ ID NO: 1036683 - RNA, 15 nt, Mycobacterium bovis subsp bovis AF2122/97
gccgucggacaccgc

SEQ ID NO: 1036684 - RNA, 19 nt, Mycobacterium bovis subsp bovis AF2122/97
gccgucggagaccagcucg

SEQ ID NO: 1036685 - RNA, 23 nt, Mycobacterium bovis subsp bovis AF2122/97
gccgucggagaccagcucguugc

SEQ ID NO: 1036686 - RNA, 14 nt, Mycobacterium bovis subsp bovis AF2122/97
gccgucggagccgg

SEQ ID NO: 1036687 - RNA, 18 nt, Mycobacterium bovis subsp bovis AF2122/97
gccgucggagccggccac

SEQ ID NO: 1036688 - RNA, 22 nt, Mycobacterium bovis subsp bovis AF2122/97
gccgucgcuagggugagcccgg

SEQ ID NO: 1036689 - RNA, 23 nt, Mycobacterium bovis subsp bovis AF2122/97
gccgucgcuagggugagcccggg

SEQ ID NO: 1036690 - RNA, 14 nt, Mycobacterium bovis subsp bovis AF2122/97
gccgucgcggcacg

SEQ ID NO: 1036691 - RNA, 20 nt, Mycobacterium bovis subsp bovis AF2122/97
gccgucguacucgaccgcga

SEQ ID NO: 1036692 - RNA, 15 nt, Mycobacterium bovis subsp bovis AF2122/97
gccgucgcggcacgc

SEQ ID NO: 1036693 - RNA, 20 nt, Mycobacterium bovis subsp bovis AF2122/97
gccgucgcggcacgcccaca

SEQ ID NO: 1036694 - RNA, 13 nt, Mycobacterium bovis subsp bovis AF2122/97
gccgucgcugacg

SEQ ID NO: 1036695 - RNA, 19 nt, Mycobacterium bovis subsp bovis AF2122/97
gccgucgucgagcaccacc

SEQ ID NO: 1036696 - RNA, 12 nt, Mycobacterium bovis subsp bovis AF2122/97
gccgucgcccca

SEQ ID NO: 1036697 - RNA, 17 nt, Mycobacterium bovis subsp bovis AF2122/97
gccgucgucgaccacga

SEQ ID NO: 1036698 - RNA, 12 nt, Mycobacterium bovis subsp bovis AF2122/97
gccgucgucagc

SEQ ID NO: 1036699 - RNA, 15 nt, Mycobacterium bovis subsp bovis AF2122/97
gccgucgucggccag

SEQ ID NO: 1036700 - RNA, 12 nt, Mycobacterium bovis subsp bovis AF2122/97
gccgucgucggu

SEQ ID NO: 1036701 - RNA, 20 nt, Mycobacterium bovis subsp bovis AF2122/97
gccgucgucgccgucggugc

SEQ ID NO: 1036702 - RNA, 19 nt, Mycobacterium bovis subsp bovis AF2122/97
gccgucgucgcgcaguacu

SEQ ID NO: 1036703 - RNA, 16 nt, Mycobacterium bovis subsp bovis AF2122/97
gccgucgucgucgaga

SEQ ID NO: 1036704 - RNA, 17 nt, Mycobacterium bovis subsp bovis AF2122/97
gccgucguugcccgacc

SEQ ID NO: 1036705 - RNA, 23 nt, Mycobacterium bovis subsp bovis AF2122/97
gccgucguugcccgacccgccga

SEQ ID NO: 1036706 - RNA, 16 nt, Mycobacterium bovis subsp bovis AF2122/97
gccgucguugccggcg

SEQ ID NO: 1036707 - RNA, 17 nt, Mycobacterium bovis subsp bovis AF2122/97
gccgucguugccggcga

SEQ ID NO: 1036708 - RNA, 16 nt, Mycobacterium bovis subsp bovis AF2122/97
gccgucuucgccgcca

SEQ ID NO: 1036709 - RNA, 17 nt, Mycobacterium bovis subsp bovis AF2122/97
gccgugaauucgccgaa

SEQ ID NO: 1036710 - RNA, 21 nt, Mycobacterium bovis subsp bovis AF2122/97
gccgugacaaggugcgcuggg

SEQ ID NO: 1036711 - RNA, 22 nt, Mycobacterium bovis subsp bovis AF2122/97
gccgugacaaggugcgcugggu

SEQ ID NO: 1036712 - RNA, 15 nt, Mycobacterium bovis subsp bovis AF2122/97
gccgugaacggcgcg

SEQ ID NO: 1036713 - RNA, 16 nt, Mycobacterium bovis subsp bovis AF2122/97
gccgugaauucgccga

SEQ ID NO: 1036714 - RNA, 14 nt, Mycobacterium bovis subsp bovis AF2122/97
gccgucucgaucgc

SEQ ID NO: 1036715 - RNA, 16 nt, Mycobacterium bovis subsp bovis AF2122/97
gccgucguugugccgg

SEQ ID NO: 1036716 - RNA, 21 nt, Mycobacterium bovis subsp bovis AF2122/97
gccgucucugccacgcguucc

SEQ ID NO: 1036717 - RNA, 23 nt, Mycobacterium bovis subsp bovis AF2122/97
gccgugauauccguacaguccac

SEQ ID NO: 1036718 - RNA, 16 nt, Mycobacterium bovis subsp bovis AF2122/97
gccgugaucagcucgc

SEQ ID NO: 1036719 - RNA, 15 nt, Mycobacterium bovis subsp bovis AF2122/97
gccgugaucgcuggc

SEQ ID NO: 1036720 - RNA, 16 nt, Mycobacterium bovis subsp bovis AF2122/97
gccgugaucgcuggcg

SEQ ID NO: 1036721 - RNA, 18 nt, Mycobacterium bovis subsp bovis AF2122/97
gccgugaucgcuggcgac

SEQ ID NO: 1036722 - RNA, 13 nt, Mycobacterium bovis subsp bovis AF2122/97
gccgugcaccagc

SEQ ID NO: 1036723 - RNA, 14 nt, Mycobacterium bovis subsp bovis AF2122/97
gccgugcaccagcg

SEQ ID NO: 1036724 - RNA, 20 nt, Mycobacterium bovis subsp bovis AF2122/97
gccgugcaccagcgaccagg

SEQ ID NO: 1036725 - RNA, 21 nt, Mycobacterium bovis subsp bovis AF2122/97
gccgugaucagcucgcgcacg

SEQ ID NO: 1036726 - RNA, 16 nt, Mycobacterium bovis subsp bovis AF2122/97
gccgugaugccacggc

SEQ ID NO: 1036727 - RNA, 21 nt, Mycobacterium bovis subsp bovis AF2122/97
gccgugaugccacggcgucgc

SEQ ID NO: 1036728 - RNA, 22 nt, Mycobacterium bovis subsp bovis AF2122/97
gccgugaugccacggcgucgcu

SEQ ID NO: 1036729 - RNA, 18 nt, Mycobacterium bovis subsp bovis AF2122/97
gccgugaacggcgcgggc

SEQ ID NO: 1036730 - RNA, 20 nt, Mycobacterium bovis subsp bovis AF2122/97
gccgugaguucacguucggc

SEQ ID NO: 1036731 - RNA, 23 nt, Mycobacterium bovis subsp bovis AF2122/97
gccgugaguagguccacguucgg

SEQ ID NO: 1036732 - RNA, 13 nt, Mycobacterium bovis subsp bovis AF2122/97
gccucgcguucgc

SEQ ID NO: 1036733 - RNA, 20 nt, Mycobacterium bovis subsp bovis AF2122/97
gccucggaccagacccacga

SEQ ID NO: 1036734 - RNA, 22 nt, Mycobacterium bovis subsp bovis AF2122/97
gccugccgaaacgccgaccgcg

SEQ ID NO: 1036735 - RNA, 14 nt, Mycobacterium bovis subsp bovis AF2122/97
gccugccgacggca

SEQ ID NO: 1036736 - RNA, 21 nt, Mycobacterium bovis subsp bovis AF2122/97
gccugccgacggcaucaacgc

SEQ ID NO: 1036737 - RNA, 13 nt, Mycobacterium bovis subsp bovis AF2122/97
gccugccgcucgc

SEQ ID NO: 1036738 - RNA, 16 nt, Mycobacterium bovis subsp bovis AF2122/97
gccugccucgccugca

SEQ ID NO: 1036739 - RNA, 16 nt, Mycobacterium bovis subsp bovis AF2122/97
gccugccucaccgccg

SEQ ID NO: 1036740 - RNA, 23 nt, Mycobacterium bovis subsp bovis AF2122/97
gccugccggcugacaacgacaac

SEQ ID NO: 1036741 - RNA, 15 nt, Mycobacterium bovis subsp bovis AF2122/97
gccugcgagucgcgc

SEQ ID NO: 1036742 - RNA, 15 nt, Mycobacterium bovis subsp bovis AF2122/97
gccugcgacagcacg

SEQ ID NO: 1036743 - RNA, 16 nt, Mycobacterium bovis subsp bovis AF2122/97
gccugcgaacacgcga

SEQ ID NO: 1036744 - RNA, 16 nt, Mycobacterium bovis subsp bovis AF2122/97
gccugcgacgagccca

SEQ ID NO: 1036745 - RNA, 15 nt, Mycobacterium bovis subsp bovis AF2122/97
gccugcgcgaccgac

SEQ ID NO: 1036746 - RNA, 12 nt, Mycobacterium bovis subsp bovis AF2122/97
gccugcgccggc

SEQ ID NO: 1036747 - RNA, 15 nt, Mycobacterium bovis subsp bovis AF2122/97
gccugcgccgcgcga

SEQ ID NO: 1036748 - RNA, 18 nt, Mycobacterium bovis subsp bovis AF2122/97
gccugcgccgacccgcgc

SEQ ID NO: 1036749 - RNA, 19 nt, Mycobacterium bovis subsp bovis AF2122/97
gccugcgccgccagcgccg

SEQ ID NO: 1036750 - RNA, 23 nt, Mycobacterium bovis subsp bovis AF2122/97
gccugcgccgcccgcgccaccga

SEQ ID NO: 1036751 - RNA, 15 nt, Mycobacterium bovis subsp bovis AF2122/97
gccugcgcgaugcga

SEQ ID NO: 1036752 - RNA, 14 nt, Mycobacterium bovis subsp bovis AF2122/97
gccugcgcgauccg

SEQ ID NO: 1036753 - RNA, 20 nt, Mycobacterium bovis subsp bovis AF2122/97
gccugcgcgauccgcgcgca

SEQ ID NO: 1036754 - RNA, 13 nt, Mycobacterium bovis subsp bovis AF2122/97
gccugcgccggcg

SEQ ID NO: 1036755 - RNA, 17 nt, Mycobacterium bovis subsp bovis AF2122/97
gccugcgccgacccgcg

SEQ ID NO: 1036756 - RNA, 13 nt, Mycobacterium bovis subsp bovis AF2122/97
gccugcgccgagu

SEQ ID NO: 1036757 - RNA, 13 nt, Mycobacterium bovis subsp bovis AF2122/97
gccugcgccgcca

SEQ ID NO: 1036758 - RNA, 15 nt, Mycobacterium bovis subsp bovis AF2122/97
gccugcgccgccagc

SEQ ID NO: 1036759 - RNA, 16 nt, Mycobacterium bovis subsp bovis AF2122/97
gccugcgccgccagcg

SEQ ID NO: 1036760 - RNA, 16 nt, Mycobacterium bovis subsp bovis AF2122/97
gccugcgccacccgcg

SEQ ID NO: 1036761 - RNA, 16 nt, Mycobacterium bovis subsp bovis AF2122/97
gccugcggcaacggcu

SEQ ID NO: 1036762 - RNA, 21 nt, Mycobacterium bovis subsp bovis AF2122/97
gccugcggcaacggcucgucg

SEQ ID NO: 1036763 - RNA, 13 nt, Mycobacterium bovis subsp bovis AF2122/97
gccugcggcaccg

SEQ ID NO: 1036764 - RNA, 15 nt, Mycobacterium bovis subsp bovis AF2122/97
gccugcggcaccggc

SEQ ID NO: 1036765 - RNA, 13 nt, Mycobacterium bovis subsp bovis AF2122/97
gccugcggcagca

SEQ ID NO: 1036766 - RNA, 13 nt, Mycobacterium bovis subsp bovis AF2122/97
gccugcggcggcg

SEQ ID NO: 1036767 - RNA, 14 nt, Mycobacterium bovis subsp bovis AF2122/97
gccugcggcgguca

SEQ ID NO: 1036768 - RNA, 20 nt, Mycobacterium bovis subsp bovis AF2122/97
gccugcucgucggccaccgc

SEQ ID NO: 1036769 - RNA, 19 nt, Mycobacterium bovis subsp bovis AF2122/97
gccugcucggcgaccgucg

SEQ ID NO: 1036770 - RNA, 18 nt, Mycobacterium bovis subsp bovis AF2122/97
gccugcuggucaccauca

SEQ ID NO: 1036771 - RNA, 17 nt, Mycobacterium bovis subsp bovis AF2122/97
gccuggcccacgccgca

SEQ ID NO: 1036772 - RNA, 15 nt, Mycobacterium bovis subsp bovis AF2122/97
gccuggccaccuggu

SEQ ID NO: 1036773 - RNA, 12 nt, Mycobacterium bovis subsp bovis AF2122/97
gccugcuggccg

SEQ ID NO: 1036774 - RNA, 14 nt, Mycobacterium bovis subsp bovis AF2122/97
gccugcuggccgcg

SEQ ID NO: 1036775 - RNA, 19 nt, Mycobacterium bovis subsp bovis AF2122/97
gccuggccggugcgcaggu

SEQ ID NO: 1036776 - RNA, 17 nt, Mycobacterium bovis subsp bovis AF2122/97
gccuggcccgucggcgu

SEQ ID NO: 1036777 - RNA, 15 nt, Mycobacterium bovis subsp bovis AF2122/97
gccuggccgggaccg

SEQ ID NO: 1036778 - RNA, 15 nt, Mycobacterium bovis subsp bovis AF2122/97
gccuggcccgucggc

SEQ ID NO: 1036779 - RNA, 16 nt, Mycobacterium bovis subsp bovis AF2122/97
gccuggcccgucggcg

SEQ ID NO: 1036780 - RNA, 22 nt, Mycobacterium bovis subsp bovis AF2122/97
gccugucaggcggcggacccgc

SEQ ID NO: 1036781 - RNA, 16 nt, Mycobacterium bovis subsp bovis AF2122/97
gccugucccgccggcc

SEQ ID NO: 1036782 - RNA, 20 nt, Mycobacterium bovis subsp bovis AF2122/97
gccugucccgccggccccgc

SEQ ID NO: 1036783 - RNA, 13 nt, Mycobacterium bovis subsp bovis AF2122/97
gccuguccacguc

SEQ ID NO: 1036784 - RNA, 16 nt, Mycobacterium bovis subsp bovis AF2122/97
gccuggccugcccagc

SEQ ID NO: 1036785 - RNA, 20 nt, Mycobacterium bovis subsp bovis AF2122/97
gccugguguacacacccgcc

SEQ ID NO: 1036786 - RNA, 18 nt, Mycobacterium bovis subsp bovis AF2122/97
gccuucuucgcggcgguc

SEQ ID NO: 1036787 - RNA, 20 nt, Mycobacterium bovis subsp bovis AF2122/97
gccuuccaggcgggcggcac

SEQ ID NO: 1036788 - RNA, 21 nt, Mycobacterium bovis subsp bovis AF2122/97
gccuugaagcgguggacgagc

SEQ ID NO: 1036789 - RNA, 18 nt, Mycobacterium bovis subsp bovis AF2122/97
gccuucuuugccggcgcc

SEQ ID NO: 1036790 - RNA, 20 nt, Mycobacterium bovis subsp bovis AF2122/97
gccuucuucgcggcggucgu

SEQ ID NO: 1036791 - RNA, 15 nt, Mycobacterium bovis subsp bovis AF2122/97
gccuugaucggcgag

SEQ ID NO: 1036792 - RNA, 20 nt, Mycobacterium bovis subsp bovis AF2122/97
gccugugcgcggugacgagc

SEQ ID NO: 1036793 - RNA, 14 nt, Mycobacterium bovis subsp bovis AF2122/97
gccugugccgccgg

SEQ ID NO: 1036794 - RNA, 15 nt, Mycobacterium bovis subsp bovis AF2122/97
gccugugccgccggc

SEQ ID NO: 1036795 - RNA, 16 nt, Mycobacterium bovis subsp bovis AF2122/97
gccugugccgccggcg

SEQ ID NO: 1036796 - RNA, 22 nt, Mycobacterium bovis subsp bovis AF2122/97
gccugugccaccgcuggaucga

SEQ ID NO: 1036797 - RNA, 14 nt, Mycobacterium bovis subsp bovis AF2122/97
gccuuauuggacgu

SEQ ID NO: 1036798 - RNA, 20 nt, Mycobacterium bovis subsp bovis AF2122/97
gccuucaaggaagccgcggc

SEQ ID NO: 1036799 - RNA, 14 nt, Mycobacterium bovis subsp bovis AF2122/97
gccuucacgcuggc

SEQ ID NO: 1036800 - RNA, 12 nt, Mycobacterium bovis subsp bovis AF2122/97
gcgaacgccgug

SEQ ID NO: 1036801 - RNA, 20 nt, Mycobacterium bovis subsp bovis AF2122/97
gcgaacgccugcugguaccg

SEQ ID NO: 1036802 - RNA, 20 nt, Mycobacterium bovis subsp bovis AF2122/97
gcgaacgcgaaugucgcgcu

SEQ ID NO: 1036803 - RNA, 18 nt, Mycobacterium bovis subsp bovis AF2122/97
gcgaacgaauccgcucga

SEQ ID NO: 1036804 - RNA, 16 nt, Mycobacterium bovis subsp bovis AF2122/97
gcgaacgaucccgccg

SEQ ID NO: 1036805 - RNA, 18 nt, Mycobacterium bovis subsp bovis AF2122/97
gcgaaccgucucggcgac

SEQ ID NO: 1036806 - RNA, 22 nt, Mycobacterium bovis subsp bovis AF2122/97
gcgaaccgucucggcgaccgac

SEQ ID NO: 1036807 - RNA, 21 nt, Mycobacterium bovis subsp bovis AF2122/97
gcgaaccugcucggcgcgccg

SEQ ID NO: 1036808 - RNA, 13 nt, Mycobacterium bovis subsp bovis AF2122/97
gcgaacccgccga

SEQ ID NO: 1036809 - RNA, 14 nt, Mycobacterium bovis subsp bovis AF2122/97
gcgaacccgccgau

SEQ ID NO: 1036810 - RNA, 12 nt, Mycobacterium bovis subsp bovis AF2122/97
gcgaacccgcag

SEQ ID NO: 1036811 - RNA, 18 nt, Mycobacterium bovis subsp bovis AF2122/97
gcgaaccgaagccgucga

SEQ ID NO: 1036812 - RNA, 15 nt, Mycobacterium bovis subsp bovis AF2122/97
gcgaacccccgccgc

SEQ ID NO: 1036813 - RNA, 16 nt, Mycobacterium bovis subsp bovis AF2122/97
gcgaacccuccgcagc

SEQ ID NO: 1036814 - RNA, 13 nt, Mycobacterium bovis subsp bovis AF2122/97
gcgaaccggccgu

SEQ ID NO: 1036815 - RNA, 19 nt, Mycobacterium bovis subsp bovis AF2122/97
gcgaaccggccgucgacgc

SEQ ID NO: 1036816 - RNA, 19 nt, Mycobacterium bovis subsp bovis AF2122/97
gcgaaccggcugggcgcca

SEQ ID NO: 1036817 - RNA, 13 nt, Mycobacterium bovis subsp bovis AF2122/97
gcgaaccgccggc

SEQ ID NO: 1036818 - RNA, 23 nt, Mycobacterium bovis subsp bovis AF2122/97
gcgaaccgccggcaccgccgccc

SEQ ID NO: 1036819 - RNA, 17 nt, Mycobacterium bovis subsp bovis AF2122/97
gcgaaccaccggcgccg

SEQ ID NO: 1036820 - RNA, 21 nt, Mycobacterium bovis subsp bovis AF2122/97
gcgaaccaccggcgccgccgg

SEQ ID NO: 1036821 - RNA, 23 nt, Mycobacterium bovis subsp bovis AF2122/97
gcgaaccaccggcgccgccggca

SEQ ID NO: 1036822 - RNA, 17 nt, Mycobacterium bovis subsp bovis AF2122/97
gcgaaccacggcagcca

SEQ ID NO: 1036823 - RNA, 17 nt, Mycobacterium bovis subsp bovis AF2122/97
gcgaacccgagccgccg

SEQ ID NO: 1036824 - RNA, 20 nt, Mycobacterium bovis subsp bovis AF2122/97
gcgaacccgagccgccgugg

SEQ ID NO: 1036825 - RNA, 21 nt, Mycobacterium bovis subsp bovis AF2122/97
gcgaacaucgccagcgccggc

SEQ ID NO: 1036826 - RNA, 15 nt, Mycobacterium bovis subsp bovis AF2122/97
gcgaacaucgccagc

SEQ ID NO: 1036827 - RNA, 18 nt, Mycobacterium bovis subsp bovis AF2122/97
gcgaacaucgccagcgcc

SEQ ID NO: 1036828 - RNA, 19 nt, Mycobacterium bovis subsp bovis AF2122/97
gcgaacaucgccagcgccg

SEQ ID NO: 1036829 - RNA, 18 nt, Mycobacterium bovis subsp bovis AF2122/97
gcgaacaucaccgucgcc

SEQ ID NO: 1036830 - RNA, 16 nt, Mycobacterium bovis subsp bovis AF2122/97
gcgaacagggcugcga

SEQ ID NO: 1036831 - RNA, 21 nt, Mycobacterium bovis subsp bovis AF2122/97
gcgaacugcgaucggccgccg

SEQ ID NO: 1036832 - RNA, 22 nt, Mycobacterium bovis subsp bovis AF2122/97
gcgaacugcgaucggccgccga

SEQ ID NO: 1036833 - RNA, 17 nt, Mycobacterium bovis subsp bovis AF2122/97
gcgaagaacgacgccac

SEQ ID NO: 1036834 - RNA, 14 nt, Mycobacterium bovis subsp bovis AF2122/97
gcgaagcaucgcgu

SEQ ID NO: 1036835 - RNA, 14 nt, Mycobacterium bovis subsp bovis AF2122/97
gcgaagccaccagg

SEQ ID NO: 1036836 - RNA, 13 nt, Mycobacterium bovis subsp bovis AF2122/97
gcgaagcaacgga

SEQ ID NO: 1036837 - RNA, 14 nt, Mycobacterium bovis subsp bovis AF2122/97
gcgaagcacaccgu

SEQ ID NO: 1036838 - RNA, 13 nt, Mycobacterium bovis subsp bovis AF2122/97
gcgaagaccagcg

SEQ ID NO: 1036839 - RNA, 19 nt, Mycobacterium bovis subsp bovis AF2122/97
gcgaagaccagcggcggcg

SEQ ID NO: 1036840 - RNA, 16 nt, Mycobacterium bovis subsp bovis AF2122/97
gcgaacgcguccagcg

SEQ ID NO: 1036841 - RNA, 17 nt, Mycobacterium bovis subsp bovis AF2122/97
gcgaacgcguccagcgc

SEQ ID NO: 1036842 - RNA, 19 nt, Mycobacterium bovis subsp bovis AF2122/97
gcgaacgcuucaccucguc

SEQ ID NO: 1036843 - RNA, 22 nt, Mycobacterium bovis subsp bovis AF2122/97
gcgaacgcuucaccucgucgac

SEQ ID NO: 1036844 - RNA, 12 nt, Mycobacterium bovis subsp bovis AF2122/97
gcgaacgcggcc

SEQ ID NO: 1036845 - RNA, 16 nt, Mycobacterium bovis subsp bovis AF2122/97
gcgaacgcggcgucga

SEQ ID NO: 1036846 - RNA, 21 nt, Mycobacterium bovis subsp bovis AF2122/97
gcgaacggcaccagaucuucg

SEQ ID NO: 1036847 - RNA, 20 nt, Mycobacterium bovis subsp bovis AF2122/97
gcgaacggcaccgcgcccac

SEQ ID NO: 1036848 - RNA, 23 nt, Mycobacterium bovis subsp bovis AF2122/97
gcgaacggauucccgcccagcag

SEQ ID NO: 1036849 - RNA, 16 nt, Mycobacterium bovis subsp bovis AF2122/97
gcgaacggcgcaguug

SEQ ID NO: 1036850 - RNA, 22 nt, Mycobacterium bovis subsp bovis AF2122/97
gcgaacugaucguuggcaucgg

SEQ ID NO: 1036851 - RNA, 14 nt, Mycobacterium bovis subsp bovis AF2122/97
gcgaacucgcgcag

SEQ ID NO: 1036852 - RNA, 14 nt, Mycobacterium bovis subsp bovis AF2122/97
gcgaacucggcgau

SEQ ID NO: 1036853 - RNA, 18 nt, Mycobacterium bovis subsp bovis AF2122/97
gcgaacuccagcagcccg

SEQ ID NO: 1036854 - RNA, 19 nt, Mycobacterium bovis subsp bovis AF2122/97
gcgaaaaucgcgcgcgaaa

SEQ ID NO: 1036855 - RNA, 17 nt, Mycobacterium bovis subsp bovis AF2122/97
gcgaaaauucgucgcgu

SEQ ID NO: 1036856 - RNA, 13 nt, Mycobacterium bovis subsp bovis AF2122/97
gcgaaaauucguc

SEQ ID NO: 1036857 - RNA, 22 nt, Mycobacterium bovis subsp bovis AF2122/97
gcgaaaaagguaccgcgugcgc

SEQ ID NO: 1036858 - RNA, 19 nt, Mycobacterium bovis subsp bovis AF2122/97
gccuuugggcuguggccgc

SEQ ID NO: 1036859 - RNA, 22 nt, Mycobacterium bovis subsp bovis AF2122/97
gccuugcgcacaggcgcgaucg

SEQ ID NO: 1036860 - RNA, 19 nt, Mycobacterium bovis subsp bovis AF2122/97
gccuuuccagcaccccgau

SEQ ID NO: 1036861 - RNA, 18 nt, Mycobacterium bovis subsp bovis AF2122/97
gccuugccgggccgcgcg

SEQ ID NO: 1036862 - RNA, 15 nt, Mycobacterium bovis subsp bovis AF2122/97
gccuuugccgccggc

SEQ ID NO: 1036863 - RNA, 13 nt, Mycobacterium bovis subsp bovis AF2122/97
gccuugcccagcg

SEQ ID NO: 1036864 - RNA, 19 nt, Mycobacterium bovis subsp bovis AF2122/97
gccuugccgccggccccgc

SEQ ID NO: 1036865 - RNA, 23 nt, Mycobacterium bovis subsp bovis AF2122/97
gccuugccgccggccccgccagc

SEQ ID NO: 1036866 - RNA, 19 nt, Mycobacterium bovis subsp bovis AF2122/97
gccuugccgccggcgccgc

SEQ ID NO: 1036867 - RNA, 21 nt, Mycobacterium bovis subsp bovis AF2122/97
gccuugauggucuccaccagg

SEQ ID NO: 1036868 - RNA, 12 nt, Mycobacterium bovis subsp bovis AF2122/97
gccuugccaccg

SEQ ID NO: 1036869 - RNA, 15 nt, Mycobacterium bovis subsp bovis AF2122/97
gccuugccaccggua

SEQ ID NO: 1036870 - RNA, 23 nt, Mycobacterium bovis subsp bovis AF2122/97
gcgaacaaguggccagcgccaac

SEQ ID NO: 1036871 - RNA, 15 nt, Mycobacterium bovis subsp bovis AF2122/97
gcgaacaaccgccgc

SEQ ID NO: 1036872 - RNA, 15 nt, Mycobacterium bovis subsp bovis AF2122/97
gcgaaauaacggagc

SEQ ID NO: 1036873 - RNA, 21 nt, Mycobacterium bovis subsp bovis AF2122/97
gcgaaaucgacagcagcgcga

SEQ ID NO: 1036874 - RNA, 16 nt, Mycobacterium bovis subsp bovis AF2122/97
gcgaaaugccggugcc

SEQ ID NO: 1036875 - RNA, 15 nt, Mycobacterium bovis subsp bovis AF2122/97
gcgaaaugccugcgc

SEQ ID NO: 1036876 - RNA, 22 nt, Mycobacterium bovis subsp bovis AF2122/97
gcgaaagugauccagucgaugu

SEQ ID NO: 1036877 - RNA, 19 nt, Mycobacterium bovis subsp bovis AF2122/97
gcgaacagacaugcgcacc

SEQ ID NO: 1036878 - RNA, 17 nt, Mycobacterium bovis subsp bovis AF2122/97
gcgaacacgucggccag

SEQ ID NO: 1036879 - RNA, 16 nt, Mycobacterium bovis subsp bovis AF2122/97
gcgaacaacuuggcca

SEQ ID NO: 1036880 - RNA, 18 nt, Mycobacterium bovis subsp bovis AF2122/97
gcgaacaaguggccagcg

SEQ ID NO: 1036881 - RNA, 16 nt, Mycobacterium bovis subsp bovis AF2122/97
gcgaaacaccggccag

SEQ ID NO: 1036882 - RNA, 14 nt, Mycobacterium bovis subsp bovis AF2122/97
gcgaaacagcacgc

SEQ ID NO: 1036883 - RNA, 20 nt, Mycobacterium bovis subsp bovis AF2122/97
gcgaaacagcacgcccgaag

SEQ ID NO: 1036884 - RNA, 23 nt, Mycobacterium bovis subsp bovis AF2122/97
gcgaaacccugaaaagggcuggu

SEQ ID NO: 1036885 - RNA, 12 nt, Mycobacterium bovis subsp bovis AF2122/97
gcgaaacaucuc

SEQ ID NO: 1036886 - RNA, 19 nt, Mycobacterium bovis subsp bovis AF2122/97
gcgaaacaucucggcgcag

SEQ ID NO: 1036887 - RNA, 23 nt, Mycobacterium bovis subsp bovis AF2122/97
gcgaaacaucucggcgcagccgg

SEQ ID NO: 1036888 - RNA, 19 nt, Mycobacterium bovis subsp bovis AF2122/97
gcgaaaauugcuccaccac

SEQ ID NO: 1036889 - RNA, 19 nt, Mycobacterium bovis subsp bovis AF2122/97
gcgaaaccgccgucccggc

SEQ ID NO: 1036890 - RNA, 14 nt, Mycobacterium bovis subsp bovis AF2122/97
gcgaaagcgccgaa

SEQ ID NO: 1036891 - RNA, 20 nt, Mycobacterium bovis subsp bovis AF2122/97
gcgaaagcgccgaaacagca

SEQ ID NO: 1036892 - RNA, 22 nt, Mycobacterium bovis subsp bovis AF2122/97
gcgaaagcacgugcacggcgag

SEQ ID NO: 1036893 - RNA, 19 nt, Mycobacterium bovis subsp bovis AF2122/97
gcgagcagggcgucgaccg

SEQ ID NO: 1036894 - RNA, 17 nt, Mycobacterium bovis subsp bovis AF2122/97
gcgagcauaccgccgcu

SEQ ID NO: 1036895 - RNA, 18 nt, Mycobacterium bovis subsp bovis AF2122/97
gcgagcauaccgccgcug

SEQ ID NO: 1036896 - RNA, 19 nt, Mycobacterium bovis subsp bovis AF2122/97
gcgagcauaccgccgcugc

SEQ ID NO: 1036897 - RNA, 16 nt, Mycobacterium bovis subsp bovis AF2122/97
gcgagcaucgacgaac

SEQ ID NO: 1036898 - RNA, 14 nt, Mycobacterium bovis subsp bovis AF2122/97
gcgagcagcacagc

SEQ ID NO: 1036899 - RNA, 12 nt, Mycobacterium bovis subsp bovis AF2122/97
gcgagcccgcau

SEQ ID NO: 1036900 - RNA, 19 nt, Mycobacterium bovis subsp bovis AF2122/97
gcgagcccacguggggccg

SEQ ID NO: 1036901 - RNA, 16 nt, Mycobacterium bovis subsp bovis AF2122/97
gcgagcccagcugcgc

SEQ ID NO: 1036902 - RNA, 12 nt, Mycobacterium bovis subsp bovis AF2122/97
gcgagccgcgcc

SEQ ID NO: 1036903 - RNA, 14 nt, Mycobacterium bovis subsp bovis AF2122/97
gcgagcccgcaucg

SEQ ID NO: 1036904 - RNA, 16 nt, Mycobacterium bovis subsp bovis AF2122/97
gcgagccucgcgcgug

SEQ ID NO: 1036905 - RNA, 22 nt, Mycobacterium bovis subsp bovis AF2122/97
gcgagccugauaaagcccggcg

SEQ ID NO: 1036906 - RNA, 20 nt, Mycobacterium bovis subsp bovis AF2122/97
gcgagcagacgcggaaucgc

SEQ ID NO: 1036907 - RNA, 21 nt, Mycobacterium bovis subsp bovis AF2122/97
gcgagcagacgcggaaucgca

SEQ ID NO: 1036908 - RNA, 20 nt, Mycobacterium bovis subsp bovis AF2122/97
gcgagcagacgcuaaagccc

SEQ ID NO: 1036909 - RNA, 19 nt, Mycobacterium bovis subsp bovis AF2122/97
gcgagcagacgugggcgcu

SEQ ID NO: 1036910 - RNA, 22 nt, Mycobacterium bovis subsp bovis AF2122/97
gcgagcagagaacuccgccacc

SEQ ID NO: 1036911 - RNA, 20 nt, Mycobacterium bovis subsp bovis AF2122/97
gcgagcagacacuaaagccc

SEQ ID NO: 1036912 - RNA, 15 nt, Mycobacterium bovis subsp bovis AF2122/97
gcgagcagacgcaaa

SEQ ID NO: 1036913 - RNA, 20 nt, Mycobacterium bovis subsp bovis AF2122/97
gcgagcagacgcagaaucgc

SEQ ID NO: 1036914 - RNA, 21 nt, Mycobacterium bovis subsp bovis AF2122/97
gcgagcagacgcagagucgca

SEQ ID NO: 1036915 - RNA, 20 nt, Mycobacterium bovis subsp bovis AF2122/97
gcgagaaggugcugcgcggg

SEQ ID NO: 1036916 - RNA, 15 nt, Mycobacterium bovis subsp bovis AF2122/97
gcgagcagacgccgc

SEQ ID NO: 1036917 - RNA, 15 nt, Mycobacterium bovis subsp bovis AF2122/97
gcgagcagacgcaga

SEQ ID NO: 1036918 - RNA, 20 nt, Mycobacterium bovis subsp bovis AF2122/97
gcgagcagacgcagaagccc

SEQ ID NO: 1036919 - RNA, 19 nt, Mycobacterium bovis subsp bovis AF2122/97
gcgagcagacgcaaaagcc

SEQ ID NO: 1036920 - RNA, 20 nt, Mycobacterium bovis subsp bovis AF2122/97
gcgagcagacacagaaucgc

SEQ ID NO: 1036921 - RNA, 23 nt, Mycobacterium bovis subsp bovis AF2122/97
gcgagcacgcgggcacugguggc

SEQ ID NO: 1036922 - RNA, 14 nt, Mycobacterium bovis subsp bovis AF2122/97
gcgagaacacccgu

SEQ ID NO: 1036923 - RNA, 14 nt, Mycobacterium bovis subsp bovis AF2122/97
gcgagaagcgucgc

SEQ ID NO: 1036924 - RNA, 16 nt, Mycobacterium bovis subsp bovis AF2122/97
gcgacugcagcggcgc

SEQ ID NO: 1036925 - RNA, 22 nt, Mycobacterium bovis subsp bovis AF2122/97
gcgacugcgaaugcugggcccg

SEQ ID NO: 1036926 - RNA, 19 nt, Mycobacterium bovis subsp bovis AF2122/97
gcgacugcgcaccuggguc

SEQ ID NO: 1036927 - RNA, 15 nt, Mycobacterium bovis subsp bovis AF2122/97
gcgacugcgucggcg

SEQ ID NO: 1036928 - RNA, 13 nt, Mycobacterium bovis subsp bovis AF2122/97
gcgacuggugccu

SEQ ID NO: 1036929 - RNA, 19 nt, Mycobacterium bovis subsp bovis AF2122/97
gcgacuggugccugccgca

SEQ ID NO: 1036930 - RNA, 20 nt, Mycobacterium bovis subsp bovis AF2122/97
gcgacuggugccugccgcac

SEQ ID NO: 1036931 - RNA, 21 nt, Mycobacterium bovis subsp bovis AF2122/97
gcgacuggugccugccgcacg

SEQ ID NO: 1036932 - RNA, 14 nt, Mycobacterium bovis subsp bovis AF2122/97
gcgacugucugguc

SEQ ID NO: 1036933 - RNA, 20 nt, Mycobacterium bovis subsp bovis AF2122/97
gcgacugugaaucucacgac

SEQ ID NO: 1036934 - RNA, 17 nt, Mycobacterium bovis subsp bovis AF2122/97
gcgagaaacacgacagc

SEQ ID NO: 1036935 - RNA, 16 nt, Mycobacterium bovis subsp bovis AF2122/97
gcgacggcccgauccc

SEQ ID NO: 1036936 - RNA, 12 nt, Mycobacterium bovis subsp bovis AF2122/97
gcgacggccuug

SEQ ID NO: 1036937 - RNA, 13 nt, Mycobacterium bovis subsp bovis AF2122/97
gcgacggccgcca

SEQ ID NO: 1036938 - RNA, 15 nt, Mycobacterium bovis subsp bovis AF2122/97
gcgacggccgccagc

SEQ ID NO: 1036939 - RNA, 16 nt, Mycobacterium bovis subsp bovis AF2122/97
gcgacggccuuggcga

SEQ ID NO: 1036940 - RNA, 18 nt, Mycobacterium bovis subsp bovis AF2122/97
gcgacggcgcucggcgag

SEQ ID NO: 1036941 - RNA, 18 nt, Mycobacterium bovis subsp bovis AF2122/97
gcgacggcggagucgcgc

SEQ ID NO: 1036942 - RNA, 11 nt, Mycobacterium bovis subsp bovis AF2122/97
gcgacggcggc

SEQ ID NO: 1036943 - RNA, 19 nt, Mycobacterium bovis subsp bovis AF2122/97
gcgacggcggcacgggcgg

SEQ ID NO: 1036944 - RNA, 20 nt, Mycobacterium bovis subsp bovis AF2122/97
gcgacucugcgucugcucac

SEQ ID NO: 1036945 - RNA, 15 nt, Mycobacterium bovis subsp bovis AF2122/97
gcgacggcgcucggc

SEQ ID NO: 1036946 - RNA, 14 nt, Mycobacterium bovis subsp bovis AF2122/97
gcgacucugugacg

SEQ ID NO: 1036947 - RNA, 18 nt, Mycobacterium bovis subsp bovis AF2122/97
gcgacucugugacgggca

SEQ ID NO: 1036948 - RNA, 20 nt, Mycobacterium bovis subsp bovis AF2122/97
gcgaguuucugcucgaccgu

SEQ ID NO: 1036949 - RNA, 14 nt, Mycobacterium bovis subsp bovis AF2122/97
gcgaguuggccgug

SEQ ID NO: 1036950 - RNA, 14 nt, Mycobacterium bovis subsp bovis AF2122/97
gcgaguucgcgcac

SEQ ID NO: 1036951 - RNA, 17 nt, Mycobacterium bovis subsp bovis AF2122/97
gcgaguuaggccgccag

SEQ ID NO: 1036952 - RNA, 18 nt, Mycobacterium bovis subsp bovis AF2122/97
gcgaguuaggccgccagc

SEQ ID NO: 1036953 - RNA, 21 nt, Mycobacterium bovis subsp bovis AF2122/97
gcgagugucagcagaugggcg

SEQ ID NO: 1036954 - RNA, 13 nt, Mycobacterium bovis subsp bovis AF2122/97
gcgauaacccgca

SEQ ID NO: 1036955 - RNA, 16 nt, Mycobacterium bovis subsp bovis AF2122/97
gcgauaacccgcaucg

SEQ ID NO: 1036956 - RNA, 17 nt, Mycobacterium bovis subsp bovis AF2122/97
gcgauaacccgcaucgg

SEQ ID NO: 1036957 - RNA, 22 nt, Mycobacterium bovis subsp bovis AF2122/97
gcgauaacccgcaucggaaucg

SEQ ID NO: 1036958 - RNA, 13 nt, Mycobacterium bovis subsp bovis AF2122/97
gcgagugcggcac

SEQ ID NO: 1036959 - RNA, 14 nt, Mycobacterium bovis subsp bovis AF2122/97
gcgagugcggcacg

SEQ ID NO: 1036960 - RNA, 19 nt, Mycobacterium bovis subsp bovis AF2122/97
gcgagugcggcacgaucgc

SEQ ID NO: 1036961 - RNA, 12 nt, Mycobacterium bovis subsp bovis AF2122/97
gcgagucgcccg

SEQ ID NO: 1036962 - RNA, 14 nt, Mycobacterium bovis subsp bovis AF2122/97
gcgagucggcgggg

SEQ ID NO: 1036963 - RNA, 17 nt, Mycobacterium bovis subsp bovis AF2122/97
gcgagucgggggccgcg

SEQ ID NO: 1036964 - RNA, 17 nt, Mycobacterium bovis subsp bovis AF2122/97
gcgauaacuccgcggcg

SEQ ID NO: 1036965 - RNA, 19 nt, Mycobacterium bovis subsp bovis AF2122/97
gcgauaacuccgcggcgaa

SEQ ID NO: 1036966 - RNA, 17 nt, Mycobacterium bovis subsp bovis AF2122/97
gcgauaaggaccgcgcc

SEQ ID NO: 1036967 - RNA, 20 nt, Mycobacterium bovis subsp bovis AF2122/97
gcgauaacuccgcggcgaac

SEQ ID NO: 1036968 - RNA, 13 nt, Mycobacterium bovis subsp bovis AF2122/97
gcgauacccaccg

SEQ ID NO: 1036969 - RNA, 21 nt, Mycobacterium bovis subsp bovis AF2122/97
gcgauaggugcucgcgaucug

SEQ ID NO: 1036970 - RNA, 13 nt, Mycobacterium bovis subsp bovis AF2122/97
gcgagcgcaucga

SEQ ID NO: 1036971 - RNA, 22 nt, Mycobacterium bovis subsp bovis AF2122/97
gcgagcgcaucgauggccgcga

SEQ ID NO: 1036972 - RNA, 17 nt, Mycobacterium bovis subsp bovis AF2122/97
gcgagcgccaggucagc

SEQ ID NO: 1036973 - RNA, 14 nt, Mycobacterium bovis subsp bovis AF2122/97
gcgagcgcggccug

SEQ ID NO: 1036974 - RNA, 14 nt, Mycobacterium bovis subsp bovis AF2122/97
gcgagcgccggccg

SEQ ID NO: 1036975 - RNA, 15 nt, Mycobacterium bovis subsp bovis AF2122/97
gcgagcgccggccgc

SEQ ID NO: 1036976 - RNA, 12 nt, Mycobacterium bovis subsp bovis AF2122/97
gcgagcgcgcgu

SEQ ID NO: 1036977 - RNA, 14 nt, Mycobacterium bovis subsp bovis AF2122/97
gcgagccggcgccg

SEQ ID NO: 1036978 - RNA, 19 nt, Mycobacterium bovis subsp bovis AF2122/97
gcgaggaauuccgcuaccg

SEQ ID NO: 1036979 - RNA, 20 nt, Mycobacterium bovis subsp bovis AF2122/97
gcgaggaauuccgcuaccgc

SEQ ID NO: 1036980 - RNA, 21 nt, Mycobacterium bovis subsp bovis AF2122/97
gcgagcuuggccagcagcagc

SEQ ID NO: 1036981 - RNA, 19 nt, Mycobacterium bovis subsp bovis AF2122/97
gcgagcuguaggucagcgc

SEQ ID NO: 1036982 - RNA, 16 nt, Mycobacterium bovis subsp bovis AF2122/97
gcgagcuugauuccgc

SEQ ID NO: 1036983 - RNA, 15 nt, Mycobacterium bovis subsp bovis AF2122/97
gcgagucccggcggu

SEQ ID NO: 1036984 - RNA, 21 nt, Mycobacterium bovis subsp bovis AF2122/97
gcgaguccucgagugccgccg

SEQ ID NO: 1036985 - RNA, 22 nt, Mycobacterium bovis subsp bovis AF2122/97
gcgaguccucgagugccgccgu

SEQ ID NO: 1036986 - RNA, 23 nt, Mycobacterium bovis subsp bovis AF2122/97
gcgaguccucgagugccgccguc

SEQ ID NO: 1036987 - RNA, 16 nt, Mycobacterium bovis subsp bovis AF2122/97
gcgagucagaaaaagc

SEQ ID NO: 1036988 - RNA, 14 nt, Mycobacterium bovis subsp bovis AF2122/97
gcgagucgacgaac

SEQ ID NO: 1036989 - RNA, 14 nt, Mycobacterium bovis subsp bovis AF2122/97
gcgagucgaucucg

SEQ ID NO: 1036990 - RNA, 21 nt, Mycobacterium bovis subsp bovis AF2122/97
gcgaggaggcuuacaugcccu

SEQ ID NO: 1036991 - RNA, 21 nt, Mycobacterium bovis subsp bovis AF2122/97
gcgaguagccgcuaggaucgg

SEQ ID NO: 1036992 - RNA, 14 nt, Mycobacterium bovis subsp bovis AF2122/97
gcgaguacgcaagc

SEQ ID NO: 1036993 - RNA, 23 nt, Mycobacterium bovis subsp bovis AF2122/97
gcgaguacggccugccgcucgcc

SEQ ID NO: 1036994 - RNA, 24 nt, Mycobacterium bovis subsp bovis AF2122/97
gcgaguacggccugccgcucgccg

SEQ ID NO: 1036995 - RNA, 15 nt, Mycobacterium bovis subsp bovis AF2122/97
gcgacgcggccagcg

SEQ ID NO: 1036996 - RNA, 15 nt, Mycobacterium bovis subsp bovis AF2122/97
gcgacgcggcgucgg

SEQ ID NO: 1036997 - RNA, 15 nt, Mycobacterium bovis subsp bovis AF2122/97
gcgacgcgaccgcga

SEQ ID NO: 1036998 - RNA, 22 nt, Mycobacterium bovis subsp bovis AF2122/97
gcgacgccggccuuggcgaucu

SEQ ID NO: 1036999 - RNA, 16 nt, Mycobacterium bovis subsp bovis AF2122/97
gcgacgcgaccgcgau

SEQ ID NO: 1037000 - RNA, 13 nt, Mycobacterium bovis subsp bovis AF2122/97
gcgacgcggccag

SEQ ID NO: 1037001 - RNA, 12 nt, Mycobacterium bovis subsp bovis AF2122/97
gcgacgccgucu

SEQ ID NO: 1037002 - RNA, 13 nt, Mycobacterium bovis subsp bovis AF2122/97
gcgacgccggauu

SEQ ID NO: 1037003 - RNA, 19 nt, Mycobacterium bovis subsp bovis AF2122/97
gcgacgccggccuuggcga

SEQ ID NO: 1037004 - RNA, 16 nt, Mycobacterium bovis subsp bovis AF2122/97
gcgacgccgaaaaugc

SEQ ID NO: 1037005 - RNA, 22 nt, Mycobacterium bovis subsp bovis AF2122/97
gcgacgccgaaaaugccgccca

SEQ ID NO: 1037006 - RNA, 23 nt, Mycobacterium bovis subsp bovis AF2122/97
gcgacgaugucgacucguggcgc

SEQ ID NO: 1037007 - RNA, 19 nt, Mycobacterium bovis subsp bovis AF2122/97
gcgacgaucucggcggccg

SEQ ID NO: 1037008 - RNA, 21 nt, Mycobacterium bovis subsp bovis AF2122/97
gcgacgaugaucucgcccacc

SEQ ID NO: 1037009 - RNA, 22 nt, Mycobacterium bovis subsp bovis AF2122/97
gcgacgaugccgggucgcggga

SEQ ID NO: 1037010 - RNA, 17 nt, Mycobacterium bovis subsp bovis AF2122/97
gcgacgcagaccgucca

SEQ ID NO: 1037011 - RNA, 18 nt, Mycobacterium bovis subsp bovis AF2122/97
gcgacgcauaaccggcgc

SEQ ID NO: 1037012 - RNA, 21 nt, Mycobacterium bovis subsp bovis AF2122/97
gcgacgaguugcgaaccauga

SEQ ID NO: 1037013 - RNA, 22 nt, Mycobacterium bovis subsp bovis AF2122/97
gcgacgaguugcgaaccaugac

SEQ ID NO: 1037014 - RNA, 19 nt, Mycobacterium bovis subsp bovis AF2122/97
gcgacgagcccaccgucgc

SEQ ID NO: 1037015 - RNA, 23 nt, Mycobacterium bovis subsp bovis AF2122/97
gcgacgagcccaccgucgcauac

SEQ ID NO: 1037016 - RNA, 15 nt, Mycobacterium bovis subsp bovis AF2122/97
gcgacgagaucugcg

SEQ ID NO: 1037017 - RNA, 17 nt, Mycobacterium bovis subsp bovis AF2122/97
gcgacgagaucugcgau

SEQ ID NO: 1037018 - RNA, 17 nt, Mycobacterium bovis subsp bovis AF2122/97
gcgacgagcaacgccac

SEQ ID NO: 1037019 - RNA, 18 nt, Mycobacterium bovis subsp bovis AF2122/97
gcgacgagcaacgccacc

SEQ ID NO: 1037020 - RNA, 14 nt, Mycobacterium bovis subsp bovis AF2122/97
gcgacgagcagcaa

SEQ ID NO: 1037021 - RNA, 14 nt, Mycobacterium bovis subsp bovis AF2122/97
gcgacgagaucagc

SEQ ID NO: 1037022 - RNA, 13 nt, Mycobacterium bovis subsp bovis AF2122/97
gcgacgacggcgc

SEQ ID NO: 1037023 - RNA, 19 nt, Mycobacterium bovis subsp bovis AF2122/97
gcgacgacggcgccgucgu

SEQ ID NO: 1037024 - RNA, 24 nt, Mycobacterium bovis subsp bovis AF2122/97
gcgacgacuucagcaugguggacg

SEQ ID NO: 1037025 - RNA, 14 nt, Mycobacterium bovis subsp bovis AF2122/97
gcgacgacgagguc

SEQ ID NO: 1037026 - RNA, 17 nt, Mycobacterium bovis subsp bovis AF2122/97
gcgacgacccgggucgg

SEQ ID NO: 1037027 - RNA, 20 nt, Mycobacterium bovis subsp bovis AF2122/97
gcgacgacaucugcccagcg

SEQ ID NO: 1037028 - RNA, 13 nt, Mycobacterium bovis subsp bovis AF2122/97
gcgacgacauugg

SEQ ID NO: 1037029 - RNA, 16 nt, Mycobacterium bovis subsp bovis AF2122/97
gcgaccuugacccgca

SEQ ID NO: 1037030 - RNA, 22 nt, Mycobacterium bovis subsp bovis AF2122/97
gcgacgacacgccugggcgacg

SEQ ID NO: 1037031 - RNA, 17 nt, Mycobacterium bovis subsp bovis AF2122/97
gcgaccgccggaccgcc

SEQ ID NO: 1037032 - RNA, 21 nt, Mycobacterium bovis subsp bovis AF2122/97
gcgaccgcauugagcuggcgc

SEQ ID NO: 1037033 - RNA, 14 nt, Mycobacterium bovis subsp bovis AF2122/97
gcgaccgcagcugg

SEQ ID NO: 1037034 - RNA, 15 nt, Mycobacterium bovis subsp bovis AF2122/97
gcgaccgaccagccg

SEQ ID NO: 1037035 - RNA, 20 nt, Mycobacterium bovis subsp bovis AF2122/97
gcgacccgucgaacgcgcgc

SEQ ID NO: 1037036 - RNA, 15 nt, Mycobacterium bovis subsp bovis AF2122/97
gcgaccgagacggcg

SEQ ID NO: 1037037 - RNA, 14 nt, Mycobacterium bovis subsp bovis AF2122/97
gcgaagccggccgg

SEQ ID NO: 1037038 - RNA, 13 nt, Mycobacterium bovis subsp bovis AF2122/97
gcgaagcccgaga

SEQ ID NO: 1037039 - RNA, 11 nt, Mycobacterium bovis subsp bovis AF2122/97
gcgaagccggg

SEQ ID NO: 1037040 - RNA, 17 nt, Mycobacterium bovis subsp bovis AF2122/97
gcgaagccgggugcugg

SEQ ID NO: 1037041 - RNA, 22 nt, Mycobacterium bovis subsp bovis AF2122/97
gcgaagcccgacaugaggcugc

SEQ ID NO: 1037042 - RNA, 14 nt, Mycobacterium bovis subsp bovis AF2122/97
gcgaagcgcucggc

SEQ ID NO: 1037043 - RNA, 20 nt, Mycobacterium bovis subsp bovis AF2122/97
gcgaagcgcucggcagccgg

SEQ ID NO: 1037044 - RNA, 18 nt, Mycobacterium bovis subsp bovis AF2122/97
gcgaagcggaccgagccg

SEQ ID NO: 1037045 - RNA, 21 nt, Mycobacterium bovis subsp bovis AF2122/97
gcgacaagccgagcccgucga

SEQ ID NO: 1037046 - RNA, 17 nt, Mycobacterium bovis subsp bovis AF2122/97
gcgacacaacggguguc

SEQ ID NO: 1037047 - RNA, 15 nt, Mycobacterium bovis subsp bovis AF2122/97
gcgacacacgccgcc

SEQ ID NO: 1037048 - RNA, 17 nt, Mycobacterium bovis subsp bovis AF2122/97
gcgacacacgccgccgg

SEQ ID NO: 1037049 - RNA, 18 nt, Mycobacterium bovis subsp bovis AF2122/97
gcgacacacgccgccggu

SEQ ID NO: 1037050 - RNA, 17 nt, Mycobacterium bovis subsp bovis AF2122/97
gcgacaccgcaggugcc

SEQ ID NO: 1037051 - RNA, 19 nt, Mycobacterium bovis subsp bovis AF2122/97
gcgacaccgcaggugccgu

SEQ ID NO: 1037052 - RNA, 21 nt, Mycobacterium bovis subsp bovis AF2122/97
gcgacagccguggcgcgacgu

SEQ ID NO: 1037053 - RNA, 18 nt, Mycobacterium bovis subsp bovis AF2122/97
gcgacagcgcggcgcgac

SEQ ID NO: 1037054 - RNA, 15 nt, Mycobacterium bovis subsp bovis AF2122/97
gcgacagcgcggcgg

SEQ ID NO: 1037055 - RNA, 14 nt, Mycobacterium bovis subsp bovis AF2122/97
gcgacagcggcgac

SEQ ID NO: 1037056 - RNA, 16 nt, Mycobacterium bovis subsp bovis AF2122/97
gcgacaggacgucggc

SEQ ID NO: 1037057 - RNA, 22 nt, Mycobacterium bovis subsp bovis AF2122/97
gcgacaggagacgguacgccag

SEQ ID NO: 1037058 - RNA, 23 nt, Mycobacterium bovis subsp bovis AF2122/97
gcgacaggagacgguacgccagu

SEQ ID NO: 1037059 - RNA, 22 nt, Mycobacterium bovis subsp bovis AF2122/97
gcgaccccgcuuuuucccggcg

SEQ ID NO: 1037060 - RNA, 15 nt, Mycobacterium bovis subsp bovis AF2122/97
gcgaccccgccgagc

SEQ ID NO: 1037061 - RNA, 17 nt, Mycobacterium bovis subsp bovis AF2122/97
gcgacccccagcgcccg

SEQ ID NO: 1037062 - RNA, 13 nt, Mycobacterium bovis subsp bovis AF2122/97
gcgaccacgauga

SEQ ID NO: 1037063 - RNA, 17 nt, Mycobacterium bovis subsp bovis AF2122/97
gcgacccgggccgcggc

SEQ ID NO: 1037064 - RNA, 19 nt, Mycobacterium bovis subsp bovis AF2122/97
gcgacccgggccgcggcgg

SEQ ID NO: 1037065 - RNA, 16 nt, Mycobacterium bovis subsp bovis AF2122/97
gcgacccgggcguccc

SEQ ID NO: 1037066 - RNA, 13 nt, Mycobacterium bovis subsp bovis AF2122/97
gcgaccccggccc

SEQ ID NO: 1037067 - RNA, 21 nt, Mycobacterium bovis subsp bovis AF2122/97
gcgacccgcagaccgccaccg

SEQ ID NO: 1037068 - RNA, 15 nt, Mycobacterium bovis subsp bovis AF2122/97
gcgacccggcccagc

SEQ ID NO: 1037069 - RNA, 21 nt, Mycobacterium bovis subsp bovis AF2122/97
gcgaccgaaaauucaggcgcc

SEQ ID NO: 1037070 - RNA, 23 nt, Mycobacterium bovis subsp bovis AF2122/97
gcgaccgaaaauucaggcgccgu

SEQ ID NO: 1037071 - RNA, 22 nt, Mycobacterium bovis subsp bovis AF2122/97
gcgacccggucacucuggcgag

SEQ ID NO: 1037072 - RNA, 17 nt, Mycobacterium bovis subsp bovis AF2122/97
gcgacccgguccacgcc

SEQ ID NO: 1037073 - RNA, 16 nt, Mycobacterium bovis subsp bovis AF2122/97
gcgaccaccaccgccg

SEQ ID NO: 1037074 - RNA, 13 nt, Mycobacterium bovis subsp bovis AF2122/97
gcgaccaccguca

SEQ ID NO: 1037075 - RNA, 14 nt, Mycobacterium bovis subsp bovis AF2122/97
gcgaccaccgcggc

SEQ ID NO: 1037076 - RNA, 19 nt, Mycobacterium bovis subsp bovis AF2122/97
gcgaccaccgcggcugcuc

SEQ ID NO: 1037077 - RNA, 19 nt, Mycobacterium bovis subsp bovis AF2122/97
gcgaccacccccggcaggc

SEQ ID NO: 1037078 - RNA, 17 nt, Mycobacterium bovis subsp bovis AF2122/97
gcgaccaccagcgccga

SEQ ID NO: 1037079 - RNA, 14 nt, Mycobacterium bovis subsp bovis AF2122/97
gcgaccaccgccga

SEQ ID NO: 1037080 - RNA, 16 nt, Mycobacterium bovis subsp bovis AF2122/97
gcgaccaagagacguu

SEQ ID NO: 1037081 - RNA, 15 nt, Mycobacterium bovis subsp bovis AF2122/97
gcgaccaaggccgac

SEQ ID NO: 1037082 - RNA, 18 nt, Mycobacterium bovis subsp bovis AF2122/97
gcgaccaauaggucccca

SEQ ID NO: 1037083 - RNA, 13 nt, Mycobacterium bovis subsp bovis AF2122/97
gcgaccaccagcg

SEQ ID NO: 1037084 - RNA, 14 nt, Mycobacterium bovis subsp bovis AF2122/97
ggcgcggccggccg

SEQ ID NO: 1037085 - RNA, 16 nt, Mycobacterium bovis subsp bovis AF2122/97
ggcgcggccggccgcu

SEQ ID NO: 1037086 - RNA, 13 nt, Mycobacterium bovis subsp bovis AF2122/97
ggcgcgggccggc

SEQ ID NO: 1037087 - RNA, 14 nt, Mycobacterium bovis subsp bovis AF2122/97
ggcgcgggccggcg

SEQ ID NO: 1037088 - RNA, 15 nt, Mycobacterium bovis subsp bovis AF2122/97
ggcgcgggccggcga

SEQ ID NO: 1037089 - RNA, 16 nt, Mycobacterium bovis subsp bovis AF2122/97
ggcgcgggccggcgac

SEQ ID NO: 1037090 - RNA, 15 nt, Mycobacterium bovis subsp bovis AF2122/97
ggcgcgggcgccggg

SEQ ID NO: 1037091 - RNA, 15 nt, Mycobacterium bovis subsp bovis AF2122/97
ggcgcgggcgacguc

SEQ ID NO: 1037092 - RNA, 17 nt, Mycobacterium bovis subsp bovis AF2122/97
ggcgcgggccaccacgc

SEQ ID NO: 1037093 - RNA, 16 nt, Mycobacterium bovis subsp bovis AF2122/97
ggcgcgggucggcgac

SEQ ID NO: 1037094 - RNA, 14 nt, Mycobacterium bovis subsp bovis AF2122/97
ggcgcggggcggcc

SEQ ID NO: 1037095 - RNA, 15 nt, Mycobacterium bovis subsp bovis AF2122/97
ggcgcggggccgccg

SEQ ID NO: 1037096 - RNA, 16 nt, Mycobacterium bovis subsp bovis AF2122/97
ggcgcggggccgccgc

SEQ ID NO: 1037097 - RNA, 13 nt, Mycobacterium bovis subsp bovis AF2122/97
ggcgcgggugacc

SEQ ID NO: 1037098 - RNA, 19 nt, Mycobacterium bovis subsp bovis AF2122/97
ggcgcgggugaccaggcgg

SEQ ID NO: 1037099 - RNA, 13 nt, Mycobacterium bovis subsp bovis AF2122/97
ggcgcggucaccg

SEQ ID NO: 1037100 - RNA, 15 nt, Mycobacterium bovis subsp bovis AF2122/97
ggcgcggugccggcg

SEQ ID NO: 1037101 - RNA, 14 nt, Mycobacterium bovis subsp bovis AF2122/97
ggcgcggugcgcgc

SEQ ID NO: 1037102 - RNA, 20 nt, Mycobacterium bovis subsp bovis AF2122/97
ggcgcgguuucggcgucacc

SEQ ID NO: 1037103 - RNA, 22 nt, Mycobacterium bovis subsp bovis AF2122/97
ggcgcgucauggcgaguacggc

SEQ ID NO: 1037104 - RNA, 22 nt, Mycobacterium bovis subsp bovis AF2122/97
ggcgcguagugccacgaggacc

SEQ ID NO: 1037105 - RNA, 21 nt, Mycobacterium bovis subsp bovis AF2122/97
ggcgcgucgcggaaguagcgc

SEQ ID NO: 1037106 - RNA, 13 nt, Mycobacterium bovis subsp bovis AF2122/97
ggcgcgcggcgcc

SEQ ID NO: 1037107 - RNA, 15 nt, Mycobacterium bovis subsp bovis AF2122/97
ggcgcgcggcgccgc

SEQ ID NO: 1037108 - RNA, 15 nt, Mycobacterium bovis subsp bovis AF2122/97
ggcgcggagugccca

SEQ ID NO: 1037109 - RNA, 22 nt, Mycobacterium bovis subsp bovis AF2122/97
ggcgcggagugcccagggccga

SEQ ID NO: 1037110 - RNA, 18 nt, Mycobacterium bovis subsp bovis AF2122/97
ggcgcggcacccggucgg

SEQ ID NO: 1037111 - RNA, 16 nt, Mycobacterium bovis subsp bovis AF2122/97
ggcgcggcaggccugg

SEQ ID NO: 1037112 - RNA, 17 nt, Mycobacterium bovis subsp bovis AF2122/97
ggcgcgacguagacgac

SEQ ID NO: 1037113 - RNA, 15 nt, Mycobacterium bovis subsp bovis AF2122/97
ggcgcgcgcgccggc

SEQ ID NO: 1037114 - RNA, 17 nt, Mycobacterium bovis subsp bovis AF2122/97
ggcgcgcgcgccggcug

SEQ ID NO: 1037115 - RNA, 15 nt, Mycobacterium bovis subsp bovis AF2122/97
ggcgcgacgcccgaa

SEQ ID NO: 1037116 - RNA, 13 nt, Mycobacterium bovis subsp bovis AF2122/97
ggcgcgacggcau

SEQ ID NO: 1037117 - RNA, 22 nt, Mycobacterium bovis subsp bovis AF2122/97
ggcgcgagccggcucagacgac

SEQ ID NO: 1037118 - RNA, 20 nt, Mycobacterium bovis subsp bovis AF2122/97
ggcgcgaagucuugaccgca

SEQ ID NO: 1037119 - RNA, 16 nt, Mycobacterium bovis subsp bovis AF2122/97
ggcgccuuggucgccg

SEQ ID NO: 1037120 - RNA, 17 nt, Mycobacterium bovis subsp bovis AF2122/97
ggcgccuuggucgccgc

SEQ ID NO: 1037121 - RNA, 15 nt, Mycobacterium bovis subsp bovis AF2122/97
ggcgcgaccccaggc

SEQ ID NO: 1037122 - RNA, 12 nt, Mycobacterium bovis subsp bovis AF2122/97
ggcgcgaccgcg

SEQ ID NO: 1037123 - RNA, 12 nt, Mycobacterium bovis subsp bovis AF2122/97
ggcgcgaccggu

SEQ ID NO: 1037124 - RNA, 19 nt, Mycobacterium bovis subsp bovis AF2122/97
ggcgcgaccggucugaucg

SEQ ID NO: 1037125 - RNA, 21 nt, Mycobacterium bovis subsp bovis AF2122/97
ggcgcuggccgucgaagacga

SEQ ID NO: 1037126 - RNA, 20 nt, Mycobacterium bovis subsp bovis AF2122/97
ggcgcuucugcuacccgagc

SEQ ID NO: 1037127 - RNA, 21 nt, Mycobacterium bovis subsp bovis AF2122/97
ggcgcuucugcuacccgagcc

SEQ ID NO: 1037128 - RNA, 22 nt, Mycobacterium bovis subsp bovis AF2122/97
ggcgcuugcaccaggggcgcgu

SEQ ID NO: 1037129 - RNA, 16 nt, Mycobacterium bovis subsp bovis AF2122/97
ggcggacccggugacc

SEQ ID NO: 1037130 - RNA, 15 nt, Mycobacterium bovis subsp bovis AF2122/97
ggcggacccucgccg

SEQ ID NO: 1037131 - RNA, 16 nt, Mycobacterium bovis subsp bovis AF2122/97
ggcggacccucgccga

SEQ ID NO: 1037132 - RNA, 19 nt, Mycobacterium bovis subsp bovis AF2122/97
ggcggacaggcccgguggc

SEQ ID NO: 1037133 - RNA, 18 nt, Mycobacterium bovis subsp bovis AF2122/97
ggcggacagggcggcaac

SEQ ID NO: 1037134 - RNA, 21 nt, Mycobacterium bovis subsp bovis AF2122/97
ggcgcuuggccggauccucga

SEQ ID NO: 1037135 - RNA, 22 nt, Mycobacterium bovis subsp bovis AF2122/97
ggcggaccaggccgcgcgcacc

SEQ ID NO: 1037136 - RNA, 20 nt, Mycobacterium bovis subsp bovis AF2122/97
ggcggagucgcgcagggcga

SEQ ID NO: 1037137 - RNA, 16 nt, Mycobacterium bovis subsp bovis AF2122/97
ggcggauagucgcggg

SEQ ID NO: 1037138 - RNA, 18 nt, Mycobacterium bovis subsp bovis AF2122/97
ggcggauaaccggcaugc

SEQ ID NO: 1037139 - RNA, 13 nt, Mycobacterium bovis subsp bovis AF2122/97
ggcggaucccgag

SEQ ID NO: 1037140 - RNA, 23 nt, Mycobacterium bovis subsp bovis AF2122/97
ggcggauacaugguccggccgcg

SEQ ID NO: 1037141 - RNA, 17 nt, Mycobacterium bovis subsp bovis AF2122/97
ggcggauaugaugaucg

SEQ ID NO: 1037142 - RNA, 20 nt, Mycobacterium bovis subsp bovis AF2122/97
ggcggauaugaugaucgguu

SEQ ID NO: 1037143 - RNA, 13 nt, Mycobacterium bovis subsp bovis AF2122/97
ggcggacucacga

SEQ ID NO: 1037144 - RNA, 13 nt, Mycobacterium bovis subsp bovis AF2122/97
ggcggacgcccgg

SEQ ID NO: 1037145 - RNA, 12 nt, Mycobacterium bovis subsp bovis AF2122/97
ggcggacgcccg

SEQ ID NO: 1037146 - RNA, 16 nt, Mycobacterium bovis subsp bovis AF2122/97
ggcggagccgaugacc

SEQ ID NO: 1037147 - RNA, 22 nt, Mycobacterium bovis subsp bovis AF2122/97
ggcggagcgggccagcacccgc

SEQ ID NO: 1037148 - RNA, 13 nt, Mycobacterium bovis subsp bovis AF2122/97
ggcgcgucgacaa

SEQ ID NO: 1037149 - RNA, 19 nt, Mycobacterium bovis subsp bovis AF2122/97
ggcgcguggaaaccggugg

SEQ ID NO: 1037150 - RNA, 21 nt, Mycobacterium bovis subsp bovis AF2122/97
ggcgcucaaugcggucaacga

SEQ ID NO: 1037151 - RNA, 22 nt, Mycobacterium bovis subsp bovis AF2122/97
ggcgcucaaugcggucaacgac

SEQ ID NO: 1037152 - RNA, 15 nt, Mycobacterium bovis subsp bovis AF2122/97
ggcgcucagcgcggc

SEQ ID NO: 1037153 - RNA, 14 nt, Mycobacterium bovis subsp bovis AF2122/97
ggcgcucagcgcgg

SEQ ID NO: 1037154 - RNA, 13 nt, Mycobacterium bovis subsp bovis AF2122/97
ggcgcucagcgcg

SEQ ID NO: 1037155 - RNA, 22 nt, Mycobacterium bovis subsp bovis AF2122/97
ggcgcucaugggcgccaucccg

SEQ ID NO: 1037156 - RNA, 13 nt, Mycobacterium bovis subsp bovis AF2122/97
ggcgcuccggcgu

SEQ ID NO: 1037157 - RNA, 21 nt, Mycobacterium bovis subsp bovis AF2122/97
ggcgcuccuucagggcgucga

SEQ ID NO: 1037158 - RNA, 14 nt, Mycobacterium bovis subsp bovis AF2122/97
ggcgcugcuggcag

SEQ ID NO: 1037159 - RNA, 13 nt, Mycobacterium bovis subsp bovis AF2122/97
ggcgcuggagacg

SEQ ID NO: 1037160 - RNA, 22 nt, Mycobacterium bovis subsp bovis AF2122/97
ggcgcuggaccgggucgggcac

SEQ ID NO: 1037161 - RNA, 19 nt, Mycobacterium bovis subsp bovis AF2122/97
ggcggcgagcgcgaugcag

SEQ ID NO: 1037162 - RNA, 21 nt, Mycobacterium bovis subsp bovis AF2122/97
ggcggcgagcggccuccagca

SEQ ID NO: 1037163 - RNA, 15 nt, Mycobacterium bovis subsp bovis AF2122/97
ggcggcgagcagcag

SEQ ID NO: 1037164 - RNA, 20 nt, Mycobacterium bovis subsp bovis AF2122/97
ggcggcgauacccaucgauc

SEQ ID NO: 1037165 - RNA, 19 nt, Mycobacterium bovis subsp bovis AF2122/97
ggcggcgaucaacucgggc

SEQ ID NO: 1037166 - RNA, 22 nt, Mycobacterium bovis subsp bovis AF2122/97
ggcggcgaucaacucgggcagc

SEQ ID NO: 1037167 - RNA, 17 nt, Mycobacterium bovis subsp bovis AF2122/97
ggcggcgauccggucgg

SEQ ID NO: 1037168 - RNA, 19 nt, Mycobacterium bovis subsp bovis AF2122/97
ggcggcgaugguaucgccg

SEQ ID NO: 1037169 - RNA, 20 nt, Mycobacterium bovis subsp bovis AF2122/97
ggcggccgggucggugacga

SEQ ID NO: 1037170 - RNA, 19 nt, Mycobacterium bovis subsp bovis AF2122/97
ggcggccgucaccggucgg

SEQ ID NO: 1037171 - RNA, 22 nt, Mycobacterium bovis subsp bovis AF2122/97
ggcggccucccgggccgccgcg

SEQ ID NO: 1037172 - RNA, 16 nt, Mycobacterium bovis subsp bovis AF2122/97
ggcggccucgccggcg

SEQ ID NO: 1037173 - RNA, 17 nt, Mycobacterium bovis subsp bovis AF2122/97
ggcggccucgccggcgc

SEQ ID NO: 1037174 - RNA, 22 nt, Mycobacterium bovis subsp bovis AF2122/97
ggcggccucgccggcgcgcagc

SEQ ID NO: 1037175 - RNA, 12 nt, Mycobacterium bovis subsp bovis AF2122/97
ggcggccgucgu

SEQ ID NO: 1037176 - RNA, 15 nt, Mycobacterium bovis subsp bovis AF2122/97
ggcggccgucgucgg

SEQ ID NO: 1037177 - RNA, 18 nt, Mycobacterium bovis subsp bovis AF2122/97
ggcggccgucgucggcca

SEQ ID NO: 1037178 - RNA, 16 nt, Mycobacterium bovis subsp bovis AF2122/97
ggcggccgugucgggc

SEQ ID NO: 1037179 - RNA, 20 nt, Mycobacterium bovis subsp bovis AF2122/97
ggcggccgugucgggcgcga

SEQ ID NO: 1037180 - RNA, 15 nt, Mycobacterium bovis subsp bovis AF2122/97
ggcggccucgcugcu

SEQ ID NO: 1037181 - RNA, 13 nt, Mycobacterium bovis subsp bovis AF2122/97
ggcggccugcccg

SEQ ID NO: 1037182 - RNA, 20 nt, Mycobacterium bovis subsp bovis AF2122/97
ggcggccuccaccacgucgg

SEQ ID NO: 1037183 - RNA, 23 nt, Mycobacterium bovis subsp bovis AF2122/97
ggcggccaguucggcggccgccg

SEQ ID NO: 1037184 - RNA, 20 nt, Mycobacterium bovis subsp bovis AF2122/97
ggcggcccaccggccacucg

SEQ ID NO: 1037185 - RNA, 18 nt, Mycobacterium bovis subsp bovis AF2122/97
ggcggccccaggggcacc

SEQ ID NO: 1037186 - RNA, 16 nt, Mycobacterium bovis subsp bovis AF2122/97
ggcggcccccggcagc

SEQ ID NO: 1037187 - RNA, 20 nt, Mycobacterium bovis subsp bovis AF2122/97
ggcggcccccggcagcgugc

SEQ ID NO: 1037188 - RNA, 13 nt, Mycobacterium bovis subsp bovis AF2122/97
ggcggccccgcgc

SEQ ID NO: 1037189 - RNA, 14 nt, Mycobacterium bovis subsp bovis AF2122/97
ggcggccccgcgcc

SEQ ID NO: 1037190 - RNA, 14 nt, Mycobacterium bovis subsp bovis AF2122/97
ggcggcccgcagcc

SEQ ID NO: 1037191 - RNA, 16 nt, Mycobacterium bovis subsp bovis AF2122/97
ggcggccgcgauggcg

SEQ ID NO: 1037192 - RNA, 13 nt, Mycobacterium bovis subsp bovis AF2122/97
ggcggccgcgacc

SEQ ID NO: 1037193 - RNA, 21 nt, Mycobacterium bovis subsp bovis AF2122/97
ggcggccgcgaccagcgccgc

SEQ ID NO: 1037194 - RNA, 21 nt, Mycobacterium bovis subsp bovis AF2122/97
ggcggccgcggugcccgucgg

SEQ ID NO: 1037195 - RNA, 17 nt, Mycobacterium bovis subsp bovis AF2122/97
ggcggccggcacgggcg

SEQ ID NO: 1037196 - RNA, 12 nt, Mycobacterium bovis subsp bovis AF2122/97
ggcggauggcgu

SEQ ID NO: 1037197 - RNA, 12 nt, Mycobacterium bovis subsp bovis AF2122/97
ggcggaucgccg

SEQ ID NO: 1037198 - RNA, 13 nt, Mycobacterium bovis subsp bovis AF2122/97
ggcggaucgcgag

SEQ ID NO: 1037199 - RNA, 16 nt, Mycobacterium bovis subsp bovis AF2122/97
ggcggcaaccccgagc

SEQ ID NO: 1037200 - RNA, 15 nt, Mycobacterium bovis subsp bovis AF2122/97
ggcggcaaccgccgc

SEQ ID NO: 1037201 - RNA, 18 nt, Mycobacterium bovis subsp bovis AF2122/97
ggcggcaaccgccgccac

SEQ ID NO: 1037202 - RNA, 20 nt, Mycobacterium bovis subsp bovis AF2122/97
ggcggcaaccgccgccacca

SEQ ID NO: 1037203 - RNA, 15 nt, Mycobacterium bovis subsp bovis AF2122/97
ggcggcaacggcgga

SEQ ID NO: 1037204 - RNA, 17 nt, Mycobacterium bovis subsp bovis AF2122/97
ggcggcaacggcggcau

SEQ ID NO: 1037205 - RNA, 22 nt, Mycobacterium bovis subsp bovis AF2122/97
ggcggccagggugcccucggcc

SEQ ID NO: 1037206 - RNA, 16 nt, Mycobacterium bovis subsp bovis AF2122/97
ggcggccaguucggcg

SEQ ID NO: 1037207 - RNA, 13 nt, Mycobacterium bovis subsp bovis AF2122/97
ggcgggugccgag

SEQ ID NO: 1037208 - RNA, 19 nt, Mycobacterium bovis subsp bovis AF2122/97
ggcgggugccgagcuggcg

SEQ ID NO: 1037209 - RNA, 20 nt, Mycobacterium bovis subsp bovis AF2122/97
ggcggguuucgcucgcaccg

SEQ ID NO: 1037210 - RNA, 16 nt, Mycobacterium bovis subsp bovis AF2122/97
ggcgguaccucgucga

SEQ ID NO: 1037211 - RNA, 17 nt, Mycobacterium bovis subsp bovis AF2122/97
ggcggguuuucucgccg

SEQ ID NO: 1037212 - RNA, 18 nt, Mycobacterium bovis subsp bovis AF2122/97
ggcggguuuucucgccgu

SEQ ID NO: 1037213 - RNA, 16 nt, Mycobacterium bovis subsp bovis AF2122/97
ggcgguaaagcucacc

SEQ ID NO: 1037214 - RNA, 17 nt, Mycobacterium bovis subsp bovis AF2122/97
ggcgguaaaugccugcc

SEQ ID NO: 1037215 - RNA, 21 nt, Mycobacterium bovis subsp bovis AF2122/97
ggcgguaaaugccugcccacc

SEQ ID NO: 1037216 - RNA, 19 nt, Mycobacterium bovis subsp bovis AF2122/97
ggcggguaagcgaccgacg

SEQ ID NO: 1037217 - RNA, 14 nt, Mycobacterium bovis subsp bovis AF2122/97
ggcggguccucgcg

SEQ ID NO: 1037218 - RNA, 18 nt, Mycobacterium bovis subsp bovis AF2122/97
ggcggguccucgcggagc

SEQ ID NO: 1037219 - RNA, 18 nt, Mycobacterium bovis subsp bovis AF2122/97
ggcgggguugaucaccga

SEQ ID NO: 1037220 - RNA, 19 nt, Mycobacterium bovis subsp bovis AF2122/97
ggcggguagcucgcugacc

SEQ ID NO: 1037221 - RNA, 22 nt, Mycobacterium bovis subsp bovis AF2122/97
ggcgggguugaucaccgacacc

SEQ ID NO: 1037222 - RNA, 14 nt, Mycobacterium bovis subsp bovis AF2122/97
ggcggucagcggcc

SEQ ID NO: 1037223 - RNA, 20 nt, Mycobacterium bovis subsp bovis AF2122/97
ggcggucagcggcucggcgg

SEQ ID NO: 1037224 - RNA, 16 nt, Mycobacterium bovis subsp bovis AF2122/97
ggcggucagcggcugg

SEQ ID NO: 1037225 - RNA, 15 nt, Mycobacterium bovis subsp bovis AF2122/97
ggcggucaacggucu

SEQ ID NO: 1037226 - RNA, 17 nt, Mycobacterium bovis subsp bovis AF2122/97
ggcgguccaaucgccgg

SEQ ID NO: 1037227 - RNA, 13 nt, Mycobacterium bovis subsp bovis AF2122/97
ggcgguccaccgg

SEQ ID NO: 1037228 - RNA, 15 nt, Mycobacterium bovis subsp bovis AF2122/97
ggcggucaccaccga

SEQ ID NO: 1037229 - RNA, 20 nt, Mycobacterium bovis subsp bovis AF2122/97
ggcggucaccaccgacccgc

SEQ ID NO: 1037230 - RNA, 17 nt, Mycobacterium bovis subsp bovis AF2122/97
ggcggucaccacgcggc

SEQ ID NO: 1037231 - RNA, 21 nt, Mycobacterium bovis subsp bovis AF2122/97
ggcggucaccacgcggcgguc

SEQ ID NO: 1037232 - RNA, 20 nt, Mycobacterium bovis subsp bovis AF2122/97
ggcgguagucggccagcucg

SEQ ID NO: 1037233 - RNA, 22 nt, Mycobacterium bovis subsp bovis AF2122/97
ggcgguaucgaaagccaacucg

SEQ ID NO: 1037234 - RNA, 13 nt, Mycobacterium bovis subsp bovis AF2122/97
ggcgguaucggca

SEQ ID NO: 1037235 - RNA, 17 nt, Mycobacterium bovis subsp bovis AF2122/97
ggcgguaccucgucgag

SEQ ID NO: 1037236 - RNA, 13 nt, Mycobacterium bovis subsp bovis AF2122/97
ggcgguacggguc

SEQ ID NO: 1037237 - RNA, 18 nt, Mycobacterium bovis subsp bovis AF2122/97
ggcgguagccgaccagcg

SEQ ID NO: 1037238 - RNA, 19 nt, Mycobacterium bovis subsp bovis AF2122/97
ggcgguagccgaccagcgc

SEQ ID NO: 1037239 - RNA, 23 nt, Mycobacterium bovis subsp bovis AF2122/97
ggcgggcaguugacccaugccga

SEQ ID NO: 1037240 - RNA, 14 nt, Mycobacterium bovis subsp bovis AF2122/97
ggcgggcccgccgg

SEQ ID NO: 1037241 - RNA, 15 nt, Mycobacterium bovis subsp bovis AF2122/97
ggcgggcccgccggc

SEQ ID NO: 1037242 - RNA, 15 nt, Mycobacterium bovis subsp bovis AF2122/97
ggcgggccucggcga

SEQ ID NO: 1037243 - RNA, 15 nt, Mycobacterium bovis subsp bovis AF2122/97
ggcgggccugcgcga

SEQ ID NO: 1037244 - RNA, 12 nt, Mycobacterium bovis subsp bovis AF2122/97
ggcggggcagaa

SEQ ID NO: 1037245 - RNA, 13 nt, Mycobacterium bovis subsp bovis AF2122/97
ggcggggcgccgg

SEQ ID NO: 1037246 - RNA, 18 nt, Mycobacterium bovis subsp bovis AF2122/97
ggcggggcggacucacga

SEQ ID NO: 1037247 - RNA, 15 nt, Mycobacterium bovis subsp bovis AF2122/97
ggcgggggcggcggc

SEQ ID NO: 1037248 - RNA, 14 nt, Mycobacterium bovis subsp bovis AF2122/97
ggcgggggagccca

SEQ ID NO: 1037249 - RNA, 18 nt, Mycobacterium bovis subsp bovis AF2122/97
ggcggcuggcccgcaugc

SEQ ID NO: 1037250 - RNA, 13 nt, Mycobacterium bovis subsp bovis AF2122/97
ggcggcugcagcc

SEQ ID NO: 1037251 - RNA, 19 nt, Mycobacterium bovis subsp bovis AF2122/97
ggcggcuguggucgcugcu

SEQ ID NO: 1037252 - RNA, 22 nt, Mycobacterium bovis subsp bovis AF2122/97
ggcggcuucaaagaggauccgc

SEQ ID NO: 1037253 - RNA, 14 nt, Mycobacterium bovis subsp bovis AF2122/97
ggcggcuucgacgu

SEQ ID NO: 1037254 - RNA, 14 nt, Mycobacterium bovis subsp bovis AF2122/97
ggcggcgcugcgcg

SEQ ID NO: 1037255 - RNA, 14 nt, Mycobacterium bovis subsp bovis AF2122/97
ggcggcgcucggcc

SEQ ID NO: 1037256 - RNA, 12 nt, Mycobacterium bovis subsp bovis AF2122/97
ggcggcugcacg

SEQ ID NO: 1037257 - RNA, 23 nt, Mycobacterium bovis subsp bovis AF2122/97
ggcggcugaacggcagccgaagc

SEQ ID NO: 1037258 - RNA, 22 nt, Mycobacterium bovis subsp bovis AF2122/97
ggcgccgccuggacgccgccgg

SEQ ID NO: 1037259 - RNA, 23 nt, Mycobacterium bovis subsp bovis AF2122/97
ggcgccgccguuaccgccggcgc

SEQ ID NO: 1037260 - RNA, 23 nt, Mycobacterium bovis subsp bovis AF2122/97
ggcgccgccguucccgccggcgc

SEQ ID NO: 1037261 - RNA, 13 nt, Mycobacterium bovis subsp bovis AF2122/97
ggcgccgccguug

SEQ ID NO: 1037262 - RNA, 16 nt, Mycobacterium bovis subsp bovis AF2122/97
ggcgccgcgccgauuc

SEQ ID NO: 1037263 - RNA, 17 nt, Mycobacterium bovis subsp bovis AF2122/97
ggcgccgcgcucgacga

SEQ ID NO: 1037264 - RNA, 14 nt, Mycobacterium bovis subsp bovis AF2122/97
ggcgccgcgcucga

SEQ ID NO: 1037265 - RNA, 16 nt, Mycobacterium bovis subsp bovis AF2122/97
ggcgccgccguugccg

SEQ ID NO: 1037266 - RNA, 19 nt, Mycobacterium bovis subsp bovis AF2122/97
ggcgccgcgccgauuccac

SEQ ID NO: 1037267 - RNA, 23 nt, Mycobacterium bovis subsp bovis AF2122/97
ggcgccgcuaggugacgccgcca

SEQ ID NO: 1037268 - RNA, 17 nt, Mycobacterium bovis subsp bovis AF2122/97
ggcgccggagccgccca

SEQ ID NO: 1037269 - RNA, 18 nt, Mycobacterium bovis subsp bovis AF2122/97
ggcgccggaacgagcggc

SEQ ID NO: 1037270 - RNA, 22 nt, Mycobacterium bovis subsp bovis AF2122/97
ggcgccggcaucuccaccgucg

SEQ ID NO: 1037271 - RNA, 15 nt, Mycobacterium bovis subsp bovis AF2122/97
ggcgccggccagcca

SEQ ID NO: 1037272 - RNA, 13 nt, Mycobacterium bovis subsp bovis AF2122/97
ggcgccggccagc

SEQ ID NO: 1037273 - RNA, 11 nt, Mycobacterium bovis subsp bovis AF2122/97
ggcgccggccg

SEQ ID NO: 1037274 - RNA, 15 nt, Mycobacterium bovis subsp bovis AF2122/97
ggcgccggccggcgc

SEQ ID NO: 1037275 - RNA, 18 nt, Mycobacterium bovis subsp bovis AF2122/97
ggcgccggcgcgucggca

SEQ ID NO: 1037276 - RNA, 15 nt, Mycobacterium bovis subsp bovis AF2122/97
ggcgccggcgcccgg

SEQ ID NO: 1037277 - RNA, 12 nt, Mycobacterium bovis subsp bovis AF2122/97
ggcgccggcggc

SEQ ID NO: 1037278 - RNA, 16 nt, Mycobacterium bovis subsp bovis AF2122/97
ggcgccggcgcugcug

SEQ ID NO: 1037279 - RNA, 17 nt, Mycobacterium bovis subsp bovis AF2122/97
ggcgccgggucgauggg

SEQ ID NO: 1037280 - RNA, 20 nt, Mycobacterium bovis subsp bovis AF2122/97
ggcgccggggaccacgguga

SEQ ID NO: 1037281 - RNA, 22 nt, Mycobacterium bovis subsp bovis AF2122/97
ggcgccggggauaccggucagc

SEQ ID NO: 1037282 - RNA, 14 nt, Mycobacterium bovis subsp bovis AF2122/97
ggcgccggggccgc

SEQ ID NO: 1037283 - RNA, 16 nt, Mycobacterium bovis subsp bovis AF2122/97
ggcgccggggccgccg

SEQ ID NO: 1037284 - RNA, 18 nt, Mycobacterium bovis subsp bovis AF2122/97
ggcgccggggccgccgau

SEQ ID NO: 1037285 - RNA, 17 nt, Mycobacterium bovis subsp bovis AF2122/97
ggcgccucggaccagac

SEQ ID NO: 1037286 - RNA, 22 nt, Mycobacterium bovis subsp bovis AF2122/97
ggcgccuagcacgaagcuggcg

SEQ ID NO: 1037287 - RNA, 12 nt, Mycobacterium bovis subsp bovis AF2122/97
ggcgccugacuc

SEQ ID NO: 1037288 - RNA, 20 nt, Mycobacterium bovis subsp bovis AF2122/97
ggcgccugacucaucaccga

SEQ ID NO: 1037289 - RNA, 15 nt, Mycobacterium bovis subsp bovis AF2122/97
ggcgccucguugccg

SEQ ID NO: 1037290 - RNA, 17 nt, Mycobacterium bovis subsp bovis AF2122/97
ggcgccgucggccgagu

SEQ ID NO: 1037291 - RNA, 20 nt, Mycobacterium bovis subsp bovis AF2122/97
ggcgccuucaccuggugugc

SEQ ID NO: 1037292 - RNA, 12 nt, Mycobacterium bovis subsp bovis AF2122/97
ggcgccggucgc

SEQ ID NO: 1037293 - RNA, 17 nt, Mycobacterium bovis subsp bovis AF2122/97
ggcgccggugccgccgg

SEQ ID NO: 1037294 - RNA, 13 nt, Mycobacterium bovis subsp bovis AF2122/97
ggcgccggugccg

SEQ ID NO: 1037295 - RNA, 18 nt, Mycobacterium bovis subsp bovis AF2122/97
ggcgccggucgccggcug

SEQ ID NO: 1037296 - RNA, 16 nt, Mycobacterium bovis subsp bovis AF2122/97
ggcgccggugcggcgg

SEQ ID NO: 1037297 - RNA, 20 nt, Mycobacterium bovis subsp bovis AF2122/97
ggcgccggugguaacggcgg

SEQ ID NO: 1037298 - RNA, 23 nt, Mycobacterium bovis subsp bovis AF2122/97
ggcgccggugguaacggcggcca

SEQ ID NO: 1037299 - RNA, 19 nt, Mycobacterium bovis subsp bovis AF2122/97
ggcgccggugguaccggcg

SEQ ID NO: 1037300 - RNA, 20 nt, Mycobacterium bovis subsp bovis AF2122/97
ggcgccggugguaccggcgg

SEQ ID NO: 1037301 - RNA, 16 nt, Mycobacterium bovis subsp bovis AF2122/97
ggcgccgguuacccgg

SEQ ID NO: 1037302 - RNA, 22 nt, Mycobacterium bovis subsp bovis AF2122/97
ggcgccguuaccgccguugccg

SEQ ID NO: 1037303 - RNA, 16 nt, Mycobacterium bovis subsp bovis AF2122/97
ggcgccguugccaccg

SEQ ID NO: 1037304 - RNA, 22 nt, Mycobacterium bovis subsp bovis AF2122/97
ggcgccguugccaccguugccg

SEQ ID NO: 1037305 - RNA, 18 nt, Mycobacterium bovis subsp bovis AF2122/97
ggcgccguugucggcggu

SEQ ID NO: 1037306 - RNA, 13 nt, Mycobacterium bovis subsp bovis AF2122/97
ggcgccguugccg

SEQ ID NO: 1037307 - RNA, 22 nt, Mycobacterium bovis subsp bovis AF2122/97
ggcgccgucgaaauacccgguc

SEQ ID NO: 1037308 - RNA, 17 nt, Mycobacterium bovis subsp bovis AF2122/97
ggcgccgguuucgaggc

SEQ ID NO: 1037309 - RNA, 13 nt, Mycobacterium bovis subsp bovis AF2122/97
ggcgccgucgccg

SEQ ID NO: 1037310 - RNA, 20 nt, Mycobacterium bovis subsp bovis AF2122/97
ggcgccgucggagccggcca

SEQ ID NO: 1037311 - RNA, 15 nt, Mycobacterium bovis subsp bovis AF2122/97
ggcgccgucggccga

SEQ ID NO: 1037312 - RNA, 23 nt, Mycobacterium bovis subsp bovis AF2122/97
ggcgccgucguugugccggucga

SEQ ID NO: 1037313 - RNA, 14 nt, Mycobacterium bovis subsp bovis AF2122/97
ggcgccgucucgau

SEQ ID NO: 1037314 - RNA, 13 nt, Mycobacterium bovis subsp bovis AF2122/97
ggcgccgucucgc

SEQ ID NO: 1037315 - RNA, 17 nt, Mycobacterium bovis subsp bovis AF2122/97
ggcgccgucucgcggug

SEQ ID NO: 1037316 - RNA, 17 nt, Mycobacterium bovis subsp bovis AF2122/97
ggcgccgaaccagcgau

SEQ ID NO: 1037317 - RNA, 15 nt, Mycobacterium bovis subsp bovis AF2122/97
ggcgccgaacaccgg

SEQ ID NO: 1037318 - RNA, 16 nt, Mycobacterium bovis subsp bovis AF2122/97
ggcgccgaacaccggc

SEQ ID NO: 1037319 - RNA, 18 nt, Mycobacterium bovis subsp bovis AF2122/97
ggcgccgaaguagccgac

SEQ ID NO: 1037320 - RNA, 19 nt, Mycobacterium bovis subsp bovis AF2122/97
ggcgccgaaguagccgacc

SEQ ID NO: 1037321 - RNA, 22 nt, Mycobacterium bovis subsp bovis AF2122/97
ggcgccgaaguagccgaccggc

SEQ ID NO: 1037322 - RNA, 14 nt, Mycobacterium bovis subsp bovis AF2122/97
ggcgcccgggccca

SEQ ID NO: 1037323 - RNA, 14 nt, Mycobacterium bovis subsp bovis AF2122/97
ggcgccgacaccgg

SEQ ID NO: 1037324 - RNA, 23 nt, Mycobacterium bovis subsp bovis AF2122/97
ggcgccgacaccggcugaccgac

SEQ ID NO: 1037325 - RNA, 21 nt, Mycobacterium bovis subsp bovis AF2122/97
ggcgccgacgacuccggcaag

SEQ ID NO: 1037326 - RNA, 20 nt, Mycobacterium bovis subsp bovis AF2122/97
ggcgccgacguacaggacgg

SEQ ID NO: 1037327 - RNA, 17 nt, Mycobacterium bovis subsp bovis AF2122/97
ggcgccgauaccggcgg

SEQ ID NO: 1037328 - RNA, 19 nt, Mycobacterium bovis subsp bovis AF2122/97
ggcgccgcccuaaggggca

SEQ ID NO: 1037329 - RNA, 18 nt, Mycobacterium bovis subsp bovis AF2122/97
ggcgccgcccuugccgcc

SEQ ID NO: 1037330 - RNA, 12 nt, Mycobacterium bovis subsp bovis AF2122/97
ggcgccgcccag

SEQ ID NO: 1037331 - RNA, 16 nt, Mycobacterium bovis subsp bovis AF2122/97
ggcgccgccaucaaca

SEQ ID NO: 1037332 - RNA, 12 nt, Mycobacterium bovis subsp bovis AF2122/97
ggcgccgccauu

SEQ ID NO: 1037333 - RNA, 23 nt, Mycobacterium bovis subsp bovis AF2122/97
ggcgccgccacugccggcagcgc

SEQ ID NO: 1037334 - RNA, 21 nt, Mycobacterium bovis subsp bovis AF2122/97
ggcgccgccagcaccaccggc

SEQ ID NO: 1037335 - RNA, 22 nt, Mycobacterium bovis subsp bovis AF2122/97
ggcgccgccagcaccaccggcu

SEQ ID NO: 1037336 - RNA, 17 nt, Mycobacterium bovis subsp bovis AF2122/97
ggcgccgcauaccagua

SEQ ID NO: 1037337 - RNA, 13 nt, Mycobacterium bovis subsp bovis AF2122/97
ggcgccgcagcgc

SEQ ID NO: 1037338 - RNA, 19 nt, Mycobacterium bovis subsp bovis AF2122/97
ggcgccgcagcgcucgcgu

SEQ ID NO: 1037339 - RNA, 19 nt, Mycobacterium bovis subsp bovis AF2122/97
ggcgccgcagaucaccgcc

SEQ ID NO: 1037340 - RNA, 23 nt, Mycobacterium bovis subsp bovis AF2122/97
ggcgccgcaccaagcagcgacca

SEQ ID NO: 1037341 - RNA, 14 nt, Mycobacterium bovis subsp bovis AF2122/97
ggcgccgcacccac

SEQ ID NO: 1037342 - RNA, 20 nt, Mycobacterium bovis subsp bovis AF2122/97
ggcgccgcaaucagacggcg

SEQ ID NO: 1037343 - RNA, 14 nt, Mycobacterium bovis subsp bovis AF2122/97
ggcgccgcaaccgc

SEQ ID NO: 1037344 - RNA, 11 nt, Mycobacterium bovis subsp bovis AF2122/97
ggcgccgcccg

SEQ ID NO: 1037345 - RNA, 15 nt, Mycobacterium bovis subsp bovis AF2122/97
ggcgccgcccgcgcc

SEQ ID NO: 1037346 - RNA, 12 nt, Mycobacterium bovis subsp bovis AF2122/97
ggcgccgccggc

SEQ ID NO: 1037347 - RNA, 14 nt, Mycobacterium bovis subsp bovis AF2122/97
ggcgccgccgaucc

SEQ ID NO: 1037348 - RNA, 19 nt, Mycobacterium bovis subsp bovis AF2122/97
ggcgccgccggugccaccg

SEQ ID NO: 1037349 - RNA, 22 nt, Mycobacterium bovis subsp bovis AF2122/97
ggcgccgccggugccaccgacg

SEQ ID NO: 1037350 - RNA, 20 nt, Mycobacterium bovis subsp bovis AF2122/97
ggcgccgccguccagcgccg

SEQ ID NO: 1037351 - RNA, 16 nt, Mycobacterium bovis subsp bovis AF2122/97
ggcgccgccgucgccg

SEQ ID NO: 1037352 - RNA, 12 nt, Mycobacterium bovis subsp bovis AF2122/97
ggcgccgccggu

SEQ ID NO: 1037353 - RNA, 18 nt, Mycobacterium bovis subsp bovis AF2122/97
ggcgccgccggcacccgc

SEQ ID NO: 1037354 - RNA, 19 nt, Mycobacterium bovis subsp bovis AF2122/97
ggcgccgccggcaccgccg

SEQ ID NO: 1037355 - RNA, 20 nt, Mycobacterium bovis subsp bovis AF2122/97
ggcgcccgcucggccgcagc

SEQ ID NO: 1037356 - RNA, 13 nt, Mycobacterium bovis subsp bovis AF2122/97
ggcgcccgccggc

SEQ ID NO: 1037357 - RNA, 15 nt, Mycobacterium bovis subsp bovis AF2122/97
ggcgcccgccggcaa

SEQ ID NO: 1037358 - RNA, 15 nt, Mycobacterium bovis subsp bovis AF2122/97
ggcgcccggcggauc

SEQ ID NO: 1037359 - RNA, 12 nt, Mycobacterium bovis subsp bovis AF2122/97
ggcgcccgggau

SEQ ID NO: 1037360 - RNA, 15 nt, Mycobacterium bovis subsp bovis AF2122/97
ggcgcccgugccgcc

SEQ ID NO: 1037361 - RNA, 21 nt, Mycobacterium bovis subsp bovis AF2122/97
ggcgcccgugccgcccgcgcc

SEQ ID NO: 1037362 - RNA, 23 nt, Mycobacterium bovis subsp bovis AF2122/97
ggcgcccgugccgcccgcgccgc

SEQ ID NO: 1037363 - RNA, 21 nt, Mycobacterium bovis subsp bovis AF2122/97
ggcgcccucaugucgggcaac

SEQ ID NO: 1037364 - RNA, 20 nt, Mycobacterium bovis subsp bovis AF2122/97
ggcgcccgggucccggcagc

SEQ ID NO: 1037365 - RNA, 18 nt, Mycobacterium bovis subsp bovis AF2122/97
ggcgcccuugccggcgag

SEQ ID NO: 1037366 - RNA, 16 nt, Mycobacterium bovis subsp bovis AF2122/97
ggcgcccuuaagccgg

SEQ ID NO: 1037367 - RNA, 19 nt, Mycobacterium bovis subsp bovis AF2122/97
ggcgcccuuaagccggcgc

SEQ ID NO: 1037368 - RNA, 20 nt, Mycobacterium bovis subsp bovis AF2122/97
ggcgcccgaagccgggcccc

SEQ ID NO: 1037369 - RNA, 21 nt, Mycobacterium bovis subsp bovis AF2122/97
ggcgcccgaagccgggcccca

SEQ ID NO: 1037370 - RNA, 15 nt, Mycobacterium bovis subsp bovis AF2122/97
ggcgcccccgccauu

SEQ ID NO: 1037371 - RNA, 23 nt, Mycobacterium bovis subsp bovis AF2122/97
ggcgcccccgccauugccgccgg

SEQ ID NO: 1037372 - RNA, 20 nt, Mycobacterium bovis subsp bovis AF2122/97
ggcgcccgagauccccaaau

SEQ ID NO: 1037373 - RNA, 17 nt, Mycobacterium bovis subsp bovis AF2122/97
ggcgcccgccaccggag

SEQ ID NO: 1037374 - RNA, 14 nt, Mycobacterium bovis subsp bovis AF2122/97
ggcgcccgccccgc

SEQ ID NO: 1037375 - RNA, 20 nt, Mycobacterium bovis subsp bovis AF2122/97
ggcgcccauagcaccucgau

SEQ ID NO: 1037376 - RNA, 14 nt, Mycobacterium bovis subsp bovis AF2122/97
ggcgcccaggccga

SEQ ID NO: 1037377 - RNA, 15 nt, Mycobacterium bovis subsp bovis AF2122/97
ggcgcccaggccgau

SEQ ID NO: 1037378 - RNA, 18 nt, Mycobacterium bovis subsp bovis AF2122/97
ggcgcccagcucgauacc

SEQ ID NO: 1037379 - RNA, 20 nt, Mycobacterium bovis subsp bovis AF2122/97
ggcgcccaugcugacacgac

SEQ ID NO: 1037380 - RNA, 15 nt, Mycobacterium bovis subsp bovis AF2122/97
ggcgccccaccggcc

SEQ ID NO: 1037381 - RNA, 14 nt, Mycobacterium bovis subsp bovis AF2122/97
ggcgcccagcgccu

SEQ ID NO: 1037382 - RNA, 13 nt, Mycobacterium bovis subsp bovis AF2122/97
ggcgcccagcgac

SEQ ID NO: 1037383 - RNA, 13 nt, Mycobacterium bovis subsp bovis AF2122/97
ggcgccaccaccc

SEQ ID NO: 1037384 - RNA, 16 nt, Mycobacterium bovis subsp bovis AF2122/97
ggcgccaccacccggc

SEQ ID NO: 1037385 - RNA, 20 nt, Mycobacterium bovis subsp bovis AF2122/97
ggcgccaauucagcggcaac

SEQ ID NO: 1037386 - RNA, 22 nt, Mycobacterium bovis subsp bovis AF2122/97
ggcgccaacgcaacggugauca

SEQ ID NO: 1037387 - RNA, 13 nt, Mycobacterium bovis subsp bovis AF2122/97
ggcgccaacgggc

SEQ ID NO: 1037388 - RNA, 17 nt, Mycobacterium bovis subsp bovis AF2122/97
ggcgccacccgcgccgc

SEQ ID NO: 1037389 - RNA, 23 nt, Mycobacterium bovis subsp bovis AF2122/97
ggcgccacggcagcgcccagauc

SEQ ID NO: 1037390 - RNA, 15 nt, Mycobacterium bovis subsp bovis AF2122/97
ggcgccaccgucgcc

SEQ ID NO: 1037391 - RNA, 16 nt, Mycobacterium bovis subsp bovis AF2122/97
ggcgccaccgucgccg

SEQ ID NO: 1037392 - RNA, 19 nt, Mycobacterium bovis subsp bovis AF2122/97
ggcgccaccgccgcugccg

SEQ ID NO: 1037393 - RNA, 14 nt, Mycobacterium bovis subsp bovis AF2122/97
ggcgccaccggcgc

SEQ ID NO: 1037394 - RNA, 17 nt, Mycobacterium bovis subsp bovis AF2122/97
ggcgccaccggcgccgc

SEQ ID NO: 1037395 - RNA, 18 nt, Mycobacterium bovis subsp bovis AF2122/97
ggcgccacugaccgcgau

SEQ ID NO: 1037396 - RNA, 11 nt, Mycobacterium bovis subsp bovis AF2122/97
ggcgccagcag

SEQ ID NO: 1037397 - RNA, 14 nt, Mycobacterium bovis subsp bovis AF2122/97
ggcgccagcagauc

SEQ ID NO: 1037398 - RNA, 13 nt, Mycobacterium bovis subsp bovis AF2122/97
ggcgccagccgac

SEQ ID NO: 1037399 - RNA, 22 nt, Mycobacterium bovis subsp bovis AF2122/97
ggcgccauagccgcgacccgcg

SEQ ID NO: 1037400 - RNA, 19 nt, Mycobacterium bovis subsp bovis AF2122/97
ggcgccaguauggccgcca

SEQ ID NO: 1037401 - RNA, 13 nt, Mycobacterium bovis subsp bovis AF2122/97
ggcgccagcgccg

SEQ ID NO: 1037402 - RNA, 17 nt, Mycobacterium bovis subsp bovis AF2122/97
ggcgccaugaagccggg

SEQ ID NO: 1037403 - RNA, 20 nt, Mycobacterium bovis subsp bovis AF2122/97
ggcgccaugaagccgggcgc

SEQ ID NO: 1037404 - RNA, 19 nt, Mycobacterium bovis subsp bovis AF2122/97
ggcgccauccccgccggcg

SEQ ID NO: 1037405 - RNA, 20 nt, Mycobacterium bovis subsp bovis AF2122/97
ggcgccauccccgccggcgc

SEQ ID NO: 1037406 - RNA, 22 nt, Mycobacterium bovis subsp bovis AF2122/97
ggcgcccacaaauauccugcgg

SEQ ID NO: 1037407 - RNA, 13 nt, Mycobacterium bovis subsp bovis AF2122/97
ggcgcagcucacc

SEQ ID NO: 1037408 - RNA, 19 nt, Mycobacterium bovis subsp bovis AF2122/97
ggcgcagcugggugcgcca

SEQ ID NO: 1037409 - RNA, 15 nt, Mycobacterium bovis subsp bovis AF2122/97
ggcgcagcugguagc

SEQ ID NO: 1037410 - RNA, 16 nt, Mycobacterium bovis subsp bovis AF2122/97
ggcgcaguagccgacc

SEQ ID NO: 1037411 - RNA, 18 nt, Mycobacterium bovis subsp bovis AF2122/97
ggcgcagguucucggugc

SEQ ID NO: 1037412 - RNA, 17 nt, Mycobacterium bovis subsp bovis AF2122/97
ggcgcaggucgcgcagu

SEQ ID NO: 1037413 - RNA, 15 nt, Mycobacterium bovis subsp bovis AF2122/97
ggcgcaguuggcacc

SEQ ID NO: 1037414 - RNA, 19 nt, Mycobacterium bovis subsp bovis AF2122/97
ggcgcaguuggcaccagcc

SEQ ID NO: 1037415 - RNA, 16 nt, Mycobacterium bovis subsp bovis AF2122/97
ggcgcauaccggcguc

SEQ ID NO: 1037416 - RNA, 18 nt, Mycobacterium bovis subsp bovis AF2122/97
ggcgcauaggcggccauc

SEQ ID NO: 1037417 - RNA, 18 nt, Mycobacterium bovis subsp bovis AF2122/97
ggcgcauagggccaccgc

SEQ ID NO: 1037418 - RNA, 15 nt, Mycobacterium bovis subsp bovis AF2122/97
ggcgcauuccggcgc

SEQ ID NO: 1037419 - RNA, 18 nt, Mycobacterium bovis subsp bovis AF2122/97
ggcgcacugguugggcga

SEQ ID NO: 1037420 - RNA, 20 nt, Mycobacterium bovis subsp bovis AF2122/97
ggcgcagcacauccugcagc

SEQ ID NO: 1037421 - RNA, 16 nt, Mycobacterium bovis subsp bovis AF2122/97
ggcgcagcgacgcgau

SEQ ID NO: 1037422 - RNA, 14 nt, Mycobacterium bovis subsp bovis AF2122/97
ggcgcagccugccg

SEQ ID NO: 1037423 - RNA, 21 nt, Mycobacterium bovis subsp bovis AF2122/97
ggcgcagccugccgaugacga

SEQ ID NO: 1037424 - RNA, 13 nt, Mycobacterium bovis subsp bovis AF2122/97
ggcgcagcgacgc

SEQ ID NO: 1037425 - RNA, 13 nt, Mycobacterium bovis subsp bovis AF2122/97
ggcgcaacgagag

SEQ ID NO: 1037426 - RNA, 20 nt, Mycobacterium bovis subsp bovis AF2122/97
ggcgcaacgagagcggcucc

SEQ ID NO: 1037427 - RNA, 22 nt, Mycobacterium bovis subsp bovis AF2122/97
ggcgcaacgccauaccagcguu

SEQ ID NO: 1037428 - RNA, 18 nt, Mycobacterium bovis subsp bovis AF2122/97
ggcgcaacgggacgucac

SEQ ID NO: 1037429 - RNA, 20 nt, Mycobacterium bovis subsp bovis AF2122/97
ggcgcaacgggacgucaccg

SEQ ID NO: 1037430 - RNA, 13 nt, Mycobacterium bovis subsp bovis AF2122/97
ggcgcaagcgccg

SEQ ID NO: 1037431 - RNA, 16 nt, Mycobacterium bovis subsp bovis AF2122/97
ggcgcaagcgccgcgc

SEQ ID NO: 1037432 - RNA, 15 nt, Mycobacterium bovis subsp bovis AF2122/97
ggcgcaagguggcau

SEQ ID NO: 1037433 - RNA, 22 nt, Mycobacterium bovis subsp bovis AF2122/97
ggcgcacgauggugugcagcaa

SEQ ID NO: 1037434 - RNA, 22 nt, Mycobacterium bovis subsp bovis AF2122/97
ggcgcacgaaaccgcagcgcga

SEQ ID NO: 1037435 - RNA, 13 nt, Mycobacterium bovis subsp bovis AF2122/97
ggcgauggcgagc

SEQ ID NO: 1037436 - RNA, 19 nt, Mycobacterium bovis subsp bovis AF2122/97
ggcgauggcgagcuggcgu

SEQ ID NO: 1037437 - RNA, 15 nt, Mycobacterium bovis subsp bovis AF2122/97
ggcgauggcggcauc

SEQ ID NO: 1037438 - RNA, 15 nt, Mycobacterium bovis subsp bovis AF2122/97
ggcgauggucuccuc

SEQ ID NO: 1037439 - RNA, 21 nt, Mycobacterium bovis subsp bovis AF2122/97
ggcgaugggccgguccggggc

SEQ ID NO: 1037440 - RNA, 15 nt, Mycobacterium bovis subsp bovis AF2122/97
ggcgaugcgcaccag

SEQ ID NO: 1037441 - RNA, 23 nt, Mycobacterium bovis subsp bovis AF2122/97
ggcgcaaccaauaggugucgacg

SEQ ID NO: 1037442 - RNA, 23 nt, Mycobacterium bovis subsp bovis AF2122/97
ggcgcaacaaccgguuggcgauc

SEQ ID NO: 1037443 - RNA, 13 nt, Mycobacterium bovis subsp bovis AF2122/97
ggcgaugcugggc

SEQ ID NO: 1037444 - RNA, 22 nt, Mycobacterium bovis subsp bovis AF2122/97
ggcgaugcgggccgccaggcgg

SEQ ID NO: 1037445 - RNA, 15 nt, Mycobacterium bovis subsp bovis AF2122/97
ggcgauggccagcac

SEQ ID NO: 1037446 - RNA, 17 nt, Mycobacterium bovis subsp bovis AF2122/97
ggcgauggccagcacgg

SEQ ID NO: 1037447 - RNA, 17 nt, Mycobacterium bovis subsp bovis AF2122/97
ggcgauggcaccggcgu

SEQ ID NO: 1037448 - RNA, 18 nt, Mycobacterium bovis subsp bovis AF2122/97
ggcgauggcaccguggau

SEQ ID NO: 1037449 - RNA, 18 nt, Mycobacterium bovis subsp bovis AF2122/97
ggcgaauucgaccacucg

SEQ ID NO: 1037450 - RNA, 14 nt, Mycobacterium bovis subsp bovis AF2122/97
ggcgaaugucgcuc

SEQ ID NO: 1037451 - RNA, 23 nt, Mycobacterium bovis subsp bovis AF2122/97
ggcgaaugucuucgccgucacgc

SEQ ID NO: 1037452 - RNA, 17 nt, Mycobacterium bovis subsp bovis AF2122/97
ggcgaauugcaggacgc

SEQ ID NO: 1037453 - RNA, 21 nt, Mycobacterium bovis subsp bovis AF2122/97
gggcccgcguucucggcaccc

SEQ ID NO: 1037454 - RNA, 12 nt, Mycobacterium bovis subsp bovis AF2122/97
gggcccgccggc

SEQ ID NO: 1037455 - RNA, 13 nt, Mycobacterium bovis subsp bovis AF2122/97
gggcccgccggcc

SEQ ID NO: 1037456 - RNA, 20 nt, Mycobacterium bovis subsp bovis AF2122/97
gggcccgccgucaccgccgu

SEQ ID NO: 1037457 - RNA, 22 nt, Mycobacterium bovis subsp bovis AF2122/97
gggcccggcgaacaggcgaccg

SEQ ID NO: 1037458 - RNA, 20 nt, Mycobacterium bovis subsp bovis AF2122/97
gggcccgccgucuuggcccg

SEQ ID NO: 1037459 - RNA, 13 nt, Mycobacterium bovis subsp bovis AF2122/97
gggcccgaugucg

SEQ ID NO: 1037460 - RNA, 23 nt, Mycobacterium bovis subsp bovis AF2122/97
gggccgccgcgauggccccuguc

SEQ ID NO: 1037461 - RNA, 18 nt, Mycobacterium bovis subsp bovis AF2122/97
gggccgaauaccacaccg

SEQ ID NO: 1037462 - RNA, 19 nt, Mycobacterium bovis subsp bovis AF2122/97
gggccgaauaccacaccgu

SEQ ID NO: 1037463 - RNA, 21 nt, Mycobacterium bovis subsp bovis AF2122/97
gggccgaauaccacaccguga

SEQ ID NO: 1037464 - RNA, 12 nt, Mycobacterium bovis subsp bovis AF2122/97
gggccgccgccc

SEQ ID NO: 1037465 - RNA, 17 nt, Mycobacterium bovis subsp bovis AF2122/97
gggccgccgcccugguc

SEQ ID NO: 1037466 - RNA, 12 nt, Mycobacterium bovis subsp bovis AF2122/97
gggccgccgagc

SEQ ID NO: 1037467 - RNA, 13 nt, Mycobacterium bovis subsp bovis AF2122/97
gggccgccgagcg

SEQ ID NO: 1037468 - RNA, 13 nt, Mycobacterium bovis subsp bovis AF2122/97
gggccgccgaugc

SEQ ID NO: 1037469 - RNA, 18 nt, Mycobacterium bovis subsp bovis AF2122/97
gggccgccgaugccaccg

SEQ ID NO: 1037470 - RNA, 11 nt, Mycobacterium bovis subsp bovis AF2122/97
gggccgccgcu

SEQ ID NO: 1037471 - RNA, 14 nt, Mycobacterium bovis subsp bovis AF2122/97
gggccgccucgcgg

SEQ ID NO: 1037472 - RNA, 17 nt, Mycobacterium bovis subsp bovis AF2122/97
gggccgccucgcggaug

SEQ ID NO: 1037473 - RNA, 15 nt, Mycobacterium bovis subsp bovis AF2122/97
gggcaggucgagcgc

SEQ ID NO: 1037474 - RNA, 14 nt, Mycobacterium bovis subsp bovis AF2122/97
gggcagucgagugc

SEQ ID NO: 1037475 - RNA, 18 nt, Mycobacterium bovis subsp bovis AF2122/97
gggcaguuuggcggcagg

SEQ ID NO: 1037476 - RNA, 13 nt, Mycobacterium bovis subsp bovis AF2122/97
gggcauacagcau

SEQ ID NO: 1037477 - RNA, 18 nt, Mycobacterium bovis subsp bovis AF2122/97
gggcagucccggugggcg

SEQ ID NO: 1037478 - RNA, 15 nt, Mycobacterium bovis subsp bovis AF2122/97
gggcaucaccgacgc

SEQ ID NO: 1037479 - RNA, 16 nt, Mycobacterium bovis subsp bovis AF2122/97
gggcaucaccgccgcg

SEQ ID NO: 1037480 - RNA, 23 nt, Mycobacterium bovis subsp bovis AF2122/97
gggcaucaccgccgcggccgccg

SEQ ID NO: 1037481 - RNA, 19 nt, Mycobacterium bovis subsp bovis AF2122/97
gggcccgcaggucggccac

SEQ ID NO: 1037482 - RNA, 15 nt, Mycobacterium bovis subsp bovis AF2122/97
gggcccgccagccca

SEQ ID NO: 1037483 - RNA, 21 nt, Mycobacterium bovis subsp bovis AF2122/97
gggcccgccagcccagcacgc

SEQ ID NO: 1037484 - RNA, 15 nt, Mycobacterium bovis subsp bovis AF2122/97
gggcaucaucgacgc

SEQ ID NO: 1037485 - RNA, 17 nt, Mycobacterium bovis subsp bovis AF2122/97
gggcaucaucgacgcgc

SEQ ID NO: 1037486 - RNA, 20 nt, Mycobacterium bovis subsp bovis AF2122/97
gggcagcugguaggucaccg

SEQ ID NO: 1037487 - RNA, 12 nt, Mycobacterium bovis subsp bovis AF2122/97
gggcaggcccca

SEQ ID NO: 1037488 - RNA, 14 nt, Mycobacterium bovis subsp bovis AF2122/97
gggcaggccgucga

SEQ ID NO: 1037489 - RNA, 13 nt, Mycobacterium bovis subsp bovis AF2122/97
gggcaggcggcca

SEQ ID NO: 1037490 - RNA, 18 nt, Mycobacterium bovis subsp bovis AF2122/97
gggcagcgggccgcccuu

SEQ ID NO: 1037491 - RNA, 15 nt, Mycobacterium bovis subsp bovis AF2122/97
gggcaggaucgaggc

SEQ ID NO: 1037492 - RNA, 22 nt, Mycobacterium bovis subsp bovis AF2122/97
gggcaggaucgaggcgucggca

SEQ ID NO: 1037493 - RNA, 16 nt, Mycobacterium bovis subsp bovis AF2122/97
gggcaggagcagcacg

SEQ ID NO: 1037494 - RNA, 20 nt, Mycobacterium bovis subsp bovis AF2122/97
gggcaggagcagcacgucga

SEQ ID NO: 1037495 - RNA, 16 nt, Mycobacterium bovis subsp bovis AF2122/97
gggccuccugcuggcc

SEQ ID NO: 1037496 - RNA, 19 nt, Mycobacterium bovis subsp bovis AF2122/97
gggccucagcuaccccggc

SEQ ID NO: 1037497 - RNA, 22 nt, Mycobacterium bovis subsp bovis AF2122/97
gggccucagcuaccccggcggu

SEQ ID NO: 1037498 - RNA, 22 nt, Mycobacterium bovis subsp bovis AF2122/97
gggccucgaccgccagccgcga

SEQ ID NO: 1037499 - RNA, 19 nt, Mycobacterium bovis subsp bovis AF2122/97
gggccucgaucagcgccgg

SEQ ID NO: 1037500 - RNA, 16 nt, Mycobacterium bovis subsp bovis AF2122/97
gggccuccacccgcca

SEQ ID NO: 1037501 - RNA, 19 nt, Mycobacterium bovis subsp bovis AF2122/97
gggccuccacccgccacgg

SEQ ID NO: 1037502 - RNA, 22 nt, Mycobacterium bovis subsp bovis AF2122/97
gggccguugugcgguugcgcgg

SEQ ID NO: 1037503 - RNA, 17 nt, Mycobacterium bovis subsp bovis AF2122/97
gggccugcguccgacgc

SEQ ID NO: 1037504 - RNA, 23 nt, Mycobacterium bovis subsp bovis AF2122/97
gggccugcaccacggcggccacc

SEQ ID NO: 1037505 - RNA, 14 nt, Mycobacterium bovis subsp bovis AF2122/97
gggccugcacgccg

SEQ ID NO: 1037506 - RNA, 16 nt, Mycobacterium bovis subsp bovis AF2122/97
gggccugcacgccggc

SEQ ID NO: 1037507 - RNA, 15 nt, Mycobacterium bovis subsp bovis AF2122/97
gggccucggucgcca

SEQ ID NO: 1037508 - RNA, 15 nt, Mycobacterium bovis subsp bovis AF2122/97
gggccugaaccacgc

SEQ ID NO: 1037509 - RNA, 15 nt, Mycobacterium bovis subsp bovis AF2122/97
gggccuggcccacgc

SEQ ID NO: 1037510 - RNA, 16 nt, Mycobacterium bovis subsp bovis AF2122/97
gggccugggccgcaca

SEQ ID NO: 1037511 - RNA, 20 nt, Mycobacterium bovis subsp bovis AF2122/97
gggcgacccguucucgguga

SEQ ID NO: 1037512 - RNA, 12 nt, Mycobacterium bovis subsp bovis AF2122/97
gggccggcaccg

SEQ ID NO: 1037513 - RNA, 16 nt, Mycobacterium bovis subsp bovis AF2122/97
gggccggcaccgcagc

SEQ ID NO: 1037514 - RNA, 17 nt, Mycobacterium bovis subsp bovis AF2122/97
gggccggcaccgcagcg

SEQ ID NO: 1037515 - RNA, 22 nt, Mycobacterium bovis subsp bovis AF2122/97
gggccggaugacgaucugguca

SEQ ID NO: 1037516 - RNA, 13 nt, Mycobacterium bovis subsp bovis AF2122/97
gggccggccggca

SEQ ID NO: 1037517 - RNA, 18 nt, Mycobacterium bovis subsp bovis AF2122/97
gggccggcgagcagacgc

SEQ ID NO: 1037518 - RNA, 12 nt, Mycobacterium bovis subsp bovis AF2122/97
gggccggccacg

SEQ ID NO: 1037519 - RNA, 15 nt, Mycobacterium bovis subsp bovis AF2122/97
gggccggcgccgcac

SEQ ID NO: 1037520 - RNA, 22 nt, Mycobacterium bovis subsp bovis AF2122/97
gggccggcgucgaugacgacgc

SEQ ID NO: 1037521 - RNA, 21 nt, Mycobacterium bovis subsp bovis AF2122/97
gggccggaccaucagcgucga

SEQ ID NO: 1037522 - RNA, 21 nt, Mycobacterium bovis subsp bovis AF2122/97
gggccggaccuuguuggccau

SEQ ID NO: 1037523 - RNA, 13 nt, Mycobacterium bovis subsp bovis AF2122/97
gggccggagccgg

SEQ ID NO: 1037524 - RNA, 15 nt, Mycobacterium bovis subsp bovis AF2122/97
gggccggagccggug

SEQ ID NO: 1037525 - RNA, 18 nt, Mycobacterium bovis subsp bovis AF2122/97
gggccggagccggugccg

SEQ ID NO: 1037526 - RNA, 23 nt, Mycobacterium bovis subsp bovis AF2122/97
gggccggagccggugccgacggc

SEQ ID NO: 1037527 - RNA, 18 nt, Mycobacterium bovis subsp bovis AF2122/97
gggcggcauuggcggugc

SEQ ID NO: 1037528 - RNA, 11 nt, Mycobacterium bovis subsp bovis AF2122/97
gggcggcagcu

SEQ ID NO: 1037529 - RNA, 12 nt, Mycobacterium bovis subsp bovis AF2122/97
gggcggccagca

SEQ ID NO: 1037530 - RNA, 15 nt, Mycobacterium bovis subsp bovis AF2122/97
gggcggccagcacgu

SEQ ID NO: 1037531 - RNA, 13 nt, Mycobacterium bovis subsp bovis AF2122/97
gggcggcagggug

SEQ ID NO: 1037532 - RNA, 22 nt, Mycobacterium bovis subsp bovis AF2122/97
gggcggccauggcacugccggc

SEQ ID NO: 1037533 - RNA, 13 nt, Mycobacterium bovis subsp bovis AF2122/97
gggcggcccaccg

SEQ ID NO: 1037534 - RNA, 15 nt, Mycobacterium bovis subsp bovis AF2122/97
gggcggcccaccggc

SEQ ID NO: 1037535 - RNA, 12 nt, Mycobacterium bovis subsp bovis AF2122/97
gggcggccgacc

SEQ ID NO: 1037536 - RNA, 14 nt, Mycobacterium bovis subsp bovis AF2122/97
gggcggccggcggc

SEQ ID NO: 1037537 - RNA, 16 nt, Mycobacterium bovis subsp bovis AF2122/97
gggcggccggcggcca

SEQ ID NO: 1037538 - RNA, 21 nt, Mycobacterium bovis subsp bovis AF2122/97
gggcggccucccgggccgccg

SEQ ID NO: 1037539 - RNA, 22 nt, Mycobacterium bovis subsp bovis AF2122/97
gggcggcggccugggccagccg

SEQ ID NO: 1037540 - RNA, 14 nt, Mycobacterium bovis subsp bovis AF2122/97
gggcgggccugcgc

SEQ ID NO: 1037541 - RNA, 23 nt, Mycobacterium bovis subsp bovis AF2122/97
gggcgggccugcgcgauccgcgc

SEQ ID NO: 1037542 - RNA, 21 nt, Mycobacterium bovis subsp bovis AF2122/97
gggcgggcaaucaccgccggc

SEQ ID NO: 1037543 - RNA, 13 nt, Mycobacterium bovis subsp bovis AF2122/97
gggcgggcgucga

SEQ ID NO: 1037544 - RNA, 16 nt, Mycobacterium bovis subsp bovis AF2122/97
gggcgguagccgacga

SEQ ID NO: 1037545 - RNA, 15 nt, Mycobacterium bovis subsp bovis AF2122/97
gggcggugaggcagc

SEQ ID NO: 1037546 - RNA, 19 nt, Mycobacterium bovis subsp bovis AF2122/97
gggcggugcacaccgucgc

SEQ ID NO: 1037547 - RNA, 12 nt, Mycobacterium bovis subsp bovis AF2122/97
gggcggcggugg

SEQ ID NO: 1037548 - RNA, 18 nt, Mycobacterium bovis subsp bovis AF2122/97
gggcggcgcuggcgucgu

SEQ ID NO: 1037549 - RNA, 12 nt, Mycobacterium bovis subsp bovis AF2122/97
gggcggcgucgg

SEQ ID NO: 1037550 - RNA, 15 nt, Mycobacterium bovis subsp bovis AF2122/97
gggcggcgucugcgc

SEQ ID NO: 1037551 - RNA, 19 nt, Mycobacterium bovis subsp bovis AF2122/97
gggcgggauggccgccgac

SEQ ID NO: 1037552 - RNA, 17 nt, Mycobacterium bovis subsp bovis AF2122/97
gggcgggaaccccggcc

SEQ ID NO: 1037553 - RNA, 20 nt, Mycobacterium bovis subsp bovis AF2122/97
gggcggcguuguuggccgca

SEQ ID NO: 1037554 - RNA, 12 nt, Mycobacterium bovis subsp bovis AF2122/97
gggcggcuucga

SEQ ID NO: 1037555 - RNA, 14 nt, Mycobacterium bovis subsp bovis AF2122/97
gggcggcucgucga

SEQ ID NO: 1037556 - RNA, 21 nt, Mycobacterium bovis subsp bovis AF2122/97
gggcgcguccucgccgcacgc

SEQ ID NO: 1037557 - RNA, 13 nt, Mycobacterium bovis subsp bovis AF2122/97
gggcggagccgau

SEQ ID NO: 1037558 - RNA, 19 nt, Mycobacterium bovis subsp bovis AF2122/97
gggcggaaagcccgucggg

SEQ ID NO: 1037559 - RNA, 22 nt, Mycobacterium bovis subsp bovis AF2122/97
gggcgcugucacguagcgagcc

SEQ ID NO: 1037560 - RNA, 14 nt, Mycobacterium bovis subsp bovis AF2122/97
gggcggcagcgagg

SEQ ID NO: 1037561 - RNA, 23 nt, Mycobacterium bovis subsp bovis AF2122/97
gggcgcgcuaucaugaccaccga

SEQ ID NO: 1037562 - RNA, 15 nt, Mycobacterium bovis subsp bovis AF2122/97
gggcgauccccagca

SEQ ID NO: 1037563 - RNA, 13 nt, Mycobacterium bovis subsp bovis AF2122/97
gggcgcggcaggc

SEQ ID NO: 1037564 - RNA, 20 nt, Mycobacterium bovis subsp bovis AF2122/97
gggcgaguagucgacgucga

SEQ ID NO: 1037565 - RNA, 18 nt, Mycobacterium bovis subsp bovis AF2122/97
gggcgaucgacaccguga

SEQ ID NO: 1037566 - RNA, 15 nt, Mycobacterium bovis subsp bovis AF2122/97
gggcgaucgccuggg

SEQ ID NO: 1037567 - RNA, 15 nt, Mycobacterium bovis subsp bovis AF2122/97
gggcgaucgcggcga

SEQ ID NO: 1037568 - RNA, 13 nt, Mycobacterium bovis subsp bovis AF2122/97
gggcgaucggcgg

SEQ ID NO: 1037569 - RNA, 16 nt, Mycobacterium bovis subsp bovis AF2122/97
gggcgaucgucagcca

SEQ ID NO: 1037570 - RNA, 15 nt, Mycobacterium bovis subsp bovis AF2122/97
gggcgacgcggcgcc

SEQ ID NO: 1037571 - RNA, 13 nt, Mycobacterium bovis subsp bovis AF2122/97
gggcgacgacgug

SEQ ID NO: 1037572 - RNA, 12 nt, Mycobacterium bovis subsp bovis AF2122/97
gggcgacggcga

SEQ ID NO: 1037573 - RNA, 12 nt, Mycobacterium bovis subsp bovis AF2122/97
gggcgacggcgg

SEQ ID NO: 1037574 - RNA, 15 nt, Mycobacterium bovis subsp bovis AF2122/97
gggcgagcucgucga

SEQ ID NO: 1037575 - RNA, 21 nt, Mycobacterium bovis subsp bovis AF2122/97
gggcgagcaacucguccagca

SEQ ID NO: 1037576 - RNA, 12 nt, Mycobacterium bovis subsp bovis AF2122/97
gggcacggccgu

SEQ ID NO: 1037577 - RNA, 15 nt, Mycobacterium bovis subsp bovis AF2122/97
gggcacggccgucga

SEQ ID NO: 1037578 - RNA, 21 nt, Mycobacterium bovis subsp bovis AF2122/97
gggcacggugaugaggaucgc

SEQ ID NO: 1037579 - RNA, 15 nt, Mycobacterium bovis subsp bovis AF2122/97
gggcacgcgaggcgc

SEQ ID NO: 1037580 - RNA, 17 nt, Mycobacterium bovis subsp bovis AF2122/97
gggcaccgugauggcgu

SEQ ID NO: 1037581 - RNA, 18 nt, Mycobacterium bovis subsp bovis AF2122/97
gggcaccguuaccgccgu

SEQ ID NO: 1037582 - RNA, 21 nt, Mycobacterium bovis subsp bovis AF2122/97
gggcaccguuaccgccgucgc

SEQ ID NO: 1037583 - RNA, 13 nt, Mycobacterium bovis subsp bovis AF2122/97
gggcaccuccaau

SEQ ID NO: 1037584 - RNA, 19 nt, Mycobacterium bovis subsp bovis AF2122/97
gggcaccuggucggccgca

SEQ ID NO: 1037585 - RNA, 20 nt, Mycobacterium bovis subsp bovis AF2122/97
gggcaccuggucggccgcaa

SEQ ID NO: 1037586 - RNA, 12 nt, Mycobacterium bovis subsp bovis AF2122/97
gggcacgaucgu

SEQ ID NO: 1037587 - RNA, 22 nt, Mycobacterium bovis subsp bovis AF2122/97
gggcacgaacaucagaucgccg

SEQ ID NO: 1037588 - RNA, 18 nt, Mycobacterium bovis subsp bovis AF2122/97
gggcaaccagcagcaggu

SEQ ID NO: 1037589 - RNA, 22 nt, Mycobacterium bovis subsp bovis AF2122/97
gggcaaaucaagcacagcccgg

SEQ ID NO: 1037590 - RNA, 16 nt, Mycobacterium bovis subsp bovis AF2122/97
gggcaaagucgguguc

SEQ ID NO: 1037591 - RNA, 22 nt, Mycobacterium bovis subsp bovis AF2122/97
gggcaccgagcugagcggccag

SEQ ID NO: 1037592 - RNA, 12 nt, Mycobacterium bovis subsp bovis AF2122/97
gggcaccgucgg

SEQ ID NO: 1037593 - RNA, 22 nt, Mycobacterium bovis subsp bovis AF2122/97
gggcaccccgcgguagccgacc

SEQ ID NO: 1037594 - RNA, 16 nt, Mycobacterium bovis subsp bovis AF2122/97
gggcagccugcugcau

SEQ ID NO: 1037595 - RNA, 14 nt, Mycobacterium bovis subsp bovis AF2122/97
gggcagccgcccgc

SEQ ID NO: 1037596 - RNA, 18 nt, Mycobacterium bovis subsp bovis AF2122/97
gggcagccgcgccgcggc

SEQ ID NO: 1037597 - RNA, 16 nt, Mycobacterium bovis subsp bovis AF2122/97
gggcagcgacggcagc

SEQ ID NO: 1037598 - RNA, 16 nt, Mycobacterium bovis subsp bovis AF2122/97
gggcagcacgucacgc

SEQ ID NO: 1037599 - RNA, 11 nt, Mycobacterium bovis subsp bovis AF2122/97
gggcagcagcc

SEQ ID NO: 1037600 - RNA, 14 nt, Mycobacterium bovis subsp bovis AF2122/97
gggcagcaucaaca

SEQ ID NO: 1037601 - RNA, 23 nt, Mycobacterium bovis subsp bovis AF2122/97
gggcagcaucaacaccggcuggu

SEQ ID NO: 1037602 - RNA, 16 nt, Mycobacterium bovis subsp bovis AF2122/97
gggcacucagcagggg

SEQ ID NO: 1037603 - RNA, 20 nt, Mycobacterium bovis subsp bovis AF2122/97
gggcacuugcccgucggcgc

SEQ ID NO: 1037604 - RNA, 17 nt, Mycobacterium bovis subsp bovis AF2122/97
gggcacguggcgguaca

SEQ ID NO: 1037605 - RNA, 15 nt, Mycobacterium bovis subsp bovis AF2122/97
gggcacguucggcgc

SEQ ID NO: 1037606 - RNA, 17 nt, Mycobacterium bovis subsp bovis AF2122/97
gggcagcacccgcgcca

SEQ ID NO: 1037607 - RNA, 18 nt, Mycobacterium bovis subsp bovis AF2122/97
gggcagcacccgcgccag

SEQ ID NO: 1037608 - RNA, 18 nt, Mycobacterium bovis subsp bovis AF2122/97
gggcagaccgaucggcag

SEQ ID NO: 1037609 - RNA, 16 nt, Mycobacterium bovis subsp bovis AF2122/97
gggacgauucucgagu

SEQ ID NO: 1037610 - RNA, 21 nt, Mycobacterium bovis subsp bovis AF2122/97
gggacgccgugugcaucggcg

SEQ ID NO: 1037611 - RNA, 12 nt, Mycobacterium bovis subsp bovis AF2122/97
gggacggcgaau

SEQ ID NO: 1037612 - RNA, 14 nt, Mycobacterium bovis subsp bovis AF2122/97
gggacgcgccccag

SEQ ID NO: 1037613 - RNA, 19 nt, Mycobacterium bovis subsp bovis AF2122/97
gggacgucgacuucgcccg

SEQ ID NO: 1037614 - RNA, 15 nt, Mycobacterium bovis subsp bovis AF2122/97
gggacggcggcaagg

SEQ ID NO: 1037615 - RNA, 12 nt, Mycobacterium bovis subsp bovis AF2122/97
gggacucggcga

SEQ ID NO: 1037616 - RNA, 13 nt, Mycobacterium bovis subsp bovis AF2122/97
gggacuggcguga

SEQ ID NO: 1037617 - RNA, 12 nt, Mycobacterium bovis subsp bovis AF2122/97
gggacgugcccg

SEQ ID NO: 1037618 - RNA, 19 nt, Mycobacterium bovis subsp bovis AF2122/97
gggacguuguccaccgcca

SEQ ID NO: 1037619 - RNA, 13 nt, Mycobacterium bovis subsp bovis AF2122/97
gggacgcggccga

SEQ ID NO: 1037620 - RNA, 22 nt, Mycobacterium bovis subsp bovis AF2122/97
gggaucccgacgaagguggcau

SEQ ID NO: 1037621 - RNA, 20 nt, Mycobacterium bovis subsp bovis AF2122/97
gggauccaugcgggugguga

SEQ ID NO: 1037622 - RNA, 18 nt, Mycobacterium bovis subsp bovis AF2122/97
gggaucccacggcgggcg

SEQ ID NO: 1037623 - RNA, 16 nt, Mycobacterium bovis subsp bovis AF2122/97
gggaucagccgugcgg

SEQ ID NO: 1037624 - RNA, 12 nt, Mycobacterium bovis subsp bovis AF2122/97
gggaucaccccg

SEQ ID NO: 1037625 - RNA, 13 nt, Mycobacterium bovis subsp bovis AF2122/97
gggaucaccgauc

SEQ ID NO: 1037626 - RNA, 21 nt, Mycobacterium bovis subsp bovis AF2122/97
gggaucgcccaggcgcgacgu

SEQ ID NO: 1037627 - RNA, 16 nt, Mycobacterium bovis subsp bovis AF2122/97
gggauccgcgcgcugg

SEQ ID NO: 1037628 - RNA, 20 nt, Mycobacterium bovis subsp bovis AF2122/97
gggauccuccggguuggcga

SEQ ID NO: 1037629 - RNA, 16 nt, Mycobacterium bovis subsp bovis AF2122/97
gggaucggcuccgccg

SEQ ID NO: 1037630 - RNA, 17 nt, Mycobacterium bovis subsp bovis AF2122/97
gggaucgcugccagcgg

SEQ ID NO: 1037631 - RNA, 17 nt, Mycobacterium bovis subsp bovis AF2122/97
gggaucgcuggccgcga

SEQ ID NO: 1037632 - RNA, 22 nt, Mycobacterium bovis subsp bovis AF2122/97
gggauugcgggccugcacgccg

SEQ ID NO: 1037633 - RNA, 18 nt, Mycobacterium bovis subsp bovis AF2122/97
gggauucugacgaccggc

SEQ ID NO: 1037634 - RNA, 20 nt, Mycobacterium bovis subsp bovis AF2122/97
gggauugaagcuggccaccg

SEQ ID NO: 1037635 - RNA, 19 nt, Mycobacterium bovis subsp bovis AF2122/97
gggauguccgcggccacca

SEQ ID NO: 1037636 - RNA, 23 nt, Mycobacterium bovis subsp bovis AF2122/97
gggauucgucgugcgggcgggcg

SEQ ID NO: 1037637 - RNA, 13 nt, Mycobacterium bovis subsp bovis AF2122/97
gggauucguuguc

SEQ ID NO: 1037638 - RNA, 16 nt, Mycobacterium bovis subsp bovis AF2122/97
gggauuuccagcagug

SEQ ID NO: 1037639 - RNA, 15 nt, Mycobacterium bovis subsp bovis AF2122/97
ggcuugacugcacac

SEQ ID NO: 1037640 - RNA, 20 nt, Mycobacterium bovis subsp bovis AF2122/97
ggcuugacugcacaccaccg

SEQ ID NO: 1037641 - RNA, 21 nt, Mycobacterium bovis subsp bovis AF2122/97
ggcuugacugcacaccaccgc

SEQ ID NO: 1037642 - RNA, 19 nt, Mycobacterium bovis subsp bovis AF2122/97
ggcuugagguaggucacca

SEQ ID NO: 1037643 - RNA, 18 nt, Mycobacterium bovis subsp bovis AF2122/97
ggcuuggugaaccgcgcg

SEQ ID NO: 1037644 - RNA, 16 nt, Mycobacterium bovis subsp bovis AF2122/97
ggcuuggugcccagcg

SEQ ID NO: 1037645 - RNA, 15 nt, Mycobacterium bovis subsp bovis AF2122/97
ggcuugggcgguagc

SEQ ID NO: 1037646 - RNA, 19 nt, Mycobacterium bovis subsp bovis AF2122/97
ggcuuggggucccgccggg

SEQ ID NO: 1037647 - RNA, 20 nt, Mycobacterium bovis subsp bovis AF2122/97
ggcuuggggucccgccgggu

SEQ ID NO: 1037648 - RNA, 14 nt, Mycobacterium bovis subsp bovis AF2122/97
ggcuugcaacaccc

SEQ ID NO: 1037649 - RNA, 18 nt, Mycobacterium bovis subsp bovis AF2122/97
ggcuugcaacaccccgag

SEQ ID NO: 1037650 - RNA, 15 nt, Mycobacterium bovis subsp bovis AF2122/97
ggcuugcaccugcaa

SEQ ID NO: 1037651 - RNA, 16 nt, Mycobacterium bovis subsp bovis AF2122/97
ggcuucguccaccgcg

SEQ ID NO: 1037652 - RNA, 17 nt, Mycobacterium bovis subsp bovis AF2122/97
ggcuguacccgaccagc

SEQ ID NO: 1037653 - RNA, 20 nt, Mycobacterium bovis subsp bovis AF2122/97
ggcuguacccgaccagcacc

SEQ ID NO: 1037654 - RNA, 20 nt, Mycobacterium bovis subsp bovis AF2122/97
ggcuguacucgcggcgcggc

SEQ ID NO: 1037655 - RNA, 21 nt, Mycobacterium bovis subsp bovis AF2122/97
ggcuucuucuucuugaccgcg

SEQ ID NO: 1037656 - RNA, 23 nt, Mycobacterium bovis subsp bovis AF2122/97
ggcuugacccuugggcaccaccc

SEQ ID NO: 1037657 - RNA, 20 nt, Mycobacterium bovis subsp bovis AF2122/97
ggcuucgucggccagcagca

SEQ ID NO: 1037658 - RNA, 13 nt, Mycobacterium bovis subsp bovis AF2122/97
ggcugggcggucg

SEQ ID NO: 1037659 - RNA, 18 nt, Mycobacterium bovis subsp bovis AF2122/97
ggcugggcgccaccaucg

SEQ ID NO: 1037660 - RNA, 22 nt, Mycobacterium bovis subsp bovis AF2122/97
ggcuggucacccguaucggguu

SEQ ID NO: 1037661 - RNA, 12 nt, Mycobacterium bovis subsp bovis AF2122/97
ggcuggucaccc

SEQ ID NO: 1037662 - RNA, 13 nt, Mycobacterium bovis subsp bovis AF2122/97
ggcugguagucgg

SEQ ID NO: 1037663 - RNA, 17 nt, Mycobacterium bovis subsp bovis AF2122/97
ggcugguaucgagcacc

SEQ ID NO: 1037664 - RNA, 20 nt, Mycobacterium bovis subsp bovis AF2122/97
ggcugguccgggugccggug

SEQ ID NO: 1037665 - RNA, 20 nt, Mycobacterium bovis subsp bovis AF2122/97
ggcuggucaggaucgcaccg

SEQ ID NO: 1037666 - RNA, 12 nt, Mycobacterium bovis subsp bovis AF2122/97
ggcuggucgccg

SEQ ID NO: 1037667 - RNA, 20 nt, Mycobacterium bovis subsp bovis AF2122/97
ggcuggugccuuaccaccgu

SEQ ID NO: 1037668 - RNA, 18 nt, Mycobacterium bovis subsp bovis AF2122/97
ggcuggucuacccgcggc

SEQ ID NO: 1037669 - RNA, 20 nt, Mycobacterium bovis subsp bovis AF2122/97
ggcuggugccaacugcgccg

SEQ ID NO: 1037670 - RNA, 15 nt, Mycobacterium bovis subsp bovis AF2122/97
ggcuggugcuacugg

SEQ ID NO: 1037671 - RNA, 19 nt, Mycobacterium bovis subsp bovis AF2122/97
ggcuguaaaaaugcuucgc

SEQ ID NO: 1037672 - RNA, 15 nt, Mycobacterium bovis subsp bovis AF2122/97
ggcuguaacacccgg

SEQ ID NO: 1037673 - RNA, 21 nt, Mycobacterium bovis subsp bovis AF2122/97
ggcuguaacacccggccgccg

SEQ ID NO: 1037674 - RNA, 18 nt, Mycobacterium bovis subsp bovis AF2122/97
ggcugguucaacaccggu

SEQ ID NO: 1037675 - RNA, 16 nt, Mycobacterium bovis subsp bovis AF2122/97
ggcugguuucggccgc

SEQ ID NO: 1037676 - RNA, 12 nt, Mycobacterium bovis subsp bovis AF2122/97
gggacagcgccg

SEQ ID NO: 1037677 - RNA, 19 nt, Mycobacterium bovis subsp bovis AF2122/97
gggacagauggcggccgag

SEQ ID NO: 1037678 - RNA, 15 nt, Mycobacterium bovis subsp bovis AF2122/97
gggacaacucgcgug

SEQ ID NO: 1037679 - RNA, 15 nt, Mycobacterium bovis subsp bovis AF2122/97
gggacaaucucggcc

SEQ ID NO: 1037680 - RNA, 22 nt, Mycobacterium bovis subsp bovis AF2122/97
gggacacagcguccgucgucgg

SEQ ID NO: 1037681 - RNA, 12 nt, Mycobacterium bovis subsp bovis AF2122/97
gggacaccagcu

SEQ ID NO: 1037682 - RNA, 12 nt, Mycobacterium bovis subsp bovis AF2122/97
gggaaugucgaa

SEQ ID NO: 1037683 - RNA, 18 nt, Mycobacterium bovis subsp bovis AF2122/97
gggaauggcccuugcucg

SEQ ID NO: 1037684 - RNA, 19 nt, Mycobacterium bovis subsp bovis AF2122/97
gggaaucacccacucgccg

SEQ ID NO: 1037685 - RNA, 12 nt, Mycobacterium bovis subsp bovis AF2122/97
gggaagugcggu

SEQ ID NO: 1037686 - RNA, 12 nt, Mycobacterium bovis subsp bovis AF2122/97
gggaaaagcccg

SEQ ID NO: 1037687 - RNA, 14 nt, Mycobacterium bovis subsp bovis AF2122/97
gggaaacaccggcu

SEQ ID NO: 1037688 - RNA, 13 nt, Mycobacterium bovis subsp bovis AF2122/97
ggcuuugcggcgc

SEQ ID NO: 1037689 - RNA, 16 nt, Mycobacterium bovis subsp bovis AF2122/97
ggcuuucgcgugcggc

SEQ ID NO: 1037690 - RNA, 17 nt, Mycobacterium bovis subsp bovis AF2122/97
ggcuuuugcgucugcuc

SEQ ID NO: 1037691 - RNA, 17 nt, Mycobacterium bovis subsp bovis AF2122/97
ggcuuuuacgucugcuc

SEQ ID NO: 1037692 - RNA, 18 nt, Mycobacterium bovis subsp bovis AF2122/97
ggcuuuuacgucugcucg

SEQ ID NO: 1037693 - RNA, 19 nt, Mycobacterium bovis subsp bovis AF2122/97
ggcuugucagccgcgaccg

SEQ ID NO: 1037694 - RNA, 20 nt, Mycobacterium bovis subsp bovis AF2122/97
ggcuugucagccgcgaccgc

SEQ ID NO: 1037695 - RNA, 15 nt, Mycobacterium bovis subsp bovis AF2122/97
ggcuuguccgguggu

SEQ ID NO: 1037696 - RNA, 22 nt, Mycobacterium bovis subsp bovis AF2122/97
ggcuuguccucacaugcccgga

SEQ ID NO: 1037697 - RNA, 21 nt, Mycobacterium bovis subsp bovis AF2122/97
ggcuugucgaccacgaccguc

SEQ ID NO: 1037698 - RNA, 14 nt, Mycobacterium bovis subsp bovis AF2122/97
ggcuugucgccggc

SEQ ID NO: 1037699 - RNA, 15 nt, Mycobacterium bovis subsp bovis AF2122/97
ggcuugucgcggugc

SEQ ID NO: 1037700 - RNA, 18 nt, Mycobacterium bovis subsp bovis AF2122/97
ggcgugaagugagcucgg

SEQ ID NO: 1037701 - RNA, 16 nt, Mycobacterium bovis subsp bovis AF2122/97
ggcgugacagggcggc

SEQ ID NO: 1037702 - RNA, 19 nt, Mycobacterium bovis subsp bovis AF2122/97
ggcgugacagggcggcaac

SEQ ID NO: 1037703 - RNA, 16 nt, Mycobacterium bovis subsp bovis AF2122/97
ggcgugccgaccagca

SEQ ID NO: 1037704 - RNA, 22 nt, Mycobacterium bovis subsp bovis AF2122/97
ggcgugacguagugcaccgccu

SEQ ID NO: 1037705 - RNA, 15 nt, Mycobacterium bovis subsp bovis AF2122/97
ggcgugccgaccagc

SEQ ID NO: 1037706 - RNA, 14 nt, Mycobacterium bovis subsp bovis AF2122/97
ggcgugccgucgcc

SEQ ID NO: 1037707 - RNA, 15 nt, Mycobacterium bovis subsp bovis AF2122/97
ggcgugcggcggccc

SEQ ID NO: 1037708 - RNA, 22 nt, Mycobacterium bovis subsp bovis AF2122/97
ggcgugcggucauauaggagcg

SEQ ID NO: 1037709 - RNA, 20 nt, Mycobacterium bovis subsp bovis AF2122/97
ggcgugcggacugacgucga

SEQ ID NO: 1037710 - RNA, 16 nt, Mycobacterium bovis subsp bovis AF2122/97
ggcgugcugccgaagc

SEQ ID NO: 1037711 - RNA, 22 nt, Mycobacterium bovis subsp bovis AF2122/97
ggcgugcugcuagccagucggc

SEQ ID NO: 1037712 - RNA, 17 nt, Mycobacterium bovis subsp bovis AF2122/97
ggcguucccccggcacc

SEQ ID NO: 1037713 - RNA, 19 nt, Mycobacterium bovis subsp bovis AF2122/97
ggcguucccccggcaccgc

SEQ ID NO: 1037714 - RNA, 21 nt, Mycobacterium bovis subsp bovis AF2122/97
ggcguucccgccauugccgcc

SEQ ID NO: 1037715 - RNA, 18 nt, Mycobacterium bovis subsp bovis AF2122/97
ggcguucgacucgaccgc

SEQ ID NO: 1037716 - RNA, 22 nt, Mycobacterium bovis subsp bovis AF2122/97
ggcguucgacucgaccgcgacg

SEQ ID NO: 1037717 - RNA, 14 nt, Mycobacterium bovis subsp bovis AF2122/97
ggcguucgaugcca

SEQ ID NO: 1037718 - RNA, 17 nt, Mycobacterium bovis subsp bovis AF2122/97
ggcguuccgggccgauc

SEQ ID NO: 1037719 - RNA, 18 nt, Mycobacterium bovis subsp bovis AF2122/97
ggcguucccccacucgga

SEQ ID NO: 1037720 - RNA, 16 nt, Mycobacterium bovis subsp bovis AF2122/97
ggcguucgccggggcg

SEQ ID NO: 1037721 - RNA, 20 nt, Mycobacterium bovis subsp bovis AF2122/97
ggcguugguagccagggcga

SEQ ID NO: 1037722 - RNA, 17 nt, Mycobacterium bovis subsp bovis AF2122/97
ggcguugguggucugcc

SEQ ID NO: 1037723 - RNA, 23 nt, Mycobacterium bovis subsp bovis AF2122/97
ggcuagcgccgaucuucgcgcgc

SEQ ID NO: 1037724 - RNA, 17 nt, Mycobacterium bovis subsp bovis AF2122/97
ggcuacggcugcccguu

SEQ ID NO: 1037725 - RNA, 19 nt, Mycobacterium bovis subsp bovis AF2122/97
ggcuacuaggcccagcacg

SEQ ID NO: 1037726 - RNA, 23 nt, Mycobacterium bovis subsp bovis AF2122/97
ggcuaccuuguccggcccguagc

SEQ ID NO: 1037727 - RNA, 14 nt, Mycobacterium bovis subsp bovis AF2122/97
ggcuacgacggcgc

SEQ ID NO: 1037728 - RNA, 13 nt, Mycobacterium bovis subsp bovis AF2122/97
ggcuacgggccgc

SEQ ID NO: 1037729 - RNA, 15 nt, Mycobacterium bovis subsp bovis AF2122/97
ggcuacgggccgcgg

SEQ ID NO: 1037730 - RNA, 17 nt, Mycobacterium bovis subsp bovis AF2122/97
ggcuacgggccgcggua

SEQ ID NO: 1037731 - RNA, 14 nt, Mycobacterium bovis subsp bovis AF2122/97
ggcuacgggccgcu

SEQ ID NO: 1037732 - RNA, 19 nt, Mycobacterium bovis subsp bovis AF2122/97
ggcguuguugaccagcacg

SEQ ID NO: 1037733 - RNA, 22 nt, Mycobacterium bovis subsp bovis AF2122/97
ggcguugguagccagggcgauc

SEQ ID NO: 1037734 - RNA, 15 nt, Mycobacterium bovis subsp bovis AF2122/97
ggcguugucgacgaa

SEQ ID NO: 1037735 - RNA, 17 nt, Mycobacterium bovis subsp bovis AF2122/97
ggcguuguugcggaucg

SEQ ID NO: 1037736 - RNA, 20 nt, Mycobacterium bovis subsp bovis AF2122/97
ggcguuucccggguccugga

SEQ ID NO: 1037737 - RNA, 21 nt, Mycobacterium bovis subsp bovis AF2122/97
ggcguuucccugccgcugugg

SEQ ID NO: 1037738 - RNA, 15 nt, Mycobacterium bovis subsp bovis AF2122/97
ggcguuugccggccg

SEQ ID NO: 1037739 - RNA, 18 nt, Mycobacterium bovis subsp bovis AF2122/97
ggcguuugccggccgauu

SEQ ID NO: 1037740 - RNA, 22 nt, Mycobacterium bovis subsp bovis AF2122/97
ggcguuuucaauuucacugcga

SEQ ID NO: 1037741 - RNA, 20 nt, Mycobacterium bovis subsp bovis AF2122/97
ggcguuuuccgggcuguucg

SEQ ID NO: 1037742 - RNA, 21 nt, Mycobacterium bovis subsp bovis AF2122/97
ggcguuuuccgggcuguucgc

SEQ ID NO: 1037743 - RNA, 16 nt, Mycobacterium bovis subsp bovis AF2122/97
ggcguuuucggugagc

SEQ ID NO: 1037744 - RNA, 18 nt, Mycobacterium bovis subsp bovis AF2122/97
ggcuaggccaagccgcgg

SEQ ID NO: 1037745 - RNA, 23 nt, Mycobacterium bovis subsp bovis AF2122/97
ggcuagcagagacaugccggcga

SEQ ID NO: 1037746 - RNA, 15 nt, Mycobacterium bovis subsp bovis AF2122/97
ggcuagucggggugg

SEQ ID NO: 1037747 - RNA, 18 nt, Mycobacterium bovis subsp bovis AF2122/97
ggcuaucguggcggcguc

SEQ ID NO: 1037748 - RNA, 14 nt, Mycobacterium bovis subsp bovis AF2122/97
ggcuaugcuggcgc

SEQ ID NO: 1037749 - RNA, 16 nt, Mycobacterium bovis subsp bovis AF2122/97
ggcuauggcgccgcgg

SEQ ID NO: 1037750 - RNA, 15 nt, Mycobacterium bovis subsp bovis AF2122/97
ggcuauggguucgcg

SEQ ID NO: 1037751 - RNA, 16 nt, Mycobacterium bovis subsp bovis AF2122/97
ggcuauuggccugaug

SEQ ID NO: 1037752 - RNA, 21 nt, Mycobacterium bovis subsp bovis AF2122/97
ggcucacaugugcgcgucgcg

SEQ ID NO: 1037753 - RNA, 13 nt, Mycobacterium bovis subsp bovis AF2122/97
ggcucaccacggu

SEQ ID NO: 1037754 - RNA, 12 nt, Mycobacterium bovis subsp bovis AF2122/97
ggcucaccagcu

SEQ ID NO: 1037755 - RNA, 16 nt, Mycobacterium bovis subsp bovis AF2122/97
ggcucaccaggcgagc

SEQ ID NO: 1037756 - RNA, 19 nt, Mycobacterium bovis subsp bovis AF2122/97
ggcucacccaggcgccgau

SEQ ID NO: 1037757 - RNA, 23 nt, Mycobacterium bovis subsp bovis AF2122/97
ggcucacccaggcgccgaugucg

SEQ ID NO: 1037758 - RNA, 20 nt, Mycobacterium bovis subsp bovis AF2122/97
ggcucacagcacagcgcagc

SEQ ID NO: 1037759 - RNA, 14 nt, Mycobacterium bovis subsp bovis AF2122/97
ggcucacagcacag

SEQ ID NO: 1037760 - RNA, 18 nt, Mycobacterium bovis subsp bovis AF2122/97
ggcucacagcacagcgca

SEQ ID NO: 1037761 - RNA, 19 nt, Mycobacterium bovis subsp bovis AF2122/97
ggcucacagcacagcgcag

SEQ ID NO: 1037762 - RNA, 18 nt, Mycobacterium bovis subsp bovis AF2122/97
ggcucaaucgaugagcgc

SEQ ID NO: 1037763 - RNA, 22 nt, Mycobacterium bovis subsp bovis AF2122/97
ggcucacacauagcgauucgcg

SEQ ID NO: 1037764 - RNA, 23 nt, Mycobacterium bovis subsp bovis AF2122/97
ggcggugaaaucgcacagcgcga

SEQ ID NO: 1037765 - RNA, 13 nt, Mycobacterium bovis subsp bovis AF2122/97
ggcggucuugccg

SEQ ID NO: 1037766 - RNA, 18 nt, Mycobacterium bovis subsp bovis AF2122/97
ggcggucuugccgcaggc

SEQ ID NO: 1037767 - RNA, 15 nt, Mycobacterium bovis subsp bovis AF2122/97
ggcggugaagugggc

SEQ ID NO: 1037768 - RNA, 15 nt, Mycobacterium bovis subsp bovis AF2122/97
ggcggugaacaccgc

SEQ ID NO: 1037769 - RNA, 23 nt, Mycobacterium bovis subsp bovis AF2122/97
ggcggugaacuucuccaccagcg

SEQ ID NO: 1037770 - RNA, 13 nt, Mycobacterium bovis subsp bovis AF2122/97
ggcggugacgaag

SEQ ID NO: 1037771 - RNA, 22 nt, Mycobacterium bovis subsp bovis AF2122/97
ggcgucgccgccauugccgccg

SEQ ID NO: 1037772 - RNA, 18 nt, Mycobacterium bovis subsp bovis AF2122/97
ggcggugcacaccgucgc

SEQ ID NO: 1037773 - RNA, 18 nt, Mycobacterium bovis subsp bovis AF2122/97
ggcgucgccgccguugcc

SEQ ID NO: 1037774 - RNA, 14 nt, Mycobacterium bovis subsp bovis AF2122/97
ggcgucgccgccgg

SEQ ID NO: 1037775 - RNA, 13 nt, Mycobacterium bovis subsp bovis AF2122/97
ggcgucgccgccg

SEQ ID NO: 1037776 - RNA, 14 nt, Mycobacterium bovis subsp bovis AF2122/97
ggcgucgccggccc

SEQ ID NO: 1037777 - RNA, 17 nt, Mycobacterium bovis subsp bovis AF2122/97
ggcgucgccggccccgc

SEQ ID NO: 1037778 - RNA, 23 nt, Mycobacterium bovis subsp bovis AF2122/97
ggcgucgccggccccgccggcgc

SEQ ID NO: 1037779 - RNA, 14 nt, Mycobacterium bovis subsp bovis AF2122/97
ggcgucgccggcac

SEQ ID NO: 1037780 - RNA, 21 nt, Mycobacterium bovis subsp bovis AF2122/97
ggcgucgccgccguugccgcc

SEQ ID NO: 1037781 - RNA, 23 nt, Mycobacterium bovis subsp bovis AF2122/97
ggcgucgcgguuguggcugaucc

SEQ ID NO: 1037782 - RNA, 14 nt, Mycobacterium bovis subsp bovis AF2122/97
ggcgucgcuggugg

SEQ ID NO: 1037783 - RNA, 13 nt, Mycobacterium bovis subsp bovis AF2122/97
ggcggucgagcga

SEQ ID NO: 1037784 - RNA, 15 nt, Mycobacterium bovis subsp bovis AF2122/97
ggcggucgccgcgcg

SEQ ID NO: 1037785 - RNA, 13 nt, Mycobacterium bovis subsp bovis AF2122/97
ggcggucgccgcg

SEQ ID NO: 1037786 - RNA, 16 nt, Mycobacterium bovis subsp bovis AF2122/97
ggcggucgcguaccgg

SEQ ID NO: 1037787 - RNA, 21 nt, Mycobacterium bovis subsp bovis AF2122/97
ggcggucggaaugccgucgcc

SEQ ID NO: 1037788 - RNA, 15 nt, Mycobacterium bovis subsp bovis AF2122/97
ggcggucggccggcu

SEQ ID NO: 1037789 - RNA, 21 nt, Mycobacterium bovis subsp bovis AF2122/97
ggcggucggccggcucguccg

SEQ ID NO: 1037790 - RNA, 20 nt, Mycobacterium bovis subsp bovis AF2122/97
ggcggucgggcccggcgagc

SEQ ID NO: 1037791 - RNA, 17 nt, Mycobacterium bovis subsp bovis AF2122/97
ggcggucucgucaaccu

SEQ ID NO: 1037792 - RNA, 16 nt, Mycobacterium bovis subsp bovis AF2122/97
ggcgucggcggccgug

SEQ ID NO: 1037793 - RNA, 21 nt, Mycobacterium bovis subsp bovis AF2122/97
ggcgucggugaaugccgucgc

SEQ ID NO: 1037794 - RNA, 22 nt, Mycobacterium bovis subsp bovis AF2122/97
ggcgucggugaaugccgucgcc

SEQ ID NO: 1037795 - RNA, 13 nt, Mycobacterium bovis subsp bovis AF2122/97
ggcgucguccgcg

SEQ ID NO: 1037796 - RNA, 14 nt, Mycobacterium bovis subsp bovis AF2122/97
ggcgucggccaccg

SEQ ID NO: 1037797 - RNA, 15 nt, Mycobacterium bovis subsp bovis AF2122/97
ggcgucggcgcggcc

SEQ ID NO: 1037798 - RNA, 13 nt, Mycobacterium bovis subsp bovis AF2122/97
ggcgucggccggc

SEQ ID NO: 1037799 - RNA, 13 nt, Mycobacterium bovis subsp bovis AF2122/97
ggcgucgcggauc

SEQ ID NO: 1037800 - RNA, 17 nt, Mycobacterium bovis subsp bovis AF2122/97
ggcgucugcccgcccag

SEQ ID NO: 1037801 - RNA, 15 nt, Mycobacterium bovis subsp bovis AF2122/97
ggcgucguugaggaa

SEQ ID NO: 1037802 - RNA, 14 nt, Mycobacterium bovis subsp bovis AF2122/97
ggcgucgucggcgg

SEQ ID NO: 1037803 - RNA, 18 nt, Mycobacterium bovis subsp bovis AF2122/97
ggcgucgucggcggcgac

SEQ ID NO: 1037804 - RNA, 19 nt, Mycobacterium bovis subsp bovis AF2122/97
ggcgucgugcgcggccggc

SEQ ID NO: 1037805 - RNA, 16 nt, Mycobacterium bovis subsp bovis AF2122/97
ggcgucgugguggcua

SEQ ID NO: 1037806 - RNA, 19 nt, Mycobacterium bovis subsp bovis AF2122/97
ggcgucuuggaaggcgcgc

SEQ ID NO: 1037807 - RNA, 20 nt, Mycobacterium bovis subsp bovis AF2122/97
ggcgucuuccucggccaccc

SEQ ID NO: 1037808 - RNA, 15 nt, Mycobacterium bovis subsp bovis AF2122/97
ggcgugacagggcgg

SEQ ID NO: 1037809 - RNA, 15 nt, Mycobacterium bovis subsp bovis AF2122/97
ggcuggcccagcgac

SEQ ID NO: 1037810 - RNA, 17 nt, Mycobacterium bovis subsp bovis AF2122/97
ggcuggccagcugcggc

SEQ ID NO: 1037811 - RNA, 15 nt, Mycobacterium bovis subsp bovis AF2122/97
ggcuggccagcacgc

SEQ ID NO: 1037812 - RNA, 22 nt, Mycobacterium bovis subsp bovis AF2122/97
ggcuggcccaccuccucgccgg

SEQ ID NO: 1037813 - RNA, 12 nt, Mycobacterium bovis subsp bovis AF2122/97
ggcuggccgcca

SEQ ID NO: 1037814 - RNA, 16 nt, Mycobacterium bovis subsp bovis AF2122/97
ggcuggccgccaccgc

SEQ ID NO: 1037815 - RNA, 18 nt, Mycobacterium bovis subsp bovis AF2122/97
ggcuggcgauggccgucc

SEQ ID NO: 1037816 - RNA, 17 nt, Mycobacterium bovis subsp bovis AF2122/97
ggcuggcgugcugcuag

SEQ ID NO: 1037817 - RNA, 21 nt, Mycobacterium bovis subsp bovis AF2122/97
ggcuggcguugcugaugucgc

SEQ ID NO: 1037818 - RNA, 21 nt, Mycobacterium bovis subsp bovis AF2122/97
ggcugggcagaccgaucggca

SEQ ID NO: 1037819 - RNA, 15 nt, Mycobacterium bovis subsp bovis AF2122/97
ggcuggaccacucgc

SEQ ID NO: 1037820 - RNA, 15 nt, Mycobacterium bovis subsp bovis AF2122/97
ggcugcguucgccgg

SEQ ID NO: 1037821 - RNA, 16 nt, Mycobacterium bovis subsp bovis AF2122/97
ggcugcguuggcuggu

SEQ ID NO: 1037822 - RNA, 18 nt, Mycobacterium bovis subsp bovis AF2122/97
ggcugcuccgucgccgaa

SEQ ID NO: 1037823 - RNA, 13 nt, Mycobacterium bovis subsp bovis AF2122/97
ggcugcgccggaa

SEQ ID NO: 1037824 - RNA, 20 nt, Mycobacterium bovis subsp bovis AF2122/97
ggcugcggcuuggccaucac

SEQ ID NO: 1037825 - RNA, 20 nt, Mycobacterium bovis subsp bovis AF2122/97
ggcugcgggaagacgucggg

SEQ ID NO: 1037826 - RNA, 13 nt, Mycobacterium bovis subsp bovis AF2122/97
ggcugcgcgucga

SEQ ID NO: 1037827 - RNA, 17 nt, Mycobacterium bovis subsp bovis AF2122/97
ggcugcgcucgcccgcg

SEQ ID NO: 1037828 - RNA, 18 nt, Mycobacterium bovis subsp bovis AF2122/97
ggcugcgcuucgaccgag

SEQ ID NO: 1037829 - RNA, 13 nt, Mycobacterium bovis subsp bovis AF2122/97
ggcugcggccgcg

SEQ ID NO: 1037830 - RNA, 16 nt, Mycobacterium bovis subsp bovis AF2122/97
ggcugccgucagccgu

SEQ ID NO: 1037831 - RNA, 16 nt, Mycobacterium bovis subsp bovis AF2122/97
ggcugccgccguugcc

SEQ ID NO: 1037832 - RNA, 19 nt, Mycobacterium bovis subsp bovis AF2122/97
ggcugccgcgcgcugccgc

SEQ ID NO: 1037833 - RNA, 20 nt, Mycobacterium bovis subsp bovis AF2122/97
ggcugccgcugcgccgucgc

SEQ ID NO: 1037834 - RNA, 21 nt, Mycobacterium bovis subsp bovis AF2122/97
ggcugccgcccaugccgggau

SEQ ID NO: 1037835 - RNA, 23 nt, Mycobacterium bovis subsp bovis AF2122/97
ggcugccguugauucggccgccg

SEQ ID NO: 1037836 - RNA, 18 nt, Mycobacterium bovis subsp bovis AF2122/97
ggcugcgacaggacgucg

SEQ ID NO: 1037837 - RNA, 18 nt, Mycobacterium bovis subsp bovis AF2122/97
ggcugcgaccggcuccgg

SEQ ID NO: 1037838 - RNA, 15 nt, Mycobacterium bovis subsp bovis AF2122/97
ggcugccuucggcga

SEQ ID NO: 1037839 - RNA, 22 nt, Mycobacterium bovis subsp bovis AF2122/97
ggcugccgaacaguucggcgag

SEQ ID NO: 1037840 - RNA, 23 nt, Mycobacterium bovis subsp bovis AF2122/97
ggcugccgaacaguucggcgagc

SEQ ID NO: 1037841 - RNA, 16 nt, Mycobacterium bovis subsp bovis AF2122/97
ggcugacgaucuccac

SEQ ID NO: 1037842 - RNA, 13 nt, Mycobacterium bovis subsp bovis AF2122/97
ggcugaccuccca

SEQ ID NO: 1037843 - RNA, 16 nt, Mycobacterium bovis subsp bovis AF2122/97
ggcugaccucccaccc

SEQ ID NO: 1037844 - RNA, 17 nt, Mycobacterium bovis subsp bovis AF2122/97
ggcugaccggggcgccc

SEQ ID NO: 1037845 - RNA, 19 nt, Mycobacterium bovis subsp bovis AF2122/97
ggcugaccggggcgcccgg

SEQ ID NO: 1037846 - RNA, 13 nt, Mycobacterium bovis subsp bovis AF2122/97
ggcugaccggggu

SEQ ID NO: 1037847 - RNA, 18 nt, Mycobacterium bovis subsp bovis AF2122/97
ggcugagcccgccgcgac

SEQ ID NO: 1037848 - RNA, 14 nt, Mycobacterium bovis subsp bovis AF2122/97
ggcugaccgacccg

SEQ ID NO: 1037849 - RNA, 19 nt, Mycobacterium bovis subsp bovis AF2122/97
ggcugaggaacgccggcau

SEQ ID NO: 1037850 - RNA, 19 nt, Mycobacterium bovis subsp bovis AF2122/97
ggcugaggcggcgacgacc

SEQ ID NO: 1037851 - RNA, 21 nt, Mycobacterium bovis subsp bovis AF2122/97
ggcugaggcggcgacgaccgu

SEQ ID NO: 1037852 - RNA, 18 nt, Mycobacterium bovis subsp bovis AF2122/97
ggcugaucccgaugcugg

SEQ ID NO: 1037853 - RNA, 14 nt, Mycobacterium bovis subsp bovis AF2122/97
ggcugccaccgcag

SEQ ID NO: 1037854 - RNA, 22 nt, Mycobacterium bovis subsp bovis AF2122/97
ggcugccagcgccgccgccgac

SEQ ID NO: 1037855 - RNA, 16 nt, Mycobacterium bovis subsp bovis AF2122/97
ggcugccagugccgcc

SEQ ID NO: 1037856 - RNA, 18 nt, Mycobacterium bovis subsp bovis AF2122/97
ggcugcauccuccucguc

SEQ ID NO: 1037857 - RNA, 14 nt, Mycobacterium bovis subsp bovis AF2122/97
ggcugcacgcucgu

SEQ ID NO: 1037858 - RNA, 15 nt, Mycobacterium bovis subsp bovis AF2122/97
ggcugcacgcucguu

SEQ ID NO: 1037859 - RNA, 18 nt, Mycobacterium bovis subsp bovis AF2122/97
ggcugauggcggcgaccc

SEQ ID NO: 1037860 - RNA, 19 nt, Mycobacterium bovis subsp bovis AF2122/97
ggcugauggcggcgacccg

SEQ ID NO: 1037861 - RNA, 19 nt, Mycobacterium bovis subsp bovis AF2122/97
ggcugcaaccagcggcaca

SEQ ID NO: 1037862 - RNA, 14 nt, Mycobacterium bovis subsp bovis AF2122/97
ggcuccggacaccc

SEQ ID NO: 1037863 - RNA, 12 nt, Mycobacterium bovis subsp bovis AF2122/97
ggcuccgccguu

SEQ ID NO: 1037864 - RNA, 13 nt, Mycobacterium bovis subsp bovis AF2122/97
ggcuccgcaacca

SEQ ID NO: 1037865 - RNA, 20 nt, Mycobacterium bovis subsp bovis AF2122/97
ggcuccgcccggcgugucgc

SEQ ID NO: 1037866 - RNA, 16 nt, Mycobacterium bovis subsp bovis AF2122/97
ggcuccgccguugacg

SEQ ID NO: 1037867 - RNA, 19 nt, Mycobacterium bovis subsp bovis AF2122/97
ggcuccgccguugacgccg

SEQ ID NO: 1037868 - RNA, 15 nt, Mycobacterium bovis subsp bovis AF2122/97
ggcuccgccguugcc

SEQ ID NO: 1037869 - RNA, 16 nt, Mycobacterium bovis subsp bovis AF2122/97
ggcuccgccguugccg

SEQ ID NO: 1037870 - RNA, 20 nt, Mycobacterium bovis subsp bovis AF2122/97
ggcuccgccguugccgccgc

SEQ ID NO: 1037871 - RNA, 15 nt, Mycobacterium bovis subsp bovis AF2122/97
ggcuccgcgacgggc

SEQ ID NO: 1037872 - RNA, 13 nt, Mycobacterium bovis subsp bovis AF2122/97
ggcucuccgguga

SEQ ID NO: 1037873 - RNA, 15 nt, Mycobacterium bovis subsp bovis AF2122/97
ggcuccggcggcagc

SEQ ID NO: 1037874 - RNA, 20 nt, Mycobacterium bovis subsp bovis AF2122/97
ggcucucggugguccagcgc

SEQ ID NO: 1037875 - RNA, 21 nt, Mycobacterium bovis subsp bovis AF2122/97
ggcucugaggucaccggcgac

SEQ ID NO: 1037876 - RNA, 15 nt, Mycobacterium bovis subsp bovis AF2122/97
ggcuccggccggcca

SEQ ID NO: 1037877 - RNA, 17 nt, Mycobacterium bovis subsp bovis AF2122/97
ggcuccggccggccagc

SEQ ID NO: 1037878 - RNA, 16 nt, Mycobacterium bovis subsp bovis AF2122/97
ggcucguugcgggcgg

SEQ ID NO: 1037879 - RNA, 16 nt, Mycobacterium bovis subsp bovis AF2122/97
ggcucucacgagcggc

SEQ ID NO: 1037880 - RNA, 13 nt, Mycobacterium bovis subsp bovis AF2122/97
ggcucaccgcgca

SEQ ID NO: 1037881 - RNA, 14 nt, Mycobacterium bovis subsp bovis AF2122/97
ggcucacgaccggc

SEQ ID NO: 1037882 - RNA, 22 nt, Mycobacterium bovis subsp bovis AF2122/97
ggcucacgaccggccaacgccg

SEQ ID NO: 1037883 - RNA, 15 nt, Mycobacterium bovis subsp bovis AF2122/97
ggcucccccaccagg

SEQ ID NO: 1037884 - RNA, 16 nt, Mycobacterium bovis subsp bovis AF2122/97
ggcuccgagggcugcg

SEQ ID NO: 1037885 - RNA, 19 nt, Mycobacterium bovis subsp bovis AF2122/97
ggcuccgagggcugcgugg

SEQ ID NO: 1037886 - RNA, 12 nt, Mycobacterium bovis subsp bovis AF2122/97
ggcuccgcagcg

SEQ ID NO: 1037887 - RNA, 20 nt, Mycobacterium bovis subsp bovis AF2122/97
ggcuccgccacuggcgccgg

SEQ ID NO: 1037888 - RNA, 22 nt, Mycobacterium bovis subsp bovis AF2122/97
ggcuccgccacuggcgccggug

SEQ ID NO: 1037889 - RNA, 15 nt, Mycobacterium bovis subsp bovis AF2122/97
ggcugaccgccaccc

SEQ ID NO: 1037890 - RNA, 22 nt, Mycobacterium bovis subsp bovis AF2122/97
ggcugaauucggcgagcgcccu

SEQ ID NO: 1037891 - RNA, 23 nt, Mycobacterium bovis subsp bovis AF2122/97
ggcucugaugguguacacgucgc

SEQ ID NO: 1037892 - RNA, 16 nt, Mycobacterium bovis subsp bovis AF2122/97
ggcucuguagcgucgc

SEQ ID NO: 1037893 - RNA, 14 nt, Mycobacterium bovis subsp bovis AF2122/97
ggcugaacaccgcg

SEQ ID NO: 1037894 - RNA, 13 nt, Mycobacterium bovis subsp bovis AF2122/97
ggcugaacaccgc

SEQ ID NO: 1037895 - RNA, 16 nt, Mycobacterium bovis subsp bovis AF2122/97
ggcugaaacauccccg

SEQ ID NO: 1037896 - RNA, 18 nt, Mycobacterium bovis subsp bovis AF2122/97
ggcugaaaccuugcggca

SEQ ID NO: 1037897 - RNA, 19 nt, Mycobacterium bovis subsp bovis AF2122/97
ggccucagacaacggguug

SEQ ID NO: 1037898 - RNA, 15 nt, Mycobacterium bovis subsp bovis AF2122/97
ggccucagccaccgg

SEQ ID NO: 1037899 - RNA, 16 nt, Mycobacterium bovis subsp bovis AF2122/97
ggccucagccaccggg

SEQ ID NO: 1037900 - RNA, 22 nt, Mycobacterium bovis subsp bovis AF2122/97
ggccucaugcuaggccaccggc

SEQ ID NO: 1037901 - RNA, 21 nt, Mycobacterium bovis subsp bovis AF2122/97
ggccuccaaaaucgcggccac

SEQ ID NO: 1037902 - RNA, 19 nt, Mycobacterium bovis subsp bovis AF2122/97
ggccuccaagcccgccgga

SEQ ID NO: 1037903 - RNA, 21 nt, Mycobacterium bovis subsp bovis AF2122/97
ggccuccacccgccacgguuc

SEQ ID NO: 1037904 - RNA, 14 nt, Mycobacterium bovis subsp bovis AF2122/97
ggccuccagcaccc

SEQ ID NO: 1037905 - RNA, 12 nt, Mycobacterium bovis subsp bovis AF2122/97
ggccucgccggc

SEQ ID NO: 1037906 - RNA, 14 nt, Mycobacterium bovis subsp bovis AF2122/97
ggccucgccggcgc

SEQ ID NO: 1037907 - RNA, 15 nt, Mycobacterium bovis subsp bovis AF2122/97
ggccucgcugcucag

SEQ ID NO: 1037908 - RNA, 15 nt, Mycobacterium bovis subsp bovis AF2122/97
ggccucggcggucgc

SEQ ID NO: 1037909 - RNA, 19 nt, Mycobacterium bovis subsp bovis AF2122/97
ggccucggcggccguggcc

SEQ ID NO: 1037910 - RNA, 20 nt, Mycobacterium bovis subsp bovis AF2122/97
ggccucggcggccguggccu

SEQ ID NO: 1037911 - RNA, 17 nt, Mycobacterium bovis subsp bovis AF2122/97
ggccucggcgccgucgg

SEQ ID NO: 1037912 - RNA, 13 nt, Mycobacterium bovis subsp bovis AF2122/97
ggccucggcgaua

SEQ ID NO: 1037913 - RNA, 12 nt, Mycobacterium bovis subsp bovis AF2122/97
ggccucggcgac

SEQ ID NO: 1037914 - RNA, 23 nt, Mycobacterium bovis subsp bovis AF2122/97
ggccucggucugguggucggcga

SEQ ID NO: 1037915 - RNA, 20 nt, Mycobacterium bovis subsp bovis AF2122/97
ggccucgggacucccgcgcg

SEQ ID NO: 1037916 - RNA, 23 nt, Mycobacterium bovis subsp bovis AF2122/97
ggccucggugagcagcucgguga

SEQ ID NO: 1037917 - RNA, 19 nt, Mycobacterium bovis subsp bovis AF2122/97
ggccucggggaucgcaagc

SEQ ID NO: 1037918 - RNA, 17 nt, Mycobacterium bovis subsp bovis AF2122/97
ggccugcaccacggcgg

SEQ ID NO: 1037919 - RNA, 14 nt, Mycobacterium bovis subsp bovis AF2122/97
ggccugcccccggc

SEQ ID NO: 1037920 - RNA, 16 nt, Mycobacterium bovis subsp bovis AF2122/97
ggccugcccccggcgc

SEQ ID NO: 1037921 - RNA, 17 nt, Mycobacterium bovis subsp bovis AF2122/97
ggccugcccggcgccgu

SEQ ID NO: 1037922 - RNA, 15 nt, Mycobacterium bovis subsp bovis AF2122/97
ggccugccgcucgcc

SEQ ID NO: 1037923 - RNA, 16 nt, Mycobacterium bovis subsp bovis AF2122/97
ggccugcgcgaccgac

SEQ ID NO: 1037924 - RNA, 19 nt, Mycobacterium bovis subsp bovis AF2122/97
ggccugcgcgauccgcgcg

SEQ ID NO: 1037925 - RNA, 23 nt, Mycobacterium bovis subsp bovis AF2122/97
ggccugcgcuucguccagcgauc

SEQ ID NO: 1037926 - RNA, 20 nt, Mycobacterium bovis subsp bovis AF2122/97
ggccugcagcgcgacccgua

SEQ ID NO: 1037927 - RNA, 15 nt, Mycobacterium bovis subsp bovis AF2122/97
ggccugcggcaccgg

SEQ ID NO: 1037928 - RNA, 20 nt, Mycobacterium bovis subsp bovis AF2122/97
ggccugguacucccgcgauc

SEQ ID NO: 1037929 - RNA, 15 nt, Mycobacterium bovis subsp bovis AF2122/97
ggcgaaccagcgcgu

SEQ ID NO: 1037930 - RNA, 12 nt, Mycobacterium bovis subsp bovis AF2122/97
ggcgaaacccgg

SEQ ID NO: 1037931 - RNA, 23 nt, Mycobacterium bovis subsp bovis AF2122/97
ggcgaacccgcagucggucacgc

SEQ ID NO: 1037932 - RNA, 16 nt, Mycobacterium bovis subsp bovis AF2122/97
ggcgaacccgccgaug

SEQ ID NO: 1037933 - RNA, 17 nt, Mycobacterium bovis subsp bovis AF2122/97
ggcgaacccuccgcagc

SEQ ID NO: 1037934 - RNA, 18 nt, Mycobacterium bovis subsp bovis AF2122/97
ggcgaacgcguccagcgc

SEQ ID NO: 1037935 - RNA, 21 nt, Mycobacterium bovis subsp bovis AF2122/97
ggcgaacggauucccgcccag

SEQ ID NO: 1037936 - RNA, 17 nt, Mycobacterium bovis subsp bovis AF2122/97
ggcgaacggcaccgcgc

SEQ ID NO: 1037937 - RNA, 14 nt, Mycobacterium bovis subsp bovis AF2122/97
ggccuggucggcca

SEQ ID NO: 1037938 - RNA, 14 nt, Mycobacterium bovis subsp bovis AF2122/97
ggccugucgaagau

SEQ ID NO: 1037939 - RNA, 15 nt, Mycobacterium bovis subsp bovis AF2122/97
ggccugucaggcggc

SEQ ID NO: 1037940 - RNA, 20 nt, Mycobacterium bovis subsp bovis AF2122/97
ggccugucaggcggcggacc

SEQ ID NO: 1037941 - RNA, 18 nt, Mycobacterium bovis subsp bovis AF2122/97
ggccugucccgcacccgg

SEQ ID NO: 1037942 - RNA, 22 nt, Mycobacterium bovis subsp bovis AF2122/97
ggccugguuguccguaucgggc

SEQ ID NO: 1037943 - RNA, 13 nt, Mycobacterium bovis subsp bovis AF2122/97
ggccuuugagcgc

SEQ ID NO: 1037944 - RNA, 15 nt, Mycobacterium bovis subsp bovis AF2122/97
ggccuugugcucgau

SEQ ID NO: 1037945 - RNA, 15 nt, Mycobacterium bovis subsp bovis AF2122/97
ggccuguucgccguc

SEQ ID NO: 1037946 - RNA, 17 nt, Mycobacterium bovis subsp bovis AF2122/97
ggccuguucgccgucgc

SEQ ID NO: 1037947 - RNA, 18 nt, Mycobacterium bovis subsp bovis AF2122/97
ggccuguucgccgucgcu

SEQ ID NO: 1037948 - RNA, 13 nt, Mycobacterium bovis subsp bovis AF2122/97
ggccuuggcgacg

SEQ ID NO: 1037949 - RNA, 14 nt, Mycobacterium bovis subsp bovis AF2122/97
ggccuuggcgacgu

SEQ ID NO: 1037950 - RNA, 16 nt, Mycobacterium bovis subsp bovis AF2122/97
ggccuguucaacuccg

SEQ ID NO: 1037951 - RNA, 17 nt, Mycobacterium bovis subsp bovis AF2122/97
ggcgaagucacgcaccc

SEQ ID NO: 1037952 - RNA, 19 nt, Mycobacterium bovis subsp bovis AF2122/97
ggcgaagucacgcacccgg

SEQ ID NO: 1037953 - RNA, 15 nt, Mycobacterium bovis subsp bovis AF2122/97
ggcgaagucgagugc

SEQ ID NO: 1037954 - RNA, 23 nt, Mycobacterium bovis subsp bovis AF2122/97
ggcgaaucuuugguagucugcac

SEQ ID NO: 1037955 - RNA, 16 nt, Mycobacterium bovis subsp bovis AF2122/97
ggcgaauccgcacagg

SEQ ID NO: 1037956 - RNA, 15 nt, Mycobacterium bovis subsp bovis AF2122/97
ggcgaaguuggugac

SEQ ID NO: 1037957 - RNA, 18 nt, Mycobacterium bovis subsp bovis AF2122/97
ggcgaauacgaccgucgc

SEQ ID NO: 1037958 - RNA, 19 nt, Mycobacterium bovis subsp bovis AF2122/97
ggcgaauacgaccgucgcg

SEQ ID NO: 1037959 - RNA, 13 nt, Mycobacterium bovis subsp bovis AF2122/97
ggcgaagauaucg

SEQ ID NO: 1037960 - RNA, 14 nt, Mycobacterium bovis subsp bovis AF2122/97
ggcgaagcuugacg

SEQ ID NO: 1037961 - RNA, 23 nt, Mycobacterium bovis subsp bovis AF2122/97
ggcgaagcgggacugcagcgcgg

SEQ ID NO: 1037962 - RNA, 21 nt, Mycobacterium bovis subsp bovis AF2122/97
ggcgaagaacaacaucgccau

SEQ ID NO: 1037963 - RNA, 23 nt, Mycobacterium bovis subsp bovis AF2122/97
ggcgaacucgaggucgagcgccg

SEQ ID NO: 1037964 - RNA, 20 nt, Mycobacterium bovis subsp bovis AF2122/97
ggcgaacucggcgaugaacg

SEQ ID NO: 1037965 - RNA, 22 nt, Mycobacterium bovis subsp bovis AF2122/97
ggccgcgaaugcugugccgaga

SEQ ID NO: 1037966 - RNA, 20 nt, Mycobacterium bovis subsp bovis AF2122/97
ggccgcgacaauggugccca

SEQ ID NO: 1037967 - RNA, 20 nt, Mycobacterium bovis subsp bovis AF2122/97
ggccgccuugaggcccugcg

SEQ ID NO: 1037968 - RNA, 23 nt, Mycobacterium bovis subsp bovis AF2122/97
ggccgccuucuccggcgucacgg

SEQ ID NO: 1037969 - RNA, 21 nt, Mycobacterium bovis subsp bovis AF2122/97
ggccgccggguccggaaccgg

SEQ ID NO: 1037970 - RNA, 20 nt, Mycobacterium bovis subsp bovis AF2122/97
ggccgccuuggcuucgacgc

SEQ ID NO: 1037971 - RNA, 15 nt, Mycobacterium bovis subsp bovis AF2122/97
ggccgcgaccagcgc

SEQ ID NO: 1037972 - RNA, 20 nt, Mycobacterium bovis subsp bovis AF2122/97
ggccgcgaccagcgccgcac

SEQ ID NO: 1037973 - RNA, 16 nt, Mycobacterium bovis subsp bovis AF2122/97
ggccgcgacgacacgc

SEQ ID NO: 1037974 - RNA, 22 nt, Mycobacterium bovis subsp bovis AF2122/97
ggccgcgagacgcaugucgggc

SEQ ID NO: 1037975 - RNA, 20 nt, Mycobacterium bovis subsp bovis AF2122/97
ggccgcgauggugcgccggg

SEQ ID NO: 1037976 - RNA, 18 nt, Mycobacterium bovis subsp bovis AF2122/97
ggccgcugucguaccgcu

SEQ ID NO: 1037977 - RNA, 13 nt, Mycobacterium bovis subsp bovis AF2122/97
ggccgcugacacc

SEQ ID NO: 1037978 - RNA, 22 nt, Mycobacterium bovis subsp bovis AF2122/97
ggccgcuuagauagggguggcc

SEQ ID NO: 1037979 - RNA, 19 nt, Mycobacterium bovis subsp bovis AF2122/97
ggccgcuucggcggucagc

SEQ ID NO: 1037980 - RNA, 16 nt, Mycobacterium bovis subsp bovis AF2122/97
ggccgcuggggcgccc

SEQ ID NO: 1037981 - RNA, 17 nt, Mycobacterium bovis subsp bovis AF2122/97
ggccgcucgggccagcg

SEQ ID NO: 1037982 - RNA, 18 nt, Mycobacterium bovis subsp bovis AF2122/97
ggccgcucgggccagcga

SEQ ID NO: 1037983 - RNA, 15 nt, Mycobacterium bovis subsp bovis AF2122/97
ggccggcacgaccgc

SEQ ID NO: 1037984 - RNA, 13 nt, Mycobacterium bovis subsp bovis AF2122/97
ggccggcaccgca

SEQ ID NO: 1037985 - RNA, 18 nt, Mycobacterium bovis subsp bovis AF2122/97
ggccggcaccgcagcgga

SEQ ID NO: 1037986 - RNA, 13 nt, Mycobacterium bovis subsp bovis AF2122/97
ggccggccaccag

SEQ ID NO: 1037987 - RNA, 16 nt, Mycobacterium bovis subsp bovis AF2122/97
ggccggccaccaccgc

SEQ ID NO: 1037988 - RNA, 21 nt, Mycobacterium bovis subsp bovis AF2122/97
ggccggcaugcuggcgaucgc

SEQ ID NO: 1037989 - RNA, 12 nt, Mycobacterium bovis subsp bovis AF2122/97
ggccggcauggc

SEQ ID NO: 1037990 - RNA, 17 nt, Mycobacterium bovis subsp bovis AF2122/97
ggccggcaucgucgggu

SEQ ID NO: 1037991 - RNA, 20 nt, Mycobacterium bovis subsp bovis AF2122/97
ggccggccagcacccgaacc

SEQ ID NO: 1037992 - RNA, 13 nt, Mycobacterium bovis subsp bovis AF2122/97
ggccggccaucgc

SEQ ID NO: 1037993 - RNA, 18 nt, Mycobacterium bovis subsp bovis AF2122/97
ggccggaugagcgaacgc

SEQ ID NO: 1037994 - RNA, 16 nt, Mycobacterium bovis subsp bovis AF2122/97
ggccggaacgcccggc

SEQ ID NO: 1037995 - RNA, 23 nt, Mycobacterium bovis subsp bovis AF2122/97
ggccggaagauccgggccuugcg

SEQ ID NO: 1037996 - RNA, 19 nt, Mycobacterium bovis subsp bovis AF2122/97
ggccggcaccccacggcca

SEQ ID NO: 1037997 - RNA, 19 nt, Mycobacterium bovis subsp bovis AF2122/97
ggccggaugucgacgagca

SEQ ID NO: 1037998 - RNA, 17 nt, Mycobacterium bovis subsp bovis AF2122/97
ggccggauccucgauau

SEQ ID NO: 1037999 - RNA, 17 nt, Mycobacterium bovis subsp bovis AF2122/97
ggccgcuuuucgauggu

SEQ ID NO: 1038000 - RNA, 23 nt, Mycobacterium bovis subsp bovis AF2122/97
ggccgcuucggcggucagcggcu

SEQ ID NO: 1038001 - RNA, 13 nt, Mycobacterium bovis subsp bovis AF2122/97
ggccgcuugcccc

SEQ ID NO: 1038002 - RNA, 14 nt, Mycobacterium bovis subsp bovis AF2122/97
ggccggcgcggucg

SEQ ID NO: 1038003 - RNA, 15 nt, Mycobacterium bovis subsp bovis AF2122/97
ggccggcgcggucuc

SEQ ID NO: 1038004 - RNA, 15 nt, Mycobacterium bovis subsp bovis AF2122/97
ggccggcggccgccc

SEQ ID NO: 1038005 - RNA, 16 nt, Mycobacterium bovis subsp bovis AF2122/97
ggccggcggcucgggu

SEQ ID NO: 1038006 - RNA, 13 nt, Mycobacterium bovis subsp bovis AF2122/97
ggccggcgguagc

SEQ ID NO: 1038007 - RNA, 23 nt, Mycobacterium bovis subsp bovis AF2122/97
ggccggcguagcggcgauaccgg

SEQ ID NO: 1038008 - RNA, 18 nt, Mycobacterium bovis subsp bovis AF2122/97
ggccgggaucucgaaggc

SEQ ID NO: 1038009 - RNA, 15 nt, Mycobacterium bovis subsp bovis AF2122/97
ggccgggcagugcgc

SEQ ID NO: 1038010 - RNA, 13 nt, Mycobacterium bovis subsp bovis AF2122/97
ggccgggccgagu

SEQ ID NO: 1038011 - RNA, 19 nt, Mycobacterium bovis subsp bovis AF2122/97
ggccgggcagugcgcggcg

SEQ ID NO: 1038012 - RNA, 17 nt, Mycobacterium bovis subsp bovis AF2122/97
ggccgggcaguucacgg

SEQ ID NO: 1038013 - RNA, 15 nt, Mycobacterium bovis subsp bovis AF2122/97
ggccgggccggccac

SEQ ID NO: 1038014 - RNA, 18 nt, Mycobacterium bovis subsp bovis AF2122/97
ggccgggccgagugccca

SEQ ID NO: 1038015 - RNA, 14 nt, Mycobacterium bovis subsp bovis AF2122/97
ggccggugccaguc

SEQ ID NO: 1038016 - RNA, 21 nt, Mycobacterium bovis subsp bovis AF2122/97
ggccgggccugcaccacggcg

SEQ ID NO: 1038017 - RNA, 17 nt, Mycobacterium bovis subsp bovis AF2122/97
ggccgggcgaucgccug

SEQ ID NO: 1038018 - RNA, 18 nt, Mycobacterium bovis subsp bovis AF2122/97
ggccggcggucagcagcg

SEQ ID NO: 1038019 - RNA, 13 nt, Mycobacterium bovis subsp bovis AF2122/97
ggccggugcgcau

SEQ ID NO: 1038020 - RNA, 21 nt, Mycobacterium bovis subsp bovis AF2122/97
ggccggugcgucacagccggg

SEQ ID NO: 1038021 - RNA, 21 nt, Mycobacterium bovis subsp bovis AF2122/97
ggccgguucccuuguucccga

SEQ ID NO: 1038022 - RNA, 15 nt, Mycobacterium bovis subsp bovis AF2122/97
ggccguaacgcggau

SEQ ID NO: 1038023 - RNA, 14 nt, Mycobacterium bovis subsp bovis AF2122/97
ggccgguucgcccg

SEQ ID NO: 1038024 - RNA, 15 nt, Mycobacterium bovis subsp bovis AF2122/97
ggccgguuggccagc

SEQ ID NO: 1038025 - RNA, 16 nt, Mycobacterium bovis subsp bovis AF2122/97
ggccgguuggccagcc

SEQ ID NO: 1038026 - RNA, 21 nt, Mycobacterium bovis subsp bovis AF2122/97
ggccgucaggcgugccgggga

SEQ ID NO: 1038027 - RNA, 17 nt, Mycobacterium bovis subsp bovis AF2122/97
ggccgucaucgccgggu

SEQ ID NO: 1038028 - RNA, 16 nt, Mycobacterium bovis subsp bovis AF2122/97
ggccgucccaccagcc

SEQ ID NO: 1038029 - RNA, 18 nt, Mycobacterium bovis subsp bovis AF2122/97
ggccgucccaccagccga

SEQ ID NO: 1038030 - RNA, 21 nt, Mycobacterium bovis subsp bovis AF2122/97
ggccguccucggucagcucgu

SEQ ID NO: 1038031 - RNA, 20 nt, Mycobacterium bovis subsp bovis AF2122/97
ggccgucgaagacgaacgug

SEQ ID NO: 1038032 - RNA, 22 nt, Mycobacterium bovis subsp bovis AF2122/97
ggccgucgaacgguagcacggu

SEQ ID NO: 1038033 - RNA, 15 nt, Mycobacterium bovis subsp bovis AF2122/97
ggccgucgaugaucu

SEQ ID NO: 1038034 - RNA, 13 nt, Mycobacterium bovis subsp bovis AF2122/97
ggccgucgauggu

SEQ ID NO: 1038035 - RNA, 20 nt, Mycobacterium bovis subsp bovis AF2122/97
ggccgucgcgaaacaccaga

SEQ ID NO: 1038036 - RNA, 23 nt, Mycobacterium bovis subsp bovis AF2122/97
ggccgucgcgaaacaccagacac

SEQ ID NO: 1038037 - RNA, 21 nt, Mycobacterium bovis subsp bovis AF2122/97
ggccgucgccggagucgauca

SEQ ID NO: 1038038 - RNA, 17 nt, Mycobacterium bovis subsp bovis AF2122/97
ggccgucgacgaucagc

SEQ ID NO: 1038039 - RNA, 21 nt, Mycobacterium bovis subsp bovis AF2122/97
ggccgucagcgucggcgcauc

SEQ ID NO: 1038040 - RNA, 19 nt, Mycobacterium bovis subsp bovis AF2122/97
ggccgucgacgcauggguc

SEQ ID NO: 1038041 - RNA, 14 nt, Mycobacterium bovis subsp bovis AF2122/97
ggccgucgccgaag

SEQ ID NO: 1038042 - RNA, 15 nt, Mycobacterium bovis subsp bovis AF2122/97
ggccgucgcuggugg

SEQ ID NO: 1038043 - RNA, 22 nt, Mycobacterium bovis subsp bovis AF2122/97
ggccgucaaccagggugccggc

SEQ ID NO: 1038044 - RNA, 15 nt, Mycobacterium bovis subsp bovis AF2122/97
ggccgucaucgccgg

SEQ ID NO: 1038045 - RNA, 12 nt, Mycobacterium bovis subsp bovis AF2122/97
ggccgucagcca

SEQ ID NO: 1038046 - RNA, 18 nt, Mycobacterium bovis subsp bovis AF2122/97
ggccgucagccaggugcc

SEQ ID NO: 1038047 - RNA, 17 nt, Mycobacterium bovis subsp bovis AF2122/97
ggccguaguggccggcu

SEQ ID NO: 1038048 - RNA, 15 nt, Mycobacterium bovis subsp bovis AF2122/97
ggccguagucggcga

SEQ ID NO: 1038049 - RNA, 18 nt, Mycobacterium bovis subsp bovis AF2122/97
ggccguagucggcgaugc

SEQ ID NO: 1038050 - RNA, 24 nt, Mycobacterium bovis subsp bovis AF2122/97
ggccguagucggcgaugcgcacca

SEQ ID NO: 1038051 - RNA, 17 nt, Mycobacterium bovis subsp bovis AF2122/97
ggccguaggcggcgacc

SEQ ID NO: 1038052 - RNA, 13 nt, Mycobacterium bovis subsp bovis AF2122/97
ggccguaggcggc

SEQ ID NO: 1038053 - RNA, 15 nt, Mycobacterium bovis subsp bovis AF2122/97
ggccguaggcggcga

SEQ ID NO: 1038054 - RNA, 16 nt, Mycobacterium bovis subsp bovis AF2122/97
ggccguaggcggcgac

SEQ ID NO: 1038055 - RNA, 15 nt, Mycobacterium bovis subsp bovis AF2122/97
ggccguacucgucgu

SEQ ID NO: 1038056 - RNA, 14 nt, Mycobacterium bovis subsp bovis AF2122/97
ggccguacgacggc

SEQ ID NO: 1038057 - RNA, 19 nt, Mycobacterium bovis subsp bovis AF2122/97
ggccgcauauugcggcgcc

SEQ ID NO: 1038058 - RNA, 15 nt, Mycobacterium bovis subsp bovis AF2122/97
ggccgcaguggcaag

SEQ ID NO: 1038059 - RNA, 17 nt, Mycobacterium bovis subsp bovis AF2122/97
ggccgcaucgccucacc

SEQ ID NO: 1038060 - RNA, 14 nt, Mycobacterium bovis subsp bovis AF2122/97
ggccgcaucgguca

SEQ ID NO: 1038061 - RNA, 15 nt, Mycobacterium bovis subsp bovis AF2122/97
ggccgcaucgucgcc

SEQ ID NO: 1038062 - RNA, 15 nt, Mycobacterium bovis subsp bovis AF2122/97
ggccgcaugccacgg

SEQ ID NO: 1038063 - RNA, 14 nt, Mycobacterium bovis subsp bovis AF2122/97
ggccgccacaccgc

SEQ ID NO: 1038064 - RNA, 18 nt, Mycobacterium bovis subsp bovis AF2122/97
ggccgccacaccgccgcc

SEQ ID NO: 1038065 - RNA, 20 nt, Mycobacterium bovis subsp bovis AF2122/97
ggccgccacaccgccgccaa

SEQ ID NO: 1038066 - RNA, 17 nt, Mycobacterium bovis subsp bovis AF2122/97
ggccgcauuagccugcg

SEQ ID NO: 1038067 - RNA, 18 nt, Mycobacterium bovis subsp bovis AF2122/97
ggccgcauuagccugcgu

SEQ ID NO: 1038068 - RNA, 17 nt, Mycobacterium bovis subsp bovis AF2122/97
ggccgccaacuccagca

SEQ ID NO: 1038069 - RNA, 20 nt, Mycobacterium bovis subsp bovis AF2122/97
ggccgccaacuucaccaccc

SEQ ID NO: 1038070 - RNA, 14 nt, Mycobacterium bovis subsp bovis AF2122/97
ggccgccaccagcg

SEQ ID NO: 1038071 - RNA, 11 nt, Mycobacterium bovis subsp bovis AF2122/97
ggccgccaccg

SEQ ID NO: 1038072 - RNA, 17 nt, Mycobacterium bovis subsp bovis AF2122/97
ggccgccaccucccagg

SEQ ID NO: 1038073 - RNA, 20 nt, Mycobacterium bovis subsp bovis AF2122/97
ggccgccaccgcgacgagcg

SEQ ID NO: 1038074 - RNA, 15 nt, Mycobacterium bovis subsp bovis AF2122/97
ggccgccaccgucac

SEQ ID NO: 1038075 - RNA, 16 nt, Mycobacterium bovis subsp bovis AF2122/97
ggccgccagcagcuuc

SEQ ID NO: 1038076 - RNA, 15 nt, Mycobacterium bovis subsp bovis AF2122/97
ggccgcagcggccag

SEQ ID NO: 1038077 - RNA, 22 nt, Mycobacterium bovis subsp bovis AF2122/97
ggccgcagccagcaagucugcc

SEQ ID NO: 1038078 - RNA, 18 nt, Mycobacterium bovis subsp bovis AF2122/97
ggccgcaggcuugccgau

SEQ ID NO: 1038079 - RNA, 15 nt, Mycobacterium bovis subsp bovis AF2122/97
ggccgcagccagcgg

SEQ ID NO: 1038080 - RNA, 16 nt, Mycobacterium bovis subsp bovis AF2122/97
ggccgcagccagcaag

SEQ ID NO: 1038081 - RNA, 16 nt, Mycobacterium bovis subsp bovis AF2122/97
ggccgcacugcugguc

SEQ ID NO: 1038082 - RNA, 13 nt, Mycobacterium bovis subsp bovis AF2122/97
ggccgcacgucga

SEQ ID NO: 1038083 - RNA, 22 nt, Mycobacterium bovis subsp bovis AF2122/97
ggccgcacguauccacggucga

SEQ ID NO: 1038084 - RNA, 19 nt, Mycobacterium bovis subsp bovis AF2122/97
ggccgcacgccggccagcg

SEQ ID NO: 1038085 - RNA, 18 nt, Mycobacterium bovis subsp bovis AF2122/97
ggccgacgaacagcggug

SEQ ID NO: 1038086 - RNA, 15 nt, Mycobacterium bovis subsp bovis AF2122/97
ggccgaucccaccgg

SEQ ID NO: 1038087 - RNA, 20 nt, Mycobacterium bovis subsp bovis AF2122/97
ggccgaucucuccggcggcg

SEQ ID NO: 1038088 - RNA, 21 nt, Mycobacterium bovis subsp bovis AF2122/97
ggccgaucucuccggcggcga

SEQ ID NO: 1038089 - RNA, 14 nt, Mycobacterium bovis subsp bovis AF2122/97
ggccgaugagccca

SEQ ID NO: 1038090 - RNA, 20 nt, Mycobacterium bovis subsp bovis AF2122/97
ggccgaugagcccagccgcg

SEQ ID NO: 1038091 - RNA, 21 nt, Mycobacterium bovis subsp bovis AF2122/97
ggccgaugagcccagccgcgg

SEQ ID NO: 1038092 - RNA, 14 nt, Mycobacterium bovis subsp bovis AF2122/97
ggccgaugacgaug

SEQ ID NO: 1038093 - RNA, 19 nt, Mycobacterium bovis subsp bovis AF2122/97
ggccgaugacgaugccgcc

SEQ ID NO: 1038094 - RNA, 17 nt, Mycobacterium bovis subsp bovis AF2122/97
ggccgauggcgucaagc

SEQ ID NO: 1038095 - RNA, 17 nt, Mycobacterium bovis subsp bovis AF2122/97
ggccgauguaguccggc

SEQ ID NO: 1038096 - RNA, 18 nt, Mycobacterium bovis subsp bovis AF2122/97
ggccgaugugucgaugag

SEQ ID NO: 1038097 - RNA, 15 nt, Mycobacterium bovis subsp bovis AF2122/97
ggccgauugcucggg

SEQ ID NO: 1038098 - RNA, 18 nt, Mycobacterium bovis subsp bovis AF2122/97
ggccgcacgccgaccagc

SEQ ID NO: 1038099 - RNA, 16 nt, Mycobacterium bovis subsp bovis AF2122/97
ggccgcacgccgacca

SEQ ID NO: 1038100 - RNA, 13 nt, Mycobacterium bovis subsp bovis AF2122/97
ggccgcaccagca

SEQ ID NO: 1038101 - RNA, 18 nt, Mycobacterium bovis subsp bovis AF2122/97
ggccgcaaggcgccgaua

SEQ ID NO: 1038102 - RNA, 15 nt, Mycobacterium bovis subsp bovis AF2122/97
ggccgcaagccgcga

SEQ ID NO: 1038103 - RNA, 20 nt, Mycobacterium bovis subsp bovis AF2122/97
ggccgcaagccgcgagucgc

SEQ ID NO: 1038104 - RNA, 22 nt, Mycobacterium bovis subsp bovis AF2122/97
ggccgccgcgcaccgcgggauc

SEQ ID NO: 1038105 - RNA, 15 nt, Mycobacterium bovis subsp bovis AF2122/97
ggccgccgccgucgg

SEQ ID NO: 1038106 - RNA, 18 nt, Mycobacterium bovis subsp bovis AF2122/97
ggccgccgccgucggcga

SEQ ID NO: 1038107 - RNA, 20 nt, Mycobacterium bovis subsp bovis AF2122/97
ggccgccgccgucggcgagc

SEQ ID NO: 1038108 - RNA, 14 nt, Mycobacterium bovis subsp bovis AF2122/97
ggccgccgcggcga

SEQ ID NO: 1038109 - RNA, 13 nt, Mycobacterium bovis subsp bovis AF2122/97
ggccgccgcgccg

SEQ ID NO: 1038110 - RNA, 15 nt, Mycobacterium bovis subsp bovis AF2122/97
ggccgccgcgccggu

SEQ ID NO: 1038111 - RNA, 13 nt, Mycobacterium bovis subsp bovis AF2122/97
ggccgccgcggga

SEQ ID NO: 1038112 - RNA, 21 nt, Mycobacterium bovis subsp bovis AF2122/97
ggccgccgcgggacaccaccg

SEQ ID NO: 1038113 - RNA, 22 nt, Mycobacterium bovis subsp bovis AF2122/97
ggccgccgcgggacaccaccgc

SEQ ID NO: 1038114 - RNA, 15 nt, Mycobacterium bovis subsp bovis AF2122/97
ggccgccgcugccgc

SEQ ID NO: 1038115 - RNA, 13 nt, Mycobacterium bovis subsp bovis AF2122/97
ggccgccggcccc

SEQ ID NO: 1038116 - RNA, 14 nt, Mycobacterium bovis subsp bovis AF2122/97
ggccgccggccccg

SEQ ID NO: 1038117 - RNA, 17 nt, Mycobacterium bovis subsp bovis AF2122/97
ggccgccggcgcuggcg

SEQ ID NO: 1038118 - RNA, 12 nt, Mycobacterium bovis subsp bovis AF2122/97
ggccgccggcgc

SEQ ID NO: 1038119 - RNA, 21 nt, Mycobacterium bovis subsp bovis AF2122/97
ggccgccguccccgccgucgc

SEQ ID NO: 1038120 - RNA, 14 nt, Mycobacterium bovis subsp bovis AF2122/97
ggccgccguugccg

SEQ ID NO: 1038121 - RNA, 16 nt, Mycobacterium bovis subsp bovis AF2122/97
ggccgccuccgcggca

SEQ ID NO: 1038122 - RNA, 15 nt, Mycobacterium bovis subsp bovis AF2122/97
ggccgccucgaucga

SEQ ID NO: 1038123 - RNA, 16 nt, Mycobacterium bovis subsp bovis AF2122/97
ggccgccugccucgcc

SEQ ID NO: 1038124 - RNA, 20 nt, Mycobacterium bovis subsp bovis AF2122/97
ggccgcccuggccgcccaga

SEQ ID NO: 1038125 - RNA, 17 nt, Mycobacterium bovis subsp bovis AF2122/97
ggccgcccgcucgaugu

SEQ ID NO: 1038126 - RNA, 19 nt, Mycobacterium bovis subsp bovis AF2122/97
ggccgcccgcucgaugucg

SEQ ID NO: 1038127 - RNA, 19 nt, Mycobacterium bovis subsp bovis AF2122/97
ggccgcccggacccaaagc

SEQ ID NO: 1038128 - RNA, 21 nt, Mycobacterium bovis subsp bovis AF2122/97
ggccgccgaaacucaccagca

SEQ ID NO: 1038129 - RNA, 19 nt, Mycobacterium bovis subsp bovis AF2122/97
ggccgccgaacacaccgag

SEQ ID NO: 1038130 - RNA, 13 nt, Mycobacterium bovis subsp bovis AF2122/97
ggccgccgaugcc

SEQ ID NO: 1038131 - RNA, 17 nt, Mycobacterium bovis subsp bovis AF2122/97
ggccgccgaugccaccg

SEQ ID NO: 1038132 - RNA, 12 nt, Mycobacterium bovis subsp bovis AF2122/97
ggccgccgacgu

SEQ ID NO: 1038133 - RNA, 21 nt, Mycobacterium bovis subsp bovis AF2122/97
ggccgccgaauccgacgucga

SEQ ID NO: 1038134 - RNA, 14 nt, Mycobacterium bovis subsp bovis AF2122/97
ggccgccgacaacc

SEQ ID NO: 1038135 - RNA, 18 nt, Mycobacterium bovis subsp bovis AF2122/97
ggccgccgacaaccccgc

SEQ ID NO: 1038136 - RNA, 13 nt, Mycobacterium bovis subsp bovis AF2122/97
ggccgccgcagcu

SEQ ID NO: 1038137 - RNA, 14 nt, Mycobacterium bovis subsp bovis AF2122/97
ggccgccgcagcuc

SEQ ID NO: 1038138 - RNA, 18 nt, Mycobacterium bovis subsp bovis AF2122/97
ggccgccgccccggcgcu

SEQ ID NO: 1038139 - RNA, 21 nt, Mycobacterium bovis subsp bovis AF2122/97
ggccgcccagaccgccgacgc

SEQ ID NO: 1038140 - RNA, 23 nt, Mycobacterium bovis subsp bovis AF2122/97
ggccgcccagaccgccgacgccg

SEQ ID NO: 1038141 - RNA, 15 nt, Mycobacterium bovis subsp bovis AF2122/97
ggccgccaguucggc

SEQ ID NO: 1038142 - RNA, 21 nt, Mycobacterium bovis subsp bovis AF2122/97
ggccgccccggccgcuggcgu

SEQ ID NO: 1038143 - RNA, 12 nt, Mycobacterium bovis subsp bovis AF2122/97
ggccgccccggc

SEQ ID NO: 1038144 - RNA, 20 nt, Mycobacterium bovis subsp bovis AF2122/97
ggccgccagccccacccgca

SEQ ID NO: 1038145 - RNA, 13 nt, Mycobacterium bovis subsp bovis AF2122/97
ggccgccagcgcg

SEQ ID NO: 1038146 - RNA, 14 nt, Mycobacterium bovis subsp bovis AF2122/97
ggccgccagcugcg

SEQ ID NO: 1038147 - RNA, 21 nt, Mycobacterium bovis subsp bovis AF2122/97
ggccgccagcugcgcagcgca

SEQ ID NO: 1038148 - RNA, 13 nt, Mycobacterium bovis subsp bovis AF2122/97
ggccgccaggcgc

SEQ ID NO: 1038149 - RNA, 17 nt, Mycobacterium bovis subsp bovis AF2122/97
ggccgccagcgcggcca

SEQ ID NO: 1038150 - RNA, 18 nt, Mycobacterium bovis subsp bovis AF2122/97
ggccgccagcggcgaguc

SEQ ID NO: 1038151 - RNA, 21 nt, Mycobacterium bovis subsp bovis AF2122/97
ggccgccagcggcgaguccac

SEQ ID NO: 1038152 - RNA, 15 nt, Mycobacterium bovis subsp bovis AF2122/97
ggccgccaguccgau

SEQ ID NO: 1038153 - RNA, 21 nt, Mycobacterium bovis subsp bovis AF2122/97
ggccgccaguccgaucgccga

SEQ ID NO: 1038154 - RNA, 22 nt, Mycobacterium bovis subsp bovis AF2122/97
ggccgccaguccgaucgccgag

SEQ ID NO: 1038155 - RNA, 13 nt, Mycobacterium bovis subsp bovis AF2122/97
ggcccgcgcggcg

SEQ ID NO: 1038156 - RNA, 22 nt, Mycobacterium bovis subsp bovis AF2122/97
ggcccgcucccugcacccagcc

SEQ ID NO: 1038157 - RNA, 15 nt, Mycobacterium bovis subsp bovis AF2122/97
ggcccgcucgaaagc

SEQ ID NO: 1038158 - RNA, 19 nt, Mycobacterium bovis subsp bovis AF2122/97
ggcccgcguucucggcacc

SEQ ID NO: 1038159 - RNA, 16 nt, Mycobacterium bovis subsp bovis AF2122/97
ggcccgcacgaaccgg

SEQ ID NO: 1038160 - RNA, 20 nt, Mycobacterium bovis subsp bovis AF2122/97
ggcccgcugaccaucacacc

SEQ ID NO: 1038161 - RNA, 11 nt, Mycobacterium bovis subsp bovis AF2122/97
ggcccggcggu

SEQ ID NO: 1038162 - RNA, 15 nt, Mycobacterium bovis subsp bovis AF2122/97
ggcccgggccaccgg

SEQ ID NO: 1038163 - RNA, 21 nt, Mycobacterium bovis subsp bovis AF2122/97
ggcccggcuacgacggcgcca

SEQ ID NO: 1038164 - RNA, 15 nt, Mycobacterium bovis subsp bovis AF2122/97
ggcccggcucggugc

SEQ ID NO: 1038165 - RNA, 13 nt, Mycobacterium bovis subsp bovis AF2122/97
ggcccgggcccgc

SEQ ID NO: 1038166 - RNA, 17 nt, Mycobacterium bovis subsp bovis AF2122/97
ggcccgggcccgcggga

SEQ ID NO: 1038167 - RNA, 14 nt, Mycobacterium bovis subsp bovis AF2122/97
ggcccgggcggcca

SEQ ID NO: 1038168 - RNA, 20 nt, Mycobacterium bovis subsp bovis AF2122/97
ggcccgggcggccagcugca

SEQ ID NO: 1038169 - RNA, 16 nt, Mycobacterium bovis subsp bovis AF2122/97
ggcccgggugacggga

SEQ ID NO: 1038170 - RNA, 14 nt, Mycobacterium bovis subsp bovis AF2122/97
ggcccgguccgcca

SEQ ID NO: 1038171 - RNA, 18 nt, Mycobacterium bovis subsp bovis AF2122/97
ggcccugcacagcagcgu

SEQ ID NO: 1038172 - RNA, 22 nt, Mycobacterium bovis subsp bovis AF2122/97
ggcccugaccucauguccgccg

SEQ ID NO: 1038173 - RNA, 14 nt, Mycobacterium bovis subsp bovis AF2122/97
ggcccugccgacgc

SEQ ID NO: 1038174 - RNA, 18 nt, Mycobacterium bovis subsp bovis AF2122/97
ggcccugccgacgcucca

SEQ ID NO: 1038175 - RNA, 20 nt, Mycobacterium bovis subsp bovis AF2122/97
ggcccugccgccggccccgc

SEQ ID NO: 1038176 - RNA, 21 nt, Mycobacterium bovis subsp bovis AF2122/97
ggcccugcuccucgcgggcgg

SEQ ID NO: 1038177 - RNA, 14 nt, Mycobacterium bovis subsp bovis AF2122/97
ggcccuggccaccc

SEQ ID NO: 1038178 - RNA, 16 nt, Mycobacterium bovis subsp bovis AF2122/97
ggcccuggccgcgccg

SEQ ID NO: 1038179 - RNA, 19 nt, Mycobacterium bovis subsp bovis AF2122/97
ggccgacaacccggccggg

SEQ ID NO: 1038180 - RNA, 16 nt, Mycobacterium bovis subsp bovis AF2122/97
ggccgaccucggcaac

SEQ ID NO: 1038181 - RNA, 18 nt, Mycobacterium bovis subsp bovis AF2122/97
ggccgaccgcgacccggc

SEQ ID NO: 1038182 - RNA, 21 nt, Mycobacterium bovis subsp bovis AF2122/97
ggccgaccuguaugccgcggu

SEQ ID NO: 1038183 - RNA, 22 nt, Mycobacterium bovis subsp bovis AF2122/97
ggccgaccgggcucuggccagu

SEQ ID NO: 1038184 - RNA, 17 nt, Mycobacterium bovis subsp bovis AF2122/97
ggccgacaaugucggcg

SEQ ID NO: 1038185 - RNA, 17 nt, Mycobacterium bovis subsp bovis AF2122/97
ggccgaacagcugcccg

SEQ ID NO: 1038186 - RNA, 23 nt, Mycobacterium bovis subsp bovis AF2122/97
ggccgaacagcugcccgccagcg

SEQ ID NO: 1038187 - RNA, 15 nt, Mycobacterium bovis subsp bovis AF2122/97
ggccgaacacaccgg

SEQ ID NO: 1038188 - RNA, 21 nt, Mycobacterium bovis subsp bovis AF2122/97
ggccgaaagagccagcggcac

SEQ ID NO: 1038189 - RNA, 17 nt, Mycobacterium bovis subsp bovis AF2122/97
ggccgaaagccaggcgg

SEQ ID NO: 1038190 - RNA, 22 nt, Mycobacterium bovis subsp bovis AF2122/97
ggccgaaagccaggcggcaagg

SEQ ID NO: 1038191 - RNA, 16 nt, Mycobacterium bovis subsp bovis AF2122/97
ggccgaacccaccacg

SEQ ID NO: 1038192 - RNA, 17 nt, Mycobacterium bovis subsp bovis AF2122/97
ggccgaacgggucggcg

SEQ ID NO: 1038193 - RNA, 13 nt, Mycobacterium bovis subsp bovis AF2122/97
ggccgaagaaaac

SEQ ID NO: 1038194 - RNA, 21 nt, Mycobacterium bovis subsp bovis AF2122/97
ggcccuuguggaguacggcga

SEQ ID NO: 1038195 - RNA, 15 nt, Mycobacterium bovis subsp bovis AF2122/97
ggcccuucaccagcc

SEQ ID NO: 1038196 - RNA, 17 nt, Mycobacterium bovis subsp bovis AF2122/97
ggcccuucaccagccac

SEQ ID NO: 1038197 - RNA, 18 nt, Mycobacterium bovis subsp bovis AF2122/97
ggcccugcuugcaggcga

SEQ ID NO: 1038198 - RNA, 21 nt, Mycobacterium bovis subsp bovis AF2122/97
ggccaggcccucgacggcguc

SEQ ID NO: 1038199 - RNA, 22 nt, Mycobacterium bovis subsp bovis AF2122/97
ggccaggcccucgacggcgucg

SEQ ID NO: 1038200 - RNA, 14 nt, Mycobacterium bovis subsp bovis AF2122/97
ggccaggccgucgg

SEQ ID NO: 1038201 - RNA, 15 nt, Mycobacterium bovis subsp bovis AF2122/97
ggccaggccgucggc

SEQ ID NO: 1038202 - RNA, 13 nt, Mycobacterium bovis subsp bovis AF2122/97
ggccaggcgaagu

SEQ ID NO: 1038203 - RNA, 14 nt, Mycobacterium bovis subsp bovis AF2122/97
ggccaggccggcgg

SEQ ID NO: 1038204 - RNA, 20 nt, Mycobacterium bovis subsp bovis AF2122/97
ggccaggaguuugaccaccu

SEQ ID NO: 1038205 - RNA, 18 nt, Mycobacterium bovis subsp bovis AF2122/97
ggcccagcgcccccagca

SEQ ID NO: 1038206 - RNA, 13 nt, Mycobacterium bovis subsp bovis AF2122/97
ggcccagcggccg

SEQ ID NO: 1038207 - RNA, 15 nt, Mycobacterium bovis subsp bovis AF2122/97
ggcccagcggccgcg

SEQ ID NO: 1038208 - RNA, 20 nt, Mycobacterium bovis subsp bovis AF2122/97
ggcccagcuagguccgaacu

SEQ ID NO: 1038209 - RNA, 22 nt, Mycobacterium bovis subsp bovis AF2122/97
ggcccaggacagcagccgccgg

SEQ ID NO: 1038210 - RNA, 23 nt, Mycobacterium bovis subsp bovis AF2122/97
ggcccaggacagcagccgccggc

SEQ ID NO: 1038211 - RNA, 22 nt, Mycobacterium bovis subsp bovis AF2122/97
ggcccagugggacaggucggca

SEQ ID NO: 1038212 - RNA, 23 nt, Mycobacterium bovis subsp bovis AF2122/97
ggcccaguuccgcugcggugccg

SEQ ID NO: 1038213 - RNA, 15 nt, Mycobacterium bovis subsp bovis AF2122/97
ggccccgcggccagc

SEQ ID NO: 1038214 - RNA, 16 nt, Mycobacterium bovis subsp bovis AF2122/97
ggccccgcggcgccgc

SEQ ID NO: 1038215 - RNA, 16 nt, Mycobacterium bovis subsp bovis AF2122/97
ggccccgccgaugccg

SEQ ID NO: 1038216 - RNA, 18 nt, Mycobacterium bovis subsp bovis AF2122/97
ggccccgccgaugccgcc

SEQ ID NO: 1038217 - RNA, 13 nt, Mycobacterium bovis subsp bovis AF2122/97
ggccccgcgccgg

SEQ ID NO: 1038218 - RNA, 16 nt, Mycobacterium bovis subsp bovis AF2122/97
ggccccgcgccggccg

SEQ ID NO: 1038219 - RNA, 17 nt, Mycobacterium bovis subsp bovis AF2122/97
ggccccgcgccggccgc

SEQ ID NO: 1038220 - RNA, 18 nt, Mycobacterium bovis subsp bovis AF2122/97
ggccccgcgccggccgca

SEQ ID NO: 1038221 - RNA, 21 nt, Mycobacterium bovis subsp bovis AF2122/97
ggcccgagccgcgugggccgc

SEQ ID NO: 1038222 - RNA, 15 nt, Mycobacterium bovis subsp bovis AF2122/97
ggcccgacggcgccc

SEQ ID NO: 1038223 - RNA, 15 nt, Mycobacterium bovis subsp bovis AF2122/97
ggcccgaucggcaac

SEQ ID NO: 1038224 - RNA, 20 nt, Mycobacterium bovis subsp bovis AF2122/97
ggccccgccaaaccuggguu

SEQ ID NO: 1038225 - RNA, 15 nt, Mycobacterium bovis subsp bovis AF2122/97
ggcccgaucgaccgc

SEQ ID NO: 1038226 - RNA, 22 nt, Mycobacterium bovis subsp bovis AF2122/97
ggcccgauccagugguaggccg

SEQ ID NO: 1038227 - RNA, 18 nt, Mycobacterium bovis subsp bovis AF2122/97
ggcccgcacccguccggc

SEQ ID NO: 1038228 - RNA, 22 nt, Mycobacterium bovis subsp bovis AF2122/97
ggcccgcaccgcugaccccggc

SEQ ID NO: 1038229 - RNA, 23 nt, Mycobacterium bovis subsp bovis AF2122/97
ggcccgauugaguucggcggcca

SEQ ID NO: 1038230 - RNA, 20 nt, Mycobacterium bovis subsp bovis AF2122/97
ggcccgcaacaucgggucgc

SEQ ID NO: 1038231 - RNA, 21 nt, Mycobacterium bovis subsp bovis AF2122/97
ggcccgcaacgcgucggucgc

SEQ ID NO: 1038232 - RNA, 22 nt, Mycobacterium bovis subsp bovis AF2122/97
ggcccauucaucuugcggcagc

SEQ ID NO: 1038233 - RNA, 20 nt, Mycobacterium bovis subsp bovis AF2122/97
ggccccgccagcgccgccga

SEQ ID NO: 1038234 - RNA, 21 nt, Mycobacterium bovis subsp bovis AF2122/97
ggccccgccagcgccgccgag

SEQ ID NO: 1038235 - RNA, 18 nt, Mycobacterium bovis subsp bovis AF2122/97
ggccccgccagcggcagc

SEQ ID NO: 1038236 - RNA, 22 nt, Mycobacterium bovis subsp bovis AF2122/97
ggcccauugucgaucaccugca

SEQ ID NO: 1038237 - RNA, 16 nt, Mycobacterium bovis subsp bovis AF2122/97
ggccccaccgacagcc

SEQ ID NO: 1038238 - RNA, 14 nt, Mycobacterium bovis subsp bovis AF2122/97
ggccccgcccgcgc

SEQ ID NO: 1038239 - RNA, 14 nt, Mycobacterium bovis subsp bovis AF2122/97
ggccccgccgucgc

SEQ ID NO: 1038240 - RNA, 16 nt, Mycobacterium bovis subsp bovis AF2122/97
ggccccgccgucgccg

SEQ ID NO: 1038241 - RNA, 15 nt, Mycobacterium bovis subsp bovis AF2122/97
ggccccgccguugcc

SEQ ID NO: 1038242 - RNA, 16 nt, Mycobacterium bovis subsp bovis AF2122/97
ggccccgccguugccg

SEQ ID NO: 1038243 - RNA, 18 nt, Mycobacterium bovis subsp bovis AF2122/97
ggccccgccguugccgcc

SEQ ID NO: 1038244 - RNA, 15 nt, Mycobacterium bovis subsp bovis AF2122/97
ggccccgccgaugcg

SEQ ID NO: 1038245 - RNA, 17 nt, Mycobacterium bovis subsp bovis AF2122/97
ggccccgccggccccgc

SEQ ID NO: 1038246 - RNA, 20 nt, Mycobacterium bovis subsp bovis AF2122/97
ggccccgccggccccgccgu

SEQ ID NO: 1038247 - RNA, 14 nt, Mycobacterium bovis subsp bovis AF2122/97
ggccccgccggcgc

SEQ ID NO: 1038248 - RNA, 17 nt, Mycobacterium bovis subsp bovis AF2122/97
ggccccgccggcgccgc

SEQ ID NO: 1038249 - RNA, 19 nt, Mycobacterium bovis subsp bovis AF2122/97
ggccccgccgguggccgcg

SEQ ID NO: 1038250 - RNA, 21 nt, Mycobacterium bovis subsp bovis AF2122/97
ggccccgccgucacccccgau

SEQ ID NO: 1038251 - RNA, 18 nt, Mycobacterium bovis subsp bovis AF2122/97
ggccccgccgucaccgcc

SEQ ID NO: 1038252 - RNA, 22 nt, Mycobacterium bovis subsp bovis AF2122/97
ggcccaucgcgacuagacgccg

SEQ ID NO: 1038253 - RNA, 23 nt, Mycobacterium bovis subsp bovis AF2122/97
ggcccaucgcgacuagacgccgc

SEQ ID NO: 1038254 - RNA, 18 nt, Mycobacterium bovis subsp bovis AF2122/97
ggcccauaacagcuggcg

SEQ ID NO: 1038255 - RNA, 15 nt, Mycobacterium bovis subsp bovis AF2122/97
ggcccauacgugccg

SEQ ID NO: 1038256 - RNA, 15 nt, Mycobacterium bovis subsp bovis AF2122/97
ggcccaucgggcgcc

SEQ ID NO: 1038257 - RNA, 16 nt, Mycobacterium bovis subsp bovis AF2122/97
ggcccaucgggcgccc

SEQ ID NO: 1038258 - RNA, 17 nt, Mycobacterium bovis subsp bovis AF2122/97
ggcccaugcagcggcga

SEQ ID NO: 1038259 - RNA, 12 nt, Mycobacterium bovis subsp bovis AF2122/97
ggccagcgcgcc

SEQ ID NO: 1038260 - RNA, 13 nt, Mycobacterium bovis subsp bovis AF2122/97
ggccagcgcggcg

SEQ ID NO: 1038261 - RNA, 18 nt, Mycobacterium bovis subsp bovis AF2122/97
ggccagcgcggcgagggc

SEQ ID NO: 1038262 - RNA, 15 nt, Mycobacterium bovis subsp bovis AF2122/97
ggccagcgcggcguc

SEQ ID NO: 1038263 - RNA, 15 nt, Mycobacterium bovis subsp bovis AF2122/97
ggccagcgcucaccg

SEQ ID NO: 1038264 - RNA, 18 nt, Mycobacterium bovis subsp bovis AF2122/97
ggccagcgcucaccggcg

SEQ ID NO: 1038265 - RNA, 19 nt, Mycobacterium bovis subsp bovis AF2122/97
ggccagcgcucaccggcgu

SEQ ID NO: 1038266 - RNA, 21 nt, Mycobacterium bovis subsp bovis AF2122/97
ggccagcgcucaccggcgucg

SEQ ID NO: 1038267 - RNA, 20 nt, Mycobacterium bovis subsp bovis AF2122/97
ggccagcgcuucgucggccg

SEQ ID NO: 1038268 - RNA, 22 nt, Mycobacterium bovis subsp bovis AF2122/97
ggccagcgcuucgucggccggc

SEQ ID NO: 1038269 - RNA, 11 nt, Mycobacterium bovis subsp bovis AF2122/97
ggccagcggcc

SEQ ID NO: 1038270 - RNA, 18 nt, Mycobacterium bovis subsp bovis AF2122/97
ggccagcagaaacaucga

SEQ ID NO: 1038271 - RNA, 22 nt, Mycobacterium bovis subsp bovis AF2122/97
ggccagcagaaacaucgacagc

SEQ ID NO: 1038272 - RNA, 22 nt, Mycobacterium bovis subsp bovis AF2122/97
ggccagcaucagcucgaugccg

SEQ ID NO: 1038273 - RNA, 21 nt, Mycobacterium bovis subsp bovis AF2122/97
ggccagcaccacggccagcgg

SEQ ID NO: 1038274 - RNA, 14 nt, Mycobacterium bovis subsp bovis AF2122/97
ggccagcaucauca

SEQ ID NO: 1038275 - RNA, 18 nt, Mycobacterium bovis subsp bovis AF2122/97
ggccagcaugucgggccg

SEQ ID NO: 1038276 - RNA, 20 nt, Mycobacterium bovis subsp bovis AF2122/97
ggccagcaugucgggccgcu

SEQ ID NO: 1038277 - RNA, 18 nt, Mycobacterium bovis subsp bovis AF2122/97
ggccagcgccucggcauc

SEQ ID NO: 1038278 - RNA, 12 nt, Mycobacterium bovis subsp bovis AF2122/97
ggccagccaugg

SEQ ID NO: 1038279 - RNA, 17 nt, Mycobacterium bovis subsp bovis AF2122/97
ggccagccacagccgac

SEQ ID NO: 1038280 - RNA, 19 nt, Mycobacterium bovis subsp bovis AF2122/97
ggccagccauggcagcgcc

SEQ ID NO: 1038281 - RNA, 16 nt, Mycobacterium bovis subsp bovis AF2122/97
ggccagcccagccggg

SEQ ID NO: 1038282 - RNA, 14 nt, Mycobacterium bovis subsp bovis AF2122/97
ggccagccagcggg

SEQ ID NO: 1038283 - RNA, 21 nt, Mycobacterium bovis subsp bovis AF2122/97
ggccagccagcgggcgaugag

SEQ ID NO: 1038284 - RNA, 23 nt, Mycobacterium bovis subsp bovis AF2122/97
ggccagccagcgggcgaugagcg

SEQ ID NO: 1038285 - RNA, 23 nt, Mycobacterium bovis subsp bovis AF2122/97
ggccagcuccucagccaccgcgg

SEQ ID NO: 1038286 - RNA, 17 nt, Mycobacterium bovis subsp bovis AF2122/97
ggccagcucgcgggccg

SEQ ID NO: 1038287 - RNA, 21 nt, Mycobacterium bovis subsp bovis AF2122/97
ggccagcugcggcuccggcgg

SEQ ID NO: 1038288 - RNA, 22 nt, Mycobacterium bovis subsp bovis AF2122/97
ggccagcugcggcuccggcggc

SEQ ID NO: 1038289 - RNA, 14 nt, Mycobacterium bovis subsp bovis AF2122/97
ggccagcugcgugg

SEQ ID NO: 1038290 - RNA, 21 nt, Mycobacterium bovis subsp bovis AF2122/97
ggccagcuccucagccaccgc

SEQ ID NO: 1038291 - RNA, 21 nt, Mycobacterium bovis subsp bovis AF2122/97
ggccagcugcagcagacccgg

SEQ ID NO: 1038292 - RNA, 18 nt, Mycobacterium bovis subsp bovis AF2122/97
ggccagcgugucccaacg

SEQ ID NO: 1038293 - RNA, 22 nt, Mycobacterium bovis subsp bovis AF2122/97
ggccagcgugucccaacgccac

SEQ ID NO: 1038294 - RNA, 20 nt, Mycobacterium bovis subsp bovis AF2122/97
ggccagcgucaacagcgugg

SEQ ID NO: 1038295 - RNA, 23 nt, Mycobacterium bovis subsp bovis AF2122/97
ggccagcgguaaugccagcggca

SEQ ID NO: 1038296 - RNA, 20 nt, Mycobacterium bovis subsp bovis AF2122/97
ggccagcgggugaaucgaca

SEQ ID NO: 1038297 - RNA, 21 nt, Mycobacterium bovis subsp bovis AF2122/97
ggccagcgggaacacaccgca

SEQ ID NO: 1038298 - RNA, 23 nt, Mycobacterium bovis subsp bovis AF2122/97
ggccacgggaguacgggagccgg

SEQ ID NO: 1038299 - RNA, 21 nt, Mycobacterium bovis subsp bovis AF2122/97
ggccacgcuucuuccgcgcgc

SEQ ID NO: 1038300 - RNA, 21 nt, Mycobacterium bovis subsp bovis AF2122/97
ggccacguccucagccgugcc

SEQ ID NO: 1038301 - RNA, 21 nt, Mycobacterium bovis subsp bovis AF2122/97
ggccacguccugcccgucguc

SEQ ID NO: 1038302 - RNA, 22 nt, Mycobacterium bovis subsp bovis AF2122/97
ggccacuacggccuggccaccu

SEQ ID NO: 1038303 - RNA, 18 nt, Mycobacterium bovis subsp bovis AF2122/97
ggccagcacaccgucgac

SEQ ID NO: 1038304 - RNA, 20 nt, Mycobacterium bovis subsp bovis AF2122/97
ggccagcacaccgucgacga

SEQ ID NO: 1038305 - RNA, 22 nt, Mycobacterium bovis subsp bovis AF2122/97
ggccagcaacuuugagcagaag

SEQ ID NO: 1038306 - RNA, 16 nt, Mycobacterium bovis subsp bovis AF2122/97
ggccagcaagacgaug

SEQ ID NO: 1038307 - RNA, 21 nt, Mycobacterium bovis subsp bovis AF2122/97
ggccagcaaguacgcgucggu

SEQ ID NO: 1038308 - RNA, 15 nt, Mycobacterium bovis subsp bovis AF2122/97
ggccagcaccacggc

SEQ ID NO: 1038309 - RNA, 19 nt, Mycobacterium bovis subsp bovis AF2122/97
ggccagcaccacggccagc

SEQ ID NO: 1038310 - RNA, 12 nt, Mycobacterium bovis subsp bovis AF2122/97
ggccagcaccgg

SEQ ID NO: 1038311 - RNA, 13 nt, Mycobacterium bovis subsp bovis AF2122/97
ggccagcacccga

SEQ ID NO: 1038312 - RNA, 18 nt, Mycobacterium bovis subsp bovis AF2122/97
ggccagcacccgaaccgg

SEQ ID NO: 1038313 - RNA, 21 nt, Mycobacterium bovis subsp bovis AF2122/97
ggccagcacccgaaccgggga

SEQ ID NO: 1038314 - RNA, 23 nt, Mycobacterium bovis subsp bovis AF2122/97
ggccagcacccgcuccagcucgg

SEQ ID NO: 1038315 - RNA, 23 nt, Mycobacterium bovis subsp bovis AF2122/97
ggccagcaccggggacagcccgg

SEQ ID NO: 1038316 - RNA, 11 nt, Mycobacterium bovis subsp bovis AF2122/97
ggccagcacgg

SEQ ID NO: 1038317 - RNA, 14 nt, Mycobacterium bovis subsp bovis AF2122/97
ggccagcacggcga

SEQ ID NO: 1038318 - RNA, 17 nt, Mycobacterium bovis subsp bovis AF2122/97
ggccagcacgccgccgg

SEQ ID NO: 1038319 - RNA, 22 nt, Mycobacterium bovis subsp bovis AF2122/97
ggccagcacgccgccggccgcc

SEQ ID NO: 1038320 - RNA, 23 nt, Mycobacterium bovis subsp bovis AF2122/97
ggccagcacgccgccggccgcca

SEQ ID NO: 1038321 - RNA, 16 nt, Mycobacterium bovis subsp bovis AF2122/97
ggccagcacggcuugg

SEQ ID NO: 1038322 - RNA, 16 nt, Mycobacterium bovis subsp bovis AF2122/97
ggccagcagagcggca

SEQ ID NO: 1038323 - RNA, 19 nt, Mycobacterium bovis subsp bovis AF2122/97
ggccagcagagcggcacgc

SEQ ID NO: 1038324 - RNA, 19 nt, Mycobacterium bovis subsp bovis AF2122/97
ggccagcagcaaccgccau

SEQ ID NO: 1038325 - RNA, 16 nt, Mycobacterium bovis subsp bovis AF2122/97
ggccaccgccgccgcc

SEQ ID NO: 1038326 - RNA, 22 nt, Mycobacterium bovis subsp bovis AF2122/97
ggccaccggacgaaacgaucgc

SEQ ID NO: 1038327 - RNA, 23 nt, Mycobacterium bovis subsp bovis AF2122/97
ggccaccggacgaaacgaucgcg

SEQ ID NO: 1038328 - RNA, 11 nt, Mycobacterium bovis subsp bovis AF2122/97
ggccaccggcg

SEQ ID NO: 1038329 - RNA, 15 nt, Mycobacterium bovis subsp bovis AF2122/97
ggccaccggcgaccg

SEQ ID NO: 1038330 - RNA, 15 nt, Mycobacterium bovis subsp bovis AF2122/97
ggccaccggcgccgu

SEQ ID NO: 1038331 - RNA, 16 nt, Mycobacterium bovis subsp bovis AF2122/97
ggccaccggcgccgug

SEQ ID NO: 1038332 - RNA, 17 nt, Mycobacterium bovis subsp bovis AF2122/97
ggccaccggggucaccu

SEQ ID NO: 1038333 - RNA, 17 nt, Mycobacterium bovis subsp bovis AF2122/97
ggccaccggcggugccg

SEQ ID NO: 1038334 - RNA, 21 nt, Mycobacterium bovis subsp bovis AF2122/97
ggccaccggcugcaaccagcg

SEQ ID NO: 1038335 - RNA, 13 nt, Mycobacterium bovis subsp bovis AF2122/97
ggccaccggcggu

SEQ ID NO: 1038336 - RNA, 14 nt, Mycobacterium bovis subsp bovis AF2122/97
ggccaccggcgguc

SEQ ID NO: 1038337 - RNA, 20 nt, Mycobacterium bovis subsp bovis AF2122/97
ggccaccuccgaggccgcca

SEQ ID NO: 1038338 - RNA, 19 nt, Mycobacterium bovis subsp bovis AF2122/97
ggccaccguaaacagcgcg

SEQ ID NO: 1038339 - RNA, 13 nt, Mycobacterium bovis subsp bovis AF2122/97
ggccaccgucgcg

SEQ ID NO: 1038340 - RNA, 14 nt, Mycobacterium bovis subsp bovis AF2122/97
ggccaccucgggug

SEQ ID NO: 1038341 - RNA, 13 nt, Mycobacterium bovis subsp bovis AF2122/97
ggccaacagucgc

SEQ ID NO: 1038342 - RNA, 23 nt, Mycobacterium bovis subsp bovis AF2122/97
ggccaacauccgguggugcucgu

SEQ ID NO: 1038343 - RNA, 15 nt, Mycobacterium bovis subsp bovis AF2122/97
ggccacccgguggcg

SEQ ID NO: 1038344 - RNA, 15 nt, Mycobacterium bovis subsp bovis AF2122/97
ggccacccgcgcgau

SEQ ID NO: 1038345 - RNA, 15 nt, Mycobacterium bovis subsp bovis AF2122/97
ggccaaccaccaacu

SEQ ID NO: 1038346 - RNA, 18 nt, Mycobacterium bovis subsp bovis AF2122/97
ggccacccggccgcgcgg

SEQ ID NO: 1038347 - RNA, 17 nt, Mycobacterium bovis subsp bovis AF2122/97
ggccaccgagucgauca

SEQ ID NO: 1038348 - RNA, 19 nt, Mycobacterium bovis subsp bovis AF2122/97
ggccacccgcgcgaugcug

SEQ ID NO: 1038349 - RNA, 15 nt, Mycobacterium bovis subsp bovis AF2122/97
ggccaacaccgccag

SEQ ID NO: 1038350 - RNA, 14 nt, Mycobacterium bovis subsp bovis AF2122/97
ggccaaagcgcggg

SEQ ID NO: 1038351 - RNA, 22 nt, Mycobacterium bovis subsp bovis AF2122/97
ggccaaaauuuugucggccgcc

SEQ ID NO: 1038352 - RNA, 13 nt, Mycobacterium bovis subsp bovis AF2122/97
ggccaaaauggcg

SEQ ID NO: 1038353 - RNA, 12 nt, Mycobacterium bovis subsp bovis AF2122/97
ggcaugcucugg

SEQ ID NO: 1038354 - RNA, 19 nt, Mycobacterium bovis subsp bovis AF2122/97
ggcaucgcgcaaccgggcg

SEQ ID NO: 1038355 - RNA, 14 nt, Mycobacterium bovis subsp bovis AF2122/97
ggcaucgcggaagc

SEQ ID NO: 1038356 - RNA, 21 nt, Mycobacterium bovis subsp bovis AF2122/97
ggcaucgcggaagcgggcgau

SEQ ID NO: 1038357 - RNA, 23 nt, Mycobacterium bovis subsp bovis AF2122/97
ggcaucggccuguucgccgucgc

SEQ ID NO: 1038358 - RNA, 12 nt, Mycobacterium bovis subsp bovis AF2122/97
ggcaucgccgcg

SEQ ID NO: 1038359 - RNA, 17 nt, Mycobacterium bovis subsp bovis AF2122/97
ggcaucgcgcgcggcuc

SEQ ID NO: 1038360 - RNA, 23 nt, Mycobacterium bovis subsp bovis AF2122/97
ggcaucgccuccaggcgccaccc

SEQ ID NO: 1038361 - RNA, 14 nt, Mycobacterium bovis subsp bovis AF2122/97
ggcaucggcggcaa

SEQ ID NO: 1038362 - RNA, 20 nt, Mycobacterium bovis subsp bovis AF2122/97
ggcaucggcggcaacggcgg

SEQ ID NO: 1038363 - RNA, 16 nt, Mycobacterium bovis subsp bovis AF2122/97
ggcaucggcggcaagg

SEQ ID NO: 1038364 - RNA, 15 nt, Mycobacterium bovis subsp bovis AF2122/97
ggcaucggcggcguc

SEQ ID NO: 1038365 - RNA, 22 nt, Mycobacterium bovis subsp bovis AF2122/97
ggcaucggugaucaaaccggcg

SEQ ID NO: 1038366 - RNA, 21 nt, Mycobacterium bovis subsp bovis AF2122/97
ggcaucggugccacggcaccg

SEQ ID NO: 1038367 - RNA, 14 nt, Mycobacterium bovis subsp bovis AF2122/97
ggcaucgucgacgc

SEQ ID NO: 1038368 - RNA, 12 nt, Mycobacterium bovis subsp bovis AF2122/97
ggcaucguccac

SEQ ID NO: 1038369 - RNA, 14 nt, Mycobacterium bovis subsp bovis AF2122/97
ggcaucguccacgc

SEQ ID NO: 1038370 - RNA, 17 nt, Mycobacterium bovis subsp bovis AF2122/97
ggcaucuccaccgucgc

SEQ ID NO: 1038371 - RNA, 15 nt, Mycobacterium bovis subsp bovis AF2122/97
ggcaucucgcaccgc

SEQ ID NO: 1038372 - RNA, 20 nt, Mycobacterium bovis subsp bovis AF2122/97
ggcaugccggcgugcggcga

SEQ ID NO: 1038373 - RNA, 14 nt, Mycobacterium bovis subsp bovis AF2122/97
ggcauuggcgucgu

SEQ ID NO: 1038374 - RNA, 16 nt, Mycobacterium bovis subsp bovis AF2122/97
ggcaugcccgcgguga

SEQ ID NO: 1038375 - RNA, 22 nt, Mycobacterium bovis subsp bovis AF2122/97
ggcaugcccgcggugaccaccc

SEQ ID NO: 1038376 - RNA, 14 nt, Mycobacterium bovis subsp bovis AF2122/97
ggcaugcgugccgg

SEQ ID NO: 1038377 - RNA, 21 nt, Mycobacterium bovis subsp bovis AF2122/97
ggcaugaagcaguuggccgag

SEQ ID NO: 1038378 - RNA, 14 nt, Mycobacterium bovis subsp bovis AF2122/97
ggcaugcagcccca

SEQ ID NO: 1038379 - RNA, 12 nt, Mycobacterium bovis subsp bovis AF2122/97
ggcaugccacac

SEQ ID NO: 1038380 - RNA, 16 nt, Mycobacterium bovis subsp bovis AF2122/97
ggcaugaccgcugccg

SEQ ID NO: 1038381 - RNA, 20 nt, Mycobacterium bovis subsp bovis AF2122/97
ggcaugacgaaugcgggugg

SEQ ID NO: 1038382 - RNA, 17 nt, Mycobacterium bovis subsp bovis AF2122/97
ggcaucgaacgcccuga

SEQ ID NO: 1038383 - RNA, 16 nt, Mycobacterium bovis subsp bovis AF2122/97
ggcaucgacugccagc

SEQ ID NO: 1038384 - RNA, 15 nt, Mycobacterium bovis subsp bovis AF2122/97
ggcaucgaguucggc

SEQ ID NO: 1038385 - RNA, 18 nt, Mycobacterium bovis subsp bovis AF2122/97
ggcaucgaguucggcccg

SEQ ID NO: 1038386 - RNA, 14 nt, Mycobacterium bovis subsp bovis AF2122/97
ggcaucgaucaaca

SEQ ID NO: 1038387 - RNA, 11 nt, Mycobacterium bovis subsp bovis AF2122/97
ggcaucccgcc

SEQ ID NO: 1038388 - RNA, 13 nt, Mycobacterium bovis subsp bovis AF2122/97
ggcauccugcacg

SEQ ID NO: 1038389 - RNA, 17 nt, Mycobacterium bovis subsp bovis AF2122/97
ggcauccuucaccagcu

SEQ ID NO: 1038390 - RNA, 14 nt, Mycobacterium bovis subsp bovis AF2122/97
ggcauccgccccgc

SEQ ID NO: 1038391 - RNA, 17 nt, Mycobacterium bovis subsp bovis AF2122/97
ggcauccgccccgcccg

SEQ ID NO: 1038392 - RNA, 15 nt, Mycobacterium bovis subsp bovis AF2122/97
ggcagucccagcgcc

SEQ ID NO: 1038393 - RNA, 14 nt, Mycobacterium bovis subsp bovis AF2122/97
ggcaguccaccgcg

SEQ ID NO: 1038394 - RNA, 15 nt, Mycobacterium bovis subsp bovis AF2122/97
ggcaguccaccgcgc

SEQ ID NO: 1038395 - RNA, 14 nt, Mycobacterium bovis subsp bovis AF2122/97
ggcaguccagccgg

SEQ ID NO: 1038396 - RNA, 14 nt, Mycobacterium bovis subsp bovis AF2122/97
ggcagugcaggcgg

SEQ ID NO: 1038397 - RNA, 17 nt, Mycobacterium bovis subsp bovis AF2122/97
ggcauccaacgcggcgc

SEQ ID NO: 1038398 - RNA, 20 nt, Mycobacterium bovis subsp bovis AF2122/97
ggcagugagggucccacggc

SEQ ID NO: 1038399 - RNA, 21 nt, Mycobacterium bovis subsp bovis AF2122/97
ggcagugaaauugccgccgcc

SEQ ID NO: 1038400 - RNA, 17 nt, Mycobacterium bovis subsp bovis AF2122/97
ggcaguaucaucggcgc

SEQ ID NO: 1038401 - RNA, 20 nt, Mycobacterium bovis subsp bovis AF2122/97
ggcaguaucaucggcgcugg

SEQ ID NO: 1038402 - RNA, 19 nt, Mycobacterium bovis subsp bovis AF2122/97
ggcaguagugaucgaucgc

SEQ ID NO: 1038403 - RNA, 15 nt, Mycobacterium bovis subsp bovis AF2122/97
ggcagguaacacucg

SEQ ID NO: 1038404 - RNA, 19 nt, Mycobacterium bovis subsp bovis AF2122/97
ggcagguaacacucgaagu

SEQ ID NO: 1038405 - RNA, 17 nt, Mycobacterium bovis subsp bovis AF2122/97
ggcaggguggccagcag

SEQ ID NO: 1038406 - RNA, 21 nt, Mycobacterium bovis subsp bovis AF2122/97
ggcaggguggccagcaggcgg

SEQ ID NO: 1038407 - RNA, 13 nt, Mycobacterium bovis subsp bovis AF2122/97
ggcaguacaccgg

SEQ ID NO: 1038408 - RNA, 16 nt, Mycobacterium bovis subsp bovis AF2122/97
ggcaguacaccggcgu

SEQ ID NO: 1038409 - RNA, 22 nt, Mycobacterium bovis subsp bovis AF2122/97
ggcaguacaccggcgugcugug

SEQ ID NO: 1038410 - RNA, 14 nt, Mycobacterium bovis subsp bovis AF2122/97
ggcaggcgaaggcg

SEQ ID NO: 1038411 - RNA, 16 nt, Mycobacterium bovis subsp bovis AF2122/97
ggcagggccagcggca

SEQ ID NO: 1038412 - RNA, 18 nt, Mycobacterium bovis subsp bovis AF2122/97
ggcagggccagcggcagc

SEQ ID NO: 1038413 - RNA, 21 nt, Mycobacterium bovis subsp bovis AF2122/97
ggcagggcccccaguucggcg

SEQ ID NO: 1038414 - RNA, 13 nt, Mycobacterium bovis subsp bovis AF2122/97
ggcaggcuggcga

SEQ ID NO: 1038415 - RNA, 16 nt, Mycobacterium bovis subsp bovis AF2122/97
ggcagcgcggccaccc

SEQ ID NO: 1038416 - RNA, 18 nt, Mycobacterium bovis subsp bovis AF2122/97
ggcagcggcgaucggagg

SEQ ID NO: 1038417 - RNA, 21 nt, Mycobacterium bovis subsp bovis AF2122/97
ggcagcggcgguaugcucgcu

SEQ ID NO: 1038418 - RNA, 20 nt, Mycobacterium bovis subsp bovis AF2122/97
ggcagcgggacugcggaagc

SEQ ID NO: 1038419 - RNA, 22 nt, Mycobacterium bovis subsp bovis AF2122/97
ggcagcggugcugguggcggca

SEQ ID NO: 1038420 - RNA, 19 nt, Mycobacterium bovis subsp bovis AF2122/97
ggcagcgggacugcggaag

SEQ ID NO: 1038421 - RNA, 16 nt, Mycobacterium bovis subsp bovis AF2122/97
ggcagcgguguagccg

SEQ ID NO: 1038422 - RNA, 17 nt, Mycobacterium bovis subsp bovis AF2122/97
ggcagcgguguagccgg

SEQ ID NO: 1038423 - RNA, 18 nt, Mycobacterium bovis subsp bovis AF2122/97
ggcagcgguguagccggc

SEQ ID NO: 1038424 - RNA, 21 nt, Mycobacterium bovis subsp bovis AF2122/97
ggcagcgguguagccggcgcc

SEQ ID NO: 1038425 - RNA, 14 nt, Mycobacterium bovis subsp bovis AF2122/97
ggcagcgucgucga

SEQ ID NO: 1038426 - RNA, 19 nt, Mycobacterium bovis subsp bovis AF2122/97
ggcagcgucgucgacgaca

SEQ ID NO: 1038427 - RNA, 15 nt, Mycobacterium bovis subsp bovis AF2122/97
ggcagcguccgaacc

SEQ ID NO: 1038428 - RNA, 22 nt, Mycobacterium bovis subsp bovis AF2122/97
ggcaggccggccaccgagucga

SEQ ID NO: 1038429 - RNA, 16 nt, Mycobacterium bovis subsp bovis AF2122/97
ggcagcguagugcugc

SEQ ID NO: 1038430 - RNA, 23 nt, Mycobacterium bovis subsp bovis AF2122/97
ggcaggccgcugggccgaccgcc

SEQ ID NO: 1038431 - RNA, 12 nt, Mycobacterium bovis subsp bovis AF2122/97
ggcaggccggcg

SEQ ID NO: 1038432 - RNA, 13 nt, Mycobacterium bovis subsp bovis AF2122/97
ggcaggccggcgu

SEQ ID NO: 1038433 - RNA, 14 nt, Mycobacterium bovis subsp bovis AF2122/97
ggcaggccggcguc

SEQ ID NO: 1038434 - RNA, 22 nt, Mycobacterium bovis subsp bovis AF2122/97
ggcagaccggugcugucgacgu

SEQ ID NO: 1038435 - RNA, 19 nt, Mycobacterium bovis subsp bovis AF2122/97
ggcagacaucugggugaac

SEQ ID NO: 1038436 - RNA, 21 nt, Mycobacterium bovis subsp bovis AF2122/97
ggcagcgcgaggcucguggcg

SEQ ID NO: 1038437 - RNA, 15 nt, Mycobacterium bovis subsp bovis AF2122/97
ggcagcgcgcccgac

SEQ ID NO: 1038438 - RNA, 14 nt, Mycobacterium bovis subsp bovis AF2122/97
ggcagcgcggcacc

SEQ ID NO: 1038439 - RNA, 21 nt, Mycobacterium bovis subsp bovis AF2122/97
ggcagcggcaucggccagccg

SEQ ID NO: 1038440 - RNA, 13 nt, Mycobacterium bovis subsp bovis AF2122/97
ggcagcgcuggcu

SEQ ID NO: 1038441 - RNA, 21 nt, Mycobacterium bovis subsp bovis AF2122/97
ggcagcggaccgcugccugcc

SEQ ID NO: 1038442 - RNA, 13 nt, Mycobacterium bovis subsp bovis AF2122/97
ggcagcggcgcgg

SEQ ID NO: 1038443 - RNA, 16 nt, Mycobacterium bovis subsp bovis AF2122/97
ggcagcggcgcgguuu

SEQ ID NO: 1038444 - RNA, 15 nt, Mycobacterium bovis subsp bovis AF2122/97
ggcagcggccuccgg

SEQ ID NO: 1038445 - RNA, 13 nt, Mycobacterium bovis subsp bovis AF2122/97
ggcagcggcgauc

SEQ ID NO: 1038446 - RNA, 14 nt, Mycobacterium bovis subsp bovis AF2122/97
ggcagcgcggccgg

SEQ ID NO: 1038447 - RNA, 14 nt, Mycobacterium bovis subsp bovis AF2122/97
ggcacugguggcga

SEQ ID NO: 1038448 - RNA, 17 nt, Mycobacterium bovis subsp bovis AF2122/97
ggcacuuccagcccggc

SEQ ID NO: 1038449 - RNA, 17 nt, Mycobacterium bovis subsp bovis AF2122/97
ggcacuugcccgucggc

SEQ ID NO: 1038450 - RNA, 19 nt, Mycobacterium bovis subsp bovis AF2122/97
ggcacuugcccgucggcgc

SEQ ID NO: 1038451 - RNA, 14 nt, Mycobacterium bovis subsp bovis AF2122/97
ggcacugccggcac

SEQ ID NO: 1038452 - RNA, 16 nt, Mycobacterium bovis subsp bovis AF2122/97
ggcacugccggcacgc

SEQ ID NO: 1038453 - RNA, 15 nt, Mycobacterium bovis subsp bovis AF2122/97
ggcacugcgaucgcg

SEQ ID NO: 1038454 - RNA, 15 nt, Mycobacterium bovis subsp bovis AF2122/97
ggcacugaccgcgau

SEQ ID NO: 1038455 - RNA, 17 nt, Mycobacterium bovis subsp bovis AF2122/97
ggcacugacgcgcccga

SEQ ID NO: 1038456 - RNA, 16 nt, Mycobacterium bovis subsp bovis AF2122/97
ggcacugcgaucgcga

SEQ ID NO: 1038457 - RNA, 17 nt, Mycobacterium bovis subsp bovis AF2122/97
ggcagaauugucaacga

SEQ ID NO: 1038458 - RNA, 17 nt, Mycobacterium bovis subsp bovis AF2122/97
ggcagacacgcugcagg

SEQ ID NO: 1038459 - RNA, 15 nt, Mycobacterium bovis subsp bovis AF2122/97
ggcagaccaacgcuc

SEQ ID NO: 1038460 - RNA, 21 nt, Mycobacterium bovis subsp bovis AF2122/97
ggcacccacuuuucgguggcg

SEQ ID NO: 1038461 - RNA, 19 nt, Mycobacterium bovis subsp bovis AF2122/97
ggcaccccgaucacccgca

SEQ ID NO: 1038462 - RNA, 21 nt, Mycobacterium bovis subsp bovis AF2122/97
ggcaccccgaucacccgcagg

SEQ ID NO: 1038463 - RNA, 23 nt, Mycobacterium bovis subsp bovis AF2122/97
ggcaccccgaucacccgcaggua

SEQ ID NO: 1038464 - RNA, 14 nt, Mycobacterium bovis subsp bovis AF2122/97
ggcacccccgucgc

SEQ ID NO: 1038465 - RNA, 15 nt, Mycobacterium bovis subsp bovis AF2122/97
ggcacccccgacgag

SEQ ID NO: 1038466 - RNA, 16 nt, Mycobacterium bovis subsp bovis AF2122/97
ggcacccccgacgaga

SEQ ID NO: 1038467 - RNA, 19 nt, Mycobacterium bovis subsp bovis AF2122/97
ggcacccaaccaggccgcg

SEQ ID NO: 1038468 - RNA, 19 nt, Mycobacterium bovis subsp bovis AF2122/97
ggcacccagucggcgccgc

SEQ ID NO: 1038469 - RNA, 22 nt, Mycobacterium bovis subsp bovis AF2122/97
ggcacccaguuccacccggugc

SEQ ID NO: 1038470 - RNA, 23 nt, Mycobacterium bovis subsp bovis AF2122/97
ggcacccaucccguucagcgacc

SEQ ID NO: 1038471 - RNA, 24 nt, Mycobacterium bovis subsp bovis AF2122/97
ggcacccaucccguucagcgacca

SEQ ID NO: 1038472 - RNA, 19 nt, Mycobacterium bovis subsp bovis AF2122/97
ggcaccccacgccugccga

SEQ ID NO: 1038473 - RNA, 12 nt, Mycobacterium bovis subsp bovis AF2122/97
ggcaccagcgaa

SEQ ID NO: 1038474 - RNA, 20 nt, Mycobacterium bovis subsp bovis AF2122/97
ggcaccagaucuucgagcgc

SEQ ID NO: 1038475 - RNA, 19 nt, Mycobacterium bovis subsp bovis AF2122/97
ggcaccagcgcgcgccgag

SEQ ID NO: 1038476 - RNA, 16 nt, Mycobacterium bovis subsp bovis AF2122/97
ggcaccagcggcaccg

SEQ ID NO: 1038477 - RNA, 18 nt, Mycobacterium bovis subsp bovis AF2122/97
ggcaccagcggcaccgcg

SEQ ID NO: 1038478 - RNA, 21 nt, Mycobacterium bovis subsp bovis AF2122/97
ggcaccauguacaggcugucc

SEQ ID NO: 1038479 - RNA, 12 nt, Mycobacterium bovis subsp bovis AF2122/97
ggcacagccagu

SEQ ID NO: 1038480 - RNA, 19 nt, Mycobacterium bovis subsp bovis AF2122/97
ggcacaccgacgccgccag

SEQ ID NO: 1038481 - RNA, 15 nt, Mycobacterium bovis subsp bovis AF2122/97
ggcacaccgguggcg

SEQ ID NO: 1038482 - RNA, 14 nt, Mycobacterium bovis subsp bovis AF2122/97
ggcacaggcggcca

SEQ ID NO: 1038483 - RNA, 16 nt, Mycobacterium bovis subsp bovis AF2122/97
ggcacaggcggccagc

SEQ ID NO: 1038484 - RNA, 18 nt, Mycobacterium bovis subsp bovis AF2122/97
ggcacaucgcgaaaccgg

SEQ ID NO: 1038485 - RNA, 22 nt, Mycobacterium bovis subsp bovis AF2122/97
ggcaccacccuugccgaugacg

SEQ ID NO: 1038486 - RNA, 16 nt, Mycobacterium bovis subsp bovis AF2122/97
ggcaccacccggcgaa

SEQ ID NO: 1038487 - RNA, 18 nt, Mycobacterium bovis subsp bovis AF2122/97
ggcaccaccccgaggccg

SEQ ID NO: 1038488 - RNA, 17 nt, Mycobacterium bovis subsp bovis AF2122/97
ggcaccaauaccgcacc

SEQ ID NO: 1038489 - RNA, 19 nt, Mycobacterium bovis subsp bovis AF2122/97
ggcaccaaugcggugacaa

SEQ ID NO: 1038490 - RNA, 18 nt, Mycobacterium bovis subsp bovis AF2122/97
ggcaccaccaagcucggc

SEQ ID NO: 1038491 - RNA, 16 nt, Mycobacterium bovis subsp bovis AF2122/97
ggcaccccuuugacgc

SEQ ID NO: 1038492 - RNA, 19 nt, Mycobacterium bovis subsp bovis AF2122/97
ggcaccccggugcccgcgg

SEQ ID NO: 1038493 - RNA, 14 nt, Mycobacterium bovis subsp bovis AF2122/97
ggcacccgcggcga

SEQ ID NO: 1038494 - RNA, 22 nt, Mycobacterium bovis subsp bovis AF2122/97
ggcacccgccggauucgcccgg

SEQ ID NO: 1038495 - RNA, 23 nt, Mycobacterium bovis subsp bovis AF2122/97
ggcacccgccgugcccccggcuu

SEQ ID NO: 1038496 - RNA, 15 nt, Mycobacterium bovis subsp bovis AF2122/97
ggcacccggggugcc

SEQ ID NO: 1038497 - RNA, 20 nt, Mycobacterium bovis subsp bovis AF2122/97
ggcacccggggugcccggcc

SEQ ID NO: 1038498 - RNA, 22 nt, Mycobacterium bovis subsp bovis AF2122/97
ggcacccggggugcccggccgc

SEQ ID NO: 1038499 - RNA, 14 nt, Mycobacterium bovis subsp bovis AF2122/97
ggcacccgcuggcg

SEQ ID NO: 1038500 - RNA, 19 nt, Mycobacterium bovis subsp bovis AF2122/97
ggcaccccuuugacgccga

SEQ ID NO: 1038501 - RNA, 23 nt, Mycobacterium bovis subsp bovis AF2122/97
ggcacccgcgucgagugccgcca

SEQ ID NO: 1038502 - RNA, 16 nt, Mycobacterium bovis subsp bovis AF2122/97
ggcacccugcggcacc

SEQ ID NO: 1038503 - RNA, 20 nt, Mycobacterium bovis subsp bovis AF2122/97
ggcacccgcuggcgguaagc

SEQ ID NO: 1038504 - RNA, 16 nt, Mycobacterium bovis subsp bovis AF2122/97
ggcacccuccgccggu

SEQ ID NO: 1038505 - RNA, 18 nt, Mycobacterium bovis subsp bovis AF2122/97
ggcaccgaagucgaugau

SEQ ID NO: 1038506 - RNA, 19 nt, Mycobacterium bovis subsp bovis AF2122/97
ggcacccuugccgauuccg

SEQ ID NO: 1038507 - RNA, 18 nt, Mycobacterium bovis subsp bovis AF2122/97
ggcaccgauggcgcaccg

SEQ ID NO: 1038508 - RNA, 21 nt, Mycobacterium bovis subsp bovis AF2122/97
ggcaccgauggcgcaccggcg

SEQ ID NO: 1038509 - RNA, 22 nt, Mycobacterium bovis subsp bovis AF2122/97
ggcaccgauggcgcaccggcgu

SEQ ID NO: 1038510 - RNA, 12 nt, Mycobacterium bovis subsp bovis AF2122/97
ggcaccgcagcg

SEQ ID NO: 1038511 - RNA, 14 nt, Mycobacterium bovis subsp bovis AF2122/97
ggcaccgcagcgga

SEQ ID NO: 1038512 - RNA, 15 nt, Mycobacterium bovis subsp bovis AF2122/97
ggcaccggccgugcc

SEQ ID NO: 1038513 - RNA, 16 nt, Mycobacterium bovis subsp bovis AF2122/97
ggcaccggccgugccg

SEQ ID NO: 1038514 - RNA, 20 nt, Mycobacterium bovis subsp bovis AF2122/97
ggcaccggccgugccgccga

SEQ ID NO: 1038515 - RNA, 21 nt, Mycobacterium bovis subsp bovis AF2122/97
ggcaccggccgugccgccgac

SEQ ID NO: 1038516 - RNA, 14 nt, Mycobacterium bovis subsp bovis AF2122/97
ggcaccggcggcga

SEQ ID NO: 1038517 - RNA, 12 nt, Mycobacterium bovis subsp bovis AF2122/97
ggcaccggcggu

SEQ ID NO: 1038518 - RNA, 16 nt, Mycobacterium bovis subsp bovis AF2122/97
ggcaccggcggucugc

SEQ ID NO: 1038519 - RNA, 18 nt, Mycobacterium bovis subsp bovis AF2122/97
ggcaccggggcugcccgc

SEQ ID NO: 1038520 - RNA, 18 nt, Mycobacterium bovis subsp bovis AF2122/97
ggcaccgcugccgcugcc

SEQ ID NO: 1038521 - RNA, 19 nt, Mycobacterium bovis subsp bovis AF2122/97
ggcaccgcugccgcugccg

SEQ ID NO: 1038522 - RNA, 22 nt, Mycobacterium bovis subsp bovis AF2122/97
ggcaccgcgcccaccagcggcg

SEQ ID NO: 1038523 - RNA, 14 nt, Mycobacterium bovis subsp bovis AF2122/97
ggcaccgcgccggc

SEQ ID NO: 1038524 - RNA, 15 nt, Mycobacterium bovis subsp bovis AF2122/97
ggcaccgcgccggcg

SEQ ID NO: 1038525 - RNA, 13 nt, Mycobacterium bovis subsp bovis AF2122/97
ggcaccgcggcca

SEQ ID NO: 1038526 - RNA, 15 nt, Mycobacterium bovis subsp bovis AF2122/97
ggcaccgcggccagc

SEQ ID NO: 1038527 - RNA, 20 nt, Mycobacterium bovis subsp bovis AF2122/97
ggcaccgccggcaccgccgg

SEQ ID NO: 1038528 - RNA, 22 nt, Mycobacterium bovis subsp bovis AF2122/97
ggcaccgccggcaccgccggcg

SEQ ID NO: 1038529 - RNA, 23 nt, Mycobacterium bovis subsp bovis AF2122/97
ggcaccgccggcaccgccggcgc

SEQ ID NO: 1038530 - RNA, 14 nt, Mycobacterium bovis subsp bovis AF2122/97
ggcaccgccggcgc

SEQ ID NO: 1038531 - RNA, 17 nt, Mycobacterium bovis subsp bovis AF2122/97
ggcaccgccggcgccac

SEQ ID NO: 1038532 - RNA, 19 nt, Mycobacterium bovis subsp bovis AF2122/97
ggcaccgccggcgccaccg

SEQ ID NO: 1038533 - RNA, 20 nt, Mycobacterium bovis subsp bovis AF2122/97
ggcaccgccggcgcccaggc

SEQ ID NO: 1038534 - RNA, 23 nt, Mycobacterium bovis subsp bovis AF2122/97
ggcaccgccggcgcccaggccga

SEQ ID NO: 1038535 - RNA, 20 nt, Mycobacterium bovis subsp bovis AF2122/97
ggcaccgccggcuccgccgu

SEQ ID NO: 1038536 - RNA, 15 nt, Mycobacterium bovis subsp bovis AF2122/97
ggcaccgccgguggc

SEQ ID NO: 1038537 - RNA, 20 nt, Mycobacterium bovis subsp bovis AF2122/97
ggcaccgccgguggcgccgg

SEQ ID NO: 1038538 - RNA, 14 nt, Mycobacterium bovis subsp bovis AF2122/97
ggcaccgccugcgc

SEQ ID NO: 1038539 - RNA, 17 nt, Mycobacterium bovis subsp bovis AF2122/97
ggcaccgccugcgccgc

SEQ ID NO: 1038540 - RNA, 17 nt, Mycobacterium bovis subsp bovis AF2122/97
ggcaccgccagccacca

SEQ ID NO: 1038541 - RNA, 21 nt, Mycobacterium bovis subsp bovis AF2122/97
ggcaccgacgguaggcccgcg

SEQ ID NO: 1038542 - RNA, 22 nt, Mycobacterium bovis subsp bovis AF2122/97
ggcaccgagcugagcggccagc

SEQ ID NO: 1038543 - RNA, 18 nt, Mycobacterium bovis subsp bovis AF2122/97
ggcaccgcccccgucggc

SEQ ID NO: 1038544 - RNA, 14 nt, Mycobacterium bovis subsp bovis AF2122/97
ggcaccgccgcccc

SEQ ID NO: 1038545 - RNA, 20 nt, Mycobacterium bovis subsp bovis AF2122/97
ggcaccgccgcccccgccgg

SEQ ID NO: 1038546 - RNA, 21 nt, Mycobacterium bovis subsp bovis AF2122/97
ggcaccgccgcccccgccggc

SEQ ID NO: 1038547 - RNA, 17 nt, Mycobacterium bovis subsp bovis AF2122/97
ggcacggaccgcgucgc

SEQ ID NO: 1038548 - RNA, 17 nt, Mycobacterium bovis subsp bovis AF2122/97
ggcacggagaccgugga

SEQ ID NO: 1038549 - RNA, 19 nt, Mycobacterium bovis subsp bovis AF2122/97
ggcacggaacgcgagguga

SEQ ID NO: 1038550 - RNA, 14 nt, Mycobacterium bovis subsp bovis AF2122/97
ggcacgcugaccgg

SEQ ID NO: 1038551 - RNA, 12 nt, Mycobacterium bovis subsp bovis AF2122/97
ggcacgcggcga

SEQ ID NO: 1038552 - RNA, 14 nt, Mycobacterium bovis subsp bovis AF2122/97
ggcacgggcgucgu

SEQ ID NO: 1038553 - RNA, 17 nt, Mycobacterium bovis subsp bovis AF2122/97
ggcacggccgucgacga

SEQ ID NO: 1038554 - RNA, 14 nt, Mycobacterium bovis subsp bovis AF2122/97
ggcacggccgucga

SEQ ID NO: 1038555 - RNA, 19 nt, Mycobacterium bovis subsp bovis AF2122/97
ggcacggugaacggcaagg

SEQ ID NO: 1038556 - RNA, 22 nt, Mycobacterium bovis subsp bovis AF2122/97
ggcacggccccugccacgacga

SEQ ID NO: 1038557 - RNA, 23 nt, Mycobacterium bovis subsp bovis AF2122/97
ggcacggguaaucaccgaauacc

SEQ ID NO: 1038558 - RNA, 16 nt, Mycobacterium bovis subsp bovis AF2122/97
ggcacggucgcccgau

SEQ ID NO: 1038559 - RNA, 22 nt, Mycobacterium bovis subsp bovis AF2122/97
ggcacggucgcccgaucggcgg

SEQ ID NO: 1038560 - RNA, 18 nt, Mycobacterium bovis subsp bovis AF2122/97
ggcacgggugacgauguc

SEQ ID NO: 1038561 - RNA, 13 nt, Mycobacterium bovis subsp bovis AF2122/97
ggcacggugucgc

SEQ ID NO: 1038562 - RNA, 18 nt, Mycobacterium bovis subsp bovis AF2122/97
ggcacguccgaucggcgc

SEQ ID NO: 1038563 - RNA, 22 nt, Mycobacterium bovis subsp bovis AF2122/97
ggcacguccgaucggcgcgccg

SEQ ID NO: 1038564 - RNA, 18 nt, Mycobacterium bovis subsp bovis AF2122/97
ggcacgucgcccccggcc

SEQ ID NO: 1038565 - RNA, 12 nt, Mycobacterium bovis subsp bovis AF2122/97
ggcacguggcga

SEQ ID NO: 1038566 - RNA, 15 nt, Mycobacterium bovis subsp bovis AF2122/97
ggcacguggcgaccg

SEQ ID NO: 1038567 - RNA, 17 nt, Mycobacterium bovis subsp bovis AF2122/97
ggcacguggcgaccggc

SEQ ID NO: 1038568 - RNA, 16 nt, Mycobacterium bovis subsp bovis AF2122/97
ggcacuccagcggcgg

SEQ ID NO: 1038569 - RNA, 13 nt, Mycobacterium bovis subsp bovis AF2122/97
ggcacuccaccgg

SEQ ID NO: 1038570 - RNA, 14 nt, Mycobacterium bovis subsp bovis AF2122/97
ggcacuccaccggg

SEQ ID NO: 1038571 - RNA, 15 nt, Mycobacterium bovis subsp bovis AF2122/97
ggcacuccagcggcg

SEQ ID NO: 1038572 - RNA, 19 nt, Mycobacterium bovis subsp bovis AF2122/97
ggcacuagcgagccggcgc

SEQ ID NO: 1038573 - RNA, 20 nt, Mycobacterium bovis subsp bovis AF2122/97
ggcacuagcgagccggcgcc

SEQ ID NO: 1038574 - RNA, 23 nt, Mycobacterium bovis subsp bovis AF2122/97
ggcacuccgggcucggcgucgcc

SEQ ID NO: 1038575 - RNA, 20 nt, Mycobacterium bovis subsp bovis AF2122/97
ggcacgaccgcucccggugu

SEQ ID NO: 1038576 - RNA, 14 nt, Mycobacterium bovis subsp bovis AF2122/97
ggcacgaucgucgc

SEQ ID NO: 1038577 - RNA, 16 nt, Mycobacterium bovis subsp bovis AF2122/97
ggcacgaucgccaacg

SEQ ID NO: 1038578 - RNA, 18 nt, Mycobacterium bovis subsp bovis AF2122/97
ggcacgcaugccggugau

SEQ ID NO: 1038579 - RNA, 15 nt, Mycobacterium bovis subsp bovis AF2122/97
ggcacgcacgcgguu

SEQ ID NO: 1038580 - RNA, 22 nt, Mycobacterium bovis subsp bovis AF2122/97
ggcacgcacgcgguucaccacg

SEQ ID NO: 1038581 - RNA, 20 nt, Mycobacterium bovis subsp bovis AF2122/97
ggcacgcacguagacggugu

SEQ ID NO: 1038582 - RNA, 13 nt, Mycobacterium bovis subsp bovis AF2122/97
ggcacgccggcgg

SEQ ID NO: 1038583 - RNA, 14 nt, Mycobacterium bovis subsp bovis AF2122/97
ggcacgccggcggc

SEQ ID NO: 1038584 - RNA, 13 nt, Mycobacterium bovis subsp bovis AF2122/97
ggcacgccgccga

SEQ ID NO: 1038585 - RNA, 20 nt, Mycobacterium bovis subsp bovis AF2122/97
ggcacgccgggcaucggcgg

SEQ ID NO: 1038586 - RNA, 13 nt, Mycobacterium bovis subsp bovis AF2122/97
ggcacgccauacc

SEQ ID NO: 1038587 - RNA, 19 nt, Mycobacterium bovis subsp bovis AF2122/97
ggcacgccauaccggcugg

SEQ ID NO: 1038588 - RNA, 18 nt, Mycobacterium bovis subsp bovis AF2122/97
ggcacgcaacaccgccaa

SEQ ID NO: 1038589 - RNA, 17 nt, Mycobacterium bovis subsp bovis AF2122/97
ggcacgccgaccggugg

SEQ ID NO: 1038590 - RNA, 21 nt, Mycobacterium bovis subsp bovis AF2122/97
ggcacgccgaccgguggcacc

SEQ ID NO: 1038591 - RNA, 18 nt, Mycobacterium bovis subsp bovis AF2122/97
ggcacgcccucgucgauc

SEQ ID NO: 1038592 - RNA, 17 nt, Mycobacterium bovis subsp bovis AF2122/97
ggcaccuggucggccgc

SEQ ID NO: 1038593 - RNA, 18 nt, Mycobacterium bovis subsp bovis AF2122/97
ggcaccuggucggccgca

SEQ ID NO: 1038594 - RNA, 15 nt, Mycobacterium bovis subsp bovis AF2122/97
ggcaccgucagacca

SEQ ID NO: 1038595 - RNA, 22 nt, Mycobacterium bovis subsp bovis AF2122/97
ggcacgaaucccccggacggca

SEQ ID NO: 1038596 - RNA, 20 nt, Mycobacterium bovis subsp bovis AF2122/97
ggcaccuuguagcgggcaag

SEQ ID NO: 1038597 - RNA, 22 nt, Mycobacterium bovis subsp bovis AF2122/97
ggcacgaacaucagaucgccga

SEQ ID NO: 1038598 - RNA, 19 nt, Mycobacterium bovis subsp bovis AF2122/97
ggcaccuuggccggccccg

SEQ ID NO: 1038599 - RNA, 20 nt, Mycobacterium bovis subsp bovis AF2122/97
ggcaccuuggccggccccgc

SEQ ID NO: 1038600 - RNA, 17 nt, Mycobacterium bovis subsp bovis AF2122/97
ggcaccgcggccagcgg

SEQ ID NO: 1038601 - RNA, 18 nt, Mycobacterium bovis subsp bovis AF2122/97
ggcaccgcggccagcggg

SEQ ID NO: 1038602 - RNA, 16 nt, Mycobacterium bovis subsp bovis AF2122/97
ggcaccgcggccgcgg

SEQ ID NO: 1038603 - RNA, 19 nt, Mycobacterium bovis subsp bovis AF2122/97
ggcaccgucggaacugacc

SEQ ID NO: 1038604 - RNA, 19 nt, Mycobacterium bovis subsp bovis AF2122/97
ggcaccgucucgcaccgcg

SEQ ID NO: 1038605 - RNA, 21 nt, Mycobacterium bovis subsp bovis AF2122/97
ggcaccgucucgcaccgcguu

SEQ ID NO: 1038606 - RNA, 20 nt, Mycobacterium bovis subsp bovis AF2122/97
ggcaccguuaccgccgucgc

SEQ ID NO: 1038607 - RNA, 20 nt, Mycobacterium bovis subsp bovis AF2122/97
ggcaccucccgggcgagccg

SEQ ID NO: 1038608 - RNA, 14 nt, Mycobacterium bovis subsp bovis AF2122/97
ggcaccuccagcac

SEQ ID NO: 1038609 - RNA, 19 nt, Mycobacterium bovis subsp bovis AF2122/97
ggcaaugacuugcgacccg

SEQ ID NO: 1038610 - RNA, 21 nt, Mycobacterium bovis subsp bovis AF2122/97
ggcaaucucccgaaucgugcg

SEQ ID NO: 1038611 - RNA, 18 nt, Mycobacterium bovis subsp bovis AF2122/97
ggcaaugcgagcacccgu

SEQ ID NO: 1038612 - RNA, 13 nt, Mycobacterium bovis subsp bovis AF2122/97
ggcaaugccgcgg

SEQ ID NO: 1038613 - RNA, 15 nt, Mycobacterium bovis subsp bovis AF2122/97
ggcaaugccgcggcc

SEQ ID NO: 1038614 - RNA, 16 nt, Mycobacterium bovis subsp bovis AF2122/97
ggcaaugcccgaccgg

SEQ ID NO: 1038615 - RNA, 19 nt, Mycobacterium bovis subsp bovis AF2122/97
ggcaaugcccgaccggucu

SEQ ID NO: 1038616 - RNA, 16 nt, Mycobacterium bovis subsp bovis AF2122/97
ggcaaucccgcggucg

SEQ ID NO: 1038617 - RNA, 18 nt, Mycobacterium bovis subsp bovis AF2122/97
ggcaaucaccgccggcgg

SEQ ID NO: 1038618 - RNA, 22 nt, Mycobacterium bovis subsp bovis AF2122/97
ggcaaucaccgccggcggcggg

SEQ ID NO: 1038619 - RNA, 19 nt, Mycobacterium bovis subsp bovis AF2122/97
ggcaaucgcucugugucgc

SEQ ID NO: 1038620 - RNA, 21 nt, Mycobacterium bovis subsp bovis AF2122/97
ggcaauggccagcaccacggc

SEQ ID NO: 1038621 - RNA, 18 nt, Mycobacterium bovis subsp bovis AF2122/97
ggcaauuaggucgaccac

SEQ ID NO: 1038622 - RNA, 20 nt, Mycobacterium bovis subsp bovis AF2122/97
ggcaaugcuccuaucugccg

SEQ ID NO: 1038623 - RNA, 18 nt, Mycobacterium bovis subsp bovis AF2122/97
ggcacaaucaccgccgcg

SEQ ID NO: 1038624 - RNA, 14 nt, Mycobacterium bovis subsp bovis AF2122/97
ggcacaaucggcgc

SEQ ID NO: 1038625 - RNA, 15 nt, Mycobacterium bovis subsp bovis AF2122/97
ggcaauuccgccgag

SEQ ID NO: 1038626 - RNA, 17 nt, Mycobacterium bovis subsp bovis AF2122/97
ggcacacccaucaccgc

SEQ ID NO: 1038627 - RNA, 14 nt, Mycobacterium bovis subsp bovis AF2122/97
ggcacacccgcacc

SEQ ID NO: 1038628 - RNA, 17 nt, Mycobacterium bovis subsp bovis AF2122/97
ggcacaacaucgccgca

SEQ ID NO: 1038629 - RNA, 22 nt, Mycobacterium bovis subsp bovis AF2122/97
ggcaagcacaccgccagcggca

SEQ ID NO: 1038630 - RNA, 14 nt, Mycobacterium bovis subsp bovis AF2122/97
ggcaagcacggcgu

SEQ ID NO: 1038631 - RNA, 23 nt, Mycobacterium bovis subsp bovis AF2122/97
ggcaagaguugccggaucgacgu

SEQ ID NO: 1038632 - RNA, 14 nt, Mycobacterium bovis subsp bovis AF2122/97
ggcaagaacccggu

SEQ ID NO: 1038633 - RNA, 13 nt, Mycobacterium bovis subsp bovis AF2122/97
ggcaagaugaucg

SEQ ID NO: 1038634 - RNA, 16 nt, Mycobacterium bovis subsp bovis AF2122/97
ggcaagcaaccggugc

SEQ ID NO: 1038635 - RNA, 16 nt, Mycobacterium bovis subsp bovis AF2122/97
ggcaagcacaccgcca

SEQ ID NO: 1038636 - RNA, 22 nt, Mycobacterium bovis subsp bovis AF2122/97
ggcaagcacggcgucgaugucg

SEQ ID NO: 1038637 - RNA, 13 nt, Mycobacterium bovis subsp bovis AF2122/97
ggcaagccugcgc

SEQ ID NO: 1038638 - RNA, 12 nt, Mycobacterium bovis subsp bovis AF2122/97
ggcaagccgggg

SEQ ID NO: 1038639 - RNA, 20 nt, Mycobacterium bovis subsp bovis AF2122/97
ggcaagccuaaaaccccgag

SEQ ID NO: 1038640 - RNA, 16 nt, Mycobacterium bovis subsp bovis AF2122/97
ggcaacuucagcaacg

SEQ ID NO: 1038641 - RNA, 13 nt, Mycobacterium bovis subsp bovis AF2122/97
ggcaagaacccga

SEQ ID NO: 1038642 - RNA, 18 nt, Mycobacterium bovis subsp bovis AF2122/97
ggcaagaacccgauaaca

SEQ ID NO: 1038643 - RNA, 18 nt, Mycobacterium bovis subsp bovis AF2122/97
ggcaacgguggcaacgga

SEQ ID NO: 1038644 - RNA, 17 nt, Mycobacterium bovis subsp bovis AF2122/97
ggcaacgggggcgccgg

SEQ ID NO: 1038645 - RNA, 18 nt, Mycobacterium bovis subsp bovis AF2122/97
ggcaacggguccgacggu

SEQ ID NO: 1038646 - RNA, 19 nt, Mycobacterium bovis subsp bovis AF2122/97
ggcaacggcggggccggcg

SEQ ID NO: 1038647 - RNA, 20 nt, Mycobacterium bovis subsp bovis AF2122/97
ggcaacggcggggccggcgg

SEQ ID NO: 1038648 - RNA, 21 nt, Mycobacterium bovis subsp bovis AF2122/97
ggcaacggcggggccggcggc

SEQ ID NO: 1038649 - RNA, 22 nt, Mycobacterium bovis subsp bovis AF2122/97
ggcaacggacgggaucgcccag

SEQ ID NO: 1038650 - RNA, 21 nt, Mycobacterium bovis subsp bovis AF2122/97
ggcaacggaggugccggcgcc

SEQ ID NO: 1038651 - RNA, 15 nt, Mycobacterium bovis subsp bovis AF2122/97
ggcaacggcgcgccg

SEQ ID NO: 1038652 - RNA, 16 nt, Mycobacterium bovis subsp bovis AF2122/97
ggcaacggcggcaucg

SEQ ID NO: 1038653 - RNA, 19 nt, Mycobacterium bovis subsp bovis AF2122/97
ggcaacggcggcaucggcg

SEQ ID NO: 1038654 - RNA, 20 nt, Mycobacterium bovis subsp bovis AF2122/97
ggcaacggcggcaucggcgg

SEQ ID NO: 1038655 - RNA, 19 nt, Mycobacterium bovis subsp bovis AF2122/97
ggcaacggcggcgacggcg

SEQ ID NO: 1038656 - RNA, 17 nt, Mycobacterium bovis subsp bovis AF2122/97
ggcaaggccaccggcgg

SEQ ID NO: 1038657 - RNA, 16 nt, Mycobacterium bovis subsp bovis AF2122/97
ggcaagcugccccgcc

SEQ ID NO: 1038658 - RNA, 22 nt, Mycobacterium bovis subsp bovis AF2122/97
ggcaaggacggagcccaaaacc

SEQ ID NO: 1038659 - RNA, 15 nt, Mycobacterium bovis subsp bovis AF2122/97
ggcaaggacguggcg

SEQ ID NO: 1038660 - RNA, 21 nt, Mycobacterium bovis subsp bovis AF2122/97
ggcaagcgugacccgccggcg

SEQ ID NO: 1038661 - RNA, 23 nt, Mycobacterium bovis subsp bovis AF2122/97
ggcaagcgugacccgccggcgac

SEQ ID NO: 1038662 - RNA, 16 nt, Mycobacterium bovis subsp bovis AF2122/97
ggcaagacgcggucga

SEQ ID NO: 1038663 - RNA, 12 nt, Mycobacterium bovis subsp bovis AF2122/97
ggcaagcgcaga

SEQ ID NO: 1038664 - RNA, 15 nt, Mycobacterium bovis subsp bovis AF2122/97
ggcaagggcggcaac

SEQ ID NO: 1038665 - RNA, 14 nt, Mycobacterium bovis subsp bovis AF2122/97
ggcaagucaacacc

SEQ ID NO: 1038666 - RNA, 19 nt, Mycobacterium bovis subsp bovis AF2122/97
ggcaagucgacgccgcagc

SEQ ID NO: 1038667 - RNA, 13 nt, Mycobacterium bovis subsp bovis AF2122/97
ggcaagucgacgc

SEQ ID NO: 1038668 - RNA, 14 nt, Mycobacterium bovis subsp bovis AF2122/97
ggcaagucgacgcc

SEQ ID NO: 1038669 - RNA, 19 nt, Mycobacterium bovis subsp bovis AF2122/97
ggcaaggucaacccgcacc

SEQ ID NO: 1038670 - RNA, 20 nt, Mycobacterium bovis subsp bovis AF2122/97
ggcaaggguggggccggcgg

SEQ ID NO: 1038671 - RNA, 21 nt, Mycobacterium bovis subsp bovis AF2122/97
ggcaaggguggggccggcggu

SEQ ID NO: 1038672 - RNA, 21 nt, Mycobacterium bovis subsp bovis AF2122/97
ggcaaacugggcaccggcggu

SEQ ID NO: 1038673 - RNA, 16 nt, Mycobacterium bovis subsp bovis AF2122/97
ggcaaagacgcuggcc

SEQ ID NO: 1038674 - RNA, 16 nt, Mycobacterium bovis subsp bovis AF2122/97
ggcaaaguaucgcagc

SEQ ID NO: 1038675 - RNA, 22 nt, Mycobacterium bovis subsp bovis AF2122/97
ggcaaaucaagcacagcccggc

SEQ ID NO: 1038676 - RNA, 15 nt, Mycobacterium bovis subsp bovis AF2122/97
ggcaacaucagcagg

SEQ ID NO: 1038677 - RNA, 14 nt, Mycobacterium bovis subsp bovis AF2122/97
ggcaaccagcagca

SEQ ID NO: 1038678 - RNA, 22 nt, Mycobacterium bovis subsp bovis AF2122/97
ggcaaccagcuucucagcacca

SEQ ID NO: 1038679 - RNA, 22 nt, Mycobacterium bovis subsp bovis AF2122/97
ggcaaccaggaugguugcgacg

SEQ ID NO: 1038680 - RNA, 17 nt, Mycobacterium bovis subsp bovis AF2122/97
ggcaacccacacgcccu

SEQ ID NO: 1038681 - RNA, 20 nt, Mycobacterium bovis subsp bovis AF2122/97
ggcaacccugcccggcccgc

SEQ ID NO: 1038682 - RNA, 22 nt, Mycobacterium bovis subsp bovis AF2122/97
ggcaaccaaccgcgcgagccuc

SEQ ID NO: 1038683 - RNA, 22 nt, Mycobacterium bovis subsp bovis AF2122/97
ggcaacccccgccggcgcccga

SEQ ID NO: 1038684 - RNA, 18 nt, Mycobacterium bovis subsp bovis AF2122/97
ggcaaccgccgccaccag

SEQ ID NO: 1038685 - RNA, 19 nt, Mycobacterium bovis subsp bovis AF2122/97
ggcaaccgccgugugccac

SEQ ID NO: 1038686 - RNA, 17 nt, Mycobacterium bovis subsp bovis AF2122/97
ggcaaccgaauugaacu

SEQ ID NO: 1038687 - RNA, 14 nt, Mycobacterium bovis subsp bovis AF2122/97
ggcaaccgaugacg

SEQ ID NO: 1038688 - RNA, 21 nt, Mycobacterium bovis subsp bovis AF2122/97
ggcaaccggagaucccggucc

SEQ ID NO: 1038689 - RNA, 16 nt, Mycobacterium bovis subsp bovis AF2122/97
ggcaaccuggacuggg

SEQ ID NO: 1038690 - RNA, 23 nt, Mycobacterium bovis subsp bovis AF2122/97
ggcaaccuggacugggucgccuc

SEQ ID NO: 1038691 - RNA, 18 nt, Mycobacterium bovis subsp bovis AF2122/97
ggcaacgcggucugcucc

SEQ ID NO: 1038692 - RNA, 13 nt, Mycobacterium bovis subsp bovis AF2122/97
ggcaacgcggccu

SEQ ID NO: 1038693 - RNA, 14 nt, Mycobacterium bovis subsp bovis AF2122/97
ggcaacgcggcucg

SEQ ID NO: 1038694 - RNA, 17 nt, Mycobacterium bovis subsp bovis AF2122/97
ggcaacgcggucugcuc

SEQ ID NO: 1038695 - RNA, 15 nt, Mycobacterium bovis subsp bovis AF2122/97
ggcaacgccgcgccg

SEQ ID NO: 1038696 - RNA, 19 nt, Mycobacterium bovis subsp bovis AF2122/97
ggcaacgcgaaccggccau

SEQ ID NO: 1038697 - RNA, 21 nt, Mycobacterium bovis subsp bovis AF2122/97
ggcaaccuuuggccgcugugg

SEQ ID NO: 1038698 - RNA, 17 nt, Mycobacterium bovis subsp bovis AF2122/97
ggcaacgacccgccgcc

SEQ ID NO: 1038699 - RNA, 18 nt, Mycobacterium bovis subsp bovis AF2122/97
ggauugaagcuggccacc

SEQ ID NO: 1038700 - RNA, 16 nt, Mycobacterium bovis subsp bovis AF2122/97
ggcaaaccaagcgcgc

SEQ ID NO: 1038701 - RNA, 19 nt, Mycobacterium bovis subsp bovis AF2122/97
ggcaaaauaaccguugacc

SEQ ID NO: 1038702 - RNA, 17 nt, Mycobacterium bovis subsp bovis AF2122/97
ggauugcgggccugcac

SEQ ID NO: 1038703 - RNA, 19 nt, Mycobacterium bovis subsp bovis AF2122/97
ggauugcgggccugcacgc

SEQ ID NO: 1038704 - RNA, 13 nt, Mycobacterium bovis subsp bovis AF2122/97
ggauuggcgacgu

SEQ ID NO: 1038705 - RNA, 19 nt, Mycobacterium bovis subsp bovis AF2122/97
ggauucccagucgcggcgc

SEQ ID NO: 1038706 - RNA, 15 nt, Mycobacterium bovis subsp bovis AF2122/97
ggauucuggcgcagc

SEQ ID NO: 1038707 - RNA, 18 nt, Mycobacterium bovis subsp bovis AF2122/97
ggauucuucagcgcggca

SEQ ID NO: 1038708 - RNA, 15 nt, Mycobacterium bovis subsp bovis AF2122/97
ggauucugcugacca

SEQ ID NO: 1038709 - RNA, 15 nt, Mycobacterium bovis subsp bovis AF2122/97
ggauucggcggucgc

SEQ ID NO: 1038710 - RNA, 18 nt, Mycobacterium bovis subsp bovis AF2122/97
ggauucgggcgccgcagc

SEQ ID NO: 1038711 - RNA, 13 nt, Mycobacterium bovis subsp bovis AF2122/97
ggagagccgacgu

SEQ ID NO: 1038712 - RNA, 20 nt, Mycobacterium bovis subsp bovis AF2122/97
ggagacgaucgccaggccga

SEQ ID NO: 1038713 - RNA, 15 nt, Mycobacterium bovis subsp bovis AF2122/97
ggagacgcugcgcgc

SEQ ID NO: 1038714 - RNA, 22 nt, Mycobacterium bovis subsp bovis AF2122/97
ggagaccugucgguaccgccca

SEQ ID NO: 1038715 - RNA, 13 nt, Mycobacterium bovis subsp bovis AF2122/97
ggagacgucgccg

SEQ ID NO: 1038716 - RNA, 18 nt, Mycobacterium bovis subsp bovis AF2122/97
ggauguugugccgaucgg

SEQ ID NO: 1038717 - RNA, 21 nt, Mycobacterium bovis subsp bovis AF2122/97
ggauguuuuccgguccggcgu

SEQ ID NO: 1038718 - RNA, 19 nt, Mycobacterium bovis subsp bovis AF2122/97
ggauucccgcccagcagca

SEQ ID NO: 1038719 - RNA, 23 nt, Mycobacterium bovis subsp bovis AF2122/97
ggauucaucacgggacgacggca

SEQ ID NO: 1038720 - RNA, 17 nt, Mycobacterium bovis subsp bovis AF2122/97
ggauucggcagcggcgc

SEQ ID NO: 1038721 - RNA, 18 nt, Mycobacterium bovis subsp bovis AF2122/97
ggauucggcagcggcgcg

SEQ ID NO: 1038722 - RNA, 16 nt, Mycobacterium bovis subsp bovis AF2122/97
ggauucggccagacgc

SEQ ID NO: 1038723 - RNA, 14 nt, Mycobacterium bovis subsp bovis AF2122/97
ggucagcccggcgc

SEQ ID NO: 1038724 - RNA, 13 nt, Mycobacterium bovis subsp bovis AF2122/97
ggucagccgcggg

SEQ ID NO: 1038725 - RNA, 15 nt, Mycobacterium bovis subsp bovis AF2122/97
ggucagccgcggggc

SEQ ID NO: 1038726 - RNA, 14 nt, Mycobacterium bovis subsp bovis AF2122/97
ggucagccggccau

SEQ ID NO: 1038727 - RNA, 15 nt, Mycobacterium bovis subsp bovis AF2122/97
ggucagccgcggcgg

SEQ ID NO: 1038728 - RNA, 14 nt, Mycobacterium bovis subsp bovis AF2122/97
ggucagccgugccg

SEQ ID NO: 1038729 - RNA, 15 nt, Mycobacterium bovis subsp bovis AF2122/97
ggucagccgugccgu

SEQ ID NO: 1038730 - RNA, 14 nt, Mycobacterium bovis subsp bovis AF2122/97
ggucagcgaccuca

SEQ ID NO: 1038731 - RNA, 14 nt, Mycobacterium bovis subsp bovis AF2122/97
ggucaggucgaggu

SEQ ID NO: 1038732 - RNA, 13 nt, Mycobacterium bovis subsp bovis AF2122/97
ggucagcgccgag

SEQ ID NO: 1038733 - RNA, 14 nt, Mycobacterium bovis subsp bovis AF2122/97
ggucagcgccgcgc

SEQ ID NO: 1038734 - RNA, 23 nt, Mycobacterium bovis subsp bovis AF2122/97
ggucagcgccgcgccccagacgc

SEQ ID NO: 1038735 - RNA, 20 nt, Mycobacterium bovis subsp bovis AF2122/97
ggucagcgaccucacugcgg

SEQ ID NO: 1038736 - RNA, 21 nt, Mycobacterium bovis subsp bovis AF2122/97
ggucagcgaccucacugcggc

SEQ ID NO: 1038737 - RNA, 22 nt, Mycobacterium bovis subsp bovis AF2122/97
ggucagcgaccucacugcggcg

SEQ ID NO: 1038738 - RNA, 14 nt, Mycobacterium bovis subsp bovis AF2122/97
gguccaaagcacgu

SEQ ID NO: 1038739 - RNA, 13 nt, Mycobacterium bovis subsp bovis AF2122/97
gguccaacagcgc

SEQ ID NO: 1038740 - RNA, 19 nt, Mycobacterium bovis subsp bovis AF2122/97
ggucaucccuuucgcgccg

SEQ ID NO: 1038741 - RNA, 22 nt, Mycobacterium bovis subsp bovis AF2122/97
ggucaucccuuucgcgccgcga

SEQ ID NO: 1038742 - RNA, 17 nt, Mycobacterium bovis subsp bovis AF2122/97
ggucaucaugucgaggu

SEQ ID NO: 1038743 - RNA, 20 nt, Mycobacterium bovis subsp bovis AF2122/97
gguccaaguccuccacggcg

SEQ ID NO: 1038744 - RNA, 16 nt, Mycobacterium bovis subsp bovis AF2122/97
gguccaagugggccgg

SEQ ID NO: 1038745 - RNA, 13 nt, Mycobacterium bovis subsp bovis AF2122/97
ggucauccggccg

SEQ ID NO: 1038746 - RNA, 18 nt, Mycobacterium bovis subsp bovis AF2122/97
ggucauccgggcgaccac

SEQ ID NO: 1038747 - RNA, 21 nt, Mycobacterium bovis subsp bovis AF2122/97
ggucauccgggcgaccaccac

SEQ ID NO: 1038748 - RNA, 16 nt, Mycobacterium bovis subsp bovis AF2122/97
gguccaaccgggccgg

SEQ ID NO: 1038749 - RNA, 15 nt, Mycobacterium bovis subsp bovis AF2122/97
gguccacagccggcg

SEQ ID NO: 1038750 - RNA, 16 nt, Mycobacterium bovis subsp bovis AF2122/97
gguccacagccggcgg

SEQ ID NO: 1038751 - RNA, 17 nt, Mycobacterium bovis subsp bovis AF2122/97
gguccacauccagggug

SEQ ID NO: 1038752 - RNA, 22 nt, Mycobacterium bovis subsp bovis AF2122/97
ggucagccggccauacgcgcgc

SEQ ID NO: 1038753 - RNA, 19 nt, Mycobacterium bovis subsp bovis AF2122/97
ggucagguuggcacgcugu

SEQ ID NO: 1038754 - RNA, 20 nt, Mycobacterium bovis subsp bovis AF2122/97
ggucagugggacgggcgcgu

SEQ ID NO: 1038755 - RNA, 21 nt, Mycobacterium bovis subsp bovis AF2122/97
ggucagguugucggcgaucaa

SEQ ID NO: 1038756 - RNA, 18 nt, Mycobacterium bovis subsp bovis AF2122/97
ggucaguccgacaccggc

SEQ ID NO: 1038757 - RNA, 22 nt, Mycobacterium bovis subsp bovis AF2122/97
ggucauagucgaauggcaacac

SEQ ID NO: 1038758 - RNA, 20 nt, Mycobacterium bovis subsp bovis AF2122/97
ggucauauugcggugcaucg

SEQ ID NO: 1038759 - RNA, 13 nt, Mycobacterium bovis subsp bovis AF2122/97
gguccucgagccg

SEQ ID NO: 1038760 - RNA, 21 nt, Mycobacterium bovis subsp bovis AF2122/97
gguccucgaucagacgcucga

SEQ ID NO: 1038761 - RNA, 16 nt, Mycobacterium bovis subsp bovis AF2122/97
gguccgcuacggcguc

SEQ ID NO: 1038762 - RNA, 18 nt, Mycobacterium bovis subsp bovis AF2122/97
gguccgcgucggcggcga

SEQ ID NO: 1038763 - RNA, 18 nt, Mycobacterium bovis subsp bovis AF2122/97
gguccgcgugcugccgua

SEQ ID NO: 1038764 - RNA, 15 nt, Mycobacterium bovis subsp bovis AF2122/97
gguccgacgggccac

SEQ ID NO: 1038765 - RNA, 14 nt, Mycobacterium bovis subsp bovis AF2122/97
gguccugcgccgca

SEQ ID NO: 1038766 - RNA, 16 nt, Mycobacterium bovis subsp bovis AF2122/97
gguccuucugccggga

SEQ ID NO: 1038767 - RNA, 18 nt, Mycobacterium bovis subsp bovis AF2122/97
gguccuucugccgggaga

SEQ ID NO: 1038768 - RNA, 15 nt, Mycobacterium bovis subsp bovis AF2122/97
gguccugcggucgcg

SEQ ID NO: 1038769 - RNA, 18 nt, Mycobacterium bovis subsp bovis AF2122/97
gguccugcggucgcggag

SEQ ID NO: 1038770 - RNA, 23 nt, Mycobacterium bovis subsp bovis AF2122/97
ggucgaaacgguacgccgccgcg

SEQ ID NO: 1038771 - RNA, 12 nt, Mycobacterium bovis subsp bovis AF2122/97
gguccaccggcc

SEQ ID NO: 1038772 - RNA, 13 nt, Mycobacterium bovis subsp bovis AF2122/97
gguccaccggcca

SEQ ID NO: 1038773 - RNA, 19 nt, Mycobacterium bovis subsp bovis AF2122/97
gguccaccggcccucgcca

SEQ ID NO: 1038774 - RNA, 20 nt, Mycobacterium bovis subsp bovis AF2122/97
gguccaccccgccgaucacc

SEQ ID NO: 1038775 - RNA, 19 nt, Mycobacterium bovis subsp bovis AF2122/97
gguccacaaaccgugcacg

SEQ ID NO: 1038776 - RNA, 16 nt, Mycobacterium bovis subsp bovis AF2122/97
gguccaccccgccgau

SEQ ID NO: 1038777 - RNA, 20 nt, Mycobacterium bovis subsp bovis AF2122/97
gguccacgcgcucggugccg

SEQ ID NO: 1038778 - RNA, 19 nt, Mycobacterium bovis subsp bovis AF2122/97
gguccaccuuggucgccaa

SEQ ID NO: 1038779 - RNA, 22 nt, Mycobacterium bovis subsp bovis AF2122/97
gguccagacaucagugcgccgg

SEQ ID NO: 1038780 - RNA, 17 nt, Mycobacterium bovis subsp bovis AF2122/97
gguccagacccagcucg

SEQ ID NO: 1038781 - RNA, 15 nt, Mycobacterium bovis subsp bovis AF2122/97
gguccgccguugccg

SEQ ID NO: 1038782 - RNA, 19 nt, Mycobacterium bovis subsp bovis AF2122/97
gguccgccguugccgaucc

SEQ ID NO: 1038783 - RNA, 13 nt, Mycobacterium bovis subsp bovis AF2122/97
gguccgaccagcg

SEQ ID NO: 1038784 - RNA, 17 nt, Mycobacterium bovis subsp bovis AF2122/97
gguccgcacugugcccu

SEQ ID NO: 1038785 - RNA, 22 nt, Mycobacterium bovis subsp bovis AF2122/97
ggucccuuguggucugccagca

SEQ ID NO: 1038786 - RNA, 17 nt, Mycobacterium bovis subsp bovis AF2122/97
ggucccguugccgccca

SEQ ID NO: 1038787 - RNA, 18 nt, Mycobacterium bovis subsp bovis AF2122/97
ggucccugaagccagcgc

SEQ ID NO: 1038788 - RNA, 19 nt, Mycobacterium bovis subsp bovis AF2122/97
ggucccugaagccagcgca

SEQ ID NO: 1038789 - RNA, 13 nt, Mycobacterium bovis subsp bovis AF2122/97
ggucgccggcguc

SEQ ID NO: 1038790 - RNA, 15 nt, Mycobacterium bovis subsp bovis AF2122/97
ggucgccggcaccgg

SEQ ID NO: 1038791 - RNA, 12 nt, Mycobacterium bovis subsp bovis AF2122/97
ggucgccggcca

SEQ ID NO: 1038792 - RNA, 15 nt, Mycobacterium bovis subsp bovis AF2122/97
ggucgccggcgucga

SEQ ID NO: 1038793 - RNA, 21 nt, Mycobacterium bovis subsp bovis AF2122/97
ggucgccggcgucgagccgga

SEQ ID NO: 1038794 - RNA, 23 nt, Mycobacterium bovis subsp bovis AF2122/97
ggucgccggucaucgccgaaacc

SEQ ID NO: 1038795 - RNA, 19 nt, Mycobacterium bovis subsp bovis AF2122/97
ggucgccuccugccgccgc

SEQ ID NO: 1038796 - RNA, 13 nt, Mycobacterium bovis subsp bovis AF2122/97
ggucgcgaugacg

SEQ ID NO: 1038797 - RNA, 14 nt, Mycobacterium bovis subsp bovis AF2122/97
ggucgcgauagccg

SEQ ID NO: 1038798 - RNA, 21 nt, Mycobacterium bovis subsp bovis AF2122/97
ggucgcggggccggaugacga

SEQ ID NO: 1038799 - RNA, 13 nt, Mycobacterium bovis subsp bovis AF2122/97
ggucgcgggugcc

SEQ ID NO: 1038800 - RNA, 17 nt, Mycobacterium bovis subsp bovis AF2122/97
ggucgcgggugccgaag

SEQ ID NO: 1038801 - RNA, 19 nt, Mycobacterium bovis subsp bovis AF2122/97
ggucgcugccggcugacga

SEQ ID NO: 1038802 - RNA, 22 nt, Mycobacterium bovis subsp bovis AF2122/97
ggucgcugccggcugacgacca

SEQ ID NO: 1038803 - RNA, 22 nt, Mycobacterium bovis subsp bovis AF2122/97
ggucgcugauccgggcgccgau

SEQ ID NO: 1038804 - RNA, 13 nt, Mycobacterium bovis subsp bovis AF2122/97
ggucgcuguccac

SEQ ID NO: 1038805 - RNA, 15 nt, Mycobacterium bovis subsp bovis AF2122/97
ggucgcugcugccgc

SEQ ID NO: 1038806 - RNA, 22 nt, Mycobacterium bovis subsp bovis AF2122/97
ggucgcugcugcgaucgccgcg

SEQ ID NO: 1038807 - RNA, 21 nt, Mycobacterium bovis subsp bovis AF2122/97
ggucgcugcuugcgggcucgu

SEQ ID NO: 1038808 - RNA, 19 nt, Mycobacterium bovis subsp bovis AF2122/97
ggucgcggucccacggccg

SEQ ID NO: 1038809 - RNA, 18 nt, Mycobacterium bovis subsp bovis AF2122/97
ggucgcgguggcggcggu

SEQ ID NO: 1038810 - RNA, 13 nt, Mycobacterium bovis subsp bovis AF2122/97
ggucgcguccacc

SEQ ID NO: 1038811 - RNA, 18 nt, Mycobacterium bovis subsp bovis AF2122/97
ggucgcgucggcugccgc

SEQ ID NO: 1038812 - RNA, 23 nt, Mycobacterium bovis subsp bovis AF2122/97
ggucgcguugcagaccaccagug

SEQ ID NO: 1038813 - RNA, 20 nt, Mycobacterium bovis subsp bovis AF2122/97
ggucgaacuugaucaccgcg

SEQ ID NO: 1038814 - RNA, 23 nt, Mycobacterium bovis subsp bovis AF2122/97
ggucgaauaguugaccaggccga

SEQ ID NO: 1038815 - RNA, 17 nt, Mycobacterium bovis subsp bovis AF2122/97
ggucgaaucgcugccgc

SEQ ID NO: 1038816 - RNA, 21 nt, Mycobacterium bovis subsp bovis AF2122/97
ggucgaaucgcugccgccgau

SEQ ID NO: 1038817 - RNA, 13 nt, Mycobacterium bovis subsp bovis AF2122/97
ggucgacaccgcg

SEQ ID NO: 1038818 - RNA, 16 nt, Mycobacterium bovis subsp bovis AF2122/97
ggucgaaucgugucgc

SEQ ID NO: 1038819 - RNA, 21 nt, Mycobacterium bovis subsp bovis AF2122/97
ggucgaaugggggcuggucgc

SEQ ID NO: 1038820 - RNA, 16 nt, Mycobacterium bovis subsp bovis AF2122/97
ggucgagccacccacc

SEQ ID NO: 1038821 - RNA, 23 nt, Mycobacterium bovis subsp bovis AF2122/97
ggucgacaccgcggugccccgga

SEQ ID NO: 1038822 - RNA, 17 nt, Mycobacterium bovis subsp bovis AF2122/97
ggucgagcagugccucg

SEQ ID NO: 1038823 - RNA, 12 nt, Mycobacterium bovis subsp bovis AF2122/97
ggucgagcaggc

SEQ ID NO: 1038824 - RNA, 14 nt, Mycobacterium bovis subsp bovis AF2122/97
ggucgagcaggcga

SEQ ID NO: 1038825 - RNA, 15 nt, Mycobacterium bovis subsp bovis AF2122/97
ggucgagcaggcgag

SEQ ID NO: 1038826 - RNA, 14 nt, Mycobacterium bovis subsp bovis AF2122/97
ggucgagcggucgc

SEQ ID NO: 1038827 - RNA, 17 nt, Mycobacterium bovis subsp bovis AF2122/97
ggucgcagcucgucgug

SEQ ID NO: 1038828 - RNA, 23 nt, Mycobacterium bovis subsp bovis AF2122/97
ggucgcaguacuugguugcgacg

SEQ ID NO: 1038829 - RNA, 16 nt, Mycobacterium bovis subsp bovis AF2122/97
ggucgcauggucgacg

SEQ ID NO: 1038830 - RNA, 16 nt, Mycobacterium bovis subsp bovis AF2122/97
ggucgcagcagaccac

SEQ ID NO: 1038831 - RNA, 16 nt, Mycobacterium bovis subsp bovis AF2122/97
ggucgccaccgccggc

SEQ ID NO: 1038832 - RNA, 17 nt, Mycobacterium bovis subsp bovis AF2122/97
ggucgccaacgccagca

SEQ ID NO: 1038833 - RNA, 22 nt, Mycobacterium bovis subsp bovis AF2122/97
ggucgccaacgccagcaccagc

SEQ ID NO: 1038834 - RNA, 21 nt, Mycobacterium bovis subsp bovis AF2122/97
ggucgaucaccgacaccgugu

SEQ ID NO: 1038835 - RNA, 15 nt, Mycobacterium bovis subsp bovis AF2122/97
ggucgccaauacgug

SEQ ID NO: 1038836 - RNA, 15 nt, Mycobacterium bovis subsp bovis AF2122/97
ggucgccaacccgau

SEQ ID NO: 1038837 - RNA, 15 nt, Mycobacterium bovis subsp bovis AF2122/97
ggucgccaacgccag

SEQ ID NO: 1038838 - RNA, 20 nt, Mycobacterium bovis subsp bovis AF2122/97
ggucgagcgaacccuucgcg

SEQ ID NO: 1038839 - RNA, 15 nt, Mycobacterium bovis subsp bovis AF2122/97
ggucgagcgacccca

SEQ ID NO: 1038840 - RNA, 19 nt, Mycobacterium bovis subsp bovis AF2122/97
ggucgagcgcccacuggug

SEQ ID NO: 1038841 - RNA, 20 nt, Mycobacterium bovis subsp bovis AF2122/97
ggucgauaccggcgugcagu

SEQ ID NO: 1038842 - RNA, 14 nt, Mycobacterium bovis subsp bovis AF2122/97
ggucgcaccgccgg

SEQ ID NO: 1038843 - RNA, 20 nt, Mycobacterium bovis subsp bovis AF2122/97
ggucgcaccccggcggcguc

SEQ ID NO: 1038844 - RNA, 17 nt, Mycobacterium bovis subsp bovis AF2122/97
ggucgaguccgacgggg

SEQ ID NO: 1038845 - RNA, 16 nt, Mycobacterium bovis subsp bovis AF2122/97
ggucgaggucggcgau

SEQ ID NO: 1038846 - RNA, 17 nt, Mycobacterium bovis subsp bovis AF2122/97
ggucgaggucggcgauc

SEQ ID NO: 1038847 - RNA, 18 nt, Mycobacterium bovis subsp bovis AF2122/97
ggucgugcaggcgacggc

SEQ ID NO: 1038848 - RNA, 17 nt, Mycobacterium bovis subsp bovis AF2122/97
ggucgugcccgggacca

SEQ ID NO: 1038849 - RNA, 19 nt, Mycobacterium bovis subsp bovis AF2122/97
ggucgucguugugauccgg

SEQ ID NO: 1038850 - RNA, 15 nt, Mycobacterium bovis subsp bovis AF2122/97
ggucgucggcgucgc

SEQ ID NO: 1038851 - RNA, 17 nt, Mycobacterium bovis subsp bovis AF2122/97
ggucguucccgccggca

SEQ ID NO: 1038852 - RNA, 16 nt, Mycobacterium bovis subsp bovis AF2122/97
ggucgugucgccacac

SEQ ID NO: 1038853 - RNA, 15 nt, Mycobacterium bovis subsp bovis AF2122/97
ggucguuggcggcgg

SEQ ID NO: 1038854 - RNA, 21 nt, Mycobacterium bovis subsp bovis AF2122/97
ggucguuggugcagaccaccg

SEQ ID NO: 1038855 - RNA, 16 nt, Mycobacterium bovis subsp bovis AF2122/97
ggucguugaggccggu

SEQ ID NO: 1038856 - RNA, 17 nt, Mycobacterium bovis subsp bovis AF2122/97
ggucguugccgcggucg

SEQ ID NO: 1038857 - RNA, 17 nt, Mycobacterium bovis subsp bovis AF2122/97
ggucguugccggacaac

SEQ ID NO: 1038858 - RNA, 15 nt, Mycobacterium bovis subsp bovis AF2122/97
ggucuugaacccgau

SEQ ID NO: 1038859 - RNA, 21 nt, Mycobacterium bovis subsp bovis AF2122/97
ggucuucaucgccgugcgccg

SEQ ID NO: 1038860 - RNA, 14 nt, Mycobacterium bovis subsp bovis AF2122/97
ggucuggcccgcga

SEQ ID NO: 1038861 - RNA, 13 nt, Mycobacterium bovis subsp bovis AF2122/97
ggucgucgaacgg

SEQ ID NO: 1038862 - RNA, 19 nt, Mycobacterium bovis subsp bovis AF2122/97
ggucuggacaucggccggc

SEQ ID NO: 1038863 - RNA, 20 nt, Mycobacterium bovis subsp bovis AF2122/97
ggucguuucccuggccgccg

SEQ ID NO: 1038864 - RNA, 23 nt, Mycobacterium bovis subsp bovis AF2122/97
ggucguuucccuggccgccgccg

SEQ ID NO: 1038865 - RNA, 16 nt, Mycobacterium bovis subsp bovis AF2122/97
ggucuacccgcggcgc

SEQ ID NO: 1038866 - RNA, 23 nt, Mycobacterium bovis subsp bovis AF2122/97
ggucuaccuuuuuggcacccacg

SEQ ID NO: 1038867 - RNA, 15 nt, Mycobacterium bovis subsp bovis AF2122/97
ggucgggggcagcgc

SEQ ID NO: 1038868 - RNA, 14 nt, Mycobacterium bovis subsp bovis AF2122/97
ggucgggggcgucc

SEQ ID NO: 1038869 - RNA, 21 nt, Mycobacterium bovis subsp bovis AF2122/97
ggucgggucgaucaccgacac

SEQ ID NO: 1038870 - RNA, 16 nt, Mycobacterium bovis subsp bovis AF2122/97
ggucgguaacggcggu

SEQ ID NO: 1038871 - RNA, 23 nt, Mycobacterium bovis subsp bovis AF2122/97
ggucgguaccccagcgcugucgu

SEQ ID NO: 1038872 - RNA, 15 nt, Mycobacterium bovis subsp bovis AF2122/97
ggucgggucgcaccc

SEQ ID NO: 1038873 - RNA, 16 nt, Mycobacterium bovis subsp bovis AF2122/97
ggucgguaccgguacc

SEQ ID NO: 1038874 - RNA, 23 nt, Mycobacterium bovis subsp bovis AF2122/97
ggucggguaaauauugcgcccgg

SEQ ID NO: 1038875 - RNA, 18 nt, Mycobacterium bovis subsp bovis AF2122/97
ggucggggaacgcggcga

SEQ ID NO: 1038876 - RNA, 17 nt, Mycobacterium bovis subsp bovis AF2122/97
ggucggugauggucagc

SEQ ID NO: 1038877 - RNA, 18 nt, Mycobacterium bovis subsp bovis AF2122/97
ggucggucgcgcgacggc

SEQ ID NO: 1038878 - RNA, 21 nt, Mycobacterium bovis subsp bovis AF2122/97
ggucggucaccauggcgccgc

SEQ ID NO: 1038879 - RNA, 16 nt, Mycobacterium bovis subsp bovis AF2122/97
ggucggucacgacggc

SEQ ID NO: 1038880 - RNA, 13 nt, Mycobacterium bovis subsp bovis AF2122/97
ggucggucacgac

SEQ ID NO: 1038881 - RNA, 20 nt, Mycobacterium bovis subsp bovis AF2122/97
ggucggugauggucagcugg

SEQ ID NO: 1038882 - RNA, 16 nt, Mycobacterium bovis subsp bovis AF2122/97
ggucgucccgcccauc

SEQ ID NO: 1038883 - RNA, 23 nt, Mycobacterium bovis subsp bovis AF2122/97
ggucguccgccugcaccgccgcc

SEQ ID NO: 1038884 - RNA, 17 nt, Mycobacterium bovis subsp bovis AF2122/97
ggucggugagccgugcc

SEQ ID NO: 1038885 - RNA, 18 nt, Mycobacterium bovis subsp bovis AF2122/97
ggucggcgaaaggccagu

SEQ ID NO: 1038886 - RNA, 15 nt, Mycobacterium bovis subsp bovis AF2122/97
ggucggcgaccacca

SEQ ID NO: 1038887 - RNA, 21 nt, Mycobacterium bovis subsp bovis AF2122/97
ggucggccugcggcaccggcu

SEQ ID NO: 1038888 - RNA, 22 nt, Mycobacterium bovis subsp bovis AF2122/97
ggucggcgaccaccccguagcg

SEQ ID NO: 1038889 - RNA, 15 nt, Mycobacterium bovis subsp bovis AF2122/97
ggucggcgaucugcg

SEQ ID NO: 1038890 - RNA, 15 nt, Mycobacterium bovis subsp bovis AF2122/97
ggucggcgaccccga

SEQ ID NO: 1038891 - RNA, 23 nt, Mycobacterium bovis subsp bovis AF2122/97
ggucggcgcgccguugccggcca

SEQ ID NO: 1038892 - RNA, 16 nt, Mycobacterium bovis subsp bovis AF2122/97
ggucggcgaucugcgc

SEQ ID NO: 1038893 - RNA, 20 nt, Mycobacterium bovis subsp bovis AF2122/97
ggucggcgaugaugacggcg

SEQ ID NO: 1038894 - RNA, 15 nt, Mycobacterium bovis subsp bovis AF2122/97
ggucgcuggugcacg

SEQ ID NO: 1038895 - RNA, 17 nt, Mycobacterium bovis subsp bovis AF2122/97
ggucggaacuagccagu

SEQ ID NO: 1038896 - RNA, 16 nt, Mycobacterium bovis subsp bovis AF2122/97
ggucgcuugcugucgu

SEQ ID NO: 1038897 - RNA, 13 nt, Mycobacterium bovis subsp bovis AF2122/97
ggucggagcgggc

SEQ ID NO: 1038898 - RNA, 22 nt, Mycobacterium bovis subsp bovis AF2122/97
ggucggacggccaucgccagcc

SEQ ID NO: 1038899 - RNA, 22 nt, Mycobacterium bovis subsp bovis AF2122/97
ggucggccugcgaacacgcgau

SEQ ID NO: 1038900 - RNA, 17 nt, Mycobacterium bovis subsp bovis AF2122/97
ggucggccugcggcaac

SEQ ID NO: 1038901 - RNA, 16 nt, Mycobacterium bovis subsp bovis AF2122/97
ggucggccugcggcac

SEQ ID NO: 1038902 - RNA, 16 nt, Mycobacterium bovis subsp bovis AF2122/97
ggucggaucgauuccg

SEQ ID NO: 1038903 - RNA, 20 nt, Mycobacterium bovis subsp bovis AF2122/97
ggucggaucgauuccgccgc

SEQ ID NO: 1038904 - RNA, 16 nt, Mycobacterium bovis subsp bovis AF2122/97
ggugaaguuggcgugg

SEQ ID NO: 1038905 - RNA, 20 nt, Mycobacterium bovis subsp bovis AF2122/97
ggugaacuucuccaccagcg

SEQ ID NO: 1038906 - RNA, 17 nt, Mycobacterium bovis subsp bovis AF2122/97
ggugaaggugccccaag

SEQ ID NO: 1038907 - RNA, 20 nt, Mycobacterium bovis subsp bovis AF2122/97
ggugaaguagucggcgccga

SEQ ID NO: 1038908 - RNA, 21 nt, Mycobacterium bovis subsp bovis AF2122/97
ggugaagccguagacguugag

SEQ ID NO: 1038909 - RNA, 22 nt, Mycobacterium bovis subsp bovis AF2122/97
ggugaaggcaaacaccagcccg

SEQ ID NO: 1038910 - RNA, 17 nt, Mycobacterium bovis subsp bovis AF2122/97
ggugaagacaccggcgu

SEQ ID NO: 1038911 - RNA, 20 nt, Mycobacterium bovis subsp bovis AF2122/97
ggugaagacaccggcgucga

SEQ ID NO: 1038912 - RNA, 17 nt, Mycobacterium bovis subsp bovis AF2122/97
ggugaacugguugacgu

SEQ ID NO: 1038913 - RNA, 16 nt, Mycobacterium bovis subsp bovis AF2122/97
ggugaacugcuggccg

SEQ ID NO: 1038914 - RNA, 21 nt, Mycobacterium bovis subsp bovis AF2122/97
ggugaacucguucagcgucga

SEQ ID NO: 1038915 - RNA, 20 nt, Mycobacterium bovis subsp bovis AF2122/97
ggugaccucgucgaccggga

SEQ ID NO: 1038916 - RNA, 20 nt, Mycobacterium bovis subsp bovis AF2122/97
ggugaaguccgagacgucgg

SEQ ID NO: 1038917 - RNA, 16 nt, Mycobacterium bovis subsp bovis AF2122/97
ggugacaagcggcccg

SEQ ID NO: 1038918 - RNA, 21 nt, Mycobacterium bovis subsp bovis AF2122/97
ggugaccgggucgaucaccga

SEQ ID NO: 1038919 - RNA, 21 nt, Mycobacterium bovis subsp bovis AF2122/97
ggugaccgguguuccgcccag

SEQ ID NO: 1038920 - RNA, 22 nt, Mycobacterium bovis subsp bovis AF2122/97
ggugaccgguguuccgcccagc

SEQ ID NO: 1038921 - RNA, 18 nt, Mycobacterium bovis subsp bovis AF2122/97
ggugaaucgacugaucgc

SEQ ID NO: 1038922 - RNA, 16 nt, Mycobacterium bovis subsp bovis AF2122/97
ggugaauaucucgccg

SEQ ID NO: 1038923 - RNA, 18 nt, Mycobacterium bovis subsp bovis AF2122/97
ggugaccggcucggcggu

SEQ ID NO: 1038924 - RNA, 13 nt, Mycobacterium bovis subsp bovis AF2122/97
ggugacgccgcca

SEQ ID NO: 1038925 - RNA, 19 nt, Mycobacterium bovis subsp bovis AF2122/97
ggugacgccgccagcaccu

SEQ ID NO: 1038926 - RNA, 13 nt, Mycobacterium bovis subsp bovis AF2122/97
ggugacgcaacau

SEQ ID NO: 1038927 - RNA, 16 nt, Mycobacterium bovis subsp bovis AF2122/97
ggugacgcaacaucgg

SEQ ID NO: 1038928 - RNA, 16 nt, Mycobacterium bovis subsp bovis AF2122/97
ggugacgaccacgucg

SEQ ID NO: 1038929 - RNA, 16 nt, Mycobacterium bovis subsp bovis AF2122/97
ggugacgcccgcuccg

SEQ ID NO: 1038930 - RNA, 16 nt, Mycobacterium bovis subsp bovis AF2122/97
ggugacgauugccacc

SEQ ID NO: 1038931 - RNA, 16 nt, Mycobacterium bovis subsp bovis AF2122/97
ggugacgcacagcagc

SEQ ID NO: 1038932 - RNA, 20 nt, Mycobacterium bovis subsp bovis AF2122/97
ggugacgcacagcagcaccg

SEQ ID NO: 1038933 - RNA, 22 nt, Mycobacterium bovis subsp bovis AF2122/97
ggugacgcacagcagcaccgcg

SEQ ID NO: 1038934 - RNA, 23 nt, Mycobacterium bovis subsp bovis AF2122/97
ggugacgcacagcagcaccgcga

SEQ ID NO: 1038935 - RNA, 12 nt, Mycobacterium bovis subsp bovis AF2122/97
ggugacgaugaa

SEQ ID NO: 1038936 - RNA, 20 nt, Mycobacterium bovis subsp bovis AF2122/97
ggugacgaucaggccgucgc

SEQ ID NO: 1038937 - RNA, 14 nt, Mycobacterium bovis subsp bovis AF2122/97
ggugacgacgucgc

SEQ ID NO: 1038938 - RNA, 18 nt, Mycobacterium bovis subsp bovis AF2122/97
ggugacgagccaccaccg

SEQ ID NO: 1038939 - RNA, 13 nt, Mycobacterium bovis subsp bovis AF2122/97
ggugaccguggcg

SEQ ID NO: 1038940 - RNA, 16 nt, Mycobacterium bovis subsp bovis AF2122/97
ggugacgaaagcgccc

SEQ ID NO: 1038941 - RNA, 15 nt, Mycobacterium bovis subsp bovis AF2122/97
ggugacggcggcaac

SEQ ID NO: 1038942 - RNA, 13 nt, Mycobacterium bovis subsp bovis AF2122/97
ggugacggcggcu

SEQ ID NO: 1038943 - RNA, 12 nt, Mycobacterium bovis subsp bovis AF2122/97
ggugacggcggu

SEQ ID NO: 1038944 - RNA, 19 nt, Mycobacterium bovis subsp bovis AF2122/97
ggugacggcgguaccgccg

SEQ ID NO: 1038945 - RNA, 16 nt, Mycobacterium bovis subsp bovis AF2122/97
ggugacggggcugacc

SEQ ID NO: 1038946 - RNA, 18 nt, Mycobacterium bovis subsp bovis AF2122/97
ggugacggccggcggucg

SEQ ID NO: 1038947 - RNA, 20 nt, Mycobacterium bovis subsp bovis AF2122/97
ggugacggccggcggucggg

SEQ ID NO: 1038948 - RNA, 17 nt, Mycobacterium bovis subsp bovis AF2122/97
ggugacggugacaucgc

SEQ ID NO: 1038949 - RNA, 19 nt, Mycobacterium bovis subsp bovis AF2122/97
ggugacgguggccggcaac

SEQ ID NO: 1038950 - RNA, 17 nt, Mycobacterium bovis subsp bovis AF2122/97
ggugauccagccgucgg

SEQ ID NO: 1038951 - RNA, 19 nt, Mycobacterium bovis subsp bovis AF2122/97
ggugaucccgauggucacu

SEQ ID NO: 1038952 - RNA, 18 nt, Mycobacterium bovis subsp bovis AF2122/97
ggugaucgagguugacgu

SEQ ID NO: 1038953 - RNA, 22 nt, Mycobacterium bovis subsp bovis AF2122/97
ggugaucgagguugacgucagg

SEQ ID NO: 1038954 - RNA, 16 nt, Mycobacterium bovis subsp bovis AF2122/97
ggugaugcccagcgcc

SEQ ID NO: 1038955 - RNA, 14 nt, Mycobacterium bovis subsp bovis AF2122/97
ggugaugccgauga

SEQ ID NO: 1038956 - RNA, 13 nt, Mycobacterium bovis subsp bovis AF2122/97
ggugaugccgccg

SEQ ID NO: 1038957 - RNA, 20 nt, Mycobacterium bovis subsp bovis AF2122/97
ggugaguagauugcugacga

SEQ ID NO: 1038958 - RNA, 18 nt, Mycobacterium bovis subsp bovis AF2122/97
ggugaguccgcugagcgg

SEQ ID NO: 1038959 - RNA, 16 nt, Mycobacterium bovis subsp bovis AF2122/97
ggugaucaaaccggcg

SEQ ID NO: 1038960 - RNA, 18 nt, Mycobacterium bovis subsp bovis AF2122/97
ggugaucaaaccggcggc

SEQ ID NO: 1038961 - RNA, 20 nt, Mycobacterium bovis subsp bovis AF2122/97
ggugaucaaaccggcggcga

SEQ ID NO: 1038962 - RNA, 13 nt, Mycobacterium bovis subsp bovis AF2122/97
ggugaguucgccg

SEQ ID NO: 1038963 - RNA, 12 nt, Mycobacterium bovis subsp bovis AF2122/97
ggugaucaccga

SEQ ID NO: 1038964 - RNA, 20 nt, Mycobacterium bovis subsp bovis AF2122/97
ggugacucagaacguggccg

SEQ ID NO: 1038965 - RNA, 21 nt, Mycobacterium bovis subsp bovis AF2122/97
ggugaucaccaugaucagcgc

SEQ ID NO: 1038966 - RNA, 14 nt, Mycobacterium bovis subsp bovis AF2122/97
ggugaucacgucgg

SEQ ID NO: 1038967 - RNA, 22 nt, Mycobacterium bovis subsp bovis AF2122/97
ggugaucagcaggaucggcagc

SEQ ID NO: 1038968 - RNA, 16 nt, Mycobacterium bovis subsp bovis AF2122/97
ggugauccacgcucgg

SEQ ID NO: 1038969 - RNA, 17 nt, Mycobacterium bovis subsp bovis AF2122/97
ggugauccacgcucggg

SEQ ID NO: 1038970 - RNA, 17 nt, Mycobacterium bovis subsp bovis AF2122/97
ggugauggccgcgcccg

SEQ ID NO: 1038971 - RNA, 19 nt, Mycobacterium bovis subsp bovis AF2122/97
ggugauggccgcgcccgcc

SEQ ID NO: 1038972 - RNA, 19 nt, Mycobacterium bovis subsp bovis AF2122/97
ggugauguagagcucaccg

SEQ ID NO: 1038973 - RNA, 23 nt, Mycobacterium bovis subsp bovis AF2122/97
ggugaugggggagccggugacgg

SEQ ID NO: 1038974 - RNA, 17 nt, Mycobacterium bovis subsp bovis AF2122/97
ggugaugcccagcgccg

SEQ ID NO: 1038975 - RNA, 18 nt, Mycobacterium bovis subsp bovis AF2122/97
ggugauguuggccgccac

SEQ ID NO: 1038976 - RNA, 21 nt, Mycobacterium bovis subsp bovis AF2122/97
ggugauguuggccgccacacc

SEQ ID NO: 1038977 - RNA, 12 nt, Mycobacterium bovis subsp bovis AF2122/97
ggugcagccaga

SEQ ID NO: 1038978 - RNA, 24 nt, Mycobacterium bovis subsp bovis AF2122/97
ggugcagcccgccggauccgccag

SEQ ID NO: 1038979 - RNA, 12 nt, Mycobacterium bovis subsp bovis AF2122/97
ggugcagcagcg

SEQ ID NO: 1038980 - RNA, 13 nt, Mycobacterium bovis subsp bovis AF2122/97
ggugcagcccgcc

SEQ ID NO: 1038981 - RNA, 12 nt, Mycobacterium bovis subsp bovis AF2122/97
ggugcacggcgc

SEQ ID NO: 1038982 - RNA, 15 nt, Mycobacterium bovis subsp bovis AF2122/97
ggugcagaucgcccc

SEQ ID NO: 1038983 - RNA, 22 nt, Mycobacterium bovis subsp bovis AF2122/97
ggugcagcacgugugcgggcac

SEQ ID NO: 1038984 - RNA, 22 nt, Mycobacterium bovis subsp bovis AF2122/97
gguaccggcuucgucggccagc

SEQ ID NO: 1038985 - RNA, 20 nt, Mycobacterium bovis subsp bovis AF2122/97
gguaccgggaucccacggcg

SEQ ID NO: 1038986 - RNA, 15 nt, Mycobacterium bovis subsp bovis AF2122/97
gguaccaucaccgcg

SEQ ID NO: 1038987 - RNA, 17 nt, Mycobacterium bovis subsp bovis AF2122/97
gguaccaucaccgcgcc

SEQ ID NO: 1038988 - RNA, 19 nt, Mycobacterium bovis subsp bovis AF2122/97
gguacccaccucccgcagc

SEQ ID NO: 1038989 - RNA, 14 nt, Mycobacterium bovis subsp bovis AF2122/97
gguaccggcgaucu

SEQ ID NO: 1038990 - RNA, 14 nt, Mycobacterium bovis subsp bovis AF2122/97
gguaccggcgccgc

SEQ ID NO: 1038991 - RNA, 18 nt, Mycobacterium bovis subsp bovis AF2122/97
gguaccgagaacaccacg

SEQ ID NO: 1038992 - RNA, 19 nt, Mycobacterium bovis subsp bovis AF2122/97
gguaccgagaacaccacgc

SEQ ID NO: 1038993 - RNA, 17 nt, Mycobacterium bovis subsp bovis AF2122/97
gguaccgccacuggcgc

SEQ ID NO: 1038994 - RNA, 16 nt, Mycobacterium bovis subsp bovis AF2122/97
gguaccgccgcugccg

SEQ ID NO: 1038995 - RNA, 20 nt, Mycobacterium bovis subsp bovis AF2122/97
gguaccgccgcugccggugg

SEQ ID NO: 1038996 - RNA, 14 nt, Mycobacterium bovis subsp bovis AF2122/97
gguaccgccggcuc

SEQ ID NO: 1038997 - RNA, 17 nt, Mycobacterium bovis subsp bovis AF2122/97
gguaccgcgugcgccgg

SEQ ID NO: 1038998 - RNA, 20 nt, Mycobacterium bovis subsp bovis AF2122/97
gguaccgcgugcgccgggga

SEQ ID NO: 1038999 - RNA, 17 nt, Mycobacterium bovis subsp bovis AF2122/97
gguaccggcggcgccgg

SEQ ID NO: 1039000 - RNA, 21 nt, Mycobacterium bovis subsp bovis AF2122/97
gguaccggcggcgccggccuc

SEQ ID NO: 1039001 - RNA, 20 nt, Mycobacterium bovis subsp bovis AF2122/97
gguaccucccgcgugcgggg

SEQ ID NO: 1039002 - RNA, 14 nt, Mycobacterium bovis subsp bovis AF2122/97
gguacgccgccgcg

SEQ ID NO: 1039003 - RNA, 15 nt, Mycobacterium bovis subsp bovis AF2122/97
gguacgccgccgcga

SEQ ID NO: 1039004 - RNA, 14 nt, Mycobacterium bovis subsp bovis AF2122/97
gguacgccgcgccg

SEQ ID NO: 1039005 - RNA, 16 nt, Mycobacterium bovis subsp bovis AF2122/97
gguacgucgaggguga

SEQ ID NO: 1039006 - RNA, 17 nt, Mycobacterium bovis subsp bovis AF2122/97
gguacgucgagggugac

SEQ ID NO: 1039007 - RNA, 21 nt, Mycobacterium bovis subsp bovis AF2122/97
gguacgugaauuaaggugacc

SEQ ID NO: 1039008 - RNA, 17 nt, Mycobacterium bovis subsp bovis AF2122/97
gguacgcgaucagcgcg

SEQ ID NO: 1039009 - RNA, 19 nt, Mycobacterium bovis subsp bovis AF2122/97
gguacggaccguggcagcu

SEQ ID NO: 1039010 - RNA, 17 nt, Mycobacterium bovis subsp bovis AF2122/97
gguacucccgcgaucgc

SEQ ID NO: 1039011 - RNA, 18 nt, Mycobacterium bovis subsp bovis AF2122/97
gguagacguugccaacac

SEQ ID NO: 1039012 - RNA, 15 nt, Mycobacterium bovis subsp bovis AF2122/97
gguagccgaccagcg

SEQ ID NO: 1039013 - RNA, 15 nt, Mycobacterium bovis subsp bovis AF2122/97
gguagccgaccgacc

SEQ ID NO: 1039014 - RNA, 12 nt, Mycobacterium bovis subsp bovis AF2122/97
gguagccgacga

SEQ ID NO: 1039015 - RNA, 14 nt, Mycobacterium bovis subsp bovis AF2122/97
gguagccagcgcgc

SEQ ID NO: 1039016 - RNA, 23 nt, Mycobacterium bovis subsp bovis AF2122/97
gguagccaaccugaagccagcgc

SEQ ID NO: 1039017 - RNA, 23 nt, Mycobacterium bovis subsp bovis AF2122/97
gguagccaugggauucggccaga

SEQ ID NO: 1039018 - RNA, 18 nt, Mycobacterium bovis subsp bovis AF2122/97
gguagccauucggugugg

SEQ ID NO: 1039019 - RNA, 18 nt, Mycobacterium bovis subsp bovis AF2122/97
gguagcacagcagcaacg

SEQ ID NO: 1039020 - RNA, 16 nt, Mycobacterium bovis subsp bovis AF2122/97
gguagcacccacggcg

SEQ ID NO: 1039021 - RNA, 18 nt, Mycobacterium bovis subsp bovis AF2122/97
gguagcagcagcgggccg

SEQ ID NO: 1039022 - RNA, 21 nt, Mycobacterium bovis subsp bovis AF2122/97
gguagcugacgugucggcugc

SEQ ID NO: 1039023 - RNA, 22 nt, Mycobacterium bovis subsp bovis AF2122/97
gguagcggcuccgaaggccgcc

SEQ ID NO: 1039024 - RNA, 17 nt, Mycobacterium bovis subsp bovis AF2122/97
gguagcugccgcggccg

SEQ ID NO: 1039025 - RNA, 18 nt, Mycobacterium bovis subsp bovis AF2122/97
gguaggcggccagcgcgc

SEQ ID NO: 1039026 - RNA, 14 nt, Mycobacterium bovis subsp bovis AF2122/97
gguaggcaggccgg

SEQ ID NO: 1039027 - RNA, 19 nt, Mycobacterium bovis subsp bovis AF2122/97
gguaggcaggccggcucgc

SEQ ID NO: 1039028 - RNA, 21 nt, Mycobacterium bovis subsp bovis AF2122/97
gguaggacucacgcagcgcca

SEQ ID NO: 1039029 - RNA, 22 nt, Mycobacterium bovis subsp bovis AF2122/97
gguaggacuugauaucggcggg

SEQ ID NO: 1039030 - RNA, 12 nt, Mycobacterium bovis subsp bovis AF2122/97
gguagccggcgu

SEQ ID NO: 1039031 - RNA, 13 nt, Mycobacterium bovis subsp bovis AF2122/97
gguagccgucgau

SEQ ID NO: 1039032 - RNA, 13 nt, Mycobacterium bovis subsp bovis AF2122/97
gguagccugacca

SEQ ID NO: 1039033 - RNA, 22 nt, Mycobacterium bovis subsp bovis AF2122/97
gguagccgcccagcguugucgg

SEQ ID NO: 1039034 - RNA, 20 nt, Mycobacterium bovis subsp bovis AF2122/97
gguagcggaucaagcgcaca

SEQ ID NO: 1039035 - RNA, 13 nt, Mycobacterium bovis subsp bovis AF2122/97
gguagguucgacg

SEQ ID NO: 1039036 - RNA, 20 nt, Mycobacterium bovis subsp bovis AF2122/97
gguaguccggcuuaccggcg

SEQ ID NO: 1039037 - RNA, 13 nt, Mycobacterium bovis subsp bovis AF2122/97
gguaggcgguguc

SEQ ID NO: 1039038 - RNA, 18 nt, Mycobacterium bovis subsp bovis AF2122/97
gguaguugaggccgucga

SEQ ID NO: 1039039 - RNA, 16 nt, Mycobacterium bovis subsp bovis AF2122/97
gguagucguugccgau

SEQ ID NO: 1039040 - RNA, 14 nt, Mycobacterium bovis subsp bovis AF2122/97
gguaguucaccgcg

SEQ ID NO: 1039041 - RNA, 23 nt, Mycobacterium bovis subsp bovis AF2122/97
gguaucaggggaucccccgcgcg

SEQ ID NO: 1039042 - RNA, 14 nt, Mycobacterium bovis subsp bovis AF2122/97
ggucaacgugaacu

SEQ ID NO: 1039043 - RNA, 15 nt, Mycobacterium bovis subsp bovis AF2122/97
ggucaacgcuucggc

SEQ ID NO: 1039044 - RNA, 21 nt, Mycobacterium bovis subsp bovis AF2122/97
ggucaacggcagaucccacgc

SEQ ID NO: 1039045 - RNA, 13 nt, Mycobacterium bovis subsp bovis AF2122/97
ggucaacggccga

SEQ ID NO: 1039046 - RNA, 17 nt, Mycobacterium bovis subsp bovis AF2122/97
ggucaaccgcgcccuag

SEQ ID NO: 1039047 - RNA, 15 nt, Mycobacterium bovis subsp bovis AF2122/97
ggucaaccgcgucga

SEQ ID NO: 1039048 - RNA, 18 nt, Mycobacterium bovis subsp bovis AF2122/97
ggucaaaaucagggugcc

SEQ ID NO: 1039049 - RNA, 16 nt, Mycobacterium bovis subsp bovis AF2122/97
gguauugacguggccg

SEQ ID NO: 1039050 - RNA, 14 nt, Mycobacterium bovis subsp bovis AF2122/97
ggucaacagcggca

SEQ ID NO: 1039051 - RNA, 20 nt, Mycobacterium bovis subsp bovis AF2122/97
ggucacaaacccagcaucgg

SEQ ID NO: 1039052 - RNA, 18 nt, Mycobacterium bovis subsp bovis AF2122/97
ggucaaggugcgccgcca

SEQ ID NO: 1039053 - RNA, 22 nt, Mycobacterium bovis subsp bovis AF2122/97
ggucaaucggguucgucgucgu

SEQ ID NO: 1039054 - RNA, 15 nt, Mycobacterium bovis subsp bovis AF2122/97
ggucaaugccggccg

SEQ ID NO: 1039055 - RNA, 21 nt, Mycobacterium bovis subsp bovis AF2122/97
ggucaaugccggccgcggggc

SEQ ID NO: 1039056 - RNA, 17 nt, Mycobacterium bovis subsp bovis AF2122/97
ggucaaugcgcuggcgc

SEQ ID NO: 1039057 - RNA, 20 nt, Mycobacterium bovis subsp bovis AF2122/97
ggucaaugcgcuggcgccgc

SEQ ID NO: 1039058 - RNA, 21 nt, Mycobacterium bovis subsp bovis AF2122/97
ggucaaugcgcuggcgccgcc

SEQ ID NO: 1039059 - RNA, 22 nt, Mycobacterium bovis subsp bovis AF2122/97
ggucaaugcgcuggcgccgccg

SEQ ID NO: 1039060 - RNA, 21 nt, Mycobacterium bovis subsp bovis AF2122/97
ggucaagaucggugccagcac

SEQ ID NO: 1039061 - RNA, 19 nt, Mycobacterium bovis subsp bovis AF2122/97
ggucaagccggcgcccgcc

SEQ ID NO: 1039062 - RNA, 16 nt, Mycobacterium bovis subsp bovis AF2122/97
gguauucguggucggc

SEQ ID NO: 1039063 - RNA, 17 nt, Mycobacterium bovis subsp bovis AF2122/97
gguaugcucgcuggcgc

SEQ ID NO: 1039064 - RNA, 19 nt, Mycobacterium bovis subsp bovis AF2122/97
gguauggcggcgacggccg

SEQ ID NO: 1039065 - RNA, 14 nt, Mycobacterium bovis subsp bovis AF2122/97
ggucaaagcacucg

SEQ ID NO: 1039066 - RNA, 17 nt, Mycobacterium bovis subsp bovis AF2122/97
ggucaaauccagcagcc

SEQ ID NO: 1039067 - RNA, 22 nt, Mycobacterium bovis subsp bovis AF2122/97
ggucaacaagacgaugcuggcg

SEQ ID NO: 1039068 - RNA, 13 nt, Mycobacterium bovis subsp bovis AF2122/97
gguauccaccgcg

SEQ ID NO: 1039069 - RNA, 14 nt, Mycobacterium bovis subsp bovis AF2122/97
gguaucccccagcc

SEQ ID NO: 1039070 - RNA, 16 nt, Mycobacterium bovis subsp bovis AF2122/97
gguaucgucauugcga

SEQ ID NO: 1039071 - RNA, 19 nt, Mycobacterium bovis subsp bovis AF2122/97
gguaucgucccggcgaccg

SEQ ID NO: 1039072 - RNA, 17 nt, Mycobacterium bovis subsp bovis AF2122/97
gguaucggcgaccagcu

SEQ ID NO: 1039073 - RNA, 18 nt, Mycobacterium bovis subsp bovis AF2122/97
ggucaccucgccggcggg

SEQ ID NO: 1039074 - RNA, 18 nt, Mycobacterium bovis subsp bovis AF2122/97
ggucaccgucugcaccgg

SEQ ID NO: 1039075 - RNA, 16 nt, Mycobacterium bovis subsp bovis AF2122/97
ggucaccggucaccgc

SEQ ID NO: 1039076 - RNA, 12 nt, Mycobacterium bovis subsp bovis AF2122/97
ggucaccggccg

SEQ ID NO: 1039077 - RNA, 14 nt, Mycobacterium bovis subsp bovis AF2122/97
ggucaccggccgcc

SEQ ID NO: 1039078 - RNA, 15 nt, Mycobacterium bovis subsp bovis AF2122/97
ggucaccggccgccg

SEQ ID NO: 1039079 - RNA, 17 nt, Mycobacterium bovis subsp bovis AF2122/97
ggucaccgcgucaccgg

SEQ ID NO: 1039080 - RNA, 23 nt, Mycobacterium bovis subsp bovis AF2122/97
ggucaccgaagaacaguugcccg

SEQ ID NO: 1039081 - RNA, 22 nt, Mycobacterium bovis subsp bovis AF2122/97
ggucacccguguucgccacacc

SEQ ID NO: 1039082 - RNA, 20 nt, Mycobacterium bovis subsp bovis AF2122/97
ggucaccccggcucggccac

SEQ ID NO: 1039083 - RNA, 21 nt, Mycobacterium bovis subsp bovis AF2122/97
ggucaccccggcucggccacc

SEQ ID NO: 1039084 - RNA, 23 nt, Mycobacterium bovis subsp bovis AF2122/97
ggucaccccggcucggccaccga

SEQ ID NO: 1039085 - RNA, 15 nt, Mycobacterium bovis subsp bovis AF2122/97
ggucaccccuucgcc

SEQ ID NO: 1039086 - RNA, 19 nt, Mycobacterium bovis subsp bovis AF2122/97
ggucaccaagacaccggcc

SEQ ID NO: 1039087 - RNA, 22 nt, Mycobacterium bovis subsp bovis AF2122/97
ggucaccaagacaccggccugc

SEQ ID NO: 1039088 - RNA, 12 nt, Mycobacterium bovis subsp bovis AF2122/97
ggucaccaccau

SEQ ID NO: 1039089 - RNA, 16 nt, Mycobacterium bovis subsp bovis AF2122/97
ggucaccaccaucacg

SEQ ID NO: 1039090 - RNA, 13 nt, Mycobacterium bovis subsp bovis AF2122/97
ggucaccacgcgg

SEQ ID NO: 1039091 - RNA, 15 nt, Mycobacterium bovis subsp bovis AF2122/97
ggucaccacgcggcg

SEQ ID NO: 1039092 - RNA, 13 nt, Mycobacterium bovis subsp bovis AF2122/97
ggucaccacggcg

SEQ ID NO: 1039093 - RNA, 19 nt, Mycobacterium bovis subsp bovis AF2122/97
ggucaccauggcgccgcgc

SEQ ID NO: 1039094 - RNA, 20 nt, Mycobacterium bovis subsp bovis AF2122/97
ggucaccauggcgccgcgcc

SEQ ID NO: 1039095 - RNA, 22 nt, Mycobacterium bovis subsp bovis AF2122/97
ggucaccauggcgccgcgccga

SEQ ID NO: 1039096 - RNA, 22 nt, Mycobacterium bovis subsp bovis AF2122/97
ggucacccaauucacgacgccg

SEQ ID NO: 1039097 - RNA, 24 nt, Mycobacterium bovis subsp bovis AF2122/97
ggucacccacguugaugaugccgg

SEQ ID NO: 1039098 - RNA, 17 nt, Mycobacterium bovis subsp bovis AF2122/97
ggucaccagcgcaucgg

SEQ ID NO: 1039099 - RNA, 23 nt, Mycobacterium bovis subsp bovis AF2122/97
ggucaccuucuuggcgggugacu

SEQ ID NO: 1039100 - RNA, 19 nt, Mycobacterium bovis subsp bovis AF2122/97
ggucacgcagucgggcagc

SEQ ID NO: 1039101 - RNA, 15 nt, Mycobacterium bovis subsp bovis AF2122/97
ggucaccuuggccgg

SEQ ID NO: 1039102 - RNA, 20 nt, Mycobacterium bovis subsp bovis AF2122/97
ggucacgaagaccaggccgg

SEQ ID NO: 1039103 - RNA, 18 nt, Mycobacterium bovis subsp bovis AF2122/97
ggucacgacggcacgcca

SEQ ID NO: 1039104 - RNA, 22 nt, Mycobacterium bovis subsp bovis AF2122/97
ggucacgcgacuugcaccccgu

SEQ ID NO: 1039105 - RNA, 15 nt, Mycobacterium bovis subsp bovis AF2122/97
ggucagcaccggcgc

SEQ ID NO: 1039106 - RNA, 16 nt, Mycobacterium bovis subsp bovis AF2122/97
ggucagcaccggcgcg

SEQ ID NO: 1039107 - RNA, 16 nt, Mycobacterium bovis subsp bovis AF2122/97
ggucagcaccaccagc

SEQ ID NO: 1039108 - RNA, 23 nt, Mycobacterium bovis subsp bovis AF2122/97
ggucagcaauacggcggcgccgc

SEQ ID NO: 1039109 - RNA, 12 nt, Mycobacterium bovis subsp bovis AF2122/97
ggucagcaccac

SEQ ID NO: 1039110 - RNA, 19 nt, Mycobacterium bovis subsp bovis AF2122/97
ggucacgucgaugagucgg

SEQ ID NO: 1039111 - RNA, 20 nt, Mycobacterium bovis subsp bovis AF2122/97
ggucacuacuccggucccgc

SEQ ID NO: 1039112 - RNA, 17 nt, Mycobacterium bovis subsp bovis AF2122/97
gggugcgccgcagcagg

SEQ ID NO: 1039113 - RNA, 18 nt, Mycobacterium bovis subsp bovis AF2122/97
gggugcgcuugcggccgc

SEQ ID NO: 1039114 - RNA, 15 nt, Mycobacterium bovis subsp bovis AF2122/97
ggguggaccggucga

SEQ ID NO: 1039115 - RNA, 20 nt, Mycobacterium bovis subsp bovis AF2122/97
gggugcuuucgcgucugcuc

SEQ ID NO: 1039116 - RNA, 21 nt, Mycobacterium bovis subsp bovis AF2122/97
gggugcuuucgcgucugcucg

SEQ ID NO: 1039117 - RNA, 17 nt, Mycobacterium bovis subsp bovis AF2122/97
gggugcuuccucgcgag

SEQ ID NO: 1039118 - RNA, 16 nt, Mycobacterium bovis subsp bovis AF2122/97
gggugcugcgcgcggc

SEQ ID NO: 1039119 - RNA, 20 nt, Mycobacterium bovis subsp bovis AF2122/97
ggguggacaccugcugcacc

SEQ ID NO: 1039120 - RNA, 19 nt, Mycobacterium bovis subsp bovis AF2122/97
ggguggauugacgcgacga

SEQ ID NO: 1039121 - RNA, 14 nt, Mycobacterium bovis subsp bovis AF2122/97
ggguggccagcagg

SEQ ID NO: 1039122 - RNA, 18 nt, Mycobacterium bovis subsp bovis AF2122/97
ggguggccacgcccaggc

SEQ ID NO: 1039123 - RNA, 13 nt, Mycobacterium bovis subsp bovis AF2122/97
ggguggccgacga

SEQ ID NO: 1039124 - RNA, 16 nt, Mycobacterium bovis subsp bovis AF2122/97
gggugguaccggcggc

SEQ ID NO: 1039125 - RNA, 19 nt, Mycobacterium bovis subsp bovis AF2122/97
gggugguaccggcggcgcc

SEQ ID NO: 1039126 - RNA, 21 nt, Mycobacterium bovis subsp bovis AF2122/97
gggugguagcugacgcugcuc

SEQ ID NO: 1039127 - RNA, 16 nt, Mycobacterium bovis subsp bovis AF2122/97
ggguggcccgaccggg

SEQ ID NO: 1039128 - RNA, 22 nt, Mycobacterium bovis subsp bovis AF2122/97
gggugggcaagcugaccgccag

SEQ ID NO: 1039129 - RNA, 14 nt, Mycobacterium bovis subsp bovis AF2122/97
ggguggcgucgcgg

SEQ ID NO: 1039130 - RNA, 14 nt, Mycobacterium bovis subsp bovis AF2122/97
ggguggcgguccgg

SEQ ID NO: 1039131 - RNA, 15 nt, Mycobacterium bovis subsp bovis AF2122/97
ggguggcgcgguacc

SEQ ID NO: 1039132 - RNA, 12 nt, Mycobacterium bovis subsp bovis AF2122/97
ggguggcggcgc

SEQ ID NO: 1039133 - RNA, 12 nt, Mycobacterium bovis subsp bovis AF2122/97
gggugggcguga

SEQ ID NO: 1039134 - RNA, 13 nt, Mycobacterium bovis subsp bovis AF2122/97
gggugguccagcc

SEQ ID NO: 1039135 - RNA, 13 nt, Mycobacterium bovis subsp bovis AF2122/97
ggguguccgucga

SEQ ID NO: 1039136 - RNA, 22 nt, Mycobacterium bovis subsp bovis AF2122/97
gggugucgacaaccgcugccgc

SEQ ID NO: 1039137 - RNA, 14 nt, Mycobacterium bovis subsp bovis AF2122/97
gggugugcgggcgg

SEQ ID NO: 1039138 - RNA, 23 nt, Mycobacterium bovis subsp bovis AF2122/97
gggugugcgggcggugcacaccg

SEQ ID NO: 1039139 - RNA, 17 nt, Mycobacterium bovis subsp bovis AF2122/97
gggugucggcgaagcgg

SEQ ID NO: 1039140 - RNA, 14 nt, Mycobacterium bovis subsp bovis AF2122/97
gggugccagccggu

SEQ ID NO: 1039141 - RNA, 15 nt, Mycobacterium bovis subsp bovis AF2122/97
gggugccagccgguc

SEQ ID NO: 1039142 - RNA, 21 nt, Mycobacterium bovis subsp bovis AF2122/97
gggugcagcacggcgccgcca

SEQ ID NO: 1039143 - RNA, 20 nt, Mycobacterium bovis subsp bovis AF2122/97
gggugcagcacguccgcgga

SEQ ID NO: 1039144 - RNA, 20 nt, Mycobacterium bovis subsp bovis AF2122/97
gggugcccucggccgccuga

SEQ ID NO: 1039145 - RNA, 23 nt, Mycobacterium bovis subsp bovis AF2122/97
gggugcccucggccgccugacgg

SEQ ID NO: 1039146 - RNA, 12 nt, Mycobacterium bovis subsp bovis AF2122/97
gggugcccgcgu

SEQ ID NO: 1039147 - RNA, 16 nt, Mycobacterium bovis subsp bovis AF2122/97
gggugcccggccgcca

SEQ ID NO: 1039148 - RNA, 23 nt, Mycobacterium bovis subsp bovis AF2122/97
gggugcccggccgccagcgcgcc

SEQ ID NO: 1039149 - RNA, 14 nt, Mycobacterium bovis subsp bovis AF2122/97
gggugccggcgccg

SEQ ID NO: 1039150 - RNA, 15 nt, Mycobacterium bovis subsp bovis AF2122/97
gggugccggcgccgc

SEQ ID NO: 1039151 - RNA, 13 nt, Mycobacterium bovis subsp bovis AF2122/97
gggugccggcggu

SEQ ID NO: 1039152 - RNA, 19 nt, Mycobacterium bovis subsp bovis AF2122/97
gggugcccccggugccgcc

SEQ ID NO: 1039153 - RNA, 13 nt, Mycobacterium bovis subsp bovis AF2122/97
gggugccgaucga

SEQ ID NO: 1039154 - RNA, 22 nt, Mycobacterium bovis subsp bovis AF2122/97
gggugcgcccggccaagccggc

SEQ ID NO: 1039155 - RNA, 21 nt, Mycobacterium bovis subsp bovis AF2122/97
gggugcgccguugccgccguc

SEQ ID NO: 1039156 - RNA, 22 nt, Mycobacterium bovis subsp bovis AF2122/97
gggugccgguguugccgccggu

SEQ ID NO: 1039157 - RNA, 20 nt, Mycobacterium bovis subsp bovis AF2122/97
gggugccguugcgucugcuc

SEQ ID NO: 1039158 - RNA, 16 nt, Mycobacterium bovis subsp bovis AF2122/97
gggugcgacggcaggu

SEQ ID NO: 1039159 - RNA, 22 nt, Mycobacterium bovis subsp bovis AF2122/97
gggugaucuuggcgcccgccgg

SEQ ID NO: 1039160 - RNA, 15 nt, Mycobacterium bovis subsp bovis AF2122/97
gggcgucgaccacgc

SEQ ID NO: 1039161 - RNA, 16 nt, Mycobacterium bovis subsp bovis AF2122/97
gggcgucgaccacgca

SEQ ID NO: 1039162 - RNA, 16 nt, Mycobacterium bovis subsp bovis AF2122/97
gggcgucgaccgcggc

SEQ ID NO: 1039163 - RNA, 20 nt, Mycobacterium bovis subsp bovis AF2122/97
gggugagcuacucacgguga

SEQ ID NO: 1039164 - RNA, 20 nt, Mycobacterium bovis subsp bovis AF2122/97
gggugaggcgggucgccgcc

SEQ ID NO: 1039165 - RNA, 14 nt, Mycobacterium bovis subsp bovis AF2122/97
gggugaggcgguga

SEQ ID NO: 1039166 - RNA, 15 nt, Mycobacterium bovis subsp bovis AF2122/97
gggcgucgcuggugg

SEQ ID NO: 1039167 - RNA, 13 nt, Mycobacterium bovis subsp bovis AF2122/97
gggugagcgaccu

SEQ ID NO: 1039168 - RNA, 20 nt, Mycobacterium bovis subsp bovis AF2122/97
gggcgucaagcaaguccacc

SEQ ID NO: 1039169 - RNA, 16 nt, Mycobacterium bovis subsp bovis AF2122/97
gggcguccacgcugac

SEQ ID NO: 1039170 - RNA, 20 nt, Mycobacterium bovis subsp bovis AF2122/97
gggcggugcucuucggcacc

SEQ ID NO: 1039171 - RNA, 16 nt, Mycobacterium bovis subsp bovis AF2122/97
gggcggugccgccgga

SEQ ID NO: 1039172 - RNA, 22 nt, Mycobacterium bovis subsp bovis AF2122/97
gggcgguuacaacuggacgggg

SEQ ID NO: 1039173 - RNA, 18 nt, Mycobacterium bovis subsp bovis AF2122/97
ggguuacucgcagcgccg

SEQ ID NO: 1039174 - RNA, 17 nt, Mycobacterium bovis subsp bovis AF2122/97
ggguguuugucgcggug

SEQ ID NO: 1039175 - RNA, 21 nt, Mycobacterium bovis subsp bovis AF2122/97
ggguguugucgucgagcgcgc

SEQ ID NO: 1039176 - RNA, 16 nt, Mycobacterium bovis subsp bovis AF2122/97
ggguuaucggcagcag

SEQ ID NO: 1039177 - RNA, 18 nt, Mycobacterium bovis subsp bovis AF2122/97
ggguguuugucgcggugg

SEQ ID NO: 1039178 - RNA, 16 nt, Mycobacterium bovis subsp bovis AF2122/97
ggguguugucgucgag

SEQ ID NO: 1039179 - RNA, 20 nt, Mycobacterium bovis subsp bovis AF2122/97
ggguguugaucucgccggug

SEQ ID NO: 1039180 - RNA, 20 nt, Mycobacterium bovis subsp bovis AF2122/97
ggguguugaugggcagccgc

SEQ ID NO: 1039181 - RNA, 23 nt, Mycobacterium bovis subsp bovis AF2122/97
ggguguuccacaccaggccgagc

SEQ ID NO: 1039182 - RNA, 16 nt, Mycobacterium bovis subsp bovis AF2122/97
gggugugugcugccgc

SEQ ID NO: 1039183 - RNA, 18 nt, Mycobacterium bovis subsp bovis AF2122/97
ggguucgccgaagccgga

SEQ ID NO: 1039184 - RNA, 22 nt, Mycobacterium bovis subsp bovis AF2122/97
ggguucacuuccgggcagcugg

SEQ ID NO: 1039185 - RNA, 16 nt, Mycobacterium bovis subsp bovis AF2122/97
ggguuccggauccgau

SEQ ID NO: 1039186 - RNA, 14 nt, Mycobacterium bovis subsp bovis AF2122/97
ggguucgacguuga

SEQ ID NO: 1039187 - RNA, 11 nt, Mycobacterium bovis subsp bovis AF2122/97
ggguugaucgc

SEQ ID NO: 1039188 - RNA, 17 nt, Mycobacterium bovis subsp bovis AF2122/97
ggguugauuggccccgg

SEQ ID NO: 1039189 - RNA, 19 nt, Mycobacterium bovis subsp bovis AF2122/97
ggguucuuuaccgaugugg

SEQ ID NO: 1039190 - RNA, 16 nt, Mycobacterium bovis subsp bovis AF2122/97
ggguugaccgccaccc

SEQ ID NO: 1039191 - RNA, 14 nt, Mycobacterium bovis subsp bovis AF2122/97
ggguugacuggccg

SEQ ID NO: 1039192 - RNA, 16 nt, Mycobacterium bovis subsp bovis AF2122/97
ggguugcggucaccgg

SEQ ID NO: 1039193 - RNA, 13 nt, Mycobacterium bovis subsp bovis AF2122/97
ggguugccgccga

SEQ ID NO: 1039194 - RNA, 21 nt, Mycobacterium bovis subsp bovis AF2122/97
ggguugccaucaaggccaccu

SEQ ID NO: 1039195 - RNA, 23 nt, Mycobacterium bovis subsp bovis AF2122/97
ggguuucaaagcgacagcgcggc

SEQ ID NO: 1039196 - RNA, 17 nt, Mycobacterium bovis subsp bovis AF2122/97
ggguuucgaucuucucg

SEQ ID NO: 1039197 - RNA, 22 nt, Mycobacterium bovis subsp bovis AF2122/97
ggguuguucggcagccaugcgg

SEQ ID NO: 1039198 - RNA, 15 nt, Mycobacterium bovis subsp bovis AF2122/97
ggguuggccggcgcu

SEQ ID NO: 1039199 - RNA, 21 nt, Mycobacterium bovis subsp bovis AF2122/97
gguaccccccagcgacggcaa

SEQ ID NO: 1039200 - RNA, 16 nt, Mycobacterium bovis subsp bovis AF2122/97
gguaauccggcugccg

SEQ ID NO: 1039201 - RNA, 15 nt, Mycobacterium bovis subsp bovis AF2122/97
gguacacccgcucgc

SEQ ID NO: 1039202 - RNA, 16 nt, Mycobacterium bovis subsp bovis AF2122/97
gguacacccgcucgcc

SEQ ID NO: 1039203 - RNA, 17 nt, Mycobacterium bovis subsp bovis AF2122/97
gguacacccgcucgccc

SEQ ID NO: 1039204 - RNA, 23 nt, Mycobacterium bovis subsp bovis AF2122/97
gguacacccgcucgcccgccgcc

SEQ ID NO: 1039205 - RNA, 15 nt, Mycobacterium bovis subsp bovis AF2122/97
gguaacaccggcgag

SEQ ID NO: 1039206 - RNA, 14 nt, Mycobacterium bovis subsp bovis AF2122/97
gguaaagggcucga

SEQ ID NO: 1039207 - RNA, 23 nt, Mycobacterium bovis subsp bovis AF2122/97
ggguuucgaucuucucgcggacg

SEQ ID NO: 1039208 - RNA, 14 nt, Mycobacterium bovis subsp bovis AF2122/97
gguaaagcgauggg

SEQ ID NO: 1039209 - RNA, 20 nt, Mycobacterium bovis subsp bovis AF2122/97
gguaaccggcccgaugaccg

SEQ ID NO: 1039210 - RNA, 14 nt, Mycobacterium bovis subsp bovis AF2122/97
gguaaccagcgcca

SEQ ID NO: 1039211 - RNA, 21 nt, Mycobacterium bovis subsp bovis AF2122/97
gguaaccagcgccacgaugac

SEQ ID NO: 1039212 - RNA, 20 nt, Mycobacterium bovis subsp bovis AF2122/97
gguaaccauauggcccgcga

SEQ ID NO: 1039213 - RNA, 20 nt, Mycobacterium bovis subsp bovis AF2122/97
gguaacgccaacaccggcau

SEQ ID NO: 1039214 - RNA, 20 nt, Mycobacterium bovis subsp bovis AF2122/97
gguaauacgcggggccggcc

SEQ ID NO: 1039215 - RNA, 14 nt, Mycobacterium bovis subsp bovis AF2122/97
gguaaggccggccg

SEQ ID NO: 1039216 - RNA, 21 nt, Mycobacterium bovis subsp bovis AF2122/97
gguaaggcuugucagccgcga

SEQ ID NO: 1039217 - RNA, 22 nt, Mycobacterium bovis subsp bovis AF2122/97
gguaacucgaguagucgcuggc

SEQ ID NO: 1039218 - RNA, 15 nt, Mycobacterium bovis subsp bovis AF2122/97
gguaagaaucgaagc

SEQ ID NO: 1039219 - RNA, 17 nt, Mycobacterium bovis subsp bovis AF2122/97
gguaagaguucgcgcgc

SEQ ID NO: 1039220 - RNA, 22 nt, Mycobacterium bovis subsp bovis AF2122/97
gguaagaguucgcgcgccgcga

SEQ ID NO: 1039221 - RNA, 14 nt, Mycobacterium bovis subsp bovis AF2122/97
gguaagcagccagc

SEQ ID NO: 1039222 - RNA, 21 nt, Mycobacterium bovis subsp bovis AF2122/97
gguaagcgaacggguagucgg

SEQ ID NO: 1039223 - RNA, 16 nt, Mycobacterium bovis subsp bovis AF2122/97
gguaagcgagucgacg

SEQ ID NO: 1039224 - RNA, 14 nt, Mycobacterium bovis subsp bovis AF2122/97
gucacccgcccgag

SEQ ID NO: 1039225 - RNA, 21 nt, Mycobacterium bovis subsp bovis AF2122/97
gucaccccggcucggccaccg

SEQ ID NO: 1039226 - RNA, 22 nt, Mycobacterium bovis subsp bovis AF2122/97
gucaccccggcucggccaccga

SEQ ID NO: 1039227 - RNA, 19 nt, Mycobacterium bovis subsp bovis AF2122/97
gucaccccggucccgccga

SEQ ID NO: 1039228 - RNA, 20 nt, Mycobacterium bovis subsp bovis AF2122/97
gucaccccggucccgccgac

SEQ ID NO: 1039229 - RNA, 18 nt, Mycobacterium bovis subsp bovis AF2122/97
gucaccccugggcggaug

SEQ ID NO: 1039230 - RNA, 19 nt, Mycobacterium bovis subsp bovis AF2122/97
gucaccccuucgccagcgc

SEQ ID NO: 1039231 - RNA, 17 nt, Mycobacterium bovis subsp bovis AF2122/97
gucaccgagcccgaucg

SEQ ID NO: 1039232 - RNA, 18 nt, Mycobacterium bovis subsp bovis AF2122/97
gucaccgagcccgaucgc

SEQ ID NO: 1039233 - RNA, 19 nt, Mycobacterium bovis subsp bovis AF2122/97
gucacccugucgcgcaccg

SEQ ID NO: 1039234 - RNA, 20 nt, Mycobacterium bovis subsp bovis AF2122/97
gucaccgcccuugccgccgg

SEQ ID NO: 1039235 - RNA, 17 nt, Mycobacterium bovis subsp bovis AF2122/97
gucaccgauucggccag

SEQ ID NO: 1039236 - RNA, 18 nt, Mycobacterium bovis subsp bovis AF2122/97
gucaccgauucggccagc

SEQ ID NO: 1039237 - RNA, 19 nt, Mycobacterium bovis subsp bovis AF2122/97
gucaccgauucggccagcg

SEQ ID NO: 1039238 - RNA, 20 nt, Mycobacterium bovis subsp bovis AF2122/97
gucaccgauucggccagcgc

SEQ ID NO: 1039239 - RNA, 18 nt, Mycobacterium bovis subsp bovis AF2122/97
gucaccgcaaccgagcug

SEQ ID NO: 1039240 - RNA, 12 nt, Mycobacterium bovis subsp bovis AF2122/97
gucaccgccggc

SEQ ID NO: 1039241 - RNA, 13 nt, Mycobacterium bovis subsp bovis AF2122/97
gucaccgccgacg

SEQ ID NO: 1039242 - RNA, 13 nt, Mycobacterium bovis subsp bovis AF2122/97
gucaccgccggug

SEQ ID NO: 1039243 - RNA, 23 nt, Mycobacterium bovis subsp bovis AF2122/97
gucaccgccguugccgccggcgc

SEQ ID NO: 1039244 - RNA, 16 nt, Mycobacterium bovis subsp bovis AF2122/97
gucaccggaggccgcc

SEQ ID NO: 1039245 - RNA, 18 nt, Mycobacterium bovis subsp bovis AF2122/97
gucaccggaggccgccgc

SEQ ID NO: 1039246 - RNA, 22 nt, Mycobacterium bovis subsp bovis AF2122/97
gucaccggaggccgccgcgccg

SEQ ID NO: 1039247 - RNA, 15 nt, Mycobacterium bovis subsp bovis AF2122/97
gucaccggccgccga

SEQ ID NO: 1039248 - RNA, 18 nt, Mycobacterium bovis subsp bovis AF2122/97
gucaccggcgaccggugc

SEQ ID NO: 1039249 - RNA, 15 nt, Mycobacterium bovis subsp bovis AF2122/97
gucaccggcgcaccg

SEQ ID NO: 1039250 - RNA, 17 nt, Mycobacterium bovis subsp bovis AF2122/97
gucaccggcacgucgcc

SEQ ID NO: 1039251 - RNA, 14 nt, Mycobacterium bovis subsp bovis AF2122/97
gucacgaucgugcc

SEQ ID NO: 1039252 - RNA, 21 nt, Mycobacterium bovis subsp bovis AF2122/97
gucacgaucgugccgggaccg

SEQ ID NO: 1039253 - RNA, 18 nt, Mycobacterium bovis subsp bovis AF2122/97
gucaccgggugcaccggc

SEQ ID NO: 1039254 - RNA, 16 nt, Mycobacterium bovis subsp bovis AF2122/97
gucaccggucaccgcg

SEQ ID NO: 1039255 - RNA, 17 nt, Mycobacterium bovis subsp bovis AF2122/97
gucaccggucaccgcgc

SEQ ID NO: 1039256 - RNA, 18 nt, Mycobacterium bovis subsp bovis AF2122/97
gucaccggguccaccgca

SEQ ID NO: 1039257 - RNA, 22 nt, Mycobacterium bovis subsp bovis AF2122/97
gucaccggcuucggccagcagu

SEQ ID NO: 1039258 - RNA, 15 nt, Mycobacterium bovis subsp bovis AF2122/97
gucaccgcgucaccg

SEQ ID NO: 1039259 - RNA, 13 nt, Mycobacterium bovis subsp bovis AF2122/97
gucaccggcgucg

SEQ ID NO: 1039260 - RNA, 14 nt, Mycobacterium bovis subsp bovis AF2122/97
gucaccggcgucgc

SEQ ID NO: 1039261 - RNA, 14 nt, Mycobacterium bovis subsp bovis AF2122/97
gucaccgggugcac

SEQ ID NO: 1039262 - RNA, 16 nt, Mycobacterium bovis subsp bovis AF2122/97
gucacgcaaccggcgg

SEQ ID NO: 1039263 - RNA, 13 nt, Mycobacterium bovis subsp bovis AF2122/97
gucacgcacccgg

SEQ ID NO: 1039264 - RNA, 16 nt, Mycobacterium bovis subsp bovis AF2122/97
gucacgcacccggcgc

SEQ ID NO: 1039265 - RNA, 12 nt, Mycobacterium bovis subsp bovis AF2122/97
gucacgcaccgc

SEQ ID NO: 1039266 - RNA, 17 nt, Mycobacterium bovis subsp bovis AF2122/97
gucacgcaccgcggugg

SEQ ID NO: 1039267 - RNA, 17 nt, Mycobacterium bovis subsp bovis AF2122/97
gucacgcagcacccugc

SEQ ID NO: 1039268 - RNA, 17 nt, Mycobacterium bovis subsp bovis AF2122/97
gucacgcagccgcgcgg

SEQ ID NO: 1039269 - RNA, 18 nt, Mycobacterium bovis subsp bovis AF2122/97
gucaccgcgcuggucagc

SEQ ID NO: 1039270 - RNA, 19 nt, Mycobacterium bovis subsp bovis AF2122/97
gucacgccccucacgugga

SEQ ID NO: 1039271 - RNA, 19 nt, Mycobacterium bovis subsp bovis AF2122/97
gucacgccugccaccggcg

SEQ ID NO: 1039272 - RNA, 13 nt, Mycobacterium bovis subsp bovis AF2122/97
gucacgcgcggcg

SEQ ID NO: 1039273 - RNA, 16 nt, Mycobacterium bovis subsp bovis AF2122/97
gucacgcgcggcggcg

SEQ ID NO: 1039274 - RNA, 21 nt, Mycobacterium bovis subsp bovis AF2122/97
gucacgcgcggcggcguccac

SEQ ID NO: 1039275 - RNA, 21 nt, Mycobacterium bovis subsp bovis AF2122/97
gucacgcccaugaccggccgc

SEQ ID NO: 1039276 - RNA, 16 nt, Mycobacterium bovis subsp bovis AF2122/97
gucacgccccucacgu

SEQ ID NO: 1039277 - RNA, 16 nt, Mycobacterium bovis subsp bovis AF2122/97
gucaccacgcggcggu

SEQ ID NO: 1039278 - RNA, 18 nt, Mycobacterium bovis subsp bovis AF2122/97
gucaccacgcggcggucg

SEQ ID NO: 1039279 - RNA, 20 nt, Mycobacterium bovis subsp bovis AF2122/97
gucaccacgcggcggucguu

SEQ ID NO: 1039280 - RNA, 17 nt, Mycobacterium bovis subsp bovis AF2122/97
gucaccacggcggcggc

SEQ ID NO: 1039281 - RNA, 19 nt, Mycobacterium bovis subsp bovis AF2122/97
gucaacgacauugccacgg

SEQ ID NO: 1039282 - RNA, 22 nt, Mycobacterium bovis subsp bovis AF2122/97
gucaccaccgccgccaccaccg

SEQ ID NO: 1039283 - RNA, 17 nt, Mycobacterium bovis subsp bovis AF2122/97
gucaccagcgcaucggc

SEQ ID NO: 1039284 - RNA, 20 nt, Mycobacterium bovis subsp bovis AF2122/97
gucaccaccaccgccgcacg

SEQ ID NO: 1039285 - RNA, 14 nt, Mycobacterium bovis subsp bovis AF2122/97
gucaccaagacacc

SEQ ID NO: 1039286 - RNA, 16 nt, Mycobacterium bovis subsp bovis AF2122/97
gucaccaagacaccgg

SEQ ID NO: 1039287 - RNA, 18 nt, Mycobacterium bovis subsp bovis AF2122/97
gucaccaagacaccggcc

SEQ ID NO: 1039288 - RNA, 15 nt, Mycobacterium bovis subsp bovis AF2122/97
gucacaggccgccug

SEQ ID NO: 1039289 - RNA, 12 nt, Mycobacterium bovis subsp bovis AF2122/97
gucacaggcgac

SEQ ID NO: 1039290 - RNA, 16 nt, Mycobacterium bovis subsp bovis AF2122/97
gucaacgccacgccga

SEQ ID NO: 1039291 - RNA, 18 nt, Mycobacterium bovis subsp bovis AF2122/97
gucaacgccacgccgaug

SEQ ID NO: 1039292 - RNA, 19 nt, Mycobacterium bovis subsp bovis AF2122/97
gucaacccgcaccccggcc

SEQ ID NO: 1039293 - RNA, 18 nt, Mycobacterium bovis subsp bovis AF2122/97
gucaaccgaucggucguc

SEQ ID NO: 1039294 - RNA, 14 nt, Mycobacterium bovis subsp bovis AF2122/97
gucaacagcgucgu

SEQ ID NO: 1039295 - RNA, 13 nt, Mycobacterium bovis subsp bovis AF2122/97
gucaacaggccgu

SEQ ID NO: 1039296 - RNA, 18 nt, Mycobacterium bovis subsp bovis AF2122/97
gucaacagggccaggaca

SEQ ID NO: 1039297 - RNA, 20 nt, Mycobacterium bovis subsp bovis AF2122/97
gucaacagggccaggacaac

SEQ ID NO: 1039298 - RNA, 17 nt, Mycobacterium bovis subsp bovis AF2122/97
gucaaccaagugaccgg

SEQ ID NO: 1039299 - RNA, 13 nt, Mycobacterium bovis subsp bovis AF2122/97
gucaaccaccagg

SEQ ID NO: 1039300 - RNA, 17 nt, Mycobacterium bovis subsp bovis AF2122/97
gucaaccacggccgccg

SEQ ID NO: 1039301 - RNA, 15 nt, Mycobacterium bovis subsp bovis AF2122/97
guaugcugcgcgccg

SEQ ID NO: 1039302 - RNA, 22 nt, Mycobacterium bovis subsp bovis AF2122/97
guaugggggugcuuccucgcga

SEQ ID NO: 1039303 - RNA, 14 nt, Mycobacterium bovis subsp bovis AF2122/97
guauggcggucggc

SEQ ID NO: 1039304 - RNA, 15 nt, Mycobacterium bovis subsp bovis AF2122/97
guauggccgccaccg

SEQ ID NO: 1039305 - RNA, 22 nt, Mycobacterium bovis subsp bovis AF2122/97
gucaaacgcaaagacagcgcgg

SEQ ID NO: 1039306 - RNA, 22 nt, Mycobacterium bovis subsp bovis AF2122/97
gucaaacccagcgacgcggcca

SEQ ID NO: 1039307 - RNA, 17 nt, Mycobacterium bovis subsp bovis AF2122/97
gucaaauccagcagcca

SEQ ID NO: 1039308 - RNA, 15 nt, Mycobacterium bovis subsp bovis AF2122/97
gucaacacccgcccg

SEQ ID NO: 1039309 - RNA, 20 nt, Mycobacterium bovis subsp bovis AF2122/97
gucaacacccgcccgggcgu

SEQ ID NO: 1039310 - RNA, 14 nt, Mycobacterium bovis subsp bovis AF2122/97
gucaacaccgcggc

SEQ ID NO: 1039311 - RNA, 15 nt, Mycobacterium bovis subsp bovis AF2122/97
gucaacaccgcggcc

SEQ ID NO: 1039312 - RNA, 18 nt, Mycobacterium bovis subsp bovis AF2122/97
gucaacaccgcggccgag

SEQ ID NO: 1039313 - RNA, 22 nt, Mycobacterium bovis subsp bovis AF2122/97
guaucgaaagccaacucgaccg

SEQ ID NO: 1039314 - RNA, 23 nt, Mycobacterium bovis subsp bovis AF2122/97
guaucgacccgaugacccacugc

SEQ ID NO: 1039315 - RNA, 20 nt, Mycobacterium bovis subsp bovis AF2122/97
guaucgagaugccaucggug

SEQ ID NO: 1039316 - RNA, 16 nt, Mycobacterium bovis subsp bovis AF2122/97
guaucgaggccgacga

SEQ ID NO: 1039317 - RNA, 18 nt, Mycobacterium bovis subsp bovis AF2122/97
guaugauucacgcucggc

SEQ ID NO: 1039318 - RNA, 15 nt, Mycobacterium bovis subsp bovis AF2122/97
guaucgagcggcaca

SEQ ID NO: 1039319 - RNA, 18 nt, Mycobacterium bovis subsp bovis AF2122/97
guauccgcgccgcaccau

SEQ ID NO: 1039320 - RNA, 21 nt, Mycobacterium bovis subsp bovis AF2122/97
guauccgcgccgcaccaucgg

SEQ ID NO: 1039321 - RNA, 16 nt, Mycobacterium bovis subsp bovis AF2122/97
guaucccccagccgcg

SEQ ID NO: 1039322 - RNA, 14 nt, Mycobacterium bovis subsp bovis AF2122/97
guauccaccgcgag

SEQ ID NO: 1039323 - RNA, 18 nt, Mycobacterium bovis subsp bovis AF2122/97
guauccacggucgaccag

SEQ ID NO: 1039324 - RNA, 17 nt, Mycobacterium bovis subsp bovis AF2122/97
guaguugccggcuucgg

SEQ ID NO: 1039325 - RNA, 13 nt, Mycobacterium bovis subsp bovis AF2122/97
guaguugcgcggc

SEQ ID NO: 1039326 - RNA, 17 nt, Mycobacterium bovis subsp bovis AF2122/97
guauagcucacgguggc

SEQ ID NO: 1039327 - RNA, 16 nt, Mycobacterium bovis subsp bovis AF2122/97
guaggacacguggugg

SEQ ID NO: 1039328 - RNA, 19 nt, Mycobacterium bovis subsp bovis AF2122/97
guagcuuccgcgacgcucg

SEQ ID NO: 1039329 - RNA, 15 nt, Mycobacterium bovis subsp bovis AF2122/97
guagcuucgaugggc

SEQ ID NO: 1039330 - RNA, 20 nt, Mycobacterium bovis subsp bovis AF2122/97
guagcugcgggucucgccga

SEQ ID NO: 1039331 - RNA, 23 nt, Mycobacterium bovis subsp bovis AF2122/97
guagcuggccagguugccgucgg

SEQ ID NO: 1039332 - RNA, 19 nt, Mycobacterium bovis subsp bovis AF2122/97
guagcuggcgaucuggucg

SEQ ID NO: 1039333 - RNA, 19 nt, Mycobacterium bovis subsp bovis AF2122/97
guagcugccgcggccggcg

SEQ ID NO: 1039334 - RNA, 16 nt, Mycobacterium bovis subsp bovis AF2122/97
guaggagccgucacgc

SEQ ID NO: 1039335 - RNA, 14 nt, Mycobacterium bovis subsp bovis AF2122/97
guaggacugccagc

SEQ ID NO: 1039336 - RNA, 19 nt, Mycobacterium bovis subsp bovis AF2122/97
guaggacugccagcguugc

SEQ ID NO: 1039337 - RNA, 14 nt, Mycobacterium bovis subsp bovis AF2122/97
guagucacggucgu

SEQ ID NO: 1039338 - RNA, 17 nt, Mycobacterium bovis subsp bovis AF2122/97
guagugcaucggcagcc

SEQ ID NO: 1039339 - RNA, 14 nt, Mycobacterium bovis subsp bovis AF2122/97
guagugcucgccgg

SEQ ID NO: 1039340 - RNA, 15 nt, Mycobacterium bovis subsp bovis AF2122/97
guaguugccggcuuc

SEQ ID NO: 1039341 - RNA, 13 nt, Mycobacterium bovis subsp bovis AF2122/97
guagugucggcgu

SEQ ID NO: 1039342 - RNA, 15 nt, Mycobacterium bovis subsp bovis AF2122/97
guagugucggcgucu

SEQ ID NO: 1039343 - RNA, 17 nt, Mycobacterium bovis subsp bovis AF2122/97
guagucugcacgucggc

SEQ ID NO: 1039344 - RNA, 20 nt, Mycobacterium bovis subsp bovis AF2122/97
guagugaucgaucgcggcgc

SEQ ID NO: 1039345 - RNA, 14 nt, Mycobacterium bovis subsp bovis AF2122/97
guaguccucggugg

SEQ ID NO: 1039346 - RNA, 16 nt, Mycobacterium bovis subsp bovis AF2122/97
guaguccugcgggccg

SEQ ID NO: 1039347 - RNA, 14 nt, Mycobacterium bovis subsp bovis AF2122/97
guaguccggccagu

SEQ ID NO: 1039348 - RNA, 19 nt, Mycobacterium bovis subsp bovis AF2122/97
guaccggaaucggcggcgg

SEQ ID NO: 1039349 - RNA, 18 nt, Mycobacterium bovis subsp bovis AF2122/97
guaccgcucgggcgcgag

SEQ ID NO: 1039350 - RNA, 21 nt, Mycobacterium bovis subsp bovis AF2122/97
guaccgcgcguugaagucgcc

SEQ ID NO: 1039351 - RNA, 13 nt, Mycobacterium bovis subsp bovis AF2122/97
guaccgcggaucg

SEQ ID NO: 1039352 - RNA, 16 nt, Mycobacterium bovis subsp bovis AF2122/97
guaccgagaacaccac

SEQ ID NO: 1039353 - RNA, 13 nt, Mycobacterium bovis subsp bovis AF2122/97
guaccgcgacgua

SEQ ID NO: 1039354 - RNA, 19 nt, Mycobacterium bovis subsp bovis AF2122/97
guaccgccacuggcgcuga

SEQ ID NO: 1039355 - RNA, 22 nt, Mycobacterium bovis subsp bovis AF2122/97
guaccgcccaguugggccucag

SEQ ID NO: 1039356 - RNA, 12 nt, Mycobacterium bovis subsp bovis AF2122/97
guaccggcggcg

SEQ ID NO: 1039357 - RNA, 13 nt, Mycobacterium bovis subsp bovis AF2122/97
guaccggcggcgc

SEQ ID NO: 1039358 - RNA, 15 nt, Mycobacterium bovis subsp bovis AF2122/97
guaccggcggcgccg

SEQ ID NO: 1039359 - RNA, 23 nt, Mycobacterium bovis subsp bovis AF2122/97
guaccggcguucccacuggaggu

SEQ ID NO: 1039360 - RNA, 16 nt, Mycobacterium bovis subsp bovis AF2122/97
guaccggcugguugac

SEQ ID NO: 1039361 - RNA, 21 nt, Mycobacterium bovis subsp bovis AF2122/97
guaccggcugguugaccgagu

SEQ ID NO: 1039362 - RNA, 14 nt, Mycobacterium bovis subsp bovis AF2122/97
guaccggccagccg

SEQ ID NO: 1039363 - RNA, 15 nt, Mycobacterium bovis subsp bovis AF2122/97
guaccggcgccaccg

SEQ ID NO: 1039364 - RNA, 20 nt, Mycobacterium bovis subsp bovis AF2122/97
guaccggcgccaccguggug

SEQ ID NO: 1039365 - RNA, 20 nt, Mycobacterium bovis subsp bovis AF2122/97
guaccguuccacgucguacu

SEQ ID NO: 1039366 - RNA, 13 nt, Mycobacterium bovis subsp bovis AF2122/97
guaccgggacgaa

SEQ ID NO: 1039367 - RNA, 21 nt, Mycobacterium bovis subsp bovis AF2122/97
guaccgggcgagucccggcgg

SEQ ID NO: 1039368 - RNA, 23 nt, Mycobacterium bovis subsp bovis AF2122/97
guaccgacgaagaucgcugcgaa

SEQ ID NO: 1039369 - RNA, 15 nt, Mycobacterium bovis subsp bovis AF2122/97
guacccggccugcgu

SEQ ID NO: 1039370 - RNA, 21 nt, Mycobacterium bovis subsp bovis AF2122/97
guacccggaggcaauccgauc

SEQ ID NO: 1039371 - RNA, 13 nt, Mycobacterium bovis subsp bovis AF2122/97
guacccgccucgg

SEQ ID NO: 1039372 - RNA, 12 nt, Mycobacterium bovis subsp bovis AF2122/97
guacccgcgccg

SEQ ID NO: 1039373 - RNA, 15 nt, Mycobacterium bovis subsp bovis AF2122/97
guacccgcgccgcgc

SEQ ID NO: 1039374 - RNA, 15 nt, Mycobacterium bovis subsp bovis AF2122/97
guacccgaucagcga

SEQ ID NO: 1039375 - RNA, 16 nt, Mycobacterium bovis subsp bovis AF2122/97
guaccccccagcgacg

SEQ ID NO: 1039376 - RNA, 15 nt, Mycobacterium bovis subsp bovis AF2122/97
guaccagguggaccg

SEQ ID NO: 1039377 - RNA, 23 nt, Mycobacterium bovis subsp bovis AF2122/97
guaccagccgaagaaccggucgc

SEQ ID NO: 1039378 - RNA, 20 nt, Mycobacterium bovis subsp bovis AF2122/97
guaccagcccaccggcgccg

SEQ ID NO: 1039379 - RNA, 22 nt, Mycobacterium bovis subsp bovis AF2122/97
guacccacgcauguuggugauc

SEQ ID NO: 1039380 - RNA, 15 nt, Mycobacterium bovis subsp bovis AF2122/97
guaccaucaccgcgc

SEQ ID NO: 1039381 - RNA, 18 nt, Mycobacterium bovis subsp bovis AF2122/97
guacuagcagcgggcugc

SEQ ID NO: 1039382 - RNA, 15 nt, Mycobacterium bovis subsp bovis AF2122/97
guacucccgcgaucg

SEQ ID NO: 1039383 - RNA, 17 nt, Mycobacterium bovis subsp bovis AF2122/97
guacucccgcgaucgcg

SEQ ID NO: 1039384 - RNA, 20 nt, Mycobacterium bovis subsp bovis AF2122/97
guacuccaccgcgccgucgu

SEQ ID NO: 1039385 - RNA, 23 nt, Mycobacterium bovis subsp bovis AF2122/97
guacucaucgacguuccagcagu

SEQ ID NO: 1039386 - RNA, 14 nt, Mycobacterium bovis subsp bovis AF2122/97
guacgccgccgcga

SEQ ID NO: 1039387 - RNA, 16 nt, Mycobacterium bovis subsp bovis AF2122/97
guacgccgccgcgacg

SEQ ID NO: 1039388 - RNA, 19 nt, Mycobacterium bovis subsp bovis AF2122/97
guacgccggacccggucgc

SEQ ID NO: 1039389 - RNA, 16 nt, Mycobacterium bovis subsp bovis AF2122/97
guacgcgaucagcgcg

SEQ ID NO: 1039390 - RNA, 19 nt, Mycobacterium bovis subsp bovis AF2122/97
guacgcgaucagcgcgcac

SEQ ID NO: 1039391 - RNA, 21 nt, Mycobacterium bovis subsp bovis AF2122/97
guacgccucgacagcggcaau

SEQ ID NO: 1039392 - RNA, 18 nt, Mycobacterium bovis subsp bovis AF2122/97
guacgcgacgggccgcga

SEQ ID NO: 1039393 - RNA, 16 nt, Mycobacterium bovis subsp bovis AF2122/97
guaccucaucgcagac

SEQ ID NO: 1039394 - RNA, 19 nt, Mycobacterium bovis subsp bovis AF2122/97
guaccuucgagcguaacgg

SEQ ID NO: 1039395 - RNA, 15 nt, Mycobacterium bovis subsp bovis AF2122/97
guacgacaccgcagc

SEQ ID NO: 1039396 - RNA, 16 nt, Mycobacterium bovis subsp bovis AF2122/97
guacgccagucgcagg

SEQ ID NO: 1039397 - RNA, 14 nt, Mycobacterium bovis subsp bovis AF2122/97
guacgcaucgccgu

SEQ ID NO: 1039398 - RNA, 18 nt, Mycobacterium bovis subsp bovis AF2122/97
guacgcaagcucaaggga

SEQ ID NO: 1039399 - RNA, 13 nt, Mycobacterium bovis subsp bovis AF2122/97
guagcgcugcggg

SEQ ID NO: 1039400 - RNA, 14 nt, Mycobacterium bovis subsp bovis AF2122/97
guagcggccgcagg

SEQ ID NO: 1039401 - RNA, 21 nt, Mycobacterium bovis subsp bovis AF2122/97
guagcggcuccgaaggccgcc

SEQ ID NO: 1039402 - RNA, 22 nt, Mycobacterium bovis subsp bovis AF2122/97
guagcggucccgcggaccgcaa

SEQ ID NO: 1039403 - RNA, 22 nt, Mycobacterium bovis subsp bovis AF2122/97
guagcgggggagcgaacggcgc

SEQ ID NO: 1039404 - RNA, 21 nt, Mycobacterium bovis subsp bovis AF2122/97
guagcggguugggaccgaaca

SEQ ID NO: 1039405 - RNA, 18 nt, Mycobacterium bovis subsp bovis AF2122/97
guagcgcggguggcucgg

SEQ ID NO: 1039406 - RNA, 11 nt, Mycobacterium bovis subsp bovis AF2122/97
guagcgcccac

SEQ ID NO: 1039407 - RNA, 19 nt, Mycobacterium bovis subsp bovis AF2122/97
guagcgcaaugcggcccgg

SEQ ID NO: 1039408 - RNA, 16 nt, Mycobacterium bovis subsp bovis AF2122/97
guagcgaugcacccca

SEQ ID NO: 1039409 - RNA, 19 nt, Mycobacterium bovis subsp bovis AF2122/97
guagcgaugcaccccauga

SEQ ID NO: 1039410 - RNA, 15 nt, Mycobacterium bovis subsp bovis AF2122/97
guagcgcaaccgcgc

SEQ ID NO: 1039411 - RNA, 19 nt, Mycobacterium bovis subsp bovis AF2122/97
guagccuggcuguccgcgg

SEQ ID NO: 1039412 - RNA, 21 nt, Mycobacterium bovis subsp bovis AF2122/97
guagcgaccgcggucgcugcg

SEQ ID NO: 1039413 - RNA, 16 nt, Mycobacterium bovis subsp bovis AF2122/97
guagcgaccucgccgc

SEQ ID NO: 1039414 - RNA, 17 nt, Mycobacterium bovis subsp bovis AF2122/97
guagcgaccucgccgcg

SEQ ID NO: 1039415 - RNA, 14 nt, Mycobacterium bovis subsp bovis AF2122/97
guagcgcagcgccu

SEQ ID NO: 1039416 - RNA, 16 nt, Mycobacterium bovis subsp bovis AF2122/97
guagccggugccggcg

SEQ ID NO: 1039417 - RNA, 17 nt, Mycobacterium bovis subsp bovis AF2122/97
guagccggugccggcgc

SEQ ID NO: 1039418 - RNA, 19 nt, Mycobacterium bovis subsp bovis AF2122/97
guagccgucgaucccgguc

SEQ ID NO: 1039419 - RNA, 15 nt, Mycobacterium bovis subsp bovis AF2122/97
guagccgucgucguc

SEQ ID NO: 1039420 - RNA, 17 nt, Mycobacterium bovis subsp bovis AF2122/97
guagccgucgucgucga

SEQ ID NO: 1039421 - RNA, 17 nt, Mycobacterium bovis subsp bovis AF2122/97
guagccguugccgccga

SEQ ID NO: 1039422 - RNA, 17 nt, Mycobacterium bovis subsp bovis AF2122/97
guagccugcggcgguca

SEQ ID NO: 1039423 - RNA, 17 nt, Mycobacterium bovis subsp bovis AF2122/97
guagaagcgggcgucgc

SEQ ID NO: 1039424 - RNA, 23 nt, Mycobacterium bovis subsp bovis AF2122/97
guagaaggaccgcucgucgccgg

SEQ ID NO: 1039425 - RNA, 17 nt, Mycobacterium bovis subsp bovis AF2122/97
guagaaguaggcggcga

SEQ ID NO: 1039426 - RNA, 20 nt, Mycobacterium bovis subsp bovis AF2122/97
guagacaaggccaagcgcca

SEQ ID NO: 1039427 - RNA, 16 nt, Mycobacterium bovis subsp bovis AF2122/97
guagacaagucggcgc

SEQ ID NO: 1039428 - RNA, 23 nt, Mycobacterium bovis subsp bovis AF2122/97
guagacaagucggcgcuggccgu

SEQ ID NO: 1039429 - RNA, 14 nt, Mycobacterium bovis subsp bovis AF2122/97
guagcaacgguagc

SEQ ID NO: 1039430 - RNA, 17 nt, Mycobacterium bovis subsp bovis AF2122/97
guagauguugccgccug

SEQ ID NO: 1039431 - RNA, 22 nt, Mycobacterium bovis subsp bovis AF2122/97
guacuugggauugcgggccugc

SEQ ID NO: 1039432 - RNA, 18 nt, Mycobacterium bovis subsp bovis AF2122/97
guacuucgacagcggcga

SEQ ID NO: 1039433 - RNA, 23 nt, Mycobacterium bovis subsp bovis AF2122/97
guacuucauauaccgcucguaga

SEQ ID NO: 1039434 - RNA, 15 nt, Mycobacterium bovis subsp bovis AF2122/97
guagccauucagugu

SEQ ID NO: 1039435 - RNA, 15 nt, Mycobacterium bovis subsp bovis AF2122/97
guagccccgucgacc

SEQ ID NO: 1039436 - RNA, 15 nt, Mycobacterium bovis subsp bovis AF2122/97
guagccggcgccgcc

SEQ ID NO: 1039437 - RNA, 19 nt, Mycobacterium bovis subsp bovis AF2122/97
guagccggcgccgccgucg

SEQ ID NO: 1039438 - RNA, 14 nt, Mycobacterium bovis subsp bovis AF2122/97
guagccggucggca

SEQ ID NO: 1039439 - RNA, 14 nt, Mycobacterium bovis subsp bovis AF2122/97
guagccggcggugg

SEQ ID NO: 1039440 - RNA, 18 nt, Mycobacterium bovis subsp bovis AF2122/97
guagcagcggcucggcgg

SEQ ID NO: 1039441 - RNA, 16 nt, Mycobacterium bovis subsp bovis AF2122/97
guagccagcagcggcu

SEQ ID NO: 1039442 - RNA, 14 nt, Mycobacterium bovis subsp bovis AF2122/97
guagccagcggcug

SEQ ID NO: 1039443 - RNA, 21 nt, Mycobacterium bovis subsp bovis AF2122/97
guagcacguugacguccaaca

SEQ ID NO: 1039444 - RNA, 16 nt, Mycobacterium bovis subsp bovis AF2122/97
guagcagaaggccgcg

SEQ ID NO: 1039445 - RNA, 13 nt, Mycobacterium bovis subsp bovis AF2122/97
guagcacaccgac

SEQ ID NO: 1039446 - RNA, 24 nt, Mycobacterium bovis subsp bovis AF2122/97
ggugggaaguagugcaucggcagc

SEQ ID NO: 1039447 - RNA, 18 nt, Mycobacterium bovis subsp bovis AF2122/97
ggugggaucgcagcgcca

SEQ ID NO: 1039448 - RNA, 13 nt, Mycobacterium bovis subsp bovis AF2122/97
ggugggagcagcc

SEQ ID NO: 1039449 - RNA, 15 nt, Mycobacterium bovis subsp bovis AF2122/97
ggugggagcagccga

SEQ ID NO: 1039450 - RNA, 16 nt, Mycobacterium bovis subsp bovis AF2122/97
ggugggacaggucggg

SEQ ID NO: 1039451 - RNA, 23 nt, Mycobacterium bovis subsp bovis AF2122/97
gguggcugcgccggaaccccucg

SEQ ID NO: 1039452 - RNA, 22 nt, Mycobacterium bovis subsp bovis AF2122/97
ggugggcagcagcuggucgugg

SEQ ID NO: 1039453 - RNA, 17 nt, Mycobacterium bovis subsp bovis AF2122/97
ggugggcagcaggccca

SEQ ID NO: 1039454 - RNA, 13 nt, Mycobacterium bovis subsp bovis AF2122/97
gguggcgucgcgg

SEQ ID NO: 1039455 - RNA, 15 nt, Mycobacterium bovis subsp bovis AF2122/97
gguggcgucgcgguu

SEQ ID NO: 1039456 - RNA, 18 nt, Mycobacterium bovis subsp bovis AF2122/97
gguggcguccagggcgcc

SEQ ID NO: 1039457 - RNA, 22 nt, Mycobacterium bovis subsp bovis AF2122/97
gguggcggcggcggcaacggcg

SEQ ID NO: 1039458 - RNA, 21 nt, Mycobacterium bovis subsp bovis AF2122/97
gguggcgggguugaucaccga

SEQ ID NO: 1039459 - RNA, 15 nt, Mycobacterium bovis subsp bovis AF2122/97
gguggcguaucgggc

SEQ ID NO: 1039460 - RNA, 14 nt, Mycobacterium bovis subsp bovis AF2122/97
gguggcgucaccgc

SEQ ID NO: 1039461 - RNA, 22 nt, Mycobacterium bovis subsp bovis AF2122/97
gguggcguuugaugcgggcggc

SEQ ID NO: 1039462 - RNA, 21 nt, Mycobacterium bovis subsp bovis AF2122/97
gguggcgugggcacuugcccg

SEQ ID NO: 1039463 - RNA, 14 nt, Mycobacterium bovis subsp bovis AF2122/97
gguggcgugcgcgu

SEQ ID NO: 1039464 - RNA, 17 nt, Mycobacterium bovis subsp bovis AF2122/97
gguggcuucaacccggg

SEQ ID NO: 1039465 - RNA, 18 nt, Mycobacterium bovis subsp bovis AF2122/97
gguggcuucgacggcggc

SEQ ID NO: 1039466 - RNA, 21 nt, Mycobacterium bovis subsp bovis AF2122/97
gguggcuuuugcgucugcucg

SEQ ID NO: 1039467 - RNA, 15 nt, Mycobacterium bovis subsp bovis AF2122/97
gguggcgcgcagcgc

SEQ ID NO: 1039468 - RNA, 22 nt, Mycobacterium bovis subsp bovis AF2122/97
gguggcggccuccgaggaauac

SEQ ID NO: 1039469 - RNA, 16 nt, Mycobacterium bovis subsp bovis AF2122/97
gguggcggugcggcga

SEQ ID NO: 1039470 - RNA, 17 nt, Mycobacterium bovis subsp bovis AF2122/97
gguggcggugucggcgc

SEQ ID NO: 1039471 - RNA, 16 nt, Mycobacterium bovis subsp bovis AF2122/97
gguggcgggcgaugcg

SEQ ID NO: 1039472 - RNA, 22 nt, Mycobacterium bovis subsp bovis AF2122/97
gguggcagcgcacccggucggc

SEQ ID NO: 1039473 - RNA, 15 nt, Mycobacterium bovis subsp bovis AF2122/97
gguggcgccgucggc

SEQ ID NO: 1039474 - RNA, 17 nt, Mycobacterium bovis subsp bovis AF2122/97
gguggcgccguugucgg

SEQ ID NO: 1039475 - RNA, 11 nt, Mycobacterium bovis subsp bovis AF2122/97
gguggcgccga

SEQ ID NO: 1039476 - RNA, 15 nt, Mycobacterium bovis subsp bovis AF2122/97
gguggcgccgaacgc

SEQ ID NO: 1039477 - RNA, 20 nt, Mycobacterium bovis subsp bovis AF2122/97
gguggcgccgaacgcaacgc

SEQ ID NO: 1039478 - RNA, 13 nt, Mycobacterium bovis subsp bovis AF2122/97
gguggcgccgacc

SEQ ID NO: 1039479 - RNA, 17 nt, Mycobacterium bovis subsp bovis AF2122/97
gguggcgccgaccugga

SEQ ID NO: 1039480 - RNA, 14 nt, Mycobacterium bovis subsp bovis AF2122/97
gguggcgccgacgu

SEQ ID NO: 1039481 - RNA, 15 nt, Mycobacterium bovis subsp bovis AF2122/97
gguggcagcggcgau

SEQ ID NO: 1039482 - RNA, 14 nt, Mycobacterium bovis subsp bovis AF2122/97
gguggcaccggcgg

SEQ ID NO: 1039483 - RNA, 16 nt, Mycobacterium bovis subsp bovis AF2122/97
gguggcaccggcggcg

SEQ ID NO: 1039484 - RNA, 18 nt, Mycobacterium bovis subsp bovis AF2122/97
gguggcaccggcggcgac

SEQ ID NO: 1039485 - RNA, 22 nt, Mycobacterium bovis subsp bovis AF2122/97
gguggcaacggaggugccggcg

SEQ ID NO: 1039486 - RNA, 22 nt, Mycobacterium bovis subsp bovis AF2122/97
gguggauuggugccggucaccu

SEQ ID NO: 1039487 - RNA, 22 nt, Mycobacterium bovis subsp bovis AF2122/97
ggugcucgucaccaaacccgau

SEQ ID NO: 1039488 - RNA, 17 nt, Mycobacterium bovis subsp bovis AF2122/97
ggugcucggaucggcuc

SEQ ID NO: 1039489 - RNA, 22 nt, Mycobacterium bovis subsp bovis AF2122/97
ggugcuagcgccgccagucguc

SEQ ID NO: 1039490 - RNA, 17 nt, Mycobacterium bovis subsp bovis AF2122/97
ggugcucgggcggcgau

SEQ ID NO: 1039491 - RNA, 20 nt, Mycobacterium bovis subsp bovis AF2122/97
ggugcugaucgguccggcga

SEQ ID NO: 1039492 - RNA, 15 nt, Mycobacterium bovis subsp bovis AF2122/97
ggugcugaccgcgcc

SEQ ID NO: 1039493 - RNA, 16 nt, Mycobacterium bovis subsp bovis AF2122/97
ggugcugcaccuggcg

SEQ ID NO: 1039494 - RNA, 20 nt, Mycobacterium bovis subsp bovis AF2122/97
gguggaugcgaugcgcgccg

SEQ ID NO: 1039495 - RNA, 14 nt, Mycobacterium bovis subsp bovis AF2122/97
gguggaucuucacc

SEQ ID NO: 1039496 - RNA, 22 nt, Mycobacterium bovis subsp bovis AF2122/97
gguggaggcguagucggcggug

SEQ ID NO: 1039497 - RNA, 17 nt, Mycobacterium bovis subsp bovis AF2122/97
gguggaguuggcugccg

SEQ ID NO: 1039498 - RNA, 20 nt, Mycobacterium bovis subsp bovis AF2122/97
gguggacgcagagucaacga

SEQ ID NO: 1039499 - RNA, 22 nt, Mycobacterium bovis subsp bovis AF2122/97
gguggacggcaggcggccgccg

SEQ ID NO: 1039500 - RNA, 20 nt, Mycobacterium bovis subsp bovis AF2122/97
ggugcugguauagccggcgc

SEQ ID NO: 1039501 - RNA, 15 nt, Mycobacterium bovis subsp bovis AF2122/97
ggugcuggucaacag

SEQ ID NO: 1039502 - RNA, 14 nt, Mycobacterium bovis subsp bovis AF2122/97
ggugcuggucgccg

SEQ ID NO: 1039503 - RNA, 16 nt, Mycobacterium bovis subsp bovis AF2122/97
ggugcuggucgccgcg

SEQ ID NO: 1039504 - RNA, 13 nt, Mycobacterium bovis subsp bovis AF2122/97
ggugcugguggcg

SEQ ID NO: 1039505 - RNA, 19 nt, Mycobacterium bovis subsp bovis AF2122/97
ggugcucgcgaucugcucg

SEQ ID NO: 1039506 - RNA, 19 nt, Mycobacterium bovis subsp bovis AF2122/97
ggugcucagcggcucgccu

SEQ ID NO: 1039507 - RNA, 20 nt, Mycobacterium bovis subsp bovis AF2122/97
ggugcucaacggcgacaucg

SEQ ID NO: 1039508 - RNA, 21 nt, Mycobacterium bovis subsp bovis AF2122/97
ggugcucaacggcgacaucgg

SEQ ID NO: 1039509 - RNA, 16 nt, Mycobacterium bovis subsp bovis AF2122/97
ggugcucaagcgcguc

SEQ ID NO: 1039510 - RNA, 13 nt, Mycobacterium bovis subsp bovis AF2122/97
ggugcgguucgcu

SEQ ID NO: 1039511 - RNA, 16 nt, Mycobacterium bovis subsp bovis AF2122/97
ggugcgguucgcugcg

SEQ ID NO: 1039512 - RNA, 14 nt, Mycobacterium bovis subsp bovis AF2122/97
ggugcgucgaugag

SEQ ID NO: 1039513 - RNA, 20 nt, Mycobacterium bovis subsp bovis AF2122/97
ggugcguccaggccagggcg

SEQ ID NO: 1039514 - RNA, 18 nt, Mycobacterium bovis subsp bovis AF2122/97
ggugcggucagauucggc

SEQ ID NO: 1039515 - RNA, 15 nt, Mycobacterium bovis subsp bovis AF2122/97
ggugcagcgacuccg

SEQ ID NO: 1039516 - RNA, 17 nt, Mycobacterium bovis subsp bovis AF2122/97
ggugcagcgccgacagc

SEQ ID NO: 1039517 - RNA, 17 nt, Mycobacterium bovis subsp bovis AF2122/97
gguggucccccgcagcc

SEQ ID NO: 1039518 - RNA, 20 nt, Mycobacterium bovis subsp bovis AF2122/97
ggugggcgcagagucaacgu

SEQ ID NO: 1039519 - RNA, 12 nt, Mycobacterium bovis subsp bovis AF2122/97
ggugggcgccgc

SEQ ID NO: 1039520 - RNA, 19 nt, Mycobacterium bovis subsp bovis AF2122/97
ggugggcuaggucgcgcug

SEQ ID NO: 1039521 - RNA, 18 nt, Mycobacterium bovis subsp bovis AF2122/97
gguggucagcaccggcgc

SEQ ID NO: 1039522 - RNA, 16 nt, Mycobacterium bovis subsp bovis AF2122/97
ggugggccagcagcaa

SEQ ID NO: 1039523 - RNA, 16 nt, Mycobacterium bovis subsp bovis AF2122/97
ggugggcggcucgucg

SEQ ID NO: 1039524 - RNA, 16 nt, Mycobacterium bovis subsp bovis AF2122/97
gguggucugcgcggug

SEQ ID NO: 1039525 - RNA, 22 nt, Mycobacterium bovis subsp bovis AF2122/97
ggugggcgggcaaucaccgccg

SEQ ID NO: 1039526 - RNA, 22 nt, Mycobacterium bovis subsp bovis AF2122/97
gguggucgucccgauggcggug

SEQ ID NO: 1039527 - RNA, 12 nt, Mycobacterium bovis subsp bovis AF2122/97
gguggucggcga

SEQ ID NO: 1039528 - RNA, 15 nt, Mycobacterium bovis subsp bovis AF2122/97
gguggucgggcgcaa

SEQ ID NO: 1039529 - RNA, 20 nt, Mycobacterium bovis subsp bovis AF2122/97
gguggucccccgcagccaga

SEQ ID NO: 1039530 - RNA, 22 nt, Mycobacterium bovis subsp bovis AF2122/97
gguggucccgauggcgaugcgc

SEQ ID NO: 1039531 - RNA, 22 nt, Mycobacterium bovis subsp bovis AF2122/97
gguggugaccaaguagucgggu

SEQ ID NO: 1039532 - RNA, 17 nt, Mycobacterium bovis subsp bovis AF2122/97
gguggugaguaccaauc

SEQ ID NO: 1039533 - RNA, 14 nt, Mycobacterium bovis subsp bovis AF2122/97
gguggugccggcgc

SEQ ID NO: 1039534 - RNA, 17 nt, Mycobacterium bovis subsp bovis AF2122/97
gguggugccggcgccgc

SEQ ID NO: 1039535 - RNA, 23 nt, Mycobacterium bovis subsp bovis AF2122/97
gguguccagugcauucccgccuu

SEQ ID NO: 1039536 - RNA, 15 nt, Mycobacterium bovis subsp bovis AF2122/97
gguguccgagcggcc

SEQ ID NO: 1039537 - RNA, 15 nt, Mycobacterium bovis subsp bovis AF2122/97
ggugucgaagagcag

SEQ ID NO: 1039538 - RNA, 14 nt, Mycobacterium bovis subsp bovis AF2122/97
gguguccaccaccg

SEQ ID NO: 1039539 - RNA, 20 nt, Mycobacterium bovis subsp bovis AF2122/97
gguguccucgaccgucacgc

SEQ ID NO: 1039540 - RNA, 23 nt, Mycobacterium bovis subsp bovis AF2122/97
ggugucgacggggaacguccgcg

SEQ ID NO: 1039541 - RNA, 20 nt, Mycobacterium bovis subsp bovis AF2122/97
ggugucgacaaccgcugccg

SEQ ID NO: 1039542 - RNA, 15 nt, Mycobacterium bovis subsp bovis AF2122/97
gguguaucgacggcg

SEQ ID NO: 1039543 - RNA, 22 nt, Mycobacterium bovis subsp bovis AF2122/97
ggugucacgacccaagucgccg

SEQ ID NO: 1039544 - RNA, 16 nt, Mycobacterium bovis subsp bovis AF2122/97
gguggugcgcucgcgg

SEQ ID NO: 1039545 - RNA, 13 nt, Mycobacterium bovis subsp bovis AF2122/97
gguggugcggaug

SEQ ID NO: 1039546 - RNA, 16 nt, Mycobacterium bovis subsp bovis AF2122/97
gguggucuuggcggug

SEQ ID NO: 1039547 - RNA, 19 nt, Mycobacterium bovis subsp bovis AF2122/97
gguguaggugccccacucg

SEQ ID NO: 1039548 - RNA, 18 nt, Mycobacterium bovis subsp bovis AF2122/97
ggugucaaugacaccggg

SEQ ID NO: 1039549 - RNA, 14 nt, Mycobacterium bovis subsp bovis AF2122/97
ggugugcugccacc

SEQ ID NO: 1039550 - RNA, 17 nt, Mycobacterium bovis subsp bovis AF2122/97
ggugugcgacgacggcg

SEQ ID NO: 1039551 - RNA, 21 nt, Mycobacterium bovis subsp bovis AF2122/97
ggugugcgacgacggcgccgu

SEQ ID NO: 1039552 - RNA, 23 nt, Mycobacterium bovis subsp bovis AF2122/97
ggugugcgcaccccgcuugcgcg

SEQ ID NO: 1039553 - RNA, 19 nt, Mycobacterium bovis subsp bovis AF2122/97
ggugugcaucgacucacgg

SEQ ID NO: 1039554 - RNA, 12 nt, Mycobacterium bovis subsp bovis AF2122/97
ggugugcgcgcc

SEQ ID NO: 1039555 - RNA, 21 nt, Mycobacterium bovis subsp bovis AF2122/97
ggugugcgcgccaggcucgau

SEQ ID NO: 1039556 - RNA, 19 nt, Mycobacterium bovis subsp bovis AF2122/97
ggugucggaaugggcgcca

SEQ ID NO: 1039557 - RNA, 14 nt, Mycobacterium bovis subsp bovis AF2122/97
ggugugaucggcgg

SEQ ID NO: 1039558 - RNA, 18 nt, Mycobacterium bovis subsp bovis AF2122/97
ggugugauacagcgccag

SEQ ID NO: 1039559 - RNA, 13 nt, Mycobacterium bovis subsp bovis AF2122/97
ggugucgaugccg

SEQ ID NO: 1039560 - RNA, 17 nt, Mycobacterium bovis subsp bovis AF2122/97
ggugucgauuggcucgc

SEQ ID NO: 1039561 - RNA, 18 nt, Mycobacterium bovis subsp bovis AF2122/97
ggugucgauuggcucgcc

SEQ ID NO: 1039562 - RNA, 20 nt, Mycobacterium bovis subsp bovis AF2122/97
ggugucgaugcgcagcccgu

SEQ ID NO: 1039563 - RNA, 14 nt, Mycobacterium bovis subsp bovis AF2122/97
ggugucgggcgcgc

SEQ ID NO: 1039564 - RNA, 14 nt, Mycobacterium bovis subsp bovis AF2122/97
ggugucgggcucgc

SEQ ID NO: 1039565 - RNA, 15 nt, Mycobacterium bovis subsp bovis AF2122/97
ggugucgggcucgca

SEQ ID NO: 1039566 - RNA, 16 nt, Mycobacterium bovis subsp bovis AF2122/97
ggugucucccuugccg

SEQ ID NO: 1039567 - RNA, 16 nt, Mycobacterium bovis subsp bovis AF2122/97
ggugucgucgaucgcg

SEQ ID NO: 1039568 - RNA, 13 nt, Mycobacterium bovis subsp bovis AF2122/97
ggugucgcggccg

SEQ ID NO: 1039569 - RNA, 14 nt, Mycobacterium bovis subsp bovis AF2122/97
ggugucgcggccgc

SEQ ID NO: 1039570 - RNA, 13 nt, Mycobacterium bovis subsp bovis AF2122/97
ggugugcucgccg

SEQ ID NO: 1039571 - RNA, 15 nt, Mycobacterium bovis subsp bovis AF2122/97
ggugugcugccaccg

SEQ ID NO: 1039572 - RNA, 19 nt, Mycobacterium bovis subsp bovis AF2122/97
gguguugugugcucgucgc

SEQ ID NO: 1039573 - RNA, 16 nt, Mycobacterium bovis subsp bovis AF2122/97
gguguuuccgaaaccc

SEQ ID NO: 1039574 - RNA, 23 nt, Mycobacterium bovis subsp bovis AF2122/97
ggugugcugccaccggccggcgc

SEQ ID NO: 1039575 - RNA, 15 nt, Mycobacterium bovis subsp bovis AF2122/97
gguguuuggccgccg

SEQ ID NO: 1039576 - RNA, 17 nt, Mycobacterium bovis subsp bovis AF2122/97
gguuacucgcagcgccg

SEQ ID NO: 1039577 - RNA, 15 nt, Mycobacterium bovis subsp bovis AF2122/97
gguuagugucguagg

SEQ ID NO: 1039578 - RNA, 18 nt, Mycobacterium bovis subsp bovis AF2122/97
gguuccagcggcaccgcg

SEQ ID NO: 1039579 - RNA, 19 nt, Mycobacterium bovis subsp bovis AF2122/97
gguuccagcggcaccgcgg

SEQ ID NO: 1039580 - RNA, 16 nt, Mycobacterium bovis subsp bovis AF2122/97
gguuccacgcugccca

SEQ ID NO: 1039581 - RNA, 17 nt, Mycobacterium bovis subsp bovis AF2122/97
gguucccgggcagccgc

SEQ ID NO: 1039582 - RNA, 19 nt, Mycobacterium bovis subsp bovis AF2122/97
gguuccauacagccgccga

SEQ ID NO: 1039583 - RNA, 16 nt, Mycobacterium bovis subsp bovis AF2122/97
gguuccguugaugccg

SEQ ID NO: 1039584 - RNA, 23 nt, Mycobacterium bovis subsp bovis AF2122/97
gguuccgccaggccgaccgcgca

SEQ ID NO: 1039585 - RNA, 18 nt, Mycobacterium bovis subsp bovis AF2122/97
gguuccgcugucgagccg

SEQ ID NO: 1039586 - RNA, 18 nt, Mycobacterium bovis subsp bovis AF2122/97
gguuccggcuucguccac

SEQ ID NO: 1039587 - RNA, 20 nt, Mycobacterium bovis subsp bovis AF2122/97
gguuccggcuucguccaccg

SEQ ID NO: 1039588 - RNA, 22 nt, Mycobacterium bovis subsp bovis AF2122/97
gguucgacccccgcaucggcgc

SEQ ID NO: 1039589 - RNA, 19 nt, Mycobacterium bovis subsp bovis AF2122/97
gguucgacggacacccugg

SEQ ID NO: 1039590 - RNA, 14 nt, Mycobacterium bovis subsp bovis AF2122/97
gguugcguccgccg

SEQ ID NO: 1039591 - RNA, 21 nt, Mycobacterium bovis subsp bovis AF2122/97
gguucgacucaugccgagcga

SEQ ID NO: 1039592 - RNA, 22 nt, Mycobacterium bovis subsp bovis AF2122/97
gguuggccgauaaaggucacuc

SEQ ID NO: 1039593 - RNA, 23 nt, Mycobacterium bovis subsp bovis AF2122/97
gguuggagaagauuuucucggug

SEQ ID NO: 1039594 - RNA, 15 nt, Mycobacterium bovis subsp bovis AF2122/97
gguuggcagccacgg

SEQ ID NO: 1039595 - RNA, 23 nt, Mycobacterium bovis subsp bovis AF2122/97
gguuggcagccacggguagcugc

SEQ ID NO: 1039596 - RNA, 12 nt, Mycobacterium bovis subsp bovis AF2122/97
gguuggcgucgc

SEQ ID NO: 1039597 - RNA, 12 nt, Mycobacterium bovis subsp bovis AF2122/97
gguuggcgccgg

SEQ ID NO: 1039598 - RNA, 15 nt, Mycobacterium bovis subsp bovis AF2122/97
gguuggcgacgauca

SEQ ID NO: 1039599 - RNA, 14 nt, Mycobacterium bovis subsp bovis AF2122/97
gguuggccggcgcu

SEQ ID NO: 1039600 - RNA, 23 nt, Mycobacterium bovis subsp bovis AF2122/97
gguuggccggguuggccggcgcu

SEQ ID NO: 1039601 - RNA, 16 nt, Mycobacterium bovis subsp bovis AF2122/97
gguugggguggcggug

SEQ ID NO: 1039602 - RNA, 17 nt, Mycobacterium bovis subsp bovis AF2122/97
gguugggguggcggugc

SEQ ID NO: 1039603 - RNA, 14 nt, Mycobacterium bovis subsp bovis AF2122/97
gguuggcucggcgc

SEQ ID NO: 1039604 - RNA, 15 nt, Mycobacterium bovis subsp bovis AF2122/97
gguugguccgccguc

SEQ ID NO: 1039605 - RNA, 21 nt, Mycobacterium bovis subsp bovis AF2122/97
gguugucgucggugggcguga

SEQ ID NO: 1039606 - RNA, 17 nt, Mycobacterium bovis subsp bovis AF2122/97
gguuguggaaccacggc

SEQ ID NO: 1039607 - RNA, 13 nt, Mycobacterium bovis subsp bovis AF2122/97
gguugucggcgac

SEQ ID NO: 1039608 - RNA, 15 nt, Mycobacterium bovis subsp bovis AF2122/97
gguugucggggucgc

SEQ ID NO: 1039609 - RNA, 12 nt, Mycobacterium bovis subsp bovis AF2122/97
gguugucgcggu

SEQ ID NO: 1039610 - RNA, 15 nt, Mycobacterium bovis subsp bovis AF2122/97
gguuguccucggcga

SEQ ID NO: 1039611 - RNA, 17 nt, Mycobacterium bovis subsp bovis AF2122/97
gguuguccucggcgauc

SEQ ID NO: 1039612 - RNA, 16 nt, Mycobacterium bovis subsp bovis AF2122/97
gguuggugcucagcgg

SEQ ID NO: 1039613 - RNA, 17 nt, Mycobacterium bovis subsp bovis AF2122/97
gguuguagacggcaccc

SEQ ID NO: 1039614 - RNA, 16 nt, Mycobacterium bovis subsp bovis AF2122/97
gguuuuguaguccgca

SEQ ID NO: 1039615 - RNA, 18 nt, Mycobacterium bovis subsp bovis AF2122/97
guaaagcucaccacaucg

SEQ ID NO: 1039616 - RNA, 22 nt, Mycobacterium bovis subsp bovis AF2122/97
gguuuggugcagccgcggucgu

SEQ ID NO: 1039617 - RNA, 18 nt, Mycobacterium bovis subsp bovis AF2122/97
gguuguggcugaucccgg

SEQ ID NO: 1039618 - RNA, 15 nt, Mycobacterium bovis subsp bovis AF2122/97
gguuguugccgacga

SEQ ID NO: 1039619 - RNA, 21 nt, Mycobacterium bovis subsp bovis AF2122/97
gguuguuggagaugucgauca

SEQ ID NO: 1039620 - RNA, 17 nt, Mycobacterium bovis subsp bovis AF2122/97
gguuugcaccgcggcca

SEQ ID NO: 1039621 - RNA, 16 nt, Mycobacterium bovis subsp bovis AF2122/97
gguuugcacggcgcgc

SEQ ID NO: 1039622 - RNA, 17 nt, Mycobacterium bovis subsp bovis AF2122/97
gguuugcagcgggauca

SEQ ID NO: 1039623 - RNA, 14 nt, Mycobacterium bovis subsp bovis AF2122/97
gguuugcguccugg

SEQ ID NO: 1039624 - RNA, 19 nt, Mycobacterium bovis subsp bovis AF2122/97
gguuguucggcagccaugc

SEQ ID NO: 1039625 - RNA, 16 nt, Mycobacterium bovis subsp bovis AF2122/97
gguuugccggcggugg

SEQ ID NO: 1039626 - RNA, 17 nt, Mycobacterium bovis subsp bovis AF2122/97
gguuugccgggcgcugg

SEQ ID NO: 1039627 - RNA, 18 nt, Mycobacterium bovis subsp bovis AF2122/97
gguuugccggugcggugg

SEQ ID NO: 1039628 - RNA, 12 nt, Mycobacterium bovis subsp bovis AF2122/97
gguuugcggugc

SEQ ID NO: 1039629 - RNA, 15 nt, Mycobacterium bovis subsp bovis AF2122/97
guaacgccaacaccg

SEQ ID NO: 1039630 - RNA, 22 nt, Mycobacterium bovis subsp bovis AF2122/97
guaacgccaacaccggcaucgc

SEQ ID NO: 1039631 - RNA, 11 nt, Mycobacterium bovis subsp bovis AF2122/97
guacagcgccu

SEQ ID NO: 1039632 - RNA, 17 nt, Mycobacterium bovis subsp bovis AF2122/97
guacagcggcggcgucg

SEQ ID NO: 1039633 - RNA, 13 nt, Mycobacterium bovis subsp bovis AF2122/97
guacaggcgcagc

SEQ ID NO: 1039634 - RNA, 20 nt, Mycobacterium bovis subsp bovis AF2122/97
guacaccucgagcgcggcga

SEQ ID NO: 1039635 - RNA, 12 nt, Mycobacterium bovis subsp bovis AF2122/97
guacacggcggc

SEQ ID NO: 1039636 - RNA, 14 nt, Mycobacterium bovis subsp bovis AF2122/97
guacaccgcgcccg

SEQ ID NO: 1039637 - RNA, 15 nt, Mycobacterium bovis subsp bovis AF2122/97
guacaggucggccca

SEQ ID NO: 1039638 - RNA, 19 nt, Mycobacterium bovis subsp bovis AF2122/97
guacaggcugcugcgcgag

SEQ ID NO: 1039639 - RNA, 16 nt, Mycobacterium bovis subsp bovis AF2122/97
guacaggcuguccagc

SEQ ID NO: 1039640 - RNA, 14 nt, Mycobacterium bovis subsp bovis AF2122/97
guacagugucugcc

SEQ ID NO: 1039641 - RNA, 13 nt, Mycobacterium bovis subsp bovis AF2122/97
guacaucaccacg

SEQ ID NO: 1039642 - RNA, 14 nt, Mycobacterium bovis subsp bovis AF2122/97
guacaucagcgcga

SEQ ID NO: 1039643 - RNA, 13 nt, Mycobacterium bovis subsp bovis AF2122/97
guacaucagcgcg

SEQ ID NO: 1039644 - RNA, 14 nt, Mycobacterium bovis subsp bovis AF2122/97
guaccacgcuggcg

SEQ ID NO: 1039645 - RNA, 22 nt, Mycobacterium bovis subsp bovis AF2122/97
guaccacgcuggcgcguaucgc

SEQ ID NO: 1039646 - RNA, 17 nt, Mycobacterium bovis subsp bovis AF2122/97
guaccaccggcacggug

SEQ ID NO: 1039647 - RNA, 22 nt, Mycobacterium bovis subsp bovis AF2122/97
guaccaaccugcgcggcgaucg

SEQ ID NO: 1039648 - RNA, 22 nt, Mycobacterium bovis subsp bovis AF2122/97
guaccaauccaggccaccccga

SEQ ID NO: 1039649 - RNA, 13 nt, Mycobacterium bovis subsp bovis AF2122/97
guacacacccgcc

SEQ ID NO: 1039650 - RNA, 13 nt, Mycobacterium bovis subsp bovis AF2122/97
guacaccgugcgc

SEQ ID NO: 1039651 - RNA, 17 nt, Mycobacterium bovis subsp bovis AF2122/97
guacaccgugcgccgaa

SEQ ID NO: 1039652 - RNA, 16 nt, Mycobacterium bovis subsp bovis AF2122/97
guacacccgcucgccc

SEQ ID NO: 1039653 - RNA, 22 nt, Mycobacterium bovis subsp bovis AF2122/97
guacaacaugauucgcugcgcc

SEQ ID NO: 1039654 - RNA, 21 nt, Mycobacterium bovis subsp bovis AF2122/97
guacaaccacccacccgcacc

SEQ ID NO: 1039655 - RNA, 15 nt, Mycobacterium bovis subsp bovis AF2122/97
guacaacgccgucgu

SEQ ID NO: 1039656 - RNA, 19 nt, Mycobacterium bovis subsp bovis AF2122/97
guacaagcauuggcgucga

SEQ ID NO: 1039657 - RNA, 15 nt, Mycobacterium bovis subsp bovis AF2122/97
guaauugccgaccgc

SEQ ID NO: 1039658 - RNA, 15 nt, Mycobacterium bovis subsp bovis AF2122/97
guaaugcucgacgua

SEQ ID NO: 1039659 - RNA, 15 nt, Mycobacterium bovis subsp bovis AF2122/97
guaauggccgccggu

SEQ ID NO: 1039660 - RNA, 18 nt, Mycobacterium bovis subsp bovis AF2122/97
guaaugcgcugccgccgu

SEQ ID NO: 1039661 - RNA, 17 nt, Mycobacterium bovis subsp bovis AF2122/97
guaaugguggcguccag

SEQ ID NO: 1039662 - RNA, 20 nt, Mycobacterium bovis subsp bovis AF2122/97
guaacgucgucgcgucgcca

SEQ ID NO: 1039663 - RNA, 16 nt, Mycobacterium bovis subsp bovis AF2122/97
guaacuucaccggcuc

SEQ ID NO: 1039664 - RNA, 22 nt, Mycobacterium bovis subsp bovis AF2122/97
gugcaggcgaguuaggccgcca

SEQ ID NO: 1039665 - RNA, 14 nt, Mycobacterium bovis subsp bovis AF2122/97
gugcaggcuucugg

SEQ ID NO: 1039666 - RNA, 23 nt, Mycobacterium bovis subsp bovis AF2122/97
gugcagggacccggcgccgucga

SEQ ID NO: 1039667 - RNA, 15 nt, Mycobacterium bovis subsp bovis AF2122/97
gugcaggucguccau

SEQ ID NO: 1039668 - RNA, 16 nt, Mycobacterium bovis subsp bovis AF2122/97
gugcagguggccgucg

SEQ ID NO: 1039669 - RNA, 18 nt, Mycobacterium bovis subsp bovis AF2122/97
gugcagguuggccugcuu

SEQ ID NO: 1039670 - RNA, 13 nt, Mycobacterium bovis subsp bovis AF2122/97
gugccaacugcgc

SEQ ID NO: 1039671 - RNA, 15 nt, Mycobacterium bovis subsp bovis AF2122/97
gugcagugaccucgu

SEQ ID NO: 1039672 - RNA, 22 nt, Mycobacterium bovis subsp bovis AF2122/97
gugcaguggcuacgcgaucagc

SEQ ID NO: 1039673 - RNA, 22 nt, Mycobacterium bovis subsp bovis AF2122/97
gugccaaugauucggcacgccg

SEQ ID NO: 1039674 - RNA, 23 nt, Mycobacterium bovis subsp bovis AF2122/97
gugccaauuccagccccccggcg

SEQ ID NO: 1039675 - RNA, 21 nt, Mycobacterium bovis subsp bovis AF2122/97
gugccaccacgcuccccagcg

SEQ ID NO: 1039676 - RNA, 23 nt, Mycobacterium bovis subsp bovis AF2122/97
gugccaccacgcuccccagcgaa

SEQ ID NO: 1039677 - RNA, 13 nt, Mycobacterium bovis subsp bovis AF2122/97
gugccaccguugg

SEQ ID NO: 1039678 - RNA, 15 nt, Mycobacterium bovis subsp bovis AF2122/97
gugcccggugcggug

SEQ ID NO: 1039679 - RNA, 20 nt, Mycobacterium bovis subsp bovis AF2122/97
gugccagcaccacgucgacg

SEQ ID NO: 1039680 - RNA, 15 nt, Mycobacterium bovis subsp bovis AF2122/97
gugccacggugaccc

SEQ ID NO: 1039681 - RNA, 17 nt, Mycobacterium bovis subsp bovis AF2122/97
gugccacguucgcgggc

SEQ ID NO: 1039682 - RNA, 14 nt, Mycobacterium bovis subsp bovis AF2122/97
gugccacucgaugc

SEQ ID NO: 1039683 - RNA, 22 nt, Mycobacterium bovis subsp bovis AF2122/97
gugccacugccguugccgccgg

SEQ ID NO: 1039684 - RNA, 23 nt, Mycobacterium bovis subsp bovis AF2122/97
gugccacugccguugccgccggu

SEQ ID NO: 1039685 - RNA, 14 nt, Mycobacterium bovis subsp bovis AF2122/97
gugccacuucuuca

SEQ ID NO: 1039686 - RNA, 16 nt, Mycobacterium bovis subsp bovis AF2122/97
gugccacagcucgccg

SEQ ID NO: 1039687 - RNA, 15 nt, Mycobacterium bovis subsp bovis AF2122/97
gugccacgaucggcg

SEQ ID NO: 1039688 - RNA, 13 nt, Mycobacterium bovis subsp bovis AF2122/97
gugccgaccagca

SEQ ID NO: 1039689 - RNA, 21 nt, Mycobacterium bovis subsp bovis AF2122/97
gugccgaagaugaccgcucgu

SEQ ID NO: 1039690 - RNA, 17 nt, Mycobacterium bovis subsp bovis AF2122/97
gugccgaaaaucgcagc

SEQ ID NO: 1039691 - RNA, 15 nt, Mycobacterium bovis subsp bovis AF2122/97
gugccgaacgccaga

SEQ ID NO: 1039692 - RNA, 21 nt, Mycobacterium bovis subsp bovis AF2122/97
gugccagcagcagcgccgcgu

SEQ ID NO: 1039693 - RNA, 21 nt, Mycobacterium bovis subsp bovis AF2122/97
gugcccugggugauggccgcg

SEQ ID NO: 1039694 - RNA, 18 nt, Mycobacterium bovis subsp bovis AF2122/97
gugcccuguccggcgccg

SEQ ID NO: 1039695 - RNA, 17 nt, Mycobacterium bovis subsp bovis AF2122/97
gugccgaacgccagacc

SEQ ID NO: 1039696 - RNA, 18 nt, Mycobacterium bovis subsp bovis AF2122/97
gugccgagaugccggcga

SEQ ID NO: 1039697 - RNA, 22 nt, Mycobacterium bovis subsp bovis AF2122/97
gugccgaguuccugcacgguca

SEQ ID NO: 1039698 - RNA, 16 nt, Mycobacterium bovis subsp bovis AF2122/97
gugccgagcgugcgcu

SEQ ID NO: 1039699 - RNA, 13 nt, Mycobacterium bovis subsp bovis AF2122/97
gugccgagcuggc

SEQ ID NO: 1039700 - RNA, 19 nt, Mycobacterium bovis subsp bovis AF2122/97
gugccgagcuucagcgcgc

SEQ ID NO: 1039701 - RNA, 20 nt, Mycobacterium bovis subsp bovis AF2122/97
gugccgagcacucggccacg

SEQ ID NO: 1039702 - RNA, 15 nt, Mycobacterium bovis subsp bovis AF2122/97
gugccgacccgccgc

SEQ ID NO: 1039703 - RNA, 17 nt, Mycobacterium bovis subsp bovis AF2122/97
gugccgacccgccgcgc

SEQ ID NO: 1039704 - RNA, 14 nt, Mycobacterium bovis subsp bovis AF2122/97
gugccgacggugau

SEQ ID NO: 1039705 - RNA, 21 nt, Mycobacterium bovis subsp bovis AF2122/97
gugccgacccuacuuccucga

SEQ ID NO: 1039706 - RNA, 12 nt, Mycobacterium bovis subsp bovis AF2122/97
gugccgcaaccg

SEQ ID NO: 1039707 - RNA, 16 nt, Mycobacterium bovis subsp bovis AF2122/97
gugccgcaaccggcga

SEQ ID NO: 1039708 - RNA, 22 nt, Mycobacterium bovis subsp bovis AF2122/97
gugccgcacccagaccgccgaa

SEQ ID NO: 1039709 - RNA, 13 nt, Mycobacterium bovis subsp bovis AF2122/97
gugccgcaccgcc

SEQ ID NO: 1039710 - RNA, 14 nt, Mycobacterium bovis subsp bovis AF2122/97
gugccgcagcggcg

SEQ ID NO: 1039711 - RNA, 15 nt, Mycobacterium bovis subsp bovis AF2122/97
gugccgcagcagggg

SEQ ID NO: 1039712 - RNA, 22 nt, Mycobacterium bovis subsp bovis AF2122/97
gugccgcagcaggggacgacca

SEQ ID NO: 1039713 - RNA, 14 nt, Mycobacterium bovis subsp bovis AF2122/97
gugccgccagcaac

SEQ ID NO: 1039714 - RNA, 15 nt, Mycobacterium bovis subsp bovis AF2122/97
gugccgcaucacccg

SEQ ID NO: 1039715 - RNA, 17 nt, Mycobacterium bovis subsp bovis AF2122/97
gugccgccaucgccgcc

SEQ ID NO: 1039716 - RNA, 20 nt, Mycobacterium bovis subsp bovis AF2122/97
gugccgccaucgccgccggu

SEQ ID NO: 1039717 - RNA, 12 nt, Mycobacterium bovis subsp bovis AF2122/97
gugccgccacca

SEQ ID NO: 1039718 - RNA, 18 nt, Mycobacterium bovis subsp bovis AF2122/97
gugccgccaccaccggcg

SEQ ID NO: 1039719 - RNA, 20 nt, Mycobacterium bovis subsp bovis AF2122/97
gugccgccaccaccggcgcc

SEQ ID NO: 1039720 - RNA, 14 nt, Mycobacterium bovis subsp bovis AF2122/97
gugccggcgccgcc

SEQ ID NO: 1039721 - RNA, 16 nt, Mycobacterium bovis subsp bovis AF2122/97
gugccggcgccgccag

SEQ ID NO: 1039722 - RNA, 21 nt, Mycobacterium bovis subsp bovis AF2122/97
gugccggcgccgccagcacca

SEQ ID NO: 1039723 - RNA, 15 nt, Mycobacterium bovis subsp bovis AF2122/97
gugccggcgccgccc

SEQ ID NO: 1039724 - RNA, 13 nt, Mycobacterium bovis subsp bovis AF2122/97
gugccgccgcaga

SEQ ID NO: 1039725 - RNA, 13 nt, Mycobacterium bovis subsp bovis AF2122/97
gugccgccgacac

SEQ ID NO: 1039726 - RNA, 19 nt, Mycobacterium bovis subsp bovis AF2122/97
gugccgccgacaccaccgg

SEQ ID NO: 1039727 - RNA, 21 nt, Mycobacterium bovis subsp bovis AF2122/97
gugccgccgauaccgccggcc

SEQ ID NO: 1039728 - RNA, 18 nt, Mycobacterium bovis subsp bovis AF2122/97
gugccgcccgcgccgccg

SEQ ID NO: 1039729 - RNA, 20 nt, Mycobacterium bovis subsp bovis AF2122/97
gugccgccauugacgccguu

SEQ ID NO: 1039730 - RNA, 20 nt, Mycobacterium bovis subsp bovis AF2122/97
gugccggcggugacggcggc

SEQ ID NO: 1039731 - RNA, 22 nt, Mycobacterium bovis subsp bovis AF2122/97
gugccggcguaggcaggaucgc

SEQ ID NO: 1039732 - RNA, 20 nt, Mycobacterium bovis subsp bovis AF2122/97
gugccggcgucgcuggccag

SEQ ID NO: 1039733 - RNA, 12 nt, Mycobacterium bovis subsp bovis AF2122/97
gugccggcguua

SEQ ID NO: 1039734 - RNA, 13 nt, Mycobacterium bovis subsp bovis AF2122/97
gugccgccgccgg

SEQ ID NO: 1039735 - RNA, 14 nt, Mycobacterium bovis subsp bovis AF2122/97
gugccgccgccggc

SEQ ID NO: 1039736 - RNA, 18 nt, Mycobacterium bovis subsp bovis AF2122/97
gugccgccgcggccacca

SEQ ID NO: 1039737 - RNA, 14 nt, Mycobacterium bovis subsp bovis AF2122/97
gugccgccggccag

SEQ ID NO: 1039738 - RNA, 15 nt, Mycobacterium bovis subsp bovis AF2122/97
gugccggcguugccg

SEQ ID NO: 1039739 - RNA, 20 nt, Mycobacterium bovis subsp bovis AF2122/97
gugccggggcugccgccguu

SEQ ID NO: 1039740 - RNA, 15 nt, Mycobacterium bovis subsp bovis AF2122/97
gugccgggaucgccg

SEQ ID NO: 1039741 - RNA, 14 nt, Mycobacterium bovis subsp bovis AF2122/97
gugccgggcaccac

SEQ ID NO: 1039742 - RNA, 16 nt, Mycobacterium bovis subsp bovis AF2122/97
gugccgggcaccacca

SEQ ID NO: 1039743 - RNA, 15 nt, Mycobacterium bovis subsp bovis AF2122/97
gugcgcgucgguguc

SEQ ID NO: 1039744 - RNA, 20 nt, Mycobacterium bovis subsp bovis AF2122/97
gugcggacuucgccgcccgc

SEQ ID NO: 1039745 - RNA, 18 nt, Mycobacterium bovis subsp bovis AF2122/97
gugcggaucagaggaccc

SEQ ID NO: 1039746 - RNA, 14 nt, Mycobacterium bovis subsp bovis AF2122/97
gugcggaacaccgc

SEQ ID NO: 1039747 - RNA, 17 nt, Mycobacterium bovis subsp bovis AF2122/97
gugcggaacaccgcccg

SEQ ID NO: 1039748 - RNA, 20 nt, Mycobacterium bovis subsp bovis AF2122/97
gugcgcugguggcggcgaca

SEQ ID NO: 1039749 - RNA, 19 nt, Mycobacterium bovis subsp bovis AF2122/97
gugcggaacaccgcccggc

SEQ ID NO: 1039750 - RNA, 18 nt, Mycobacterium bovis subsp bovis AF2122/97
gugcggaacacgaugcgc

SEQ ID NO: 1039751 - RNA, 17 nt, Mycobacterium bovis subsp bovis AF2122/97
gugcgcggugacgagcc

SEQ ID NO: 1039752 - RNA, 22 nt, Mycobacterium bovis subsp bovis AF2122/97
gugcgcgucagccgcaccccgc

SEQ ID NO: 1039753 - RNA, 13 nt, Mycobacterium bovis subsp bovis AF2122/97
gugcgcgucgcgc

SEQ ID NO: 1039754 - RNA, 15 nt, Mycobacterium bovis subsp bovis AF2122/97
gugcgcgcggcgacc

SEQ ID NO: 1039755 - RNA, 23 nt, Mycobacterium bovis subsp bovis AF2122/97
gugcggccacucgcccgauccgg

SEQ ID NO: 1039756 - RNA, 17 nt, Mycobacterium bovis subsp bovis AF2122/97
gugcggcauugguaccg

SEQ ID NO: 1039757 - RNA, 14 nt, Mycobacterium bovis subsp bovis AF2122/97
gugcggcagcccgc

SEQ ID NO: 1039758 - RNA, 15 nt, Mycobacterium bovis subsp bovis AF2122/97
gugcggcagcggugg

SEQ ID NO: 1039759 - RNA, 15 nt, Mycobacterium bovis subsp bovis AF2122/97
gugcgcuggcggcgc

SEQ ID NO: 1039760 - RNA, 17 nt, Mycobacterium bovis subsp bovis AF2122/97
gugcggaaccugcucgg

SEQ ID NO: 1039761 - RNA, 22 nt, Mycobacterium bovis subsp bovis AF2122/97
gugcggaacgauggacgcccag

SEQ ID NO: 1039762 - RNA, 16 nt, Mycobacterium bovis subsp bovis AF2122/97
gugcggaacggccagg

SEQ ID NO: 1039763 - RNA, 12 nt, Mycobacterium bovis subsp bovis AF2122/97
gugcggccgggg

SEQ ID NO: 1039764 - RNA, 21 nt, Mycobacterium bovis subsp bovis AF2122/97
gugcggccuuggcgacgucgc

SEQ ID NO: 1039765 - RNA, 14 nt, Mycobacterium bovis subsp bovis AF2122/97
gugcggcccaaccg

SEQ ID NO: 1039766 - RNA, 16 nt, Mycobacterium bovis subsp bovis AF2122/97
gugcgugcgcgucggu

SEQ ID NO: 1039767 - RNA, 15 nt, Mycobacterium bovis subsp bovis AF2122/97
gugcgucugcggcgg

SEQ ID NO: 1039768 - RNA, 14 nt, Mycobacterium bovis subsp bovis AF2122/97
gugcggccaggcgg

SEQ ID NO: 1039769 - RNA, 13 nt, Mycobacterium bovis subsp bovis AF2122/97
gugcgucacagcc

SEQ ID NO: 1039770 - RNA, 13 nt, Mycobacterium bovis subsp bovis AF2122/97
gugcggcggcguc

SEQ ID NO: 1039771 - RNA, 13 nt, Mycobacterium bovis subsp bovis AF2122/97
gugcgcaccagca

SEQ ID NO: 1039772 - RNA, 20 nt, Mycobacterium bovis subsp bovis AF2122/97
gugcgcaccagcacacccgu

SEQ ID NO: 1039773 - RNA, 20 nt, Mycobacterium bovis subsp bovis AF2122/97
gugcgauuuugugucugcuc

SEQ ID NO: 1039774 - RNA, 19 nt, Mycobacterium bovis subsp bovis AF2122/97
gugcgcaacccagccgcgc

SEQ ID NO: 1039775 - RNA, 14 nt, Mycobacterium bovis subsp bovis AF2122/97
gugcgcaaggccgc

SEQ ID NO: 1039776 - RNA, 22 nt, Mycobacterium bovis subsp bovis AF2122/97
gugcgaucgucaacgacgacga

SEQ ID NO: 1039777 - RNA, 16 nt, Mycobacterium bovis subsp bovis AF2122/97
gugcgaugcagcgcgc

SEQ ID NO: 1039778 - RNA, 17 nt, Mycobacterium bovis subsp bovis AF2122/97
gugcgauucugcgucug

SEQ ID NO: 1039779 - RNA, 19 nt, Mycobacterium bovis subsp bovis AF2122/97
gugcgauuuugugucugcu

SEQ ID NO: 1039780 - RNA, 19 nt, Mycobacterium bovis subsp bovis AF2122/97
gugcgaucaccuccgcgac

SEQ ID NO: 1039781 - RNA, 19 nt, Mycobacterium bovis subsp bovis AF2122/97
gugcgauccagggccgacg

SEQ ID NO: 1039782 - RNA, 13 nt, Mycobacterium bovis subsp bovis AF2122/97
gugcgcaccccgc

SEQ ID NO: 1039783 - RNA, 22 nt, Mycobacterium bovis subsp bovis AF2122/97
gugcgcaccccgcuugcgcggc

SEQ ID NO: 1039784 - RNA, 13 nt, Mycobacterium bovis subsp bovis AF2122/97
gugcgcacggcgg

SEQ ID NO: 1039785 - RNA, 14 nt, Mycobacterium bovis subsp bovis AF2122/97
gugcgcacggcggc

SEQ ID NO: 1039786 - RNA, 14 nt, Mycobacterium bovis subsp bovis AF2122/97
gugcgcagaacacc

SEQ ID NO: 1039787 - RNA, 22 nt, Mycobacterium bovis subsp bovis AF2122/97
gugcgcagaacaccaccgccag

SEQ ID NO: 1039788 - RNA, 22 nt, Mycobacterium bovis subsp bovis AF2122/97
gugcgauccagggccgacgcga

SEQ ID NO: 1039789 - RNA, 16 nt, Mycobacterium bovis subsp bovis AF2122/97
gugcgccguugccgcc

SEQ ID NO: 1039790 - RNA, 14 nt, Mycobacterium bovis subsp bovis AF2122/97
gugcgccgugcgau

SEQ ID NO: 1039791 - RNA, 23 nt, Mycobacterium bovis subsp bovis AF2122/97
gugcgcgaaguuugcgacgacgc

SEQ ID NO: 1039792 - RNA, 20 nt, Mycobacterium bovis subsp bovis AF2122/97
gugcgcgaccacccgccgca

SEQ ID NO: 1039793 - RNA, 16 nt, Mycobacterium bovis subsp bovis AF2122/97
gugcgcgaggucggcg

SEQ ID NO: 1039794 - RNA, 18 nt, Mycobacterium bovis subsp bovis AF2122/97
gugcgcgaggucggcggc

SEQ ID NO: 1039795 - RNA, 19 nt, Mycobacterium bovis subsp bovis AF2122/97
gugcgcgaggucggcggcg

SEQ ID NO: 1039796 - RNA, 22 nt, Mycobacterium bovis subsp bovis AF2122/97
gugcgcgcgaccauacccgcgc

SEQ ID NO: 1039797 - RNA, 22 nt, Mycobacterium bovis subsp bovis AF2122/97
gugccguggugaaaugccgaga

SEQ ID NO: 1039798 - RNA, 17 nt, Mycobacterium bovis subsp bovis AF2122/97
gugccguguccagcaug

SEQ ID NO: 1039799 - RNA, 17 nt, Mycobacterium bovis subsp bovis AF2122/97
gugccgugaucggcgcc

SEQ ID NO: 1039800 - RNA, 15 nt, Mycobacterium bovis subsp bovis AF2122/97
gugccgugcucacgg

SEQ ID NO: 1039801 - RNA, 15 nt, Mycobacterium bovis subsp bovis AF2122/97
gugccguggcuaccg

SEQ ID NO: 1039802 - RNA, 15 nt, Mycobacterium bovis subsp bovis AF2122/97
gugccgucgccgccc

SEQ ID NO: 1039803 - RNA, 23 nt, Mycobacterium bovis subsp bovis AF2122/97
gugcgaguaacccguccggugga

SEQ ID NO: 1039804 - RNA, 16 nt, Mycobacterium bovis subsp bovis AF2122/97
gugccguuccagcauc

SEQ ID NO: 1039805 - RNA, 21 nt, Mycobacterium bovis subsp bovis AF2122/97
gugccguugaagcccaacagc

SEQ ID NO: 1039806 - RNA, 13 nt, Mycobacterium bovis subsp bovis AF2122/97
gugccgucaacga

SEQ ID NO: 1039807 - RNA, 21 nt, Mycobacterium bovis subsp bovis AF2122/97
gugccgugugcuucgagcacc

SEQ ID NO: 1039808 - RNA, 21 nt, Mycobacterium bovis subsp bovis AF2122/97
gugccggucgaugaccuccaa

SEQ ID NO: 1039809 - RNA, 20 nt, Mycobacterium bovis subsp bovis AF2122/97
gugccgguggugacggcggu

SEQ ID NO: 1039810 - RNA, 14 nt, Mycobacterium bovis subsp bovis AF2122/97
gugccgggucaccg

SEQ ID NO: 1039811 - RNA, 20 nt, Mycobacterium bovis subsp bovis AF2122/97
gugccggucaccucgccggc

SEQ ID NO: 1039812 - RNA, 14 nt, Mycobacterium bovis subsp bovis AF2122/97
gugccggucgauga

SEQ ID NO: 1039813 - RNA, 19 nt, Mycobacterium bovis subsp bovis AF2122/97
gugccggggauaucacgac

SEQ ID NO: 1039814 - RNA, 12 nt, Mycobacterium bovis subsp bovis AF2122/97
gugccggucacc

SEQ ID NO: 1039815 - RNA, 22 nt, Mycobacterium bovis subsp bovis AF2122/97
gugcaacggcguuggcgccguu

SEQ ID NO: 1039816 - RNA, 13 nt, Mycobacterium bovis subsp bovis AF2122/97
gugcaaccgugcc

SEQ ID NO: 1039817 - RNA, 19 nt, Mycobacterium bovis subsp bovis AF2122/97
gugcaacaggcgcgucggu

SEQ ID NO: 1039818 - RNA, 18 nt, Mycobacterium bovis subsp bovis AF2122/97
gugcaaccacggcggcau

SEQ ID NO: 1039819 - RNA, 23 nt, Mycobacterium bovis subsp bovis AF2122/97
gugcaaccccaaguccagcagcg

SEQ ID NO: 1039820 - RNA, 15 nt, Mycobacterium bovis subsp bovis AF2122/97
gugcaaaggcgccgu

SEQ ID NO: 1039821 - RNA, 18 nt, Mycobacterium bovis subsp bovis AF2122/97
gugauuucaacgucgcgu

SEQ ID NO: 1039822 - RNA, 23 nt, Mycobacterium bovis subsp bovis AF2122/97
gugcacaacgcccaccacgcgac

SEQ ID NO: 1039823 - RNA, 20 nt, Mycobacterium bovis subsp bovis AF2122/97
gugcaccgcgaccgcgcacg

SEQ ID NO: 1039824 - RNA, 13 nt, Mycobacterium bovis subsp bovis AF2122/97
gugcaccgucggg

SEQ ID NO: 1039825 - RNA, 21 nt, Mycobacterium bovis subsp bovis AF2122/97
gugcaccgcgucguagccacg

SEQ ID NO: 1039826 - RNA, 18 nt, Mycobacterium bovis subsp bovis AF2122/97
gugcacgagcggacaggg

SEQ ID NO: 1039827 - RNA, 16 nt, Mycobacterium bovis subsp bovis AF2122/97
gugcagaaaccaggac

SEQ ID NO: 1039828 - RNA, 14 nt, Mycobacterium bovis subsp bovis AF2122/97
gugcacugaccgcg

SEQ ID NO: 1039829 - RNA, 14 nt, Mycobacterium bovis subsp bovis AF2122/97
gugcacggcggcca

SEQ ID NO: 1039830 - RNA, 19 nt, Mycobacterium bovis subsp bovis AF2122/97
gugcagcacggcgccgcca

SEQ ID NO: 1039831 - RNA, 17 nt, Mycobacterium bovis subsp bovis AF2122/97
gugcagcacguccgcgg

SEQ ID NO: 1039832 - RNA, 14 nt, Mycobacterium bovis subsp bovis AF2122/97
gugcagcacgugug

SEQ ID NO: 1039833 - RNA, 21 nt, Mycobacterium bovis subsp bovis AF2122/97
gugcagcacuuccaagccgac

SEQ ID NO: 1039834 - RNA, 14 nt, Mycobacterium bovis subsp bovis AF2122/97
gugcagcaccagcc

SEQ ID NO: 1039835 - RNA, 14 nt, Mycobacterium bovis subsp bovis AF2122/97
gugcagcacggcgc

SEQ ID NO: 1039836 - RNA, 22 nt, Mycobacterium bovis subsp bovis AF2122/97
gugcagcaacaucuugccgucg

SEQ ID NO: 1039837 - RNA, 14 nt, Mycobacterium bovis subsp bovis AF2122/97
gugcagaccaccgc

SEQ ID NO: 1039838 - RNA, 18 nt, Mycobacterium bovis subsp bovis AF2122/97
gugcagaccaccgccugg

SEQ ID NO: 1039839 - RNA, 23 nt, Mycobacterium bovis subsp bovis AF2122/97
gugcacuacaggguuggcagcca

SEQ ID NO: 1039840 - RNA, 18 nt, Mycobacterium bovis subsp bovis AF2122/97
gugaucugcccugcacuu

SEQ ID NO: 1039841 - RNA, 19 nt, Mycobacterium bovis subsp bovis AF2122/97
gugaucgggcagcacgcca

SEQ ID NO: 1039842 - RNA, 18 nt, Mycobacterium bovis subsp bovis AF2122/97
gugaucggcgaacccacc

SEQ ID NO: 1039843 - RNA, 17 nt, Mycobacterium bovis subsp bovis AF2122/97
gugauacagcucggugc

SEQ ID NO: 1039844 - RNA, 13 nt, Mycobacterium bovis subsp bovis AF2122/97
gugagugaccacg

SEQ ID NO: 1039845 - RNA, 13 nt, Mycobacterium bovis subsp bovis AF2122/97
gugagguagucgg

SEQ ID NO: 1039846 - RNA, 17 nt, Mycobacterium bovis subsp bovis AF2122/97
gugaguccagccggcgc

SEQ ID NO: 1039847 - RNA, 16 nt, Mycobacterium bovis subsp bovis AF2122/97
gugagucccacgccag

SEQ ID NO: 1039848 - RNA, 20 nt, Mycobacterium bovis subsp bovis AF2122/97
gugaguaccaauccaggcca

SEQ ID NO: 1039849 - RNA, 22 nt, Mycobacterium bovis subsp bovis AF2122/97
gugaguacggugugcgugcggu

SEQ ID NO: 1039850 - RNA, 12 nt, Mycobacterium bovis subsp bovis AF2122/97
gugauugcgcgg

SEQ ID NO: 1039851 - RNA, 16 nt, Mycobacterium bovis subsp bovis AF2122/97
gugauugcggccgccg

SEQ ID NO: 1039852 - RNA, 18 nt, Mycobacterium bovis subsp bovis AF2122/97
gugauugcggccgccgag

SEQ ID NO: 1039853 - RNA, 23 nt, Mycobacterium bovis subsp bovis AF2122/97
gugauugcggccgccgagucaaa

SEQ ID NO: 1039854 - RNA, 22 nt, Mycobacterium bovis subsp bovis AF2122/97
gugauugagcagcaagccgccg

SEQ ID NO: 1039855 - RNA, 19 nt, Mycobacterium bovis subsp bovis AF2122/97
gugauuaccugguucgacu

SEQ ID NO: 1039856 - RNA, 19 nt, Mycobacterium bovis subsp bovis AF2122/97
gugauuccgggucggcgaa

SEQ ID NO: 1039857 - RNA, 18 nt, Mycobacterium bovis subsp bovis AF2122/97
gugauguagggcugcucc

SEQ ID NO: 1039858 - RNA, 13 nt, Mycobacterium bovis subsp bovis AF2122/97
gugauggccgcgc

SEQ ID NO: 1039859 - RNA, 19 nt, Mycobacterium bovis subsp bovis AF2122/97
gugaucugguccggcaaca

SEQ ID NO: 1039860 - RNA, 16 nt, Mycobacterium bovis subsp bovis AF2122/97
gugaugggcauggugg

SEQ ID NO: 1039861 - RNA, 17 nt, Mycobacterium bovis subsp bovis AF2122/97
gugauggcggcgcaccu

SEQ ID NO: 1039862 - RNA, 20 nt, Mycobacterium bovis subsp bovis AF2122/97
gugaucuuggcgcccgccgg

SEQ ID NO: 1039863 - RNA, 16 nt, Mycobacterium bovis subsp bovis AF2122/97
gugauguuggccgcca

SEQ ID NO: 1039864 - RNA, 23 nt, Mycobacterium bovis subsp bovis AF2122/97
gugaugucuaccaacaccgcccg

SEQ ID NO: 1039865 - RNA, 21 nt, Mycobacterium bovis subsp bovis AF2122/97
gugauggugaauaucucgccg

SEQ ID NO: 1039866 - RNA, 15 nt, Mycobacterium bovis subsp bovis AF2122/97
gugauggugaccagc

SEQ ID NO: 1039867 - RNA, 17 nt, Mycobacterium bovis subsp bovis AF2122/97
gugauggugugcagcag

SEQ ID NO: 1039868 - RNA, 13 nt, Mycobacterium bovis subsp bovis AF2122/97
gugauguagcugc

SEQ ID NO: 1039869 - RNA, 20 nt, Mycobacterium bovis subsp bovis AF2122/97
gugauggucagcuggccgcg

SEQ ID NO: 1039870 - RNA, 21 nt, Mycobacterium bovis subsp bovis AF2122/97
gugauggucagcuggccgcgg

SEQ ID NO: 1039871 - RNA, 17 nt, Mycobacterium bovis subsp bovis AF2122/97
gugacgaguucgcugac

SEQ ID NO: 1039872 - RNA, 17 nt, Mycobacterium bovis subsp bovis AF2122/97
gugacgagccaccaccg

SEQ ID NO: 1039873 - RNA, 17 nt, Mycobacterium bovis subsp bovis AF2122/97
gugacgaucaagcuggc

SEQ ID NO: 1039874 - RNA, 15 nt, Mycobacterium bovis subsp bovis AF2122/97
gugacgaucacaugc

SEQ ID NO: 1039875 - RNA, 19 nt, Mycobacterium bovis subsp bovis AF2122/97
gugacgaacuucgaugccg

SEQ ID NO: 1039876 - RNA, 18 nt, Mycobacterium bovis subsp bovis AF2122/97
gugacgaagagcaccgcg

SEQ ID NO: 1039877 - RNA, 17 nt, Mycobacterium bovis subsp bovis AF2122/97
gugacccgccggcgacu

SEQ ID NO: 1039878 - RNA, 20 nt, Mycobacterium bovis subsp bovis AF2122/97
gugacgaaggcugucaguuc

SEQ ID NO: 1039879 - RNA, 20 nt, Mycobacterium bovis subsp bovis AF2122/97
gugacgauccccauugcgcc

SEQ ID NO: 1039880 - RNA, 16 nt, Mycobacterium bovis subsp bovis AF2122/97
gugacgaucgacagcc

SEQ ID NO: 1039881 - RNA, 19 nt, Mycobacterium bovis subsp bovis AF2122/97
gugacgaucaggccgucgc

SEQ ID NO: 1039882 - RNA, 20 nt, Mycobacterium bovis subsp bovis AF2122/97
gugacgaucaggccgucgcc

SEQ ID NO: 1039883 - RNA, 22 nt, Mycobacterium bovis subsp bovis AF2122/97
gugacgaucaggccgucgccgg

SEQ ID NO: 1039884 - RNA, 20 nt, Mycobacterium bovis subsp bovis AF2122/97
gugacgaucguagccguagc

SEQ ID NO: 1039885 - RNA, 15 nt, Mycobacterium bovis subsp bovis AF2122/97
gugacgcacagcagc

SEQ ID NO: 1039886 - RNA, 13 nt, Mycobacterium bovis subsp bovis AF2122/97
gugacgauugcca

SEQ ID NO: 1039887 - RNA, 16 nt, Mycobacterium bovis subsp bovis AF2122/97
gugacgccgccagcac

SEQ ID NO: 1039888 - RNA, 14 nt, Mycobacterium bovis subsp bovis AF2122/97
gugacccugguggu

SEQ ID NO: 1039889 - RNA, 16 nt, Mycobacterium bovis subsp bovis AF2122/97
gugaccgaccgccaug

SEQ ID NO: 1039890 - RNA, 12 nt, Mycobacterium bovis subsp bovis AF2122/97
gugaccggcggg

SEQ ID NO: 1039891 - RNA, 19 nt, Mycobacterium bovis subsp bovis AF2122/97
gugaccggcaaugccacgg

SEQ ID NO: 1039892 - RNA, 14 nt, Mycobacterium bovis subsp bovis AF2122/97
gugaccgcuggugu

SEQ ID NO: 1039893 - RNA, 18 nt, Mycobacterium bovis subsp bovis AF2122/97
gugaccgggucgaucacc

SEQ ID NO: 1039894 - RNA, 19 nt, Mycobacterium bovis subsp bovis AF2122/97
gugaccgggucgaucaccg

SEQ ID NO: 1039895 - RNA, 22 nt, Mycobacterium bovis subsp bovis AF2122/97
gugaccgguguuccgcccagcg

SEQ ID NO: 1039896 - RNA, 18 nt, Mycobacterium bovis subsp bovis AF2122/97
gugaccucgucggcgacg

SEQ ID NO: 1039897 - RNA, 24 nt, Mycobacterium bovis subsp bovis AF2122/97
gugaccucgucggcgacggccagc

SEQ ID NO: 1039898 - RNA, 16 nt, Mycobacterium bovis subsp bovis AF2122/97
gugaccgugccgucgg

SEQ ID NO: 1039899 - RNA, 17 nt, Mycobacterium bovis subsp bovis AF2122/97
gugaccgugccgucggc

SEQ ID NO: 1039900 - RNA, 17 nt, Mycobacterium bovis subsp bovis AF2122/97
gugaccugacgcucggu

SEQ ID NO: 1039901 - RNA, 22 nt, Mycobacterium bovis subsp bovis AF2122/97
gugaccugacgcucggucgcca

SEQ ID NO: 1039902 - RNA, 23 nt, Mycobacterium bovis subsp bovis AF2122/97
gugaccugacgcucggucgccac

SEQ ID NO: 1039903 - RNA, 16 nt, Mycobacterium bovis subsp bovis AF2122/97
gugacguuccgcucgc

SEQ ID NO: 1039904 - RNA, 21 nt, Mycobacterium bovis subsp bovis AF2122/97
gugacucaccgugaaccgccc

SEQ ID NO: 1039905 - RNA, 21 nt, Mycobacterium bovis subsp bovis AF2122/97
gugacuuggagugcggguggu

SEQ ID NO: 1039906 - RNA, 21 nt, Mycobacterium bovis subsp bovis AF2122/97
gugagaucguagggacgccga

SEQ ID NO: 1039907 - RNA, 17 nt, Mycobacterium bovis subsp bovis AF2122/97
gugagauggcggugagc

SEQ ID NO: 1039908 - RNA, 21 nt, Mycobacterium bovis subsp bovis AF2122/97
gugagacgaaaagccgcgucg

SEQ ID NO: 1039909 - RNA, 14 nt, Mycobacterium bovis subsp bovis AF2122/97
gugagcuuagcgca

SEQ ID NO: 1039910 - RNA, 17 nt, Mycobacterium bovis subsp bovis AF2122/97
gugagauugguggcccg

SEQ ID NO: 1039911 - RNA, 12 nt, Mycobacterium bovis subsp bovis AF2122/97
gugagcacaccg

SEQ ID NO: 1039912 - RNA, 20 nt, Mycobacterium bovis subsp bovis AF2122/97
gugagcacaccgacagcacc

SEQ ID NO: 1039913 - RNA, 15 nt, Mycobacterium bovis subsp bovis AF2122/97
gugagcaccagcagc

SEQ ID NO: 1039914 - RNA, 17 nt, Mycobacterium bovis subsp bovis AF2122/97
gugagcaccagcagcac

SEQ ID NO: 1039915 - RNA, 16 nt, Mycobacterium bovis subsp bovis AF2122/97
gugaggccuucgccga

SEQ ID NO: 1039916 - RNA, 16 nt, Mycobacterium bovis subsp bovis AF2122/97
gugaggccgaccagca

SEQ ID NO: 1039917 - RNA, 18 nt, Mycobacterium bovis subsp bovis AF2122/97
gugagcaccggauacagc

SEQ ID NO: 1039918 - RNA, 20 nt, Mycobacterium bovis subsp bovis AF2122/97
gugagcaccggauacagcca

SEQ ID NO: 1039919 - RNA, 18 nt, Mycobacterium bovis subsp bovis AF2122/97
gugacgguggccggcaac

SEQ ID NO: 1039920 - RNA, 14 nt, Mycobacterium bovis subsp bovis AF2122/97
gugacggucgucga

SEQ ID NO: 1039921 - RNA, 19 nt, Mycobacterium bovis subsp bovis AF2122/97
gugacgguccguucgaugc

SEQ ID NO: 1039922 - RNA, 17 nt, Mycobacterium bovis subsp bovis AF2122/97
gugacgguccacgacgu

SEQ ID NO: 1039923 - RNA, 20 nt, Mycobacterium bovis subsp bovis AF2122/97
gugacgguccacgacgucga

SEQ ID NO: 1039924 - RNA, 18 nt, Mycobacterium bovis subsp bovis AF2122/97
gugacgucguggcgcucg

SEQ ID NO: 1039925 - RNA, 14 nt, Mycobacterium bovis subsp bovis AF2122/97
gugacguaccacgg

SEQ ID NO: 1039926 - RNA, 14 nt, Mycobacterium bovis subsp bovis AF2122/97
gugacgcuuggcca

SEQ ID NO: 1039927 - RNA, 12 nt, Mycobacterium bovis subsp bovis AF2122/97
gugacguagaug

SEQ ID NO: 1039928 - RNA, 20 nt, Mycobacterium bovis subsp bovis AF2122/97
gugacgggaaacuccgcggc

SEQ ID NO: 1039929 - RNA, 19 nt, Mycobacterium bovis subsp bovis AF2122/97
gugacggggcugaccgcca

SEQ ID NO: 1039930 - RNA, 22 nt, Mycobacterium bovis subsp bovis AF2122/97
gugacgggguugaccgccaccc

SEQ ID NO: 1039931 - RNA, 18 nt, Mycobacterium bovis subsp bovis AF2122/97
gucgucgggaacgccgaa

SEQ ID NO: 1039932 - RNA, 13 nt, Mycobacterium bovis subsp bovis AF2122/97
gucgucgaccagg

SEQ ID NO: 1039933 - RNA, 13 nt, Mycobacterium bovis subsp bovis AF2122/97
gucgucggcgucg

SEQ ID NO: 1039934 - RNA, 23 nt, Mycobacterium bovis subsp bovis AF2122/97
gucgucgccaaucgaguagcuga

SEQ ID NO: 1039935 - RNA, 13 nt, Mycobacterium bovis subsp bovis AF2122/97
gucgucggccugc

SEQ ID NO: 1039936 - RNA, 19 nt, Mycobacterium bovis subsp bovis AF2122/97
gucgucgaggucagugggc

SEQ ID NO: 1039937 - RNA, 15 nt, Mycobacterium bovis subsp bovis AF2122/97
gucgucgaguuggcc

SEQ ID NO: 1039938 - RNA, 18 nt, Mycobacterium bovis subsp bovis AF2122/97
gucgucgguaaugccggg

SEQ ID NO: 1039939 - RNA, 21 nt, Mycobacterium bovis subsp bovis AF2122/97
gucgucggugaucaccgcggc

SEQ ID NO: 1039940 - RNA, 16 nt, Mycobacterium bovis subsp bovis AF2122/97
gucgucgguguuccgc

SEQ ID NO: 1039941 - RNA, 13 nt, Mycobacterium bovis subsp bovis AF2122/97
gucgucgaucgac

SEQ ID NO: 1039942 - RNA, 13 nt, Mycobacterium bovis subsp bovis AF2122/97
gucgucgagcuga

SEQ ID NO: 1039943 - RNA, 20 nt, Mycobacterium bovis subsp bovis AF2122/97
gucgucgagcaccacccggg

SEQ ID NO: 1039944 - RNA, 14 nt, Mycobacterium bovis subsp bovis AF2122/97
gucgucgacgaggu

SEQ ID NO: 1039945 - RNA, 22 nt, Mycobacterium bovis subsp bovis AF2122/97
gucgucgaccacgacguucgac

SEQ ID NO: 1039946 - RNA, 18 nt, Mycobacterium bovis subsp bovis AF2122/97
gucgucgacacggugauc

SEQ ID NO: 1039947 - RNA, 21 nt, Mycobacterium bovis subsp bovis AF2122/97
gucgucaugccagucgccgaa

SEQ ID NO: 1039948 - RNA, 15 nt, Mycobacterium bovis subsp bovis AF2122/97
gucgucaucgagcgg

SEQ ID NO: 1039949 - RNA, 21 nt, Mycobacterium bovis subsp bovis AF2122/97
gucgucaucgaguugcucggc

SEQ ID NO: 1039950 - RNA, 22 nt, Mycobacterium bovis subsp bovis AF2122/97
gucgucaucgaguugcucggcc

SEQ ID NO: 1039951 - RNA, 22 nt, Mycobacterium bovis subsp bovis AF2122/97
gucgucaguaauucggccaucg

SEQ ID NO: 1039952 - RNA, 23 nt, Mycobacterium bovis subsp bovis AF2122/97
gucguccagacgccacugccagc

SEQ ID NO: 1039953 - RNA, 20 nt, Mycobacterium bovis subsp bovis AF2122/97
gucgucaucggggccugcgu

SEQ ID NO: 1039954 - RNA, 19 nt, Mycobacterium bovis subsp bovis AF2122/97
gucgucaccgaugcgccgg

SEQ ID NO: 1039955 - RNA, 20 nt, Mycobacterium bovis subsp bovis AF2122/97
gucgucaccgaugcgccgga

SEQ ID NO: 1039956 - RNA, 17 nt, Mycobacterium bovis subsp bovis AF2122/97
gucgucacggaccgcca

SEQ ID NO: 1039957 - RNA, 22 nt, Mycobacterium bovis subsp bovis AF2122/97
gucguaccuaaggcucaccagg

SEQ ID NO: 1039958 - RNA, 15 nt, Mycobacterium bovis subsp bovis AF2122/97
gucguaccgcucggc

SEQ ID NO: 1039959 - RNA, 20 nt, Mycobacterium bovis subsp bovis AF2122/97
gucguaccuaaggcucacca

SEQ ID NO: 1039960 - RNA, 15 nt, Mycobacterium bovis subsp bovis AF2122/97
gucguacucggcggc

SEQ ID NO: 1039961 - RNA, 20 nt, Mycobacterium bovis subsp bovis AF2122/97
gucguacucccaggccgccg

SEQ ID NO: 1039962 - RNA, 21 nt, Mycobacterium bovis subsp bovis AF2122/97
gucguacucccaggccgccgc

SEQ ID NO: 1039963 - RNA, 18 nt, Mycobacterium bovis subsp bovis AF2122/97
gucguagaacugcaucau

SEQ ID NO: 1039964 - RNA, 15 nt, Mycobacterium bovis subsp bovis AF2122/97
gucguagacagucug

SEQ ID NO: 1039965 - RNA, 16 nt, Mycobacterium bovis subsp bovis AF2122/97
gucguagacgguuacc

SEQ ID NO: 1039966 - RNA, 14 nt, Mycobacterium bovis subsp bovis AF2122/97
gucguagacggcga

SEQ ID NO: 1039967 - RNA, 18 nt, Mycobacterium bovis subsp bovis AF2122/97
gucguacucggcggccac

SEQ ID NO: 1039968 - RNA, 19 nt, Mycobacterium bovis subsp bovis AF2122/97
gucguagacagucugcgac

SEQ ID NO: 1039969 - RNA, 17 nt, Mycobacterium bovis subsp bovis AF2122/97
gucguaguaggcgccgc

SEQ ID NO: 1039970 - RNA, 14 nt, Mycobacterium bovis subsp bovis AF2122/97
gucguagcuuccgg

SEQ ID NO: 1039971 - RNA, 20 nt, Mycobacterium bovis subsp bovis AF2122/97
gucguagcuuccgguccagc

SEQ ID NO: 1039972 - RNA, 19 nt, Mycobacterium bovis subsp bovis AF2122/97
gucguagcucgguaggccg

SEQ ID NO: 1039973 - RNA, 19 nt, Mycobacterium bovis subsp bovis AF2122/97
gucguauugccucaccagg

SEQ ID NO: 1039974 - RNA, 21 nt, Mycobacterium bovis subsp bovis AF2122/97
gucgucaaaucuggcuggacc

SEQ ID NO: 1039975 - RNA, 17 nt, Mycobacterium bovis subsp bovis AF2122/97
gucguaggacaccaccg

SEQ ID NO: 1039976 - RNA, 14 nt, Mycobacterium bovis subsp bovis AF2122/97
gucguaaucggcaa

SEQ ID NO: 1039977 - RNA, 14 nt, Mycobacterium bovis subsp bovis AF2122/97
gucguacaacacgg

SEQ ID NO: 1039978 - RNA, 15 nt, Mycobacterium bovis subsp bovis AF2122/97
gucguacaacacggg

SEQ ID NO: 1039979 - RNA, 20 nt, Mycobacterium bovis subsp bovis AF2122/97
gucguacaacacgggcagcu

SEQ ID NO: 1039980 - RNA, 20 nt, Mycobacterium bovis subsp bovis AF2122/97
gucgguuuccuccggcagca

SEQ ID NO: 1039981 - RNA, 16 nt, Mycobacterium bovis subsp bovis AF2122/97
gucguaccgcggaucg

SEQ ID NO: 1039982 - RNA, 22 nt, Mycobacterium bovis subsp bovis AF2122/97
gucguacccggcaacgggaucu

SEQ ID NO: 1039983 - RNA, 17 nt, Mycobacterium bovis subsp bovis AF2122/97
gucgguucaucaaggug

SEQ ID NO: 1039984 - RNA, 19 nt, Mycobacterium bovis subsp bovis AF2122/97
gucgguugccacgccgccg

SEQ ID NO: 1039985 - RNA, 20 nt, Mycobacterium bovis subsp bovis AF2122/97
gucgguugccacgccgccgg

SEQ ID NO: 1039986 - RNA, 14 nt, Mycobacterium bovis subsp bovis AF2122/97
gucgguuggcagcc

SEQ ID NO: 1039987 - RNA, 15 nt, Mycobacterium bovis subsp bovis AF2122/97
gucgguuccggugua

SEQ ID NO: 1039988 - RNA, 23 nt, Mycobacterium bovis subsp bovis AF2122/97
gucgguucggccggagccgccgg

SEQ ID NO: 1039989 - RNA, 12 nt, Mycobacterium bovis subsp bovis AF2122/97
gucggugcgcgc

SEQ ID NO: 1039990 - RNA, 13 nt, Mycobacterium bovis subsp bovis AF2122/97
gucggugcagcgc

SEQ ID NO: 1039991 - RNA, 22 nt, Mycobacterium bovis subsp bovis AF2122/97
gucggugcagcgcacgcagccg

SEQ ID NO: 1039992 - RNA, 16 nt, Mycobacterium bovis subsp bovis AF2122/97
gucggugccgcggacg

SEQ ID NO: 1039993 - RNA, 17 nt, Mycobacterium bovis subsp bovis AF2122/97
gucggugccgccgccgg

SEQ ID NO: 1039994 - RNA, 14 nt, Mycobacterium bovis subsp bovis AF2122/97
gucggugccgcgga

SEQ ID NO: 1039995 - RNA, 16 nt, Mycobacterium bovis subsp bovis AF2122/97
gucggugcgcgcggcg

SEQ ID NO: 1039996 - RNA, 14 nt, Mycobacterium bovis subsp bovis AF2122/97
gucggugcgcggca

SEQ ID NO: 1039997 - RNA, 15 nt, Mycobacterium bovis subsp bovis AF2122/97
gucggugccgucgag

SEQ ID NO: 1039998 - RNA, 20 nt, Mycobacterium bovis subsp bovis AF2122/97
gucggugcugaccccgccgg

SEQ ID NO: 1039999 - RNA, 21 nt, Mycobacterium bovis subsp bovis AF2122/97
gucggugagccgugccgccag

SEQ ID NO: 1040000 - RNA, 23 nt, Mycobacterium bovis subsp bovis AF2122/97
gucggugcguccggugcuggucc

SEQ ID NO: 1040001 - RNA, 20 nt, Mycobacterium bovis subsp bovis AF2122/97
gucgggguuucaggcggcag

SEQ ID NO: 1040002 - RNA, 22 nt, Mycobacterium bovis subsp bovis AF2122/97
gucgggucgaucaccgacaccg

SEQ ID NO: 1040003 - RNA, 23 nt, Mycobacterium bovis subsp bovis AF2122/97
gucgggucgcaccccggcggcgu

SEQ ID NO: 1040004 - RNA, 17 nt, Mycobacterium bovis subsp bovis AF2122/97
gucgggucgaucaccga

SEQ ID NO: 1040005 - RNA, 22 nt, Mycobacterium bovis subsp bovis AF2122/97
gucgggugcagcacggcgccgc

SEQ ID NO: 1040006 - RNA, 20 nt, Mycobacterium bovis subsp bovis AF2122/97
gucgggugugcaggccgcgg

SEQ ID NO: 1040007 - RNA, 12 nt, Mycobacterium bovis subsp bovis AF2122/97
gucgggugcuga

SEQ ID NO: 1040008 - RNA, 16 nt, Mycobacterium bovis subsp bovis AF2122/97
gucgguaccccagcgc

SEQ ID NO: 1040009 - RNA, 21 nt, Mycobacterium bovis subsp bovis AF2122/97
gucggugaucacggucggcgg

SEQ ID NO: 1040010 - RNA, 22 nt, Mycobacterium bovis subsp bovis AF2122/97
gucggugauggucagcuggccg

SEQ ID NO: 1040011 - RNA, 23 nt, Mycobacterium bovis subsp bovis AF2122/97
gucggugauggucagcuggccgc

SEQ ID NO: 1040012 - RNA, 20 nt, Mycobacterium bovis subsp bovis AF2122/97
gucggucaccauggcgccgc

SEQ ID NO: 1040013 - RNA, 14 nt, Mycobacterium bovis subsp bovis AF2122/97
gucgguaccguccu

SEQ ID NO: 1040014 - RNA, 20 nt, Mycobacterium bovis subsp bovis AF2122/97
gucgguaccguccucgaaga

SEQ ID NO: 1040015 - RNA, 22 nt, Mycobacterium bovis subsp bovis AF2122/97
gucggucaauucggugcgcugg

SEQ ID NO: 1040016 - RNA, 23 nt, Mycobacterium bovis subsp bovis AF2122/97
gucggucaauucggugcgcuggc

SEQ ID NO: 1040017 - RNA, 18 nt, Mycobacterium bovis subsp bovis AF2122/97
gucggucaccauggcgcc

SEQ ID NO: 1040018 - RNA, 19 nt, Mycobacterium bovis subsp bovis AF2122/97
gucgggguguucgaugggu

SEQ ID NO: 1040019 - RNA, 23 nt, Mycobacterium bovis subsp bovis AF2122/97
gucgggguugacuggccgcccgg

SEQ ID NO: 1040020 - RNA, 22 nt, Mycobacterium bovis subsp bovis AF2122/97
gucgggguuguccucggcgauc

SEQ ID NO: 1040021 - RNA, 23 nt, Mycobacterium bovis subsp bovis AF2122/97
gucgggguuuaguuuaucggccg

SEQ ID NO: 1040022 - RNA, 21 nt, Mycobacterium bovis subsp bovis AF2122/97
gucggggucguugaggccggu

SEQ ID NO: 1040023 - RNA, 15 nt, Mycobacterium bovis subsp bovis AF2122/97
gucgggggcuucggg

SEQ ID NO: 1040024 - RNA, 21 nt, Mycobacterium bovis subsp bovis AF2122/97
gucgggguaauacgcggggcc

SEQ ID NO: 1040025 - RNA, 14 nt, Mycobacterium bovis subsp bovis AF2122/97
gucgggggcagcgc

SEQ ID NO: 1040026 - RNA, 17 nt, Mycobacterium bovis subsp bovis AF2122/97
gucggggcccccgccgg

SEQ ID NO: 1040027 - RNA, 16 nt, Mycobacterium bovis subsp bovis AF2122/97
gucgggaacgccgaac

SEQ ID NO: 1040028 - RNA, 21 nt, Mycobacterium bovis subsp bovis AF2122/97
gucggcuuccuccucggcgcg

SEQ ID NO: 1040029 - RNA, 19 nt, Mycobacterium bovis subsp bovis AF2122/97
gucggcuucgacaaccucg

SEQ ID NO: 1040030 - RNA, 16 nt, Mycobacterium bovis subsp bovis AF2122/97
gucggcuuccggugcc

SEQ ID NO: 1040031 - RNA, 17 nt, Mycobacterium bovis subsp bovis AF2122/97
gucggcuuccuccucgg

SEQ ID NO: 1040032 - RNA, 20 nt, Mycobacterium bovis subsp bovis AF2122/97
gucggcuucgacaaccucga

SEQ ID NO: 1040033 - RNA, 17 nt, Mycobacterium bovis subsp bovis AF2122/97
gucggcgggcgacaucg

SEQ ID NO: 1040034 - RNA, 19 nt, Mycobacterium bovis subsp bovis AF2122/97
gucggccaccccacagucg

SEQ ID NO: 1040035 - RNA, 23 nt, Mycobacterium bovis subsp bovis AF2122/97
gucggccacccggacauagccgc

SEQ ID NO: 1040036 - RNA, 13 nt, Mycobacterium bovis subsp bovis AF2122/97
gucggcggggcgc

SEQ ID NO: 1040037 - RNA, 18 nt, Mycobacterium bovis subsp bovis AF2122/97
gucggcgguagccgacca

SEQ ID NO: 1040038 - RNA, 20 nt, Mycobacterium bovis subsp bovis AF2122/97
gucggcgguagccgaccagc

SEQ ID NO: 1040039 - RNA, 15 nt, Mycobacterium bovis subsp bovis AF2122/97
gucggcguacagcgc

SEQ ID NO: 1040040 - RNA, 12 nt, Mycobacterium bovis subsp bovis AF2122/97
gucggcggugac

SEQ ID NO: 1040041 - RNA, 13 nt, Mycobacterium bovis subsp bovis AF2122/97
gucggcggugccg

SEQ ID NO: 1040042 - RNA, 12 nt, Mycobacterium bovis subsp bovis AF2122/97
gucggcggugcc

SEQ ID NO: 1040043 - RNA, 18 nt, Mycobacterium bovis subsp bovis AF2122/97
gucggcucggcccccgag

SEQ ID NO: 1040044 - RNA, 19 nt, Mycobacterium bovis subsp bovis AF2122/97
gucggcuggacggcgccgg

SEQ ID NO: 1040045 - RNA, 20 nt, Mycobacterium bovis subsp bovis AF2122/97
gucggcugauuggcccaccg

SEQ ID NO: 1040046 - RNA, 23 nt, Mycobacterium bovis subsp bovis AF2122/97
gucggcugauuggcccaccgccg

SEQ ID NO: 1040047 - RNA, 21 nt, Mycobacterium bovis subsp bovis AF2122/97
gucggcugccgcaaacgcggc

SEQ ID NO: 1040048 - RNA, 19 nt, Mycobacterium bovis subsp bovis AF2122/97
gucggcugauuggcccacc

SEQ ID NO: 1040049 - RNA, 16 nt, Mycobacterium bovis subsp bovis AF2122/97
gucggauagccucggc

SEQ ID NO: 1040050 - RNA, 15 nt, Mycobacterium bovis subsp bovis AF2122/97
gucggcagcuccagc

SEQ ID NO: 1040051 - RNA, 16 nt, Mycobacterium bovis subsp bovis AF2122/97
gucggcagcuccagca

SEQ ID NO: 1040052 - RNA, 15 nt, Mycobacterium bovis subsp bovis AF2122/97
gucggccacauccag

SEQ ID NO: 1040053 - RNA, 12 nt, Mycobacterium bovis subsp bovis AF2122/97
gucggcaugggc

SEQ ID NO: 1040054 - RNA, 17 nt, Mycobacterium bovis subsp bovis AF2122/97
gucggcaugggccggcg

SEQ ID NO: 1040055 - RNA, 20 nt, Mycobacterium bovis subsp bovis AF2122/97
gucggcaugggccggcgccg

SEQ ID NO: 1040056 - RNA, 22 nt, Mycobacterium bovis subsp bovis AF2122/97
gucggcauccucugaaccagcu

SEQ ID NO: 1040057 - RNA, 17 nt, Mycobacterium bovis subsp bovis AF2122/97
gucggcaucgcgagcug

SEQ ID NO: 1040058 - RNA, 18 nt, Mycobacterium bovis subsp bovis AF2122/97
gucggcaucgcgagcugc

SEQ ID NO: 1040059 - RNA, 16 nt, Mycobacterium bovis subsp bovis AF2122/97
gucggaguaccgcgcg

SEQ ID NO: 1040060 - RNA, 13 nt, Mycobacterium bovis subsp bovis AF2122/97
gucggagaccagc

SEQ ID NO: 1040061 - RNA, 14 nt, Mycobacterium bovis subsp bovis AF2122/97
gucggagaccagcu

SEQ ID NO: 1040062 - RNA, 17 nt, Mycobacterium bovis subsp bovis AF2122/97
gucggagaccagcucgu

SEQ ID NO: 1040063 - RNA, 13 nt, Mycobacterium bovis subsp bovis AF2122/97
gucggagcgggug

SEQ ID NO: 1040064 - RNA, 22 nt, Mycobacterium bovis subsp bovis AF2122/97
gucggagcuagacccgucaccg

SEQ ID NO: 1040065 - RNA, 14 nt, Mycobacterium bovis subsp bovis AF2122/97
gucggcagcagcgg

SEQ ID NO: 1040066 - RNA, 20 nt, Mycobacterium bovis subsp bovis AF2122/97
gucggcagcagcggugcagc

SEQ ID NO: 1040067 - RNA, 18 nt, Mycobacterium bovis subsp bovis AF2122/97
gucggcagaccgaccucg

SEQ ID NO: 1040068 - RNA, 22 nt, Mycobacterium bovis subsp bovis AF2122/97
gucggcacgggaaucgcucgcg

SEQ ID NO: 1040069 - RNA, 13 nt, Mycobacterium bovis subsp bovis AF2122/97
gugaauucgccga

SEQ ID NO: 1040070 - RNA, 12 nt, Mycobacterium bovis subsp bovis AF2122/97
gugaaugccguc

SEQ ID NO: 1040071 - RNA, 18 nt, Mycobacterium bovis subsp bovis AF2122/97
gugaaucgaagcccggcg

SEQ ID NO: 1040072 - RNA, 13 nt, Mycobacterium bovis subsp bovis AF2122/97
gugaaucgcacga

SEQ ID NO: 1040073 - RNA, 13 nt, Mycobacterium bovis subsp bovis AF2122/97
gugaaucggaccg

SEQ ID NO: 1040074 - RNA, 20 nt, Mycobacterium bovis subsp bovis AF2122/97
gugaaucugacgacgcgaca

SEQ ID NO: 1040075 - RNA, 15 nt, Mycobacterium bovis subsp bovis AF2122/97
gugaaguggcgcagc

SEQ ID NO: 1040076 - RNA, 13 nt, Mycobacterium bovis subsp bovis AF2122/97
gugacaccaacac

SEQ ID NO: 1040077 - RNA, 16 nt, Mycobacterium bovis subsp bovis AF2122/97
gugacaccaacaccgg

SEQ ID NO: 1040078 - RNA, 19 nt, Mycobacterium bovis subsp bovis AF2122/97
gugacaccaacaccggugg

SEQ ID NO: 1040079 - RNA, 15 nt, Mycobacterium bovis subsp bovis AF2122/97
gugacaccacaucgg

SEQ ID NO: 1040080 - RNA, 13 nt, Mycobacterium bovis subsp bovis AF2122/97
gugaauucggcga

SEQ ID NO: 1040081 - RNA, 13 nt, Mycobacterium bovis subsp bovis AF2122/97
gugacaaccgcgc

SEQ ID NO: 1040082 - RNA, 22 nt, Mycobacterium bovis subsp bovis AF2122/97
gugacaaccguuguaccccagc

SEQ ID NO: 1040083 - RNA, 17 nt, Mycobacterium bovis subsp bovis AF2122/97
gugacaacgcgaugccg

SEQ ID NO: 1040084 - RNA, 15 nt, Mycobacterium bovis subsp bovis AF2122/97
gugacaaauucggcg

SEQ ID NO: 1040085 - RNA, 16 nt, Mycobacterium bovis subsp bovis AF2122/97
gugaaggccccgccgg

SEQ ID NO: 1040086 - RNA, 12 nt, Mycobacterium bovis subsp bovis AF2122/97
gugacacgacgu

SEQ ID NO: 1040087 - RNA, 16 nt, Mycobacterium bovis subsp bovis AF2122/97
gugacagcccgcuggc

SEQ ID NO: 1040088 - RNA, 13 nt, Mycobacterium bovis subsp bovis AF2122/97
gugacagcggcau

SEQ ID NO: 1040089 - RNA, 18 nt, Mycobacterium bovis subsp bovis AF2122/97
gugacccucagcaccgcu

SEQ ID NO: 1040090 - RNA, 22 nt, Mycobacterium bovis subsp bovis AF2122/97
gugacccucagcaccgcuggca

SEQ ID NO: 1040091 - RNA, 14 nt, Mycobacterium bovis subsp bovis AF2122/97
gugacccgcugggc

SEQ ID NO: 1040092 - RNA, 17 nt, Mycobacterium bovis subsp bovis AF2122/97
gugaccagucgcggcgu

SEQ ID NO: 1040093 - RNA, 16 nt, Mycobacterium bovis subsp bovis AF2122/97
gugaccaggccggccc

SEQ ID NO: 1040094 - RNA, 21 nt, Mycobacterium bovis subsp bovis AF2122/97
gugaccaggcggacgccgcgc

SEQ ID NO: 1040095 - RNA, 16 nt, Mycobacterium bovis subsp bovis AF2122/97
gugaccaggcggcgcg

SEQ ID NO: 1040096 - RNA, 16 nt, Mycobacterium bovis subsp bovis AF2122/97
gugaccaggccgagcu

SEQ ID NO: 1040097 - RNA, 13 nt, Mycobacterium bovis subsp bovis AF2122/97
gugaccaggccgg

SEQ ID NO: 1040098 - RNA, 15 nt, Mycobacterium bovis subsp bovis AF2122/97
gugaccagcaaccac

SEQ ID NO: 1040099 - RNA, 23 nt, Mycobacterium bovis subsp bovis AF2122/97
gugaccagcaaccaccccagggc

SEQ ID NO: 1040100 - RNA, 12 nt, Mycobacterium bovis subsp bovis AF2122/97
gugaccagcagg

SEQ ID NO: 1040101 - RNA, 14 nt, Mycobacterium bovis subsp bovis AF2122/97
gugaccaacggugc

SEQ ID NO: 1040102 - RNA, 18 nt, Mycobacterium bovis subsp bovis AF2122/97
gugacaucgggccgccga

SEQ ID NO: 1040103 - RNA, 16 nt, Mycobacterium bovis subsp bovis AF2122/97
gugacauagacguugc

SEQ ID NO: 1040104 - RNA, 22 nt, Mycobacterium bovis subsp bovis AF2122/97
gugaagccaagcgacucgccgg

SEQ ID NO: 1040105 - RNA, 14 nt, Mycobacterium bovis subsp bovis AF2122/97
gugaagaccaccgc

SEQ ID NO: 1040106 - RNA, 16 nt, Mycobacterium bovis subsp bovis AF2122/97
gugaagaccaccgccc

SEQ ID NO: 1040107 - RNA, 17 nt, Mycobacterium bovis subsp bovis AF2122/97
gugaagacaccaggccc

SEQ ID NO: 1040108 - RNA, 15 nt, Mycobacterium bovis subsp bovis AF2122/97
gugaagacaccggcg

SEQ ID NO: 1040109 - RNA, 20 nt, Mycobacterium bovis subsp bovis AF2122/97
gugaacuucuccaccagcgu

SEQ ID NO: 1040110 - RNA, 17 nt, Mycobacterium bovis subsp bovis AF2122/97
gugaaggaugcggcccc

SEQ ID NO: 1040111 - RNA, 19 nt, Mycobacterium bovis subsp bovis AF2122/97
gugaaggcaaacaccagcc

SEQ ID NO: 1040112 - RNA, 20 nt, Mycobacterium bovis subsp bovis AF2122/97
gugaaggcaaacaccagccc

SEQ ID NO: 1040113 - RNA, 20 nt, Mycobacterium bovis subsp bovis AF2122/97
gugaaguuguuggccagacc

SEQ ID NO: 1040114 - RNA, 19 nt, Mycobacterium bovis subsp bovis AF2122/97
gucuguacaacgacacgcc

SEQ ID NO: 1040115 - RNA, 21 nt, Mycobacterium bovis subsp bovis AF2122/97
gucuguacaacgacacgccgc

SEQ ID NO: 1040116 - RNA, 19 nt, Mycobacterium bovis subsp bovis AF2122/97
gucugggcaucaucgacgc

SEQ ID NO: 1040117 - RNA, 21 nt, Mycobacterium bovis subsp bovis AF2122/97
gucuucgauaccgaccgaaag

SEQ ID NO: 1040118 - RNA, 13 nt, Mycobacterium bovis subsp bovis AF2122/97
gucugggcgaucg

SEQ ID NO: 1040119 - RNA, 22 nt, Mycobacterium bovis subsp bovis AF2122/97
gucugggucaggcgaaccuggu

SEQ ID NO: 1040120 - RNA, 16 nt, Mycobacterium bovis subsp bovis AF2122/97
gucuggucauggccga

SEQ ID NO: 1040121 - RNA, 15 nt, Mycobacterium bovis subsp bovis AF2122/97
gucuggguugcguag

SEQ ID NO: 1040122 - RNA, 15 nt, Mycobacterium bovis subsp bovis AF2122/97
gucugguggcagcgc

SEQ ID NO: 1040123 - RNA, 19 nt, Mycobacterium bovis subsp bovis AF2122/97
gucugguggucggcgacgu

SEQ ID NO: 1040124 - RNA, 17 nt, Mycobacterium bovis subsp bovis AF2122/97
gucugguguccaccgca

SEQ ID NO: 1040125 - RNA, 15 nt, Mycobacterium bovis subsp bovis AF2122/97
gucuucggucgcggc

SEQ ID NO: 1040126 - RNA, 13 nt, Mycobacterium bovis subsp bovis AF2122/97
gucuucggcgaca

SEQ ID NO: 1040127 - RNA, 20 nt, Mycobacterium bovis subsp bovis AF2122/97
gucuucgucauggccggcca

SEQ ID NO: 1040128 - RNA, 18 nt, Mycobacterium bovis subsp bovis AF2122/97
gucuugacggcgccaggc

SEQ ID NO: 1040129 - RNA, 17 nt, Mycobacterium bovis subsp bovis AF2122/97
gucgucguccgacgggc

SEQ ID NO: 1040130 - RNA, 18 nt, Mycobacterium bovis subsp bovis AF2122/97
gucgucguagcuggcgau

SEQ ID NO: 1040131 - RNA, 18 nt, Mycobacterium bovis subsp bovis AF2122/97
gucgucuucuucgcggau

SEQ ID NO: 1040132 - RNA, 19 nt, Mycobacterium bovis subsp bovis AF2122/97
gucgucguugugugccagc

SEQ ID NO: 1040133 - RNA, 22 nt, Mycobacterium bovis subsp bovis AF2122/97
gucgucuucgucauggccggcc

SEQ ID NO: 1040134 - RNA, 22 nt, Mycobacterium bovis subsp bovis AF2122/97
gucgugagucacccggccguug

SEQ ID NO: 1040135 - RNA, 17 nt, Mycobacterium bovis subsp bovis AF2122/97
gucgugauacagcucgg

SEQ ID NO: 1040136 - RNA, 15 nt, Mycobacterium bovis subsp bovis AF2122/97
gucgugaucagcagg

SEQ ID NO: 1040137 - RNA, 15 nt, Mycobacterium bovis subsp bovis AF2122/97
gucgugaucgcguuu

SEQ ID NO: 1040138 - RNA, 14 nt, Mycobacterium bovis subsp bovis AF2122/97
gucgugaucggcgu

SEQ ID NO: 1040139 - RNA, 14 nt, Mycobacterium bovis subsp bovis AF2122/97
gucguggcuuccgg

SEQ ID NO: 1040140 - RNA, 15 nt, Mycobacterium bovis subsp bovis AF2122/97
gucgugggccaccac

SEQ ID NO: 1040141 - RNA, 16 nt, Mycobacterium bovis subsp bovis AF2122/97
gucguggggaccggca

SEQ ID NO: 1040142 - RNA, 14 nt, Mycobacterium bovis subsp bovis AF2122/97
gucguguaggaccu

SEQ ID NO: 1040143 - RNA, 21 nt, Mycobacterium bovis subsp bovis AF2122/97
gucguggucgauccacucggc

SEQ ID NO: 1040144 - RNA, 16 nt, Mycobacterium bovis subsp bovis AF2122/97
gucguggucgugggug

SEQ ID NO: 1040145 - RNA, 15 nt, Mycobacterium bovis subsp bovis AF2122/97
gucgugguggccacg

SEQ ID NO: 1040146 - RNA, 17 nt, Mycobacterium bovis subsp bovis AF2122/97
gucgugguggccacgga

SEQ ID NO: 1040147 - RNA, 15 nt, Mycobacterium bovis subsp bovis AF2122/97
gucucgacggcggcc

SEQ ID NO: 1040148 - RNA, 17 nt, Mycobacterium bovis subsp bovis AF2122/97
gucucgacggcggccgc

SEQ ID NO: 1040149 - RNA, 15 nt, Mycobacterium bovis subsp bovis AF2122/97
gucucgagggugaag

SEQ ID NO: 1040150 - RNA, 17 nt, Mycobacterium bovis subsp bovis AF2122/97
gucucgcaccgcguuga

SEQ ID NO: 1040151 - RNA, 21 nt, Mycobacterium bovis subsp bovis AF2122/97
gucucgcagcaacggcggcgu

SEQ ID NO: 1040152 - RNA, 16 nt, Mycobacterium bovis subsp bovis AF2122/97
gucucgcaugcucacg

SEQ ID NO: 1040153 - RNA, 17 nt, Mycobacterium bovis subsp bovis AF2122/97
gucucgccgaccuuggc

SEQ ID NO: 1040154 - RNA, 18 nt, Mycobacterium bovis subsp bovis AF2122/97
gucucgccguggauggcc

SEQ ID NO: 1040155 - RNA, 17 nt, Mycobacterium bovis subsp bovis AF2122/97
gucuccuugggcgacgc

SEQ ID NO: 1040156 - RNA, 18 nt, Mycobacterium bovis subsp bovis AF2122/97
gucucgaaagccgcggcc

SEQ ID NO: 1040157 - RNA, 20 nt, Mycobacterium bovis subsp bovis AF2122/97
gucucgaaagccgcggccga

SEQ ID NO: 1040158 - RNA, 18 nt, Mycobacterium bovis subsp bovis AF2122/97
gucuccucggucaccgag

SEQ ID NO: 1040159 - RNA, 20 nt, Mycobacterium bovis subsp bovis AF2122/97
gucguucgcgucacaccagc

SEQ ID NO: 1040160 - RNA, 21 nt, Mycobacterium bovis subsp bovis AF2122/97
gucguucgcgucacaccagcg

SEQ ID NO: 1040161 - RNA, 17 nt, Mycobacterium bovis subsp bovis AF2122/97
gucguuccgccgccucg

SEQ ID NO: 1040162 - RNA, 16 nt, Mycobacterium bovis subsp bovis AF2122/97
gucguguucgcugacg

SEQ ID NO: 1040163 - RNA, 19 nt, Mycobacterium bovis subsp bovis AF2122/97
gucguuaagacggcgacga

SEQ ID NO: 1040164 - RNA, 15 nt, Mycobacterium bovis subsp bovis AF2122/97
gucgugucgccgccg

SEQ ID NO: 1040165 - RNA, 15 nt, Mycobacterium bovis subsp bovis AF2122/97
gucguggcgguggcc

SEQ ID NO: 1040166 - RNA, 18 nt, Mycobacterium bovis subsp bovis AF2122/97
gucucgguggcugcgccg

SEQ ID NO: 1040167 - RNA, 20 nt, Mycobacterium bovis subsp bovis AF2122/97
gucucgguggcugcgccgga

SEQ ID NO: 1040168 - RNA, 17 nt, Mycobacterium bovis subsp bovis AF2122/97
gucucggggugcacgau

SEQ ID NO: 1040169 - RNA, 23 nt, Mycobacterium bovis subsp bovis AF2122/97
gucucgggguuguucggcagcca

SEQ ID NO: 1040170 - RNA, 15 nt, Mycobacterium bovis subsp bovis AF2122/97
gucucuaccacggag

SEQ ID NO: 1040171 - RNA, 13 nt, Mycobacterium bovis subsp bovis AF2122/97
gucugcucgccag

SEQ ID NO: 1040172 - RNA, 22 nt, Mycobacterium bovis subsp bovis AF2122/97
gucucgggcgcgggugaccagg

SEQ ID NO: 1040173 - RNA, 17 nt, Mycobacterium bovis subsp bovis AF2122/97
gucucggcgucgaccag

SEQ ID NO: 1040174 - RNA, 19 nt, Mycobacterium bovis subsp bovis AF2122/97
gucucggcgucgaccaguu

SEQ ID NO: 1040175 - RNA, 13 nt, Mycobacterium bovis subsp bovis AF2122/97
gucucggcgaccg

SEQ ID NO: 1040176 - RNA, 17 nt, Mycobacterium bovis subsp bovis AF2122/97
gucucggcgaccgacgc

SEQ ID NO: 1040177 - RNA, 15 nt, Mycobacterium bovis subsp bovis AF2122/97
gucucgcgcagccgg

SEQ ID NO: 1040178 - RNA, 14 nt, Mycobacterium bovis subsp bovis AF2122/97
gucucgcgcgauga

SEQ ID NO: 1040179 - RNA, 16 nt, Mycobacterium bovis subsp bovis AF2122/97
gucucgcggcccgaga

SEQ ID NO: 1040180 - RNA, 23 nt, Mycobacterium bovis subsp bovis AF2122/97
gucucgcggugcggcaacagcgc

SEQ ID NO: 1040181 - RNA, 17 nt, Mycobacterium bovis subsp bovis AF2122/97
gucucggaggcgaccac

SEQ ID NO: 1040182 - RNA, 21 nt, Mycobacterium bovis subsp bovis AF2122/97
gucucgcgagcguuucaccag

SEQ ID NO: 1040183 - RNA, 14 nt, Mycobacterium bovis subsp bovis AF2122/97
gucucgcgagguga

SEQ ID NO: 1040184 - RNA, 13 nt, Mycobacterium bovis subsp bovis AF2122/97
gucugcucggcgg

SEQ ID NO: 1040185 - RNA, 20 nt, Mycobacterium bovis subsp bovis AF2122/97
gucugcggucaucgccucgg

SEQ ID NO: 1040186 - RNA, 16 nt, Mycobacterium bovis subsp bovis AF2122/97
gucugcucgcgcccgc

SEQ ID NO: 1040187 - RNA, 16 nt, Mycobacterium bovis subsp bovis AF2122/97
gucugcucgccgggca

SEQ ID NO: 1040188 - RNA, 15 nt, Mycobacterium bovis subsp bovis AF2122/97
gucugcucgccagcg

SEQ ID NO: 1040189 - RNA, 14 nt, Mycobacterium bovis subsp bovis AF2122/97
gucugcucgccgag

SEQ ID NO: 1040190 - RNA, 15 nt, Mycobacterium bovis subsp bovis AF2122/97
gucugcucgccgagg

SEQ ID NO: 1040191 - RNA, 15 nt, Mycobacterium bovis subsp bovis AF2122/97
gucugcucggcggcc

SEQ ID NO: 1040192 - RNA, 17 nt, Mycobacterium bovis subsp bovis AF2122/97
gucugcugaucgagcgg

SEQ ID NO: 1040193 - RNA, 19 nt, Mycobacterium bovis subsp bovis AF2122/97
gucugcucggcgcgguggg

SEQ ID NO: 1040194 - RNA, 17 nt, Mycobacterium bovis subsp bovis AF2122/97
gucuggcgcggagcuga

SEQ ID NO: 1040195 - RNA, 15 nt, Mycobacterium bovis subsp bovis AF2122/97
gucuggacugcagcc

SEQ ID NO: 1040196 - RNA, 16 nt, Mycobacterium bovis subsp bovis AF2122/97
gucuggacaucggccg

SEQ ID NO: 1040197 - RNA, 19 nt, Mycobacterium bovis subsp bovis AF2122/97
gucuggaucagaucccgcc

SEQ ID NO: 1040198 - RNA, 12 nt, Mycobacterium bovis subsp bovis AF2122/97
gucuggccgucg

SEQ ID NO: 1040199 - RNA, 15 nt, Mycobacterium bovis subsp bovis AF2122/97
gucuggcgaacagug

SEQ ID NO: 1040200 - RNA, 22 nt, Mycobacterium bovis subsp bovis AF2122/97
gucgaacagcaccgccggcgac

SEQ ID NO: 1040201 - RNA, 17 nt, Mycobacterium bovis subsp bovis AF2122/97
gucgaacaggccggccg

SEQ ID NO: 1040202 - RNA, 16 nt, Mycobacterium bovis subsp bovis AF2122/97
gucgaacaugauccgc

SEQ ID NO: 1040203 - RNA, 21 nt, Mycobacterium bovis subsp bovis AF2122/97
gucgaaccugucgaucacggc

SEQ ID NO: 1040204 - RNA, 20 nt, Mycobacterium bovis subsp bovis AF2122/97
gucgaacgcaugcucgaucg

SEQ ID NO: 1040205 - RNA, 19 nt, Mycobacterium bovis subsp bovis AF2122/97
gucgaaccaguccucgggc

SEQ ID NO: 1040206 - RNA, 16 nt, Mycobacterium bovis subsp bovis AF2122/97
gucgaacccgcgagca

SEQ ID NO: 1040207 - RNA, 13 nt, Mycobacterium bovis subsp bovis AF2122/97
gucgaaccgccgg

SEQ ID NO: 1040208 - RNA, 19 nt, Mycobacterium bovis subsp bovis AF2122/97
gucgaaccgccggcugcgc

SEQ ID NO: 1040209 - RNA, 13 nt, Mycobacterium bovis subsp bovis AF2122/97
gucgaacgguagc

SEQ ID NO: 1040210 - RNA, 14 nt, Mycobacterium bovis subsp bovis AF2122/97
gucgaacugccgga

SEQ ID NO: 1040211 - RNA, 20 nt, Mycobacterium bovis subsp bovis AF2122/97
gucgaacgguagcacggucu

SEQ ID NO: 1040212 - RNA, 22 nt, Mycobacterium bovis subsp bovis AF2122/97
gucgaacuugaucaccgcguag

SEQ ID NO: 1040213 - RNA, 16 nt, Mycobacterium bovis subsp bovis AF2122/97
gucgaagaaccggccg

SEQ ID NO: 1040214 - RNA, 19 nt, Mycobacterium bovis subsp bovis AF2122/97
gucgaagaaccggccgacg

SEQ ID NO: 1040215 - RNA, 22 nt, Mycobacterium bovis subsp bovis AF2122/97
gucgaagaaccggccgacgaac

SEQ ID NO: 1040216 - RNA, 22 nt, Mycobacterium bovis subsp bovis AF2122/97
gucgaagacguuggcgcgguug

SEQ ID NO: 1040217 - RNA, 15 nt, Mycobacterium bovis subsp bovis AF2122/97
gucgaagagcaggcc

SEQ ID NO: 1040218 - RNA, 22 nt, Mycobacterium bovis subsp bovis AF2122/97
gucgaagaauaugccgaugacc

SEQ ID NO: 1040219 - RNA, 14 nt, Mycobacterium bovis subsp bovis AF2122/97
gucgaacgcgcgcg

SEQ ID NO: 1040220 - RNA, 22 nt, Mycobacterium bovis subsp bovis AF2122/97
gucgaagaccaagagcgcgcag

SEQ ID NO: 1040221 - RNA, 16 nt, Mycobacterium bovis subsp bovis AF2122/97
gucgaagauccagcgc

SEQ ID NO: 1040222 - RNA, 20 nt, Mycobacterium bovis subsp bovis AF2122/97
gucgaagcgauccggcugcg

SEQ ID NO: 1040223 - RNA, 17 nt, Mycobacterium bovis subsp bovis AF2122/97
gucgaagcggaccagcg

SEQ ID NO: 1040224 - RNA, 21 nt, Mycobacterium bovis subsp bovis AF2122/97
gucgaagggaucacgaccgcg

SEQ ID NO: 1040225 - RNA, 22 nt, Mycobacterium bovis subsp bovis AF2122/97
gucgaagggaucacgaccgcgc

SEQ ID NO: 1040226 - RNA, 13 nt, Mycobacterium bovis subsp bovis AF2122/97
gucgaaggugacc

SEQ ID NO: 1040227 - RNA, 17 nt, Mycobacterium bovis subsp bovis AF2122/97
gucgaaguagccgacgu

SEQ ID NO: 1040228 - RNA, 23 nt, Mycobacterium bovis subsp bovis AF2122/97
gucgaaguuggcgaagcccgaca

SEQ ID NO: 1040229 - RNA, 16 nt, Mycobacterium bovis subsp bovis AF2122/97
gucgaauccugccgca

SEQ ID NO: 1040230 - RNA, 14 nt, Mycobacterium bovis subsp bovis AF2122/97
gucgaaucgcugcc

SEQ ID NO: 1040231 - RNA, 22 nt, Mycobacterium bovis subsp bovis AF2122/97
gucgaaucgcugccgccgaucg

SEQ ID NO: 1040232 - RNA, 20 nt, Mycobacterium bovis subsp bovis AF2122/97
guccugcucgcacagcacca

SEQ ID NO: 1040233 - RNA, 13 nt, Mycobacterium bovis subsp bovis AF2122/97
guccugcucgcga

SEQ ID NO: 1040234 - RNA, 16 nt, Mycobacterium bovis subsp bovis AF2122/97
guccugcgggccguag

SEQ ID NO: 1040235 - RNA, 17 nt, Mycobacterium bovis subsp bovis AF2122/97
guccugcggguagguga

SEQ ID NO: 1040236 - RNA, 19 nt, Mycobacterium bovis subsp bovis AF2122/97
guccugccaaugcugcagg

SEQ ID NO: 1040237 - RNA, 20 nt, Mycobacterium bovis subsp bovis AF2122/97
guccuggcgaacucgcgcag

SEQ ID NO: 1040238 - RNA, 13 nt, Mycobacterium bovis subsp bovis AF2122/97
guccugggccgcc

SEQ ID NO: 1040239 - RNA, 14 nt, Mycobacterium bovis subsp bovis AF2122/97
guccugggccgccg

SEQ ID NO: 1040240 - RNA, 13 nt, Mycobacterium bovis subsp bovis AF2122/97
guccugcccgucg

SEQ ID NO: 1040241 - RNA, 21 nt, Mycobacterium bovis subsp bovis AF2122/97
guccuggaaccaaaccugggc

SEQ ID NO: 1040242 - RNA, 16 nt, Mycobacterium bovis subsp bovis AF2122/97
guccuuggccgccacu

SEQ ID NO: 1040243 - RNA, 14 nt, Mycobacterium bovis subsp bovis AF2122/97
guccuugggcgucg

SEQ ID NO: 1040244 - RNA, 16 nt, Mycobacterium bovis subsp bovis AF2122/97
guccuuguuggccagu

SEQ ID NO: 1040245 - RNA, 21 nt, Mycobacterium bovis subsp bovis AF2122/97
gucgaaaucggugcacaacgc

SEQ ID NO: 1040246 - RNA, 19 nt, Mycobacterium bovis subsp bovis AF2122/97
gucgaaauggauugcggca

SEQ ID NO: 1040247 - RNA, 20 nt, Mycobacterium bovis subsp bovis AF2122/97
gucgaaacgguacgccgccg

SEQ ID NO: 1040248 - RNA, 15 nt, Mycobacterium bovis subsp bovis AF2122/97
gucgaaaagccgugc

SEQ ID NO: 1040249 - RNA, 22 nt, Mycobacterium bovis subsp bovis AF2122/97
gucgaaaagccgugcaccagcg

SEQ ID NO: 1040250 - RNA, 23 nt, Mycobacterium bovis subsp bovis AF2122/97
guccuugaggauccgcaccacgc

SEQ ID NO: 1040251 - RNA, 15 nt, Mycobacterium bovis subsp bovis AF2122/97
guccucgaagaacug

SEQ ID NO: 1040252 - RNA, 22 nt, Mycobacterium bovis subsp bovis AF2122/97
guccucgaagaacuggugcuuc

SEQ ID NO: 1040253 - RNA, 20 nt, Mycobacterium bovis subsp bovis AF2122/97
guccucgagguccucgucgg

SEQ ID NO: 1040254 - RNA, 21 nt, Mycobacterium bovis subsp bovis AF2122/97
guccucgagguccucgucggc

SEQ ID NO: 1040255 - RNA, 17 nt, Mycobacterium bovis subsp bovis AF2122/97
guccucgagcaccgcga

SEQ ID NO: 1040256 - RNA, 13 nt, Mycobacterium bovis subsp bovis AF2122/97
guccucgaggucc

SEQ ID NO: 1040257 - RNA, 19 nt, Mycobacterium bovis subsp bovis AF2122/97
guccucgagguccucgucg

SEQ ID NO: 1040258 - RNA, 14 nt, Mycobacterium bovis subsp bovis AF2122/97
guccucgccgcacg

SEQ ID NO: 1040259 - RNA, 18 nt, Mycobacterium bovis subsp bovis AF2122/97
guccuccacggcgggaac

SEQ ID NO: 1040260 - RNA, 22 nt, Mycobacterium bovis subsp bovis AF2122/97
guccuccacuuuuccgccggcc

SEQ ID NO: 1040261 - RNA, 18 nt, Mycobacterium bovis subsp bovis AF2122/97
guccucaucgagcgcgcg

SEQ ID NO: 1040262 - RNA, 19 nt, Mycobacterium bovis subsp bovis AF2122/97
guccucaucgagcgcgcga

SEQ ID NO: 1040263 - RNA, 14 nt, Mycobacterium bovis subsp bovis AF2122/97
guccuauccgggcc

SEQ ID NO: 1040264 - RNA, 17 nt, Mycobacterium bovis subsp bovis AF2122/97
guccucgucggcgucga

SEQ ID NO: 1040265 - RNA, 17 nt, Mycobacterium bovis subsp bovis AF2122/97
guccucgucuucgucgg

SEQ ID NO: 1040266 - RNA, 15 nt, Mycobacterium bovis subsp bovis AF2122/97
guccucgucggcguc

SEQ ID NO: 1040267 - RNA, 21 nt, Mycobacterium bovis subsp bovis AF2122/97
guccucgggcaggcggccagc

SEQ ID NO: 1040268 - RNA, 18 nt, Mycobacterium bovis subsp bovis AF2122/97
guccucggcggacccggu

SEQ ID NO: 1040269 - RNA, 20 nt, Mycobacterium bovis subsp bovis AF2122/97
guccucggcggacccgguga

SEQ ID NO: 1040270 - RNA, 22 nt, Mycobacterium bovis subsp bovis AF2122/97
guccucgagguccucgucggcg

SEQ ID NO: 1040271 - RNA, 11 nt, Mycobacterium bovis subsp bovis AF2122/97
guccugcagga

SEQ ID NO: 1040272 - RNA, 15 nt, Mycobacterium bovis subsp bovis AF2122/97
guccugcagugcggc

SEQ ID NO: 1040273 - RNA, 16 nt, Mycobacterium bovis subsp bovis AF2122/97
guccugcagugcggcg

SEQ ID NO: 1040274 - RNA, 18 nt, Mycobacterium bovis subsp bovis AF2122/97
guccugaaucgguucggc

SEQ ID NO: 1040275 - RNA, 16 nt, Mycobacterium bovis subsp bovis AF2122/97
guccugaaaacaccgc

SEQ ID NO: 1040276 - RNA, 17 nt, Mycobacterium bovis subsp bovis AF2122/97
guccggcuuggcggcga

SEQ ID NO: 1040277 - RNA, 18 nt, Mycobacterium bovis subsp bovis AF2122/97
guccggcuuggcggcgau

SEQ ID NO: 1040278 - RNA, 17 nt, Mycobacterium bovis subsp bovis AF2122/97
guccggcuucggcgaac

SEQ ID NO: 1040279 - RNA, 19 nt, Mycobacterium bovis subsp bovis AF2122/97
guccggcuuaccggcgggc

SEQ ID NO: 1040280 - RNA, 21 nt, Mycobacterium bovis subsp bovis AF2122/97
guccggcucaugcgagucguc

SEQ ID NO: 1040281 - RNA, 19 nt, Mycobacterium bovis subsp bovis AF2122/97
guccggcguacgccguacc

SEQ ID NO: 1040282 - RNA, 20 nt, Mycobacterium bovis subsp bovis AF2122/97
guccggcggacccucgccga

SEQ ID NO: 1040283 - RNA, 13 nt, Mycobacterium bovis subsp bovis AF2122/97
guccggcgugggc

SEQ ID NO: 1040284 - RNA, 15 nt, Mycobacterium bovis subsp bovis AF2122/97
guccggguagcggcg

SEQ ID NO: 1040285 - RNA, 17 nt, Mycobacterium bovis subsp bovis AF2122/97
guccggguagcggcgcc

SEQ ID NO: 1040286 - RNA, 19 nt, Mycobacterium bovis subsp bovis AF2122/97
guccggggaaagccgcagc

SEQ ID NO: 1040287 - RNA, 15 nt, Mycobacterium bovis subsp bovis AF2122/97
guccggggccgcggc

SEQ ID NO: 1040288 - RNA, 17 nt, Mycobacterium bovis subsp bovis AF2122/97
guccggggccgcggccc

SEQ ID NO: 1040289 - RNA, 16 nt, Mycobacterium bovis subsp bovis AF2122/97
guccgggucaccagcg

SEQ ID NO: 1040290 - RNA, 17 nt, Mycobacterium bovis subsp bovis AF2122/97
guccgggucaccagcgc

SEQ ID NO: 1040291 - RNA, 18 nt, Mycobacterium bovis subsp bovis AF2122/97
guccggguagacaugggu

SEQ ID NO: 1040292 - RNA, 15 nt, Mycobacterium bovis subsp bovis AF2122/97
guccgggcagccgcg

SEQ ID NO: 1040293 - RNA, 19 nt, Mycobacterium bovis subsp bovis AF2122/97
guccgggccccacggcggg

SEQ ID NO: 1040294 - RNA, 20 nt, Mycobacterium bovis subsp bovis AF2122/97
guccgggcggccucccgggc

SEQ ID NO: 1040295 - RNA, 23 nt, Mycobacterium bovis subsp bovis AF2122/97
guccggguuuugcgcggccaccu

SEQ ID NO: 1040296 - RNA, 14 nt, Mycobacterium bovis subsp bovis AF2122/97
guccggucgcggcg

SEQ ID NO: 1040297 - RNA, 17 nt, Mycobacterium bovis subsp bovis AF2122/97
guccggucgcggcgguc

SEQ ID NO: 1040298 - RNA, 19 nt, Mycobacterium bovis subsp bovis AF2122/97
guccggucuuuguccgucg

SEQ ID NO: 1040299 - RNA, 15 nt, Mycobacterium bovis subsp bovis AF2122/97
guccggugauccaac

SEQ ID NO: 1040300 - RNA, 23 nt, Mycobacterium bovis subsp bovis AF2122/97
guccggugauccaacuggccgcg

SEQ ID NO: 1040301 - RNA, 21 nt, Mycobacterium bovis subsp bovis AF2122/97
guccgguggaauccaccagcc

SEQ ID NO: 1040302 - RNA, 15 nt, Mycobacterium bovis subsp bovis AF2122/97
guccgguggaccgcc

SEQ ID NO: 1040303 - RNA, 22 nt, Mycobacterium bovis subsp bovis AF2122/97
guccgguggaccgccgaucggc

SEQ ID NO: 1040304 - RNA, 16 nt, Mycobacterium bovis subsp bovis AF2122/97
guccgguuacgcucgc

SEQ ID NO: 1040305 - RNA, 21 nt, Mycobacterium bovis subsp bovis AF2122/97
guccgguuacuuuucgagugu

SEQ ID NO: 1040306 - RNA, 21 nt, Mycobacterium bovis subsp bovis AF2122/97
guccgguuagcggcgcgagca

SEQ ID NO: 1040307 - RNA, 17 nt, Mycobacterium bovis subsp bovis AF2122/97
guccguacuugccaccc

SEQ ID NO: 1040308 - RNA, 20 nt, Mycobacterium bovis subsp bovis AF2122/97
guccgucaccaccgccgcca

SEQ ID NO: 1040309 - RNA, 23 nt, Mycobacterium bovis subsp bovis AF2122/97
guccgucaccaccgccgccacca

SEQ ID NO: 1040310 - RNA, 14 nt, Mycobacterium bovis subsp bovis AF2122/97
guccgucgucggcg

SEQ ID NO: 1040311 - RNA, 16 nt, Mycobacterium bovis subsp bovis AF2122/97
guccgucgucggcguc

SEQ ID NO: 1040312 - RNA, 19 nt, Mycobacterium bovis subsp bovis AF2122/97
guccgucgagucgccgagg

SEQ ID NO: 1040313 - RNA, 20 nt, Mycobacterium bovis subsp bovis AF2122/97
guccgucgcgcgggcgagcg

SEQ ID NO: 1040314 - RNA, 17 nt, Mycobacterium bovis subsp bovis AF2122/97
guccgucggcgcucguc

SEQ ID NO: 1040315 - RNA, 15 nt, Mycobacterium bovis subsp bovis AF2122/97
guccguagcgcggcc

SEQ ID NO: 1040316 - RNA, 13 nt, Mycobacterium bovis subsp bovis AF2122/97
guccguccgcgac

SEQ ID NO: 1040317 - RNA, 17 nt, Mycobacterium bovis subsp bovis AF2122/97
guccgcgcucagcuccg

SEQ ID NO: 1040318 - RNA, 18 nt, Mycobacterium bovis subsp bovis AF2122/97
guccgcgcucagcuccgg

SEQ ID NO: 1040319 - RNA, 17 nt, Mycobacterium bovis subsp bovis AF2122/97
guccgcgggggaccgcc

SEQ ID NO: 1040320 - RNA, 18 nt, Mycobacterium bovis subsp bovis AF2122/97
guccgcugagcgggcaac

SEQ ID NO: 1040321 - RNA, 20 nt, Mycobacterium bovis subsp bovis AF2122/97
guccgcugccaucggcacca

SEQ ID NO: 1040322 - RNA, 21 nt, Mycobacterium bovis subsp bovis AF2122/97
guccgcucaccuuuggccgcg

SEQ ID NO: 1040323 - RNA, 13 nt, Mycobacterium bovis subsp bovis AF2122/97
guccggaaccaac

SEQ ID NO: 1040324 - RNA, 14 nt, Mycobacterium bovis subsp bovis AF2122/97
guccggacggcagc

SEQ ID NO: 1040325 - RNA, 21 nt, Mycobacterium bovis subsp bovis AF2122/97
guccggcaacaugagcgucgc

SEQ ID NO: 1040326 - RNA, 19 nt, Mycobacterium bovis subsp bovis AF2122/97
guccggcacugcggccagu

SEQ ID NO: 1040327 - RNA, 17 nt, Mycobacterium bovis subsp bovis AF2122/97
guccggccacgguccgg

SEQ ID NO: 1040328 - RNA, 23 nt, Mycobacterium bovis subsp bovis AF2122/97
guccggcccccgaggcuggcauc

SEQ ID NO: 1040329 - RNA, 16 nt, Mycobacterium bovis subsp bovis AF2122/97
guccggccgacccgga

SEQ ID NO: 1040330 - RNA, 17 nt, Mycobacterium bovis subsp bovis AF2122/97
guccggcccguagcugc

SEQ ID NO: 1040331 - RNA, 14 nt, Mycobacterium bovis subsp bovis AF2122/97
guccggcgccgagg

SEQ ID NO: 1040332 - RNA, 17 nt, Mycobacterium bovis subsp bovis AF2122/97
guccggcgccgaggucg

SEQ ID NO: 1040333 - RNA, 12 nt, Mycobacterium bovis subsp bovis AF2122/97
guccggcgccga

SEQ ID NO: 1040334 - RNA, 15 nt, Mycobacterium bovis subsp bovis AF2122/97
guccggcggcaggaa

SEQ ID NO: 1040335 - RNA, 19 nt, Mycobacterium bovis subsp bovis AF2122/97
guccggcggacccucgccg

SEQ ID NO: 1040336 - RNA, 23 nt, Mycobacterium bovis subsp bovis AF2122/97
guccggcgcccacaucgucggcg

SEQ ID NO: 1040337 - RNA, 20 nt, Mycobacterium bovis subsp bovis AF2122/97
guccggcgcccacaucgucg

SEQ ID NO: 1040338 - RNA, 21 nt, Mycobacterium bovis subsp bovis AF2122/97
guccggcgaaaagacugcgcc

SEQ ID NO: 1040339 - RNA, 19 nt, Mycobacterium bovis subsp bovis AF2122/97
guccggcccuacgcagcgc

SEQ ID NO: 1040340 - RNA, 17 nt, Mycobacterium bovis subsp bovis AF2122/97
guccgcgccgacggcca

SEQ ID NO: 1040341 - RNA, 22 nt, Mycobacterium bovis subsp bovis AF2122/97
guccgcgccgacggccagcagg

SEQ ID NO: 1040342 - RNA, 13 nt, Mycobacterium bovis subsp bovis AF2122/97
guccgcgccgagc

SEQ ID NO: 1040343 - RNA, 22 nt, Mycobacterium bovis subsp bovis AF2122/97
guccgcgaagugcuugggccgc

SEQ ID NO: 1040344 - RNA, 12 nt, Mycobacterium bovis subsp bovis AF2122/97
guccgcgccgac

SEQ ID NO: 1040345 - RNA, 15 nt, Mycobacterium bovis subsp bovis AF2122/97
guccgcgccgacggc

SEQ ID NO: 1040346 - RNA, 12 nt, Mycobacterium bovis subsp bovis AF2122/97
guccgccggcga

SEQ ID NO: 1040347 - RNA, 13 nt, Mycobacterium bovis subsp bovis AF2122/97
guccgccggcgag

SEQ ID NO: 1040348 - RNA, 16 nt, Mycobacterium bovis subsp bovis AF2122/97
guccgccgggccccgg

SEQ ID NO: 1040349 - RNA, 15 nt, Mycobacterium bovis subsp bovis AF2122/97
guccgccguaugccg

SEQ ID NO: 1040350 - RNA, 16 nt, Mycobacterium bovis subsp bovis AF2122/97
guccgccgucgaccac

SEQ ID NO: 1040351 - RNA, 22 nt, Mycobacterium bovis subsp bovis AF2122/97
guccgcgaacgauuucggccca

SEQ ID NO: 1040352 - RNA, 19 nt, Mycobacterium bovis subsp bovis AF2122/97
guccgccugcaccgccgcc

SEQ ID NO: 1040353 - RNA, 15 nt, Mycobacterium bovis subsp bovis AF2122/97
gucccggaccaucgc

SEQ ID NO: 1040354 - RNA, 22 nt, Mycobacterium bovis subsp bovis AF2122/97
gucccgcgugccacucgaugcu

SEQ ID NO: 1040355 - RNA, 15 nt, Mycobacterium bovis subsp bovis AF2122/97
gucccucaucaccuc

SEQ ID NO: 1040356 - RNA, 16 nt, Mycobacterium bovis subsp bovis AF2122/97
guccgaaagccgccga

SEQ ID NO: 1040357 - RNA, 18 nt, Mycobacterium bovis subsp bovis AF2122/97
guccgaaagccgccgaga

SEQ ID NO: 1040358 - RNA, 16 nt, Mycobacterium bovis subsp bovis AF2122/97
guccgaacacggugaa

SEQ ID NO: 1040359 - RNA, 18 nt, Mycobacterium bovis subsp bovis AF2122/97
gucccugugucgccgucg

SEQ ID NO: 1040360 - RNA, 22 nt, Mycobacterium bovis subsp bovis AF2122/97
guccgccauugucgaucuggua

SEQ ID NO: 1040361 - RNA, 14 nt, Mycobacterium bovis subsp bovis AF2122/97
guccgaaccgacgu

SEQ ID NO: 1040362 - RNA, 19 nt, Mycobacterium bovis subsp bovis AF2122/97
guccgaaccaccuguccgg

SEQ ID NO: 1040363 - RNA, 18 nt, Mycobacterium bovis subsp bovis AF2122/97
guccgaaccgacguuccc

SEQ ID NO: 1040364 - RNA, 19 nt, Mycobacterium bovis subsp bovis AF2122/97
guccgaacuugacgaacuc

SEQ ID NO: 1040365 - RNA, 16 nt, Mycobacterium bovis subsp bovis AF2122/97
guccgcccagccgcag

SEQ ID NO: 1040366 - RNA, 22 nt, Mycobacterium bovis subsp bovis AF2122/97
guccgccccguugugucaccgg

SEQ ID NO: 1040367 - RNA, 17 nt, Mycobacterium bovis subsp bovis AF2122/97
guccgccgcagaccugc

SEQ ID NO: 1040368 - RNA, 18 nt, Mycobacterium bovis subsp bovis AF2122/97
guccgccgcagacgccga

SEQ ID NO: 1040369 - RNA, 19 nt, Mycobacterium bovis subsp bovis AF2122/97
guccaucacauccacgcac

SEQ ID NO: 1040370 - RNA, 16 nt, Mycobacterium bovis subsp bovis AF2122/97
guccaucgccaccgcg

SEQ ID NO: 1040371 - RNA, 21 nt, Mycobacterium bovis subsp bovis AF2122/97
gucccccuguggacacggcgc

SEQ ID NO: 1040372 - RNA, 15 nt, Mycobacterium bovis subsp bovis AF2122/97
guccaucgcgcggcu

SEQ ID NO: 1040373 - RNA, 24 nt, Mycobacterium bovis subsp bovis AF2122/97
guccaucgcgcggcugugcccgau

SEQ ID NO: 1040374 - RNA, 22 nt, Mycobacterium bovis subsp bovis AF2122/97
guccccgccgucgccaccaucg

SEQ ID NO: 1040375 - RNA, 12 nt, Mycobacterium bovis subsp bovis AF2122/97
guccccgccgac

SEQ ID NO: 1040376 - RNA, 15 nt, Mycobacterium bovis subsp bovis AF2122/97
guccccgccgacgcc

SEQ ID NO: 1040377 - RNA, 16 nt, Mycobacterium bovis subsp bovis AF2122/97
guccccgccgacgccg

SEQ ID NO: 1040378 - RNA, 18 nt, Mycobacterium bovis subsp bovis AF2122/97
guccccgccgacgccgau

SEQ ID NO: 1040379 - RNA, 19 nt, Mycobacterium bovis subsp bovis AF2122/97
guccccgccgacgccgaua

SEQ ID NO: 1040380 - RNA, 15 nt, Mycobacterium bovis subsp bovis AF2122/97
guccauagccggcau

SEQ ID NO: 1040381 - RNA, 23 nt, Mycobacterium bovis subsp bovis AF2122/97
guccagguucuucuccaccaccg

SEQ ID NO: 1040382 - RNA, 15 nt, Mycobacterium bovis subsp bovis AF2122/97
guccaguccguccag

SEQ ID NO: 1040383 - RNA, 22 nt, Mycobacterium bovis subsp bovis AF2122/97
guccccggucaggacggcaccc

SEQ ID NO: 1040384 - RNA, 23 nt, Mycobacterium bovis subsp bovis AF2122/97
guccccgucgcuggccggcaccg

SEQ ID NO: 1040385 - RNA, 17 nt, Mycobacterium bovis subsp bovis AF2122/97
guccccucccaccagcg

SEQ ID NO: 1040386 - RNA, 18 nt, Mycobacterium bovis subsp bovis AF2122/97
gucccgaguggccggugg

SEQ ID NO: 1040387 - RNA, 13 nt, Mycobacterium bovis subsp bovis AF2122/97
gucccgauggcga

SEQ ID NO: 1040388 - RNA, 13 nt, Mycobacterium bovis subsp bovis AF2122/97
gucccgauggcgg

SEQ ID NO: 1040389 - RNA, 18 nt, Mycobacterium bovis subsp bovis AF2122/97
gucccgaugguggccgcg

SEQ ID NO: 1040390 - RNA, 17 nt, Mycobacterium bovis subsp bovis AF2122/97
gucccgcucuggucguc

SEQ ID NO: 1040391 - RNA, 17 nt, Mycobacterium bovis subsp bovis AF2122/97
gucccgcggaccgcaac

SEQ ID NO: 1040392 - RNA, 15 nt, Mycobacterium bovis subsp bovis AF2122/97
gucccgccggccccg

SEQ ID NO: 1040393 - RNA, 21 nt, Mycobacterium bovis subsp bovis AF2122/97
gucccgcgagcagcccggcga

SEQ ID NO: 1040394 - RNA, 17 nt, Mycobacterium bovis subsp bovis AF2122/97
gucccgcggcgcggaga

SEQ ID NO: 1040395 - RNA, 17 nt, Mycobacterium bovis subsp bovis AF2122/97
gucccgccgcgcgucgc

SEQ ID NO: 1040396 - RNA, 12 nt, Mycobacterium bovis subsp bovis AF2122/97
gucccgaucacc

SEQ ID NO: 1040397 - RNA, 22 nt, Mycobacterium bovis subsp bovis AF2122/97
gucccgcauaccuaacgagccg

SEQ ID NO: 1040398 - RNA, 18 nt, Mycobacterium bovis subsp bovis AF2122/97
gucagcaccuccaccgcg

SEQ ID NO: 1040399 - RNA, 19 nt, Mycobacterium bovis subsp bovis AF2122/97
gucagcaccuccaccgcgc

SEQ ID NO: 1040400 - RNA, 20 nt, Mycobacterium bovis subsp bovis AF2122/97
gucagcaccuccaccgcgcc

SEQ ID NO: 1040401 - RNA, 22 nt, Mycobacterium bovis subsp bovis AF2122/97
gucagcaccuccaccgcgccgg

SEQ ID NO: 1040402 - RNA, 15 nt, Mycobacterium bovis subsp bovis AF2122/97
gucagcaccggcgcg

SEQ ID NO: 1040403 - RNA, 21 nt, Mycobacterium bovis subsp bovis AF2122/97
gucagcacccaacccggcggc

SEQ ID NO: 1040404 - RNA, 23 nt, Mycobacterium bovis subsp bovis AF2122/97
gucagcacccaacccggcggcag

SEQ ID NO: 1040405 - RNA, 23 nt, Mycobacterium bovis subsp bovis AF2122/97
gucagcacaugguccaaccagca

SEQ ID NO: 1040406 - RNA, 16 nt, Mycobacterium bovis subsp bovis AF2122/97
gucagcaagaucggca

SEQ ID NO: 1040407 - RNA, 18 nt, Mycobacterium bovis subsp bovis AF2122/97
gucagcaauacggcggcg

SEQ ID NO: 1040408 - RNA, 17 nt, Mycobacterium bovis subsp bovis AF2122/97
gucagcacaaacccagu

SEQ ID NO: 1040409 - RNA, 22 nt, Mycobacterium bovis subsp bovis AF2122/97
guccaggaauuccccaccgucg

SEQ ID NO: 1040410 - RNA, 13 nt, Mycobacterium bovis subsp bovis AF2122/97
guccaggccggca

SEQ ID NO: 1040411 - RNA, 20 nt, Mycobacterium bovis subsp bovis AF2122/97
guccaggcacuccagcggcg

SEQ ID NO: 1040412 - RNA, 22 nt, Mycobacterium bovis subsp bovis AF2122/97
gucagcacgacgacaaccggcc

SEQ ID NO: 1040413 - RNA, 18 nt, Mycobacterium bovis subsp bovis AF2122/97
gucacggcgugaccacug

SEQ ID NO: 1040414 - RNA, 23 nt, Mycobacterium bovis subsp bovis AF2122/97
gucacgccggauggucggccacg

SEQ ID NO: 1040415 - RNA, 15 nt, Mycobacterium bovis subsp bovis AF2122/97
gucacggucguggug

SEQ ID NO: 1040416 - RNA, 21 nt, Mycobacterium bovis subsp bovis AF2122/97
gucacgcguuccauggcccgc

SEQ ID NO: 1040417 - RNA, 22 nt, Mycobacterium bovis subsp bovis AF2122/97
gucacggacccuuccgccgccg

SEQ ID NO: 1040418 - RNA, 14 nt, Mycobacterium bovis subsp bovis AF2122/97
gucacggaccugga

SEQ ID NO: 1040419 - RNA, 20 nt, Mycobacterium bovis subsp bovis AF2122/97
gucacgcugugcgguaucgg

SEQ ID NO: 1040420 - RNA, 20 nt, Mycobacterium bovis subsp bovis AF2122/97
gucacgcggguugcgcggcu

SEQ ID NO: 1040421 - RNA, 16 nt, Mycobacterium bovis subsp bovis AF2122/97
gucacgccugccaccg

SEQ ID NO: 1040422 - RNA, 15 nt, Mycobacterium bovis subsp bovis AF2122/97
gucacgucgacggcg

SEQ ID NO: 1040423 - RNA, 16 nt, Mycobacterium bovis subsp bovis AF2122/97
gucagacgacgaugau

SEQ ID NO: 1040424 - RNA, 22 nt, Mycobacterium bovis subsp bovis AF2122/97
gucagaucguuaugaccucgac

SEQ ID NO: 1040425 - RNA, 15 nt, Mycobacterium bovis subsp bovis AF2122/97
gucgacccggccagg

SEQ ID NO: 1040426 - RNA, 18 nt, Mycobacterium bovis subsp bovis AF2122/97
gucgacccccugccacag

SEQ ID NO: 1040427 - RNA, 19 nt, Mycobacterium bovis subsp bovis AF2122/97
gucgacccccugccacagc

SEQ ID NO: 1040428 - RNA, 15 nt, Mycobacterium bovis subsp bovis AF2122/97
gucgaccccggccag

SEQ ID NO: 1040429 - RNA, 15 nt, Mycobacterium bovis subsp bovis AF2122/97
gucgacccagcugac

SEQ ID NO: 1040430 - RNA, 19 nt, Mycobacterium bovis subsp bovis AF2122/97
gucgaccaggacgguuggu

SEQ ID NO: 1040431 - RNA, 21 nt, Mycobacterium bovis subsp bovis AF2122/97
gucgaccaugagccggcgccg

SEQ ID NO: 1040432 - RNA, 17 nt, Mycobacterium bovis subsp bovis AF2122/97
gucgaccgaacccgacg

SEQ ID NO: 1040433 - RNA, 21 nt, Mycobacterium bovis subsp bovis AF2122/97
gucgaccgaacccgacgucgc

SEQ ID NO: 1040434 - RNA, 13 nt, Mycobacterium bovis subsp bovis AF2122/97
gucgaccgcggcc

SEQ ID NO: 1040435 - RNA, 14 nt, Mycobacterium bovis subsp bovis AF2122/97
gucgaccgcggccc

SEQ ID NO: 1040436 - RNA, 22 nt, Mycobacterium bovis subsp bovis AF2122/97
gucgaccgcggcccggacgucg

SEQ ID NO: 1040437 - RNA, 13 nt, Mycobacterium bovis subsp bovis AF2122/97
gucgaccgccgag

SEQ ID NO: 1040438 - RNA, 13 nt, Mycobacterium bovis subsp bovis AF2122/97
gucgaccggcggg

SEQ ID NO: 1040439 - RNA, 23 nt, Mycobacterium bovis subsp bovis AF2122/97
gucgaccgggaacaggguggugg

SEQ ID NO: 1040440 - RNA, 20 nt, Mycobacterium bovis subsp bovis AF2122/97
gucgaccggcccccggucga

SEQ ID NO: 1040441 - RNA, 15 nt, Mycobacterium bovis subsp bovis AF2122/97
gucgacacgccgaac

SEQ ID NO: 1040442 - RNA, 23 nt, Mycobacterium bovis subsp bovis AF2122/97
gucgacaguucaacgggccuucg

SEQ ID NO: 1040443 - RNA, 20 nt, Mycobacterium bovis subsp bovis AF2122/97
gucgacaguuuucaccgcga

SEQ ID NO: 1040444 - RNA, 16 nt, Mycobacterium bovis subsp bovis AF2122/97
gucgacagcgaaggcg

SEQ ID NO: 1040445 - RNA, 21 nt, Mycobacterium bovis subsp bovis AF2122/97
gucgacagcgaaggcgccgaa

SEQ ID NO: 1040446 - RNA, 19 nt, Mycobacterium bovis subsp bovis AF2122/97
gucgacagucaacagggcc

SEQ ID NO: 1040447 - RNA, 17 nt, Mycobacterium bovis subsp bovis AF2122/97
gucgacaguucaacggg

SEQ ID NO: 1040448 - RNA, 15 nt, Mycobacterium bovis subsp bovis AF2122/97
gucgacacggugauc

SEQ ID NO: 1040449 - RNA, 12 nt, Mycobacterium bovis subsp bovis AF2122/97
gucgacaccgcg

SEQ ID NO: 1040450 - RNA, 22 nt, Mycobacterium bovis subsp bovis AF2122/97
gucgacaccgcggacccgcagc

SEQ ID NO: 1040451 - RNA, 23 nt, Mycobacterium bovis subsp bovis AF2122/97
gucgacaacaaacccggccucgg

SEQ ID NO: 1040452 - RNA, 23 nt, Mycobacterium bovis subsp bovis AF2122/97
gucgacaacacgccgucgaccgg

SEQ ID NO: 1040453 - RNA, 17 nt, Mycobacterium bovis subsp bovis AF2122/97
gucgacaaccgcugccg

SEQ ID NO: 1040454 - RNA, 21 nt, Mycobacterium bovis subsp bovis AF2122/97
gucgacaaucaguagcagcgg

SEQ ID NO: 1040455 - RNA, 19 nt, Mycobacterium bovis subsp bovis AF2122/97
gucgacaaacagcgccauc

SEQ ID NO: 1040456 - RNA, 23 nt, Mycobacterium bovis subsp bovis AF2122/97
gucgaccacgacguucgacgaca

SEQ ID NO: 1040457 - RNA, 20 nt, Mycobacterium bovis subsp bovis AF2122/97
gucgaccaauaccaguccgu

SEQ ID NO: 1040458 - RNA, 20 nt, Mycobacterium bovis subsp bovis AF2122/97
gucgacaucggugacgguca

SEQ ID NO: 1040459 - RNA, 20 nt, Mycobacterium bovis subsp bovis AF2122/97
gucgaccaagguguccagca

SEQ ID NO: 1040460 - RNA, 18 nt, Mycobacterium bovis subsp bovis AF2122/97
gucgacauaggccaccuc

SEQ ID NO: 1040461 - RNA, 15 nt, Mycobacterium bovis subsp bovis AF2122/97
gucgacaucggugac

SEQ ID NO: 1040462 - RNA, 21 nt, Mycobacterium bovis subsp bovis AF2122/97
gucgacgaacaccccgggcgc

SEQ ID NO: 1040463 - RNA, 16 nt, Mycobacterium bovis subsp bovis AF2122/97
gucgacgagcaccgcg

SEQ ID NO: 1040464 - RNA, 22 nt, Mycobacterium bovis subsp bovis AF2122/97
gucgacgaauaacgcggucggc

SEQ ID NO: 1040465 - RNA, 14 nt, Mycobacterium bovis subsp bovis AF2122/97
gucgacgacaacga

SEQ ID NO: 1040466 - RNA, 17 nt, Mycobacterium bovis subsp bovis AF2122/97
gucgacgacgucgcgca

SEQ ID NO: 1040467 - RNA, 17 nt, Mycobacterium bovis subsp bovis AF2122/97
gucgacgacaacgaugu

SEQ ID NO: 1040468 - RNA, 19 nt, Mycobacterium bovis subsp bovis AF2122/97
gucgacgaugucggcacca

SEQ ID NO: 1040469 - RNA, 18 nt, Mycobacterium bovis subsp bovis AF2122/97
gucgaccgugcgucgaug

SEQ ID NO: 1040470 - RNA, 19 nt, Mycobacterium bovis subsp bovis AF2122/97
gucgacgaucucgccggcg

SEQ ID NO: 1040471 - RNA, 17 nt, Mycobacterium bovis subsp bovis AF2122/97
gucgacgcccgauacgc

SEQ ID NO: 1040472 - RNA, 12 nt, Mycobacterium bovis subsp bovis AF2122/97
gucgacgccgac

SEQ ID NO: 1040473 - RNA, 17 nt, Mycobacterium bovis subsp bovis AF2122/97
gucgacgccgagaccgc

SEQ ID NO: 1040474 - RNA, 21 nt, Mycobacterium bovis subsp bovis AF2122/97
gucgacgccggccagcggcca

SEQ ID NO: 1040475 - RNA, 18 nt, Mycobacterium bovis subsp bovis AF2122/97
gucgacgccgcagcgucc

SEQ ID NO: 1040476 - RNA, 15 nt, Mycobacterium bovis subsp bovis AF2122/97
gucgacugcgugccg

SEQ ID NO: 1040477 - RNA, 23 nt, Mycobacterium bovis subsp bovis AF2122/97
gucgacuggccguuucggcgccg

SEQ ID NO: 1040478 - RNA, 17 nt, Mycobacterium bovis subsp bovis AF2122/97
gucgacugggacgacgc

SEQ ID NO: 1040479 - RNA, 21 nt, Mycobacterium bovis subsp bovis AF2122/97
gucgacucguggcgccacggc

SEQ ID NO: 1040480 - RNA, 17 nt, Mycobacterium bovis subsp bovis AF2122/97
gucgacucguggcgcca

SEQ ID NO: 1040481 - RNA, 14 nt, Mycobacterium bovis subsp bovis AF2122/97
gucgacuccagcac

SEQ ID NO: 1040482 - RNA, 15 nt, Mycobacterium bovis subsp bovis AF2122/97
gucgacuccagcacc

SEQ ID NO: 1040483 - RNA, 19 nt, Mycobacterium bovis subsp bovis AF2122/97
gucgacuccagcaccagca

SEQ ID NO: 1040484 - RNA, 22 nt, Mycobacterium bovis subsp bovis AF2122/97
gucgacguucgguggcgaugcg

SEQ ID NO: 1040485 - RNA, 23 nt, Mycobacterium bovis subsp bovis AF2122/97
gucgacguuggcaaagccgaaau

SEQ ID NO: 1040486 - RNA, 22 nt, Mycobacterium bovis subsp bovis AF2122/97
gucgagacgcuuuccgccgcac

SEQ ID NO: 1040487 - RNA, 20 nt, Mycobacterium bovis subsp bovis AF2122/97
gucgagagguucgccgucgg

SEQ ID NO: 1040488 - RNA, 18 nt, Mycobacterium bovis subsp bovis AF2122/97
gucgagauagucggccgg

SEQ ID NO: 1040489 - RNA, 20 nt, Mycobacterium bovis subsp bovis AF2122/97
gucgagauagucggccggcg

SEQ ID NO: 1040490 - RNA, 21 nt, Mycobacterium bovis subsp bovis AF2122/97
gucgagauagucggccggcgg

SEQ ID NO: 1040491 - RNA, 16 nt, Mycobacterium bovis subsp bovis AF2122/97
gucgagaaucggcauu

SEQ ID NO: 1040492 - RNA, 18 nt, Mycobacterium bovis subsp bovis AF2122/97
gucgacuguugucuacuc

SEQ ID NO: 1040493 - RNA, 18 nt, Mycobacterium bovis subsp bovis AF2122/97
gucgacuucagcggccgg

SEQ ID NO: 1040494 - RNA, 18 nt, Mycobacterium bovis subsp bovis AF2122/97
gucgacuugugacggucg

SEQ ID NO: 1040495 - RNA, 23 nt, Mycobacterium bovis subsp bovis AF2122/97
gucgaggucuuucgaugaugggc

SEQ ID NO: 1040496 - RNA, 15 nt, Mycobacterium bovis subsp bovis AF2122/97
gucgaggucggcgau

SEQ ID NO: 1040497 - RNA, 16 nt, Mycobacterium bovis subsp bovis AF2122/97
gucgaggucggcgauc

SEQ ID NO: 1040498 - RNA, 15 nt, Mycobacterium bovis subsp bovis AF2122/97
gucgagguggcgggc

SEQ ID NO: 1040499 - RNA, 14 nt, Mycobacterium bovis subsp bovis AF2122/97
gucgaggucggcga

SEQ ID NO: 1040500 - RNA, 18 nt, Mycobacterium bovis subsp bovis AF2122/97
gucgagguacacgccgag

SEQ ID NO: 1040501 - RNA, 22 nt, Mycobacterium bovis subsp bovis AF2122/97
gucgagguacacgccgaggucu

SEQ ID NO: 1040502 - RNA, 16 nt, Mycobacterium bovis subsp bovis AF2122/97
gucgaggucacgcgag

SEQ ID NO: 1040503 - RNA, 19 nt, Mycobacterium bovis subsp bovis AF2122/97
gucgaggucacgcgaggcg

SEQ ID NO: 1040504 - RNA, 20 nt, Mycobacterium bovis subsp bovis AF2122/97
gucgagguccucgagguccu

SEQ ID NO: 1040505 - RNA, 21 nt, Mycobacterium bovis subsp bovis AF2122/97
gucgagggcuuuagugucugc

SEQ ID NO: 1040506 - RNA, 16 nt, Mycobacterium bovis subsp bovis AF2122/97
gucgagauccucgucg

SEQ ID NO: 1040507 - RNA, 17 nt, Mycobacterium bovis subsp bovis AF2122/97
gucgagauccucgucga

SEQ ID NO: 1040508 - RNA, 23 nt, Mycobacterium bovis subsp bovis AF2122/97
gucgagauccucgucgagguccu

SEQ ID NO: 1040509 - RNA, 18 nt, Mycobacterium bovis subsp bovis AF2122/97
gucgagcaccacccgggc

SEQ ID NO: 1040510 - RNA, 19 nt, Mycobacterium bovis subsp bovis AF2122/97
gucgagcacaccgucgucg

SEQ ID NO: 1040511 - RNA, 17 nt, Mycobacterium bovis subsp bovis AF2122/97
gucgagugccucgaccu

SEQ ID NO: 1040512 - RNA, 16 nt, Mycobacterium bovis subsp bovis AF2122/97
gucgaguccacagcgc

SEQ ID NO: 1040513 - RNA, 17 nt, Mycobacterium bovis subsp bovis AF2122/97
gucgaguccacagcgca

SEQ ID NO: 1040514 - RNA, 18 nt, Mycobacterium bovis subsp bovis AF2122/97
gucgaguccaggccggca

SEQ ID NO: 1040515 - RNA, 19 nt, Mycobacterium bovis subsp bovis AF2122/97
gucgaguccaggccggcag

SEQ ID NO: 1040516 - RNA, 20 nt, Mycobacterium bovis subsp bovis AF2122/97
gucgagguuuuucgaugggu

SEQ ID NO: 1040517 - RNA, 16 nt, Mycobacterium bovis subsp bovis AF2122/97
gucgaguagccguagc

SEQ ID NO: 1040518 - RNA, 21 nt, Mycobacterium bovis subsp bovis AF2122/97
gucgaguagccguagccgccg

SEQ ID NO: 1040519 - RNA, 22 nt, Mycobacterium bovis subsp bovis AF2122/97
gucgaguagccguagccgccgu

SEQ ID NO: 1040520 - RNA, 13 nt, Mycobacterium bovis subsp bovis AF2122/97
gucgaguucgguu

SEQ ID NO: 1040521 - RNA, 22 nt, Mycobacterium bovis subsp bovis AF2122/97
gucgaguccgacggggaugggg

SEQ ID NO: 1040522 - RNA, 22 nt, Mycobacterium bovis subsp bovis AF2122/97
gucgauaaugaucucggcaagg

SEQ ID NO: 1040523 - RNA, 18 nt, Mycobacterium bovis subsp bovis AF2122/97
gucgaucaccugcagcac

SEQ ID NO: 1040524 - RNA, 19 nt, Mycobacterium bovis subsp bovis AF2122/97
gucgaucaacaccaacgac

SEQ ID NO: 1040525 - RNA, 18 nt, Mycobacterium bovis subsp bovis AF2122/97
gucgauagcccgccaccc

SEQ ID NO: 1040526 - RNA, 21 nt, Mycobacterium bovis subsp bovis AF2122/97
gucgaucacguacgccgccga

SEQ ID NO: 1040527 - RNA, 14 nt, Mycobacterium bovis subsp bovis AF2122/97
gucgaucacgucgu

SEQ ID NO: 1040528 - RNA, 22 nt, Mycobacterium bovis subsp bovis AF2122/97
gucgaucagaacgugacggucc

SEQ ID NO: 1040529 - RNA, 22 nt, Mycobacterium bovis subsp bovis AF2122/97
gucgaucaacaacagccgcagc

SEQ ID NO: 1040530 - RNA, 23 nt, Mycobacterium bovis subsp bovis AF2122/97
gucgaucaacaacagccgcagcc

SEQ ID NO: 1040531 - RNA, 17 nt, Mycobacterium bovis subsp bovis AF2122/97
gucgaucaacaccaacg

SEQ ID NO: 1040532 - RNA, 17 nt, Mycobacterium bovis subsp bovis AF2122/97
gucgaucagccgcaucu

SEQ ID NO: 1040533 - RNA, 13 nt, Mycobacterium bovis subsp bovis AF2122/97
gucgaucagcgcg

SEQ ID NO: 1040534 - RNA, 14 nt, Mycobacterium bovis subsp bovis AF2122/97
gucgaucaccgaca

SEQ ID NO: 1040535 - RNA, 16 nt, Mycobacterium bovis subsp bovis AF2122/97
gucgaucagcgcgacg

SEQ ID NO: 1040536 - RNA, 22 nt, Mycobacterium bovis subsp bovis AF2122/97
gucgaucagcuugggcagcagc

SEQ ID NO: 1040537 - RNA, 23 nt, Mycobacterium bovis subsp bovis AF2122/97
gucgaucagcuugggcagcagcg

SEQ ID NO: 1040538 - RNA, 16 nt, Mycobacterium bovis subsp bovis AF2122/97
gucgaucagcggcagc

SEQ ID NO: 1040539 - RNA, 14 nt, Mycobacterium bovis subsp bovis AF2122/97
gucgaucaggccgu

SEQ ID NO: 1040540 - RNA, 15 nt, Mycobacterium bovis subsp bovis AF2122/97
gucgaucaggccgug

SEQ ID NO: 1040541 - RNA, 20 nt, Mycobacterium bovis subsp bovis AF2122/97
gucgaugcgcugcucacgca

SEQ ID NO: 1040542 - RNA, 13 nt, Mycobacterium bovis subsp bovis AF2122/97
gucgaugcgcagc

SEQ ID NO: 1040543 - RNA, 21 nt, Mycobacterium bovis subsp bovis AF2122/97
gucgaugcugaacacgcagcc

SEQ ID NO: 1040544 - RNA, 17 nt, Mycobacterium bovis subsp bovis AF2122/97
gucgaugcugacggugg

SEQ ID NO: 1040545 - RNA, 22 nt, Mycobacterium bovis subsp bovis AF2122/97
gucgauguacaccgugcgccga

SEQ ID NO: 1040546 - RNA, 23 nt, Mycobacterium bovis subsp bovis AF2122/97
gucgauggucuccggacgcacga

SEQ ID NO: 1040547 - RNA, 13 nt, Mycobacterium bovis subsp bovis AF2122/97
gucgauggcgucg

SEQ ID NO: 1040548 - RNA, 17 nt, Mycobacterium bovis subsp bovis AF2122/97
gucgaugucgacgucgc

SEQ ID NO: 1040549 - RNA, 19 nt, Mycobacterium bovis subsp bovis AF2122/97
gucgauguccgcagcaccg

SEQ ID NO: 1040550 - RNA, 14 nt, Mycobacterium bovis subsp bovis AF2122/97
gucgauguucgccg

SEQ ID NO: 1040551 - RNA, 19 nt, Mycobacterium bovis subsp bovis AF2122/97
gucgauguugcccagcaug

SEQ ID NO: 1040552 - RNA, 20 nt, Mycobacterium bovis subsp bovis AF2122/97
gucgcaggauucccagucgc

SEQ ID NO: 1040553 - RNA, 22 nt, Mycobacterium bovis subsp bovis AF2122/97
gucgcaggauucccagucgcgg

SEQ ID NO: 1040554 - RNA, 17 nt, Mycobacterium bovis subsp bovis AF2122/97
gucgaugucguuggcca

SEQ ID NO: 1040555 - RNA, 18 nt, Mycobacterium bovis subsp bovis AF2122/97
gucgaugucgucgacauc

SEQ ID NO: 1040556 - RNA, 13 nt, Mycobacterium bovis subsp bovis AF2122/97
gucgccaccgaug

SEQ ID NO: 1040557 - RNA, 16 nt, Mycobacterium bovis subsp bovis AF2122/97
gucgccaccgauggcg

SEQ ID NO: 1040558 - RNA, 21 nt, Mycobacterium bovis subsp bovis AF2122/97
gucgccaacgccagcaccagc

SEQ ID NO: 1040559 - RNA, 16 nt, Mycobacterium bovis subsp bovis AF2122/97
gucgccacacccgcga

SEQ ID NO: 1040560 - RNA, 22 nt, Mycobacterium bovis subsp bovis AF2122/97
gucgccacaccggggcggccga

SEQ ID NO: 1040561 - RNA, 23 nt, Mycobacterium bovis subsp bovis AF2122/97
gucgccacaccggggcggccgac

SEQ ID NO: 1040562 - RNA, 13 nt, Mycobacterium bovis subsp bovis AF2122/97
gucgccaccaucg

SEQ ID NO: 1040563 - RNA, 17 nt, Mycobacterium bovis subsp bovis AF2122/97
gucgccaaucgaguagc

SEQ ID NO: 1040564 - RNA, 15 nt, Mycobacterium bovis subsp bovis AF2122/97
gucgccaacgccagc

SEQ ID NO: 1040565 - RNA, 17 nt, Mycobacterium bovis subsp bovis AF2122/97
gucgcauggcggcuggu

SEQ ID NO: 1040566 - RNA, 15 nt, Mycobacterium bovis subsp bovis AF2122/97
gucgccagcucggca

SEQ ID NO: 1040567 - RNA, 18 nt, Mycobacterium bovis subsp bovis AF2122/97
gucgccagcucggcaccc

SEQ ID NO: 1040568 - RNA, 17 nt, Mycobacterium bovis subsp bovis AF2122/97
gucgcccuuagggucgc

SEQ ID NO: 1040569 - RNA, 20 nt, Mycobacterium bovis subsp bovis AF2122/97
gucgccgaaagggucgacgu

SEQ ID NO: 1040570 - RNA, 24 nt, Mycobacterium bovis subsp bovis AF2122/97
gucgcccgugucguaccagccaug

SEQ ID NO: 1040571 - RNA, 18 nt, Mycobacterium bovis subsp bovis AF2122/97
gucgccacgaugccggcu

SEQ ID NO: 1040572 - RNA, 18 nt, Mycobacterium bovis subsp bovis AF2122/97
gucgccaccgccggcagc

SEQ ID NO: 1040573 - RNA, 18 nt, Mycobacterium bovis subsp bovis AF2122/97
gucgccaccaucguugcc

SEQ ID NO: 1040574 - RNA, 13 nt, Mycobacterium bovis subsp bovis AF2122/97
gucgccaccggua

SEQ ID NO: 1040575 - RNA, 15 nt, Mycobacterium bovis subsp bovis AF2122/97
gucgccaccgguacc

SEQ ID NO: 1040576 - RNA, 15 nt, Mycobacterium bovis subsp bovis AF2122/97
gucgccacgcccagc

SEQ ID NO: 1040577 - RNA, 15 nt, Mycobacterium bovis subsp bovis AF2122/97
gucgccgccaccagg

SEQ ID NO: 1040578 - RNA, 15 nt, Mycobacterium bovis subsp bovis AF2122/97
gucgccgccgcuacc

SEQ ID NO: 1040579 - RNA, 20 nt, Mycobacterium bovis subsp bovis AF2122/97
gucgccgccgcuaccgccgg

SEQ ID NO: 1040580 - RNA, 20 nt, Mycobacterium bovis subsp bovis AF2122/97
gucgccgcccuggccgccgg

SEQ ID NO: 1040581 - RNA, 16 nt, Mycobacterium bovis subsp bovis AF2122/97
gucgccgcaucggcgg

SEQ ID NO: 1040582 - RNA, 18 nt, Mycobacterium bovis subsp bovis AF2122/97
gucgccgaacgccaccac

SEQ ID NO: 1040583 - RNA, 14 nt, Mycobacterium bovis subsp bovis AF2122/97
gucgccgaacaccg

SEQ ID NO: 1040584 - RNA, 17 nt, Mycobacterium bovis subsp bovis AF2122/97
gucgccgaacagcgacg

SEQ ID NO: 1040585 - RNA, 19 nt, Mycobacterium bovis subsp bovis AF2122/97
gucgccgaauggcugggcu

SEQ ID NO: 1040586 - RNA, 21 nt, Mycobacterium bovis subsp bovis AF2122/97
gucgccgaaguuccagccgac

SEQ ID NO: 1040587 - RNA, 19 nt, Mycobacterium bovis subsp bovis AF2122/97
gucgccuuugagggcgacg

SEQ ID NO: 1040588 - RNA, 22 nt, Mycobacterium bovis subsp bovis AF2122/97
gucgccuucuucgcggcggucg

SEQ ID NO: 1040589 - RNA, 17 nt, Mycobacterium bovis subsp bovis AF2122/97
gucgccugcgggaacgc

SEQ ID NO: 1040590 - RNA, 22 nt, Mycobacterium bovis subsp bovis AF2122/97
gucgcgaccuugcccgcuagcg

SEQ ID NO: 1040591 - RNA, 22 nt, Mycobacterium bovis subsp bovis AF2122/97
gucgcgaggcucggucggcagc

SEQ ID NO: 1040592 - RNA, 14 nt, Mycobacterium bovis subsp bovis AF2122/97
gucgcgacgucggc

SEQ ID NO: 1040593 - RNA, 21 nt, Mycobacterium bovis subsp bovis AF2122/97
gucgcgauccacuccggcgau

SEQ ID NO: 1040594 - RNA, 13 nt, Mycobacterium bovis subsp bovis AF2122/97
gucgccgcccgug

SEQ ID NO: 1040595 - RNA, 16 nt, Mycobacterium bovis subsp bovis AF2122/97
gucgccgcccgugccg

SEQ ID NO: 1040596 - RNA, 18 nt, Mycobacterium bovis subsp bovis AF2122/97
gucgccgcccgugccgcc

SEQ ID NO: 1040597 - RNA, 12 nt, Mycobacterium bovis subsp bovis AF2122/97
gucgccgccggc

SEQ ID NO: 1040598 - RNA, 16 nt, Mycobacterium bovis subsp bovis AF2122/97
gucgccgccggcgccg

SEQ ID NO: 1040599 - RNA, 16 nt, Mycobacterium bovis subsp bovis AF2122/97
gucgccggcaccggcc

SEQ ID NO: 1040600 - RNA, 15 nt, Mycobacterium bovis subsp bovis AF2122/97
gucgccggcauacac

SEQ ID NO: 1040601 - RNA, 13 nt, Mycobacterium bovis subsp bovis AF2122/97
gucgccgccgguc

SEQ ID NO: 1040602 - RNA, 14 nt, Mycobacterium bovis subsp bovis AF2122/97
gucgccgccggucc

SEQ ID NO: 1040603 - RNA, 13 nt, Mycobacterium bovis subsp bovis AF2122/97
gucgccggccggc

SEQ ID NO: 1040604 - RNA, 12 nt, Mycobacterium bovis subsp bovis AF2122/97
gucgccggccac

SEQ ID NO: 1040605 - RNA, 16 nt, Mycobacterium bovis subsp bovis AF2122/97
gucgccggccccgccg

SEQ ID NO: 1040606 - RNA, 22 nt, Mycobacterium bovis subsp bovis AF2122/97
gucgccugcccccgcgcgcacg

SEQ ID NO: 1040607 - RNA, 19 nt, Mycobacterium bovis subsp bovis AF2122/97
gucgccggucaggccgccg

SEQ ID NO: 1040608 - RNA, 23 nt, Mycobacterium bovis subsp bovis AF2122/97
gucgccggucaggccgccgcggc

SEQ ID NO: 1040609 - RNA, 22 nt, Mycobacterium bovis subsp bovis AF2122/97
gucgccucgcuaacuccccaga

SEQ ID NO: 1040610 - RNA, 22 nt, Mycobacterium bovis subsp bovis AF2122/97
gucgccgggcaguuuggcggca

SEQ ID NO: 1040611 - RNA, 14 nt, Mycobacterium bovis subsp bovis AF2122/97
gucgccggcggcgg

SEQ ID NO: 1040612 - RNA, 19 nt, Mycobacterium bovis subsp bovis AF2122/97
gucgcggcuauggcgccgc

SEQ ID NO: 1040613 - RNA, 15 nt, Mycobacterium bovis subsp bovis AF2122/97
gucgcggcguucggc

SEQ ID NO: 1040614 - RNA, 19 nt, Mycobacterium bovis subsp bovis AF2122/97
gucgcgcgcuaggugcaac

SEQ ID NO: 1040615 - RNA, 16 nt, Mycobacterium bovis subsp bovis AF2122/97
gucgcgcggcaccgau

SEQ ID NO: 1040616 - RNA, 16 nt, Mycobacterium bovis subsp bovis AF2122/97
gucgcggcguucggcu

SEQ ID NO: 1040617 - RNA, 15 nt, Mycobacterium bovis subsp bovis AF2122/97
gucgcgggccaccac

SEQ ID NO: 1040618 - RNA, 18 nt, Mycobacterium bovis subsp bovis AF2122/97
gucgcgggccaccaccga

SEQ ID NO: 1040619 - RNA, 21 nt, Mycobacterium bovis subsp bovis AF2122/97
gucgcgggccaccaccgagua

SEQ ID NO: 1040620 - RNA, 22 nt, Mycobacterium bovis subsp bovis AF2122/97
gucgcgggugaugacgccgucg

SEQ ID NO: 1040621 - RNA, 13 nt, Mycobacterium bovis subsp bovis AF2122/97
gucgcgggugccg

SEQ ID NO: 1040622 - RNA, 20 nt, Mycobacterium bovis subsp bovis AF2122/97
gucgcgggucacaaaaccug

SEQ ID NO: 1040623 - RNA, 18 nt, Mycobacterium bovis subsp bovis AF2122/97
gucgcggguccaggcguu

SEQ ID NO: 1040624 - RNA, 15 nt, Mycobacterium bovis subsp bovis AF2122/97
gucgcgccugcccgg

SEQ ID NO: 1040625 - RNA, 13 nt, Mycobacterium bovis subsp bovis AF2122/97
gucgcgcgcggca

SEQ ID NO: 1040626 - RNA, 17 nt, Mycobacterium bovis subsp bovis AF2122/97
gucgcgcaccggaucgc

SEQ ID NO: 1040627 - RNA, 17 nt, Mycobacterium bovis subsp bovis AF2122/97
gucgcugccgccgccgg

SEQ ID NO: 1040628 - RNA, 16 nt, Mycobacterium bovis subsp bovis AF2122/97
gucgcugccgccgucg

SEQ ID NO: 1040629 - RNA, 17 nt, Mycobacterium bovis subsp bovis AF2122/97
gucgcugccgccgucgc

SEQ ID NO: 1040630 - RNA, 21 nt, Mycobacterium bovis subsp bovis AF2122/97
gucgcugcggcgcuggccagc

SEQ ID NO: 1040631 - RNA, 18 nt, Mycobacterium bovis subsp bovis AF2122/97
gucgcugccggcugacga

SEQ ID NO: 1040632 - RNA, 14 nt, Mycobacterium bovis subsp bovis AF2122/97
gucgcugcuugcgg

SEQ ID NO: 1040633 - RNA, 19 nt, Mycobacterium bovis subsp bovis AF2122/97
gucggaccagcugccggcg

SEQ ID NO: 1040634 - RNA, 19 nt, Mycobacterium bovis subsp bovis AF2122/97
gucggaccguuucgucggc

SEQ ID NO: 1040635 - RNA, 20 nt, Mycobacterium bovis subsp bovis AF2122/97
gucggaccguuucgucggcc

SEQ ID NO: 1040636 - RNA, 17 nt, Mycobacterium bovis subsp bovis AF2122/97
gucggaccucgcccaug

SEQ ID NO: 1040637 - RNA, 14 nt, Mycobacterium bovis subsp bovis AF2122/97
gucggaccuuccgg

SEQ ID NO: 1040638 - RNA, 14 nt, Mycobacterium bovis subsp bovis AF2122/97
gucgcuggccggca

SEQ ID NO: 1040639 - RNA, 15 nt, Mycobacterium bovis subsp bovis AF2122/97
gucggagaacgcccg

SEQ ID NO: 1040640 - RNA, 21 nt, Mycobacterium bovis subsp bovis AF2122/97
gucggacggccaucgccagcc

SEQ ID NO: 1040641 - RNA, 16 nt, Mycobacterium bovis subsp bovis AF2122/97
gucgcugggugcgcga

SEQ ID NO: 1040642 - RNA, 17 nt, Mycobacterium bovis subsp bovis AF2122/97
gucgcugggugcgcgaa

SEQ ID NO: 1040643 - RNA, 15 nt, Mycobacterium bovis subsp bovis AF2122/97
gucgcuaucgugcgc

SEQ ID NO: 1040644 - RNA, 17 nt, Mycobacterium bovis subsp bovis AF2122/97
gucgcuaucgugcgccg

SEQ ID NO: 1040645 - RNA, 23 nt, Mycobacterium bovis subsp bovis AF2122/97
gucgcggucccacggccggccgc

SEQ ID NO: 1040646 - RNA, 15 nt, Mycobacterium bovis subsp bovis AF2122/97
gucgcgguaggcggg

SEQ ID NO: 1040647 - RNA, 18 nt, Mycobacterium bovis subsp bovis AF2122/97
gucgcguucuccggcacc

SEQ ID NO: 1040648 - RNA, 22 nt, Mycobacterium bovis subsp bovis AF2122/97
gucgcggucuuugagccgguag

SEQ ID NO: 1040649 - RNA, 17 nt, Mycobacterium bovis subsp bovis AF2122/97
gucgcguuguggcugaa

SEQ ID NO: 1040650 - RNA, 15 nt, Mycobacterium bovis subsp bovis AF2122/97
cggugaucgcggugg

SEQ ID NO: 1040651 - RNA, 20 nt, Mycobacterium bovis subsp bovis AF2122/97
cggugaucgcgguggcggug

SEQ ID NO: 1040652 - RNA, 13 nt, Mycobacterium bovis subsp bovis AF2122/97
cggugaucggcgg

SEQ ID NO: 1040653 - RNA, 13 nt, Mycobacterium bovis subsp bovis AF2122/97
cggugaucgggca

SEQ ID NO: 1040654 - RNA, 18 nt, Mycobacterium bovis subsp bovis AF2122/97
cggugaugaggaucgcgu

SEQ ID NO: 1040655 - RNA, 18 nt, Mycobacterium bovis subsp bovis AF2122/97
cggugaugagucaggcgc

SEQ ID NO: 1040656 - RNA, 20 nt, Mycobacterium bovis subsp bovis AF2122/97
cggugaucuuguccgggccc

SEQ ID NO: 1040657 - RNA, 17 nt, Mycobacterium bovis subsp bovis AF2122/97
cggugaugcccagcgcc

SEQ ID NO: 1040658 - RNA, 18 nt, Mycobacterium bovis subsp bovis AF2122/97
cggugaugcccagcgccg

SEQ ID NO: 1040659 - RNA, 19 nt, Mycobacterium bovis subsp bovis AF2122/97
cggugaugcccagcgccga

SEQ ID NO: 1040660 - RNA, 20 nt, Mycobacterium bovis subsp bovis AF2122/97
cggugauggacugaucgcga

SEQ ID NO: 1040661 - RNA, 21 nt, Mycobacterium bovis subsp bovis AF2122/97
cggugauggacugaucgcgau

SEQ ID NO: 1040662 - RNA, 16 nt, Mycobacterium bovis subsp bovis AF2122/97
cggugauggagccggu

SEQ ID NO: 1040663 - RNA, 17 nt, Mycobacterium bovis subsp bovis AF2122/97
cggugauggagccggug

SEQ ID NO: 1040664 - RNA, 21 nt, Mycobacterium bovis subsp bovis AF2122/97
cggugauggagccggugacgg

SEQ ID NO: 1040665 - RNA, 23 nt, Mycobacterium bovis subsp bovis AF2122/97
cggugauggagccggugacggug

SEQ ID NO: 1040666 - RNA, 20 nt, Mycobacterium bovis subsp bovis AF2122/97
cggugauggucagcuggccg

SEQ ID NO: 1040667 - RNA, 15 nt, Mycobacterium bovis subsp bovis AF2122/97
cggugauggugacca

SEQ ID NO: 1040668 - RNA, 20 nt, Mycobacterium bovis subsp bovis AF2122/97
cggugauggugaccagcagg

SEQ ID NO: 1040669 - RNA, 18 nt, Mycobacterium bovis subsp bovis AF2122/97
cggugaugggggagccgg

SEQ ID NO: 1040670 - RNA, 19 nt, Mycobacterium bovis subsp bovis AF2122/97
cggugaugggggagccggu

SEQ ID NO: 1040671 - RNA, 13 nt, Mycobacterium bovis subsp bovis AF2122/97
cggugaugggggu

SEQ ID NO: 1040672 - RNA, 18 nt, Mycobacterium bovis subsp bovis AF2122/97
cggugaucaccgacaccg

SEQ ID NO: 1040673 - RNA, 15 nt, Mycobacterium bovis subsp bovis AF2122/97
cggugaucaccgcgg

SEQ ID NO: 1040674 - RNA, 19 nt, Mycobacterium bovis subsp bovis AF2122/97
cggugaucacggucggcgg

SEQ ID NO: 1040675 - RNA, 16 nt, Mycobacterium bovis subsp bovis AF2122/97
cggugaucaccaugau

SEQ ID NO: 1040676 - RNA, 21 nt, Mycobacterium bovis subsp bovis AF2122/97
cggugaucagguaagcgaacg

SEQ ID NO: 1040677 - RNA, 14 nt, Mycobacterium bovis subsp bovis AF2122/97
cggugaucagccac

SEQ ID NO: 1040678 - RNA, 18 nt, Mycobacterium bovis subsp bovis AF2122/97
cggugaucagccaccggg

SEQ ID NO: 1040679 - RNA, 22 nt, Mycobacterium bovis subsp bovis AF2122/97
cggugaucgaacugggggccgg

SEQ ID NO: 1040680 - RNA, 23 nt, Mycobacterium bovis subsp bovis AF2122/97
cggugaucgaacugggggccggc

SEQ ID NO: 1040681 - RNA, 18 nt, Mycobacterium bovis subsp bovis AF2122/97
cggugaggaagcggccgg

SEQ ID NO: 1040682 - RNA, 18 nt, Mycobacterium bovis subsp bovis AF2122/97
cggugauccaacuggccg

SEQ ID NO: 1040683 - RNA, 20 nt, Mycobacterium bovis subsp bovis AF2122/97
cggugauccaacuggccgcg

SEQ ID NO: 1040684 - RNA, 23 nt, Mycobacterium bovis subsp bovis AF2122/97
cggugagggguugcggucgacgu

SEQ ID NO: 1040685 - RNA, 17 nt, Mycobacterium bovis subsp bovis AF2122/97
cggugaggaagcggccg

SEQ ID NO: 1040686 - RNA, 22 nt, Mycobacterium bovis subsp bovis AF2122/97
cggugagguauucguggucggc

SEQ ID NO: 1040687 - RNA, 15 nt, Mycobacterium bovis subsp bovis AF2122/97
cggugagguccucgg

SEQ ID NO: 1040688 - RNA, 16 nt, Mycobacterium bovis subsp bovis AF2122/97
cggugaccguggcggg

SEQ ID NO: 1040689 - RNA, 14 nt, Mycobacterium bovis subsp bovis AF2122/97
cggugaccggcucg

SEQ ID NO: 1040690 - RNA, 18 nt, Mycobacterium bovis subsp bovis AF2122/97
cggugacgauugccacca

SEQ ID NO: 1040691 - RNA, 16 nt, Mycobacterium bovis subsp bovis AF2122/97
cggugacgagccacca

SEQ ID NO: 1040692 - RNA, 21 nt, Mycobacterium bovis subsp bovis AF2122/97
cggugacgagccaccaccgcc

SEQ ID NO: 1040693 - RNA, 22 nt, Mycobacterium bovis subsp bovis AF2122/97
cggugacgagccaccaccgccg

SEQ ID NO: 1040694 - RNA, 22 nt, Mycobacterium bovis subsp bovis AF2122/97
cggugaccuucgcuauggcggc

SEQ ID NO: 1040695 - RNA, 22 nt, Mycobacterium bovis subsp bovis AF2122/97
cggucagcacaugguccaacca

SEQ ID NO: 1040696 - RNA, 21 nt, Mycobacterium bovis subsp bovis AF2122/97
cggugacgacgucgccgccgc

SEQ ID NO: 1040697 - RNA, 23 nt, Mycobacterium bovis subsp bovis AF2122/97
cggugacgacgucgccgccgcgg

SEQ ID NO: 1040698 - RNA, 18 nt, Mycobacterium bovis subsp bovis AF2122/97
cggugacgagcacaugcu

SEQ ID NO: 1040699 - RNA, 23 nt, Mycobacterium bovis subsp bovis AF2122/97
cggugacggccggcggucgggcc

SEQ ID NO: 1040700 - RNA, 15 nt, Mycobacterium bovis subsp bovis AF2122/97
cggugacggcggcaa

SEQ ID NO: 1040701 - RNA, 22 nt, Mycobacterium bovis subsp bovis AF2122/97
cggugacggcggcugucggccg

SEQ ID NO: 1040702 - RNA, 17 nt, Mycobacterium bovis subsp bovis AF2122/97
cggugacgaugaccgcg

SEQ ID NO: 1040703 - RNA, 22 nt, Mycobacterium bovis subsp bovis AF2122/97
cggugacgcacagcagcaccgc

SEQ ID NO: 1040704 - RNA, 23 nt, Mycobacterium bovis subsp bovis AF2122/97
cggugacgcacagcagcaccgcg

SEQ ID NO: 1040705 - RNA, 22 nt, Mycobacterium bovis subsp bovis AF2122/97
cggugagccggaugaugucggu

SEQ ID NO: 1040706 - RNA, 23 nt, Mycobacterium bovis subsp bovis AF2122/97
cggugagccggaugaugucgguc

SEQ ID NO: 1040707 - RNA, 14 nt, Mycobacterium bovis subsp bovis AF2122/97
cggugagccgggcg

SEQ ID NO: 1040708 - RNA, 17 nt, Mycobacterium bovis subsp bovis AF2122/97
cggugagccgggcggcc

SEQ ID NO: 1040709 - RNA, 23 nt, Mycobacterium bovis subsp bovis AF2122/97
cggugagccgguggcccgccggc

SEQ ID NO: 1040710 - RNA, 16 nt, Mycobacterium bovis subsp bovis AF2122/97
cggugagccgugccgc

SEQ ID NO: 1040711 - RNA, 17 nt, Mycobacterium bovis subsp bovis AF2122/97
cggugagccgugccgcc

SEQ ID NO: 1040712 - RNA, 18 nt, Mycobacterium bovis subsp bovis AF2122/97
cggugagccgugccgcca

SEQ ID NO: 1040713 - RNA, 13 nt, Mycobacterium bovis subsp bovis AF2122/97
cggugagcgagcg

SEQ ID NO: 1040714 - RNA, 17 nt, Mycobacterium bovis subsp bovis AF2122/97
cggugagcgcgucgcgg

SEQ ID NO: 1040715 - RNA, 15 nt, Mycobacterium bovis subsp bovis AF2122/97
cggugagauggcggu

SEQ ID NO: 1040716 - RNA, 15 nt, Mycobacterium bovis subsp bovis AF2122/97
cggugagaucggguu

SEQ ID NO: 1040717 - RNA, 16 nt, Mycobacterium bovis subsp bovis AF2122/97
cggugacucggccucc

SEQ ID NO: 1040718 - RNA, 17 nt, Mycobacterium bovis subsp bovis AF2122/97
cggugagaagaagccca

SEQ ID NO: 1040719 - RNA, 20 nt, Mycobacterium bovis subsp bovis AF2122/97
cggugacgggguugaccgcc

SEQ ID NO: 1040720 - RNA, 22 nt, Mycobacterium bovis subsp bovis AF2122/97
cggugacgggguugaccgccac

SEQ ID NO: 1040721 - RNA, 23 nt, Mycobacterium bovis subsp bovis AF2122/97
cggugacgggguugaccgccacc

SEQ ID NO: 1040722 - RNA, 15 nt, Mycobacterium bovis subsp bovis AF2122/97
cggugacggugccgg

SEQ ID NO: 1040723 - RNA, 13 nt, Mycobacterium bovis subsp bovis AF2122/97
cggugacgguguu

SEQ ID NO: 1040724 - RNA, 23 nt, Mycobacterium bovis subsp bovis AF2122/97
cggugacggggcugaccgccacc

SEQ ID NO: 1040725 - RNA, 19 nt, Mycobacterium bovis subsp bovis AF2122/97
cggugacgggguugaccgc

SEQ ID NO: 1040726 - RNA, 12 nt, Mycobacterium bovis subsp bovis AF2122/97
cggugacguaga

SEQ ID NO: 1040727 - RNA, 15 nt, Mycobacterium bovis subsp bovis AF2122/97
cggugacguagacgg

SEQ ID NO: 1040728 - RNA, 13 nt, Mycobacterium bovis subsp bovis AF2122/97
cggugccgaucgg

SEQ ID NO: 1040729 - RNA, 16 nt, Mycobacterium bovis subsp bovis AF2122/97
cggugccgaugaccga

SEQ ID NO: 1040730 - RNA, 13 nt, Mycobacterium bovis subsp bovis AF2122/97
cggugccgcccga

SEQ ID NO: 1040731 - RNA, 22 nt, Mycobacterium bovis subsp bovis AF2122/97
cggugccgccaucgccgccggu

SEQ ID NO: 1040732 - RNA, 13 nt, Mycobacterium bovis subsp bovis AF2122/97
cggugccgccauu

SEQ ID NO: 1040733 - RNA, 21 nt, Mycobacterium bovis subsp bovis AF2122/97
cggugccgccauugacgccgu

SEQ ID NO: 1040734 - RNA, 16 nt, Mycobacterium bovis subsp bovis AF2122/97
cggugccgcccgagcc

SEQ ID NO: 1040735 - RNA, 18 nt, Mycobacterium bovis subsp bovis AF2122/97
cggugccgcccgcgccgc

SEQ ID NO: 1040736 - RNA, 20 nt, Mycobacterium bovis subsp bovis AF2122/97
cggugccgcccgcgccgccg

SEQ ID NO: 1040737 - RNA, 21 nt, Mycobacterium bovis subsp bovis AF2122/97
cggugccgcccgcgccgccgc

SEQ ID NO: 1040738 - RNA, 22 nt, Mycobacterium bovis subsp bovis AF2122/97
cggugccgcccgcgccuccguu

SEQ ID NO: 1040739 - RNA, 12 nt, Mycobacterium bovis subsp bovis AF2122/97
cggugccgccgc

SEQ ID NO: 1040740 - RNA, 16 nt, Mycobacterium bovis subsp bovis AF2122/97
cggugccgccgccggc

SEQ ID NO: 1040741 - RNA, 16 nt, Mycobacterium bovis subsp bovis AF2122/97
cggugccgccgccugc

SEQ ID NO: 1040742 - RNA, 13 nt, Mycobacterium bovis subsp bovis AF2122/97
cggugccgccgcg

SEQ ID NO: 1040743 - RNA, 16 nt, Mycobacterium bovis subsp bovis AF2122/97
cggugccgccgcggcc

SEQ ID NO: 1040744 - RNA, 12 nt, Mycobacterium bovis subsp bovis AF2122/97
cggugccgccgg

SEQ ID NO: 1040745 - RNA, 13 nt, Mycobacterium bovis subsp bovis AF2122/97
cggugccgcggcu

SEQ ID NO: 1040746 - RNA, 15 nt, Mycobacterium bovis subsp bovis AF2122/97
cggugccgcgguagg

SEQ ID NO: 1040747 - RNA, 19 nt, Mycobacterium bovis subsp bovis AF2122/97
cggugccgccggugccgcc

SEQ ID NO: 1040748 - RNA, 15 nt, Mycobacterium bovis subsp bovis AF2122/97
cggugccgccgucga

SEQ ID NO: 1040749 - RNA, 22 nt, Mycobacterium bovis subsp bovis AF2122/97
cggugccgccguucccaccacc

SEQ ID NO: 1040750 - RNA, 20 nt, Mycobacterium bovis subsp bovis AF2122/97
cggugccgccuccgccugcc

SEQ ID NO: 1040751 - RNA, 12 nt, Mycobacterium bovis subsp bovis AF2122/97
cggugccgccgu

SEQ ID NO: 1040752 - RNA, 13 nt, Mycobacterium bovis subsp bovis AF2122/97
cggugccgccgau

SEQ ID NO: 1040753 - RNA, 20 nt, Mycobacterium bovis subsp bovis AF2122/97
cggugccgccgauaccgccg

SEQ ID NO: 1040754 - RNA, 21 nt, Mycobacterium bovis subsp bovis AF2122/97
cggugccgccgauaccgccgg

SEQ ID NO: 1040755 - RNA, 17 nt, Mycobacterium bovis subsp bovis AF2122/97
cggugccgccaucgccg

SEQ ID NO: 1040756 - RNA, 14 nt, Mycobacterium bovis subsp bovis AF2122/97
cggugccgagcacu

SEQ ID NO: 1040757 - RNA, 13 nt, Mycobacterium bovis subsp bovis AF2122/97
cggugccgaccgc

SEQ ID NO: 1040758 - RNA, 15 nt, Mycobacterium bovis subsp bovis AF2122/97
cggugccgacgguga

SEQ ID NO: 1040759 - RNA, 22 nt, Mycobacterium bovis subsp bovis AF2122/97
cggugccgacggugauggggga

SEQ ID NO: 1040760 - RNA, 16 nt, Mycobacterium bovis subsp bovis AF2122/97
cggugccgacggcgcc

SEQ ID NO: 1040761 - RNA, 13 nt, Mycobacterium bovis subsp bovis AF2122/97
cggugccgacggu

SEQ ID NO: 1040762 - RNA, 12 nt, Mycobacterium bovis subsp bovis AF2122/97
cggugccgacga

SEQ ID NO: 1040763 - RNA, 16 nt, Mycobacterium bovis subsp bovis AF2122/97
cggugcccugccggca

SEQ ID NO: 1040764 - RNA, 18 nt, Mycobacterium bovis subsp bovis AF2122/97
cggugcccgcaccacacc

SEQ ID NO: 1040765 - RNA, 20 nt, Mycobacterium bovis subsp bovis AF2122/97
cggugcccgcaccacaccgu

SEQ ID NO: 1040766 - RNA, 17 nt, Mycobacterium bovis subsp bovis AF2122/97
cggugcccugccggcag

SEQ ID NO: 1040767 - RNA, 19 nt, Mycobacterium bovis subsp bovis AF2122/97
cggugcccugccggcagcg

SEQ ID NO: 1040768 - RNA, 18 nt, Mycobacterium bovis subsp bovis AF2122/97
cggugccgaagcugccca

SEQ ID NO: 1040769 - RNA, 21 nt, Mycobacterium bovis subsp bovis AF2122/97
cggugcccugccggcagcggc

SEQ ID NO: 1040770 - RNA, 20 nt, Mycobacterium bovis subsp bovis AF2122/97
cggugcccgggcgucaagcc

SEQ ID NO: 1040771 - RNA, 18 nt, Mycobacterium bovis subsp bovis AF2122/97
cggugcccgcggugacga

SEQ ID NO: 1040772 - RNA, 15 nt, Mycobacterium bovis subsp bovis AF2122/97
cggugcccagggcga

SEQ ID NO: 1040773 - RNA, 16 nt, Mycobacterium bovis subsp bovis AF2122/97
cggugcccgcaccaca

SEQ ID NO: 1040774 - RNA, 16 nt, Mycobacterium bovis subsp bovis AF2122/97
cggugcccaccaccga

SEQ ID NO: 1040775 - RNA, 17 nt, Mycobacterium bovis subsp bovis AF2122/97
cggugccaucgggcgcg

SEQ ID NO: 1040776 - RNA, 18 nt, Mycobacterium bovis subsp bovis AF2122/97
cggugccaucgggcgcgg

SEQ ID NO: 1040777 - RNA, 21 nt, Mycobacterium bovis subsp bovis AF2122/97
cggugccagcaccacgucgac

SEQ ID NO: 1040778 - RNA, 13 nt, Mycobacterium bovis subsp bovis AF2122/97
cggugccagcagg

SEQ ID NO: 1040779 - RNA, 12 nt, Mycobacterium bovis subsp bovis AF2122/97
cggugccaccga

SEQ ID NO: 1040780 - RNA, 20 nt, Mycobacterium bovis subsp bovis AF2122/97
cggugccagcaggccgaaga

SEQ ID NO: 1040781 - RNA, 16 nt, Mycobacterium bovis subsp bovis AF2122/97
cggugcagcagcgcgc

SEQ ID NO: 1040782 - RNA, 22 nt, Mycobacterium bovis subsp bovis AF2122/97
cggugcagcagggcgcgcaucu

SEQ ID NO: 1040783 - RNA, 16 nt, Mycobacterium bovis subsp bovis AF2122/97
cggugcagaucggcuc

SEQ ID NO: 1040784 - RNA, 13 nt, Mycobacterium bovis subsp bovis AF2122/97
cggugcagcccgc

SEQ ID NO: 1040785 - RNA, 19 nt, Mycobacterium bovis subsp bovis AF2122/97
cggugcagcccgccgcuga

SEQ ID NO: 1040786 - RNA, 17 nt, Mycobacterium bovis subsp bovis AF2122/97
cggugcagcuccccgcc

SEQ ID NO: 1040787 - RNA, 20 nt, Mycobacterium bovis subsp bovis AF2122/97
cggugcaggaccagaacucg

SEQ ID NO: 1040788 - RNA, 21 nt, Mycobacterium bovis subsp bovis AF2122/97
cggugcauauuggaucgucgg

SEQ ID NO: 1040789 - RNA, 21 nt, Mycobacterium bovis subsp bovis AF2122/97
cggugcauugagccugccgga

SEQ ID NO: 1040790 - RNA, 16 nt, Mycobacterium bovis subsp bovis AF2122/97
cggugcaucgccacca

SEQ ID NO: 1040791 - RNA, 21 nt, Mycobacterium bovis subsp bovis AF2122/97
cggugccacugccguugccgc

SEQ ID NO: 1040792 - RNA, 19 nt, Mycobacterium bovis subsp bovis AF2122/97
cggugccagaaugccgaac

SEQ ID NO: 1040793 - RNA, 20 nt, Mycobacterium bovis subsp bovis AF2122/97
cggugccacccuugccgccg

SEQ ID NO: 1040794 - RNA, 21 nt, Mycobacterium bovis subsp bovis AF2122/97
cggugccacccuugccgccgg

SEQ ID NO: 1040795 - RNA, 22 nt, Mycobacterium bovis subsp bovis AF2122/97
cggugccacccuugccgccggu

SEQ ID NO: 1040796 - RNA, 19 nt, Mycobacterium bovis subsp bovis AF2122/97
cggugccaagggccggaug

SEQ ID NO: 1040797 - RNA, 14 nt, Mycobacterium bovis subsp bovis AF2122/97
cggugccaccacgc

SEQ ID NO: 1040798 - RNA, 22 nt, Mycobacterium bovis subsp bovis AF2122/97
cggugccaccacgcuccccagc

SEQ ID NO: 1040799 - RNA, 16 nt, Mycobacterium bovis subsp bovis AF2122/97
cggugcacaccgucgc

SEQ ID NO: 1040800 - RNA, 13 nt, Mycobacterium bovis subsp bovis AF2122/97
cggugcacaacgc

SEQ ID NO: 1040801 - RNA, 13 nt, Mycobacterium bovis subsp bovis AF2122/97
cggugcacaccgu

SEQ ID NO: 1040802 - RNA, 12 nt, Mycobacterium bovis subsp bovis AF2122/97
cggugcaccagg

SEQ ID NO: 1040803 - RNA, 21 nt, Mycobacterium bovis subsp bovis AF2122/97
cggugcacacugaccccgccg

SEQ ID NO: 1040804 - RNA, 17 nt, Mycobacterium bovis subsp bovis AF2122/97
cggugcacgagcggaca

SEQ ID NO: 1040805 - RNA, 13 nt, Mycobacterium bovis subsp bovis AF2122/97
cggugaugguggc

SEQ ID NO: 1040806 - RNA, 20 nt, Mycobacterium bovis subsp bovis AF2122/97
cggugaugguggcaacgggu

SEQ ID NO: 1040807 - RNA, 20 nt, Mycobacterium bovis subsp bovis AF2122/97
cggugauguagggcugcucc

SEQ ID NO: 1040808 - RNA, 21 nt, Mycobacterium bovis subsp bovis AF2122/97
cggugauguccgcacaacgau

SEQ ID NO: 1040809 - RNA, 23 nt, Mycobacterium bovis subsp bovis AF2122/97
cggugaucucguacuccccgcgc

SEQ ID NO: 1040810 - RNA, 14 nt, Mycobacterium bovis subsp bovis AF2122/97
cggugaugucggug

SEQ ID NO: 1040811 - RNA, 22 nt, Mycobacterium bovis subsp bovis AF2122/97
cggugauugcaagcgggcaccg

SEQ ID NO: 1040812 - RNA, 20 nt, Mycobacterium bovis subsp bovis AF2122/97
cggugcacaaaauacuccgc

SEQ ID NO: 1040813 - RNA, 18 nt, Mycobacterium bovis subsp bovis AF2122/97
cggugccgucggugccgc

SEQ ID NO: 1040814 - RNA, 19 nt, Mycobacterium bovis subsp bovis AF2122/97
cggugccgugaucggcgcc

SEQ ID NO: 1040815 - RNA, 17 nt, Mycobacterium bovis subsp bovis AF2122/97
cggugccgugcucacgg

SEQ ID NO: 1040816 - RNA, 21 nt, Mycobacterium bovis subsp bovis AF2122/97
cggugccgugguggacgaugc

SEQ ID NO: 1040817 - RNA, 16 nt, Mycobacterium bovis subsp bovis AF2122/97
cggugccgucgagucc

SEQ ID NO: 1040818 - RNA, 20 nt, Mycobacterium bovis subsp bovis AF2122/97
cggugccgucgaguccaggc

SEQ ID NO: 1040819 - RNA, 22 nt, Mycobacterium bovis subsp bovis AF2122/97
cggugccgggcaccaccacacc

SEQ ID NO: 1040820 - RNA, 21 nt, Mycobacterium bovis subsp bovis AF2122/97
cggugccggggcugccgccgu

SEQ ID NO: 1040821 - RNA, 17 nt, Mycobacterium bovis subsp bovis AF2122/97
cggugccgcgaucgcgg

SEQ ID NO: 1040822 - RNA, 21 nt, Mycobacterium bovis subsp bovis AF2122/97
cggugccgucgaguccaggcc

SEQ ID NO: 1040823 - RNA, 20 nt, Mycobacterium bovis subsp bovis AF2122/97
cggugcgaucaggcugccgc

SEQ ID NO: 1040824 - RNA, 13 nt, Mycobacterium bovis subsp bovis AF2122/97
cggugcgaucagg

SEQ ID NO: 1040825 - RNA, 16 nt, Mycobacterium bovis subsp bovis AF2122/97
cggugccgguagcggc

SEQ ID NO: 1040826 - RNA, 19 nt, Mycobacterium bovis subsp bovis AF2122/97
cggugccgguggugacggc

SEQ ID NO: 1040827 - RNA, 18 nt, Mycobacterium bovis subsp bovis AF2122/97
cggugccgucagcggcgg

SEQ ID NO: 1040828 - RNA, 19 nt, Mycobacterium bovis subsp bovis AF2122/97
cggugccgucagcggcggc

SEQ ID NO: 1040829 - RNA, 20 nt, Mycobacterium bovis subsp bovis AF2122/97
cggugccgucagcggcggcc

SEQ ID NO: 1040830 - RNA, 21 nt, Mycobacterium bovis subsp bovis AF2122/97
cggugccgucagcggcggcca

SEQ ID NO: 1040831 - RNA, 14 nt, Mycobacterium bovis subsp bovis AF2122/97
cggugccggcguag

SEQ ID NO: 1040832 - RNA, 14 nt, Mycobacterium bovis subsp bovis AF2122/97
cggugccggcguug

SEQ ID NO: 1040833 - RNA, 18 nt, Mycobacterium bovis subsp bovis AF2122/97
cggugccggcguugccgc

SEQ ID NO: 1040834 - RNA, 20 nt, Mycobacterium bovis subsp bovis AF2122/97
cggugccggcguugccgccg

SEQ ID NO: 1040835 - RNA, 17 nt, Mycobacterium bovis subsp bovis AF2122/97
cggugccgggaugccgc

SEQ ID NO: 1040836 - RNA, 17 nt, Mycobacterium bovis subsp bovis AF2122/97
cggugccgggcaccacc

SEQ ID NO: 1040837 - RNA, 14 nt, Mycobacterium bovis subsp bovis AF2122/97
cggugccggccugu

SEQ ID NO: 1040838 - RNA, 13 nt, Mycobacterium bovis subsp bovis AF2122/97
cggugccggcgac

SEQ ID NO: 1040839 - RNA, 14 nt, Mycobacterium bovis subsp bovis AF2122/97
cggugccggcgacg

SEQ ID NO: 1040840 - RNA, 12 nt, Mycobacterium bovis subsp bovis AF2122/97
cggugccggcgg

SEQ ID NO: 1040841 - RNA, 13 nt, Mycobacterium bovis subsp bovis AF2122/97
cggugccggccgc

SEQ ID NO: 1040842 - RNA, 18 nt, Mycobacterium bovis subsp bovis AF2122/97
cggugccggaaacgccag

SEQ ID NO: 1040843 - RNA, 18 nt, Mycobacterium bovis subsp bovis AF2122/97
cggugccggcacccgagu

SEQ ID NO: 1040844 - RNA, 12 nt, Mycobacterium bovis subsp bovis AF2122/97
cggugccggcca

SEQ ID NO: 1040845 - RNA, 14 nt, Mycobacterium bovis subsp bovis AF2122/97
cggugccggccaga

SEQ ID NO: 1040846 - RNA, 21 nt, Mycobacterium bovis subsp bovis AF2122/97
cggugccggccagacucgcgg

SEQ ID NO: 1040847 - RNA, 12 nt, Mycobacterium bovis subsp bovis AF2122/97
cggugccggccc

SEQ ID NO: 1040848 - RNA, 15 nt, Mycobacterium bovis subsp bovis AF2122/97
cggugcgcgcggcga

SEQ ID NO: 1040849 - RNA, 18 nt, Mycobacterium bovis subsp bovis AF2122/97
cggugcgcgcggcgacca

SEQ ID NO: 1040850 - RNA, 15 nt, Mycobacterium bovis subsp bovis AF2122/97
cggugcgcgugacga

SEQ ID NO: 1040851 - RNA, 15 nt, Mycobacterium bovis subsp bovis AF2122/97
cggugcgcuggcggc

SEQ ID NO: 1040852 - RNA, 20 nt, Mycobacterium bovis subsp bovis AF2122/97
cggugcgauuccgcgucugc

SEQ ID NO: 1040853 - RNA, 23 nt, Mycobacterium bovis subsp bovis AF2122/97
cggugcgauccugaccagccagg

SEQ ID NO: 1040854 - RNA, 22 nt, Mycobacterium bovis subsp bovis AF2122/97
cggugcgcaccagcacacccgu

SEQ ID NO: 1040855 - RNA, 15 nt, Mycobacterium bovis subsp bovis AF2122/97
cggugcgccgauccc

SEQ ID NO: 1040856 - RNA, 18 nt, Mycobacterium bovis subsp bovis AF2122/97
cggugcgccgaucccgcc

SEQ ID NO: 1040857 - RNA, 18 nt, Mycobacterium bovis subsp bovis AF2122/97
cggugcggcagauacucg

SEQ ID NO: 1040858 - RNA, 16 nt, Mycobacterium bovis subsp bovis AF2122/97
cggugcggaacaccgc

SEQ ID NO: 1040859 - RNA, 18 nt, Mycobacterium bovis subsp bovis AF2122/97
cggugcggaacaccgccc

SEQ ID NO: 1040860 - RNA, 19 nt, Mycobacterium bovis subsp bovis AF2122/97
cggugcggcaacagcgcca

SEQ ID NO: 1040861 - RNA, 14 nt, Mycobacterium bovis subsp bovis AF2122/97
cggugcggcgggcu

SEQ ID NO: 1040862 - RNA, 21 nt, Mycobacterium bovis subsp bovis AF2122/97
cggugcggccaaugacgucgg

SEQ ID NO: 1040863 - RNA, 21 nt, Mycobacterium bovis subsp bovis AF2122/97
cggugcgguucgcugcggcgg

SEQ ID NO: 1040864 - RNA, 23 nt, Mycobacterium bovis subsp bovis AF2122/97
cggugcgguuucaccgacgacgc

SEQ ID NO: 1040865 - RNA, 21 nt, Mycobacterium bovis subsp bovis AF2122/97
cggugcggguggugccggcgg

SEQ ID NO: 1040866 - RNA, 13 nt, Mycobacterium bovis subsp bovis AF2122/97
cggugcgggcgcc

SEQ ID NO: 1040867 - RNA, 15 nt, Mycobacterium bovis subsp bovis AF2122/97
cggugcgggcgccag

SEQ ID NO: 1040868 - RNA, 15 nt, Mycobacterium bovis subsp bovis AF2122/97
cggugcgggcgccgc

SEQ ID NO: 1040869 - RNA, 21 nt, Mycobacterium bovis subsp bovis AF2122/97
cggugcgggcuaggcggcguu

SEQ ID NO: 1040870 - RNA, 20 nt, Mycobacterium bovis subsp bovis AF2122/97
cggugcugaccccgccggcu

SEQ ID NO: 1040871 - RNA, 18 nt, Mycobacterium bovis subsp bovis AF2122/97
cggugcugacgacgaggg

SEQ ID NO: 1040872 - RNA, 19 nt, Mycobacterium bovis subsp bovis AF2122/97
cggugcugacgacgagggc

SEQ ID NO: 1040873 - RNA, 21 nt, Mycobacterium bovis subsp bovis AF2122/97
cggugcugaucgguccggcga

SEQ ID NO: 1040874 - RNA, 13 nt, Mycobacterium bovis subsp bovis AF2122/97
cggugcugacgac

SEQ ID NO: 1040875 - RNA, 21 nt, Mycobacterium bovis subsp bovis AF2122/97
cggugcucuucggcaccaccg

SEQ ID NO: 1040876 - RNA, 13 nt, Mycobacterium bovis subsp bovis AF2122/97
cggugcucgucga

SEQ ID NO: 1040877 - RNA, 13 nt, Mycobacterium bovis subsp bovis AF2122/97
cggugcgucgugg

SEQ ID NO: 1040878 - RNA, 16 nt, Mycobacterium bovis subsp bovis AF2122/97
cggugcuaccggcuug

SEQ ID NO: 1040879 - RNA, 23 nt, Mycobacterium bovis subsp bovis AF2122/97
cggugcuaugcaacaccgcaccg

SEQ ID NO: 1040880 - RNA, 22 nt, Mycobacterium bovis subsp bovis AF2122/97
cggugcucaccaaucugcgggc

SEQ ID NO: 1040881 - RNA, 17 nt, Mycobacterium bovis subsp bovis AF2122/97
cgguggccgcugccagc

SEQ ID NO: 1040882 - RNA, 19 nt, Mycobacterium bovis subsp bovis AF2122/97
cgguggccgcugccagccg

SEQ ID NO: 1040883 - RNA, 13 nt, Mycobacterium bovis subsp bovis AF2122/97
cgguggccgucgg

SEQ ID NO: 1040884 - RNA, 23 nt, Mycobacterium bovis subsp bovis AF2122/97
cgguggccggcaacggcgcgccg

SEQ ID NO: 1040885 - RNA, 15 nt, Mycobacterium bovis subsp bovis AF2122/97
cgguggccggcagcc

SEQ ID NO: 1040886 - RNA, 22 nt, Mycobacterium bovis subsp bovis AF2122/97
cgguggccggcagccagacugc

SEQ ID NO: 1040887 - RNA, 17 nt, Mycobacterium bovis subsp bovis AF2122/97
cgguggccucccacggc

SEQ ID NO: 1040888 - RNA, 18 nt, Mycobacterium bovis subsp bovis AF2122/97
cgguggccucccacggcg

SEQ ID NO: 1040889 - RNA, 14 nt, Mycobacterium bovis subsp bovis AF2122/97
cgguggcggcacgc

SEQ ID NO: 1040890 - RNA, 14 nt, Mycobacterium bovis subsp bovis AF2122/97
cgguggcggcagca

SEQ ID NO: 1040891 - RNA, 18 nt, Mycobacterium bovis subsp bovis AF2122/97
cgguggcggacggcguuu

SEQ ID NO: 1040892 - RNA, 14 nt, Mycobacterium bovis subsp bovis AF2122/97
cgguggcgcggugc

SEQ ID NO: 1040893 - RNA, 18 nt, Mycobacterium bovis subsp bovis AF2122/97
cgguggcgcgcagcgcga

SEQ ID NO: 1040894 - RNA, 18 nt, Mycobacterium bovis subsp bovis AF2122/97
cgguggcgccgucggccg

SEQ ID NO: 1040895 - RNA, 21 nt, Mycobacterium bovis subsp bovis AF2122/97
cgguggcgccggggccgccga

SEQ ID NO: 1040896 - RNA, 16 nt, Mycobacterium bovis subsp bovis AF2122/97
cgguggcgccggggcg

SEQ ID NO: 1040897 - RNA, 20 nt, Mycobacterium bovis subsp bovis AF2122/97
cgguggcgccggggcgcagg

SEQ ID NO: 1040898 - RNA, 18 nt, Mycobacterium bovis subsp bovis AF2122/97
cgguggcggcggcggcaa

SEQ ID NO: 1040899 - RNA, 22 nt, Mycobacterium bovis subsp bovis AF2122/97
cgguggcggcggcggcaacggc

SEQ ID NO: 1040900 - RNA, 16 nt, Mycobacterium bovis subsp bovis AF2122/97
cgguggcggcucacga

SEQ ID NO: 1040901 - RNA, 15 nt, Mycobacterium bovis subsp bovis AF2122/97
cgguggcggugucgg

SEQ ID NO: 1040902 - RNA, 19 nt, Mycobacterium bovis subsp bovis AF2122/97
cgguggcggugucggcgcc

SEQ ID NO: 1040903 - RNA, 23 nt, Mycobacterium bovis subsp bovis AF2122/97
cgguggcggucgccacacccgcg

SEQ ID NO: 1040904 - RNA, 21 nt, Mycobacterium bovis subsp bovis AF2122/97
cgguggcggucuugccgcagg

SEQ ID NO: 1040905 - RNA, 15 nt, Mycobacterium bovis subsp bovis AF2122/97
cgguggcgucgucgg

SEQ ID NO: 1040906 - RNA, 12 nt, Mycobacterium bovis subsp bovis AF2122/97
cgguggcuacgc

SEQ ID NO: 1040907 - RNA, 22 nt, Mycobacterium bovis subsp bovis AF2122/97
cgguggcugccacuuggacgaa

SEQ ID NO: 1040908 - RNA, 20 nt, Mycobacterium bovis subsp bovis AF2122/97
cgguggcuuuugcgucugcu

SEQ ID NO: 1040909 - RNA, 12 nt, Mycobacterium bovis subsp bovis AF2122/97
cgguggcugcgc

SEQ ID NO: 1040910 - RNA, 15 nt, Mycobacterium bovis subsp bovis AF2122/97
cgguggcuggccgcc

SEQ ID NO: 1040911 - RNA, 17 nt, Mycobacterium bovis subsp bovis AF2122/97
cgguggcuggccgccac

SEQ ID NO: 1040912 - RNA, 17 nt, Mycobacterium bovis subsp bovis AF2122/97
cgguggcuucaacccgg

SEQ ID NO: 1040913 - RNA, 19 nt, Mycobacterium bovis subsp bovis AF2122/97
cgguggcuucaacccgggc

SEQ ID NO: 1040914 - RNA, 19 nt, Mycobacterium bovis subsp bovis AF2122/97
cggugggcggcgagcgcga

SEQ ID NO: 1040915 - RNA, 15 nt, Mycobacterium bovis subsp bovis AF2122/97
cggugggcagcagcu

SEQ ID NO: 1040916 - RNA, 20 nt, Mycobacterium bovis subsp bovis AF2122/97
cggugggcgccgacaccggc

SEQ ID NO: 1040917 - RNA, 15 nt, Mycobacterium bovis subsp bovis AF2122/97
cgguggaccaccgga

SEQ ID NO: 1040918 - RNA, 21 nt, Mycobacterium bovis subsp bovis AF2122/97
cgguggacagaaucgaccgcc

SEQ ID NO: 1040919 - RNA, 22 nt, Mycobacterium bovis subsp bovis AF2122/97
cgguggacagaaucgaccgccg

SEQ ID NO: 1040920 - RNA, 16 nt, Mycobacterium bovis subsp bovis AF2122/97
cgguggaaaccgggcg

SEQ ID NO: 1040921 - RNA, 15 nt, Mycobacterium bovis subsp bovis AF2122/97
cggugcugguccagc

SEQ ID NO: 1040922 - RNA, 23 nt, Mycobacterium bovis subsp bovis AF2122/97
cggugcugaccccgccggcugcg

SEQ ID NO: 1040923 - RNA, 18 nt, Mycobacterium bovis subsp bovis AF2122/97
cggugcuggucgccgcgg

SEQ ID NO: 1040924 - RNA, 18 nt, Mycobacterium bovis subsp bovis AF2122/97
cggugcugucgacgucgg

SEQ ID NO: 1040925 - RNA, 17 nt, Mycobacterium bovis subsp bovis AF2122/97
cggugcuguugcgcggu

SEQ ID NO: 1040926 - RNA, 20 nt, Mycobacterium bovis subsp bovis AF2122/97
cggugcuguugucgaacaac

SEQ ID NO: 1040927 - RNA, 17 nt, Mycobacterium bovis subsp bovis AF2122/97
cgguggaggcguagucg

SEQ ID NO: 1040928 - RNA, 18 nt, Mycobacterium bovis subsp bovis AF2122/97
cgguggaggcguagucgg

SEQ ID NO: 1040929 - RNA, 15 nt, Mycobacterium bovis subsp bovis AF2122/97
cgguggacccggcgg

SEQ ID NO: 1040930 - RNA, 13 nt, Mycobacterium bovis subsp bovis AF2122/97
cgguggacgagcc

SEQ ID NO: 1040931 - RNA, 17 nt, Mycobacterium bovis subsp bovis AF2122/97
cgguggacgauacgcgc

SEQ ID NO: 1040932 - RNA, 20 nt, Mycobacterium bovis subsp bovis AF2122/97
cgguggacgcagagucaaca

SEQ ID NO: 1040933 - RNA, 17 nt, Mycobacterium bovis subsp bovis AF2122/97
cgguggcagccugcugc

SEQ ID NO: 1040934 - RNA, 16 nt, Mycobacterium bovis subsp bovis AF2122/97
cgguggccaacaccgc

SEQ ID NO: 1040935 - RNA, 17 nt, Mycobacterium bovis subsp bovis AF2122/97
cgguggccaacaccgcc

SEQ ID NO: 1040936 - RNA, 17 nt, Mycobacterium bovis subsp bovis AF2122/97
cgguggccacccggccg

SEQ ID NO: 1040937 - RNA, 18 nt, Mycobacterium bovis subsp bovis AF2122/97
cgguggccacccggccgc

SEQ ID NO: 1040938 - RNA, 21 nt, Mycobacterium bovis subsp bovis AF2122/97
cgguggcauccuugccaaucg

SEQ ID NO: 1040939 - RNA, 19 nt, Mycobacterium bovis subsp bovis AF2122/97
cgguggccaacaccgccag

SEQ ID NO: 1040940 - RNA, 20 nt, Mycobacterium bovis subsp bovis AF2122/97
cgguggccaacaccgccagc

SEQ ID NO: 1040941 - RNA, 13 nt, Mycobacterium bovis subsp bovis AF2122/97
cgguggagcgcgc

SEQ ID NO: 1040942 - RNA, 22 nt, Mycobacterium bovis subsp bovis AF2122/97
cgguggagcgcgccucgcccag

SEQ ID NO: 1040943 - RNA, 22 nt, Mycobacterium bovis subsp bovis AF2122/97
cgguggcaacggaggugccggc

SEQ ID NO: 1040944 - RNA, 17 nt, Mycobacterium bovis subsp bovis AF2122/97
cgguggcaacgggucgg

SEQ ID NO: 1040945 - RNA, 18 nt, Mycobacterium bovis subsp bovis AF2122/97
cgguggcacccgcgucga

SEQ ID NO: 1040946 - RNA, 13 nt, Mycobacterium bovis subsp bovis AF2122/97
cgguggcaccggc

SEQ ID NO: 1040947 - RNA, 17 nt, Mycobacterium bovis subsp bovis AF2122/97
cgguggcagagccgccg

SEQ ID NO: 1040948 - RNA, 20 nt, Mycobacterium bovis subsp bovis AF2122/97
cgguggcagagccgccguug

SEQ ID NO: 1040949 - RNA, 20 nt, Mycobacterium bovis subsp bovis AF2122/97
cgguggccgacaagucaaga

SEQ ID NO: 1040950 - RNA, 14 nt, Mycobacterium bovis subsp bovis AF2122/97
cgguggcccgccgg

SEQ ID NO: 1040951 - RNA, 14 nt, Mycobacterium bovis subsp bovis AF2122/97
cgguggccagaucg

SEQ ID NO: 1040952 - RNA, 15 nt, Mycobacterium bovis subsp bovis AF2122/97
cgguucguagcgggc

SEQ ID NO: 1040953 - RNA, 23 nt, Mycobacterium bovis subsp bovis AF2122/97
cgguucguugccaaugacgucgc

SEQ ID NO: 1040954 - RNA, 12 nt, Mycobacterium bovis subsp bovis AF2122/97
cgguucgggacg

SEQ ID NO: 1040955 - RNA, 14 nt, Mycobacterium bovis subsp bovis AF2122/97
cgguucgggcagca

SEQ ID NO: 1040956 - RNA, 15 nt, Mycobacterium bovis subsp bovis AF2122/97
cgguucggucgggga

SEQ ID NO: 1040957 - RNA, 13 nt, Mycobacterium bovis subsp bovis AF2122/97
cgguugacccggc

SEQ ID NO: 1040958 - RNA, 19 nt, Mycobacterium bovis subsp bovis AF2122/97
cgguugacccggcagcccg

SEQ ID NO: 1040959 - RNA, 15 nt, Mycobacterium bovis subsp bovis AF2122/97
cgguucugcggccgc

SEQ ID NO: 1040960 - RNA, 19 nt, Mycobacterium bovis subsp bovis AF2122/97
cgguucgacccccgcaucg

SEQ ID NO: 1040961 - RNA, 21 nt, Mycobacterium bovis subsp bovis AF2122/97
cgguucgacccccgcaucggc

SEQ ID NO: 1040962 - RNA, 19 nt, Mycobacterium bovis subsp bovis AF2122/97
cgguucggcgaucuccggc

SEQ ID NO: 1040963 - RNA, 20 nt, Mycobacterium bovis subsp bovis AF2122/97
cgguucggccggagccgccg

SEQ ID NO: 1040964 - RNA, 23 nt, Mycobacterium bovis subsp bovis AF2122/97
cgguucggcguacaaaccgucgg

SEQ ID NO: 1040965 - RNA, 22 nt, Mycobacterium bovis subsp bovis AF2122/97
cgguucgccgccguuggcucga

SEQ ID NO: 1040966 - RNA, 14 nt, Mycobacterium bovis subsp bovis AF2122/97
cgguuucgggugcg

SEQ ID NO: 1040967 - RNA, 16 nt, Mycobacterium bovis subsp bovis AF2122/97
cgguuucugcggcccc

SEQ ID NO: 1040968 - RNA, 16 nt, Mycobacterium bovis subsp bovis AF2122/97
cgguuucuucggccag

SEQ ID NO: 1040969 - RNA, 15 nt, Mycobacterium bovis subsp bovis AF2122/97
cgguuugcaccgcgg

SEQ ID NO: 1040970 - RNA, 18 nt, Mycobacterium bovis subsp bovis AF2122/97
cgguuugcacgcaccaca

SEQ ID NO: 1040971 - RNA, 22 nt, Mycobacterium bovis subsp bovis AF2122/97
cgguuugcacgucacgcggaaa

SEQ ID NO: 1040972 - RNA, 19 nt, Mycobacterium bovis subsp bovis AF2122/97
cgguuugcguccugguggc

SEQ ID NO: 1040973 - RNA, 17 nt, Mycobacterium bovis subsp bovis AF2122/97
cgguuuggaucacccgc

SEQ ID NO: 1040974 - RNA, 12 nt, Mycobacterium bovis subsp bovis AF2122/97
cgguuuggccga

SEQ ID NO: 1040975 - RNA, 13 nt, Mycobacterium bovis subsp bovis AF2122/97
cgguugacgccgg

SEQ ID NO: 1040976 - RNA, 23 nt, Mycobacterium bovis subsp bovis AF2122/97
cgguugacgccgguccccgccgg

SEQ ID NO: 1040977 - RNA, 15 nt, Mycobacterium bovis subsp bovis AF2122/97
cgguugaccggucga

SEQ ID NO: 1040978 - RNA, 14 nt, Mycobacterium bovis subsp bovis AF2122/97
cgguuucaccgacg

SEQ ID NO: 1040979 - RNA, 18 nt, Mycobacterium bovis subsp bovis AF2122/97
cgguuuggcgacgucgac

SEQ ID NO: 1040980 - RNA, 17 nt, Mycobacterium bovis subsp bovis AF2122/97
cgguuuucggcugccgc

SEQ ID NO: 1040981 - RNA, 24 nt, Mycobacterium bovis subsp bovis AF2122/97
cguaauccacacacagccgguggc

SEQ ID NO: 1040982 - RNA, 18 nt, Mycobacterium bovis subsp bovis AF2122/97
cguaauccacgccgaccu

SEQ ID NO: 1040983 - RNA, 17 nt, Mycobacterium bovis subsp bovis AF2122/97
cguaauccgagcgcggc

SEQ ID NO: 1040984 - RNA, 22 nt, Mycobacterium bovis subsp bovis AF2122/97
cguaaaccgauaucgcugcgga

SEQ ID NO: 1040985 - RNA, 18 nt, Mycobacterium bovis subsp bovis AF2122/97
cguaaaccguggccgcga

SEQ ID NO: 1040986 - RNA, 21 nt, Mycobacterium bovis subsp bovis AF2122/97
cguacaccucgagcgcggcga

SEQ ID NO: 1040987 - RNA, 16 nt, Mycobacterium bovis subsp bovis AF2122/97
cguacaggccggccac

SEQ ID NO: 1040988 - RNA, 15 nt, Mycobacterium bovis subsp bovis AF2122/97
cguacagcggcggcg

SEQ ID NO: 1040989 - RNA, 20 nt, Mycobacterium bovis subsp bovis AF2122/97
cguacaacaugauucgcugc

SEQ ID NO: 1040990 - RNA, 15 nt, Mycobacterium bovis subsp bovis AF2122/97
cguaauugucgaugu

SEQ ID NO: 1040991 - RNA, 19 nt, Mycobacterium bovis subsp bovis AF2122/97
cguacaacacgggcagcuu

SEQ ID NO: 1040992 - RNA, 15 nt, Mycobacterium bovis subsp bovis AF2122/97
cguaaugcgcugccg

SEQ ID NO: 1040993 - RNA, 22 nt, Mycobacterium bovis subsp bovis AF2122/97
cguaaucggcaaugagcuaccg

SEQ ID NO: 1040994 - RNA, 15 nt, Mycobacterium bovis subsp bovis AF2122/97
cgguggggucgacgc

SEQ ID NO: 1040995 - RNA, 14 nt, Mycobacterium bovis subsp bovis AF2122/97
cgguggggcgccgg

SEQ ID NO: 1040996 - RNA, 16 nt, Mycobacterium bovis subsp bovis AF2122/97
cgguggggcgcgccgg

SEQ ID NO: 1040997 - RNA, 18 nt, Mycobacterium bovis subsp bovis AF2122/97
cgguggggucgcugccgc

SEQ ID NO: 1040998 - RNA, 20 nt, Mycobacterium bovis subsp bovis AF2122/97
cgguggggucgcugccgccg

SEQ ID NO: 1040999 - RNA, 18 nt, Mycobacterium bovis subsp bovis AF2122/97
cgguggggauggcgccca

SEQ ID NO: 1041000 - RNA, 19 nt, Mycobacterium bovis subsp bovis AF2122/97
cgguggggauggcgcccag

SEQ ID NO: 1041001 - RNA, 14 nt, Mycobacterium bovis subsp bovis AF2122/97
cggugggcuuggcg

SEQ ID NO: 1041002 - RNA, 18 nt, Mycobacterium bovis subsp bovis AF2122/97
cgguggggacccgcucca

SEQ ID NO: 1041003 - RNA, 14 nt, Mycobacterium bovis subsp bovis AF2122/97
cggugggcggcucg

SEQ ID NO: 1041004 - RNA, 22 nt, Mycobacterium bovis subsp bovis AF2122/97
cggugggcgggcaaucaccgcc

SEQ ID NO: 1041005 - RNA, 21 nt, Mycobacterium bovis subsp bovis AF2122/97
cggugggucugcucagcgcgg

SEQ ID NO: 1041006 - RNA, 17 nt, Mycobacterium bovis subsp bovis AF2122/97
cggugggugccagccgg

SEQ ID NO: 1041007 - RNA, 18 nt, Mycobacterium bovis subsp bovis AF2122/97
cggugguaacaccggcga

SEQ ID NO: 1041008 - RNA, 16 nt, Mycobacterium bovis subsp bovis AF2122/97
cggugguaagacgccg

SEQ ID NO: 1041009 - RNA, 17 nt, Mycobacterium bovis subsp bovis AF2122/97
cggugguaagacgccga

SEQ ID NO: 1041010 - RNA, 13 nt, Mycobacterium bovis subsp bovis AF2122/97
cggugggugacgu

SEQ ID NO: 1041011 - RNA, 20 nt, Mycobacterium bovis subsp bovis AF2122/97
cggugguaauacgucccgag

SEQ ID NO: 1041012 - RNA, 16 nt, Mycobacterium bovis subsp bovis AF2122/97
cggugguaccggcgcc

SEQ ID NO: 1041013 - RNA, 15 nt, Mycobacterium bovis subsp bovis AF2122/97
cggugguaccggcgg

SEQ ID NO: 1041014 - RNA, 19 nt, Mycobacterium bovis subsp bovis AF2122/97
cggugguaccggcggcgcc

SEQ ID NO: 1041015 - RNA, 21 nt, Mycobacterium bovis subsp bovis AF2122/97
cggugguaccggcggcgccgg

SEQ ID NO: 1041016 - RNA, 17 nt, Mycobacterium bovis subsp bovis AF2122/97
cggugguagcgacgaug

SEQ ID NO: 1041017 - RNA, 20 nt, Mycobacterium bovis subsp bovis AF2122/97
cgguggucaggaacacucgc

SEQ ID NO: 1041018 - RNA, 23 nt, Mycobacterium bovis subsp bovis AF2122/97
cggugguagcggcgguuucggug

SEQ ID NO: 1041019 - RNA, 17 nt, Mycobacterium bovis subsp bovis AF2122/97
cggugguaggacgccag

SEQ ID NO: 1041020 - RNA, 15 nt, Mycobacterium bovis subsp bovis AF2122/97
cgguggucccgaugg

SEQ ID NO: 1041021 - RNA, 17 nt, Mycobacterium bovis subsp bovis AF2122/97
cggugguguuccagguc

SEQ ID NO: 1041022 - RNA, 20 nt, Mycobacterium bovis subsp bovis AF2122/97
cgguggugucagccaccggu

SEQ ID NO: 1041023 - RNA, 17 nt, Mycobacterium bovis subsp bovis AF2122/97
cgguggugcugucgugg

SEQ ID NO: 1041024 - RNA, 17 nt, Mycobacterium bovis subsp bovis AF2122/97
cgguggucagcaccggc

SEQ ID NO: 1041025 - RNA, 17 nt, Mycobacterium bovis subsp bovis AF2122/97
cgguggucccgauggcg

SEQ ID NO: 1041026 - RNA, 14 nt, Mycobacterium bovis subsp bovis AF2122/97
cgguggugucagcc

SEQ ID NO: 1041027 - RNA, 19 nt, Mycobacterium bovis subsp bovis AF2122/97
cgguguacagucgcgcgcu

SEQ ID NO: 1041028 - RNA, 20 nt, Mycobacterium bovis subsp bovis AF2122/97
cggugguuagguggcuggcu

SEQ ID NO: 1041029 - RNA, 21 nt, Mycobacterium bovis subsp bovis AF2122/97
cgguguccucgaccgucacgc

SEQ ID NO: 1041030 - RNA, 13 nt, Mycobacterium bovis subsp bovis AF2122/97
cgguguccuggcc

SEQ ID NO: 1041031 - RNA, 23 nt, Mycobacterium bovis subsp bovis AF2122/97
cgguguaacugcguuggcgacca

SEQ ID NO: 1041032 - RNA, 12 nt, Mycobacterium bovis subsp bovis AF2122/97
cgguguccagcc

SEQ ID NO: 1041033 - RNA, 16 nt, Mycobacterium bovis subsp bovis AF2122/97
cggugucaugaacgac

SEQ ID NO: 1041034 - RNA, 21 nt, Mycobacterium bovis subsp bovis AF2122/97
cgguguaccagguggaccggc

SEQ ID NO: 1041035 - RNA, 14 nt, Mycobacterium bovis subsp bovis AF2122/97
cgguguacgcccgc

SEQ ID NO: 1041036 - RNA, 20 nt, Mycobacterium bovis subsp bovis AF2122/97
cgguuccgguguaggccugc

SEQ ID NO: 1041037 - RNA, 14 nt, Mycobacterium bovis subsp bovis AF2122/97
cgguuccgggcgcg

SEQ ID NO: 1041038 - RNA, 15 nt, Mycobacterium bovis subsp bovis AF2122/97
cgguuccggccggcu

SEQ ID NO: 1041039 - RNA, 16 nt, Mycobacterium bovis subsp bovis AF2122/97
cgguuccggccccguc

SEQ ID NO: 1041040 - RNA, 23 nt, Mycobacterium bovis subsp bovis AF2122/97
cgguuccgccggccccaccggua

SEQ ID NO: 1041041 - RNA, 22 nt, Mycobacterium bovis subsp bovis AF2122/97
cgguuccgccaccggacaucug

SEQ ID NO: 1041042 - RNA, 20 nt, Mycobacterium bovis subsp bovis AF2122/97
cgguuccgccaggccgaccg

SEQ ID NO: 1041043 - RNA, 17 nt, Mycobacterium bovis subsp bovis AF2122/97
cgguuccgccggcccca

SEQ ID NO: 1041044 - RNA, 17 nt, Mycobacterium bovis subsp bovis AF2122/97
cgguucccagcuuccgc

SEQ ID NO: 1041045 - RNA, 20 nt, Mycobacterium bovis subsp bovis AF2122/97
cgguuauguauccgcgccgc

SEQ ID NO: 1041046 - RNA, 16 nt, Mycobacterium bovis subsp bovis AF2122/97
cgguuacccggaccgu

SEQ ID NO: 1041047 - RNA, 13 nt, Mycobacterium bovis subsp bovis AF2122/97
cgguuagcgcggc

SEQ ID NO: 1041048 - RNA, 16 nt, Mycobacterium bovis subsp bovis AF2122/97
cgguuagcgcggccag

SEQ ID NO: 1041049 - RNA, 14 nt, Mycobacterium bovis subsp bovis AF2122/97
cgguuaucgccgag

SEQ ID NO: 1041050 - RNA, 13 nt, Mycobacterium bovis subsp bovis AF2122/97
cggugucgaugcg

SEQ ID NO: 1041051 - RNA, 21 nt, Mycobacterium bovis subsp bovis AF2122/97
cggugucgaugcgcagcccgu

SEQ ID NO: 1041052 - RNA, 14 nt, Mycobacterium bovis subsp bovis AF2122/97
cggugucgacgggg

SEQ ID NO: 1041053 - RNA, 19 nt, Mycobacterium bovis subsp bovis AF2122/97
cggugugcggcguacucgg

SEQ ID NO: 1041054 - RNA, 17 nt, Mycobacterium bovis subsp bovis AF2122/97
cggugugcggcagcccg

SEQ ID NO: 1041055 - RNA, 20 nt, Mycobacterium bovis subsp bovis AF2122/97
cggugugcggcagcccgcug

SEQ ID NO: 1041056 - RNA, 22 nt, Mycobacterium bovis subsp bovis AF2122/97
cggugugcgcaccccgcuugcg

SEQ ID NO: 1041057 - RNA, 14 nt, Mycobacterium bovis subsp bovis AF2122/97
cggugugcgcgcca

SEQ ID NO: 1041058 - RNA, 17 nt, Mycobacterium bovis subsp bovis AF2122/97
cggugugcaggaucacg

SEQ ID NO: 1041059 - RNA, 18 nt, Mycobacterium bovis subsp bovis AF2122/97
cggugugcaucgccggca

SEQ ID NO: 1041060 - RNA, 20 nt, Mycobacterium bovis subsp bovis AF2122/97
cggugugcaucgccggcacg

SEQ ID NO: 1041061 - RNA, 17 nt, Mycobacterium bovis subsp bovis AF2122/97
cggugucgccgaacacc

SEQ ID NO: 1041062 - RNA, 15 nt, Mycobacterium bovis subsp bovis AF2122/97
cggugugcucgccga

SEQ ID NO: 1041063 - RNA, 16 nt, Mycobacterium bovis subsp bovis AF2122/97
cgguguggacugggcc

SEQ ID NO: 1041064 - RNA, 19 nt, Mycobacterium bovis subsp bovis AF2122/97
cgguguggacuucagcagg

SEQ ID NO: 1041065 - RNA, 23 nt, Mycobacterium bovis subsp bovis AF2122/97
cgguguggacuucagcaggccca

SEQ ID NO: 1041066 - RNA, 16 nt, Mycobacterium bovis subsp bovis AF2122/97
cggugugcuugcucgg

SEQ ID NO: 1041067 - RNA, 15 nt, Mycobacterium bovis subsp bovis AF2122/97
cggugugcggcauug

SEQ ID NO: 1041068 - RNA, 14 nt, Mycobacterium bovis subsp bovis AF2122/97
cgguguggcccaac

SEQ ID NO: 1041069 - RNA, 17 nt, Mycobacterium bovis subsp bovis AF2122/97
cgguguggcccaacacc

SEQ ID NO: 1041070 - RNA, 21 nt, Mycobacterium bovis subsp bovis AF2122/97
cgguguggcccaacaccgcca

SEQ ID NO: 1041071 - RNA, 17 nt, Mycobacterium bovis subsp bovis AF2122/97
cgguguuuggccgccga

SEQ ID NO: 1041072 - RNA, 20 nt, Mycobacterium bovis subsp bovis AF2122/97
cguagacccacagucgccgg

SEQ ID NO: 1041073 - RNA, 21 nt, Mycobacterium bovis subsp bovis AF2122/97
cguagaccgucgauccgucgg

SEQ ID NO: 1041074 - RNA, 15 nt, Mycobacterium bovis subsp bovis AF2122/97
cguagcagcgccggc

SEQ ID NO: 1041075 - RNA, 17 nt, Mycobacterium bovis subsp bovis AF2122/97
cguagcagguguaggug

SEQ ID NO: 1041076 - RNA, 23 nt, Mycobacterium bovis subsp bovis AF2122/97
cguagcaucgggcgagcucgucg

SEQ ID NO: 1041077 - RNA, 17 nt, Mycobacterium bovis subsp bovis AF2122/97
cguagcaacccaggauu

SEQ ID NO: 1041078 - RNA, 18 nt, Mycobacterium bovis subsp bovis AF2122/97
cguagcccaggucgaugc

SEQ ID NO: 1041079 - RNA, 16 nt, Mycobacterium bovis subsp bovis AF2122/97
cguagccagcagcggc

SEQ ID NO: 1041080 - RNA, 14 nt, Mycobacterium bovis subsp bovis AF2122/97
cguagcccacgacg

SEQ ID NO: 1041081 - RNA, 14 nt, Mycobacterium bovis subsp bovis AF2122/97
cguacuugccaccc

SEQ ID NO: 1041082 - RNA, 15 nt, Mycobacterium bovis subsp bovis AF2122/97
cguagaacccaggcc

SEQ ID NO: 1041083 - RNA, 19 nt, Mycobacterium bovis subsp bovis AF2122/97
cguacccguuaugcgccgc

SEQ ID NO: 1041084 - RNA, 20 nt, Mycobacterium bovis subsp bovis AF2122/97
cguagaccaggcccagguca

SEQ ID NO: 1041085 - RNA, 16 nt, Mycobacterium bovis subsp bovis AF2122/97
cguagaccacgccggu

SEQ ID NO: 1041086 - RNA, 17 nt, Mycobacterium bovis subsp bovis AF2122/97
cguagaccacgccggug

SEQ ID NO: 1041087 - RNA, 18 nt, Mycobacterium bovis subsp bovis AF2122/97
cguagaaugcgccgucgg

SEQ ID NO: 1041088 - RNA, 21 nt, Mycobacterium bovis subsp bovis AF2122/97
cguaccgacgaagaucgcugc

SEQ ID NO: 1041089 - RNA, 15 nt, Mycobacterium bovis subsp bovis AF2122/97
cguacccggcaacgg

SEQ ID NO: 1041090 - RNA, 14 nt, Mycobacterium bovis subsp bovis AF2122/97
cguacccggccugc

SEQ ID NO: 1041091 - RNA, 16 nt, Mycobacterium bovis subsp bovis AF2122/97
cguacugguccgcacg

SEQ ID NO: 1041092 - RNA, 20 nt, Mycobacterium bovis subsp bovis AF2122/97
cguaccacugcucgaugucc

SEQ ID NO: 1041093 - RNA, 15 nt, Mycobacterium bovis subsp bovis AF2122/97
cguacaucagcgcga

SEQ ID NO: 1041094 - RNA, 17 nt, Mycobacterium bovis subsp bovis AF2122/97
cguacaggccggccacc

SEQ ID NO: 1041095 - RNA, 16 nt, Mycobacterium bovis subsp bovis AF2122/97
cguacagugucugcca

SEQ ID NO: 1041096 - RNA, 14 nt, Mycobacterium bovis subsp bovis AF2122/97
cguacauucgggcg

SEQ ID NO: 1041097 - RNA, 23 nt, Mycobacterium bovis subsp bovis AF2122/97
cguacauucgggcgugcucgccg

SEQ ID NO: 1041098 - RNA, 15 nt, Mycobacterium bovis subsp bovis AF2122/97
cguaggacucggcgg

SEQ ID NO: 1041099 - RNA, 12 nt, Mycobacterium bovis subsp bovis AF2122/97
cguagccgccgu

SEQ ID NO: 1041100 - RNA, 13 nt, Mycobacterium bovis subsp bovis AF2122/97
cguagccgccgug

SEQ ID NO: 1041101 - RNA, 22 nt, Mycobacterium bovis subsp bovis AF2122/97
cguagcccaggucgaugcgggc

SEQ ID NO: 1041102 - RNA, 14 nt, Mycobacterium bovis subsp bovis AF2122/97
cguaggcgaugagc

SEQ ID NO: 1041103 - RNA, 23 nt, Mycobacterium bovis subsp bovis AF2122/97
cguaggccuugcucagccggccc

SEQ ID NO: 1041104 - RNA, 21 nt, Mycobacterium bovis subsp bovis AF2122/97
cguaggcaccccggugcccgc

SEQ ID NO: 1041105 - RNA, 19 nt, Mycobacterium bovis subsp bovis AF2122/97
cguaggccacagcccggcg

SEQ ID NO: 1041106 - RNA, 21 nt, Mycobacterium bovis subsp bovis AF2122/97
cguagucggcgaugcgcacca

SEQ ID NO: 1041107 - RNA, 23 nt, Mycobacterium bovis subsp bovis AF2122/97
cguagucgucuucgucauggccg

SEQ ID NO: 1041108 - RNA, 19 nt, Mycobacterium bovis subsp bovis AF2122/97
cguagugaacggcucgggc

SEQ ID NO: 1041109 - RNA, 23 nt, Mycobacterium bovis subsp bovis AF2122/97
cguagugaacggcucgggcagcg

SEQ ID NO: 1041110 - RNA, 14 nt, Mycobacterium bovis subsp bovis AF2122/97
cguagugcaccgcc

SEQ ID NO: 1041111 - RNA, 20 nt, Mycobacterium bovis subsp bovis AF2122/97
cguagugcaccgccugcgcc

SEQ ID NO: 1041112 - RNA, 18 nt, Mycobacterium bovis subsp bovis AF2122/97
cguagugcacgucggcgg

SEQ ID NO: 1041113 - RNA, 20 nt, Mycobacterium bovis subsp bovis AF2122/97
cguagugcacgucggcgggc

SEQ ID NO: 1041114 - RNA, 14 nt, Mycobacterium bovis subsp bovis AF2122/97
cguagucggcaucg

SEQ ID NO: 1041115 - RNA, 16 nt, Mycobacterium bovis subsp bovis AF2122/97
cguagucccacugcca

SEQ ID NO: 1041116 - RNA, 20 nt, Mycobacterium bovis subsp bovis AF2122/97
cguaguccaggccgucguug

SEQ ID NO: 1041117 - RNA, 15 nt, Mycobacterium bovis subsp bovis AF2122/97
cguagucgcugucgg

SEQ ID NO: 1041118 - RNA, 14 nt, Mycobacterium bovis subsp bovis AF2122/97
cguaggcgccgaac

SEQ ID NO: 1041119 - RNA, 16 nt, Mycobacterium bovis subsp bovis AF2122/97
cguaggcgauggcggc

SEQ ID NO: 1041120 - RNA, 23 nt, Mycobacterium bovis subsp bovis AF2122/97
cguaggcgauggcggcgcguucg

SEQ ID NO: 1041121 - RNA, 18 nt, Mycobacterium bovis subsp bovis AF2122/97
cgucaccaaguucagcac

SEQ ID NO: 1041122 - RNA, 13 nt, Mycobacterium bovis subsp bovis AF2122/97
cgucaccgccguu

SEQ ID NO: 1041123 - RNA, 14 nt, Mycobacterium bovis subsp bovis AF2122/97
cgucaccgccguug

SEQ ID NO: 1041124 - RNA, 21 nt, Mycobacterium bovis subsp bovis AF2122/97
cgucaccgccguugccgccgg

SEQ ID NO: 1041125 - RNA, 22 nt, Mycobacterium bovis subsp bovis AF2122/97
cgucaccgccguugccgccggc

SEQ ID NO: 1041126 - RNA, 24 nt, Mycobacterium bovis subsp bovis AF2122/97
cgucaccgccguugccgccggcgc

SEQ ID NO: 1041127 - RNA, 14 nt, Mycobacterium bovis subsp bovis AF2122/97
cgucaccgcgacgg

SEQ ID NO: 1041128 - RNA, 17 nt, Mycobacterium bovis subsp bovis AF2122/97
cgucaccgcgacggaac

SEQ ID NO: 1041129 - RNA, 17 nt, Mycobacterium bovis subsp bovis AF2122/97
cgucaccggucagcgac

SEQ ID NO: 1041130 - RNA, 22 nt, Mycobacterium bovis subsp bovis AF2122/97
cgucaccggaggccgccgcgcc

SEQ ID NO: 1041131 - RNA, 24 nt, Mycobacterium bovis subsp bovis AF2122/97
cgucaccggaggccgccgcgccgg

SEQ ID NO: 1041132 - RNA, 21 nt, Mycobacterium bovis subsp bovis AF2122/97
cgucaccgugggccugcccgg

SEQ ID NO: 1041133 - RNA, 17 nt, Mycobacterium bovis subsp bovis AF2122/97
cgucaccgucaguucgg

SEQ ID NO: 1041134 - RNA, 17 nt, Mycobacterium bovis subsp bovis AF2122/97
cgucaccgucuugcacg

SEQ ID NO: 1041135 - RNA, 19 nt, Mycobacterium bovis subsp bovis AF2122/97
cgucacgaucagggcgaug

SEQ ID NO: 1041136 - RNA, 14 nt, Mycobacterium bovis subsp bovis AF2122/97
cgucacgcaaccgg

SEQ ID NO: 1041137 - RNA, 13 nt, Mycobacterium bovis subsp bovis AF2122/97
cgucacggugcgu

SEQ ID NO: 1041138 - RNA, 13 nt, Mycobacterium bovis subsp bovis AF2122/97
cgucacgucgacg

SEQ ID NO: 1041139 - RNA, 21 nt, Mycobacterium bovis subsp bovis AF2122/97
cgucagcggguaagacgucgg

SEQ ID NO: 1041140 - RNA, 17 nt, Mycobacterium bovis subsp bovis AF2122/97
cgucagcggcggccacg

SEQ ID NO: 1041141 - RNA, 19 nt, Mycobacterium bovis subsp bovis AF2122/97
cgucagcggcggccacggc

SEQ ID NO: 1041142 - RNA, 13 nt, Mycobacterium bovis subsp bovis AF2122/97
cgucagcgccgcc

SEQ ID NO: 1041143 - RNA, 20 nt, Mycobacterium bovis subsp bovis AF2122/97
cgucagcgccgccggaagcg

SEQ ID NO: 1041144 - RNA, 23 nt, Mycobacterium bovis subsp bovis AF2122/97
cgucagcgccgccggaagcgccg

SEQ ID NO: 1041145 - RNA, 14 nt, Mycobacterium bovis subsp bovis AF2122/97
cgucagcgccgcgc

SEQ ID NO: 1041146 - RNA, 14 nt, Mycobacterium bovis subsp bovis AF2122/97
cgucagcgccgcug

SEQ ID NO: 1041147 - RNA, 16 nt, Mycobacterium bovis subsp bovis AF2122/97
cgucagcuccccgucg

SEQ ID NO: 1041148 - RNA, 21 nt, Mycobacterium bovis subsp bovis AF2122/97
cgucagcuuggacccugcgcc

SEQ ID NO: 1041149 - RNA, 14 nt, Mycobacterium bovis subsp bovis AF2122/97
cgucaggaaccacc

SEQ ID NO: 1041150 - RNA, 18 nt, Mycobacterium bovis subsp bovis AF2122/97
cgucaggaaccacccacc

SEQ ID NO: 1041151 - RNA, 22 nt, Mycobacterium bovis subsp bovis AF2122/97
cgucaggaaccacccaccggcc

SEQ ID NO: 1041152 - RNA, 24 nt, Mycobacterium bovis subsp bovis AF2122/97
cgucaggaaccacccaccggccac

SEQ ID NO: 1041153 - RNA, 17 nt, Mycobacterium bovis subsp bovis AF2122/97
cgucagcgcgccgucgg

SEQ ID NO: 1041154 - RNA, 14 nt, Mycobacterium bovis subsp bovis AF2122/97
cgucagcucaccac

SEQ ID NO: 1041155 - RNA, 15 nt, Mycobacterium bovis subsp bovis AF2122/97
cgucagcgucggcgc

SEQ ID NO: 1041156 - RNA, 13 nt, Mycobacterium bovis subsp bovis AF2122/97
cgucagcgucuga

SEQ ID NO: 1041157 - RNA, 15 nt, Mycobacterium bovis subsp bovis AF2122/97
cgucacucaccccaa

SEQ ID NO: 1041158 - RNA, 14 nt, Mycobacterium bovis subsp bovis AF2122/97
cgucagaacaccgg

SEQ ID NO: 1041159 - RNA, 22 nt, Mycobacterium bovis subsp bovis AF2122/97
cgucacgucgacggcggccgcc

SEQ ID NO: 1041160 - RNA, 18 nt, Mycobacterium bovis subsp bovis AF2122/97
cgucacguggucggccac

SEQ ID NO: 1041161 - RNA, 13 nt, Mycobacterium bovis subsp bovis AF2122/97
cgucacucccgac

SEQ ID NO: 1041162 - RNA, 17 nt, Mycobacterium bovis subsp bovis AF2122/97
cguaugacgcccaccga

SEQ ID NO: 1041163 - RNA, 17 nt, Mycobacterium bovis subsp bovis AF2122/97
cgucaagaacgccacga

SEQ ID NO: 1041164 - RNA, 15 nt, Mycobacterium bovis subsp bovis AF2122/97
cgucaagccgggcac

SEQ ID NO: 1041165 - RNA, 15 nt, Mycobacterium bovis subsp bovis AF2122/97
cguaucgggcaacga

SEQ ID NO: 1041166 - RNA, 18 nt, Mycobacterium bovis subsp bovis AF2122/97
cguaucgucgagcaccuu

SEQ ID NO: 1041167 - RNA, 13 nt, Mycobacterium bovis subsp bovis AF2122/97
cgucaccaccgcc

SEQ ID NO: 1041168 - RNA, 18 nt, Mycobacterium bovis subsp bovis AF2122/97
cguaucgugggugccggc

SEQ ID NO: 1041169 - RNA, 14 nt, Mycobacterium bovis subsp bovis AF2122/97
cgucacagccgggu

SEQ ID NO: 1041170 - RNA, 19 nt, Mycobacterium bovis subsp bovis AF2122/97
cgucacagccggguuuggu

SEQ ID NO: 1041171 - RNA, 16 nt, Mycobacterium bovis subsp bovis AF2122/97
cgucacauccgacagc

SEQ ID NO: 1041172 - RNA, 16 nt, Mycobacterium bovis subsp bovis AF2122/97
cgucacaagcugacac

SEQ ID NO: 1041173 - RNA, 15 nt, Mycobacterium bovis subsp bovis AF2122/97
cgucaaucaccaccg

SEQ ID NO: 1041174 - RNA, 17 nt, Mycobacterium bovis subsp bovis AF2122/97
cgucaaucaccaccgcc

SEQ ID NO: 1041175 - RNA, 19 nt, Mycobacterium bovis subsp bovis AF2122/97
cgucaaucaccaccgccag

SEQ ID NO: 1041176 - RNA, 16 nt, Mycobacterium bovis subsp bovis AF2122/97
cgucaauggaaccggu

SEQ ID NO: 1041177 - RNA, 23 nt, Mycobacterium bovis subsp bovis AF2122/97
cgucaaguccuucacugcgaccg

SEQ ID NO: 1041178 - RNA, 19 nt, Mycobacterium bovis subsp bovis AF2122/97
cgucaagucugugcucacg

SEQ ID NO: 1041179 - RNA, 19 nt, Mycobacterium bovis subsp bovis AF2122/97
cguaucacgguugccgcga

SEQ ID NO: 1041180 - RNA, 22 nt, Mycobacterium bovis subsp bovis AF2122/97
cguaucacgguugccgcgaucg

SEQ ID NO: 1041181 - RNA, 23 nt, Mycobacterium bovis subsp bovis AF2122/97
cguaucacgguugccgcgaucgg

SEQ ID NO: 1041182 - RNA, 20 nt, Mycobacterium bovis subsp bovis AF2122/97
cguauccacggucgaccagg

SEQ ID NO: 1041183 - RNA, 19 nt, Mycobacterium bovis subsp bovis AF2122/97
cguauagcaugccgcggcg

SEQ ID NO: 1041184 - RNA, 14 nt, Mycobacterium bovis subsp bovis AF2122/97
cguagugcgcgcca

SEQ ID NO: 1041185 - RNA, 14 nt, Mycobacterium bovis subsp bovis AF2122/97
cguauacccgggcg

SEQ ID NO: 1041186 - RNA, 14 nt, Mycobacterium bovis subsp bovis AF2122/97
cguaguggccggcu

SEQ ID NO: 1041187 - RNA, 21 nt, Mycobacterium bovis subsp bovis AF2122/97
cguaguugccggcuucggcga

SEQ ID NO: 1041188 - RNA, 22 nt, Mycobacterium bovis subsp bovis AF2122/97
cguaguugccggcuucggcgag

SEQ ID NO: 1041189 - RNA, 24 nt, Mycobacterium bovis subsp bovis AF2122/97
cguaguugccggcuucggcgagcg

SEQ ID NO: 1041190 - RNA, 16 nt, Mycobacterium bovis subsp bovis AF2122/97
cgucauacagcgcccu

SEQ ID NO: 1041191 - RNA, 13 nt, Mycobacterium bovis subsp bovis AF2122/97
cgucauacccagc

SEQ ID NO: 1041192 - RNA, 18 nt, Mycobacterium bovis subsp bovis AF2122/97
cgucauacucgacaccga

SEQ ID NO: 1041193 - RNA, 21 nt, Mycobacterium bovis subsp bovis AF2122/97
cgucaguucggugugcggcgc

SEQ ID NO: 1041194 - RNA, 13 nt, Mycobacterium bovis subsp bovis AF2122/97
cgucaggccagcg

SEQ ID NO: 1041195 - RNA, 14 nt, Mycobacterium bovis subsp bovis AF2122/97
cgucaggccagcgc

SEQ ID NO: 1041196 - RNA, 20 nt, Mycobacterium bovis subsp bovis AF2122/97
cgucaggcagcuccgccgcc

SEQ ID NO: 1041197 - RNA, 22 nt, Mycobacterium bovis subsp bovis AF2122/97
cgucaggcagcuccgccgccga

SEQ ID NO: 1041198 - RNA, 17 nt, Mycobacterium bovis subsp bovis AF2122/97
cgucaggccagagucgc

SEQ ID NO: 1041199 - RNA, 19 nt, Mycobacterium bovis subsp bovis AF2122/97
cgucagcucaccacccaga

SEQ ID NO: 1041200 - RNA, 21 nt, Mycobacterium bovis subsp bovis AF2122/97
cgucagucaacucaccgucgg

SEQ ID NO: 1041201 - RNA, 14 nt, Mycobacterium bovis subsp bovis AF2122/97
cgucagugccccgc

SEQ ID NO: 1041202 - RNA, 18 nt, Mycobacterium bovis subsp bovis AF2122/97
cgucagugccccgcagca

SEQ ID NO: 1041203 - RNA, 20 nt, Mycobacterium bovis subsp bovis AF2122/97
cgucagugccccgcagcacu

SEQ ID NO: 1041204 - RNA, 16 nt, Mycobacterium bovis subsp bovis AF2122/97
cgucaguagccacgcc

SEQ ID NO: 1041205 - RNA, 13 nt, Mycobacterium bovis subsp bovis AF2122/97
cgucccagcgcgg

SEQ ID NO: 1041206 - RNA, 16 nt, Mycobacterium bovis subsp bovis AF2122/97
cgucccagcgcggugu

SEQ ID NO: 1041207 - RNA, 20 nt, Mycobacterium bovis subsp bovis AF2122/97
cgucccagucccgcgucgga

SEQ ID NO: 1041208 - RNA, 17 nt, Mycobacterium bovis subsp bovis AF2122/97
cgucccagggcacaucg

SEQ ID NO: 1041209 - RNA, 17 nt, Mycobacterium bovis subsp bovis AF2122/97
cgucccagcgguagccg

SEQ ID NO: 1041210 - RNA, 20 nt, Mycobacterium bovis subsp bovis AF2122/97
cgucccaggacuccggccgc

SEQ ID NO: 1041211 - RNA, 16 nt, Mycobacterium bovis subsp bovis AF2122/97
cgucccggcucgagcu

SEQ ID NO: 1041212 - RNA, 19 nt, Mycobacterium bovis subsp bovis AF2122/97
cgucccggcggucagcggc

SEQ ID NO: 1041213 - RNA, 14 nt, Mycobacterium bovis subsp bovis AF2122/97
cgucccggcucgag

SEQ ID NO: 1041214 - RNA, 12 nt, Mycobacterium bovis subsp bovis AF2122/97
cgucccggccuc

SEQ ID NO: 1041215 - RNA, 15 nt, Mycobacterium bovis subsp bovis AF2122/97
cgucccggcgaccgg

SEQ ID NO: 1041216 - RNA, 17 nt, Mycobacterium bovis subsp bovis AF2122/97
cgucccggcgaccgggu

SEQ ID NO: 1041217 - RNA, 16 nt, Mycobacterium bovis subsp bovis AF2122/97
cguccaucgccaccgc

SEQ ID NO: 1041218 - RNA, 18 nt, Mycobacterium bovis subsp bovis AF2122/97
cguccaucgccaccgcgu

SEQ ID NO: 1041219 - RNA, 19 nt, Mycobacterium bovis subsp bovis AF2122/97
cguccaucgccaccgcguc

SEQ ID NO: 1041220 - RNA, 17 nt, Mycobacterium bovis subsp bovis AF2122/97
cguccaucgcgcgccga

SEQ ID NO: 1041221 - RNA, 14 nt, Mycobacterium bovis subsp bovis AF2122/97
cguccauggucgcg

SEQ ID NO: 1041222 - RNA, 20 nt, Mycobacterium bovis subsp bovis AF2122/97
cgucccaaugcaacaaggca

SEQ ID NO: 1041223 - RNA, 17 nt, Mycobacterium bovis subsp bovis AF2122/97
cgucccagccgaucacg

SEQ ID NO: 1041224 - RNA, 16 nt, Mycobacterium bovis subsp bovis AF2122/97
cguccucgcuggauca

SEQ ID NO: 1041225 - RNA, 20 nt, Mycobacterium bovis subsp bovis AF2122/97
cguccgggcagaugaugccg

SEQ ID NO: 1041226 - RNA, 13 nt, Mycobacterium bovis subsp bovis AF2122/97
cguccucgccgca

SEQ ID NO: 1041227 - RNA, 18 nt, Mycobacterium bovis subsp bovis AF2122/97
cguccugaaucgguucgg

SEQ ID NO: 1041228 - RNA, 21 nt, Mycobacterium bovis subsp bovis AF2122/97
cguccugaaucgguucggcca

SEQ ID NO: 1041229 - RNA, 20 nt, Mycobacterium bovis subsp bovis AF2122/97
cguccuccccuacugcguug

SEQ ID NO: 1041230 - RNA, 18 nt, Mycobacterium bovis subsp bovis AF2122/97
cguccggcuuggcggcga

SEQ ID NO: 1041231 - RNA, 15 nt, Mycobacterium bovis subsp bovis AF2122/97
cguccgggcggccuc

SEQ ID NO: 1041232 - RNA, 16 nt, Mycobacterium bovis subsp bovis AF2122/97
cguccggaucggucgg

SEQ ID NO: 1041233 - RNA, 17 nt, Mycobacterium bovis subsp bovis AF2122/97
cguccgacaacgacugc

SEQ ID NO: 1041234 - RNA, 18 nt, Mycobacterium bovis subsp bovis AF2122/97
cguccggaucggucggca

SEQ ID NO: 1041235 - RNA, 22 nt, Mycobacterium bovis subsp bovis AF2122/97
cguccgcugguggucagcaccc

SEQ ID NO: 1041236 - RNA, 16 nt, Mycobacterium bovis subsp bovis AF2122/97
cgucccugugucgccg

SEQ ID NO: 1041237 - RNA, 16 nt, Mycobacterium bovis subsp bovis AF2122/97
cgucgaccgaacccga

SEQ ID NO: 1041238 - RNA, 23 nt, Mycobacterium bovis subsp bovis AF2122/97
cgucgacccgaacugggcgaucg

SEQ ID NO: 1041239 - RNA, 18 nt, Mycobacterium bovis subsp bovis AF2122/97
cgucgacaacaaacccgg

SEQ ID NO: 1041240 - RNA, 19 nt, Mycobacterium bovis subsp bovis AF2122/97
cgucgacaacacgccgucg

SEQ ID NO: 1041241 - RNA, 20 nt, Mycobacterium bovis subsp bovis AF2122/97
cgucgacaacacgccgucga

SEQ ID NO: 1041242 - RNA, 19 nt, Mycobacterium bovis subsp bovis AF2122/97
cgucgacacacccaccgga

SEQ ID NO: 1041243 - RNA, 22 nt, Mycobacterium bovis subsp bovis AF2122/97
cgucgacacacccaccggacca

SEQ ID NO: 1041244 - RNA, 13 nt, Mycobacterium bovis subsp bovis AF2122/97
cgucgaccgcgcc

SEQ ID NO: 1041245 - RNA, 13 nt, Mycobacterium bovis subsp bovis AF2122/97
cgucgaccgcggc

SEQ ID NO: 1041246 - RNA, 17 nt, Mycobacterium bovis subsp bovis AF2122/97
cgucgaccgcggcccgg

SEQ ID NO: 1041247 - RNA, 13 nt, Mycobacterium bovis subsp bovis AF2122/97
cgucgaccggaac

SEQ ID NO: 1041248 - RNA, 13 nt, Mycobacterium bovis subsp bovis AF2122/97
cgucgaccggcgg

SEQ ID NO: 1041249 - RNA, 17 nt, Mycobacterium bovis subsp bovis AF2122/97
cgucgaccgugucaccg

SEQ ID NO: 1041250 - RNA, 19 nt, Mycobacterium bovis subsp bovis AF2122/97
cgucgaccgugucaccgcc

SEQ ID NO: 1041251 - RNA, 21 nt, Mycobacterium bovis subsp bovis AF2122/97
cgucgaccgugucaccgccgg

SEQ ID NO: 1041252 - RNA, 16 nt, Mycobacterium bovis subsp bovis AF2122/97
cgucgaccuccaccaa

SEQ ID NO: 1041253 - RNA, 24 nt, Mycobacterium bovis subsp bovis AF2122/97
cgucgacccgaacugggcgaucga

SEQ ID NO: 1041254 - RNA, 13 nt, Mycobacterium bovis subsp bovis AF2122/97
cgucgaccgacgg

SEQ ID NO: 1041255 - RNA, 14 nt, Mycobacterium bovis subsp bovis AF2122/97
cgucgacggcugcg

SEQ ID NO: 1041256 - RNA, 21 nt, Mycobacterium bovis subsp bovis AF2122/97
cgucgacgucggcaucggcgg

SEQ ID NO: 1041257 - RNA, 16 nt, Mycobacterium bovis subsp bovis AF2122/97
cgucgacgucggcgag

SEQ ID NO: 1041258 - RNA, 15 nt, Mycobacterium bovis subsp bovis AF2122/97
cgucgacgucgaugg

SEQ ID NO: 1041259 - RNA, 16 nt, Mycobacterium bovis subsp bovis AF2122/97
cgucgacgucgauggu

SEQ ID NO: 1041260 - RNA, 12 nt, Mycobacterium bovis subsp bovis AF2122/97
cgucgacgucgg

SEQ ID NO: 1041261 - RNA, 12 nt, Mycobacterium bovis subsp bovis AF2122/97
cgucgacgucga

SEQ ID NO: 1041262 - RNA, 16 nt, Mycobacterium bovis subsp bovis AF2122/97
cgucgacgucgacggc

SEQ ID NO: 1041263 - RNA, 17 nt, Mycobacterium bovis subsp bovis AF2122/97
cgucgagccggacaggc

SEQ ID NO: 1041264 - RNA, 18 nt, Mycobacterium bovis subsp bovis AF2122/97
cgucgagccgaucgcccg

SEQ ID NO: 1041265 - RNA, 17 nt, Mycobacterium bovis subsp bovis AF2122/97
cgucgagccgugccucg

SEQ ID NO: 1041266 - RNA, 19 nt, Mycobacterium bovis subsp bovis AF2122/97
cgucgagccgugccucgag

SEQ ID NO: 1041267 - RNA, 16 nt, Mycobacterium bovis subsp bovis AF2122/97
cgucgagcgccggccg

SEQ ID NO: 1041268 - RNA, 18 nt, Mycobacterium bovis subsp bovis AF2122/97
cgucgagcgccggccgcg

SEQ ID NO: 1041269 - RNA, 22 nt, Mycobacterium bovis subsp bovis AF2122/97
cgucgagcgcggugccgccacc

SEQ ID NO: 1041270 - RNA, 23 nt, Mycobacterium bovis subsp bovis AF2122/97
cgucgacuggccguuucggcgcc

SEQ ID NO: 1041271 - RNA, 16 nt, Mycobacterium bovis subsp bovis AF2122/97
cgucgacuucagcggc

SEQ ID NO: 1041272 - RNA, 19 nt, Mycobacterium bovis subsp bovis AF2122/97
cgucgacuucgcccgggga

SEQ ID NO: 1041273 - RNA, 19 nt, Mycobacterium bovis subsp bovis AF2122/97
cgucgacuuguugggcgcg

SEQ ID NO: 1041274 - RNA, 18 nt, Mycobacterium bovis subsp bovis AF2122/97
cgucgacgucgacggcga

SEQ ID NO: 1041275 - RNA, 15 nt, Mycobacterium bovis subsp bovis AF2122/97
cgucgaaauccacaa

SEQ ID NO: 1041276 - RNA, 16 nt, Mycobacterium bovis subsp bovis AF2122/97
cgucgaaauacccggu

SEQ ID NO: 1041277 - RNA, 22 nt, Mycobacterium bovis subsp bovis AF2122/97
cgucgaaauccacaaugcccgg

SEQ ID NO: 1041278 - RNA, 21 nt, Mycobacterium bovis subsp bovis AF2122/97
cgucgaaauggauugcggcac

SEQ ID NO: 1041279 - RNA, 22 nt, Mycobacterium bovis subsp bovis AF2122/97
cgucgaaaagccgugcaccagc

SEQ ID NO: 1041280 - RNA, 23 nt, Mycobacterium bovis subsp bovis AF2122/97
cgucgaaaagccgugcaccagcg

SEQ ID NO: 1041281 - RNA, 23 nt, Mycobacterium bovis subsp bovis AF2122/97
cgucgaaggugaccaggcggacg

SEQ ID NO: 1041282 - RNA, 18 nt, Mycobacterium bovis subsp bovis AF2122/97
cgucgaagggaucacgac

SEQ ID NO: 1041283 - RNA, 18 nt, Mycobacterium bovis subsp bovis AF2122/97
cgucgaacagcaccgccg

SEQ ID NO: 1041284 - RNA, 17 nt, Mycobacterium bovis subsp bovis AF2122/97
cgucgacaaacagcgcc

SEQ ID NO: 1041285 - RNA, 15 nt, Mycobacterium bovis subsp bovis AF2122/97
cgucgaauccucgcg

SEQ ID NO: 1041286 - RNA, 21 nt, Mycobacterium bovis subsp bovis AF2122/97
cgucgaaguuggcgaagcccg

SEQ ID NO: 1041287 - RNA, 20 nt, Mycobacterium bovis subsp bovis AF2122/97
cgucgaaguagccgacgucg

SEQ ID NO: 1041288 - RNA, 14 nt, Mycobacterium bovis subsp bovis AF2122/97
cguccuugcgcagc

SEQ ID NO: 1041289 - RNA, 21 nt, Mycobacterium bovis subsp bovis AF2122/97
cguccuggugagauugguggc

SEQ ID NO: 1041290 - RNA, 15 nt, Mycobacterium bovis subsp bovis AF2122/97
cguccuucgcuggua

SEQ ID NO: 1041291 - RNA, 17 nt, Mycobacterium bovis subsp bovis AF2122/97
cguccuucuuguugguc

SEQ ID NO: 1041292 - RNA, 14 nt, Mycobacterium bovis subsp bovis AF2122/97
cguccugguggcgg

SEQ ID NO: 1041293 - RNA, 20 nt, Mycobacterium bovis subsp bovis AF2122/97
cguccugccaguccgcagcg

SEQ ID NO: 1041294 - RNA, 11 nt, Mycobacterium bovis subsp bovis AF2122/97
cguccugcgag

SEQ ID NO: 1041295 - RNA, 17 nt, Mycobacterium bovis subsp bovis AF2122/97
cguccugcccgucgucg

SEQ ID NO: 1041296 - RNA, 22 nt, Mycobacterium bovis subsp bovis AF2122/97
cguccugcccgucgucggcaac

SEQ ID NO: 1041297 - RNA, 23 nt, Mycobacterium bovis subsp bovis AF2122/97
cguccugcggguaggugacgacg

SEQ ID NO: 1041298 - RNA, 23 nt, Mycobacterium bovis subsp bovis AF2122/97
cguccugcgagaggugcugcacc

SEQ ID NO: 1041299 - RNA, 14 nt, Mycobacterium bovis subsp bovis AF2122/97
cgucgcgacgucgg

SEQ ID NO: 1041300 - RNA, 18 nt, Mycobacterium bovis subsp bovis AF2122/97
cgucgcgacgucggccgu

SEQ ID NO: 1041301 - RNA, 17 nt, Mycobacterium bovis subsp bovis AF2122/97
cgucgcgcugccggccg

SEQ ID NO: 1041302 - RNA, 19 nt, Mycobacterium bovis subsp bovis AF2122/97
cgucgcgcugccggccgcg

SEQ ID NO: 1041303 - RNA, 16 nt, Mycobacterium bovis subsp bovis AF2122/97
cgucgcggaucagccc

SEQ ID NO: 1041304 - RNA, 18 nt, Mycobacterium bovis subsp bovis AF2122/97
cgucgcggaucagcccgc

SEQ ID NO: 1041305 - RNA, 16 nt, Mycobacterium bovis subsp bovis AF2122/97
cgucgcggaaucgcga

SEQ ID NO: 1041306 - RNA, 19 nt, Mycobacterium bovis subsp bovis AF2122/97
cgucgcggaaucgcgacac

SEQ ID NO: 1041307 - RNA, 20 nt, Mycobacterium bovis subsp bovis AF2122/97
cgucgccgucggugccgccg

SEQ ID NO: 1041308 - RNA, 21 nt, Mycobacterium bovis subsp bovis AF2122/97
cgucgccgucggugccgccgc

SEQ ID NO: 1041309 - RNA, 22 nt, Mycobacterium bovis subsp bovis AF2122/97
cgucgccgucggugccgccgcc

SEQ ID NO: 1041310 - RNA, 14 nt, Mycobacterium bovis subsp bovis AF2122/97
cgucgccugcgacu

SEQ ID NO: 1041311 - RNA, 21 nt, Mycobacterium bovis subsp bovis AF2122/97
cgucgcgacgacguagauggu

SEQ ID NO: 1041312 - RNA, 21 nt, Mycobacterium bovis subsp bovis AF2122/97
cgucgccuucguaaccacgac

SEQ ID NO: 1041313 - RNA, 12 nt, Mycobacterium bovis subsp bovis AF2122/97
cgucgccgaccc

SEQ ID NO: 1041314 - RNA, 14 nt, Mycobacterium bovis subsp bovis AF2122/97
cgucgccgacccgg

SEQ ID NO: 1041315 - RNA, 15 nt, Mycobacterium bovis subsp bovis AF2122/97
cgucgccaccaucgu

SEQ ID NO: 1041316 - RNA, 21 nt, Mycobacterium bovis subsp bovis AF2122/97
cgucgccgaucagcugcgcau

SEQ ID NO: 1041317 - RNA, 13 nt, Mycobacterium bovis subsp bovis AF2122/97
cgucgccgacggu

SEQ ID NO: 1041318 - RNA, 11 nt, Mycobacterium bovis subsp bovis AF2122/97
cgucgccgacg

SEQ ID NO: 1041319 - RNA, 16 nt, Mycobacterium bovis subsp bovis AF2122/97
cgucgccgacgccggu

SEQ ID NO: 1041320 - RNA, 12 nt, Mycobacterium bovis subsp bovis AF2122/97
cgucgccagggc

SEQ ID NO: 1041321 - RNA, 13 nt, Mycobacterium bovis subsp bovis AF2122/97
cgucgccagggcc

SEQ ID NO: 1041322 - RNA, 16 nt, Mycobacterium bovis subsp bovis AF2122/97
cgucgccagggccgcc

SEQ ID NO: 1041323 - RNA, 17 nt, Mycobacterium bovis subsp bovis AF2122/97
cgucgccgccauugccg

SEQ ID NO: 1041324 - RNA, 20 nt, Mycobacterium bovis subsp bovis AF2122/97
cgucgccgccauugccgccg

SEQ ID NO: 1041325 - RNA, 21 nt, Mycobacterium bovis subsp bovis AF2122/97
cgucgccguacaaccacccac

SEQ ID NO: 1041326 - RNA, 22 nt, Mycobacterium bovis subsp bovis AF2122/97
cgucgccguacaaccacccacc

SEQ ID NO: 1041327 - RNA, 16 nt, Mycobacterium bovis subsp bovis AF2122/97
cgucgccguccagucg

SEQ ID NO: 1041328 - RNA, 17 nt, Mycobacterium bovis subsp bovis AF2122/97
cgucgccguccagucgg

SEQ ID NO: 1041329 - RNA, 19 nt, Mycobacterium bovis subsp bovis AF2122/97
cgucgccgacgguuaccca

SEQ ID NO: 1041330 - RNA, 15 nt, Mycobacterium bovis subsp bovis AF2122/97
cgucgccgcccgugc

SEQ ID NO: 1041331 - RNA, 16 nt, Mycobacterium bovis subsp bovis AF2122/97
cgucgccgccgcuacc

SEQ ID NO: 1041332 - RNA, 12 nt, Mycobacterium bovis subsp bovis AF2122/97
cgucgccgccgg

SEQ ID NO: 1041333 - RNA, 13 nt, Mycobacterium bovis subsp bovis AF2122/97
cgucgccgccggc

SEQ ID NO: 1041334 - RNA, 19 nt, Mycobacterium bovis subsp bovis AF2122/97
cgucgccgcccuggccgcc

SEQ ID NO: 1041335 - RNA, 20 nt, Mycobacterium bovis subsp bovis AF2122/97
cgucgccgcccuggccgccg

SEQ ID NO: 1041336 - RNA, 15 nt, Mycobacterium bovis subsp bovis AF2122/97
cgucgccgccgcggg

SEQ ID NO: 1041337 - RNA, 16 nt, Mycobacterium bovis subsp bovis AF2122/97
cgucgccgccgcgggc

SEQ ID NO: 1041338 - RNA, 19 nt, Mycobacterium bovis subsp bovis AF2122/97
cgucgccgccgcgggcgcc

SEQ ID NO: 1041339 - RNA, 14 nt, Mycobacterium bovis subsp bovis AF2122/97
cgucgccgccgcua

SEQ ID NO: 1041340 - RNA, 23 nt, Mycobacterium bovis subsp bovis AF2122/97
cgucgagcgugcgcacggcgccg

SEQ ID NO: 1041341 - RNA, 12 nt, Mycobacterium bovis subsp bovis AF2122/97
cgucgaucucga

SEQ ID NO: 1041342 - RNA, 12 nt, Mycobacterium bovis subsp bovis AF2122/97
cgucgaucggcu

SEQ ID NO: 1041343 - RNA, 14 nt, Mycobacterium bovis subsp bovis AF2122/97
cgucgaucggcuug

SEQ ID NO: 1041344 - RNA, 14 nt, Mycobacterium bovis subsp bovis AF2122/97
cgucgaucucggcg

SEQ ID NO: 1041345 - RNA, 16 nt, Mycobacterium bovis subsp bovis AF2122/97
cgucgaucucggcgca

SEQ ID NO: 1041346 - RNA, 21 nt, Mycobacterium bovis subsp bovis AF2122/97
cgucgaugagguucaucgccg

SEQ ID NO: 1041347 - RNA, 14 nt, Mycobacterium bovis subsp bovis AF2122/97
cgucgaugaucugc

SEQ ID NO: 1041348 - RNA, 14 nt, Mycobacterium bovis subsp bovis AF2122/97
cgucgaugccggcu

SEQ ID NO: 1041349 - RNA, 19 nt, Mycobacterium bovis subsp bovis AF2122/97
cgucgcaaggcccgcaccg

SEQ ID NO: 1041350 - RNA, 20 nt, Mycobacterium bovis subsp bovis AF2122/97
cgucgcaauaugccacagac

SEQ ID NO: 1041351 - RNA, 23 nt, Mycobacterium bovis subsp bovis AF2122/97
cgucgcacccaacuccaucagcg

SEQ ID NO: 1041352 - RNA, 20 nt, Mycobacterium bovis subsp bovis AF2122/97
cgucgcacccagggcguugg

SEQ ID NO: 1041353 - RNA, 20 nt, Mycobacterium bovis subsp bovis AF2122/97
cgucgaugaucugcuugcca

SEQ ID NO: 1041354 - RNA, 19 nt, Mycobacterium bovis subsp bovis AF2122/97
cgucgccaccgauggcggu

SEQ ID NO: 1041355 - RNA, 16 nt, Mycobacterium bovis subsp bovis AF2122/97
cgucgccaccgguacc

SEQ ID NO: 1041356 - RNA, 14 nt, Mycobacterium bovis subsp bovis AF2122/97
cgucgccaccggua

SEQ ID NO: 1041357 - RNA, 19 nt, Mycobacterium bovis subsp bovis AF2122/97
cgucgccacgaugccggcu

SEQ ID NO: 1041358 - RNA, 18 nt, Mycobacterium bovis subsp bovis AF2122/97
cgucgccacgcccagcgc

SEQ ID NO: 1041359 - RNA, 21 nt, Mycobacterium bovis subsp bovis AF2122/97
cgucgccacgcccagcgcccg

SEQ ID NO: 1041360 - RNA, 14 nt, Mycobacterium bovis subsp bovis AF2122/97
cgucgccaaucugc

SEQ ID NO: 1041361 - RNA, 22 nt, Mycobacterium bovis subsp bovis AF2122/97
cgucgccaaucugcgcgagggg

SEQ ID NO: 1041362 - RNA, 13 nt, Mycobacterium bovis subsp bovis AF2122/97
cgucgccaccgau

SEQ ID NO: 1041363 - RNA, 22 nt, Mycobacterium bovis subsp bovis AF2122/97
cgucgcagaaaccauucggcga

SEQ ID NO: 1041364 - RNA, 16 nt, Mycobacterium bovis subsp bovis AF2122/97
cgucgcacgcgcgcag

SEQ ID NO: 1041365 - RNA, 18 nt, Mycobacterium bovis subsp bovis AF2122/97
cgucgcacgcgcgcaggc

SEQ ID NO: 1041366 - RNA, 23 nt, Mycobacterium bovis subsp bovis AF2122/97
cgucgcacgcgcgcaggccgccg

SEQ ID NO: 1041367 - RNA, 21 nt, Mycobacterium bovis subsp bovis AF2122/97
cgucgcaggauucccagucgc

SEQ ID NO: 1041368 - RNA, 19 nt, Mycobacterium bovis subsp bovis AF2122/97
cgucggcacccucggcguu

SEQ ID NO: 1041369 - RNA, 11 nt, Mycobacterium bovis subsp bovis AF2122/97
cgucggcaccg

SEQ ID NO: 1041370 - RNA, 16 nt, Mycobacterium bovis subsp bovis AF2122/97
cgucggcaccagcagc

SEQ ID NO: 1041371 - RNA, 21 nt, Mycobacterium bovis subsp bovis AF2122/97
cgucggcaccagcagccagcc

SEQ ID NO: 1041372 - RNA, 22 nt, Mycobacterium bovis subsp bovis AF2122/97
cgucggcaauacuccgcugacg

SEQ ID NO: 1041373 - RNA, 15 nt, Mycobacterium bovis subsp bovis AF2122/97
cgucggcaaucucga

SEQ ID NO: 1041374 - RNA, 18 nt, Mycobacterium bovis subsp bovis AF2122/97
cgucggcagcagcggugc

SEQ ID NO: 1041375 - RNA, 22 nt, Mycobacterium bovis subsp bovis AF2122/97
cgucggcagcagcggugcagcc

SEQ ID NO: 1041376 - RNA, 17 nt, Mycobacterium bovis subsp bovis AF2122/97
cgucggcaccgauccug

SEQ ID NO: 1041377 - RNA, 18 nt, Mycobacterium bovis subsp bovis AF2122/97
cgucggcaccgauccugg

SEQ ID NO: 1041378 - RNA, 20 nt, Mycobacterium bovis subsp bovis AF2122/97
cgucggcauugcgcaggaug

SEQ ID NO: 1041379 - RNA, 23 nt, Mycobacterium bovis subsp bovis AF2122/97
cgucggcaugacauacagcgggc

SEQ ID NO: 1041380 - RNA, 15 nt, Mycobacterium bovis subsp bovis AF2122/97
cgucggcaugggccg

SEQ ID NO: 1041381 - RNA, 19 nt, Mycobacterium bovis subsp bovis AF2122/97
cgucggcaugggccggcgc

SEQ ID NO: 1041382 - RNA, 21 nt, Mycobacterium bovis subsp bovis AF2122/97
cgucggcaugggccggcgccg

SEQ ID NO: 1041383 - RNA, 23 nt, Mycobacterium bovis subsp bovis AF2122/97
cgucggcaugggccggcgccgca

SEQ ID NO: 1041384 - RNA, 22 nt, Mycobacterium bovis subsp bovis AF2122/97
cgucggcaggcagcucggcaac

SEQ ID NO: 1041385 - RNA, 14 nt, Mycobacterium bovis subsp bovis AF2122/97
cgucggcaucggcg

SEQ ID NO: 1041386 - RNA, 20 nt, Mycobacterium bovis subsp bovis AF2122/97
cgucggccaccgccugagcg

SEQ ID NO: 1041387 - RNA, 16 nt, Mycobacterium bovis subsp bovis AF2122/97
cgucggccaccgcggc

SEQ ID NO: 1041388 - RNA, 17 nt, Mycobacterium bovis subsp bovis AF2122/97
cgucggccaccgcggcg

SEQ ID NO: 1041389 - RNA, 23 nt, Mycobacterium bovis subsp bovis AF2122/97
cgucggccacccgguccaccgac

SEQ ID NO: 1041390 - RNA, 20 nt, Mycobacterium bovis subsp bovis AF2122/97
cgucggccagcagaucaggu

SEQ ID NO: 1041391 - RNA, 15 nt, Mycobacterium bovis subsp bovis AF2122/97
cgucggccagugcgc

SEQ ID NO: 1041392 - RNA, 19 nt, Mycobacterium bovis subsp bovis AF2122/97
cgucggccagugcguggug

SEQ ID NO: 1041393 - RNA, 13 nt, Mycobacterium bovis subsp bovis AF2122/97
cgucggccaggcc

SEQ ID NO: 1041394 - RNA, 19 nt, Mycobacterium bovis subsp bovis AF2122/97
cgucggccaggccacgggc

SEQ ID NO: 1041395 - RNA, 20 nt, Mycobacterium bovis subsp bovis AF2122/97
cgucggccaggccacgggcg

SEQ ID NO: 1041396 - RNA, 14 nt, Mycobacterium bovis subsp bovis AF2122/97
cgucggccaggauc

SEQ ID NO: 1041397 - RNA, 15 nt, Mycobacterium bovis subsp bovis AF2122/97
cgucggcccggugcu

SEQ ID NO: 1041398 - RNA, 16 nt, Mycobacterium bovis subsp bovis AF2122/97
cgucggccgacaccgc

SEQ ID NO: 1041399 - RNA, 21 nt, Mycobacterium bovis subsp bovis AF2122/97
cgucggccgacaccgccacca

SEQ ID NO: 1041400 - RNA, 23 nt, Mycobacterium bovis subsp bovis AF2122/97
cgucggccgagucgauugccacc

SEQ ID NO: 1041401 - RNA, 20 nt, Mycobacterium bovis subsp bovis AF2122/97
cgucggcccauaacagcugg

SEQ ID NO: 1041402 - RNA, 15 nt, Mycobacterium bovis subsp bovis AF2122/97
cgucggccggcaacg

SEQ ID NO: 1041403 - RNA, 21 nt, Mycobacterium bovis subsp bovis AF2122/97
cgucggccggcaacgugcggu

SEQ ID NO: 1041404 - RNA, 17 nt, Mycobacterium bovis subsp bovis AF2122/97
cgucggaguaccgcgcg

SEQ ID NO: 1041405 - RNA, 20 nt, Mycobacterium bovis subsp bovis AF2122/97
cgucggaguaccgcgcguug

SEQ ID NO: 1041406 - RNA, 17 nt, Mycobacterium bovis subsp bovis AF2122/97
cgucggauccgcccgcc

SEQ ID NO: 1041407 - RNA, 22 nt, Mycobacterium bovis subsp bovis AF2122/97
cgucggauggaaggcggccagg

SEQ ID NO: 1041408 - RNA, 17 nt, Mycobacterium bovis subsp bovis AF2122/97
cgucggacagcuuuccg

SEQ ID NO: 1041409 - RNA, 17 nt, Mycobacterium bovis subsp bovis AF2122/97
cgucgcuggccggcacc

SEQ ID NO: 1041410 - RNA, 18 nt, Mycobacterium bovis subsp bovis AF2122/97
cgucggaauacaacagcu

SEQ ID NO: 1041411 - RNA, 15 nt, Mycobacterium bovis subsp bovis AF2122/97
cgucggaccagcugc

SEQ ID NO: 1041412 - RNA, 16 nt, Mycobacterium bovis subsp bovis AF2122/97
cgucggaccagcugcc

SEQ ID NO: 1041413 - RNA, 16 nt, Mycobacterium bovis subsp bovis AF2122/97
cgucggagaccagcuc

SEQ ID NO: 1041414 - RNA, 16 nt, Mycobacterium bovis subsp bovis AF2122/97
cgucgcugguggcggu

SEQ ID NO: 1041415 - RNA, 18 nt, Mycobacterium bovis subsp bovis AF2122/97
cgucgcugguggcgguca

SEQ ID NO: 1041416 - RNA, 22 nt, Mycobacterium bovis subsp bovis AF2122/97
cgucgcugguggcggucaccac

SEQ ID NO: 1041417 - RNA, 22 nt, Mycobacterium bovis subsp bovis AF2122/97
cgucgcuggugggaucgcagcg

SEQ ID NO: 1041418 - RNA, 18 nt, Mycobacterium bovis subsp bovis AF2122/97
cgucgcuguaggccagcc

SEQ ID NO: 1041419 - RNA, 23 nt, Mycobacterium bovis subsp bovis AF2122/97
cgucgcuguaggccagcccggcg

SEQ ID NO: 1041420 - RNA, 20 nt, Mycobacterium bovis subsp bovis AF2122/97
cgucgcuguaggcgauaucg

SEQ ID NO: 1041421 - RNA, 20 nt, Mycobacterium bovis subsp bovis AF2122/97
cgucggaaauuccaagcggc

SEQ ID NO: 1041422 - RNA, 19 nt, Mycobacterium bovis subsp bovis AF2122/97
cgucggaacugaccacguc

SEQ ID NO: 1041423 - RNA, 16 nt, Mycobacterium bovis subsp bovis AF2122/97
cgucgcuucggcaccg

SEQ ID NO: 1041424 - RNA, 21 nt, Mycobacterium bovis subsp bovis AF2122/97
cgucgcuucggcaccgacugc

SEQ ID NO: 1041425 - RNA, 22 nt, Mycobacterium bovis subsp bovis AF2122/97
cgucgcugcccaucacacccgg

SEQ ID NO: 1041426 - RNA, 18 nt, Mycobacterium bovis subsp bovis AF2122/97
cgucgcugcccaugcggc

SEQ ID NO: 1041427 - RNA, 21 nt, Mycobacterium bovis subsp bovis AF2122/97
cgucgcugcccaugcggcagg

SEQ ID NO: 1041428 - RNA, 19 nt, Mycobacterium bovis subsp bovis AF2122/97
cgucgcugcccgcgcggcc

SEQ ID NO: 1041429 - RNA, 16 nt, Mycobacterium bovis subsp bovis AF2122/97
cgucgcugccgccacc

SEQ ID NO: 1041430 - RNA, 21 nt, Mycobacterium bovis subsp bovis AF2122/97
cgucgcugggaggcgcggucg

SEQ ID NO: 1041431 - RNA, 21 nt, Mycobacterium bovis subsp bovis AF2122/97
cgucgcugaauuucgaugagg

SEQ ID NO: 1041432 - RNA, 14 nt, Mycobacterium bovis subsp bovis AF2122/97
cgucgcugaccgcg

SEQ ID NO: 1041433 - RNA, 23 nt, Mycobacterium bovis subsp bovis AF2122/97
cgucgcugaaaucgguggccacc

SEQ ID NO: 1041434 - RNA, 19 nt, Mycobacterium bovis subsp bovis AF2122/97
cgucgcucgaauacaccuu

SEQ ID NO: 1041435 - RNA, 20 nt, Mycobacterium bovis subsp bovis AF2122/97
cgucgcucgucgucaccgau

SEQ ID NO: 1041436 - RNA, 17 nt, Mycobacterium bovis subsp bovis AF2122/97
cgucgcugagcacggcg

SEQ ID NO: 1041437 - RNA, 17 nt, Mycobacterium bovis subsp bovis AF2122/97
cgucgcugagcagcgcc

SEQ ID NO: 1041438 - RNA, 18 nt, Mycobacterium bovis subsp bovis AF2122/97
cgucgcugagcagcgccg

SEQ ID NO: 1041439 - RNA, 19 nt, Mycobacterium bovis subsp bovis AF2122/97
cgucgcggccacggucagc

SEQ ID NO: 1041440 - RNA, 15 nt, Mycobacterium bovis subsp bovis AF2122/97
cgucgcggcccgcga

SEQ ID NO: 1041441 - RNA, 16 nt, Mycobacterium bovis subsp bovis AF2122/97
cgucgcggccgcggcc

SEQ ID NO: 1041442 - RNA, 14 nt, Mycobacterium bovis subsp bovis AF2122/97
cgucgcggccggcg

SEQ ID NO: 1041443 - RNA, 18 nt, Mycobacterium bovis subsp bovis AF2122/97
cgucgcggccggcggccg

SEQ ID NO: 1041444 - RNA, 18 nt, Mycobacterium bovis subsp bovis AF2122/97
cgucgcggccgucgcggg

SEQ ID NO: 1041445 - RNA, 18 nt, Mycobacterium bovis subsp bovis AF2122/97
cgucgcuaucgugcgccg

SEQ ID NO: 1041446 - RNA, 23 nt, Mycobacterium bovis subsp bovis AF2122/97
cgucgcuaucgugcgccgacggu

SEQ ID NO: 1041447 - RNA, 15 nt, Mycobacterium bovis subsp bovis AF2122/97
cgucgcuaugcgccg

SEQ ID NO: 1041448 - RNA, 17 nt, Mycobacterium bovis subsp bovis AF2122/97
cgucgcuaugcgccgca

SEQ ID NO: 1041449 - RNA, 18 nt, Mycobacterium bovis subsp bovis AF2122/97
cgucgcuaugcgccgcau

SEQ ID NO: 1041450 - RNA, 22 nt, Mycobacterium bovis subsp bovis AF2122/97
cgucgcguucuccggcaccggu

SEQ ID NO: 1041451 - RNA, 14 nt, Mycobacterium bovis subsp bovis AF2122/97
cgucgcggccagca

SEQ ID NO: 1041452 - RNA, 16 nt, Mycobacterium bovis subsp bovis AF2122/97
cgucgcuagggugagc

SEQ ID NO: 1041453 - RNA, 14 nt, Mycobacterium bovis subsp bovis AF2122/97
cgugccgggaccgg

SEQ ID NO: 1041454 - RNA, 17 nt, Mycobacterium bovis subsp bovis AF2122/97
cgugccgggaccggugu

SEQ ID NO: 1041455 - RNA, 13 nt, Mycobacterium bovis subsp bovis AF2122/97
cgugccggcagcg

SEQ ID NO: 1041456 - RNA, 12 nt, Mycobacterium bovis subsp bovis AF2122/97
cgugccgcggcg

SEQ ID NO: 1041457 - RNA, 17 nt, Mycobacterium bovis subsp bovis AF2122/97
cgugccgggcgacgguu

SEQ ID NO: 1041458 - RNA, 15 nt, Mycobacterium bovis subsp bovis AF2122/97
cgugccgggcgacgg

SEQ ID NO: 1041459 - RNA, 16 nt, Mycobacterium bovis subsp bovis AF2122/97
cgugccgggcgacggu

SEQ ID NO: 1041460 - RNA, 13 nt, Mycobacterium bovis subsp bovis AF2122/97
cgugccggcguug

SEQ ID NO: 1041461 - RNA, 14 nt, Mycobacterium bovis subsp bovis AF2122/97
cgugccgggccaga

SEQ ID NO: 1041462 - RNA, 18 nt, Mycobacterium bovis subsp bovis AF2122/97
cgugccgucgccuccagc

SEQ ID NO: 1041463 - RNA, 20 nt, Mycobacterium bovis subsp bovis AF2122/97
cgugccguugaagcccaaca

SEQ ID NO: 1041464 - RNA, 21 nt, Mycobacterium bovis subsp bovis AF2122/97
cgugccucgaggacggcguag

SEQ ID NO: 1041465 - RNA, 21 nt, Mycobacterium bovis subsp bovis AF2122/97
cgugccucggacaaagccguc

SEQ ID NO: 1041466 - RNA, 18 nt, Mycobacterium bovis subsp bovis AF2122/97
cgugccugcaguucggcg

SEQ ID NO: 1041467 - RNA, 16 nt, Mycobacterium bovis subsp bovis AF2122/97
cgugccgucggcgugc

SEQ ID NO: 1041468 - RNA, 14 nt, Mycobacterium bovis subsp bovis AF2122/97
cgugccgggucacc

SEQ ID NO: 1041469 - RNA, 15 nt, Mycobacterium bovis subsp bovis AF2122/97
cgugccgggucaccg

SEQ ID NO: 1041470 - RNA, 17 nt, Mycobacterium bovis subsp bovis AF2122/97
cgugccgguuuggccga

SEQ ID NO: 1041471 - RNA, 17 nt, Mycobacterium bovis subsp bovis AF2122/97
cgugccguacgcccagg

SEQ ID NO: 1041472 - RNA, 15 nt, Mycobacterium bovis subsp bovis AF2122/97
cgugccgcccucacc

SEQ ID NO: 1041473 - RNA, 11 nt, Mycobacterium bovis subsp bovis AF2122/97
cgugccgccga

SEQ ID NO: 1041474 - RNA, 18 nt, Mycobacterium bovis subsp bovis AF2122/97
cgugcagguagguauagc

SEQ ID NO: 1041475 - RNA, 15 nt, Mycobacterium bovis subsp bovis AF2122/97
cgugcaggcgacggc

SEQ ID NO: 1041476 - RNA, 12 nt, Mycobacterium bovis subsp bovis AF2122/97
cgugcaggcgca

SEQ ID NO: 1041477 - RNA, 23 nt, Mycobacterium bovis subsp bovis AF2122/97
cgugcaggcugguuucggccgca

SEQ ID NO: 1041478 - RNA, 16 nt, Mycobacterium bovis subsp bovis AF2122/97
cgugcgucggcccggu

SEQ ID NO: 1041479 - RNA, 20 nt, Mycobacterium bovis subsp bovis AF2122/97
cgugcgugggcgcggcgcca

SEQ ID NO: 1041480 - RNA, 22 nt, Mycobacterium bovis subsp bovis AF2122/97
cgugcucacggcaggcggugaa

SEQ ID NO: 1041481 - RNA, 17 nt, Mycobacterium bovis subsp bovis AF2122/97
cgugcuacccauucggc

SEQ ID NO: 1041482 - RNA, 21 nt, Mycobacterium bovis subsp bovis AF2122/97
cgugcucgccguaagcaccag

SEQ ID NO: 1041483 - RNA, 14 nt, Mycobacterium bovis subsp bovis AF2122/97
cgugcucggaggcg

SEQ ID NO: 1041484 - RNA, 13 nt, Mycobacterium bovis subsp bovis AF2122/97
cgugcucgccgua

SEQ ID NO: 1041485 - RNA, 15 nt, Mycobacterium bovis subsp bovis AF2122/97
cgugcgucgauggcg

SEQ ID NO: 1041486 - RNA, 14 nt, Mycobacterium bovis subsp bovis AF2122/97
cgugcggucguugg

SEQ ID NO: 1041487 - RNA, 18 nt, Mycobacterium bovis subsp bovis AF2122/97
cgugcgguggcgcgcagc

SEQ ID NO: 1041488 - RNA, 22 nt, Mycobacterium bovis subsp bovis AF2122/97
cgugcggucauauaggagcggg

SEQ ID NO: 1041489 - RNA, 23 nt, Mycobacterium bovis subsp bovis AF2122/97
cgugcgggggacgggucgccgcc

SEQ ID NO: 1041490 - RNA, 14 nt, Mycobacterium bovis subsp bovis AF2122/97
cgugcgggcaguug

SEQ ID NO: 1041491 - RNA, 14 nt, Mycobacterium bovis subsp bovis AF2122/97
cgugcgggcgggcg

SEQ ID NO: 1041492 - RNA, 18 nt, Mycobacterium bovis subsp bovis AF2122/97
cgugcgggcgggcgucca

SEQ ID NO: 1041493 - RNA, 15 nt, Mycobacterium bovis subsp bovis AF2122/97
cgugccuuccucgcc

SEQ ID NO: 1041494 - RNA, 18 nt, Mycobacterium bovis subsp bovis AF2122/97
cgugccuuccucgccgga

SEQ ID NO: 1041495 - RNA, 16 nt, Mycobacterium bovis subsp bovis AF2122/97
cgugccuggccggugc

SEQ ID NO: 1041496 - RNA, 19 nt, Mycobacterium bovis subsp bovis AF2122/97
cgugccuggccggugcgca

SEQ ID NO: 1041497 - RNA, 21 nt, Mycobacterium bovis subsp bovis AF2122/97
cgugcgacuucgagauugccg

SEQ ID NO: 1041498 - RNA, 17 nt, Mycobacterium bovis subsp bovis AF2122/97
cgugcgagggcacggcg

SEQ ID NO: 1041499 - RNA, 17 nt, Mycobacterium bovis subsp bovis AF2122/97
cgugcggcucgccggcg

SEQ ID NO: 1041500 - RNA, 14 nt, Mycobacterium bovis subsp bovis AF2122/97
cgugcggcggccca

SEQ ID NO: 1041501 - RNA, 13 nt, Mycobacterium bovis subsp bovis AF2122/97
cgugcggcggccu

SEQ ID NO: 1041502 - RNA, 14 nt, Mycobacterium bovis subsp bovis AF2122/97
cgugcggcggccuc

SEQ ID NO: 1041503 - RNA, 14 nt, Mycobacterium bovis subsp bovis AF2122/97
cgugcgaucaccuc

SEQ ID NO: 1041504 - RNA, 16 nt, Mycobacterium bovis subsp bovis AF2122/97
cgugcgaucaccuccg

SEQ ID NO: 1041505 - RNA, 21 nt, Mycobacterium bovis subsp bovis AF2122/97
cgugcgaucaccuccgcgacg

SEQ ID NO: 1041506 - RNA, 13 nt, Mycobacterium bovis subsp bovis AF2122/97
cgugcgcacggcg

SEQ ID NO: 1041507 - RNA, 17 nt, Mycobacterium bovis subsp bovis AF2122/97
cgugcgaugcagcgcgc

SEQ ID NO: 1041508 - RNA, 17 nt, Mycobacterium bovis subsp bovis AF2122/97
cgugcaggaucggcuug

SEQ ID NO: 1041509 - RNA, 21 nt, Mycobacterium bovis subsp bovis AF2122/97
cgugcaggaccagcaccgccg

SEQ ID NO: 1041510 - RNA, 22 nt, Mycobacterium bovis subsp bovis AF2122/97
cgugcaggaccagcaccgccgc

SEQ ID NO: 1041511 - RNA, 17 nt, Mycobacterium bovis subsp bovis AF2122/97
cgugcaggaacacccau

SEQ ID NO: 1041512 - RNA, 23 nt, Mycobacterium bovis subsp bovis AF2122/97
cgugcagccgcaggugggcguug

SEQ ID NO: 1041513 - RNA, 21 nt, Mycobacterium bovis subsp bovis AF2122/97
cgugcagccauugacggucca

SEQ ID NO: 1041514 - RNA, 20 nt, Mycobacterium bovis subsp bovis AF2122/97
cgugcagcacuuggccagcu

SEQ ID NO: 1041515 - RNA, 15 nt, Mycobacterium bovis subsp bovis AF2122/97
cgugaugcguucggc

SEQ ID NO: 1041516 - RNA, 17 nt, Mycobacterium bovis subsp bovis AF2122/97
cgugaugcguucggccg

SEQ ID NO: 1041517 - RNA, 22 nt, Mycobacterium bovis subsp bovis AF2122/97
cgugaugccacggcgucgcucg

SEQ ID NO: 1041518 - RNA, 22 nt, Mycobacterium bovis subsp bovis AF2122/97
cgugcagaauccguucgacgag

SEQ ID NO: 1041519 - RNA, 14 nt, Mycobacterium bovis subsp bovis AF2122/97
cgugcagacccggu

SEQ ID NO: 1041520 - RNA, 16 nt, Mycobacterium bovis subsp bovis AF2122/97
cgugaugccacggcgu

SEQ ID NO: 1041521 - RNA, 18 nt, Mycobacterium bovis subsp bovis AF2122/97
cgugaugccacggcgucg

SEQ ID NO: 1041522 - RNA, 14 nt, Mycobacterium bovis subsp bovis AF2122/97
cgugaugcggucgc

SEQ ID NO: 1041523 - RNA, 22 nt, Mycobacterium bovis subsp bovis AF2122/97
cgugaucggcgaacccaccgca

SEQ ID NO: 1041524 - RNA, 15 nt, Mycobacterium bovis subsp bovis AF2122/97
cgugaucggcgcccg

SEQ ID NO: 1041525 - RNA, 14 nt, Mycobacterium bovis subsp bovis AF2122/97
cgugaucggcgaac

SEQ ID NO: 1041526 - RNA, 13 nt, Mycobacterium bovis subsp bovis AF2122/97
cgugauccgccga

SEQ ID NO: 1041527 - RNA, 12 nt, Mycobacterium bovis subsp bovis AF2122/97
cgugaucgacga

SEQ ID NO: 1041528 - RNA, 15 nt, Mycobacterium bovis subsp bovis AF2122/97
cgugaucgaggcggc

SEQ ID NO: 1041529 - RNA, 12 nt, Mycobacterium bovis subsp bovis AF2122/97
cgugaucgaccg

SEQ ID NO: 1041530 - RNA, 21 nt, Mycobacterium bovis subsp bovis AF2122/97
cgugaacggcgcgggccacca

SEQ ID NO: 1041531 - RNA, 13 nt, Mycobacterium bovis subsp bovis AF2122/97
cgugauagcgcgu

SEQ ID NO: 1041532 - RNA, 19 nt, Mycobacterium bovis subsp bovis AF2122/97
cgugauacagcucggugca

SEQ ID NO: 1041533 - RNA, 20 nt, Mycobacterium bovis subsp bovis AF2122/97
cgugauacagcucggugcac

SEQ ID NO: 1041534 - RNA, 20 nt, Mycobacterium bovis subsp bovis AF2122/97
cgugauaucagagggccgcg

SEQ ID NO: 1041535 - RNA, 21 nt, Mycobacterium bovis subsp bovis AF2122/97
cgugauauccuuugccgccga

SEQ ID NO: 1041536 - RNA, 19 nt, Mycobacterium bovis subsp bovis AF2122/97
cgugaucaccggcaucccg

SEQ ID NO: 1041537 - RNA, 13 nt, Mycobacterium bovis subsp bovis AF2122/97
cgugaucagguca

SEQ ID NO: 1041538 - RNA, 21 nt, Mycobacterium bovis subsp bovis AF2122/97
cgugauccccgcguucggcgg

SEQ ID NO: 1041539 - RNA, 22 nt, Mycobacterium bovis subsp bovis AF2122/97
cgugaagcccuggccagcgaaa

SEQ ID NO: 1041540 - RNA, 18 nt, Mycobacterium bovis subsp bovis AF2122/97
cgugaggucccggcuggg

SEQ ID NO: 1041541 - RNA, 20 nt, Mycobacterium bovis subsp bovis AF2122/97
cgugaguacucggucaacgu

SEQ ID NO: 1041542 - RNA, 14 nt, Mycobacterium bovis subsp bovis AF2122/97
cgugagucacccgg

SEQ ID NO: 1041543 - RNA, 14 nt, Mycobacterium bovis subsp bovis AF2122/97
cgugagugccggcg

SEQ ID NO: 1041544 - RNA, 15 nt, Mycobacterium bovis subsp bovis AF2122/97
cgugagugccggcgu

SEQ ID NO: 1041545 - RNA, 14 nt, Mycobacterium bovis subsp bovis AF2122/97
cgugacguaccacg

SEQ ID NO: 1041546 - RNA, 17 nt, Mycobacterium bovis subsp bovis AF2122/97
cgugacguagggcagcg

SEQ ID NO: 1041547 - RNA, 18 nt, Mycobacterium bovis subsp bovis AF2122/97
cgugacguagugcaccgc

SEQ ID NO: 1041548 - RNA, 21 nt, Mycobacterium bovis subsp bovis AF2122/97
cgugacguaucgccgcgggcg

SEQ ID NO: 1041549 - RNA, 21 nt, Mycobacterium bovis subsp bovis AF2122/97
cgugaagaugcccuucgucgg

SEQ ID NO: 1041550 - RNA, 22 nt, Mycobacterium bovis subsp bovis AF2122/97
cgugaagaugcccuucgucggc

SEQ ID NO: 1041551 - RNA, 19 nt, Mycobacterium bovis subsp bovis AF2122/97
cgugaagcagacgucaugc

SEQ ID NO: 1041552 - RNA, 17 nt, Mycobacterium bovis subsp bovis AF2122/97
cgugaagggauccggaa

SEQ ID NO: 1041553 - RNA, 16 nt, Mycobacterium bovis subsp bovis AF2122/97
cgugaacacgucgcgg

SEQ ID NO: 1041554 - RNA, 21 nt, Mycobacterium bovis subsp bovis AF2122/97
cgugaacacgucgcgguaggc

SEQ ID NO: 1041555 - RNA, 14 nt, Mycobacterium bovis subsp bovis AF2122/97
cgugaaccgcccgc

SEQ ID NO: 1041556 - RNA, 19 nt, Mycobacterium bovis subsp bovis AF2122/97
cgugaaccgcccgcccuug

SEQ ID NO: 1041557 - RNA, 23 nt, Mycobacterium bovis subsp bovis AF2122/97
cgugaacuguccgggugggcgcu

SEQ ID NO: 1041558 - RNA, 23 nt, Mycobacterium bovis subsp bovis AF2122/97
cgucuuguaggacaagugccggc

SEQ ID NO: 1041559 - RNA, 15 nt, Mycobacterium bovis subsp bovis AF2122/97
cgucuuggcgaucgg

SEQ ID NO: 1041560 - RNA, 21 nt, Mycobacterium bovis subsp bovis AF2122/97
cgucuugcaucagcggcgcca

SEQ ID NO: 1041561 - RNA, 16 nt, Mycobacterium bovis subsp bovis AF2122/97
cgucggugccggggcu

SEQ ID NO: 1041562 - RNA, 22 nt, Mycobacterium bovis subsp bovis AF2122/97
cgucggugccggggcugccgcc

SEQ ID NO: 1041563 - RNA, 14 nt, Mycobacterium bovis subsp bovis AF2122/97
cgucggugccgccg

SEQ ID NO: 1041564 - RNA, 22 nt, Mycobacterium bovis subsp bovis AF2122/97
cgucggugccgccgccggcgcc

SEQ ID NO: 1041565 - RNA, 16 nt, Mycobacterium bovis subsp bovis AF2122/97
cgucggugccgcggac

SEQ ID NO: 1041566 - RNA, 13 nt, Mycobacterium bovis subsp bovis AF2122/97
cgucggugccacc

SEQ ID NO: 1041567 - RNA, 16 nt, Mycobacterium bovis subsp bovis AF2122/97
cgucggugccaccacg

SEQ ID NO: 1041568 - RNA, 17 nt, Mycobacterium bovis subsp bovis AF2122/97
cgucggugaucaccgcg

SEQ ID NO: 1041569 - RNA, 21 nt, Mycobacterium bovis subsp bovis AF2122/97
cgucggugauggagccgguga

SEQ ID NO: 1041570 - RNA, 21 nt, Mycobacterium bovis subsp bovis AF2122/97
cgucggugaccucggcgacca

SEQ ID NO: 1041571 - RNA, 14 nt, Mycobacterium bovis subsp bovis AF2122/97
cgucggugcgcgcg

SEQ ID NO: 1041572 - RNA, 18 nt, Mycobacterium bovis subsp bovis AF2122/97
cgucggugcgcgcggcga

SEQ ID NO: 1041573 - RNA, 20 nt, Mycobacterium bovis subsp bovis AF2122/97
cgucggugggcgugacguag

SEQ ID NO: 1041574 - RNA, 20 nt, Mycobacterium bovis subsp bovis AF2122/97
cgucggugguuuucccgucg

SEQ ID NO: 1041575 - RNA, 18 nt, Mycobacterium bovis subsp bovis AF2122/97
cgucgguguaacccuggc

SEQ ID NO: 1041576 - RNA, 14 nt, Mycobacterium bovis subsp bovis AF2122/97
cgucggugucgaug

SEQ ID NO: 1041577 - RNA, 14 nt, Mycobacterium bovis subsp bovis AF2122/97
cgucggugucgguu

SEQ ID NO: 1041578 - RNA, 16 nt, Mycobacterium bovis subsp bovis AF2122/97
cgucggugugcgcgcc

SEQ ID NO: 1041579 - RNA, 17 nt, Mycobacterium bovis subsp bovis AF2122/97
cgucggugugcgcgcca

SEQ ID NO: 1041580 - RNA, 19 nt, Mycobacterium bovis subsp bovis AF2122/97
cgucggugugcgcgccagg

SEQ ID NO: 1041581 - RNA, 22 nt, Mycobacterium bovis subsp bovis AF2122/97
cgucgguguuccgccgcgcuac

SEQ ID NO: 1041582 - RNA, 18 nt, Mycobacterium bovis subsp bovis AF2122/97
cgucggugggugccagcc

SEQ ID NO: 1041583 - RNA, 21 nt, Mycobacterium bovis subsp bovis AF2122/97
cgucgguuccgggcgcgugga

SEQ ID NO: 1041584 - RNA, 15 nt, Mycobacterium bovis subsp bovis AF2122/97
cgucguaaaccggga

SEQ ID NO: 1041585 - RNA, 16 nt, Mycobacterium bovis subsp bovis AF2122/97
cgucguaaaccgggau

SEQ ID NO: 1041586 - RNA, 22 nt, Mycobacterium bovis subsp bovis AF2122/97
cgucguaaccgucgccugccga

SEQ ID NO: 1041587 - RNA, 17 nt, Mycobacterium bovis subsp bovis AF2122/97
cgucgguugccacgccg

SEQ ID NO: 1041588 - RNA, 19 nt, Mycobacterium bovis subsp bovis AF2122/97
cgucgguugccacgccgcc

SEQ ID NO: 1041589 - RNA, 18 nt, Mycobacterium bovis subsp bovis AF2122/97
cgucguacaccucgagcg

SEQ ID NO: 1041590 - RNA, 19 nt, Mycobacterium bovis subsp bovis AF2122/97
cgucguacaccucgagcgc

SEQ ID NO: 1041591 - RNA, 20 nt, Mycobacterium bovis subsp bovis AF2122/97
cgucggugaacgcgucguug

SEQ ID NO: 1041592 - RNA, 19 nt, Mycobacterium bovis subsp bovis AF2122/97
cgucgggcauggcggcgua

SEQ ID NO: 1041593 - RNA, 23 nt, Mycobacterium bovis subsp bovis AF2122/97
cgucggucaugucggccaccggc

SEQ ID NO: 1041594 - RNA, 22 nt, Mycobacterium bovis subsp bovis AF2122/97
cgucggugaaguagugcucgca

SEQ ID NO: 1041595 - RNA, 20 nt, Mycobacterium bovis subsp bovis AF2122/97
cgucggucaugucggccacc

SEQ ID NO: 1041596 - RNA, 15 nt, Mycobacterium bovis subsp bovis AF2122/97
cgucgggacgccgcc

SEQ ID NO: 1041597 - RNA, 14 nt, Mycobacterium bovis subsp bovis AF2122/97
cgucgggaugcucg

SEQ ID NO: 1041598 - RNA, 20 nt, Mycobacterium bovis subsp bovis AF2122/97
cgucgggcccagccggaccg

SEQ ID NO: 1041599 - RNA, 22 nt, Mycobacterium bovis subsp bovis AF2122/97
cgucgggcccagccggaccgcg

SEQ ID NO: 1041600 - RNA, 20 nt, Mycobacterium bovis subsp bovis AF2122/97
cgucgggcccgaugucgucg

SEQ ID NO: 1041601 - RNA, 21 nt, Mycobacterium bovis subsp bovis AF2122/97
cgucggcgccgaacaccggcu

SEQ ID NO: 1041602 - RNA, 14 nt, Mycobacterium bovis subsp bovis AF2122/97
cgucgggcacaccg

SEQ ID NO: 1041603 - RNA, 22 nt, Mycobacterium bovis subsp bovis AF2122/97
cgucgggcacaccgacgccgcc

SEQ ID NO: 1041604 - RNA, 17 nt, Mycobacterium bovis subsp bovis AF2122/97
cgucgggauggacggca

SEQ ID NO: 1041605 - RNA, 20 nt, Mycobacterium bovis subsp bovis AF2122/97
cgucgggauggacggcagcc

SEQ ID NO: 1041606 - RNA, 15 nt, Mycobacterium bovis subsp bovis AF2122/97
cgucggccugcgccg

SEQ ID NO: 1041607 - RNA, 21 nt, Mycobacterium bovis subsp bovis AF2122/97
cgucggcgaauccgccgccua

SEQ ID NO: 1041608 - RNA, 14 nt, Mycobacterium bovis subsp bovis AF2122/97
cgucggcgaacgcg

SEQ ID NO: 1041609 - RNA, 22 nt, Mycobacterium bovis subsp bovis AF2122/97
cgucggcgaacgcguccagcgc

SEQ ID NO: 1041610 - RNA, 16 nt, Mycobacterium bovis subsp bovis AF2122/97
cgucggcgaagguguc

SEQ ID NO: 1041611 - RNA, 20 nt, Mycobacterium bovis subsp bovis AF2122/97
cgucggcgaauccgccgccu

SEQ ID NO: 1041612 - RNA, 20 nt, Mycobacterium bovis subsp bovis AF2122/97
cgucggcgauaucggagcgc

SEQ ID NO: 1041613 - RNA, 21 nt, Mycobacterium bovis subsp bovis AF2122/97
cgucggcgauaucggagcgca

SEQ ID NO: 1041614 - RNA, 21 nt, Mycobacterium bovis subsp bovis AF2122/97
cgucggcgagcucggccccgc

SEQ ID NO: 1041615 - RNA, 12 nt, Mycobacterium bovis subsp bovis AF2122/97
cgucggcgagca

SEQ ID NO: 1041616 - RNA, 15 nt, Mycobacterium bovis subsp bovis AF2122/97
cgucggccgcaucgc

SEQ ID NO: 1041617 - RNA, 13 nt, Mycobacterium bovis subsp bovis AF2122/97
cgucggcgaccag

SEQ ID NO: 1041618 - RNA, 22 nt, Mycobacterium bovis subsp bovis AF2122/97
cgucggcgaugaacagcgacgc

SEQ ID NO: 1041619 - RNA, 18 nt, Mycobacterium bovis subsp bovis AF2122/97
cgucggcgauggccagca

SEQ ID NO: 1041620 - RNA, 13 nt, Mycobacterium bovis subsp bovis AF2122/97
cgucggcgcauca

SEQ ID NO: 1041621 - RNA, 15 nt, Mycobacterium bovis subsp bovis AF2122/97
cgucggcgcaucacc

SEQ ID NO: 1041622 - RNA, 13 nt, Mycobacterium bovis subsp bovis AF2122/97
cgucggcgccgaa

SEQ ID NO: 1041623 - RNA, 14 nt, Mycobacterium bovis subsp bovis AF2122/97
cgucggcgccgaac

SEQ ID NO: 1041624 - RNA, 13 nt, Mycobacterium bovis subsp bovis AF2122/97
cgucggcgcccag

SEQ ID NO: 1041625 - RNA, 18 nt, Mycobacterium bovis subsp bovis AF2122/97
cgucggcgcccagcucga

SEQ ID NO: 1041626 - RNA, 12 nt, Mycobacterium bovis subsp bovis AF2122/97
cgucggcgcccg

SEQ ID NO: 1041627 - RNA, 16 nt, Mycobacterium bovis subsp bovis AF2122/97
cgucggcgcugcgcgc

SEQ ID NO: 1041628 - RNA, 12 nt, Mycobacterium bovis subsp bovis AF2122/97
cgucggcggcca

SEQ ID NO: 1041629 - RNA, 13 nt, Mycobacterium bovis subsp bovis AF2122/97
cgucggcggccag

SEQ ID NO: 1041630 - RNA, 18 nt, Mycobacterium bovis subsp bovis AF2122/97
cgucggcgcugacgaccc

SEQ ID NO: 1041631 - RNA, 14 nt, Mycobacterium bovis subsp bovis AF2122/97
cgucggcggcguug

SEQ ID NO: 1041632 - RNA, 16 nt, Mycobacterium bovis subsp bovis AF2122/97
cgucggcggccguggc

SEQ ID NO: 1041633 - RNA, 14 nt, Mycobacterium bovis subsp bovis AF2122/97
cgucggcggcgacc

SEQ ID NO: 1041634 - RNA, 19 nt, Mycobacterium bovis subsp bovis AF2122/97
cgucuccgccggcucgucg

SEQ ID NO: 1041635 - RNA, 13 nt, Mycobacterium bovis subsp bovis AF2122/97
cgucuccggcgcc

SEQ ID NO: 1041636 - RNA, 18 nt, Mycobacterium bovis subsp bovis AF2122/97
cgucugacgaaauccgcc

SEQ ID NO: 1041637 - RNA, 21 nt, Mycobacterium bovis subsp bovis AF2122/97
cgucugacaauuccuggaucg

SEQ ID NO: 1041638 - RNA, 18 nt, Mycobacterium bovis subsp bovis AF2122/97
cgucugacaucgucgacg

SEQ ID NO: 1041639 - RNA, 14 nt, Mycobacterium bovis subsp bovis AF2122/97
cgucugagcgccgg

SEQ ID NO: 1041640 - RNA, 14 nt, Mycobacterium bovis subsp bovis AF2122/97
cgucugcggucgag

SEQ ID NO: 1041641 - RNA, 15 nt, Mycobacterium bovis subsp bovis AF2122/97
cgucugcggucgagg

SEQ ID NO: 1041642 - RNA, 17 nt, Mycobacterium bovis subsp bovis AF2122/97
cgucugcggaccggcgc

SEQ ID NO: 1041643 - RNA, 18 nt, Mycobacterium bovis subsp bovis AF2122/97
cgucugcggaccggcgcg

SEQ ID NO: 1041644 - RNA, 12 nt, Mycobacterium bovis subsp bovis AF2122/97
cgucugcucgcc

SEQ ID NO: 1041645 - RNA, 16 nt, Mycobacterium bovis subsp bovis AF2122/97
cgucugcucgccagcc

SEQ ID NO: 1041646 - RNA, 17 nt, Mycobacterium bovis subsp bovis AF2122/97
cgucugcucgccagccg

SEQ ID NO: 1041647 - RNA, 18 nt, Mycobacterium bovis subsp bovis AF2122/97
cgucugcucgccagccgg

SEQ ID NO: 1041648 - RNA, 19 nt, Mycobacterium bovis subsp bovis AF2122/97
cgucugcucgccagccggc

SEQ ID NO: 1041649 - RNA, 17 nt, Mycobacterium bovis subsp bovis AF2122/97
cgucugcucgccaggcc

SEQ ID NO: 1041650 - RNA, 21 nt, Mycobacterium bovis subsp bovis AF2122/97
cgucugcagaccuguccggca

SEQ ID NO: 1041651 - RNA, 14 nt, Mycobacterium bovis subsp bovis AF2122/97
cgucugcgacccgg

SEQ ID NO: 1041652 - RNA, 22 nt, Mycobacterium bovis subsp bovis AF2122/97
cgucuugaccgcuugcccgcgc

SEQ ID NO: 1041653 - RNA, 20 nt, Mycobacterium bovis subsp bovis AF2122/97
cgucuugauguaaugcgggc

SEQ ID NO: 1041654 - RNA, 22 nt, Mycobacterium bovis subsp bovis AF2122/97
cgucuggcaugaccgcugccga

SEQ ID NO: 1041655 - RNA, 14 nt, Mycobacterium bovis subsp bovis AF2122/97
cgucuucgccgcca

SEQ ID NO: 1041656 - RNA, 16 nt, Mycobacterium bovis subsp bovis AF2122/97
cgucuucgccgccacc

SEQ ID NO: 1041657 - RNA, 19 nt, Mycobacterium bovis subsp bovis AF2122/97
cgucugggcaucaucgacg

SEQ ID NO: 1041658 - RNA, 16 nt, Mycobacterium bovis subsp bovis AF2122/97
cgucugcuggccgggu

SEQ ID NO: 1041659 - RNA, 22 nt, Mycobacterium bovis subsp bovis AF2122/97
cgucugcuucacgucagcguug

SEQ ID NO: 1041660 - RNA, 15 nt, Mycobacterium bovis subsp bovis AF2122/97
cgucugcucggcgcg

SEQ ID NO: 1041661 - RNA, 13 nt, Mycobacterium bovis subsp bovis AF2122/97
cgucuggaguucg

SEQ ID NO: 1041662 - RNA, 13 nt, Mycobacterium bovis subsp bovis AF2122/97
cgucugcucggca

SEQ ID NO: 1041663 - RNA, 16 nt, Mycobacterium bovis subsp bovis AF2122/97
cgucugcucggcaucg

SEQ ID NO: 1041664 - RNA, 15 nt, Mycobacterium bovis subsp bovis AF2122/97
cgucugcucggcgca

SEQ ID NO: 1041665 - RNA, 17 nt, Mycobacterium bovis subsp bovis AF2122/97
cgucugcucgccguggu

SEQ ID NO: 1041666 - RNA, 16 nt, Mycobacterium bovis subsp bovis AF2122/97
cgucugcucgcgccgg

SEQ ID NO: 1041667 - RNA, 13 nt, Mycobacterium bovis subsp bovis AF2122/97
cgucugcucgccg

SEQ ID NO: 1041668 - RNA, 14 nt, Mycobacterium bovis subsp bovis AF2122/97
cgucguggcgcucg

SEQ ID NO: 1041669 - RNA, 12 nt, Mycobacterium bovis subsp bovis AF2122/97
cgucguccggcc

SEQ ID NO: 1041670 - RNA, 15 nt, Mycobacterium bovis subsp bovis AF2122/97
cgucguccggccacg

SEQ ID NO: 1041671 - RNA, 18 nt, Mycobacterium bovis subsp bovis AF2122/97
cgucguggucggcgaccc

SEQ ID NO: 1041672 - RNA, 14 nt, Mycobacterium bovis subsp bovis AF2122/97
cgucguggggaccg

SEQ ID NO: 1041673 - RNA, 18 nt, Mycobacterium bovis subsp bovis AF2122/97
cgucguggcgcucggcga

SEQ ID NO: 1041674 - RNA, 15 nt, Mycobacterium bovis subsp bovis AF2122/97
cgucguggcgguggc

SEQ ID NO: 1041675 - RNA, 19 nt, Mycobacterium bovis subsp bovis AF2122/97
cgucguggcuuccgguggu

SEQ ID NO: 1041676 - RNA, 23 nt, Mycobacterium bovis subsp bovis AF2122/97
cgucgucagccaggaagcggugg

SEQ ID NO: 1041677 - RNA, 15 nt, Mycobacterium bovis subsp bovis AF2122/97
cgucgucaucgagcg

SEQ ID NO: 1041678 - RNA, 13 nt, Mycobacterium bovis subsp bovis AF2122/97
cgucguccagggc

SEQ ID NO: 1041679 - RNA, 13 nt, Mycobacterium bovis subsp bovis AF2122/97
cgucguccgcgcc

SEQ ID NO: 1041680 - RNA, 15 nt, Mycobacterium bovis subsp bovis AF2122/97
cgucguccgcgccag

SEQ ID NO: 1041681 - RNA, 16 nt, Mycobacterium bovis subsp bovis AF2122/97
cgucuccuugaucgac

SEQ ID NO: 1041682 - RNA, 23 nt, Mycobacterium bovis subsp bovis AF2122/97
cgucuccuugaucgacaacgcgg

SEQ ID NO: 1041683 - RNA, 20 nt, Mycobacterium bovis subsp bovis AF2122/97
cgucuccacuuucugcgguc

SEQ ID NO: 1041684 - RNA, 22 nt, Mycobacterium bovis subsp bovis AF2122/97
cgucuccacuuucugcggucaa

SEQ ID NO: 1041685 - RNA, 15 nt, Mycobacterium bovis subsp bovis AF2122/97
cgucguucgcgggug

SEQ ID NO: 1041686 - RNA, 14 nt, Mycobacterium bovis subsp bovis AF2122/97
cgucgugucgccgc

SEQ ID NO: 1041687 - RNA, 16 nt, Mycobacterium bovis subsp bovis AF2122/97
cgucgugucgccgccg

SEQ ID NO: 1041688 - RNA, 17 nt, Mycobacterium bovis subsp bovis AF2122/97
cgucgugucgccgccgu

SEQ ID NO: 1041689 - RNA, 22 nt, Mycobacterium bovis subsp bovis AF2122/97
cgucgugucgccgccguugccg

SEQ ID NO: 1041690 - RNA, 17 nt, Mycobacterium bovis subsp bovis AF2122/97
cgucguuaagacggcga

SEQ ID NO: 1041691 - RNA, 16 nt, Mycobacterium bovis subsp bovis AF2122/97
cucggccagcacgccg

SEQ ID NO: 1041692 - RNA, 20 nt, Mycobacterium bovis subsp bovis AF2122/97
cucggccagcaucagcucga

SEQ ID NO: 1041693 - RNA, 16 nt, Mycobacterium bovis subsp bovis AF2122/97
cucggccagccagcgg

SEQ ID NO: 1041694 - RNA, 21 nt, Mycobacterium bovis subsp bovis AF2122/97
cucggccagcuccgccugccg

SEQ ID NO: 1041695 - RNA, 20 nt, Mycobacterium bovis subsp bovis AF2122/97
cucggccagcuugcggagcc

SEQ ID NO: 1041696 - RNA, 20 nt, Mycobacterium bovis subsp bovis AF2122/97
cucggcgaaccuugguugcc

SEQ ID NO: 1041697 - RNA, 19 nt, Mycobacterium bovis subsp bovis AF2122/97
cucggcgaaggccgcgcgc

SEQ ID NO: 1041698 - RNA, 13 nt, Mycobacterium bovis subsp bovis AF2122/97
cucggcgaacgcg

SEQ ID NO: 1041699 - RNA, 23 nt, Mycobacterium bovis subsp bovis AF2122/97
cucggcgagugucuuagccagca

SEQ ID NO: 1041700 - RNA, 23 nt, Mycobacterium bovis subsp bovis AF2122/97
cucggcgaccaucugaucgggcc

SEQ ID NO: 1041701 - RNA, 23 nt, Mycobacterium bovis subsp bovis AF2122/97
cucggcgaguucggcagcgggcu

SEQ ID NO: 1041702 - RNA, 22 nt, Mycobacterium bovis subsp bovis AF2122/97
cucggcgaggaacuggaccggu

SEQ ID NO: 1041703 - RNA, 15 nt, Mycobacterium bovis subsp bovis AF2122/97
cucggcgagcaccgu

SEQ ID NO: 1041704 - RNA, 16 nt, Mycobacterium bovis subsp bovis AF2122/97
cucggcgagcacguca

SEQ ID NO: 1041705 - RNA, 12 nt, Mycobacterium bovis subsp bovis AF2122/97
cucggcgagccg

SEQ ID NO: 1041706 - RNA, 15 nt, Mycobacterium bovis subsp bovis AF2122/97
cucggcgagcacguc

SEQ ID NO: 1041707 - RNA, 19 nt, Mycobacterium bovis subsp bovis AF2122/97
cucggcgacugcgucggcg

SEQ ID NO: 1041708 - RNA, 22 nt, Mycobacterium bovis subsp bovis AF2122/97
cucggcgaccugccggaccgcg

SEQ ID NO: 1041709 - RNA, 11 nt, Mycobacterium bovis subsp bovis AF2122/97
cucggcgauga

SEQ ID NO: 1041710 - RNA, 21 nt, Mycobacterium bovis subsp bovis AF2122/97
cucggcgaugaacgggaucga

SEQ ID NO: 1041711 - RNA, 15 nt, Mycobacterium bovis subsp bovis AF2122/97
cucggcgaucacgcg

SEQ ID NO: 1041712 - RNA, 22 nt, Mycobacterium bovis subsp bovis AF2122/97
cucggcgauuuugcgucgcgcc

SEQ ID NO: 1041713 - RNA, 12 nt, Mycobacterium bovis subsp bovis AF2122/97
cucggcgcagca

SEQ ID NO: 1041714 - RNA, 23 nt, Mycobacterium bovis subsp bovis AF2122/97
cucggcgcagcacauccugcagc

SEQ ID NO: 1041715 - RNA, 13 nt, Mycobacterium bovis subsp bovis AF2122/97
cucggcgccgaac

SEQ ID NO: 1041716 - RNA, 21 nt, Mycobacterium bovis subsp bovis AF2122/97
cucggcgccgaacucaacgac

SEQ ID NO: 1041717 - RNA, 16 nt, Mycobacterium bovis subsp bovis AF2122/97
cucggcgcagcuaacc

SEQ ID NO: 1041718 - RNA, 19 nt, Mycobacterium bovis subsp bovis AF2122/97
cucggcggacccggugacc

SEQ ID NO: 1041719 - RNA, 23 nt, Mycobacterium bovis subsp bovis AF2122/97
cucggcggaagaccggaucgccu

SEQ ID NO: 1041720 - RNA, 20 nt, Mycobacterium bovis subsp bovis AF2122/97
cucggcgcugcgcaccgccg

SEQ ID NO: 1041721 - RNA, 13 nt, Mycobacterium bovis subsp bovis AF2122/97
cucggcgcggugg

SEQ ID NO: 1041722 - RNA, 14 nt, Mycobacterium bovis subsp bovis AF2122/97
cucggcgcgguggg

SEQ ID NO: 1041723 - RNA, 17 nt, Mycobacterium bovis subsp bovis AF2122/97
cucggcgccgcccagca

SEQ ID NO: 1041724 - RNA, 14 nt, Mycobacterium bovis subsp bovis AF2122/97
cucggcgcgcagcg

SEQ ID NO: 1041725 - RNA, 19 nt, Mycobacterium bovis subsp bovis AF2122/97
cucggcgcgccggucgccg

SEQ ID NO: 1041726 - RNA, 16 nt, Mycobacterium bovis subsp bovis AF2122/97
cucggcggcccggccg

SEQ ID NO: 1041727 - RNA, 19 nt, Mycobacterium bovis subsp bovis AF2122/97
cucggcggcccggccgaac

SEQ ID NO: 1041728 - RNA, 14 nt, Mycobacterium bovis subsp bovis AF2122/97
cucggcggccacca

SEQ ID NO: 1041729 - RNA, 12 nt, Mycobacterium bovis subsp bovis AF2122/97
cucggcggccag

SEQ ID NO: 1041730 - RNA, 21 nt, Mycobacterium bovis subsp bovis AF2122/97
cucggcggcggcacgcugacc

SEQ ID NO: 1041731 - RNA, 13 nt, Mycobacterium bovis subsp bovis AF2122/97
cucggcggcgccg

SEQ ID NO: 1041732 - RNA, 13 nt, Mycobacterium bovis subsp bovis AF2122/97
cucggcggccgcg

SEQ ID NO: 1041733 - RNA, 22 nt, Mycobacterium bovis subsp bovis AF2122/97
cucggcggccgcgugcucgccg

SEQ ID NO: 1041734 - RNA, 15 nt, Mycobacterium bovis subsp bovis AF2122/97
cucggcggcggcuuc

SEQ ID NO: 1041735 - RNA, 23 nt, Mycobacterium bovis subsp bovis AF2122/97
cucggcggguauauggugcgcca

SEQ ID NO: 1041736 - RNA, 16 nt, Mycobacterium bovis subsp bovis AF2122/97
cucggcggucuuggcg

SEQ ID NO: 1041737 - RNA, 20 nt, Mycobacterium bovis subsp bovis AF2122/97
cucggcggucuuggcgcgcc

SEQ ID NO: 1041738 - RNA, 22 nt, Mycobacterium bovis subsp bovis AF2122/97
cucggcggucuuggcgcgccca

SEQ ID NO: 1041739 - RNA, 21 nt, Mycobacterium bovis subsp bovis AF2122/97
cucggcggugcaguggcuacg

SEQ ID NO: 1041740 - RNA, 16 nt, Mycobacterium bovis subsp bovis AF2122/97
cucggcuagugugacc

SEQ ID NO: 1041741 - RNA, 18 nt, Mycobacterium bovis subsp bovis AF2122/97
cucggcuagugugaccgu

SEQ ID NO: 1041742 - RNA, 19 nt, Mycobacterium bovis subsp bovis AF2122/97
cucggcguuuucggugagc

SEQ ID NO: 1041743 - RNA, 16 nt, Mycobacterium bovis subsp bovis AF2122/97
cucggcguguccgccg

SEQ ID NO: 1041744 - RNA, 17 nt, Mycobacterium bovis subsp bovis AF2122/97
cucggcgguuccggcgg

SEQ ID NO: 1041745 - RNA, 15 nt, Mycobacterium bovis subsp bovis AF2122/97
cucggcgugcucggc

SEQ ID NO: 1041746 - RNA, 16 nt, Mycobacterium bovis subsp bovis AF2122/97
cucggcgucgccgcca

SEQ ID NO: 1041747 - RNA, 12 nt, Mycobacterium bovis subsp bovis AF2122/97
cucggcgucgac

SEQ ID NO: 1041748 - RNA, 15 nt, Mycobacterium bovis subsp bovis AF2122/97
cucggcgucgaccag

SEQ ID NO: 1041749 - RNA, 23 nt, Mycobacterium bovis subsp bovis AF2122/97
cucggcguaggcgauggcggcgc

SEQ ID NO: 1041750 - RNA, 17 nt, Mycobacterium bovis subsp bovis AF2122/97
cucgggauucggcagcg

SEQ ID NO: 1041751 - RNA, 17 nt, Mycobacterium bovis subsp bovis AF2122/97
cucgggcaaggccaccg

SEQ ID NO: 1041752 - RNA, 18 nt, Mycobacterium bovis subsp bovis AF2122/97
cucgggcaaugucgacac

SEQ ID NO: 1041753 - RNA, 15 nt, Mycobacterium bovis subsp bovis AF2122/97
cucgggaucaccgau

SEQ ID NO: 1041754 - RNA, 13 nt, Mycobacterium bovis subsp bovis AF2122/97
cucgggaucggcg

SEQ ID NO: 1041755 - RNA, 13 nt, Mycobacterium bovis subsp bovis AF2122/97
cucggcuucggag

SEQ ID NO: 1041756 - RNA, 15 nt, Mycobacterium bovis subsp bovis AF2122/97
cucggcugcucgacg

SEQ ID NO: 1041757 - RNA, 16 nt, Mycobacterium bovis subsp bovis AF2122/97
cucggcuauggguucg

SEQ ID NO: 1041758 - RNA, 14 nt, Mycobacterium bovis subsp bovis AF2122/97
cucgcuguugaagc

SEQ ID NO: 1041759 - RNA, 16 nt, Mycobacterium bovis subsp bovis AF2122/97
cucgcuguuggccggu

SEQ ID NO: 1041760 - RNA, 19 nt, Mycobacterium bovis subsp bovis AF2122/97
cucgcuccgaccgguggcg

SEQ ID NO: 1041761 - RNA, 20 nt, Mycobacterium bovis subsp bovis AF2122/97
cucgcucgacguacagcgcg

SEQ ID NO: 1041762 - RNA, 16 nt, Mycobacterium bovis subsp bovis AF2122/97
cucggaauucggcguc

SEQ ID NO: 1041763 - RNA, 12 nt, Mycobacterium bovis subsp bovis AF2122/97
cucggacacgcu

SEQ ID NO: 1041764 - RNA, 14 nt, Mycobacterium bovis subsp bovis AF2122/97
cucggaaucggcgg

SEQ ID NO: 1041765 - RNA, 12 nt, Mycobacterium bovis subsp bovis AF2122/97
cucggacgcgcc

SEQ ID NO: 1041766 - RNA, 16 nt, Mycobacterium bovis subsp bovis AF2122/97
cucggacgcgccggcg

SEQ ID NO: 1041767 - RNA, 22 nt, Mycobacterium bovis subsp bovis AF2122/97
cucggcaugagucgaaccaggu

SEQ ID NO: 1041768 - RNA, 22 nt, Mycobacterium bovis subsp bovis AF2122/97
cucggcaugcagccccacuucg

SEQ ID NO: 1041769 - RNA, 16 nt, Mycobacterium bovis subsp bovis AF2122/97
cucggagcgcacgaac

SEQ ID NO: 1041770 - RNA, 19 nt, Mycobacterium bovis subsp bovis AF2122/97
cucggaggcgaucaggaug

SEQ ID NO: 1041771 - RNA, 14 nt, Mycobacterium bovis subsp bovis AF2122/97
cucggagaucgcca

SEQ ID NO: 1041772 - RNA, 22 nt, Mycobacterium bovis subsp bovis AF2122/97
cucggaggcgaccacgucggcg

SEQ ID NO: 1041773 - RNA, 14 nt, Mycobacterium bovis subsp bovis AF2122/97
cucggaggcgauca

SEQ ID NO: 1041774 - RNA, 15 nt, Mycobacterium bovis subsp bovis AF2122/97
cucggccaccagcgc

SEQ ID NO: 1041775 - RNA, 20 nt, Mycobacterium bovis subsp bovis AF2122/97
cucggccaccagcgcccggc

SEQ ID NO: 1041776 - RNA, 15 nt, Mycobacterium bovis subsp bovis AF2122/97
cucggacugcagcgc

SEQ ID NO: 1041777 - RNA, 15 nt, Mycobacterium bovis subsp bovis AF2122/97
cucggcauucaccgc

SEQ ID NO: 1041778 - RNA, 17 nt, Mycobacterium bovis subsp bovis AF2122/97
cucggccaacgacggcc

SEQ ID NO: 1041779 - RNA, 18 nt, Mycobacterium bovis subsp bovis AF2122/97
cucggccaacgacggccg

SEQ ID NO: 1041780 - RNA, 19 nt, Mycobacterium bovis subsp bovis AF2122/97
cucggccaauccggggccc

SEQ ID NO: 1041781 - RNA, 14 nt, Mycobacterium bovis subsp bovis AF2122/97
cucggccacccgca

SEQ ID NO: 1041782 - RNA, 13 nt, Mycobacterium bovis subsp bovis AF2122/97
cucggccaccgaa

SEQ ID NO: 1041783 - RNA, 16 nt, Mycobacterium bovis subsp bovis AF2122/97
cucggccacggcgucg

SEQ ID NO: 1041784 - RNA, 16 nt, Mycobacterium bovis subsp bovis AF2122/97
cucgcggauccgggcg

SEQ ID NO: 1041785 - RNA, 19 nt, Mycobacterium bovis subsp bovis AF2122/97
cucgcggaugagcucggcc

SEQ ID NO: 1041786 - RNA, 20 nt, Mycobacterium bovis subsp bovis AF2122/97
cucgcggaugagcucggcca

SEQ ID NO: 1041787 - RNA, 22 nt, Mycobacterium bovis subsp bovis AF2122/97
cucgcggugcggcaacagcgcc

SEQ ID NO: 1041788 - RNA, 19 nt, Mycobacterium bovis subsp bovis AF2122/97
cucgcgguagucguugccg

SEQ ID NO: 1041789 - RNA, 21 nt, Mycobacterium bovis subsp bovis AF2122/97
cucgcgguaguugucccgccg

SEQ ID NO: 1041790 - RNA, 16 nt, Mycobacterium bovis subsp bovis AF2122/97
cucgcgguggccgaac

SEQ ID NO: 1041791 - RNA, 16 nt, Mycobacterium bovis subsp bovis AF2122/97
cucgcggcgcggccgc

SEQ ID NO: 1041792 - RNA, 18 nt, Mycobacterium bovis subsp bovis AF2122/97
cucgcggcgcggccgcag

SEQ ID NO: 1041793 - RNA, 13 nt, Mycobacterium bovis subsp bovis AF2122/97
cucgcggccggcg

SEQ ID NO: 1041794 - RNA, 14 nt, Mycobacterium bovis subsp bovis AF2122/97
cucgcggcgaccau

SEQ ID NO: 1041795 - RNA, 16 nt, Mycobacterium bovis subsp bovis AF2122/97
cucgcggauuggcacu

SEQ ID NO: 1041796 - RNA, 21 nt, Mycobacterium bovis subsp bovis AF2122/97
cucgcggcgaccauauucagc

SEQ ID NO: 1041797 - RNA, 14 nt, Mycobacterium bovis subsp bovis AF2122/97
cucgcguggcaccg

SEQ ID NO: 1041798 - RNA, 17 nt, Mycobacterium bovis subsp bovis AF2122/97
cucgcguagggccagcg

SEQ ID NO: 1041799 - RNA, 19 nt, Mycobacterium bovis subsp bovis AF2122/97
cucgcgguuuuggucgcga

SEQ ID NO: 1041800 - RNA, 19 nt, Mycobacterium bovis subsp bovis AF2122/97
cucgcuaauugcggccgcc

SEQ ID NO: 1041801 - RNA, 20 nt, Mycobacterium bovis subsp bovis AF2122/97
cucgauggcggccaccagcg

SEQ ID NO: 1041802 - RNA, 20 nt, Mycobacterium bovis subsp bovis AF2122/97
cucgauucccggcgcggugg

SEQ ID NO: 1041803 - RNA, 16 nt, Mycobacterium bovis subsp bovis AF2122/97
cucgauuguggccagc

SEQ ID NO: 1041804 - RNA, 18 nt, Mycobacterium bovis subsp bovis AF2122/97
cucgaugucgcggucgcc

SEQ ID NO: 1041805 - RNA, 16 nt, Mycobacterium bovis subsp bovis AF2122/97
cucgaugucagcggcc

SEQ ID NO: 1041806 - RNA, 17 nt, Mycobacterium bovis subsp bovis AF2122/97
cucgaugucagcggccg

SEQ ID NO: 1041807 - RNA, 16 nt, Mycobacterium bovis subsp bovis AF2122/97
cucgccgggaaacacc

SEQ ID NO: 1041808 - RNA, 22 nt, Mycobacterium bovis subsp bovis AF2122/97
cucgccgguguccuuggccgcc

SEQ ID NO: 1041809 - RNA, 16 nt, Mycobacterium bovis subsp bovis AF2122/97
cucgauggcgguggcg

SEQ ID NO: 1041810 - RNA, 13 nt, Mycobacterium bovis subsp bovis AF2122/97
cucgccggugacg

SEQ ID NO: 1041811 - RNA, 13 nt, Mycobacterium bovis subsp bovis AF2122/97
cucgccggugagc

SEQ ID NO: 1041812 - RNA, 17 nt, Mycobacterium bovis subsp bovis AF2122/97
cucgccggugagccgga

SEQ ID NO: 1041813 - RNA, 16 nt, Mycobacterium bovis subsp bovis AF2122/97
cucgccgugaccaggu

SEQ ID NO: 1041814 - RNA, 15 nt, Mycobacterium bovis subsp bovis AF2122/97
cucgccguugauguc

SEQ ID NO: 1041815 - RNA, 20 nt, Mycobacterium bovis subsp bovis AF2122/97
cucgcgcgcugggcgcgcuc

SEQ ID NO: 1041816 - RNA, 13 nt, Mycobacterium bovis subsp bovis AF2122/97
cucgcgcucgccg

SEQ ID NO: 1041817 - RNA, 14 nt, Mycobacterium bovis subsp bovis AF2122/97
cucgcgcgucgcga

SEQ ID NO: 1041818 - RNA, 11 nt, Mycobacterium bovis subsp bovis AF2122/97
cucgccguugg

SEQ ID NO: 1041819 - RNA, 23 nt, Mycobacterium bovis subsp bovis AF2122/97
cucgcgcagauauuccucgucgg

SEQ ID NO: 1041820 - RNA, 17 nt, Mycobacterium bovis subsp bovis AF2122/97
cucgaucugucgcgccg

SEQ ID NO: 1041821 - RNA, 22 nt, Mycobacterium bovis subsp bovis AF2122/97
cucgaucuggucaagacccgca

SEQ ID NO: 1041822 - RNA, 23 nt, Mycobacterium bovis subsp bovis AF2122/97
cucgaugaugucgagcacaccgu

SEQ ID NO: 1041823 - RNA, 14 nt, Mycobacterium bovis subsp bovis AF2122/97
cucgaugccgcgua

SEQ ID NO: 1041824 - RNA, 21 nt, Mycobacterium bovis subsp bovis AF2122/97
cucgaugcgacgaaccucggc

SEQ ID NO: 1041825 - RNA, 15 nt, Mycobacterium bovis subsp bovis AF2122/97
cucgaugcgaucgac

SEQ ID NO: 1041826 - RNA, 20 nt, Mycobacterium bovis subsp bovis AF2122/97
cucgaugcgggcgccccacc

SEQ ID NO: 1041827 - RNA, 21 nt, Mycobacterium bovis subsp bovis AF2122/97
cucgaucaccucgcgggugcu

SEQ ID NO: 1041828 - RNA, 15 nt, Mycobacterium bovis subsp bovis AF2122/97
cucgaucacggcggg

SEQ ID NO: 1041829 - RNA, 22 nt, Mycobacterium bovis subsp bovis AF2122/97
cucgaucaccaugauguagcgg

SEQ ID NO: 1041830 - RNA, 18 nt, Mycobacterium bovis subsp bovis AF2122/97
cucgauauaacccggcuc

SEQ ID NO: 1041831 - RNA, 22 nt, Mycobacterium bovis subsp bovis AF2122/97
cucgauauggguugccagcgac

SEQ ID NO: 1041832 - RNA, 21 nt, Mycobacterium bovis subsp bovis AF2122/97
cucgaucaucaugucggcgca

SEQ ID NO: 1041833 - RNA, 15 nt, Mycobacterium bovis subsp bovis AF2122/97
cucgaucagcgccgg

SEQ ID NO: 1041834 - RNA, 18 nt, Mycobacterium bovis subsp bovis AF2122/97
cucgaucuggucaagacc

SEQ ID NO: 1041835 - RNA, 15 nt, Mycobacterium bovis subsp bovis AF2122/97
cucgaucugcccggu

SEQ ID NO: 1041836 - RNA, 15 nt, Mycobacterium bovis subsp bovis AF2122/97
cucgaucgucgacgc

SEQ ID NO: 1041837 - RNA, 17 nt, Mycobacterium bovis subsp bovis AF2122/97
cucgaucagacgcucga

SEQ ID NO: 1041838 - RNA, 14 nt, Mycobacterium bovis subsp bovis AF2122/97
cucgauccgggcgu

SEQ ID NO: 1041839 - RNA, 23 nt, Mycobacterium bovis subsp bovis AF2122/97
cucgaccaggaccggcugcaggu

SEQ ID NO: 1041840 - RNA, 22 nt, Mycobacterium bovis subsp bovis AF2122/97
cucgacguccaucccggcgccg

SEQ ID NO: 1041841 - RNA, 18 nt, Mycobacterium bovis subsp bovis AF2122/97
cucgacgucgggcauggc

SEQ ID NO: 1041842 - RNA, 20 nt, Mycobacterium bovis subsp bovis AF2122/97
cucgacgucgucgucgacgg

SEQ ID NO: 1041843 - RNA, 14 nt, Mycobacterium bovis subsp bovis AF2122/97
cucgacguagucgc

SEQ ID NO: 1041844 - RNA, 20 nt, Mycobacterium bovis subsp bovis AF2122/97
cucgacguauuggcgcagca

SEQ ID NO: 1041845 - RNA, 18 nt, Mycobacterium bovis subsp bovis AF2122/97
cucgaccgcggggcagcg

SEQ ID NO: 1041846 - RNA, 20 nt, Mycobacterium bovis subsp bovis AF2122/97
cucgaccgccagcccgguga

SEQ ID NO: 1041847 - RNA, 22 nt, Mycobacterium bovis subsp bovis AF2122/97
cucgaccgccagccgcgagccg

SEQ ID NO: 1041848 - RNA, 20 nt, Mycobacterium bovis subsp bovis AF2122/97
cucgaccgcgccuggagcga

SEQ ID NO: 1041849 - RNA, 15 nt, Mycobacterium bovis subsp bovis AF2122/97
cucgaguggcgaacg

SEQ ID NO: 1041850 - RNA, 14 nt, Mycobacterium bovis subsp bovis AF2122/97
cucgaguguggccg

SEQ ID NO: 1041851 - RNA, 22 nt, Mycobacterium bovis subsp bovis AF2122/97
cucgaguccguacuugccaccc

SEQ ID NO: 1041852 - RNA, 14 nt, Mycobacterium bovis subsp bovis AF2122/97
cucgagucugcgca

SEQ ID NO: 1041853 - RNA, 15 nt, Mycobacterium bovis subsp bovis AF2122/97
cucgagugccgccgu

SEQ ID NO: 1041854 - RNA, 15 nt, Mycobacterium bovis subsp bovis AF2122/97
cucgaggucgagcgc

SEQ ID NO: 1041855 - RNA, 21 nt, Mycobacterium bovis subsp bovis AF2122/97
cucgaggucgagcgccgcgga

SEQ ID NO: 1041856 - RNA, 16 nt, Mycobacterium bovis subsp bovis AF2122/97
cucgaguuuggccagu

SEQ ID NO: 1041857 - RNA, 13 nt, Mycobacterium bovis subsp bovis AF2122/97
cucgaggucucca

SEQ ID NO: 1041858 - RNA, 16 nt, Mycobacterium bovis subsp bovis AF2122/97
cucgauacccaggaug

SEQ ID NO: 1041859 - RNA, 20 nt, Mycobacterium bovis subsp bovis AF2122/97
cucgauaucguuggcgacca

SEQ ID NO: 1041860 - RNA, 15 nt, Mycobacterium bovis subsp bovis AF2122/97
cucgauagcggcgcc

SEQ ID NO: 1041861 - RNA, 21 nt, Mycobacterium bovis subsp bovis AF2122/97
cucgagcaccgcgaacauggu

SEQ ID NO: 1041862 - RNA, 16 nt, Mycobacterium bovis subsp bovis AF2122/97
cucgagcaggcgcacc

SEQ ID NO: 1041863 - RNA, 14 nt, Mycobacterium bovis subsp bovis AF2122/97
cucgagcagcgcgc

SEQ ID NO: 1041864 - RNA, 17 nt, Mycobacterium bovis subsp bovis AF2122/97
cucgagcagcgcgccgu

SEQ ID NO: 1041865 - RNA, 15 nt, Mycobacterium bovis subsp bovis AF2122/97
cucgacugccaccgu

SEQ ID NO: 1041866 - RNA, 14 nt, Mycobacterium bovis subsp bovis AF2122/97
cucgagacggucga

SEQ ID NO: 1041867 - RNA, 14 nt, Mycobacterium bovis subsp bovis AF2122/97
cucgacuugcuugg

SEQ ID NO: 1041868 - RNA, 13 nt, Mycobacterium bovis subsp bovis AF2122/97
cucgacgugcacg

SEQ ID NO: 1041869 - RNA, 18 nt, Mycobacterium bovis subsp bovis AF2122/97
cucgagaguggccucguc

SEQ ID NO: 1041870 - RNA, 13 nt, Mycobacterium bovis subsp bovis AF2122/97
cuccgucagcgcc

SEQ ID NO: 1041871 - RNA, 14 nt, Mycobacterium bovis subsp bovis AF2122/97
cuccgucagcgccg

SEQ ID NO: 1041872 - RNA, 16 nt, Mycobacterium bovis subsp bovis AF2122/97
cuccgucagcgccgcg

SEQ ID NO: 1041873 - RNA, 21 nt, Mycobacterium bovis subsp bovis AF2122/97
cuccggugaucaccgacaccg

SEQ ID NO: 1041874 - RNA, 16 nt, Mycobacterium bovis subsp bovis AF2122/97
cuccggugcgcagcca

SEQ ID NO: 1041875 - RNA, 18 nt, Mycobacterium bovis subsp bovis AF2122/97
cuccgguggccaacaccg

SEQ ID NO: 1041876 - RNA, 21 nt, Mycobacterium bovis subsp bovis AF2122/97
cuccgguggccaacaccgcca

SEQ ID NO: 1041877 - RNA, 22 nt, Mycobacterium bovis subsp bovis AF2122/97
cuccguaaacgaggucgccgca

SEQ ID NO: 1041878 - RNA, 18 nt, Mycobacterium bovis subsp bovis AF2122/97
cuccgguaucggcgacca

SEQ ID NO: 1041879 - RNA, 15 nt, Mycobacterium bovis subsp bovis AF2122/97
cuccggucagcgcgg

SEQ ID NO: 1041880 - RNA, 16 nt, Mycobacterium bovis subsp bovis AF2122/97
cuccggucccgcauac

SEQ ID NO: 1041881 - RNA, 17 nt, Mycobacterium bovis subsp bovis AF2122/97
cucccgcgugcggggga

SEQ ID NO: 1041882 - RNA, 18 nt, Mycobacterium bovis subsp bovis AF2122/97
cucccccggcuccgcaac

SEQ ID NO: 1041883 - RNA, 19 nt, Mycobacterium bovis subsp bovis AF2122/97
cuccccgaccgccaccgcc

SEQ ID NO: 1041884 - RNA, 16 nt, Mycobacterium bovis subsp bovis AF2122/97
cuccccgaccgcgccc

SEQ ID NO: 1041885 - RNA, 23 nt, Mycobacterium bovis subsp bovis AF2122/97
cuccccggauuccucgucaccgc

SEQ ID NO: 1041886 - RNA, 20 nt, Mycobacterium bovis subsp bovis AF2122/97
cucccgauucucgaucuggu

SEQ ID NO: 1041887 - RNA, 21 nt, Mycobacterium bovis subsp bovis AF2122/97
cucccgcaaugcgagcgcgcc

SEQ ID NO: 1041888 - RNA, 22 nt, Mycobacterium bovis subsp bovis AF2122/97
cucccgcaaugcgagcgcgccg

SEQ ID NO: 1041889 - RNA, 18 nt, Mycobacterium bovis subsp bovis AF2122/97
cucccgcaauucgcgguc

SEQ ID NO: 1041890 - RNA, 13 nt, Mycobacterium bovis subsp bovis AF2122/97
cucccgagccaca

SEQ ID NO: 1041891 - RNA, 14 nt, Mycobacterium bovis subsp bovis AF2122/97
cuccccgccgggca

SEQ ID NO: 1041892 - RNA, 22 nt, Mycobacterium bovis subsp bovis AF2122/97
cucccgaaaagcgccucggugg

SEQ ID NO: 1041893 - RNA, 19 nt, Mycobacterium bovis subsp bovis AF2122/97
cuccguggugcuagcgccg

SEQ ID NO: 1041894 - RNA, 16 nt, Mycobacterium bovis subsp bovis AF2122/97
cuccgugaucgaggcg

SEQ ID NO: 1041895 - RNA, 23 nt, Mycobacterium bovis subsp bovis AF2122/97
cuccgugacaccggggacgucga

SEQ ID NO: 1041896 - RNA, 14 nt, Mycobacterium bovis subsp bovis AF2122/97
cuccgugagccgga

SEQ ID NO: 1041897 - RNA, 15 nt, Mycobacterium bovis subsp bovis AF2122/97
cuccgugaucgaggc

SEQ ID NO: 1041898 - RNA, 19 nt, Mycobacterium bovis subsp bovis AF2122/97
cuccgugaucgaggcggcg

SEQ ID NO: 1041899 - RNA, 20 nt, Mycobacterium bovis subsp bovis AF2122/97
cuccgugaucgaggcggcgg

SEQ ID NO: 1041900 - RNA, 12 nt, Mycobacterium bovis subsp bovis AF2122/97
cuccgugccgag

SEQ ID NO: 1041901 - RNA, 16 nt, Mycobacterium bovis subsp bovis AF2122/97
cuccguuguccagcgc

SEQ ID NO: 1041902 - RNA, 23 nt, Mycobacterium bovis subsp bovis AF2122/97
cuccgugcuuccauucgcggucc

SEQ ID NO: 1041903 - RNA, 22 nt, Mycobacterium bovis subsp bovis AF2122/97
cuccguggugcuagcgccgcca

SEQ ID NO: 1041904 - RNA, 23 nt, Mycobacterium bovis subsp bovis AF2122/97
cuccuagccaacgagcgcgcugc

SEQ ID NO: 1041905 - RNA, 22 nt, Mycobacterium bovis subsp bovis AF2122/97
cuccucggugugcucgccgacc

SEQ ID NO: 1041906 - RNA, 15 nt, Mycobacterium bovis subsp bovis AF2122/97
cuccucggucaccga

SEQ ID NO: 1041907 - RNA, 15 nt, Mycobacterium bovis subsp bovis AF2122/97
cuccucagccaccgc

SEQ ID NO: 1041908 - RNA, 18 nt, Mycobacterium bovis subsp bovis AF2122/97
cuccucagccaccgcggu

SEQ ID NO: 1041909 - RNA, 19 nt, Mycobacterium bovis subsp bovis AF2122/97
cuccucagccaccgcgguc

SEQ ID NO: 1041910 - RNA, 13 nt, Mycobacterium bovis subsp bovis AF2122/97
cuccugcagcccg

SEQ ID NO: 1041911 - RNA, 18 nt, Mycobacterium bovis subsp bovis AF2122/97
cuccugaguugcggugug

SEQ ID NO: 1041912 - RNA, 21 nt, Mycobacterium bovis subsp bovis AF2122/97
cuccugaguugcggugugccg

SEQ ID NO: 1041913 - RNA, 15 nt, Mycobacterium bovis subsp bovis AF2122/97
cucgacaucggccag

SEQ ID NO: 1041914 - RNA, 14 nt, Mycobacterium bovis subsp bovis AF2122/97
cucgaccaccgccg

SEQ ID NO: 1041915 - RNA, 18 nt, Mycobacterium bovis subsp bovis AF2122/97
cucgaccaccgccggccc

SEQ ID NO: 1041916 - RNA, 19 nt, Mycobacterium bovis subsp bovis AF2122/97
cucgaccaccgccggcccg

SEQ ID NO: 1041917 - RNA, 16 nt, Mycobacterium bovis subsp bovis AF2122/97
cucgacagcggcaauc

SEQ ID NO: 1041918 - RNA, 12 nt, Mycobacterium bovis subsp bovis AF2122/97
cucgacaccgac

SEQ ID NO: 1041919 - RNA, 14 nt, Mycobacterium bovis subsp bovis AF2122/97
cucgacaccgacuc

SEQ ID NO: 1041920 - RNA, 19 nt, Mycobacterium bovis subsp bovis AF2122/97
cucgacacgccgugcgugc

SEQ ID NO: 1041921 - RNA, 22 nt, Mycobacterium bovis subsp bovis AF2122/97
cuccuggaaaggacggccggcc

SEQ ID NO: 1041922 - RNA, 19 nt, Mycobacterium bovis subsp bovis AF2122/97
cucgacaacugcccgauga

SEQ ID NO: 1041923 - RNA, 18 nt, Mycobacterium bovis subsp bovis AF2122/97
cuccuggaaggaggccgg

SEQ ID NO: 1041924 - RNA, 22 nt, Mycobacterium bovis subsp bovis AF2122/97
cuccuggaaguacacggcggcc

SEQ ID NO: 1041925 - RNA, 22 nt, Mycobacterium bovis subsp bovis AF2122/97
cuccugcucgucgagccgaccg

SEQ ID NO: 1041926 - RNA, 18 nt, Mycobacterium bovis subsp bovis AF2122/97
cuccuggguuugccgaug

SEQ ID NO: 1041927 - RNA, 19 nt, Mycobacterium bovis subsp bovis AF2122/97
cucgaaggccgccaaccgu

SEQ ID NO: 1041928 - RNA, 21 nt, Mycobacterium bovis subsp bovis AF2122/97
cucgaaggcguucgacucgac

SEQ ID NO: 1041929 - RNA, 20 nt, Mycobacterium bovis subsp bovis AF2122/97
cugacgcgucagcggcgagc

SEQ ID NO: 1041930 - RNA, 14 nt, Mycobacterium bovis subsp bovis AF2122/97
cugacgcggccggg

SEQ ID NO: 1041931 - RNA, 15 nt, Mycobacterium bovis subsp bovis AF2122/97
cugacgcggccgggc

SEQ ID NO: 1041932 - RNA, 15 nt, Mycobacterium bovis subsp bovis AF2122/97
cugacgcgcccgacg

SEQ ID NO: 1041933 - RNA, 20 nt, Mycobacterium bovis subsp bovis AF2122/97
cugacgcucggucgccaccg

SEQ ID NO: 1041934 - RNA, 21 nt, Mycobacterium bovis subsp bovis AF2122/97
cugacgcucggucgccaccgc

SEQ ID NO: 1041935 - RNA, 17 nt, Mycobacterium bovis subsp bovis AF2122/97
cugacgcucggucgcca

SEQ ID NO: 1041936 - RNA, 14 nt, Mycobacterium bovis subsp bovis AF2122/97
cugacgcucggucg

SEQ ID NO: 1041937 - RNA, 15 nt, Mycobacterium bovis subsp bovis AF2122/97
cugacgugcggcgcg

SEQ ID NO: 1041938 - RNA, 14 nt, Mycobacterium bovis subsp bovis AF2122/97
cugacgugucggcu

SEQ ID NO: 1041939 - RNA, 15 nt, Mycobacterium bovis subsp bovis AF2122/97
cugacuccugcggca

SEQ ID NO: 1041940 - RNA, 15 nt, Mycobacterium bovis subsp bovis AF2122/97
cugacucaucaccga

SEQ ID NO: 1041941 - RNA, 19 nt, Mycobacterium bovis subsp bovis AF2122/97
cugacuaucucgcucgacg

SEQ ID NO: 1041942 - RNA, 23 nt, Mycobacterium bovis subsp bovis AF2122/97
cugagauccagggagcggcugca

SEQ ID NO: 1041943 - RNA, 16 nt, Mycobacterium bovis subsp bovis AF2122/97
cugagacugccgccgc

SEQ ID NO: 1041944 - RNA, 16 nt, Mycobacterium bovis subsp bovis AF2122/97
cugagaugaugcguga

SEQ ID NO: 1041945 - RNA, 18 nt, Mycobacterium bovis subsp bovis AF2122/97
cugagaugaugcgugacc

SEQ ID NO: 1041946 - RNA, 17 nt, Mycobacterium bovis subsp bovis AF2122/97
cugagagaguaucgacc

SEQ ID NO: 1041947 - RNA, 18 nt, Mycobacterium bovis subsp bovis AF2122/97
cugacuuugggucggcga

SEQ ID NO: 1041948 - RNA, 20 nt, Mycobacterium bovis subsp bovis AF2122/97
cugagacacgauuuucgggg

SEQ ID NO: 1041949 - RNA, 22 nt, Mycobacterium bovis subsp bovis AF2122/97
cugagacagaccgggcccggcg

SEQ ID NO: 1041950 - RNA, 17 nt, Mycobacterium bovis subsp bovis AF2122/97
cugagcuuggucgccgg

SEQ ID NO: 1041951 - RNA, 20 nt, Mycobacterium bovis subsp bovis AF2122/97
cugagcuuggucgccgggca

SEQ ID NO: 1041952 - RNA, 20 nt, Mycobacterium bovis subsp bovis AF2122/97
cugagcuagccguucggcug

SEQ ID NO: 1041953 - RNA, 14 nt, Mycobacterium bovis subsp bovis AF2122/97
cugagcacggcgcg

SEQ ID NO: 1041954 - RNA, 13 nt, Mycobacterium bovis subsp bovis AF2122/97
cugagcacguuca

SEQ ID NO: 1041955 - RNA, 18 nt, Mycobacterium bovis subsp bovis AF2122/97
cugagcacguucaccgcg

SEQ ID NO: 1041956 - RNA, 16 nt, Mycobacterium bovis subsp bovis AF2122/97
cugagcagcgcggcca

SEQ ID NO: 1041957 - RNA, 18 nt, Mycobacterium bovis subsp bovis AF2122/97
cugagcagcgcggccaga

SEQ ID NO: 1041958 - RNA, 19 nt, Mycobacterium bovis subsp bovis AF2122/97
cugaagccgcgcugcgacu

SEQ ID NO: 1041959 - RNA, 15 nt, Mycobacterium bovis subsp bovis AF2122/97
cugaagccagcgcaa

SEQ ID NO: 1041960 - RNA, 23 nt, Mycobacterium bovis subsp bovis AF2122/97
cugaagagcaauggcgcgguccu

SEQ ID NO: 1041961 - RNA, 18 nt, Mycobacterium bovis subsp bovis AF2122/97
cugaccguggcgccgguc

SEQ ID NO: 1041962 - RNA, 12 nt, Mycobacterium bovis subsp bovis AF2122/97
cugaaggccggu

SEQ ID NO: 1041963 - RNA, 18 nt, Mycobacterium bovis subsp bovis AF2122/97
cugaagggccgccucgcg

SEQ ID NO: 1041964 - RNA, 16 nt, Mycobacterium bovis subsp bovis AF2122/97
cugaagguggcgaacc

SEQ ID NO: 1041965 - RNA, 22 nt, Mycobacterium bovis subsp bovis AF2122/97
cugaagguggcgaacccgguca

SEQ ID NO: 1041966 - RNA, 19 nt, Mycobacterium bovis subsp bovis AF2122/97
cugaagcuguaggcgacca

SEQ ID NO: 1041967 - RNA, 15 nt, Mycobacterium bovis subsp bovis AF2122/97
cugacgccauucauc

SEQ ID NO: 1041968 - RNA, 14 nt, Mycobacterium bovis subsp bovis AF2122/97
cugacgccgagcug

SEQ ID NO: 1041969 - RNA, 21 nt, Mycobacterium bovis subsp bovis AF2122/97
cugacgaucuccacccgccgg

SEQ ID NO: 1041970 - RNA, 19 nt, Mycobacterium bovis subsp bovis AF2122/97
cugacgaccaaccaccgaa

SEQ ID NO: 1041971 - RNA, 16 nt, Mycobacterium bovis subsp bovis AF2122/97
cugacgaauccacugg

SEQ ID NO: 1041972 - RNA, 18 nt, Mycobacterium bovis subsp bovis AF2122/97
cugacgaaucgccuaccg

SEQ ID NO: 1041973 - RNA, 20 nt, Mycobacterium bovis subsp bovis AF2122/97
cugacgaaggucuccggcaa

SEQ ID NO: 1041974 - RNA, 19 nt, Mycobacterium bovis subsp bovis AF2122/97
cugacgaaauccgccgggc

SEQ ID NO: 1041975 - RNA, 17 nt, Mycobacterium bovis subsp bovis AF2122/97
cugaccucauguccgcc

SEQ ID NO: 1041976 - RNA, 18 nt, Mycobacterium bovis subsp bovis AF2122/97
cugaccucccacccccgg

SEQ ID NO: 1041977 - RNA, 13 nt, Mycobacterium bovis subsp bovis AF2122/97
cugaccgugcuga

SEQ ID NO: 1041978 - RNA, 21 nt, Mycobacterium bovis subsp bovis AF2122/97
cugaccucgucaaucaccacc

SEQ ID NO: 1041979 - RNA, 20 nt, Mycobacterium bovis subsp bovis AF2122/97
cugcaagacaaagccgucga

SEQ ID NO: 1041980 - RNA, 23 nt, Mycobacterium bovis subsp bovis AF2122/97
cugcaagacaaagccgucgacgc

SEQ ID NO: 1041981 - RNA, 19 nt, Mycobacterium bovis subsp bovis AF2122/97
cugauuggcccaccgccgu

SEQ ID NO: 1041982 - RNA, 17 nt, Mycobacterium bovis subsp bovis AF2122/97
cugauuccacugggccu

SEQ ID NO: 1041983 - RNA, 17 nt, Mycobacterium bovis subsp bovis AF2122/97
cugauggcgcugcaccg

SEQ ID NO: 1041984 - RNA, 21 nt, Mycobacterium bovis subsp bovis AF2122/97
cugauggugccgaaccggcgc

SEQ ID NO: 1041985 - RNA, 22 nt, Mycobacterium bovis subsp bovis AF2122/97
cugauggugccgaaccggcgca

SEQ ID NO: 1041986 - RNA, 14 nt, Mycobacterium bovis subsp bovis AF2122/97
cugaugucacccgc

SEQ ID NO: 1041987 - RNA, 14 nt, Mycobacterium bovis subsp bovis AF2122/97
cugauguucugcgg

SEQ ID NO: 1041988 - RNA, 19 nt, Mycobacterium bovis subsp bovis AF2122/97
cugcaagacgccgauccgg

SEQ ID NO: 1041989 - RNA, 20 nt, Mycobacterium bovis subsp bovis AF2122/97
cugcaccgggucaacgccau

SEQ ID NO: 1041990 - RNA, 20 nt, Mycobacterium bovis subsp bovis AF2122/97
cugcacagugcggccccgac

SEQ ID NO: 1041991 - RNA, 22 nt, Mycobacterium bovis subsp bovis AF2122/97
cugcacagcaggcucgaaccga

SEQ ID NO: 1041992 - RNA, 14 nt, Mycobacterium bovis subsp bovis AF2122/97
cugcacacaggacu

SEQ ID NO: 1041993 - RNA, 15 nt, Mycobacterium bovis subsp bovis AF2122/97
cugaggcggcgacga

SEQ ID NO: 1041994 - RNA, 20 nt, Mycobacterium bovis subsp bovis AF2122/97
cugaggcggcgacgaccguc

SEQ ID NO: 1041995 - RNA, 17 nt, Mycobacterium bovis subsp bovis AF2122/97
cugaggcuuccagcucg

SEQ ID NO: 1041996 - RNA, 18 nt, Mycobacterium bovis subsp bovis AF2122/97
cugaggcuuccagcucgg

SEQ ID NO: 1041997 - RNA, 14 nt, Mycobacterium bovis subsp bovis AF2122/97
cugaggaacgccgg

SEQ ID NO: 1041998 - RNA, 15 nt, Mycobacterium bovis subsp bovis AF2122/97
cugaggaacgccggc

SEQ ID NO: 1041999 - RNA, 16 nt, Mycobacterium bovis subsp bovis AF2122/97
cugaggaacgccggca

SEQ ID NO: 1042000 - RNA, 19 nt, Mycobacterium bovis subsp bovis AF2122/97
cugaggaagcggcggcaac

SEQ ID NO: 1042001 - RNA, 17 nt, Mycobacterium bovis subsp bovis AF2122/97
cugaggcaccucggccu

SEQ ID NO: 1042002 - RNA, 18 nt, Mycobacterium bovis subsp bovis AF2122/97
cugagggugcucucgugg

SEQ ID NO: 1042003 - RNA, 20 nt, Mycobacterium bovis subsp bovis AF2122/97
cugaggguggaccggucgac

SEQ ID NO: 1042004 - RNA, 20 nt, Mycobacterium bovis subsp bovis AF2122/97
cugagguauugggcgcggca

SEQ ID NO: 1042005 - RNA, 22 nt, Mycobacterium bovis subsp bovis AF2122/97
cugagguauugggcgcggcagg

SEQ ID NO: 1042006 - RNA, 21 nt, Mycobacterium bovis subsp bovis AF2122/97
cugagguggcggugcggcgag

SEQ ID NO: 1042007 - RNA, 19 nt, Mycobacterium bovis subsp bovis AF2122/97
cugaguccccaggugggca

SEQ ID NO: 1042008 - RNA, 21 nt, Mycobacterium bovis subsp bovis AF2122/97
cugagucgguucagccacgca

SEQ ID NO: 1042009 - RNA, 21 nt, Mycobacterium bovis subsp bovis AF2122/97
cugagucugauggccucgcga

SEQ ID NO: 1042010 - RNA, 19 nt, Mycobacterium bovis subsp bovis AF2122/97
cugauaaagcccggcggca

SEQ ID NO: 1042011 - RNA, 23 nt, Mycobacterium bovis subsp bovis AF2122/97
cugaugcgguagucgccgagguc

SEQ ID NO: 1042012 - RNA, 13 nt, Mycobacterium bovis subsp bovis AF2122/97
cugaugcuggcca

SEQ ID NO: 1042013 - RNA, 21 nt, Mycobacterium bovis subsp bovis AF2122/97
cugaugcguugauacgcgucg

SEQ ID NO: 1042014 - RNA, 20 nt, Mycobacterium bovis subsp bovis AF2122/97
cucggugaugcccagcgccg

SEQ ID NO: 1042015 - RNA, 21 nt, Mycobacterium bovis subsp bovis AF2122/97
cucggugaugcccagcgccga

SEQ ID NO: 1042016 - RNA, 13 nt, Mycobacterium bovis subsp bovis AF2122/97
cucggugacgaug

SEQ ID NO: 1042017 - RNA, 20 nt, Mycobacterium bovis subsp bovis AF2122/97
cucggugagcagcucgguga

SEQ ID NO: 1042018 - RNA, 17 nt, Mycobacterium bovis subsp bovis AF2122/97
cucggugaaguggcgca

SEQ ID NO: 1042019 - RNA, 19 nt, Mycobacterium bovis subsp bovis AF2122/97
cucggugaaguggcgcacc

SEQ ID NO: 1042020 - RNA, 16 nt, Mycobacterium bovis subsp bovis AF2122/97
cucggugaacgccgcc

SEQ ID NO: 1042021 - RNA, 23 nt, Mycobacterium bovis subsp bovis AF2122/97
cucggugaccaggccggcccgca

SEQ ID NO: 1042022 - RNA, 14 nt, Mycobacterium bovis subsp bovis AF2122/97
cucggucucgucgc

SEQ ID NO: 1042023 - RNA, 13 nt, Mycobacterium bovis subsp bovis AF2122/97
cucggugcgcagc

SEQ ID NO: 1042024 - RNA, 18 nt, Mycobacterium bovis subsp bovis AF2122/97
cucggugccacugccggu

SEQ ID NO: 1042025 - RNA, 16 nt, Mycobacterium bovis subsp bovis AF2122/97
cucggugaugucggug

SEQ ID NO: 1042026 - RNA, 11 nt, Mycobacterium bovis subsp bovis AF2122/97
cucggugcacg

SEQ ID NO: 1042027 - RNA, 15 nt, Mycobacterium bovis subsp bovis AF2122/97
cucggugcagcagcg

SEQ ID NO: 1042028 - RNA, 16 nt, Mycobacterium bovis subsp bovis AF2122/97
cucggugccacugccg

SEQ ID NO: 1042029 - RNA, 20 nt, Mycobacterium bovis subsp bovis AF2122/97
cucggugcggaacaccgccc

SEQ ID NO: 1042030 - RNA, 17 nt, Mycobacterium bovis subsp bovis AF2122/97
cucguagaaucggcuca

SEQ ID NO: 1042031 - RNA, 14 nt, Mycobacterium bovis subsp bovis AF2122/97
cucggugccggccg

SEQ ID NO: 1042032 - RNA, 18 nt, Mycobacterium bovis subsp bovis AF2122/97
cucgucggccaccgcggc

SEQ ID NO: 1042033 - RNA, 21 nt, Mycobacterium bovis subsp bovis AF2122/97
cucgucgcucccgguuggggu

SEQ ID NO: 1042034 - RNA, 17 nt, Mycobacterium bovis subsp bovis AF2122/97
cucgucgcgggcgaugg

SEQ ID NO: 1042035 - RNA, 21 nt, Mycobacterium bovis subsp bovis AF2122/97
cucgucgauguucgccgcgcg

SEQ ID NO: 1042036 - RNA, 18 nt, Mycobacterium bovis subsp bovis AF2122/97
cucgucgauugucaaccc

SEQ ID NO: 1042037 - RNA, 14 nt, Mycobacterium bovis subsp bovis AF2122/97
cucgucgccccguu

SEQ ID NO: 1042038 - RNA, 18 nt, Mycobacterium bovis subsp bovis AF2122/97
cucgucgaugucgacguc

SEQ ID NO: 1042039 - RNA, 19 nt, Mycobacterium bovis subsp bovis AF2122/97
cucgucgaucgccgcgccg

SEQ ID NO: 1042040 - RNA, 16 nt, Mycobacterium bovis subsp bovis AF2122/97
cucgucgaugcggugg

SEQ ID NO: 1042041 - RNA, 19 nt, Mycobacterium bovis subsp bovis AF2122/97
cucgucgaugcggugguag

SEQ ID NO: 1042042 - RNA, 15 nt, Mycobacterium bovis subsp bovis AF2122/97
cucgucgaucuccuc

SEQ ID NO: 1042043 - RNA, 17 nt, Mycobacterium bovis subsp bovis AF2122/97
cucgucgaucucgaucg

SEQ ID NO: 1042044 - RNA, 16 nt, Mycobacterium bovis subsp bovis AF2122/97
cucgucacccgguguc

SEQ ID NO: 1042045 - RNA, 19 nt, Mycobacterium bovis subsp bovis AF2122/97
cucguccaggucggccgcc

SEQ ID NO: 1042046 - RNA, 20 nt, Mycobacterium bovis subsp bovis AF2122/97
cucgucauccauccgggccg

SEQ ID NO: 1042047 - RNA, 18 nt, Mycobacterium bovis subsp bovis AF2122/97
cucguaugccguggccgc

SEQ ID NO: 1042048 - RNA, 20 nt, Mycobacterium bovis subsp bovis AF2122/97
cucguaugccguggccgcca

SEQ ID NO: 1042049 - RNA, 20 nt, Mycobacterium bovis subsp bovis AF2122/97
cucgucaaucaccaccgcca

SEQ ID NO: 1042050 - RNA, 20 nt, Mycobacterium bovis subsp bovis AF2122/97
cucguauacccgggcggucg

SEQ ID NO: 1042051 - RNA, 19 nt, Mycobacterium bovis subsp bovis AF2122/97
cucgucaaccugcgcauca

SEQ ID NO: 1042052 - RNA, 13 nt, Mycobacterium bovis subsp bovis AF2122/97
cucggucccgccg

SEQ ID NO: 1042053 - RNA, 16 nt, Mycobacterium bovis subsp bovis AF2122/97
cucggucccguugccg

SEQ ID NO: 1042054 - RNA, 12 nt, Mycobacterium bovis subsp bovis AF2122/97
cucggucgacgg

SEQ ID NO: 1042055 - RNA, 12 nt, Mycobacterium bovis subsp bovis AF2122/97
cucggucgaugc

SEQ ID NO: 1042056 - RNA, 13 nt, Mycobacterium bovis subsp bovis AF2122/97
cucggucgaugcu

SEQ ID NO: 1042057 - RNA, 15 nt, Mycobacterium bovis subsp bovis AF2122/97
cucggucgaugcuca

SEQ ID NO: 1042058 - RNA, 18 nt, Mycobacterium bovis subsp bovis AF2122/97
cucggucaggcggcuggc

SEQ ID NO: 1042059 - RNA, 23 nt, Mycobacterium bovis subsp bovis AF2122/97
cucggucaggcggcuggcccgca

SEQ ID NO: 1042060 - RNA, 14 nt, Mycobacterium bovis subsp bovis AF2122/97
cucggucagcucgu

SEQ ID NO: 1042061 - RNA, 19 nt, Mycobacterium bovis subsp bovis AF2122/97
cucgguaagugccucgcgg

SEQ ID NO: 1042062 - RNA, 16 nt, Mycobacterium bovis subsp bovis AF2122/97
cucggggugcacgaug

SEQ ID NO: 1042063 - RNA, 20 nt, Mycobacterium bovis subsp bovis AF2122/97
cucgggguuguucggcagcc

SEQ ID NO: 1042064 - RNA, 23 nt, Mycobacterium bovis subsp bovis AF2122/97
cucgggucaucuugccaccgcug

SEQ ID NO: 1042065 - RNA, 15 nt, Mycobacterium bovis subsp bovis AF2122/97
cucggguggccagcg

SEQ ID NO: 1042066 - RNA, 19 nt, Mycobacterium bovis subsp bovis AF2122/97
cucggucaccacggcggcg

SEQ ID NO: 1042067 - RNA, 14 nt, Mycobacterium bovis subsp bovis AF2122/97
cucgguaggccggc

SEQ ID NO: 1042068 - RNA, 17 nt, Mycobacterium bovis subsp bovis AF2122/97
cucgggcaccuggucgg

SEQ ID NO: 1042069 - RNA, 14 nt, Mycobacterium bovis subsp bovis AF2122/97
cucgggcagcgcgg

SEQ ID NO: 1042070 - RNA, 23 nt, Mycobacterium bovis subsp bovis AF2122/97
cucgggcaggccccacuggugca

SEQ ID NO: 1042071 - RNA, 16 nt, Mycobacterium bovis subsp bovis AF2122/97
cucgggcagcgucacc

SEQ ID NO: 1042072 - RNA, 17 nt, Mycobacterium bovis subsp bovis AF2122/97
cucgggcgcgggugacc

SEQ ID NO: 1042073 - RNA, 12 nt, Mycobacterium bovis subsp bovis AF2122/97
cucgggcgcccg

SEQ ID NO: 1042074 - RNA, 13 nt, Mycobacterium bovis subsp bovis AF2122/97
cucggggcgauga

SEQ ID NO: 1042075 - RNA, 17 nt, Mycobacterium bovis subsp bovis AF2122/97
cucgggcugccgcaugc

SEQ ID NO: 1042076 - RNA, 22 nt, Mycobacterium bovis subsp bovis AF2122/97
cucggggcucucgaguccaggc

SEQ ID NO: 1042077 - RNA, 14 nt, Mycobacterium bovis subsp bovis AF2122/97
cucgggggccgacc

SEQ ID NO: 1042078 - RNA, 19 nt, Mycobacterium bovis subsp bovis AF2122/97
cucguggaacuccguccgc

SEQ ID NO: 1042079 - RNA, 16 nt, Mycobacterium bovis subsp bovis AF2122/97
cucguggauggccgcc

SEQ ID NO: 1042080 - RNA, 19 nt, Mycobacterium bovis subsp bovis AF2122/97
cucguguccgccgucaccc

SEQ ID NO: 1042081 - RNA, 23 nt, Mycobacterium bovis subsp bovis AF2122/97
cucgucggccgacaccgccacca

SEQ ID NO: 1042082 - RNA, 20 nt, Mycobacterium bovis subsp bovis AF2122/97
cucguuagaguaggccacca

SEQ ID NO: 1042083 - RNA, 16 nt, Mycobacterium bovis subsp bovis AF2122/97
cucguuaucgaccgcc

SEQ ID NO: 1042084 - RNA, 17 nt, Mycobacterium bovis subsp bovis AF2122/97
cucguucaacuuggggu

SEQ ID NO: 1042085 - RNA, 23 nt, Mycobacterium bovis subsp bovis AF2122/97
cucguucaacuuggggucguucg

SEQ ID NO: 1042086 - RNA, 15 nt, Mycobacterium bovis subsp bovis AF2122/97
cucgucggccgacac

SEQ ID NO: 1042087 - RNA, 13 nt, Mycobacterium bovis subsp bovis AF2122/97
cucgucggcgaug

SEQ ID NO: 1042088 - RNA, 17 nt, Mycobacterium bovis subsp bovis AF2122/97
cucgugcaggaccagca

SEQ ID NO: 1042089 - RNA, 23 nt, Mycobacterium bovis subsp bovis AF2122/97
cucgugcgcuuggucgaccgccg

SEQ ID NO: 1042090 - RNA, 23 nt, Mycobacterium bovis subsp bovis AF2122/97
cucuggcggcgggggcggcggcu

SEQ ID NO: 1042091 - RNA, 12 nt, Mycobacterium bovis subsp bovis AF2122/97
cucuggucgucg

SEQ ID NO: 1042092 - RNA, 13 nt, Mycobacterium bovis subsp bovis AF2122/97
cucuggugacggu

SEQ ID NO: 1042093 - RNA, 14 nt, Mycobacterium bovis subsp bovis AF2122/97
cucucgggggccga

SEQ ID NO: 1042094 - RNA, 19 nt, Mycobacterium bovis subsp bovis AF2122/97
cucucggugaacgccgccc

SEQ ID NO: 1042095 - RNA, 21 nt, Mycobacterium bovis subsp bovis AF2122/97
cucucgucguauugccucacc

SEQ ID NO: 1042096 - RNA, 18 nt, Mycobacterium bovis subsp bovis AF2122/97
cucuccgucgcgcacggc

SEQ ID NO: 1042097 - RNA, 20 nt, Mycobacterium bovis subsp bovis AF2122/97
cucucgcagcauguccgcag

SEQ ID NO: 1042098 - RNA, 14 nt, Mycobacterium bovis subsp bovis AF2122/97
cucucgccacgccg

SEQ ID NO: 1042099 - RNA, 20 nt, Mycobacterium bovis subsp bovis AF2122/97
cucuccauggccgauuccgc

SEQ ID NO: 1042100 - RNA, 13 nt, Mycobacterium bovis subsp bovis AF2122/97
cucuccggugauc

SEQ ID NO: 1042101 - RNA, 20 nt, Mycobacterium bovis subsp bovis AF2122/97
cucuccggugaucaccgaca

SEQ ID NO: 1042102 - RNA, 19 nt, Mycobacterium bovis subsp bovis AF2122/97
cugaaaugccgucgucaaa

SEQ ID NO: 1042103 - RNA, 14 nt, Mycobacterium bovis subsp bovis AF2122/97
cugaacaaccagca

SEQ ID NO: 1042104 - RNA, 17 nt, Mycobacterium bovis subsp bovis AF2122/97
cucuucccaaccgcccg

SEQ ID NO: 1042105 - RNA, 16 nt, Mycobacterium bovis subsp bovis AF2122/97
cucuucggaggugacc

SEQ ID NO: 1042106 - RNA, 17 nt, Mycobacterium bovis subsp bovis AF2122/97
cucuucggcaccaccgc

SEQ ID NO: 1042107 - RNA, 21 nt, Mycobacterium bovis subsp bovis AF2122/97
cucuucggcaccaccgcgacc

SEQ ID NO: 1042108 - RNA, 22 nt, Mycobacterium bovis subsp bovis AF2122/97
cucuucggcggacaggcccggu

SEQ ID NO: 1042109 - RNA, 13 nt, Mycobacterium bovis subsp bovis AF2122/97
cucuucggcggug

SEQ ID NO: 1042110 - RNA, 15 nt, Mycobacterium bovis subsp bovis AF2122/97
cucuguaccccaacg

SEQ ID NO: 1042111 - RNA, 16 nt, Mycobacterium bovis subsp bovis AF2122/97
cucuucagcaagccaa

SEQ ID NO: 1042112 - RNA, 15 nt, Mycobacterium bovis subsp bovis AF2122/97
cguuggggcugccgu

SEQ ID NO: 1042113 - RNA, 21 nt, Mycobacterium bovis subsp bovis AF2122/97
cguuggucaucaacgccacga

SEQ ID NO: 1042114 - RNA, 20 nt, Mycobacterium bovis subsp bovis AF2122/97
cguuggguugaaaacgcccg

SEQ ID NO: 1042115 - RNA, 23 nt, Mycobacterium bovis subsp bovis AF2122/97
cguuggguugaaaacgcccggca

SEQ ID NO: 1042116 - RNA, 16 nt, Mycobacterium bovis subsp bovis AF2122/97
cguugguagccagggc

SEQ ID NO: 1042117 - RNA, 15 nt, Mycobacterium bovis subsp bovis AF2122/97
cguuggugcagacca

SEQ ID NO: 1042118 - RNA, 15 nt, Mycobacterium bovis subsp bovis AF2122/97
cguuguccagcgcga

SEQ ID NO: 1042119 - RNA, 18 nt, Mycobacterium bovis subsp bovis AF2122/97
cguuguccaccgccacca

SEQ ID NO: 1042120 - RNA, 22 nt, Mycobacterium bovis subsp bovis AF2122/97
cguugucagcgaacggccagga

SEQ ID NO: 1042121 - RNA, 22 nt, Mycobacterium bovis subsp bovis AF2122/97
cguuguaugcguuacgccgcga

SEQ ID NO: 1042122 - RNA, 18 nt, Mycobacterium bovis subsp bovis AF2122/97
cguuguaugcugcgcgcc

SEQ ID NO: 1042123 - RNA, 13 nt, Mycobacterium bovis subsp bovis AF2122/97
cguuguagacggc

SEQ ID NO: 1042124 - RNA, 13 nt, Mycobacterium bovis subsp bovis AF2122/97
cguuguaggcuuc

SEQ ID NO: 1042125 - RNA, 18 nt, Mycobacterium bovis subsp bovis AF2122/97
cguuguaguccugcgggc

SEQ ID NO: 1042126 - RNA, 18 nt, Mycobacterium bovis subsp bovis AF2122/97
cguuggcgugcucaccau

SEQ ID NO: 1042127 - RNA, 13 nt, Mycobacterium bovis subsp bovis AF2122/97
cguuggcgguggu

SEQ ID NO: 1042128 - RNA, 18 nt, Mycobacterium bovis subsp bovis AF2122/97
cguuggcucgagccgccc

SEQ ID NO: 1042129 - RNA, 19 nt, Mycobacterium bovis subsp bovis AF2122/97
cguuggcucgagccgcccg

SEQ ID NO: 1042130 - RNA, 17 nt, Mycobacterium bovis subsp bovis AF2122/97
cguuggcuucuucgguc

SEQ ID NO: 1042131 - RNA, 21 nt, Mycobacterium bovis subsp bovis AF2122/97
cguuggcuucuucggucaccu

SEQ ID NO: 1042132 - RNA, 16 nt, Mycobacterium bovis subsp bovis AF2122/97
cguugggaaugucgaa

SEQ ID NO: 1042133 - RNA, 16 nt, Mycobacterium bovis subsp bovis AF2122/97
cguugggaccagugcg

SEQ ID NO: 1042134 - RNA, 18 nt, Mycobacterium bovis subsp bovis AF2122/97
cguugggaucccagcgca

SEQ ID NO: 1042135 - RNA, 19 nt, Mycobacterium bovis subsp bovis AF2122/97
cguugggaucccagcgcag

SEQ ID NO: 1042136 - RNA, 17 nt, Mycobacterium bovis subsp bovis AF2122/97
cguugggccaccggcgc

SEQ ID NO: 1042137 - RNA, 21 nt, Mycobacterium bovis subsp bovis AF2122/97
cguugggaucccagcgcagcg

SEQ ID NO: 1042138 - RNA, 19 nt, Mycobacterium bovis subsp bovis AF2122/97
cguugggaucgcgcagcgc

SEQ ID NO: 1042139 - RNA, 20 nt, Mycobacterium bovis subsp bovis AF2122/97
cguugggcagcuccaccagg

SEQ ID NO: 1042140 - RNA, 18 nt, Mycobacterium bovis subsp bovis AF2122/97
cguuggcgaacugguagc

SEQ ID NO: 1042141 - RNA, 16 nt, Mycobacterium bovis subsp bovis AF2122/97
cguuggcgaccaccgc

SEQ ID NO: 1042142 - RNA, 18 nt, Mycobacterium bovis subsp bovis AF2122/97
cguuggcgaccaccgcgu

SEQ ID NO: 1042143 - RNA, 20 nt, Mycobacterium bovis subsp bovis AF2122/97
cguuggcgaccaccgcgucg

SEQ ID NO: 1042144 - RNA, 19 nt, Mycobacterium bovis subsp bovis AF2122/97
cguuggcggccagcgcacc

SEQ ID NO: 1042145 - RNA, 20 nt, Mycobacterium bovis subsp bovis AF2122/97
cguuggcgccaccagucacg

SEQ ID NO: 1042146 - RNA, 19 nt, Mycobacterium bovis subsp bovis AF2122/97
cguuggcggcggucggcug

SEQ ID NO: 1042147 - RNA, 18 nt, Mycobacterium bovis subsp bovis AF2122/97
cguuggcgggagcaccga

SEQ ID NO: 1042148 - RNA, 17 nt, Mycobacterium bovis subsp bovis AF2122/97
cguugucgcccacccac

SEQ ID NO: 1042149 - RNA, 16 nt, Mycobacterium bovis subsp bovis AF2122/97
cguugucggcuggacg

SEQ ID NO: 1042150 - RNA, 20 nt, Mycobacterium bovis subsp bovis AF2122/97
cguugucggcuggacggcgc

SEQ ID NO: 1042151 - RNA, 19 nt, Mycobacterium bovis subsp bovis AF2122/97
cguugucgggcaacacgau

SEQ ID NO: 1042152 - RNA, 20 nt, Mycobacterium bovis subsp bovis AF2122/97
cguuguucccauagccagcc

SEQ ID NO: 1042153 - RNA, 21 nt, Mycobacterium bovis subsp bovis AF2122/97
cguugugcagguggccgucgc

SEQ ID NO: 1042154 - RNA, 15 nt, Mycobacterium bovis subsp bovis AF2122/97
cguuguucaccgacg

SEQ ID NO: 1042155 - RNA, 21 nt, Mycobacterium bovis subsp bovis AF2122/97
cguuguuggauccggccacca

SEQ ID NO: 1042156 - RNA, 16 nt, Mycobacterium bovis subsp bovis AF2122/97
cguugugucaccggcg

SEQ ID NO: 1042157 - RNA, 14 nt, Mycobacterium bovis subsp bovis AF2122/97
cguugugauccggu

SEQ ID NO: 1042158 - RNA, 22 nt, Mycobacterium bovis subsp bovis AF2122/97
cguuuauuguccugccgacagu

SEQ ID NO: 1042159 - RNA, 17 nt, Mycobacterium bovis subsp bovis AF2122/97
cguuucacccgggcugc

SEQ ID NO: 1042160 - RNA, 20 nt, Mycobacterium bovis subsp bovis AF2122/97
cguuucacgaaacccagucg

SEQ ID NO: 1042161 - RNA, 17 nt, Mycobacterium bovis subsp bovis AF2122/97
cguuuagggugcccgcg

SEQ ID NO: 1042162 - RNA, 19 nt, Mycobacterium bovis subsp bovis AF2122/97
cguuuacggcccggcaccc

SEQ ID NO: 1042163 - RNA, 20 nt, Mycobacterium bovis subsp bovis AF2122/97
cguuuacauagaccaccggc

SEQ ID NO: 1042164 - RNA, 12 nt, Mycobacterium bovis subsp bovis AF2122/97
cguuguugucga

SEQ ID NO: 1042165 - RNA, 20 nt, Mycobacterium bovis subsp bovis AF2122/97
cguuuccucagcugcucguc

SEQ ID NO: 1042166 - RNA, 20 nt, Mycobacterium bovis subsp bovis AF2122/97
cguuuccgccgccgccgcca

SEQ ID NO: 1042167 - RNA, 12 nt, Mycobacterium bovis subsp bovis AF2122/97
cguuuccgcugg

SEQ ID NO: 1042168 - RNA, 21 nt, Mycobacterium bovis subsp bovis AF2122/97
cguuuccgcugggagcggaug

SEQ ID NO: 1042169 - RNA, 19 nt, Mycobacterium bovis subsp bovis AF2122/97
cguuucccuggccgccgcc

SEQ ID NO: 1042170 - RNA, 23 nt, Mycobacterium bovis subsp bovis AF2122/97
cguuucgcgaugugcgccaccuc

SEQ ID NO: 1042171 - RNA, 12 nt, Mycobacterium bovis subsp bovis AF2122/97
cguuucggcgcc

SEQ ID NO: 1042172 - RNA, 21 nt, Mycobacterium bovis subsp bovis AF2122/97
cguuugcgagcaggggaguug

SEQ ID NO: 1042173 - RNA, 16 nt, Mycobacterium bovis subsp bovis AF2122/97
cguuugacgcgcucgc

SEQ ID NO: 1042174 - RNA, 18 nt, Mycobacterium bovis subsp bovis AF2122/97
cguuuggcagagccgacu

SEQ ID NO: 1042175 - RNA, 14 nt, Mycobacterium bovis subsp bovis AF2122/97
cguuuugcggcccg

SEQ ID NO: 1042176 - RNA, 22 nt, Mycobacterium bovis subsp bovis AF2122/97
cguuuuggugcggaccugcgcc

SEQ ID NO: 1042177 - RNA, 14 nt, Mycobacterium bovis subsp bovis AF2122/97
cguuuucggccuga

SEQ ID NO: 1042178 - RNA, 13 nt, Mycobacterium bovis subsp bovis AF2122/97
cguuuggcugccg

SEQ ID NO: 1042179 - RNA, 14 nt, Mycobacterium bovis subsp bovis AF2122/97
cguuugggucaucg

SEQ ID NO: 1042180 - RNA, 18 nt, Mycobacterium bovis subsp bovis AF2122/97
cuaaacaggccgccaccg

SEQ ID NO: 1042181 - RNA, 16 nt, Mycobacterium bovis subsp bovis AF2122/97
cuaaacuccgugccga

SEQ ID NO: 1042182 - RNA, 22 nt, Mycobacterium bovis subsp bovis AF2122/97
cguugccaccggugccggcgac

SEQ ID NO: 1042183 - RNA, 12 nt, Mycobacterium bovis subsp bovis AF2122/97
cguugccaccgu

SEQ ID NO: 1042184 - RNA, 21 nt, Mycobacterium bovis subsp bovis AF2122/97
cguugccaccguugccgccgu

SEQ ID NO: 1042185 - RNA, 13 nt, Mycobacterium bovis subsp bovis AF2122/97
cguugccgaacgu

SEQ ID NO: 1042186 - RNA, 22 nt, Mycobacterium bovis subsp bovis AF2122/97
cguugccgaccgauacaccgac

SEQ ID NO: 1042187 - RNA, 23 nt, Mycobacterium bovis subsp bovis AF2122/97
cguugccgaccgauacaccgacg

SEQ ID NO: 1042188 - RNA, 12 nt, Mycobacterium bovis subsp bovis AF2122/97
cguugccgccga

SEQ ID NO: 1042189 - RNA, 20 nt, Mycobacterium bovis subsp bovis AF2122/97
cguugccgccgaagccgacg

SEQ ID NO: 1042190 - RNA, 14 nt, Mycobacterium bovis subsp bovis AF2122/97
cguugccgaucacc

SEQ ID NO: 1042191 - RNA, 16 nt, Mycobacterium bovis subsp bovis AF2122/97
cguugccgaucaccac

SEQ ID NO: 1042192 - RNA, 18 nt, Mycobacterium bovis subsp bovis AF2122/97
cguugccgauggugaugg

SEQ ID NO: 1042193 - RNA, 21 nt, Mycobacterium bovis subsp bovis AF2122/97
cguugcccacguugacggcga

SEQ ID NO: 1042194 - RNA, 18 nt, Mycobacterium bovis subsp bovis AF2122/97
cguugcgaggccgcacgu

SEQ ID NO: 1042195 - RNA, 21 nt, Mycobacterium bovis subsp bovis AF2122/97
cguugcgaggccgcacgucga

SEQ ID NO: 1042196 - RNA, 22 nt, Mycobacterium bovis subsp bovis AF2122/97
cguugcgacaccuccgucagcg

SEQ ID NO: 1042197 - RNA, 20 nt, Mycobacterium bovis subsp bovis AF2122/97
cguugccgucgucgccgucg

SEQ ID NO: 1042198 - RNA, 19 nt, Mycobacterium bovis subsp bovis AF2122/97
cguugccguuggugccgcc

SEQ ID NO: 1042199 - RNA, 21 nt, Mycobacterium bovis subsp bovis AF2122/97
cguugccguuggugccgccug

SEQ ID NO: 1042200 - RNA, 18 nt, Mycobacterium bovis subsp bovis AF2122/97
cguugccucgucgccgcg

SEQ ID NO: 1042201 - RNA, 19 nt, Mycobacterium bovis subsp bovis AF2122/97
cguugccucgucgccgcgg

SEQ ID NO: 1042202 - RNA, 14 nt, Mycobacterium bovis subsp bovis AF2122/97
cguugccggcguug

SEQ ID NO: 1042203 - RNA, 15 nt, Mycobacterium bovis subsp bovis AF2122/97
cguugccggcgacca

SEQ ID NO: 1042204 - RNA, 15 nt, Mycobacterium bovis subsp bovis AF2122/97
cguugccggugccgc

SEQ ID NO: 1042205 - RNA, 17 nt, Mycobacterium bovis subsp bovis AF2122/97
cguugccggugccgccg

SEQ ID NO: 1042206 - RNA, 21 nt, Mycobacterium bovis subsp bovis AF2122/97
cguugccguagcugacggccu

SEQ ID NO: 1042207 - RNA, 22 nt, Mycobacterium bovis subsp bovis AF2122/97
cguugccgggguaggggucgag

SEQ ID NO: 1042208 - RNA, 14 nt, Mycobacterium bovis subsp bovis AF2122/97
cguugccgggguug

SEQ ID NO: 1042209 - RNA, 15 nt, Mycobacterium bovis subsp bovis AF2122/97
cguugccgccggcuc

SEQ ID NO: 1042210 - RNA, 14 nt, Mycobacterium bovis subsp bovis AF2122/97
cguugccgccggug

SEQ ID NO: 1042211 - RNA, 18 nt, Mycobacterium bovis subsp bovis AF2122/97
cguugccgccgucaccgc

SEQ ID NO: 1042212 - RNA, 23 nt, Mycobacterium bovis subsp bovis AF2122/97
cguugccgccguccccgccgacg

SEQ ID NO: 1042213 - RNA, 20 nt, Mycobacterium bovis subsp bovis AF2122/97
cguugccgccgucgccgccg

SEQ ID NO: 1042214 - RNA, 14 nt, Mycobacterium bovis subsp bovis AF2122/97
cguugccgccguua

SEQ ID NO: 1042215 - RNA, 16 nt, Mycobacterium bovis subsp bovis AF2122/97
cguugccgccggcgcc

SEQ ID NO: 1042216 - RNA, 21 nt, Mycobacterium bovis subsp bovis AF2122/97
cguugccgccggcgccgccga

SEQ ID NO: 1042217 - RNA, 23 nt, Mycobacterium bovis subsp bovis AF2122/97
cguugccgccggcgccgccguua

SEQ ID NO: 1042218 - RNA, 20 nt, Mycobacterium bovis subsp bovis AF2122/97
cguugcccccauugccgccg

SEQ ID NO: 1042219 - RNA, 14 nt, Mycobacterium bovis subsp bovis AF2122/97
cguugccgccgacg

SEQ ID NO: 1042220 - RNA, 12 nt, Mycobacterium bovis subsp bovis AF2122/97
cguugccgccgg

SEQ ID NO: 1042221 - RNA, 14 nt, Mycobacterium bovis subsp bovis AF2122/97
cguugccgccguug

SEQ ID NO: 1042222 - RNA, 18 nt, Mycobacterium bovis subsp bovis AF2122/97
cguugccgccguugccgc

SEQ ID NO: 1042223 - RNA, 20 nt, Mycobacterium bovis subsp bovis AF2122/97
cguugccgccguugccgccg

SEQ ID NO: 1042224 - RNA, 23 nt, Mycobacterium bovis subsp bovis AF2122/97
cguugccgccguugccgccgaag

SEQ ID NO: 1042225 - RNA, 23 nt, Mycobacterium bovis subsp bovis AF2122/97
cguugccgccguugccgccguua

SEQ ID NO: 1042226 - RNA, 19 nt, Mycobacterium bovis subsp bovis AF2122/97
cguugccgccguugccggc

SEQ ID NO: 1042227 - RNA, 21 nt, Mycobacterium bovis subsp bovis AF2122/97
cguugccgccguugccggcuu

SEQ ID NO: 1042228 - RNA, 20 nt, Mycobacterium bovis subsp bovis AF2122/97
cguugccgccuuugcccccg

SEQ ID NO: 1042229 - RNA, 20 nt, Mycobacterium bovis subsp bovis AF2122/97
cguugccgccggcgccggca

SEQ ID NO: 1042230 - RNA, 12 nt, Mycobacterium bovis subsp bovis AF2122/97
cguugcgccagc

SEQ ID NO: 1042231 - RNA, 13 nt, Mycobacterium bovis subsp bovis AF2122/97
cguugcgccagcg

SEQ ID NO: 1042232 - RNA, 17 nt, Mycobacterium bovis subsp bovis AF2122/97
cguugcgcaagcuggua

SEQ ID NO: 1042233 - RNA, 20 nt, Mycobacterium bovis subsp bovis AF2122/97
cguugcguagcaggucgacg

SEQ ID NO: 1042234 - RNA, 22 nt, Mycobacterium bovis subsp bovis AF2122/97
cguugcguagcaggucgacggc

SEQ ID NO: 1042235 - RNA, 19 nt, Mycobacterium bovis subsp bovis AF2122/97
cguugcguuggcgccacca

SEQ ID NO: 1042236 - RNA, 19 nt, Mycobacterium bovis subsp bovis AF2122/97
cguugcggaaucagcaccc

SEQ ID NO: 1042237 - RNA, 17 nt, Mycobacterium bovis subsp bovis AF2122/97
cguugcggacggcguug

SEQ ID NO: 1042238 - RNA, 17 nt, Mycobacterium bovis subsp bovis AF2122/97
cguugcgcugcgcgacg

SEQ ID NO: 1042239 - RNA, 15 nt, Mycobacterium bovis subsp bovis AF2122/97
cguugcuggcggcca

SEQ ID NO: 1042240 - RNA, 21 nt, Mycobacterium bovis subsp bovis AF2122/97
cguugcuggcggccagcaucg

SEQ ID NO: 1042241 - RNA, 21 nt, Mycobacterium bovis subsp bovis AF2122/97
cguugcuggcuggguggcccc

SEQ ID NO: 1042242 - RNA, 17 nt, Mycobacterium bovis subsp bovis AF2122/97
cguugcuggucgccguc

SEQ ID NO: 1042243 - RNA, 19 nt, Mycobacterium bovis subsp bovis AF2122/97
cguugcuggucgccgucga

SEQ ID NO: 1042244 - RNA, 17 nt, Mycobacterium bovis subsp bovis AF2122/97
cguugcucggucucguc

SEQ ID NO: 1042245 - RNA, 21 nt, Mycobacterium bovis subsp bovis AF2122/97
cguugcucggucucgucgcgg

SEQ ID NO: 1042246 - RNA, 16 nt, Mycobacterium bovis subsp bovis AF2122/97
cguugcugauggugcc

SEQ ID NO: 1042247 - RNA, 20 nt, Mycobacterium bovis subsp bovis AF2122/97
cguugcugauggugccgaac

SEQ ID NO: 1042248 - RNA, 21 nt, Mycobacterium bovis subsp bovis AF2122/97
cguugcugaugucgccggugu

SEQ ID NO: 1042249 - RNA, 21 nt, Mycobacterium bovis subsp bovis AF2122/97
cguugcugcagcagcgcaguc

SEQ ID NO: 1042250 - RNA, 14 nt, Mycobacterium bovis subsp bovis AF2122/97
cguugcugccggcg

SEQ ID NO: 1042251 - RNA, 14 nt, Mycobacterium bovis subsp bovis AF2122/97
cguuggagccgcca

SEQ ID NO: 1042252 - RNA, 18 nt, Mycobacterium bovis subsp bovis AF2122/97
cguuggccccgcggagcg

SEQ ID NO: 1042253 - RNA, 13 nt, Mycobacterium bovis subsp bovis AF2122/97
cguuggcagcccu

SEQ ID NO: 1042254 - RNA, 13 nt, Mycobacterium bovis subsp bovis AF2122/97
cguuggcccgccu

SEQ ID NO: 1042255 - RNA, 21 nt, Mycobacterium bovis subsp bovis AF2122/97
cguuggccgagcagggccggc

SEQ ID NO: 1042256 - RNA, 19 nt, Mycobacterium bovis subsp bovis AF2122/97
cguuggcaaugaccccggc

SEQ ID NO: 1042257 - RNA, 14 nt, Mycobacterium bovis subsp bovis AF2122/97
cguuggcagcacag

SEQ ID NO: 1042258 - RNA, 22 nt, Mycobacterium bovis subsp bovis AF2122/97
cguugaugaccaggucggucag

SEQ ID NO: 1042259 - RNA, 20 nt, Mycobacterium bovis subsp bovis AF2122/97
cguugaugaugccggcguug

SEQ ID NO: 1042260 - RNA, 18 nt, Mycobacterium bovis subsp bovis AF2122/97
cguugauucggccgccga

SEQ ID NO: 1042261 - RNA, 21 nt, Mycobacterium bovis subsp bovis AF2122/97
cguugauucggccgccgacgu

SEQ ID NO: 1042262 - RNA, 15 nt, Mycobacterium bovis subsp bovis AF2122/97
cguugaugccgccgg

SEQ ID NO: 1042263 - RNA, 15 nt, Mycobacterium bovis subsp bovis AF2122/97
cguugauuucggcgg

SEQ ID NO: 1042264 - RNA, 21 nt, Mycobacterium bovis subsp bovis AF2122/97
cguugaccagaaccuggagcc

SEQ ID NO: 1042265 - RNA, 21 nt, Mycobacterium bovis subsp bovis AF2122/97
cguugacgccguugccaccgu

SEQ ID NO: 1042266 - RNA, 18 nt, Mycobacterium bovis subsp bovis AF2122/97
cguugacggcuucggcag

SEQ ID NO: 1042267 - RNA, 20 nt, Mycobacterium bovis subsp bovis AF2122/97
cguugacgguugccccggcg

SEQ ID NO: 1042268 - RNA, 15 nt, Mycobacterium bovis subsp bovis AF2122/97
cguugacguccaaca

SEQ ID NO: 1042269 - RNA, 17 nt, Mycobacterium bovis subsp bovis AF2122/97
cguugacguccaacagc

SEQ ID NO: 1042270 - RNA, 22 nt, Mycobacterium bovis subsp bovis AF2122/97
cguugaguggaugcgccgcacg

SEQ ID NO: 1042271 - RNA, 23 nt, Mycobacterium bovis subsp bovis AF2122/97
cguugauaaaaaccuggcccgcc

SEQ ID NO: 1042272 - RNA, 17 nt, Mycobacterium bovis subsp bovis AF2122/97
cguugauacgcgucgau

SEQ ID NO: 1042273 - RNA, 17 nt, Mycobacterium bovis subsp bovis AF2122/97
cguugauacggcaugcg

SEQ ID NO: 1042274 - RNA, 20 nt, Mycobacterium bovis subsp bovis AF2122/97
cguucucggcacccucagcg

SEQ ID NO: 1042275 - RNA, 17 nt, Mycobacterium bovis subsp bovis AF2122/97
cguucucgauugucgcc

SEQ ID NO: 1042276 - RNA, 15 nt, Mycobacterium bovis subsp bovis AF2122/97
cguugaagucgccgg

SEQ ID NO: 1042277 - RNA, 18 nt, Mycobacterium bovis subsp bovis AF2122/97
cguugaagucgccgguga

SEQ ID NO: 1042278 - RNA, 20 nt, Mycobacterium bovis subsp bovis AF2122/97
cguugaccgcggucugcgcg

SEQ ID NO: 1042279 - RNA, 22 nt, Mycobacterium bovis subsp bovis AF2122/97
cguugaccgcgugagcagacgc

SEQ ID NO: 1042280 - RNA, 20 nt, Mycobacterium bovis subsp bovis AF2122/97
cguugaccagcacgacugca

SEQ ID NO: 1042281 - RNA, 21 nt, Mycobacterium bovis subsp bovis AF2122/97
cguugaccgggucgccgauga

SEQ ID NO: 1042282 - RNA, 17 nt, Mycobacterium bovis subsp bovis AF2122/97
cguugaccucuucgggc

SEQ ID NO: 1042283 - RNA, 19 nt, Mycobacterium bovis subsp bovis AF2122/97
cguugacgaacaccucggg

SEQ ID NO: 1042284 - RNA, 15 nt, Mycobacterium bovis subsp bovis AF2122/97
cguggaaagccggcg

SEQ ID NO: 1042285 - RNA, 21 nt, Mycobacterium bovis subsp bovis AF2122/97
cguggaacacgaagucgaacg

SEQ ID NO: 1042286 - RNA, 13 nt, Mycobacterium bovis subsp bovis AF2122/97
cguucccggcaga

SEQ ID NO: 1042287 - RNA, 17 nt, Mycobacterium bovis subsp bovis AF2122/97
cguucccccggcaccgc

SEQ ID NO: 1042288 - RNA, 18 nt, Mycobacterium bovis subsp bovis AF2122/97
cgugcuuggcagcggugu

SEQ ID NO: 1042289 - RNA, 16 nt, Mycobacterium bovis subsp bovis AF2122/97
cgugcuuccauucgcg

SEQ ID NO: 1042290 - RNA, 19 nt, Mycobacterium bovis subsp bovis AF2122/97
cgugcuuuccuugcgcgcc

SEQ ID NO: 1042291 - RNA, 21 nt, Mycobacterium bovis subsp bovis AF2122/97
cgugcucgucguacaugggca

SEQ ID NO: 1042292 - RNA, 21 nt, Mycobacterium bovis subsp bovis AF2122/97
cgugcuggugguaucggcgug

SEQ ID NO: 1042293 - RNA, 19 nt, Mycobacterium bovis subsp bovis AF2122/97
cgugcugggugacaccggu

SEQ ID NO: 1042294 - RNA, 15 nt, Mycobacterium bovis subsp bovis AF2122/97
cgugcugugcucacg

SEQ ID NO: 1042295 - RNA, 14 nt, Mycobacterium bovis subsp bovis AF2122/97
cgugcuugaccgcc

SEQ ID NO: 1042296 - RNA, 15 nt, Mycobacterium bovis subsp bovis AF2122/97
cgugcuugaccgccu

SEQ ID NO: 1042297 - RNA, 19 nt, Mycobacterium bovis subsp bovis AF2122/97
cgugcuguggaugccgacg

SEQ ID NO: 1042298 - RNA, 23 nt, Mycobacterium bovis subsp bovis AF2122/97
cguuccugaucgagcgccagcgc

SEQ ID NO: 1042299 - RNA, 21 nt, Mycobacterium bovis subsp bovis AF2122/97
cguucccgccauugccgccgu

SEQ ID NO: 1042300 - RNA, 14 nt, Mycobacterium bovis subsp bovis AF2122/97
cguuccgcucgccg

SEQ ID NO: 1042301 - RNA, 17 nt, Mycobacterium bovis subsp bovis AF2122/97
cguuccgcucgccguuu

SEQ ID NO: 1042302 - RNA, 14 nt, Mycobacterium bovis subsp bovis AF2122/97
cguuccgcuggacg

SEQ ID NO: 1042303 - RNA, 17 nt, Mycobacterium bovis subsp bovis AF2122/97
cguucggugaucucgua

SEQ ID NO: 1042304 - RNA, 16 nt, Mycobacterium bovis subsp bovis AF2122/97
cguucgucaccacgau

SEQ ID NO: 1042305 - RNA, 15 nt, Mycobacterium bovis subsp bovis AF2122/97
cguucgugggcauug

SEQ ID NO: 1042306 - RNA, 16 nt, Mycobacterium bovis subsp bovis AF2122/97
cuaccugcacccaggc

SEQ ID NO: 1042307 - RNA, 15 nt, Mycobacterium bovis subsp bovis AF2122/97
cuaccgucgaccacu

SEQ ID NO: 1042308 - RNA, 14 nt, Mycobacterium bovis subsp bovis AF2122/97
cuaccgugcuggca

SEQ ID NO: 1042309 - RNA, 17 nt, Mycobacterium bovis subsp bovis AF2122/97
cuaccgugcuggcacca

SEQ ID NO: 1042310 - RNA, 13 nt, Mycobacterium bovis subsp bovis AF2122/97
cuaccuaacccgc

SEQ ID NO: 1042311 - RNA, 14 nt, Mycobacterium bovis subsp bovis AF2122/97
cuaccgggcccgcg

SEQ ID NO: 1042312 - RNA, 13 nt, Mycobacterium bovis subsp bovis AF2122/97
cuacccauggccc

SEQ ID NO: 1042313 - RNA, 14 nt, Mycobacterium bovis subsp bovis AF2122/97
cuaccccggugaca

SEQ ID NO: 1042314 - RNA, 22 nt, Mycobacterium bovis subsp bovis AF2122/97
cuaccagccauagugcggcagc

SEQ ID NO: 1042315 - RNA, 23 nt, Mycobacterium bovis subsp bovis AF2122/97
cuaccagccauagugcggcagcg

SEQ ID NO: 1042316 - RNA, 15 nt, Mycobacterium bovis subsp bovis AF2122/97
cuaccagccgccccg

SEQ ID NO: 1042317 - RNA, 13 nt, Mycobacterium bovis subsp bovis AF2122/97
cuaccaggcgcgg

SEQ ID NO: 1042318 - RNA, 15 nt, Mycobacterium bovis subsp bovis AF2122/97
cuaccaggcgcggcc

SEQ ID NO: 1042319 - RNA, 16 nt, Mycobacterium bovis subsp bovis AF2122/97
cuaccaggcgcggccc

SEQ ID NO: 1042320 - RNA, 15 nt, Mycobacterium bovis subsp bovis AF2122/97
cuacccagccagccg

SEQ ID NO: 1042321 - RNA, 15 nt, Mycobacterium bovis subsp bovis AF2122/97
cuaauugcggccgcc

SEQ ID NO: 1042322 - RNA, 21 nt, Mycobacterium bovis subsp bovis AF2122/97
cuaccaacgcaacacgggcgc

SEQ ID NO: 1042323 - RNA, 16 nt, Mycobacterium bovis subsp bovis AF2122/97
cuaacggcagccaccg

SEQ ID NO: 1042324 - RNA, 18 nt, Mycobacterium bovis subsp bovis AF2122/97
cuaacggcagccaccguc

SEQ ID NO: 1042325 - RNA, 15 nt, Mycobacterium bovis subsp bovis AF2122/97
cuaacccgcaccgga

SEQ ID NO: 1042326 - RNA, 22 nt, Mycobacterium bovis subsp bovis AF2122/97
cuaacccgcaccggaucggcua

SEQ ID NO: 1042327 - RNA, 22 nt, Mycobacterium bovis subsp bovis AF2122/97
cuaacgcaccugcgcgcggccg

SEQ ID NO: 1042328 - RNA, 14 nt, Mycobacterium bovis subsp bovis AF2122/97
cuaacccgcgccgg

SEQ ID NO: 1042329 - RNA, 17 nt, Mycobacterium bovis subsp bovis AF2122/97
cuaagcauucagcgcgc

SEQ ID NO: 1042330 - RNA, 21 nt, Mycobacterium bovis subsp bovis AF2122/97
cuaucccaggggcaccgagcu

SEQ ID NO: 1042331 - RNA, 16 nt, Mycobacterium bovis subsp bovis AF2122/97
cuaggacgccgcccuc

SEQ ID NO: 1042332 - RNA, 17 nt, Mycobacterium bovis subsp bovis AF2122/97
cuauccuugguuagccg

SEQ ID NO: 1042333 - RNA, 23 nt, Mycobacterium bovis subsp bovis AF2122/97
cuaucgaggaggcggucgaucag

SEQ ID NO: 1042334 - RNA, 12 nt, Mycobacterium bovis subsp bovis AF2122/97
cuagucgcggcc

SEQ ID NO: 1042335 - RNA, 17 nt, Mycobacterium bovis subsp bovis AF2122/97
cuagucguagacggcga

SEQ ID NO: 1042336 - RNA, 19 nt, Mycobacterium bovis subsp bovis AF2122/97
cuaguucgagcugccaggc

SEQ ID NO: 1042337 - RNA, 18 nt, Mycobacterium bovis subsp bovis AF2122/97
cuaugucauagcgcacca

SEQ ID NO: 1042338 - RNA, 16 nt, Mycobacterium bovis subsp bovis AF2122/97
cuaucgguucagcugc

SEQ ID NO: 1042339 - RNA, 14 nt, Mycobacterium bovis subsp bovis AF2122/97
cuauggucaaccgc

SEQ ID NO: 1042340 - RNA, 16 nt, Mycobacterium bovis subsp bovis AF2122/97
cuauggucaaccgcgc

SEQ ID NO: 1042341 - RNA, 16 nt, Mycobacterium bovis subsp bovis AF2122/97
cuaucguugugcggac

SEQ ID NO: 1042342 - RNA, 20 nt, Mycobacterium bovis subsp bovis AF2122/97
cuaucgggaagccgccgggc

SEQ ID NO: 1042343 - RNA, 16 nt, Mycobacterium bovis subsp bovis AF2122/97
cuacggccuggccacc

SEQ ID NO: 1042344 - RNA, 19 nt, Mycobacterium bovis subsp bovis AF2122/97
cuacgcgaucagcugggca

SEQ ID NO: 1042345 - RNA, 14 nt, Mycobacterium bovis subsp bovis AF2122/97
cuacgaccguuggg

SEQ ID NO: 1042346 - RNA, 14 nt, Mycobacterium bovis subsp bovis AF2122/97
cuacgacggcgcca

SEQ ID NO: 1042347 - RNA, 20 nt, Mycobacterium bovis subsp bovis AF2122/97
cuacgacggcgccauuggcg

SEQ ID NO: 1042348 - RNA, 22 nt, Mycobacterium bovis subsp bovis AF2122/97
cuacgacgguccguucgcgccg

SEQ ID NO: 1042349 - RNA, 23 nt, Mycobacterium bovis subsp bovis AF2122/97
cuacgacgguccguucgcgccgu

SEQ ID NO: 1042350 - RNA, 15 nt, Mycobacterium bovis subsp bovis AF2122/97
cuaccagcaccggga

SEQ ID NO: 1042351 - RNA, 16 nt, Mycobacterium bovis subsp bovis AF2122/97
cuacgucggcucgucg

SEQ ID NO: 1042352 - RNA, 20 nt, Mycobacterium bovis subsp bovis AF2122/97
cuacggcgacacgccagccg

SEQ ID NO: 1042353 - RNA, 19 nt, Mycobacterium bovis subsp bovis AF2122/97
cuacggcugcccguucugc

SEQ ID NO: 1042354 - RNA, 14 nt, Mycobacterium bovis subsp bovis AF2122/97
cuaggacggcgcga

SEQ ID NO: 1042355 - RNA, 16 nt, Mycobacterium bovis subsp bovis AF2122/97
cuaggacggcugccgu

SEQ ID NO: 1042356 - RNA, 21 nt, Mycobacterium bovis subsp bovis AF2122/97
cuaggaucggauggcggccac

SEQ ID NO: 1042357 - RNA, 17 nt, Mycobacterium bovis subsp bovis AF2122/97
cuagcuuggcggccagc

SEQ ID NO: 1042358 - RNA, 15 nt, Mycobacterium bovis subsp bovis AF2122/97
cuaggaacgccaccc

SEQ ID NO: 1042359 - RNA, 15 nt, Mycobacterium bovis subsp bovis AF2122/97
cuaggccccaccauu

SEQ ID NO: 1042360 - RNA, 18 nt, Mycobacterium bovis subsp bovis AF2122/97
cuaggccccuggccgccg

SEQ ID NO: 1042361 - RNA, 20 nt, Mycobacterium bovis subsp bovis AF2122/97
cuaggccccuggccgccgca

SEQ ID NO: 1042362 - RNA, 17 nt, Mycobacterium bovis subsp bovis AF2122/97
cuaggcaugccacacac

SEQ ID NO: 1042363 - RNA, 19 nt, Mycobacterium bovis subsp bovis AF2122/97
cuaggccaccggcgaccga

SEQ ID NO: 1042364 - RNA, 14 nt, Mycobacterium bovis subsp bovis AF2122/97
cuaggccagcacgg

SEQ ID NO: 1042365 - RNA, 18 nt, Mycobacterium bovis subsp bovis AF2122/97
cuagggaaaggcgccggu

SEQ ID NO: 1042366 - RNA, 19 nt, Mycobacterium bovis subsp bovis AF2122/97
cuagggcagcagcccgggc

SEQ ID NO: 1042367 - RNA, 15 nt, Mycobacterium bovis subsp bovis AF2122/97
cuaggucgacgccga

SEQ ID NO: 1042368 - RNA, 19 nt, Mycobacterium bovis subsp bovis AF2122/97
cuaggugcaacaggcgcgu

SEQ ID NO: 1042369 - RNA, 21 nt, Mycobacterium bovis subsp bovis AF2122/97
cuagguucaguuccaccgcgc

SEQ ID NO: 1042370 - RNA, 17 nt, Mycobacterium bovis subsp bovis AF2122/97
cuaguccggcacugcgg

SEQ ID NO: 1042371 - RNA, 15 nt, Mycobacterium bovis subsp bovis AF2122/97
cucagcccggccagc

SEQ ID NO: 1042372 - RNA, 16 nt, Mycobacterium bovis subsp bovis AF2122/97
cucagcccggccagcc

SEQ ID NO: 1042373 - RNA, 14 nt, Mycobacterium bovis subsp bovis AF2122/97
cucagaccggcgcc

SEQ ID NO: 1042374 - RNA, 19 nt, Mycobacterium bovis subsp bovis AF2122/97
cucagacuuucgcccaguc

SEQ ID NO: 1042375 - RNA, 20 nt, Mycobacterium bovis subsp bovis AF2122/97
cucagaccaaggcgaagguc

SEQ ID NO: 1042376 - RNA, 12 nt, Mycobacterium bovis subsp bovis AF2122/97
cucagccaccgg

SEQ ID NO: 1042377 - RNA, 21 nt, Mycobacterium bovis subsp bovis AF2122/97
cucacgaggcacaaucaccgc

SEQ ID NO: 1042378 - RNA, 21 nt, Mycobacterium bovis subsp bovis AF2122/97
cucaccuuuggccgcgaccgg

SEQ ID NO: 1042379 - RNA, 18 nt, Mycobacterium bovis subsp bovis AF2122/97
cucacgaagaccgcgucg

SEQ ID NO: 1042380 - RNA, 19 nt, Mycobacterium bovis subsp bovis AF2122/97
cucacgaagaccgcgucgg

SEQ ID NO: 1042381 - RNA, 18 nt, Mycobacterium bovis subsp bovis AF2122/97
cucacgaucacccgcacg

SEQ ID NO: 1042382 - RNA, 21 nt, Mycobacterium bovis subsp bovis AF2122/97
cucacgcaggaaaaccccggc

SEQ ID NO: 1042383 - RNA, 23 nt, Mycobacterium bovis subsp bovis AF2122/97
cucacgcaggaaaaccccggcca

SEQ ID NO: 1042384 - RNA, 20 nt, Mycobacterium bovis subsp bovis AF2122/97
cucacuggugacccugauga

SEQ ID NO: 1042385 - RNA, 14 nt, Mycobacterium bovis subsp bovis AF2122/97
cucaggccgguacc

SEQ ID NO: 1042386 - RNA, 20 nt, Mycobacterium bovis subsp bovis AF2122/97
cucaggccgguaccgggacg

SEQ ID NO: 1042387 - RNA, 21 nt, Mycobacterium bovis subsp bovis AF2122/97
cucaggccgguaccgggacga

SEQ ID NO: 1042388 - RNA, 18 nt, Mycobacterium bovis subsp bovis AF2122/97
cucaguuuggcgggugcg

SEQ ID NO: 1042389 - RNA, 14 nt, Mycobacterium bovis subsp bovis AF2122/97
cucagcgguagagc

SEQ ID NO: 1042390 - RNA, 12 nt, Mycobacterium bovis subsp bovis AF2122/97
cucagccgcgcc

SEQ ID NO: 1042391 - RNA, 14 nt, Mycobacterium bovis subsp bovis AF2122/97
cucagccgcgccgg

SEQ ID NO: 1042392 - RNA, 13 nt, Mycobacterium bovis subsp bovis AF2122/97
cucagcgugcgcu

SEQ ID NO: 1042393 - RNA, 15 nt, Mycobacterium bovis subsp bovis AF2122/97
cucagcuagcgcggg

SEQ ID NO: 1042394 - RNA, 15 nt, Mycobacterium bovis subsp bovis AF2122/97
cucagcuggucggcu

SEQ ID NO: 1042395 - RNA, 18 nt, Mycobacterium bovis subsp bovis AF2122/97
cucagcugguggcggcgg

SEQ ID NO: 1042396 - RNA, 16 nt, Mycobacterium bovis subsp bovis AF2122/97
cucagcuccggcgacu

SEQ ID NO: 1042397 - RNA, 13 nt, Mycobacterium bovis subsp bovis AF2122/97
cucagcugcucgu

SEQ ID NO: 1042398 - RNA, 14 nt, Mycobacterium bovis subsp bovis AF2122/97
cucaccccggucga

SEQ ID NO: 1042399 - RNA, 13 nt, Mycobacterium bovis subsp bovis AF2122/97
cucacccgagcca

SEQ ID NO: 1042400 - RNA, 23 nt, Mycobacterium bovis subsp bovis AF2122/97
cucacccgccgcgguuaucgccg

SEQ ID NO: 1042401 - RNA, 22 nt, Mycobacterium bovis subsp bovis AF2122/97
cucaccaggcgagccggcgcgc

SEQ ID NO: 1042402 - RNA, 23 nt, Mycobacterium bovis subsp bovis AF2122/97
cucaccaggcgagccggcgcgca

SEQ ID NO: 1042403 - RNA, 22 nt, Mycobacterium bovis subsp bovis AF2122/97
cucacccugcucgaacgcugag

SEQ ID NO: 1042404 - RNA, 14 nt, Mycobacterium bovis subsp bovis AF2122/97
cucacccgggcagc

SEQ ID NO: 1042405 - RNA, 17 nt, Mycobacterium bovis subsp bovis AF2122/97
cucacccgggcagccug

SEQ ID NO: 1042406 - RNA, 19 nt, Mycobacterium bovis subsp bovis AF2122/97
cucaccgaucccgcggccg

SEQ ID NO: 1042407 - RNA, 22 nt, Mycobacterium bovis subsp bovis AF2122/97
cucaccgaucccgcggccgggc

SEQ ID NO: 1042408 - RNA, 21 nt, Mycobacterium bovis subsp bovis AF2122/97
cucaccgccgcuaccgcccgc

SEQ ID NO: 1042409 - RNA, 15 nt, Mycobacterium bovis subsp bovis AF2122/97
cucaccugcgggugc

SEQ ID NO: 1042410 - RNA, 22 nt, Mycobacterium bovis subsp bovis AF2122/97
cucaccugcgggugcgucgaug

SEQ ID NO: 1042411 - RNA, 20 nt, Mycobacterium bovis subsp bovis AF2122/97
cucaccugacacgcccgcga

SEQ ID NO: 1042412 - RNA, 17 nt, Mycobacterium bovis subsp bovis AF2122/97
cucaccggcuggugcca

SEQ ID NO: 1042413 - RNA, 23 nt, Mycobacterium bovis subsp bovis AF2122/97
cucaccgggagcgugcacgggga

SEQ ID NO: 1042414 - RNA, 16 nt, Mycobacterium bovis subsp bovis AF2122/97
cucaccgggcccgacg

SEQ ID NO: 1042415 - RNA, 23 nt, Mycobacterium bovis subsp bovis AF2122/97
cucaccggguuggaagccgcacc

SEQ ID NO: 1042416 - RNA, 16 nt, Mycobacterium bovis subsp bovis AF2122/97
cucaccggcgcccagc

SEQ ID NO: 1042417 - RNA, 16 nt, Mycobacterium bovis subsp bovis AF2122/97
cucaccggcgcgagca

SEQ ID NO: 1042418 - RNA, 19 nt, Mycobacterium bovis subsp bovis AF2122/97
cucaccgugaaccgcccgc

SEQ ID NO: 1042419 - RNA, 20 nt, Mycobacterium bovis subsp bovis AF2122/97
cucaccgugaaccgcccgcc

SEQ ID NO: 1042420 - RNA, 16 nt, Mycobacterium bovis subsp bovis AF2122/97
cuauuugccugccgcg

SEQ ID NO: 1042421 - RNA, 18 nt, Mycobacterium bovis subsp bovis AF2122/97
cuauuugccugccgcgca

SEQ ID NO: 1042422 - RNA, 16 nt, Mycobacterium bovis subsp bovis AF2122/97
cuauuugcgaccccgc

SEQ ID NO: 1042423 - RNA, 15 nt, Mycobacterium bovis subsp bovis AF2122/97
cuauucgccagcgcc

SEQ ID NO: 1042424 - RNA, 13 nt, Mycobacterium bovis subsp bovis AF2122/97
cuauucggcggca

SEQ ID NO: 1042425 - RNA, 15 nt, Mycobacterium bovis subsp bovis AF2122/97
cuauuccaugucguc

SEQ ID NO: 1042426 - RNA, 18 nt, Mycobacterium bovis subsp bovis AF2122/97
cucacccacccgcaccgc

SEQ ID NO: 1042427 - RNA, 14 nt, Mycobacterium bovis subsp bovis AF2122/97
cucacccagcucgc

SEQ ID NO: 1042428 - RNA, 15 nt, Mycobacterium bovis subsp bovis AF2122/97
cucacccagcucgcg

SEQ ID NO: 1042429 - RNA, 20 nt, Mycobacterium bovis subsp bovis AF2122/97
cucacccagcucgcgcaccc

SEQ ID NO: 1042430 - RNA, 13 nt, Mycobacterium bovis subsp bovis AF2122/97
cucacccaggcgc

SEQ ID NO: 1042431 - RNA, 21 nt, Mycobacterium bovis subsp bovis AF2122/97
cuccagcaccagcacggcaac

SEQ ID NO: 1042432 - RNA, 16 nt, Mycobacterium bovis subsp bovis AF2122/97
cuccagcaccacggcg

SEQ ID NO: 1042433 - RNA, 18 nt, Mycobacterium bovis subsp bovis AF2122/97
cuccagcaccacggcgcg

SEQ ID NO: 1042434 - RNA, 17 nt, Mycobacterium bovis subsp bovis AF2122/97
cuccagcaccagcacgg

SEQ ID NO: 1042435 - RNA, 17 nt, Mycobacterium bovis subsp bovis AF2122/97
cuccagcacccgcugca

SEQ ID NO: 1042436 - RNA, 15 nt, Mycobacterium bovis subsp bovis AF2122/97
cuccagauucgccgc

SEQ ID NO: 1042437 - RNA, 19 nt, Mycobacterium bovis subsp bovis AF2122/97
cuccacggucgggaccggc

SEQ ID NO: 1042438 - RNA, 20 nt, Mycobacterium bovis subsp bovis AF2122/97
cuccagauccacgccgacca

SEQ ID NO: 1042439 - RNA, 20 nt, Mycobacterium bovis subsp bovis AF2122/97
cuccagcaaaacccgcucca

SEQ ID NO: 1042440 - RNA, 15 nt, Mycobacterium bovis subsp bovis AF2122/97
cuccagcaccaccgg

SEQ ID NO: 1042441 - RNA, 18 nt, Mycobacterium bovis subsp bovis AF2122/97
cuccagcaccaccggaac

SEQ ID NO: 1042442 - RNA, 19 nt, Mycobacterium bovis subsp bovis AF2122/97
cuccacgucaucuggcgcu

SEQ ID NO: 1042443 - RNA, 13 nt, Mycobacterium bovis subsp bovis AF2122/97
cuccacguccggc

SEQ ID NO: 1042444 - RNA, 12 nt, Mycobacterium bovis subsp bovis AF2122/97
cuccacggcggg

SEQ ID NO: 1042445 - RNA, 14 nt, Mycobacterium bovis subsp bovis AF2122/97
cuccacggucaggc

SEQ ID NO: 1042446 - RNA, 19 nt, Mycobacterium bovis subsp bovis AF2122/97
cuccacgaucggcccagcc

SEQ ID NO: 1042447 - RNA, 23 nt, Mycobacterium bovis subsp bovis AF2122/97
cuccacgcuggcgcccccgacga

SEQ ID NO: 1042448 - RNA, 23 nt, Mycobacterium bovis subsp bovis AF2122/97
cuccagaaccgaagccucggcau

SEQ ID NO: 1042449 - RNA, 20 nt, Mycobacterium bovis subsp bovis AF2122/97
cuccacuuggggcgccaggg

SEQ ID NO: 1042450 - RNA, 19 nt, Mycobacterium bovis subsp bovis AF2122/97
cuccacuuuuccgccggcc

SEQ ID NO: 1042451 - RNA, 19 nt, Mycobacterium bovis subsp bovis AF2122/97
cuccaugaaucgcgcuuca

SEQ ID NO: 1042452 - RNA, 13 nt, Mycobacterium bovis subsp bovis AF2122/97
cucccaggccgcc

SEQ ID NO: 1042453 - RNA, 18 nt, Mycobacterium bovis subsp bovis AF2122/97
cuccaucgucugguggca

SEQ ID NO: 1042454 - RNA, 14 nt, Mycobacterium bovis subsp bovis AF2122/97
cuccaucagcgcga

SEQ ID NO: 1042455 - RNA, 16 nt, Mycobacterium bovis subsp bovis AF2122/97
cuccaucagcgcgacc

SEQ ID NO: 1042456 - RNA, 19 nt, Mycobacterium bovis subsp bovis AF2122/97
cucccagggcucggcggcc

SEQ ID NO: 1042457 - RNA, 20 nt, Mycobacterium bovis subsp bovis AF2122/97
cucccagggcucggcggccc

SEQ ID NO: 1042458 - RNA, 21 nt, Mycobacterium bovis subsp bovis AF2122/97
cuccccaagucgacgguggcg

SEQ ID NO: 1042459 - RNA, 16 nt, Mycobacterium bovis subsp bovis AF2122/97
cuccaguagccggugc

SEQ ID NO: 1042460 - RNA, 18 nt, Mycobacterium bovis subsp bovis AF2122/97
cuccaucaaccgcgcugu

SEQ ID NO: 1042461 - RNA, 17 nt, Mycobacterium bovis subsp bovis AF2122/97
cuccaucagcgcgaccg

SEQ ID NO: 1042462 - RNA, 18 nt, Mycobacterium bovis subsp bovis AF2122/97
cuccaucagcgcgaccga

SEQ ID NO: 1042463 - RNA, 18 nt, Mycobacterium bovis subsp bovis AF2122/97
cuccaguggcgccagggc

SEQ ID NO: 1042464 - RNA, 14 nt, Mycobacterium bovis subsp bovis AF2122/97
cuccaagcucgaca

SEQ ID NO: 1042465 - RNA, 15 nt, Mycobacterium bovis subsp bovis AF2122/97
cuccaaggcggucac

SEQ ID NO: 1042466 - RNA, 21 nt, Mycobacterium bovis subsp bovis AF2122/97
cuccaaggcggucaccaccgu

SEQ ID NO: 1042467 - RNA, 22 nt, Mycobacterium bovis subsp bovis AF2122/97
cuccaaaucggcaucggcgacg

SEQ ID NO: 1042468 - RNA, 22 nt, Mycobacterium bovis subsp bovis AF2122/97
cuccaaauggugagcucgcgca

SEQ ID NO: 1042469 - RNA, 20 nt, Mycobacterium bovis subsp bovis AF2122/97
cuccaacaacuccagcaggu

SEQ ID NO: 1042470 - RNA, 19 nt, Mycobacterium bovis subsp bovis AF2122/97
cuccaaaaucgcggccaca

SEQ ID NO: 1042471 - RNA, 17 nt, Mycobacterium bovis subsp bovis AF2122/97
cucaucacccagcgccg

SEQ ID NO: 1042472 - RNA, 19 nt, Mycobacterium bovis subsp bovis AF2122/97
cucaucacccagcgccgac

SEQ ID NO: 1042473 - RNA, 13 nt, Mycobacterium bovis subsp bovis AF2122/97
cuccaccgcgccg

SEQ ID NO: 1042474 - RNA, 13 nt, Mycobacterium bovis subsp bovis AF2122/97
cuccaccgccgcg

SEQ ID NO: 1042475 - RNA, 14 nt, Mycobacterium bovis subsp bovis AF2122/97
cuccacccuugccg

SEQ ID NO: 1042476 - RNA, 14 nt, Mycobacterium bovis subsp bovis AF2122/97
cuccacccgccacg

SEQ ID NO: 1042477 - RNA, 13 nt, Mycobacterium bovis subsp bovis AF2122/97
cuccacccgccgg

SEQ ID NO: 1042478 - RNA, 18 nt, Mycobacterium bovis subsp bovis AF2122/97
cuccaccgggcccgccgg

SEQ ID NO: 1042479 - RNA, 19 nt, Mycobacterium bovis subsp bovis AF2122/97
cuccaccgggcccgccggc

SEQ ID NO: 1042480 - RNA, 18 nt, Mycobacterium bovis subsp bovis AF2122/97
cuccaccgucgccgccgg

SEQ ID NO: 1042481 - RNA, 20 nt, Mycobacterium bovis subsp bovis AF2122/97
cuccaccgcuggcccggcgc

SEQ ID NO: 1042482 - RNA, 23 nt, Mycobacterium bovis subsp bovis AF2122/97
cuccacgagguugggccgguuga

SEQ ID NO: 1042483 - RNA, 20 nt, Mycobacterium bovis subsp bovis AF2122/97
cuccacgcagcccgucggcg

SEQ ID NO: 1042484 - RNA, 23 nt, Mycobacterium bovis subsp bovis AF2122/97
cuccacgcagcccgucggcgccg

SEQ ID NO: 1042485 - RNA, 19 nt, Mycobacterium bovis subsp bovis AF2122/97
cuccaccccacccagcgac

SEQ ID NO: 1042486 - RNA, 17 nt, Mycobacterium bovis subsp bovis AF2122/97
cuccaccaggacguggu

SEQ ID NO: 1042487 - RNA, 18 nt, Mycobacterium bovis subsp bovis AF2122/97
cuccaccaacucgacgug

SEQ ID NO: 1042488 - RNA, 14 nt, Mycobacterium bovis subsp bovis AF2122/97
cuccaccaccgucg

SEQ ID NO: 1042489 - RNA, 15 nt, Mycobacterium bovis subsp bovis AF2122/97
cuccaauugcggccg

SEQ ID NO: 1042490 - RNA, 22 nt, Mycobacterium bovis subsp bovis AF2122/97
cugggcgcccgcgguccggcga

SEQ ID NO: 1042491 - RNA, 21 nt, Mycobacterium bovis subsp bovis AF2122/97
cugggcgccaugcgccaaccc

SEQ ID NO: 1042492 - RNA, 20 nt, Mycobacterium bovis subsp bovis AF2122/97
cugggcgcgaccccaggcgc

SEQ ID NO: 1042493 - RNA, 17 nt, Mycobacterium bovis subsp bovis AF2122/97
cugggcgcgcucaucga

SEQ ID NO: 1042494 - RNA, 19 nt, Mycobacterium bovis subsp bovis AF2122/97
cugggcgcgcucaucgacc

SEQ ID NO: 1042495 - RNA, 21 nt, Mycobacterium bovis subsp bovis AF2122/97
cugggcgcgcucaucgaccgc

SEQ ID NO: 1042496 - RNA, 22 nt, Mycobacterium bovis subsp bovis AF2122/97
cugggcgcgcucaucgaccggg

SEQ ID NO: 1042497 - RNA, 14 nt, Mycobacterium bovis subsp bovis AF2122/97
cugggcggccagca

SEQ ID NO: 1042498 - RNA, 15 nt, Mycobacterium bovis subsp bovis AF2122/97
cugggcggccagcac

SEQ ID NO: 1042499 - RNA, 14 nt, Mycobacterium bovis subsp bovis AF2122/97
cugggcgccgcgcu

SEQ ID NO: 1042500 - RNA, 18 nt, Mycobacterium bovis subsp bovis AF2122/97
cugggcgcccgcgguccg

SEQ ID NO: 1042501 - RNA, 20 nt, Mycobacterium bovis subsp bovis AF2122/97
cugggcgauauuggacgcgc

SEQ ID NO: 1042502 - RNA, 15 nt, Mycobacterium bovis subsp bovis AF2122/97
cuggcuguaguccgc

SEQ ID NO: 1042503 - RNA, 19 nt, Mycobacterium bovis subsp bovis AF2122/97
cuggcuguccgcgggccgc

SEQ ID NO: 1042504 - RNA, 16 nt, Mycobacterium bovis subsp bovis AF2122/97
cugggcgacuaccggc

SEQ ID NO: 1042505 - RNA, 16 nt, Mycobacterium bovis subsp bovis AF2122/97
cuggcuggccagcugc

SEQ ID NO: 1042506 - RNA, 23 nt, Mycobacterium bovis subsp bovis AF2122/97
cuggcuggaccacucgccggcgg

SEQ ID NO: 1042507 - RNA, 21 nt, Mycobacterium bovis subsp bovis AF2122/97
cugggcgcgcuggcgggcggc

SEQ ID NO: 1042508 - RNA, 16 nt, Mycobacterium bovis subsp bovis AF2122/97
cuggggccguccggcu

SEQ ID NO: 1042509 - RNA, 18 nt, Mycobacterium bovis subsp bovis AF2122/97
cuggggcgccaccacccg

SEQ ID NO: 1042510 - RNA, 21 nt, Mycobacterium bovis subsp bovis AF2122/97
cuggggcgcccgagaccgggc

SEQ ID NO: 1042511 - RNA, 16 nt, Mycobacterium bovis subsp bovis AF2122/97
cuggggccccgcgccg

SEQ ID NO: 1042512 - RNA, 17 nt, Mycobacterium bovis subsp bovis AF2122/97
cuggggccccgcgccgg

SEQ ID NO: 1042513 - RNA, 21 nt, Mycobacterium bovis subsp bovis AF2122/97
cuggggccccgcgccggccgc

SEQ ID NO: 1042514 - RNA, 13 nt, Mycobacterium bovis subsp bovis AF2122/97
cugggguagccau

SEQ ID NO: 1042515 - RNA, 14 nt, Mycobacterium bovis subsp bovis AF2122/97
cugggggccggcac

SEQ ID NO: 1042516 - RNA, 18 nt, Mycobacterium bovis subsp bovis AF2122/97
cuggggugcucgggcggc

SEQ ID NO: 1042517 - RNA, 18 nt, Mycobacterium bovis subsp bovis AF2122/97
cuggguaguucaccgcgu

SEQ ID NO: 1042518 - RNA, 17 nt, Mycobacterium bovis subsp bovis AF2122/97
cuggguccacgcgcucg

SEQ ID NO: 1042519 - RNA, 17 nt, Mycobacterium bovis subsp bovis AF2122/97
cugggucggcacgggaa

SEQ ID NO: 1042520 - RNA, 21 nt, Mycobacterium bovis subsp bovis AF2122/97
cugguaucgagcaccccgacg

SEQ ID NO: 1042521 - RNA, 14 nt, Mycobacterium bovis subsp bovis AF2122/97
cugguccacccgug

SEQ ID NO: 1042522 - RNA, 11 nt, Mycobacterium bovis subsp bovis AF2122/97
cugguccagca

SEQ ID NO: 1042523 - RNA, 13 nt, Mycobacterium bovis subsp bovis AF2122/97
cugguccagcacc

SEQ ID NO: 1042524 - RNA, 21 nt, Mycobacterium bovis subsp bovis AF2122/97
cugguccgggugccggugcgc

SEQ ID NO: 1042525 - RNA, 17 nt, Mycobacterium bovis subsp bovis AF2122/97
cugguccagccggugac

SEQ ID NO: 1042526 - RNA, 16 nt, Mycobacterium bovis subsp bovis AF2122/97
cuggucccacaccucc

SEQ ID NO: 1042527 - RNA, 20 nt, Mycobacterium bovis subsp bovis AF2122/97
cugguccucacgggucagca

SEQ ID NO: 1042528 - RNA, 18 nt, Mycobacterium bovis subsp bovis AF2122/97
cugguccuccuucggugg

SEQ ID NO: 1042529 - RNA, 13 nt, Mycobacterium bovis subsp bovis AF2122/97
cuggucagcggcg

SEQ ID NO: 1042530 - RNA, 16 nt, Mycobacterium bovis subsp bovis AF2122/97
cuggucagccgugccg

SEQ ID NO: 1042531 - RNA, 17 nt, Mycobacterium bovis subsp bovis AF2122/97
cuggucagccgugccgu

SEQ ID NO: 1042532 - RNA, 16 nt, Mycobacterium bovis subsp bovis AF2122/97
cuggucaagguugacg

SEQ ID NO: 1042533 - RNA, 16 nt, Mycobacterium bovis subsp bovis AF2122/97
cuggucaacagcggca

SEQ ID NO: 1042534 - RNA, 15 nt, Mycobacterium bovis subsp bovis AF2122/97
cuggucagccgcggc

SEQ ID NO: 1042535 - RNA, 21 nt, Mycobacterium bovis subsp bovis AF2122/97
cuggucagccgcggcggcagc

SEQ ID NO: 1042536 - RNA, 22 nt, Mycobacterium bovis subsp bovis AF2122/97
cuggucagccgcggcggcagca

SEQ ID NO: 1042537 - RNA, 19 nt, Mycobacterium bovis subsp bovis AF2122/97
cuggccggguuccagcggc

SEQ ID NO: 1042538 - RNA, 16 nt, Mycobacterium bovis subsp bovis AF2122/97
cuggccgucggcguga

SEQ ID NO: 1042539 - RNA, 19 nt, Mycobacterium bovis subsp bovis AF2122/97
cuggccguaacgcggaucg

SEQ ID NO: 1042540 - RNA, 21 nt, Mycobacterium bovis subsp bovis AF2122/97
cuggccgucgaagacgaacgu

SEQ ID NO: 1042541 - RNA, 22 nt, Mycobacterium bovis subsp bovis AF2122/97
cuggccguauaggcccgggcgg

SEQ ID NO: 1042542 - RNA, 20 nt, Mycobacterium bovis subsp bovis AF2122/97
cuggccguuguucuugucgg

SEQ ID NO: 1042543 - RNA, 20 nt, Mycobacterium bovis subsp bovis AF2122/97
cuggccguugcccgacucgg

SEQ ID NO: 1042544 - RNA, 23 nt, Mycobacterium bovis subsp bovis AF2122/97
cuggccuccuggaaggaggccgg

SEQ ID NO: 1042545 - RNA, 12 nt, Mycobacterium bovis subsp bovis AF2122/97
cuggccucgucg

SEQ ID NO: 1042546 - RNA, 14 nt, Mycobacterium bovis subsp bovis AF2122/97
cuggcgcugcuggc

SEQ ID NO: 1042547 - RNA, 21 nt, Mycobacterium bovis subsp bovis AF2122/97
cuggcgcucauaggccggcgg

SEQ ID NO: 1042548 - RNA, 17 nt, Mycobacterium bovis subsp bovis AF2122/97
cuggcgcugaugcuggc

SEQ ID NO: 1042549 - RNA, 19 nt, Mycobacterium bovis subsp bovis AF2122/97
cuggcgcugaugcuggcca

SEQ ID NO: 1042550 - RNA, 23 nt, Mycobacterium bovis subsp bovis AF2122/97
cuggcgcugaugcuggccauguu

SEQ ID NO: 1042551 - RNA, 16 nt, Mycobacterium bovis subsp bovis AF2122/97
cuggcgugcagcagga

SEQ ID NO: 1042552 - RNA, 14 nt, Mycobacterium bovis subsp bovis AF2122/97
cuggcgucgaugcc

SEQ ID NO: 1042553 - RNA, 16 nt, Mycobacterium bovis subsp bovis AF2122/97
cuggcggauggccgcc

SEQ ID NO: 1042554 - RNA, 13 nt, Mycobacterium bovis subsp bovis AF2122/97
cuggcggccagca

SEQ ID NO: 1042555 - RNA, 19 nt, Mycobacterium bovis subsp bovis AF2122/97
cuggcggccucgccggcgc

SEQ ID NO: 1042556 - RNA, 22 nt, Mycobacterium bovis subsp bovis AF2122/97
cuggcggccucgccggcgcgca

SEQ ID NO: 1042557 - RNA, 14 nt, Mycobacterium bovis subsp bovis AF2122/97
cuggcggcgccgca

SEQ ID NO: 1042558 - RNA, 21 nt, Mycobacterium bovis subsp bovis AF2122/97
cuggcggcgccgcagaucacc

SEQ ID NO: 1042559 - RNA, 14 nt, Mycobacterium bovis subsp bovis AF2122/97
cuggcggcgcgaca

SEQ ID NO: 1042560 - RNA, 16 nt, Mycobacterium bovis subsp bovis AF2122/97
cuggcggcguggcgcc

SEQ ID NO: 1042561 - RNA, 18 nt, Mycobacterium bovis subsp bovis AF2122/97
cuggcguagugcucgccg

SEQ ID NO: 1042562 - RNA, 22 nt, Mycobacterium bovis subsp bovis AF2122/97
cuggcguagugcucgccggcac

SEQ ID NO: 1042563 - RNA, 16 nt, Mycobacterium bovis subsp bovis AF2122/97
cuggcguugccaccgg

SEQ ID NO: 1042564 - RNA, 22 nt, Mycobacterium bovis subsp bovis AF2122/97
cuggcguugcugaugucgccgg

SEQ ID NO: 1042565 - RNA, 19 nt, Mycobacterium bovis subsp bovis AF2122/97
cuggcguuguugacgauca

SEQ ID NO: 1042566 - RNA, 21 nt, Mycobacterium bovis subsp bovis AF2122/97
cuggcguuguugacgaucacc

SEQ ID NO: 1042567 - RNA, 17 nt, Mycobacterium bovis subsp bovis AF2122/97
cuggcuacccaccggcc

SEQ ID NO: 1042568 - RNA, 19 nt, Mycobacterium bovis subsp bovis AF2122/97
cuggcuacccaccggccgg

SEQ ID NO: 1042569 - RNA, 20 nt, Mycobacterium bovis subsp bovis AF2122/97
cuggcuacccaccggccggu

SEQ ID NO: 1042570 - RNA, 17 nt, Mycobacterium bovis subsp bovis AF2122/97
cuggcgugucgccgcca

SEQ ID NO: 1042571 - RNA, 18 nt, Mycobacterium bovis subsp bovis AF2122/97
cuggcgugucgccgccac

SEQ ID NO: 1042572 - RNA, 20 nt, Mycobacterium bovis subsp bovis AF2122/97
cuggcguucagcggccagca

SEQ ID NO: 1042573 - RNA, 19 nt, Mycobacterium bovis subsp bovis AF2122/97
cuggcgugucgccgccacc

SEQ ID NO: 1042574 - RNA, 23 nt, Mycobacterium bovis subsp bovis AF2122/97
cuggcgugugugcgccuccggga

SEQ ID NO: 1042575 - RNA, 17 nt, Mycobacterium bovis subsp bovis AF2122/97
cuggcuacgggccgcgg

SEQ ID NO: 1042576 - RNA, 16 nt, Mycobacterium bovis subsp bovis AF2122/97
cuggcuacgggccgcu

SEQ ID NO: 1042577 - RNA, 21 nt, Mycobacterium bovis subsp bovis AF2122/97
cuggcuaguugggugggugca

SEQ ID NO: 1042578 - RNA, 24 nt, Mycobacterium bovis subsp bovis AF2122/97
cuggcuaguugggugggugcagca

SEQ ID NO: 1042579 - RNA, 21 nt, Mycobacterium bovis subsp bovis AF2122/97
cuggccaugguggcgccgacg

SEQ ID NO: 1042580 - RNA, 19 nt, Mycobacterium bovis subsp bovis AF2122/97
cuggccaucgagggcaucg

SEQ ID NO: 1042581 - RNA, 23 nt, Mycobacterium bovis subsp bovis AF2122/97
cuggcacccggggugcccggccg

SEQ ID NO: 1042582 - RNA, 19 nt, Mycobacterium bovis subsp bovis AF2122/97
cuggcccaauugcgccgag

SEQ ID NO: 1042583 - RNA, 20 nt, Mycobacterium bovis subsp bovis AF2122/97
cuggcccaccuccucgccgg

SEQ ID NO: 1042584 - RNA, 15 nt, Mycobacterium bovis subsp bovis AF2122/97
cuggcccacgccgca

SEQ ID NO: 1042585 - RNA, 21 nt, Mycobacterium bovis subsp bovis AF2122/97
cuggccgauguaguccggcca

SEQ ID NO: 1042586 - RNA, 20 nt, Mycobacterium bovis subsp bovis AF2122/97
cuggccgcccagaccgccga

SEQ ID NO: 1042587 - RNA, 21 nt, Mycobacterium bovis subsp bovis AF2122/97
cuggccgcccagaccgccgac

SEQ ID NO: 1042588 - RNA, 14 nt, Mycobacterium bovis subsp bovis AF2122/97
cuggccgcccgcug

SEQ ID NO: 1042589 - RNA, 15 nt, Mycobacterium bovis subsp bovis AF2122/97
cuggccgcccggcga

SEQ ID NO: 1042590 - RNA, 16 nt, Mycobacterium bovis subsp bovis AF2122/97
cuggccgcccggcgag

SEQ ID NO: 1042591 - RNA, 16 nt, Mycobacterium bovis subsp bovis AF2122/97
cuggccgcccuggccg

SEQ ID NO: 1042592 - RNA, 21 nt, Mycobacterium bovis subsp bovis AF2122/97
cuggccgcccuggccgcccag

SEQ ID NO: 1042593 - RNA, 14 nt, Mycobacterium bovis subsp bovis AF2122/97
cuggccgccgccgu

SEQ ID NO: 1042594 - RNA, 17 nt, Mycobacterium bovis subsp bovis AF2122/97
cuggccgccgcgcaccg

SEQ ID NO: 1042595 - RNA, 19 nt, Mycobacterium bovis subsp bovis AF2122/97
cuggccgccgcgcaccgcg

SEQ ID NO: 1042596 - RNA, 16 nt, Mycobacterium bovis subsp bovis AF2122/97
cuggccgccuccgcgg

SEQ ID NO: 1042597 - RNA, 14 nt, Mycobacterium bovis subsp bovis AF2122/97
cuggccgccggccc

SEQ ID NO: 1042598 - RNA, 15 nt, Mycobacterium bovis subsp bovis AF2122/97
cuggccgccggcgcc

SEQ ID NO: 1042599 - RNA, 18 nt, Mycobacterium bovis subsp bovis AF2122/97
cuggccgcgggcgcggcc

SEQ ID NO: 1042600 - RNA, 23 nt, Mycobacterium bovis subsp bovis AF2122/97
cuggccgcuuugcgcggucagcc

SEQ ID NO: 1042601 - RNA, 23 nt, Mycobacterium bovis subsp bovis AF2122/97
cuggccgauguaguccggccagu

SEQ ID NO: 1042602 - RNA, 12 nt, Mycobacterium bovis subsp bovis AF2122/97
cuggccgcggcc

SEQ ID NO: 1042603 - RNA, 12 nt, Mycobacterium bovis subsp bovis AF2122/97
cuggccgcgccg

SEQ ID NO: 1042604 - RNA, 16 nt, Mycobacterium bovis subsp bovis AF2122/97
cuggccaacuugaccc

SEQ ID NO: 1042605 - RNA, 18 nt, Mycobacterium bovis subsp bovis AF2122/97
cuggccaacuugacccgg

SEQ ID NO: 1042606 - RNA, 18 nt, Mycobacterium bovis subsp bovis AF2122/97
cuggccagcugcggcucc

SEQ ID NO: 1042607 - RNA, 18 nt, Mycobacterium bovis subsp bovis AF2122/97
cuggccagguggccgcau

SEQ ID NO: 1042608 - RNA, 19 nt, Mycobacterium bovis subsp bovis AF2122/97
cuggccagguugccgucgg

SEQ ID NO: 1042609 - RNA, 19 nt, Mycobacterium bovis subsp bovis AF2122/97
cuggcaugaccgcugccga

SEQ ID NO: 1042610 - RNA, 16 nt, Mycobacterium bovis subsp bovis AF2122/97
cuggcauaggaucgcg

SEQ ID NO: 1042611 - RNA, 23 nt, Mycobacterium bovis subsp bovis AF2122/97
cuggcauaucccuugccguccug

SEQ ID NO: 1042612 - RNA, 14 nt, Mycobacterium bovis subsp bovis AF2122/97
cuggcauccgcccc

SEQ ID NO: 1042613 - RNA, 16 nt, Mycobacterium bovis subsp bovis AF2122/97
cuggcauccgccccgc

SEQ ID NO: 1042614 - RNA, 20 nt, Mycobacterium bovis subsp bovis AF2122/97
cuggcaccucgcccucccgg

SEQ ID NO: 1042615 - RNA, 21 nt, Mycobacterium bovis subsp bovis AF2122/97
cuggaugucgucgacgaucag

SEQ ID NO: 1042616 - RNA, 18 nt, Mycobacterium bovis subsp bovis AF2122/97
cuggauucuucagcgcgg

SEQ ID NO: 1042617 - RNA, 19 nt, Mycobacterium bovis subsp bovis AF2122/97
cuggauucuucagcgcggc

SEQ ID NO: 1042618 - RNA, 20 nt, Mycobacterium bovis subsp bovis AF2122/97
cuggauucuucagcgcggca

SEQ ID NO: 1042619 - RNA, 17 nt, Mycobacterium bovis subsp bovis AF2122/97
cuggcacacggucaccg

SEQ ID NO: 1042620 - RNA, 13 nt, Mycobacterium bovis subsp bovis AF2122/97
cuggcaacgacac

SEQ ID NO: 1042621 - RNA, 17 nt, Mycobacterium bovis subsp bovis AF2122/97
cuggcaacgccgcgccg

SEQ ID NO: 1042622 - RNA, 18 nt, Mycobacterium bovis subsp bovis AF2122/97
cuggcaacgccgcgccgu

SEQ ID NO: 1042623 - RNA, 16 nt, Mycobacterium bovis subsp bovis AF2122/97
cugcugguaccgggcu

SEQ ID NO: 1042624 - RNA, 15 nt, Mycobacterium bovis subsp bovis AF2122/97
cugcugggcuucgag

SEQ ID NO: 1042625 - RNA, 21 nt, Mycobacterium bovis subsp bovis AF2122/97
cugcuguggaucgacaccgac

SEQ ID NO: 1042626 - RNA, 22 nt, Mycobacterium bovis subsp bovis AF2122/97
cugcuggccggguuccagcggc

SEQ ID NO: 1042627 - RNA, 16 nt, Mycobacterium bovis subsp bovis AF2122/97
cugcuggccgcggccu

SEQ ID NO: 1042628 - RNA, 14 nt, Mycobacterium bovis subsp bovis AF2122/97
cugcuggcgcacga

SEQ ID NO: 1042629 - RNA, 19 nt, Mycobacterium bovis subsp bovis AF2122/97
cugcugggagggaccaccc

SEQ ID NO: 1042630 - RNA, 20 nt, Mycobacterium bovis subsp bovis AF2122/97
cugcugggagggaccacccg

SEQ ID NO: 1042631 - RNA, 18 nt, Mycobacterium bovis subsp bovis AF2122/97
cugcuggcagaccaacgc

SEQ ID NO: 1042632 - RNA, 14 nt, Mycobacterium bovis subsp bovis AF2122/97
cugcuggaucucgg

SEQ ID NO: 1042633 - RNA, 22 nt, Mycobacterium bovis subsp bovis AF2122/97
cugcugcuugacuccgcgcgcu

SEQ ID NO: 1042634 - RNA, 14 nt, Mycobacterium bovis subsp bovis AF2122/97
cugcugcucggccu

SEQ ID NO: 1042635 - RNA, 16 nt, Mycobacterium bovis subsp bovis AF2122/97
cugcugcugcagcgau

SEQ ID NO: 1042636 - RNA, 17 nt, Mycobacterium bovis subsp bovis AF2122/97
cuggaaggucagcgccc

SEQ ID NO: 1042637 - RNA, 16 nt, Mycobacterium bovis subsp bovis AF2122/97
cuggaauccggccaga

SEQ ID NO: 1042638 - RNA, 18 nt, Mycobacterium bovis subsp bovis AF2122/97
cuggaccacagccgcgcc

SEQ ID NO: 1042639 - RNA, 22 nt, Mycobacterium bovis subsp bovis AF2122/97
cuggaccacagccgcgccgacc

SEQ ID NO: 1042640 - RNA, 17 nt, Mycobacterium bovis subsp bovis AF2122/97
cuggacaaccucgucga

SEQ ID NO: 1042641 - RNA, 17 nt, Mycobacterium bovis subsp bovis AF2122/97
cuggaccacucgccggc

SEQ ID NO: 1042642 - RNA, 18 nt, Mycobacterium bovis subsp bovis AF2122/97
cuggaccacucgccggcg

SEQ ID NO: 1042643 - RNA, 18 nt, Mycobacterium bovis subsp bovis AF2122/97
cuggaccagcgggcggcc

SEQ ID NO: 1042644 - RNA, 14 nt, Mycobacterium bovis subsp bovis AF2122/97
cuggaacgugaugc

SEQ ID NO: 1042645 - RNA, 16 nt, Mycobacterium bovis subsp bovis AF2122/97
cuggaagcggcgacua

SEQ ID NO: 1042646 - RNA, 23 nt, Mycobacterium bovis subsp bovis AF2122/97
cuggaagaagagguuggcggccu

SEQ ID NO: 1042647 - RNA, 19 nt, Mycobacterium bovis subsp bovis AF2122/97
cuggaaccaaaccugggcg

SEQ ID NO: 1042648 - RNA, 15 nt, Mycobacterium bovis subsp bovis AF2122/97
cuggaaagggccgcc

SEQ ID NO: 1042649 - RNA, 22 nt, Mycobacterium bovis subsp bovis AF2122/97
cugcuugaugguguccucgucg

SEQ ID NO: 1042650 - RNA, 18 nt, Mycobacterium bovis subsp bovis AF2122/97
cugcuugccaccgccgcc

SEQ ID NO: 1042651 - RNA, 23 nt, Mycobacterium bovis subsp bovis AF2122/97
cugcggacacguugcgacgucuc

SEQ ID NO: 1042652 - RNA, 20 nt, Mycobacterium bovis subsp bovis AF2122/97
cugcggacaagucggcaccg

SEQ ID NO: 1042653 - RNA, 14 nt, Mycobacterium bovis subsp bovis AF2122/97
cugcggaccggcgc

SEQ ID NO: 1042654 - RNA, 15 nt, Mycobacterium bovis subsp bovis AF2122/97
cugcggaccggcgcg

SEQ ID NO: 1042655 - RNA, 22 nt, Mycobacterium bovis subsp bovis AF2122/97
cugcggacuggcauccgccccg

SEQ ID NO: 1042656 - RNA, 15 nt, Mycobacterium bovis subsp bovis AF2122/97
cugcggaggcgggug

SEQ ID NO: 1042657 - RNA, 18 nt, Mycobacterium bovis subsp bovis AF2122/97
cugcggaggcggguugca

SEQ ID NO: 1042658 - RNA, 21 nt, Mycobacterium bovis subsp bovis AF2122/97
cugcggauacagccgccgccg

SEQ ID NO: 1042659 - RNA, 23 nt, Mycobacterium bovis subsp bovis AF2122/97
cugcggauacagccgccgccggc

SEQ ID NO: 1042660 - RNA, 17 nt, Mycobacterium bovis subsp bovis AF2122/97
cugcggauagugguugc

SEQ ID NO: 1042661 - RNA, 14 nt, Mycobacterium bovis subsp bovis AF2122/97
cugcggauccacca

SEQ ID NO: 1042662 - RNA, 19 nt, Mycobacterium bovis subsp bovis AF2122/97
cugcgcuuugcacagcggc

SEQ ID NO: 1042663 - RNA, 19 nt, Mycobacterium bovis subsp bovis AF2122/97
cugcgcucgggcugccgca

SEQ ID NO: 1042664 - RNA, 14 nt, Mycobacterium bovis subsp bovis AF2122/97
cugcggccagcgcg

SEQ ID NO: 1042665 - RNA, 16 nt, Mycobacterium bovis subsp bovis AF2122/97
cugcggccagcgcggc

SEQ ID NO: 1042666 - RNA, 19 nt, Mycobacterium bovis subsp bovis AF2122/97
cugcggccagcgcggcgcg

SEQ ID NO: 1042667 - RNA, 20 nt, Mycobacterium bovis subsp bovis AF2122/97
cugcggcccacaccagcgca

SEQ ID NO: 1042668 - RNA, 21 nt, Mycobacterium bovis subsp bovis AF2122/97
cugcggcccacaccagcgcag

SEQ ID NO: 1042669 - RNA, 23 nt, Mycobacterium bovis subsp bovis AF2122/97
cugcggcccacaccagcgcagca

SEQ ID NO: 1042670 - RNA, 18 nt, Mycobacterium bovis subsp bovis AF2122/97
cugcggcccaugaucucg

SEQ ID NO: 1042671 - RNA, 20 nt, Mycobacterium bovis subsp bovis AF2122/97
cugcggcccgacccggccga

SEQ ID NO: 1042672 - RNA, 11 nt, Mycobacterium bovis subsp bovis AF2122/97
cugcggcaccg

SEQ ID NO: 1042673 - RNA, 22 nt, Mycobacterium bovis subsp bovis AF2122/97
cugcggcaacgaggucugcggc

SEQ ID NO: 1042674 - RNA, 14 nt, Mycobacterium bovis subsp bovis AF2122/97
cugcggcaccggcu

SEQ ID NO: 1042675 - RNA, 20 nt, Mycobacterium bovis subsp bovis AF2122/97
cugcggcaguaccccucgca

SEQ ID NO: 1042676 - RNA, 13 nt, Mycobacterium bovis subsp bovis AF2122/97
cugcggcagcgcg

SEQ ID NO: 1042677 - RNA, 14 nt, Mycobacterium bovis subsp bovis AF2122/97
cugcggcagcgcgg

SEQ ID NO: 1042678 - RNA, 16 nt, Mycobacterium bovis subsp bovis AF2122/97
cugcggcagcgcggcc

SEQ ID NO: 1042679 - RNA, 13 nt, Mycobacterium bovis subsp bovis AF2122/97
cugcggcagcgga

SEQ ID NO: 1042680 - RNA, 19 nt, Mycobacterium bovis subsp bovis AF2122/97
cugcggccaauggugggcg

SEQ ID NO: 1042681 - RNA, 14 nt, Mycobacterium bovis subsp bovis AF2122/97
cugcggccacgccg

SEQ ID NO: 1042682 - RNA, 20 nt, Mycobacterium bovis subsp bovis AF2122/97
cugcggccacgccgaugcgg

SEQ ID NO: 1042683 - RNA, 15 nt, Mycobacterium bovis subsp bovis AF2122/97
cugcggcaccggcuc

SEQ ID NO: 1042684 - RNA, 20 nt, Mycobacterium bovis subsp bovis AF2122/97
cugcggcagcggaccgcugc

SEQ ID NO: 1042685 - RNA, 21 nt, Mycobacterium bovis subsp bovis AF2122/97
cugcggccacgccgaugcggu

SEQ ID NO: 1042686 - RNA, 22 nt, Mycobacterium bovis subsp bovis AF2122/97
cugcgcgauggccguugccaac

SEQ ID NO: 1042687 - RNA, 22 nt, Mycobacterium bovis subsp bovis AF2122/97
cugcgcgaugucguucgcguca

SEQ ID NO: 1042688 - RNA, 14 nt, Mycobacterium bovis subsp bovis AF2122/97
cugcgcgaugcgau

SEQ ID NO: 1042689 - RNA, 15 nt, Mycobacterium bovis subsp bovis AF2122/97
cugcgcgaugcgauu

SEQ ID NO: 1042690 - RNA, 16 nt, Mycobacterium bovis subsp bovis AF2122/97
cugcgcgaggggccgg

SEQ ID NO: 1042691 - RNA, 21 nt, Mycobacterium bovis subsp bovis AF2122/97
cugcgcgaagccaccaggucg

SEQ ID NO: 1042692 - RNA, 16 nt, Mycobacterium bovis subsp bovis AF2122/97
cugcgcgaagccacca

SEQ ID NO: 1042693 - RNA, 15 nt, Mycobacterium bovis subsp bovis AF2122/97
cugcgcgaagccacc

SEQ ID NO: 1042694 - RNA, 12 nt, Mycobacterium bovis subsp bovis AF2122/97
cugcgcggugcc

SEQ ID NO: 1042695 - RNA, 17 nt, Mycobacterium bovis subsp bovis AF2122/97
cugcgcggugcccgcga

SEQ ID NO: 1042696 - RNA, 17 nt, Mycobacterium bovis subsp bovis AF2122/97
cugcgcggugccggccg

SEQ ID NO: 1042697 - RNA, 20 nt, Mycobacterium bovis subsp bovis AF2122/97
cugcgcggguguggcuacga

SEQ ID NO: 1042698 - RNA, 17 nt, Mycobacterium bovis subsp bovis AF2122/97
cugcgcgucgagcagca

SEQ ID NO: 1042699 - RNA, 19 nt, Mycobacterium bovis subsp bovis AF2122/97
cugcgcgugcucgacgcgc

SEQ ID NO: 1042700 - RNA, 20 nt, Mycobacterium bovis subsp bovis AF2122/97
cugcgcgugcuuggcagcgg

SEQ ID NO: 1042701 - RNA, 14 nt, Mycobacterium bovis subsp bovis AF2122/97
cugcgcggcugccg

SEQ ID NO: 1042702 - RNA, 16 nt, Mycobacterium bovis subsp bovis AF2122/97
cugcgcggcugccguc

SEQ ID NO: 1042703 - RNA, 19 nt, Mycobacterium bovis subsp bovis AF2122/97
cugcgcggcuucgucgaca

SEQ ID NO: 1042704 - RNA, 23 nt, Mycobacterium bovis subsp bovis AF2122/97
cugcgcggcuucgucgacaucgc

SEQ ID NO: 1042705 - RNA, 20 nt, Mycobacterium bovis subsp bovis AF2122/97
cugcgcgcccaccgggcggc

SEQ ID NO: 1042706 - RNA, 17 nt, Mycobacterium bovis subsp bovis AF2122/97
cugcgcgcggccgcgcu

SEQ ID NO: 1042707 - RNA, 12 nt, Mycobacterium bovis subsp bovis AF2122/97
cugcgcggcacu

SEQ ID NO: 1042708 - RNA, 14 nt, Mycobacterium bovis subsp bovis AF2122/97
cugcgcgcucggcc

SEQ ID NO: 1042709 - RNA, 21 nt, Mycobacterium bovis subsp bovis AF2122/97
cugcacgacaucgucgcgacg

SEQ ID NO: 1042710 - RNA, 15 nt, Mycobacterium bovis subsp bovis AF2122/97
cugcaccuggcgcag

SEQ ID NO: 1042711 - RNA, 14 nt, Mycobacterium bovis subsp bovis AF2122/97
cugcacgccggcgc

SEQ ID NO: 1042712 - RNA, 19 nt, Mycobacterium bovis subsp bovis AF2122/97
cugcacgagugcggcgacc

SEQ ID NO: 1042713 - RNA, 21 nt, Mycobacterium bovis subsp bovis AF2122/97
cugcgaugaugugcgaccaca

SEQ ID NO: 1042714 - RNA, 18 nt, Mycobacterium bovis subsp bovis AF2122/97
cugcgaugcugaucaccg

SEQ ID NO: 1042715 - RNA, 20 nt, Mycobacterium bovis subsp bovis AF2122/97
cugcgaugcugaucaccguc

SEQ ID NO: 1042716 - RNA, 19 nt, Mycobacterium bovis subsp bovis AF2122/97
cugcgauuuucggcacgga

SEQ ID NO: 1042717 - RNA, 17 nt, Mycobacterium bovis subsp bovis AF2122/97
cugcgcaacaccaucag

SEQ ID NO: 1042718 - RNA, 14 nt, Mycobacterium bovis subsp bovis AF2122/97
cugcgaucgccgcg

SEQ ID NO: 1042719 - RNA, 17 nt, Mycobacterium bovis subsp bovis AF2122/97
cugcgaucgccgcgcug

SEQ ID NO: 1042720 - RNA, 15 nt, Mycobacterium bovis subsp bovis AF2122/97
cugcgaucggccgcc

SEQ ID NO: 1042721 - RNA, 17 nt, Mycobacterium bovis subsp bovis AF2122/97
cugcgagugcggcacga

SEQ ID NO: 1042722 - RNA, 18 nt, Mycobacterium bovis subsp bovis AF2122/97
cugcgaguucguagucgg

SEQ ID NO: 1042723 - RNA, 12 nt, Mycobacterium bovis subsp bovis AF2122/97
cugcacgccguc

SEQ ID NO: 1042724 - RNA, 14 nt, Mycobacterium bovis subsp bovis AF2122/97
cugcacgccucaaa

SEQ ID NO: 1042725 - RNA, 22 nt, Mycobacterium bovis subsp bovis AF2122/97
cugcgcagcgccugcggcagca

SEQ ID NO: 1042726 - RNA, 14 nt, Mycobacterium bovis subsp bovis AF2122/97
cugcgcagcgcaaa

SEQ ID NO: 1042727 - RNA, 18 nt, Mycobacterium bovis subsp bovis AF2122/97
cugcgcagcgcaacaucg

SEQ ID NO: 1042728 - RNA, 17 nt, Mycobacterium bovis subsp bovis AF2122/97
cugcgcacgucgggccc

SEQ ID NO: 1042729 - RNA, 20 nt, Mycobacterium bovis subsp bovis AF2122/97
cugcgcaccugggucgacga

SEQ ID NO: 1042730 - RNA, 18 nt, Mycobacterium bovis subsp bovis AF2122/97
cugcgcaacaccaucagc

SEQ ID NO: 1042731 - RNA, 22 nt, Mycobacterium bovis subsp bovis AF2122/97
cugcgccaaaauccgcccaccg

SEQ ID NO: 1042732 - RNA, 17 nt, Mycobacterium bovis subsp bovis AF2122/97
cugcgccacacccggca

SEQ ID NO: 1042733 - RNA, 21 nt, Mycobacterium bovis subsp bovis AF2122/97
cugcgcaucaccacuggcggu

SEQ ID NO: 1042734 - RNA, 21 nt, Mycobacterium bovis subsp bovis AF2122/97
cugcgcaucgccaccaucacc

SEQ ID NO: 1042735 - RNA, 14 nt, Mycobacterium bovis subsp bovis AF2122/97
cugcgcaucgccac

SEQ ID NO: 1042736 - RNA, 18 nt, Mycobacterium bovis subsp bovis AF2122/97
cugcgcagccgccucaau

SEQ ID NO: 1042737 - RNA, 14 nt, Mycobacterium bovis subsp bovis AF2122/97
cugcgcccgccacg

SEQ ID NO: 1042738 - RNA, 16 nt, Mycobacterium bovis subsp bovis AF2122/97
cugcgccgaacaccac

SEQ ID NO: 1042739 - RNA, 14 nt, Mycobacterium bovis subsp bovis AF2122/97
cugcgcccguccgc

SEQ ID NO: 1042740 - RNA, 19 nt, Mycobacterium bovis subsp bovis AF2122/97
cugcgcccauagcugccgg

SEQ ID NO: 1042741 - RNA, 13 nt, Mycobacterium bovis subsp bovis AF2122/97
cugcgccaucaca

SEQ ID NO: 1042742 - RNA, 23 nt, Mycobacterium bovis subsp bovis AF2122/97
cugcgccaguaggcuucgaccgu

SEQ ID NO: 1042743 - RNA, 14 nt, Mycobacterium bovis subsp bovis AF2122/97
cugcgccaggcggc

SEQ ID NO: 1042744 - RNA, 15 nt, Mycobacterium bovis subsp bovis AF2122/97
cugcgccaggcggca

SEQ ID NO: 1042745 - RNA, 16 nt, Mycobacterium bovis subsp bovis AF2122/97
cugcgccacccgcggu

SEQ ID NO: 1042746 - RNA, 13 nt, Mycobacterium bovis subsp bovis AF2122/97
cugcgccaccggu

SEQ ID NO: 1042747 - RNA, 17 nt, Mycobacterium bovis subsp bovis AF2122/97
cugcgccaccggugagg

SEQ ID NO: 1042748 - RNA, 14 nt, Mycobacterium bovis subsp bovis AF2122/97
cugcgccgccagcg

SEQ ID NO: 1042749 - RNA, 12 nt, Mycobacterium bovis subsp bovis AF2122/97
cugcgccgcccg

SEQ ID NO: 1042750 - RNA, 19 nt, Mycobacterium bovis subsp bovis AF2122/97
cugcgccgcccgcgccacc

SEQ ID NO: 1042751 - RNA, 21 nt, Mycobacterium bovis subsp bovis AF2122/97
cugcgccgcccgcgccaccga

SEQ ID NO: 1042752 - RNA, 20 nt, Mycobacterium bovis subsp bovis AF2122/97
cugcgccgccacagcaccca

SEQ ID NO: 1042753 - RNA, 18 nt, Mycobacterium bovis subsp bovis AF2122/97
cugcgccgucaacaccau

SEQ ID NO: 1042754 - RNA, 12 nt, Mycobacterium bovis subsp bovis AF2122/97
cugcgccgccgg

SEQ ID NO: 1042755 - RNA, 17 nt, Mycobacterium bovis subsp bovis AF2122/97
cugcgccuaaccccggc

SEQ ID NO: 1042756 - RNA, 15 nt, Mycobacterium bovis subsp bovis AF2122/97
cugcgccuucgccag

SEQ ID NO: 1042757 - RNA, 17 nt, Mycobacterium bovis subsp bovis AF2122/97
cugcgccuucgccagcg

SEQ ID NO: 1042758 - RNA, 23 nt, Mycobacterium bovis subsp bovis AF2122/97
cugcgccguucgcucccccgcua

SEQ ID NO: 1042759 - RNA, 18 nt, Mycobacterium bovis subsp bovis AF2122/97
cugcgccucggcggccag

SEQ ID NO: 1042760 - RNA, 18 nt, Mycobacterium bovis subsp bovis AF2122/97
cugcucaucgcgcccgcc

SEQ ID NO: 1042761 - RNA, 13 nt, Mycobacterium bovis subsp bovis AF2122/97
cugcuccaggcgc

SEQ ID NO: 1042762 - RNA, 17 nt, Mycobacterium bovis subsp bovis AF2122/97
cugcuccaggcgcgccg

SEQ ID NO: 1042763 - RNA, 19 nt, Mycobacterium bovis subsp bovis AF2122/97
cugcuccaggcgcgccgca

SEQ ID NO: 1042764 - RNA, 20 nt, Mycobacterium bovis subsp bovis AF2122/97
cugcucauccaccucgaugg

SEQ ID NO: 1042765 - RNA, 13 nt, Mycobacterium bovis subsp bovis AF2122/97
cugcucagggcgc

SEQ ID NO: 1042766 - RNA, 20 nt, Mycobacterium bovis subsp bovis AF2122/97
cugcucgacgaggccacggg

SEQ ID NO: 1042767 - RNA, 14 nt, Mycobacterium bovis subsp bovis AF2122/97
cugcuccgcuguca

SEQ ID NO: 1042768 - RNA, 21 nt, Mycobacterium bovis subsp bovis AF2122/97
cugcuccuggaaguacacggc

SEQ ID NO: 1042769 - RNA, 15 nt, Mycobacterium bovis subsp bovis AF2122/97
cugcucgaucaucgg

SEQ ID NO: 1042770 - RNA, 12 nt, Mycobacterium bovis subsp bovis AF2122/97
cugcucgacaag

SEQ ID NO: 1042771 - RNA, 20 nt, Mycobacterium bovis subsp bovis AF2122/97
cugcucgagcagaucagcac

SEQ ID NO: 1042772 - RNA, 13 nt, Mycobacterium bovis subsp bovis AF2122/97
cugcuccucgcgg

SEQ ID NO: 1042773 - RNA, 22 nt, Mycobacterium bovis subsp bovis AF2122/97
cugcucgaaaucgcacagcgca

SEQ ID NO: 1042774 - RNA, 22 nt, Mycobacterium bovis subsp bovis AF2122/97
cugcucggauccggccaggucg

SEQ ID NO: 1042775 - RNA, 14 nt, Mycobacterium bovis subsp bovis AF2122/97
cugcucggcaucga

SEQ ID NO: 1042776 - RNA, 16 nt, Mycobacterium bovis subsp bovis AF2122/97
cugcucggauccggcc

SEQ ID NO: 1042777 - RNA, 13 nt, Mycobacterium bovis subsp bovis AF2122/97
cugcucgcgcucg

SEQ ID NO: 1042778 - RNA, 23 nt, Mycobacterium bovis subsp bovis AF2122/97
cugcucgcgguaguuaacccagg

SEQ ID NO: 1042779 - RNA, 12 nt, Mycobacterium bovis subsp bovis AF2122/97
cugcucggcgua

SEQ ID NO: 1042780 - RNA, 18 nt, Mycobacterium bovis subsp bovis AF2122/97
cugcucggcgaccgucgg

SEQ ID NO: 1042781 - RNA, 19 nt, Mycobacterium bovis subsp bovis AF2122/97
cugcucggcgaccgucggg

SEQ ID NO: 1042782 - RNA, 16 nt, Mycobacterium bovis subsp bovis AF2122/97
cugcucggcgcgccgg

SEQ ID NO: 1042783 - RNA, 23 nt, Mycobacterium bovis subsp bovis AF2122/97
cugcucguagcggcggcgcccgg

SEQ ID NO: 1042784 - RNA, 19 nt, Mycobacterium bovis subsp bovis AF2122/97
cugcucguaggugccgaag

SEQ ID NO: 1042785 - RNA, 15 nt, Mycobacterium bovis subsp bovis AF2122/97
cugcucgcgccgcua

SEQ ID NO: 1042786 - RNA, 13 nt, Mycobacterium bovis subsp bovis AF2122/97
cugcucgcgccgg

SEQ ID NO: 1042787 - RNA, 13 nt, Mycobacterium bovis subsp bovis AF2122/97
cugcucgccgggg

SEQ ID NO: 1042788 - RNA, 19 nt, Mycobacterium bovis subsp bovis AF2122/97
cugcucgcgcaaggcgccg

SEQ ID NO: 1042789 - RNA, 24 nt, Mycobacterium bovis subsp bovis AF2122/97
cugcucgccggccaacugggccga

SEQ ID NO: 1042790 - RNA, 15 nt, Mycobacterium bovis subsp bovis AF2122/97
cugcucgauccgcaa

SEQ ID NO: 1042791 - RNA, 14 nt, Mycobacterium bovis subsp bovis AF2122/97
cugcucgcacagca

SEQ ID NO: 1042792 - RNA, 12 nt, Mycobacterium bovis subsp bovis AF2122/97
cugcugcagcaa

SEQ ID NO: 1042793 - RNA, 13 nt, Mycobacterium bovis subsp bovis AF2122/97
cugcugcagggcc

SEQ ID NO: 1042794 - RNA, 19 nt, Mycobacterium bovis subsp bovis AF2122/97
cugcugcacaucgcaucca

SEQ ID NO: 1042795 - RNA, 22 nt, Mycobacterium bovis subsp bovis AF2122/97
cugcugcaaccgacuucgaugg

SEQ ID NO: 1042796 - RNA, 13 nt, Mycobacterium bovis subsp bovis AF2122/97
cugcugaugcggu

SEQ ID NO: 1042797 - RNA, 19 nt, Mycobacterium bovis subsp bovis AF2122/97
cugcugaccaugaccgggc

SEQ ID NO: 1042798 - RNA, 17 nt, Mycobacterium bovis subsp bovis AF2122/97
cugcugagcugcucgcc

SEQ ID NO: 1042799 - RNA, 19 nt, Mycobacterium bovis subsp bovis AF2122/97
cugcugagcugcucgccgg

SEQ ID NO: 1042800 - RNA, 15 nt, Mycobacterium bovis subsp bovis AF2122/97
cugcugcgaucgccg

SEQ ID NO: 1042801 - RNA, 23 nt, Mycobacterium bovis subsp bovis AF2122/97
cugcugcauguuaugggugacga

SEQ ID NO: 1042802 - RNA, 14 nt, Mycobacterium bovis subsp bovis AF2122/97
cugcugaacaccgg

SEQ ID NO: 1042803 - RNA, 23 nt, Mycobacterium bovis subsp bovis AF2122/97
cugcugaacaccggugaaacgau

SEQ ID NO: 1042804 - RNA, 21 nt, Mycobacterium bovis subsp bovis AF2122/97
cugcucuuuuagccacaaucg

SEQ ID NO: 1042805 - RNA, 18 nt, Mycobacterium bovis subsp bovis AF2122/97
cugcugaacaaccagcau

SEQ ID NO: 1042806 - RNA, 15 nt, Mycobacterium bovis subsp bovis AF2122/97
cugcugaccaugacc

SEQ ID NO: 1042807 - RNA, 18 nt, Mycobacterium bovis subsp bovis AF2122/97
cugcucgucggccaccgc

SEQ ID NO: 1042808 - RNA, 19 nt, Mycobacterium bovis subsp bovis AF2122/97
cugcucgucuuggcggcgg

SEQ ID NO: 1042809 - RNA, 20 nt, Mycobacterium bovis subsp bovis AF2122/97
cugcucgucuuggcggcggu

SEQ ID NO: 1042810 - RNA, 21 nt, Mycobacterium bovis subsp bovis AF2122/97
cugcucgugagccccagcgac

SEQ ID NO: 1042811 - RNA, 22 nt, Mycobacterium bovis subsp bovis AF2122/97
cugcucgugagccccagcgacg

SEQ ID NO: 1042812 - RNA, 18 nt, Mycobacterium bovis subsp bovis AF2122/97
cugcucgucgagccgacc

SEQ ID NO: 1042813 - RNA, 12 nt, Mycobacterium bovis subsp bovis AF2122/97
cugcucggcgcu

SEQ ID NO: 1042814 - RNA, 13 nt, Mycobacterium bovis subsp bovis AF2122/97
cugcucggcggcc

SEQ ID NO: 1042815 - RNA, 14 nt, Mycobacterium bovis subsp bovis AF2122/97
cugcucgggggccg

SEQ ID NO: 1042816 - RNA, 21 nt, Mycobacterium bovis subsp bovis AF2122/97
cugcucuccgucgcgcacggc

SEQ ID NO: 1042817 - RNA, 17 nt, Mycobacterium bovis subsp bovis AF2122/97
cugcucugcgaccucgc

SEQ ID NO: 1042818 - RNA, 19 nt, Mycobacterium bovis subsp bovis AF2122/97
cugcggguggauuggugcc

SEQ ID NO: 1042819 - RNA, 15 nt, Mycobacterium bovis subsp bovis AF2122/97
cugcgggugcgucga

SEQ ID NO: 1042820 - RNA, 17 nt, Mycobacterium bovis subsp bovis AF2122/97
cugcgggucucgccgac

SEQ ID NO: 1042821 - RNA, 19 nt, Mycobacterium bovis subsp bovis AF2122/97
cugcgggucgugccccggc

SEQ ID NO: 1042822 - RNA, 22 nt, Mycobacterium bovis subsp bovis AF2122/97
cugcgggucgugccccggcgcg

SEQ ID NO: 1042823 - RNA, 17 nt, Mycobacterium bovis subsp bovis AF2122/97
cugcgggucagcgccga

SEQ ID NO: 1042824 - RNA, 20 nt, Mycobacterium bovis subsp bovis AF2122/97
cugcgggucccaaucgucgg

SEQ ID NO: 1042825 - RNA, 15 nt, Mycobacterium bovis subsp bovis AF2122/97
cugcgggucgaagcg

SEQ ID NO: 1042826 - RNA, 19 nt, Mycobacterium bovis subsp bovis AF2122/97
cugcgggucgaagcgaucc

SEQ ID NO: 1042827 - RNA, 24 nt, Mycobacterium bovis subsp bovis AF2122/97
cugcggggcuaugaccugcgaagu

SEQ ID NO: 1042828 - RNA, 21 nt, Mycobacterium bovis subsp bovis AF2122/97
cugcggggugagugaccacgc

SEQ ID NO: 1042829 - RNA, 22 nt, Mycobacterium bovis subsp bovis AF2122/97
cugcggggugagugaccacgcu

SEQ ID NO: 1042830 - RNA, 22 nt, Mycobacterium bovis subsp bovis AF2122/97
cugcggguagauguucacgccg

SEQ ID NO: 1042831 - RNA, 20 nt, Mycobacterium bovis subsp bovis AF2122/97
cugcggguaggugacgacgu

SEQ ID NO: 1042832 - RNA, 24 nt, Mycobacterium bovis subsp bovis AF2122/97
cugcggguaggugacgacgucguu

SEQ ID NO: 1042833 - RNA, 14 nt, Mycobacterium bovis subsp bovis AF2122/97
cugcgggcggucca

SEQ ID NO: 1042834 - RNA, 13 nt, Mycobacterium bovis subsp bovis AF2122/97
cugcgggccguag

SEQ ID NO: 1042835 - RNA, 21 nt, Mycobacterium bovis subsp bovis AF2122/97
cugcggucaucgccucggcgu

SEQ ID NO: 1042836 - RNA, 14 nt, Mycobacterium bovis subsp bovis AF2122/97
cugcggucgcccag

SEQ ID NO: 1042837 - RNA, 20 nt, Mycobacterium bovis subsp bovis AF2122/97
cugcgguaaucgccaccgca

SEQ ID NO: 1042838 - RNA, 15 nt, Mycobacterium bovis subsp bovis AF2122/97
cugcggucgcccagg

SEQ ID NO: 1042839 - RNA, 21 nt, Mycobacterium bovis subsp bovis AF2122/97
cugcgguuuccaguaugaggu

SEQ ID NO: 1042840 - RNA, 12 nt, Mycobacterium bovis subsp bovis AF2122/97
cugcgguugagu

SEQ ID NO: 1042841 - RNA, 16 nt, Mycobacterium bovis subsp bovis AF2122/97
cugcgguugaguugca

SEQ ID NO: 1042842 - RNA, 22 nt, Mycobacterium bovis subsp bovis AF2122/97
cugcggugcaggauucggcggu

SEQ ID NO: 1042843 - RNA, 20 nt, Mycobacterium bovis subsp bovis AF2122/97
cugcggucuggacaucggcc

SEQ ID NO: 1042844 - RNA, 21 nt, Mycobacterium bovis subsp bovis AF2122/97
cugcggucuggacaucggccg

SEQ ID NO: 1042845 - RNA, 13 nt, Mycobacterium bovis subsp bovis AF2122/97
cugcggcggccau

SEQ ID NO: 1042846 - RNA, 17 nt, Mycobacterium bovis subsp bovis AF2122/97
cugcggcgcuggccagc

SEQ ID NO: 1042847 - RNA, 16 nt, Mycobacterium bovis subsp bovis AF2122/97
cugcggcgcccggucg

SEQ ID NO: 1042848 - RNA, 17 nt, Mycobacterium bovis subsp bovis AF2122/97
cugcggcgcccggucga

SEQ ID NO: 1042849 - RNA, 21 nt, Mycobacterium bovis subsp bovis AF2122/97
cugcggcgcccggucgagcca

SEQ ID NO: 1042850 - RNA, 11 nt, Mycobacterium bovis subsp bovis AF2122/97
cugcggcggcu

SEQ ID NO: 1042851 - RNA, 20 nt, Mycobacterium bovis subsp bovis AF2122/97
cugcggcggcuuuggccgcc

SEQ ID NO: 1042852 - RNA, 21 nt, Mycobacterium bovis subsp bovis AF2122/97
cugcggcucagaacccuccgc

SEQ ID NO: 1042853 - RNA, 17 nt, Mycobacterium bovis subsp bovis AF2122/97
cugcggcuccggcggca

SEQ ID NO: 1042854 - RNA, 20 nt, Mycobacterium bovis subsp bovis AF2122/97
cugcgggccggcaucgucgg

SEQ ID NO: 1042855 - RNA, 14 nt, Mycobacterium bovis subsp bovis AF2122/97
cugcgggacgucgu

SEQ ID NO: 1042856 - RNA, 14 nt, Mycobacterium bovis subsp bovis AF2122/97
cugcgggaacccca

SEQ ID NO: 1042857 - RNA, 23 nt, Mycobacterium bovis subsp bovis AF2122/97
cugcggcucgcugaucuggggca

SEQ ID NO: 1042858 - RNA, 17 nt, Mycobacterium bovis subsp bovis AF2122/97
cugcggcuuggccauca

SEQ ID NO: 1042859 - RNA, 19 nt, Mycobacterium bovis subsp bovis AF2122/97
cugcggcuuggccaucacg

SEQ ID NO: 1042860 - RNA, 17 nt, Mycobacterium bovis subsp bovis AF2122/97
cugcgugccgcaccgcc

SEQ ID NO: 1042861 - RNA, 14 nt, Mycobacterium bovis subsp bovis AF2122/97
cugcgucugcucgg

SEQ ID NO: 1042862 - RNA, 18 nt, Mycobacterium bovis subsp bovis AF2122/97
cugcgucugcucggcgcg

SEQ ID NO: 1042863 - RNA, 18 nt, Mycobacterium bovis subsp bovis AF2122/97
cugcgucugcucggcgcu

SEQ ID NO: 1042864 - RNA, 19 nt, Mycobacterium bovis subsp bovis AF2122/97
cugcgucugcucaccagcg

SEQ ID NO: 1042865 - RNA, 22 nt, Mycobacterium bovis subsp bovis AF2122/97
cugcgucugcucaccagcgguc

SEQ ID NO: 1042866 - RNA, 15 nt, Mycobacterium bovis subsp bovis AF2122/97
cugcgucugcucgcc

SEQ ID NO: 1042867 - RNA, 21 nt, Mycobacterium bovis subsp bovis AF2122/97
cugcgucugcucgccagccgg

SEQ ID NO: 1042868 - RNA, 23 nt, Mycobacterium bovis subsp bovis AF2122/97
cugcgucugcucgccguggugga

SEQ ID NO: 1042869 - RNA, 17 nt, Mycobacterium bovis subsp bovis AF2122/97
cugcgucugcucgcgca

SEQ ID NO: 1042870 - RNA, 15 nt, Mycobacterium bovis subsp bovis AF2122/97
cugcgucggcccgcg

SEQ ID NO: 1042871 - RNA, 15 nt, Mycobacterium bovis subsp bovis AF2122/97
cugcgucucgaugag

SEQ ID NO: 1042872 - RNA, 14 nt, Mycobacterium bovis subsp bovis AF2122/97
cugcguccugcucg

SEQ ID NO: 1042873 - RNA, 13 nt, Mycobacterium bovis subsp bovis AF2122/97
cugcguccaccac

SEQ ID NO: 1042874 - RNA, 12 nt, Mycobacterium bovis subsp bovis AF2122/97
cugcgucaucgc

SEQ ID NO: 1042875 - RNA, 14 nt, Mycobacterium bovis subsp bovis AF2122/97
cugcguccaccacg

SEQ ID NO: 1042876 - RNA, 14 nt, Mycobacterium bovis subsp bovis AF2122/97
cugcguccaccgga

SEQ ID NO: 1042877 - RNA, 18 nt, Mycobacterium bovis subsp bovis AF2122/97
cugcguccaccggacggg

SEQ ID NO: 1042878 - RNA, 17 nt, Mycobacterium bovis subsp bovis AF2122/97
cugcguccagaucucga

SEQ ID NO: 1042879 - RNA, 20 nt, Mycobacterium bovis subsp bovis AF2122/97
cugcguccagaucucgauua

SEQ ID NO: 1042880 - RNA, 14 nt, Mycobacterium bovis subsp bovis AF2122/97
cugcguggcgaacc

SEQ ID NO: 1042881 - RNA, 14 nt, Mycobacterium bovis subsp bovis AF2122/97
cugcguugacguca

SEQ ID NO: 1042882 - RNA, 17 nt, Mycobacterium bovis subsp bovis AF2122/97
cugcguuggcuggugca

SEQ ID NO: 1042883 - RNA, 19 nt, Mycobacterium bovis subsp bovis AF2122/97
cugcguuccaucgccgacg

SEQ ID NO: 1042884 - RNA, 13 nt, Mycobacterium bovis subsp bovis AF2122/97
cugcguucgccgg

SEQ ID NO: 1042885 - RNA, 15 nt, Mycobacterium bovis subsp bovis AF2122/97
cugcuagccagucgg

SEQ ID NO: 1042886 - RNA, 17 nt, Mycobacterium bovis subsp bovis AF2122/97
cugcuagccagucggcc

SEQ ID NO: 1042887 - RNA, 20 nt, Mycobacterium bovis subsp bovis AF2122/97
cugcuagccagucggccacc

SEQ ID NO: 1042888 - RNA, 18 nt, Mycobacterium bovis subsp bovis AF2122/97
cugcuagcuuggcggcca

SEQ ID NO: 1042889 - RNA, 14 nt, Mycobacterium bovis subsp bovis AF2122/97
cugcuacccgagcc

SEQ ID NO: 1042890 - RNA, 21 nt, Mycobacterium bovis subsp bovis AF2122/97
cugcuacccgagccggcacgc

SEQ ID NO: 1042891 - RNA, 18 nt, Mycobacterium bovis subsp bovis AF2122/97
cuguguuugcggcuucgg

SEQ ID NO: 1042892 - RNA, 16 nt, Mycobacterium bovis subsp bovis AF2122/97
cugugucguacccggc

SEQ ID NO: 1042893 - RNA, 17 nt, Mycobacterium bovis subsp bovis AF2122/97
cugugucguacccggca

SEQ ID NO: 1042894 - RNA, 22 nt, Mycobacterium bovis subsp bovis AF2122/97
cuguggugacagauccgccccg

SEQ ID NO: 1042895 - RNA, 20 nt, Mycobacterium bovis subsp bovis AF2122/97
cuguggucgcugcugccgca

SEQ ID NO: 1042896 - RNA, 22 nt, Mycobacterium bovis subsp bovis AF2122/97
cuguggucgcugcugccgcacc

SEQ ID NO: 1042897 - RNA, 15 nt, Mycobacterium bovis subsp bovis AF2122/97
cuguggucggugcca

SEQ ID NO: 1042898 - RNA, 15 nt, Mycobacterium bovis subsp bovis AF2122/97
cuguggacacggcgc

SEQ ID NO: 1042899 - RNA, 14 nt, Mycobacterium bovis subsp bovis AF2122/97
cuguggcgccgccg

SEQ ID NO: 1042900 - RNA, 19 nt, Mycobacterium bovis subsp bovis AF2122/97
cuguggcgccgccggcacc

SEQ ID NO: 1042901 - RNA, 15 nt, Mycobacterium bovis subsp bovis AF2122/97
cuguggccgcgucgc

SEQ ID NO: 1042902 - RNA, 20 nt, Mycobacterium bovis subsp bovis AF2122/97
cuguggaucgacaccgacgc

SEQ ID NO: 1042903 - RNA, 19 nt, Mycobacterium bovis subsp bovis AF2122/97
cuguggcugaacaccgcgg

SEQ ID NO: 1042904 - RNA, 18 nt, Mycobacterium bovis subsp bovis AF2122/97
cugugggauuugcacuac

SEQ ID NO: 1042905 - RNA, 15 nt, Mycobacterium bovis subsp bovis AF2122/97
cugugggcgaucggc

SEQ ID NO: 1042906 - RNA, 15 nt, Mycobacterium bovis subsp bovis AF2122/97
cugugaucgagucgc

SEQ ID NO: 1042907 - RNA, 13 nt, Mycobacterium bovis subsp bovis AF2122/97
cugugcucacggc

SEQ ID NO: 1042908 - RNA, 16 nt, Mycobacterium bovis subsp bovis AF2122/97
cugugcgguaucgguc

SEQ ID NO: 1042909 - RNA, 21 nt, Mycobacterium bovis subsp bovis AF2122/97
cuguggaagcccgucgcggcc

SEQ ID NO: 1042910 - RNA, 15 nt, Mycobacterium bovis subsp bovis AF2122/97
cugugaacagcgcgu

SEQ ID NO: 1042911 - RNA, 21 nt, Mycobacterium bovis subsp bovis AF2122/97
cugucgucuuggcgaucgggu

SEQ ID NO: 1042912 - RNA, 16 nt, Mycobacterium bovis subsp bovis AF2122/97
cugucgugccucucgg

SEQ ID NO: 1042913 - RNA, 21 nt, Mycobacterium bovis subsp bovis AF2122/97
cugucgaagauccagcgcacc

SEQ ID NO: 1042914 - RNA, 13 nt, Mycobacterium bovis subsp bovis AF2122/97
cugucgaccgcga

SEQ ID NO: 1042915 - RNA, 22 nt, Mycobacterium bovis subsp bovis AF2122/97
cugucgagguggucgacccggc

SEQ ID NO: 1042916 - RNA, 18 nt, Mycobacterium bovis subsp bovis AF2122/97
cuguccgcgggccgcgcg

SEQ ID NO: 1042917 - RNA, 22 nt, Mycobacterium bovis subsp bovis AF2122/97
cugucauguccugggccgccgc

SEQ ID NO: 1042918 - RNA, 15 nt, Mycobacterium bovis subsp bovis AF2122/97
cuguccggcauaccg

SEQ ID NO: 1042919 - RNA, 17 nt, Mycobacterium bovis subsp bovis AF2122/97
cuguccggguagcggcg

SEQ ID NO: 1042920 - RNA, 19 nt, Mycobacterium bovis subsp bovis AF2122/97
cuguccggguagcggcgcc

SEQ ID NO: 1042921 - RNA, 20 nt, Mycobacterium bovis subsp bovis AF2122/97
cuguccggguagcggcgccg

SEQ ID NO: 1042922 - RNA, 22 nt, Mycobacterium bovis subsp bovis AF2122/97
cuguccggguagcggcgccgcc

SEQ ID NO: 1042923 - RNA, 14 nt, Mycobacterium bovis subsp bovis AF2122/97
cuguccucgcgggc

SEQ ID NO: 1042924 - RNA, 15 nt, Mycobacterium bovis subsp bovis AF2122/97
cuguccggcgccgag

SEQ ID NO: 1042925 - RNA, 16 nt, Mycobacterium bovis subsp bovis AF2122/97
cuggucgaccaucggu

SEQ ID NO: 1042926 - RNA, 17 nt, Mycobacterium bovis subsp bovis AF2122/97
cuggucgaccggcguug

SEQ ID NO: 1042927 - RNA, 15 nt, Mycobacterium bovis subsp bovis AF2122/97
cugucagccgaccga

SEQ ID NO: 1042928 - RNA, 18 nt, Mycobacterium bovis subsp bovis AF2122/97
cugucagcgcggcgcgca

SEQ ID NO: 1042929 - RNA, 17 nt, Mycobacterium bovis subsp bovis AF2122/97
cugucaggcggcggacc

SEQ ID NO: 1042930 - RNA, 21 nt, Mycobacterium bovis subsp bovis AF2122/97
cugucaggcucacacucggcc

SEQ ID NO: 1042931 - RNA, 14 nt, Mycobacterium bovis subsp bovis AF2122/97
cuuaccggcgggcg

SEQ ID NO: 1042932 - RNA, 22 nt, Mycobacterium bovis subsp bovis AF2122/97
cuuaagcgaacccgagccgccg

SEQ ID NO: 1042933 - RNA, 23 nt, Mycobacterium bovis subsp bovis AF2122/97
cuuaagcgaacccgagccgccgu

SEQ ID NO: 1042934 - RNA, 18 nt, Mycobacterium bovis subsp bovis AF2122/97
cuguuggugccgccacca

SEQ ID NO: 1042935 - RNA, 15 nt, Mycobacterium bovis subsp bovis AF2122/97
cuguuguacggccca

SEQ ID NO: 1042936 - RNA, 24 nt, Mycobacterium bovis subsp bovis AF2122/97
cuguuguugccccggucggcgacg

SEQ ID NO: 1042937 - RNA, 19 nt, Mycobacterium bovis subsp bovis AF2122/97
cuguuacuccgacggcccg

SEQ ID NO: 1042938 - RNA, 23 nt, Mycobacterium bovis subsp bovis AF2122/97
cuguuucggcaggaaugccgcgg

SEQ ID NO: 1042939 - RNA, 18 nt, Mycobacterium bovis subsp bovis AF2122/97
cuuacuugaucucggcga

SEQ ID NO: 1042940 - RNA, 16 nt, Mycobacterium bovis subsp bovis AF2122/97
cuuagaacgugcuggu

SEQ ID NO: 1042941 - RNA, 21 nt, Mycobacterium bovis subsp bovis AF2122/97
cuuagagcuauacagcggacc

SEQ ID NO: 1042942 - RNA, 17 nt, Mycobacterium bovis subsp bovis AF2122/97
cuuaucgucgacgccga

SEQ ID NO: 1042943 - RNA, 13 nt, Mycobacterium bovis subsp bovis AF2122/97
cuuaucggcgucg

SEQ ID NO: 1042944 - RNA, 22 nt, Mycobacterium bovis subsp bovis AF2122/97
cuucaacuuacgcgacgccguc

SEQ ID NO: 1042945 - RNA, 15 nt, Mycobacterium bovis subsp bovis AF2122/97
cuucaaagaucgccu

SEQ ID NO: 1042946 - RNA, 14 nt, Mycobacterium bovis subsp bovis AF2122/97
cuucuccucgucgg

SEQ ID NO: 1042947 - RNA, 16 nt, Mycobacterium bovis subsp bovis AF2122/97
cuucucgagccgccgg

SEQ ID NO: 1042948 - RNA, 17 nt, Mycobacterium bovis subsp bovis AF2122/97
cuucucgagccgccgga

SEQ ID NO: 1042949 - RNA, 13 nt, Mycobacterium bovis subsp bovis AF2122/97
cuucuccaccacc

SEQ ID NO: 1042950 - RNA, 20 nt, Mycobacterium bovis subsp bovis AF2122/97
cuucuccaccagcguggacg

SEQ ID NO: 1042951 - RNA, 16 nt, Mycobacterium bovis subsp bovis AF2122/97
cuucuaugacgaccgu

SEQ ID NO: 1042952 - RNA, 20 nt, Mycobacterium bovis subsp bovis AF2122/97
cuucucagcaccaugcucgg

SEQ ID NO: 1042953 - RNA, 15 nt, Mycobacterium bovis subsp bovis AF2122/97
cuucgguaggcaggc

SEQ ID NO: 1042954 - RNA, 20 nt, Mycobacterium bovis subsp bovis AF2122/97
cuucggugucgccgaacacc

SEQ ID NO: 1042955 - RNA, 14 nt, Mycobacterium bovis subsp bovis AF2122/97
cuucggucgcggcc

SEQ ID NO: 1042956 - RNA, 18 nt, Mycobacterium bovis subsp bovis AF2122/97
cuucggugacccgggcgg

SEQ ID NO: 1042957 - RNA, 22 nt, Mycobacterium bovis subsp bovis AF2122/97
cuucggugccgugaucggcgcc

SEQ ID NO: 1042958 - RNA, 15 nt, Mycobacterium bovis subsp bovis AF2122/97
cuucgguggcgggcu

SEQ ID NO: 1042959 - RNA, 23 nt, Mycobacterium bovis subsp bovis AF2122/97
cuucgguggcgggcuugccgucu

SEQ ID NO: 1042960 - RNA, 19 nt, Mycobacterium bovis subsp bovis AF2122/97
cuucgguggggucgcugcc

SEQ ID NO: 1042961 - RNA, 22 nt, Mycobacterium bovis subsp bovis AF2122/97
cuucgguggggucgcugccgcc

SEQ ID NO: 1042962 - RNA, 18 nt, Mycobacterium bovis subsp bovis AF2122/97
cuucgguguagcccagcc

SEQ ID NO: 1042963 - RNA, 17 nt, Mycobacterium bovis subsp bovis AF2122/97
cuucgggguaaccggcg

SEQ ID NO: 1042964 - RNA, 18 nt, Mycobacterium bovis subsp bovis AF2122/97
cuucgggguaguugaggc

SEQ ID NO: 1042965 - RNA, 22 nt, Mycobacterium bovis subsp bovis AF2122/97
cuucgggguaguugaggccguc

SEQ ID NO: 1042966 - RNA, 18 nt, Mycobacterium bovis subsp bovis AF2122/97
cuucggggugcacgcgga

SEQ ID NO: 1042967 - RNA, 18 nt, Mycobacterium bovis subsp bovis AF2122/97
cuucgggcucguccagca

SEQ ID NO: 1042968 - RNA, 20 nt, Mycobacterium bovis subsp bovis AF2122/97
cuucgggcucguccagcaac

SEQ ID NO: 1042969 - RNA, 15 nt, Mycobacterium bovis subsp bovis AF2122/97
cuucgggcuggucgg

SEQ ID NO: 1042970 - RNA, 15 nt, Mycobacterium bovis subsp bovis AF2122/97
cuucgggcagcgcgu

SEQ ID NO: 1042971 - RNA, 19 nt, Mycobacterium bovis subsp bovis AF2122/97
cuucgggccgacgggcgca

SEQ ID NO: 1042972 - RNA, 19 nt, Mycobacterium bovis subsp bovis AF2122/97
cuucgggaacgcucgucga

SEQ ID NO: 1042973 - RNA, 13 nt, Mycobacterium bovis subsp bovis AF2122/97
cuucgccggcgcc

SEQ ID NO: 1042974 - RNA, 13 nt, Mycobacterium bovis subsp bovis AF2122/97
cuucgccgcgcag

SEQ ID NO: 1042975 - RNA, 13 nt, Mycobacterium bovis subsp bovis AF2122/97
cuucgccgcggga

SEQ ID NO: 1042976 - RNA, 12 nt, Mycobacterium bovis subsp bovis AF2122/97
cuucgccgcccg

SEQ ID NO: 1042977 - RNA, 14 nt, Mycobacterium bovis subsp bovis AF2122/97
cuucgcccgggccg

SEQ ID NO: 1042978 - RNA, 19 nt, Mycobacterium bovis subsp bovis AF2122/97
cuucugccaucaacaggcc

SEQ ID NO: 1042979 - RNA, 14 nt, Mycobacterium bovis subsp bovis AF2122/97
cuucugccugcgca

SEQ ID NO: 1042980 - RNA, 16 nt, Mycobacterium bovis subsp bovis AF2122/97
cuucugccuuggccgg

SEQ ID NO: 1042981 - RNA, 17 nt, Mycobacterium bovis subsp bovis AF2122/97
cuucugcgucugcucgc

SEQ ID NO: 1042982 - RNA, 16 nt, Mycobacterium bovis subsp bovis AF2122/97
cuucugcgccacgucg

SEQ ID NO: 1042983 - RNA, 16 nt, Mycobacterium bovis subsp bovis AF2122/97
cuucugguccagcacc

SEQ ID NO: 1042984 - RNA, 17 nt, Mycobacterium bovis subsp bovis AF2122/97
cuugaaacccaggccgu

SEQ ID NO: 1042985 - RNA, 17 nt, Mycobacterium bovis subsp bovis AF2122/97
cuucgaagcgaucgccg

SEQ ID NO: 1042986 - RNA, 14 nt, Mycobacterium bovis subsp bovis AF2122/97
cuucgacagcgcgc

SEQ ID NO: 1042987 - RNA, 14 nt, Mycobacterium bovis subsp bovis AF2122/97
cuucgacagcggcg

SEQ ID NO: 1042988 - RNA, 16 nt, Mycobacterium bovis subsp bovis AF2122/97
cuucgacgcgcauucg

SEQ ID NO: 1042989 - RNA, 16 nt, Mycobacterium bovis subsp bovis AF2122/97
cuucgacgcggcgacc

SEQ ID NO: 1042990 - RNA, 15 nt, Mycobacterium bovis subsp bovis AF2122/97
cuucgacggcggcca

SEQ ID NO: 1042991 - RNA, 16 nt, Mycobacterium bovis subsp bovis AF2122/97
cuucgacgucggcgac

SEQ ID NO: 1042992 - RNA, 14 nt, Mycobacterium bovis subsp bovis AF2122/97
cuucgccagcggcg

SEQ ID NO: 1042993 - RNA, 13 nt, Mycobacterium bovis subsp bovis AF2122/97
cuucgccagcggc

SEQ ID NO: 1042994 - RNA, 22 nt, Mycobacterium bovis subsp bovis AF2122/97
cuucgagcaccgacaccggccg

SEQ ID NO: 1042995 - RNA, 13 nt, Mycobacterium bovis subsp bovis AF2122/97
cuuccgccgccgc

SEQ ID NO: 1042996 - RNA, 16 nt, Mycobacterium bovis subsp bovis AF2122/97
cuuccgacccaacgac

SEQ ID NO: 1042997 - RNA, 21 nt, Mycobacterium bovis subsp bovis AF2122/97
cuuccgacccaacgaccacca

SEQ ID NO: 1042998 - RNA, 16 nt, Mycobacterium bovis subsp bovis AF2122/97
cuuccgacgaccaggu

SEQ ID NO: 1042999 - RNA, 14 nt, Mycobacterium bovis subsp bovis AF2122/97
cuucccgucgacga

SEQ ID NO: 1043000 - RNA, 15 nt, Mycobacterium bovis subsp bovis AF2122/97
cuuccuugccagggu

SEQ ID NO: 1043001 - RNA, 15 nt, Mycobacterium bovis subsp bovis AF2122/97
cuuccggcgcgaccg

SEQ ID NO: 1043002 - RNA, 19 nt, Mycobacterium bovis subsp bovis AF2122/97
cuucacccaaccccgccgg

SEQ ID NO: 1043003 - RNA, 21 nt, Mycobacterium bovis subsp bovis AF2122/97
cuucacccaaccccgccggcc

SEQ ID NO: 1043004 - RNA, 22 nt, Mycobacterium bovis subsp bovis AF2122/97
cuucacccaaccccgccggccg

SEQ ID NO: 1043005 - RNA, 15 nt, Mycobacterium bovis subsp bovis AF2122/97
cuucacccaacggug

SEQ ID NO: 1043006 - RNA, 13 nt, Mycobacterium bovis subsp bovis AF2122/97
cuucaccacccug

SEQ ID NO: 1043007 - RNA, 22 nt, Mycobacterium bovis subsp bovis AF2122/97
cuuccacacgggaagccgcgcc

SEQ ID NO: 1043008 - RNA, 15 nt, Mycobacterium bovis subsp bovis AF2122/97
cuucaccacgccgua

SEQ ID NO: 1043009 - RNA, 16 nt, Mycobacterium bovis subsp bovis AF2122/97
cuucacagccaccagc

SEQ ID NO: 1043010 - RNA, 19 nt, Mycobacterium bovis subsp bovis AF2122/97
cuuccccgguagcguucgg

SEQ ID NO: 1043011 - RNA, 16 nt, Mycobacterium bovis subsp bovis AF2122/97
cuuccccucggccgcc

SEQ ID NO: 1043012 - RNA, 17 nt, Mycobacterium bovis subsp bovis AF2122/97
cuucccauuucggcaaa

SEQ ID NO: 1043013 - RNA, 16 nt, Mycobacterium bovis subsp bovis AF2122/97
cuucccaaccgcccgu

SEQ ID NO: 1043014 - RNA, 21 nt, Mycobacterium bovis subsp bovis AF2122/97
cuucccggaagcgccggccca

SEQ ID NO: 1043015 - RNA, 17 nt, Mycobacterium bovis subsp bovis AF2122/97
cuucccggauagacggc

SEQ ID NO: 1043016 - RNA, 22 nt, Mycobacterium bovis subsp bovis AF2122/97
cuuccccagcaguucgccgcgc

SEQ ID NO: 1043017 - RNA, 16 nt, Mycobacterium bovis subsp bovis AF2122/97
cuuccacgccggacua

SEQ ID NO: 1043018 - RNA, 16 nt, Mycobacterium bovis subsp bovis AF2122/97
cuugcagcgcguucgg

SEQ ID NO: 1043019 - RNA, 22 nt, Mycobacterium bovis subsp bovis AF2122/97
cuugcaguaacuucaccggcuc

SEQ ID NO: 1043020 - RNA, 17 nt, Mycobacterium bovis subsp bovis AF2122/97
cuugcaaggucgcugcu

SEQ ID NO: 1043021 - RNA, 16 nt, Mycobacterium bovis subsp bovis AF2122/97
cuugcagugccgccgg

SEQ ID NO: 1043022 - RNA, 15 nt, Mycobacterium bovis subsp bovis AF2122/97
cuugcauccggccca

SEQ ID NO: 1043023 - RNA, 16 nt, Mycobacterium bovis subsp bovis AF2122/97
cuugcauccggcccac

SEQ ID NO: 1043024 - RNA, 23 nt, Mycobacterium bovis subsp bovis AF2122/97
cuugccaccgguaccgccggcuc

SEQ ID NO: 1043025 - RNA, 20 nt, Mycobacterium bovis subsp bovis AF2122/97
cuugccaccgcugccggcac

SEQ ID NO: 1043026 - RNA, 15 nt, Mycobacterium bovis subsp bovis AF2122/97
cuugaucagccgcca

SEQ ID NO: 1043027 - RNA, 19 nt, Mycobacterium bovis subsp bovis AF2122/97
cuugaucagccgccaaccg

SEQ ID NO: 1043028 - RNA, 13 nt, Mycobacterium bovis subsp bovis AF2122/97
cuugaugccgcac

SEQ ID NO: 1043029 - RNA, 22 nt, Mycobacterium bovis subsp bovis AF2122/97
cuugaugccggccaaguugacc

SEQ ID NO: 1043030 - RNA, 19 nt, Mycobacterium bovis subsp bovis AF2122/97
cuugauguaaugcgggcgc

SEQ ID NO: 1043031 - RNA, 15 nt, Mycobacterium bovis subsp bovis AF2122/97
cuugauguccgcgac

SEQ ID NO: 1043032 - RNA, 16 nt, Mycobacterium bovis subsp bovis AF2122/97
cuugauguccgcgacg

SEQ ID NO: 1043033 - RNA, 16 nt, Mycobacterium bovis subsp bovis AF2122/97
cuugagcgaguugcag

SEQ ID NO: 1043034 - RNA, 17 nt, Mycobacterium bovis subsp bovis AF2122/97
cuugagcacuccgucgu

SEQ ID NO: 1043035 - RNA, 14 nt, Mycobacterium bovis subsp bovis AF2122/97
cuugagaaacccga

SEQ ID NO: 1043036 - RNA, 21 nt, Mycobacterium bovis subsp bovis AF2122/97
cuugagcgcggcuacggucgc

SEQ ID NO: 1043037 - RNA, 20 nt, Mycobacterium bovis subsp bovis AF2122/97
cuugaggauccgcaccacgc

SEQ ID NO: 1043038 - RNA, 14 nt, Mycobacterium bovis subsp bovis AF2122/97
cuugaggucaucgg

SEQ ID NO: 1043039 - RNA, 17 nt, Mycobacterium bovis subsp bovis AF2122/97
cuugagguccgucgcgc

SEQ ID NO: 1043040 - RNA, 21 nt, Mycobacterium bovis subsp bovis AF2122/97
cuugaccgggucgaugacgcc

SEQ ID NO: 1043041 - RNA, 15 nt, Mycobacterium bovis subsp bovis AF2122/97
cuugaccguccaccg

SEQ ID NO: 1043042 - RNA, 18 nt, Mycobacterium bovis subsp bovis AF2122/97
cuugaccguccaccgacg

SEQ ID NO: 1043043 - RNA, 19 nt, Mycobacterium bovis subsp bovis AF2122/97
cuugaccuauuugcgaccc

SEQ ID NO: 1043044 - RNA, 19 nt, Mycobacterium bovis subsp bovis AF2122/97
cuugaccccuggccgccgg

SEQ ID NO: 1043045 - RNA, 21 nt, Mycobacterium bovis subsp bovis AF2122/97
cuugaccgcggugacucggcc

SEQ ID NO: 1043046 - RNA, 20 nt, Mycobacterium bovis subsp bovis AF2122/97
cuugacggcgccaggcacca

SEQ ID NO: 1043047 - RNA, 20 nt, Mycobacterium bovis subsp bovis AF2122/97
cuugaccacagcggagacga

SEQ ID NO: 1043048 - RNA, 23 nt, Mycobacterium bovis subsp bovis AF2122/97
cuugaccacagcggagacgaucg

SEQ ID NO: 1043049 - RNA, 23 nt, Mycobacterium bovis subsp bovis AF2122/97
cuugacagcuuucuuggcgggcg

SEQ ID NO: 1043050 - RNA, 19 nt, Mycobacterium bovis subsp bovis AF2122/97
cuugacagcuuucuuggcg

SEQ ID NO: 1043051 - RNA, 15 nt, Mycobacterium bovis subsp bovis AF2122/97
cuuggcggccagccg

SEQ ID NO: 1043052 - RNA, 14 nt, Mycobacterium bovis subsp bovis AF2122/97
cuuggcggccagcg

SEQ ID NO: 1043053 - RNA, 15 nt, Mycobacterium bovis subsp bovis AF2122/97
cuuggcgggaucgag

SEQ ID NO: 1043054 - RNA, 13 nt, Mycobacterium bovis subsp bovis AF2122/97
cuuggcgggcgcc

SEQ ID NO: 1043055 - RNA, 19 nt, Mycobacterium bovis subsp bovis AF2122/97
cuuggcgggcgccuugguc

SEQ ID NO: 1043056 - RNA, 13 nt, Mycobacterium bovis subsp bovis AF2122/97
cuuggcgccaccg

SEQ ID NO: 1043057 - RNA, 16 nt, Mycobacterium bovis subsp bovis AF2122/97
cuuggcgccaccggcg

SEQ ID NO: 1043058 - RNA, 16 nt, Mycobacterium bovis subsp bovis AF2122/97
cuuggcgaucucaccu

SEQ ID NO: 1043059 - RNA, 17 nt, Mycobacterium bovis subsp bovis AF2122/97
cuuggccaccaucgccg

SEQ ID NO: 1043060 - RNA, 14 nt, Mycobacterium bovis subsp bovis AF2122/97
cuuggccaccgccg

SEQ ID NO: 1043061 - RNA, 14 nt, Mycobacterium bovis subsp bovis AF2122/97
cuuggcgaccaugc

SEQ ID NO: 1043062 - RNA, 16 nt, Mycobacterium bovis subsp bovis AF2122/97
cuuggcgaacgccacg

SEQ ID NO: 1043063 - RNA, 16 nt, Mycobacterium bovis subsp bovis AF2122/97
cuuggcaucgcgagcc

SEQ ID NO: 1043064 - RNA, 21 nt, Mycobacterium bovis subsp bovis AF2122/97
cuuggcaucgcgagccagcug

SEQ ID NO: 1043065 - RNA, 18 nt, Mycobacterium bovis subsp bovis AF2122/97
cuuggcauugaccaccga

SEQ ID NO: 1043066 - RNA, 18 nt, Mycobacterium bovis subsp bovis AF2122/97
cuuggcaagcacgcgacg

SEQ ID NO: 1043067 - RNA, 19 nt, Mycobacterium bovis subsp bovis AF2122/97
cuuggcgucgaugcgggcc

SEQ ID NO: 1043068 - RNA, 12 nt, Mycobacterium bovis subsp bovis AF2122/97
cuuggcgucgac

SEQ ID NO: 1043069 - RNA, 23 nt, Mycobacterium bovis subsp bovis AF2122/97
cuuggcgucgacaucggugacgg

SEQ ID NO: 1043070 - RNA, 12 nt, Mycobacterium bovis subsp bovis AF2122/97
cuuggcgucgau

SEQ ID NO: 1043071 - RNA, 13 nt, Mycobacterium bovis subsp bovis AF2122/97
cuuggcugcgaga

SEQ ID NO: 1043072 - RNA, 17 nt, Mycobacterium bovis subsp bovis AF2122/97
cuuggcugggcccgccg

SEQ ID NO: 1043073 - RNA, 22 nt, Mycobacterium bovis subsp bovis AF2122/97
cuuggcugugauguuguucagc

SEQ ID NO: 1043074 - RNA, 17 nt, Mycobacterium bovis subsp bovis AF2122/97
cuugggcagcagcgcgc

SEQ ID NO: 1043075 - RNA, 20 nt, Mycobacterium bovis subsp bovis AF2122/97
cuugggaaacccggccagcu

SEQ ID NO: 1043076 - RNA, 15 nt, Mycobacterium bovis subsp bovis AF2122/97
cuugggacugcggac

SEQ ID NO: 1043077 - RNA, 22 nt, Mycobacterium bovis subsp bovis AF2122/97
cuugggcgacgcggcgccgcca

SEQ ID NO: 1043078 - RNA, 21 nt, Mycobacterium bovis subsp bovis AF2122/97
cuugggcggcacuggauccgg

SEQ ID NO: 1043079 - RNA, 18 nt, Mycobacterium bovis subsp bovis AF2122/97
cuugggcguacucggcgc

SEQ ID NO: 1043080 - RNA, 17 nt, Mycobacterium bovis subsp bovis AF2122/97
cuugggucggucacgac

SEQ ID NO: 1043081 - RNA, 20 nt, Mycobacterium bovis subsp bovis AF2122/97
cuuggucaaaaagcucggcc

SEQ ID NO: 1043082 - RNA, 18 nt, Mycobacterium bovis subsp bovis AF2122/97
cuuggguugauuggcccc

SEQ ID NO: 1043083 - RNA, 15 nt, Mycobacterium bovis subsp bovis AF2122/97
cuugguagccggccg

SEQ ID NO: 1043084 - RNA, 13 nt, Mycobacterium bovis subsp bovis AF2122/97
cuugccggugcgc

SEQ ID NO: 1043085 - RNA, 15 nt, Mycobacterium bovis subsp bovis AF2122/97
cuugccgccggcgcc

SEQ ID NO: 1043086 - RNA, 22 nt, Mycobacterium bovis subsp bovis AF2122/97
cuugccgccggccccgccggcg

SEQ ID NO: 1043087 - RNA, 16 nt, Mycobacterium bovis subsp bovis AF2122/97
cuugccgcccgcuccg

SEQ ID NO: 1043088 - RNA, 17 nt, Mycobacterium bovis subsp bovis AF2122/97
cuugccgauggcggugg

SEQ ID NO: 1043089 - RNA, 13 nt, Mycobacterium bovis subsp bovis AF2122/97
cuugccgauuccg

SEQ ID NO: 1043090 - RNA, 20 nt, Mycobacterium bovis subsp bovis AF2122/97
cuugcggggauuggugccca

SEQ ID NO: 1043091 - RNA, 18 nt, Mycobacterium bovis subsp bovis AF2122/97
cuugcgggcagccgcccg

SEQ ID NO: 1043092 - RNA, 19 nt, Mycobacterium bovis subsp bovis AF2122/97
cuugcgggcagccgcccgc

SEQ ID NO: 1043093 - RNA, 21 nt, Mycobacterium bovis subsp bovis AF2122/97
cuugcggcgugaugucuacca

SEQ ID NO: 1043094 - RNA, 16 nt, Mycobacterium bovis subsp bovis AF2122/97
cuugcgguaggcggug

SEQ ID NO: 1043095 - RNA, 17 nt, Mycobacterium bovis subsp bovis AF2122/97
cuugcgguaggcgguga

SEQ ID NO: 1043096 - RNA, 19 nt, Mycobacterium bovis subsp bovis AF2122/97
cuugcgguccaggccggca

SEQ ID NO: 1043097 - RNA, 18 nt, Mycobacterium bovis subsp bovis AF2122/97
cuuggagaucgccgccgg

SEQ ID NO: 1043098 - RNA, 23 nt, Mycobacterium bovis subsp bovis AF2122/97
cuuggacgugguguaucgacggc

SEQ ID NO: 1043099 - RNA, 23 nt, Mycobacterium bovis subsp bovis AF2122/97
cuuggacucaucggcgugcuugc

SEQ ID NO: 1043100 - RNA, 15 nt, Mycobacterium bovis subsp bovis AF2122/97
cuuggacgacccggg

SEQ ID NO: 1043101 - RNA, 17 nt, Mycobacterium bovis subsp bovis AF2122/97
cuugcgucaucggcuca

SEQ ID NO: 1043102 - RNA, 19 nt, Mycobacterium bovis subsp bovis AF2122/97
cuuggaaagcccgcucgga

SEQ ID NO: 1043103 - RNA, 19 nt, Mycobacterium bovis subsp bovis AF2122/97
cuuggacccugcgccgcca

SEQ ID NO: 1043104 - RNA, 15 nt, Mycobacterium bovis subsp bovis AF2122/97
cuuggaaggcgcgcg

SEQ ID NO: 1043105 - RNA, 19 nt, Mycobacterium bovis subsp bovis AF2122/97
cuuucuuggcgggcgccuu

SEQ ID NO: 1043106 - RNA, 14 nt, Mycobacterium bovis subsp bovis AF2122/97
cuuugcuugccgca

SEQ ID NO: 1043107 - RNA, 15 nt, Mycobacterium bovis subsp bovis AF2122/97
cuuugcucucggucu

SEQ ID NO: 1043108 - RNA, 14 nt, Mycobacterium bovis subsp bovis AF2122/97
cuuugcccgccacg

SEQ ID NO: 1043109 - RNA, 17 nt, Mycobacterium bovis subsp bovis AF2122/97
cuuugccgccggcaccg

SEQ ID NO: 1043110 - RNA, 16 nt, Mycobacterium bovis subsp bovis AF2122/97
cuuugcacagcggcau

SEQ ID NO: 1043111 - RNA, 20 nt, Mycobacterium bovis subsp bovis AF2122/97
cuuugaucgcccgguucagc

SEQ ID NO: 1043112 - RNA, 20 nt, Mycobacterium bovis subsp bovis AF2122/97
cuuugaugccgaugucgaug

SEQ ID NO: 1043113 - RNA, 17 nt, Mycobacterium bovis subsp bovis AF2122/97
cuuugagcgcggccacc

SEQ ID NO: 1043114 - RNA, 18 nt, Mycobacterium bovis subsp bovis AF2122/97
cuuugagcgcggccacca

SEQ ID NO: 1043115 - RNA, 19 nt, Mycobacterium bovis subsp bovis AF2122/97
cuuugacgcccucggcgac

SEQ ID NO: 1043116 - RNA, 11 nt, Mycobacterium bovis subsp bovis AF2122/97
cuuucagcgcu

SEQ ID NO: 1043117 - RNA, 13 nt, Mycobacterium bovis subsp bovis AF2122/97
cuuucagcgcuuc

SEQ ID NO: 1043118 - RNA, 16 nt, Mycobacterium bovis subsp bovis AF2122/97
cuuucgacccgcggcg

SEQ ID NO: 1043119 - RNA, 15 nt, Mycobacterium bovis subsp bovis AF2122/97
cuuuccggccgccug

SEQ ID NO: 1043120 - RNA, 17 nt, Mycobacterium bovis subsp bovis AF2122/97
cuugucagccgcgaccg

SEQ ID NO: 1043121 - RNA, 21 nt, Mycobacterium bovis subsp bovis AF2122/97
cuugucgagcaccucgaaggc

SEQ ID NO: 1043122 - RNA, 16 nt, Mycobacterium bovis subsp bovis AF2122/97
cuuucacaugcgccga

SEQ ID NO: 1043123 - RNA, 21 nt, Mycobacterium bovis subsp bovis AF2122/97
cuuucagaucgaucugcgggc

SEQ ID NO: 1043124 - RNA, 14 nt, Mycobacterium bovis subsp bovis AF2122/97
cuuguagcgcaucg

SEQ ID NO: 1043125 - RNA, 15 nt, Mycobacterium bovis subsp bovis AF2122/97
cuuguccaggaucgc

SEQ ID NO: 1043126 - RNA, 16 nt, Mycobacterium bovis subsp bovis AF2122/97
gaaaccaugccgccga

SEQ ID NO: 1043127 - RNA, 21 nt, Mycobacterium bovis subsp bovis AF2122/97
gaaaccgccccgugggccucg

SEQ ID NO: 1043128 - RNA, 11 nt, Mycobacterium bovis subsp bovis AF2122/97
gaaaccgccgu

SEQ ID NO: 1043129 - RNA, 16 nt, Mycobacterium bovis subsp bovis AF2122/97
gaaacccggccgccga

SEQ ID NO: 1043130 - RNA, 14 nt, Mycobacterium bovis subsp bovis AF2122/97
gaaacccggcgacc

SEQ ID NO: 1043131 - RNA, 22 nt, Mycobacterium bovis subsp bovis AF2122/97
gaaaccgaccuacugcggucgc

SEQ ID NO: 1043132 - RNA, 22 nt, Mycobacterium bovis subsp bovis AF2122/97
gaaacaucucggcgcagccggu

SEQ ID NO: 1043133 - RNA, 14 nt, Mycobacterium bovis subsp bovis AF2122/97
gaaaccaccggccg

SEQ ID NO: 1043134 - RNA, 20 nt, Mycobacterium bovis subsp bovis AF2122/97
gaaaccaccggccgucccgc

SEQ ID NO: 1043135 - RNA, 19 nt, Mycobacterium bovis subsp bovis AF2122/97
gaaaccacuggauggcucg

SEQ ID NO: 1043136 - RNA, 17 nt, Mycobacterium bovis subsp bovis AF2122/97
gaaacccaugcaugcgu

SEQ ID NO: 1043137 - RNA, 18 nt, Mycobacterium bovis subsp bovis AF2122/97
gaaaccaucgccagccgg

SEQ ID NO: 1043138 - RNA, 16 nt, Mycobacterium bovis subsp bovis AF2122/97
gaaaccggccagccga

SEQ ID NO: 1043139 - RNA, 20 nt, Mycobacterium bovis subsp bovis AF2122/97
gaaaccgccgucccggcucg

SEQ ID NO: 1043140 - RNA, 21 nt, Mycobacterium bovis subsp bovis AF2122/97
gaaaccgcugggggcggucgc

SEQ ID NO: 1043141 - RNA, 20 nt, Mycobacterium bovis subsp bovis AF2122/97
gaaaccggaccugaccggug

SEQ ID NO: 1043142 - RNA, 14 nt, Mycobacterium bovis subsp bovis AF2122/97
gaaaccgcagcgcg

SEQ ID NO: 1043143 - RNA, 15 nt, Mycobacterium bovis subsp bovis AF2122/97
gaaaccggucagcac

SEQ ID NO: 1043144 - RNA, 21 nt, Mycobacterium bovis subsp bovis AF2122/97
gaaaacccucgcugcggugga

SEQ ID NO: 1043145 - RNA, 15 nt, Mycobacterium bovis subsp bovis AF2122/97
gaaaagcgccucggu

SEQ ID NO: 1043146 - RNA, 22 nt, Mycobacterium bovis subsp bovis AF2122/97
gaaaauccggggggauccagca

SEQ ID NO: 1043147 - RNA, 21 nt, Mycobacterium bovis subsp bovis AF2122/97
gaaacagguaagcagccagca

SEQ ID NO: 1043148 - RNA, 13 nt, Mycobacterium bovis subsp bovis AF2122/97
gaaaacaccgcac

SEQ ID NO: 1043149 - RNA, 20 nt, Mycobacterium bovis subsp bovis AF2122/97
gaaaaagaccgacagcggca

SEQ ID NO: 1043150 - RNA, 13 nt, Mycobacterium bovis subsp bovis AF2122/97
gaaaaagcccgac

SEQ ID NO: 1043151 - RNA, 13 nt, Mycobacterium bovis subsp bovis AF2122/97
gaaaaagccgcgu

SEQ ID NO: 1043152 - RNA, 15 nt, Mycobacterium bovis subsp bovis AF2122/97
gaaaaaccucgacgc

SEQ ID NO: 1043153 - RNA, 20 nt, Mycobacterium bovis subsp bovis AF2122/97
gaccgcgaucgccgacgcca

SEQ ID NO: 1043154 - RNA, 16 nt, Mycobacterium bovis subsp bovis AF2122/97
gaccgcgaucgccgac

SEQ ID NO: 1043155 - RNA, 15 nt, Mycobacterium bovis subsp bovis AF2122/97
gaccgcgagcagcac

SEQ ID NO: 1043156 - RNA, 19 nt, Mycobacterium bovis subsp bovis AF2122/97
gaccgcgagggccagcaag

SEQ ID NO: 1043157 - RNA, 14 nt, Mycobacterium bovis subsp bovis AF2122/97
gaccgcgccggaca

SEQ ID NO: 1043158 - RNA, 21 nt, Mycobacterium bovis subsp bovis AF2122/97
gaccgcgccaacuccgaucca

SEQ ID NO: 1043159 - RNA, 17 nt, Mycobacterium bovis subsp bovis AF2122/97
gaccgcgcccagaccga

SEQ ID NO: 1043160 - RNA, 23 nt, Mycobacterium bovis subsp bovis AF2122/97
gaccgcgcccagaccgacccgca

SEQ ID NO: 1043161 - RNA, 16 nt, Mycobacterium bovis subsp bovis AF2122/97
gaccgcgccgaucacc

SEQ ID NO: 1043162 - RNA, 18 nt, Mycobacterium bovis subsp bovis AF2122/97
gaccgcgcaacaccucgu

SEQ ID NO: 1043163 - RNA, 15 nt, Mycobacterium bovis subsp bovis AF2122/97
gaccgcggugacccg

SEQ ID NO: 1043164 - RNA, 16 nt, Mycobacterium bovis subsp bovis AF2122/97
gaccgcggugacccgg

SEQ ID NO: 1043165 - RNA, 17 nt, Mycobacterium bovis subsp bovis AF2122/97
gaccgcgccgaucacca

SEQ ID NO: 1043166 - RNA, 21 nt, Mycobacterium bovis subsp bovis AF2122/97
gaccgcguacaggccggccac

SEQ ID NO: 1043167 - RNA, 16 nt, Mycobacterium bovis subsp bovis AF2122/97
gaccgcguagaccagu

SEQ ID NO: 1043168 - RNA, 18 nt, Mycobacterium bovis subsp bovis AF2122/97
gaccgcguagagcagcag

SEQ ID NO: 1043169 - RNA, 14 nt, Mycobacterium bovis subsp bovis AF2122/97
gaccgcgcggcacu

SEQ ID NO: 1043170 - RNA, 15 nt, Mycobacterium bovis subsp bovis AF2122/97
gaccgcgcggcccgc

SEQ ID NO: 1043171 - RNA, 13 nt, Mycobacterium bovis subsp bovis AF2122/97
gaccgcgucggcg

SEQ ID NO: 1043172 - RNA, 19 nt, Mycobacterium bovis subsp bovis AF2122/97
gaccgcguagagcagcaga

SEQ ID NO: 1043173 - RNA, 18 nt, Mycobacterium bovis subsp bovis AF2122/97
gaccgccgcugccgccga

SEQ ID NO: 1043174 - RNA, 13 nt, Mycobacterium bovis subsp bovis AF2122/97
gaccgccgcuggg

SEQ ID NO: 1043175 - RNA, 19 nt, Mycobacterium bovis subsp bovis AF2122/97
gaccgccgcuggguccccu

SEQ ID NO: 1043176 - RNA, 14 nt, Mycobacterium bovis subsp bovis AF2122/97
gaccgccgcgagca

SEQ ID NO: 1043177 - RNA, 16 nt, Mycobacterium bovis subsp bovis AF2122/97
gaccgccgcgagcaga

SEQ ID NO: 1043178 - RNA, 21 nt, Mycobacterium bovis subsp bovis AF2122/97
gaccgccgcuaccccagccgg

SEQ ID NO: 1043179 - RNA, 13 nt, Mycobacterium bovis subsp bovis AF2122/97
gaccgccuccucg

SEQ ID NO: 1043180 - RNA, 13 nt, Mycobacterium bovis subsp bovis AF2122/97
gaccgccucgccg

SEQ ID NO: 1043181 - RNA, 15 nt, Mycobacterium bovis subsp bovis AF2122/97
gaccgcgacaacaac

SEQ ID NO: 1043182 - RNA, 15 nt, Mycobacterium bovis subsp bovis AF2122/97
gaccgcgacccggcc

SEQ ID NO: 1043183 - RNA, 17 nt, Mycobacterium bovis subsp bovis AF2122/97
gaccgcgacccggccca

SEQ ID NO: 1043184 - RNA, 14 nt, Mycobacterium bovis subsp bovis AF2122/97
gaccgcgaccgcau

SEQ ID NO: 1043185 - RNA, 19 nt, Mycobacterium bovis subsp bovis AF2122/97
gaccgcgacggcgccggca

SEQ ID NO: 1043186 - RNA, 23 nt, Mycobacterium bovis subsp bovis AF2122/97
gaccgcgacggcgccggcaucgg

SEQ ID NO: 1043187 - RNA, 14 nt, Mycobacterium bovis subsp bovis AF2122/97
gaccgcgacggcgc

SEQ ID NO: 1043188 - RNA, 19 nt, Mycobacterium bovis subsp bovis AF2122/97
gaccgccugcuggccgcgg

SEQ ID NO: 1043189 - RNA, 23 nt, Mycobacterium bovis subsp bovis AF2122/97
gaccgccuccucgauagcggcgc

SEQ ID NO: 1043190 - RNA, 19 nt, Mycobacterium bovis subsp bovis AF2122/97
gaccgccucgucgaugccu

SEQ ID NO: 1043191 - RNA, 16 nt, Mycobacterium bovis subsp bovis AF2122/97
gaccgcgaacagcggg

SEQ ID NO: 1043192 - RNA, 14 nt, Mycobacterium bovis subsp bovis AF2122/97
gaccgccgacgccg

SEQ ID NO: 1043193 - RNA, 20 nt, Mycobacterium bovis subsp bovis AF2122/97
gaccgcccgugccgucgccc

SEQ ID NO: 1043194 - RNA, 21 nt, Mycobacterium bovis subsp bovis AF2122/97
gaccgcccuagcgagcggcac

SEQ ID NO: 1043195 - RNA, 14 nt, Mycobacterium bovis subsp bovis AF2122/97
gaccgcccgugccg

SEQ ID NO: 1043196 - RNA, 15 nt, Mycobacterium bovis subsp bovis AF2122/97
gaccgcccgugccgu

SEQ ID NO: 1043197 - RNA, 19 nt, Mycobacterium bovis subsp bovis AF2122/97
gaccgcccgagucucgucg

SEQ ID NO: 1043198 - RNA, 16 nt, Mycobacterium bovis subsp bovis AF2122/97
gaccgcccgccagcga

SEQ ID NO: 1043199 - RNA, 17 nt, Mycobacterium bovis subsp bovis AF2122/97
gaccgccgaucggccac

SEQ ID NO: 1043200 - RNA, 21 nt, Mycobacterium bovis subsp bovis AF2122/97
gaccgccgaugcccgacaccg

SEQ ID NO: 1043201 - RNA, 18 nt, Mycobacterium bovis subsp bovis AF2122/97
gaccgccgccggaucgcc

SEQ ID NO: 1043202 - RNA, 15 nt, Mycobacterium bovis subsp bovis AF2122/97
gaccgccagcccggu

SEQ ID NO: 1043203 - RNA, 13 nt, Mycobacterium bovis subsp bovis AF2122/97
gaccgaaccuggu

SEQ ID NO: 1043204 - RNA, 15 nt, Mycobacterium bovis subsp bovis AF2122/97
gaccgccagccgcga

SEQ ID NO: 1043205 - RNA, 19 nt, Mycobacterium bovis subsp bovis AF2122/97
gaccgccagccgcgagccg

SEQ ID NO: 1043206 - RNA, 22 nt, Mycobacterium bovis subsp bovis AF2122/97
gaccgccaccgccagcgucgac

SEQ ID NO: 1043207 - RNA, 12 nt, Mycobacterium bovis subsp bovis AF2122/97
gaccgccaccgu

SEQ ID NO: 1043208 - RNA, 22 nt, Mycobacterium bovis subsp bovis AF2122/97
gaccgccagcggccgcuccacc

SEQ ID NO: 1043209 - RNA, 17 nt, Mycobacterium bovis subsp bovis AF2122/97
gaccgccauuucgcccg

SEQ ID NO: 1043210 - RNA, 17 nt, Mycobacterium bovis subsp bovis AF2122/97
gaccgccaucgccaaca

SEQ ID NO: 1043211 - RNA, 22 nt, Mycobacterium bovis subsp bovis AF2122/97
gacccuuccgccgccgccgggu

SEQ ID NO: 1043212 - RNA, 13 nt, Mycobacterium bovis subsp bovis AF2122/97
gaccgaaagccgc

SEQ ID NO: 1043213 - RNA, 14 nt, Mycobacterium bovis subsp bovis AF2122/97
gaccgaaagccgca

SEQ ID NO: 1043214 - RNA, 19 nt, Mycobacterium bovis subsp bovis AF2122/97
gaccgccaccccugucggg

SEQ ID NO: 1043215 - RNA, 14 nt, Mycobacterium bovis subsp bovis AF2122/97
gaccgccaccgcca

SEQ ID NO: 1043216 - RNA, 20 nt, Mycobacterium bovis subsp bovis AF2122/97
gaccgccaccgccagcgucg

SEQ ID NO: 1043217 - RNA, 21 nt, Mycobacterium bovis subsp bovis AF2122/97
gaccgccaccgccagcgucga

SEQ ID NO: 1043218 - RNA, 15 nt, Mycobacterium bovis subsp bovis AF2122/97
gaccgaaccgucagc

SEQ ID NO: 1043219 - RNA, 14 nt, Mycobacterium bovis subsp bovis AF2122/97
gacccugauggggc

SEQ ID NO: 1043220 - RNA, 18 nt, Mycobacterium bovis subsp bovis AF2122/97
gaccgaaagccgcaccag

SEQ ID NO: 1043221 - RNA, 18 nt, Mycobacterium bovis subsp bovis AF2122/97
gaccgaacagcaccgaac

SEQ ID NO: 1043222 - RNA, 18 nt, Mycobacterium bovis subsp bovis AF2122/97
gacccucgggucgucgcg

SEQ ID NO: 1043223 - RNA, 16 nt, Mycobacterium bovis subsp bovis AF2122/97
gacccugaucgugaac

SEQ ID NO: 1043224 - RNA, 16 nt, Mycobacterium bovis subsp bovis AF2122/97
gacccugaugaucguc

SEQ ID NO: 1043225 - RNA, 21 nt, Mycobacterium bovis subsp bovis AF2122/97
gacccugaugaucguccagcc

SEQ ID NO: 1043226 - RNA, 15 nt, Mycobacterium bovis subsp bovis AF2122/97
gacccgugcacgauc

SEQ ID NO: 1043227 - RNA, 21 nt, Mycobacterium bovis subsp bovis AF2122/97
gacccguuccacgccggcauc

SEQ ID NO: 1043228 - RNA, 22 nt, Mycobacterium bovis subsp bovis AF2122/97
gacccguuccacgccggcaucg

SEQ ID NO: 1043229 - RNA, 19 nt, Mycobacterium bovis subsp bovis AF2122/97
gacccuacuuccucgacga

SEQ ID NO: 1043230 - RNA, 22 nt, Mycobacterium bovis subsp bovis AF2122/97
gacccuacuuccucgacgagca

SEQ ID NO: 1043231 - RNA, 21 nt, Mycobacterium bovis subsp bovis AF2122/97
gacccuagauaugcacccgca

SEQ ID NO: 1043232 - RNA, 21 nt, Mycobacterium bovis subsp bovis AF2122/97
gacccucaagggcaaccgccc

SEQ ID NO: 1043233 - RNA, 23 nt, Mycobacterium bovis subsp bovis AF2122/97
gacccagccagcagcggcgagcc

SEQ ID NO: 1043234 - RNA, 21 nt, Mycobacterium bovis subsp bovis AF2122/97
gacccaucaccagcggcugca

SEQ ID NO: 1043235 - RNA, 13 nt, Mycobacterium bovis subsp bovis AF2122/97
gacccaucgccag

SEQ ID NO: 1043236 - RNA, 16 nt, Mycobacterium bovis subsp bovis AF2122/97
gacccccagcagggug

SEQ ID NO: 1043237 - RNA, 17 nt, Mycobacterium bovis subsp bovis AF2122/97
gacccccagcgcccgcc

SEQ ID NO: 1043238 - RNA, 19 nt, Mycobacterium bovis subsp bovis AF2122/97
gaccccccgaccccgacgg

SEQ ID NO: 1043239 - RNA, 20 nt, Mycobacterium bovis subsp bovis AF2122/97
gacccauucucggccggcgg

SEQ ID NO: 1043240 - RNA, 22 nt, Mycobacterium bovis subsp bovis AF2122/97
gacccauucucggccggcggcg

SEQ ID NO: 1043241 - RNA, 14 nt, Mycobacterium bovis subsp bovis AF2122/97
gaccccgccagccg

SEQ ID NO: 1043242 - RNA, 16 nt, Mycobacterium bovis subsp bovis AF2122/97
gaccccgacgaugcgc

SEQ ID NO: 1043243 - RNA, 13 nt, Mycobacterium bovis subsp bovis AF2122/97
gaccccgacggca

SEQ ID NO: 1043244 - RNA, 17 nt, Mycobacterium bovis subsp bovis AF2122/97
gaccccgacggcaaugc

SEQ ID NO: 1043245 - RNA, 15 nt, Mycobacterium bovis subsp bovis AF2122/97
gacccccugacggca

SEQ ID NO: 1043246 - RNA, 18 nt, Mycobacterium bovis subsp bovis AF2122/97
gaccccgaacauccgccg

SEQ ID NO: 1043247 - RNA, 21 nt, Mycobacterium bovis subsp bovis AF2122/97
gaccccgaacauccgccgccc

SEQ ID NO: 1043248 - RNA, 22 nt, Mycobacterium bovis subsp bovis AF2122/97
gaccccgaagaugaccucggcg

SEQ ID NO: 1043249 - RNA, 12 nt, Mycobacterium bovis subsp bovis AF2122/97
gacccgccgcgg

SEQ ID NO: 1043250 - RNA, 21 nt, Mycobacterium bovis subsp bovis AF2122/97
gacccgccgcggacaccagga

SEQ ID NO: 1043251 - RNA, 19 nt, Mycobacterium bovis subsp bovis AF2122/97
gacccgccggguccgccgg

SEQ ID NO: 1043252 - RNA, 15 nt, Mycobacterium bovis subsp bovis AF2122/97
gacccgccgccccac

SEQ ID NO: 1043253 - RNA, 20 nt, Mycobacterium bovis subsp bovis AF2122/97
gacccgccgcgcccggcgca

SEQ ID NO: 1043254 - RNA, 19 nt, Mycobacterium bovis subsp bovis AF2122/97
gacccccgcaucggcgcca

SEQ ID NO: 1043255 - RNA, 13 nt, Mycobacterium bovis subsp bovis AF2122/97
gaccccgccgcca

SEQ ID NO: 1043256 - RNA, 17 nt, Mycobacterium bovis subsp bovis AF2122/97
gacccgucccccgcacg

SEQ ID NO: 1043257 - RNA, 14 nt, Mycobacterium bovis subsp bovis AF2122/97
gacccgucgaacgc

SEQ ID NO: 1043258 - RNA, 15 nt, Mycobacterium bovis subsp bovis AF2122/97
gacccgucgaacgcg

SEQ ID NO: 1043259 - RNA, 15 nt, Mycobacterium bovis subsp bovis AF2122/97
gacccguacccacga

SEQ ID NO: 1043260 - RNA, 17 nt, Mycobacterium bovis subsp bovis AF2122/97
gacccgggggcgcccgg

SEQ ID NO: 1043261 - RNA, 19 nt, Mycobacterium bovis subsp bovis AF2122/97
gacccgccgacgccgccgg

SEQ ID NO: 1043262 - RNA, 19 nt, Mycobacterium bovis subsp bovis AF2122/97
gacccggugacccgcuggg

SEQ ID NO: 1043263 - RNA, 20 nt, Mycobacterium bovis subsp bovis AF2122/97
gacccggugacccgcugggc

SEQ ID NO: 1043264 - RNA, 21 nt, Mycobacterium bovis subsp bovis AF2122/97
gacccgguccacgccaggagc

SEQ ID NO: 1043265 - RNA, 17 nt, Mycobacterium bovis subsp bovis AF2122/97
gacccgggucggcacga

SEQ ID NO: 1043266 - RNA, 13 nt, Mycobacterium bovis subsp bovis AF2122/97
gacccgcggcggg

SEQ ID NO: 1043267 - RNA, 12 nt, Mycobacterium bovis subsp bovis AF2122/97
gacccgcgguag

SEQ ID NO: 1043268 - RNA, 17 nt, Mycobacterium bovis subsp bovis AF2122/97
gacccgcgcgucgccca

SEQ ID NO: 1043269 - RNA, 15 nt, Mycobacterium bovis subsp bovis AF2122/97
gacccgcugccaccc

SEQ ID NO: 1043270 - RNA, 16 nt, Mycobacterium bovis subsp bovis AF2122/97
gacccagcucgucgac

SEQ ID NO: 1043271 - RNA, 21 nt, Mycobacterium bovis subsp bovis AF2122/97
gacccagccagcagcggcgag

SEQ ID NO: 1043272 - RNA, 19 nt, Mycobacterium bovis subsp bovis AF2122/97
gacccacgauggcaaacgc

SEQ ID NO: 1043273 - RNA, 20 nt, Mycobacterium bovis subsp bovis AF2122/97
gacccacucggggacggcga

SEQ ID NO: 1043274 - RNA, 14 nt, Mycobacterium bovis subsp bovis AF2122/97
gacccacccgcacc

SEQ ID NO: 1043275 - RNA, 15 nt, Mycobacterium bovis subsp bovis AF2122/97
gacccacccgcaccg

SEQ ID NO: 1043276 - RNA, 19 nt, Mycobacterium bovis subsp bovis AF2122/97
gacccacccgcaccgccgg

SEQ ID NO: 1043277 - RNA, 17 nt, Mycobacterium bovis subsp bovis AF2122/97
gacccacauuccguagc

SEQ ID NO: 1043278 - RNA, 20 nt, Mycobacterium bovis subsp bovis AF2122/97
gacccacccgcaccgccggc

SEQ ID NO: 1043279 - RNA, 23 nt, Mycobacterium bovis subsp bovis AF2122/97
gacccacccgcaccgccggcaau

SEQ ID NO: 1043280 - RNA, 20 nt, Mycobacterium bovis subsp bovis AF2122/97
gacccaccgccccggcggcg

SEQ ID NO: 1043281 - RNA, 14 nt, Mycobacterium bovis subsp bovis AF2122/97
gacccaccgucacc

SEQ ID NO: 1043282 - RNA, 17 nt, Mycobacterium bovis subsp bovis AF2122/97
gacccaccgucaccccc

SEQ ID NO: 1043283 - RNA, 20 nt, Mycobacterium bovis subsp bovis AF2122/97
gacccaccgucacccccgau

SEQ ID NO: 1043284 - RNA, 18 nt, Mycobacterium bovis subsp bovis AF2122/97
gacccacgagagcgcugu

SEQ ID NO: 1043285 - RNA, 20 nt, Mycobacterium bovis subsp bovis AF2122/97
gacccaauguggucacccgc

SEQ ID NO: 1043286 - RNA, 22 nt, Mycobacterium bovis subsp bovis AF2122/97
gacccaauguggucacccgcag

SEQ ID NO: 1043287 - RNA, 19 nt, Mycobacterium bovis subsp bovis AF2122/97
gacccacaucaggucggcg

SEQ ID NO: 1043288 - RNA, 20 nt, Mycobacterium bovis subsp bovis AF2122/97
gacccacaucaggucggcga

SEQ ID NO: 1043289 - RNA, 14 nt, Mycobacterium bovis subsp bovis AF2122/97
gacccaacgaccac

SEQ ID NO: 1043290 - RNA, 15 nt, Mycobacterium bovis subsp bovis AF2122/97
gacccaacgaccacc

SEQ ID NO: 1043291 - RNA, 16 nt, Mycobacterium bovis subsp bovis AF2122/97
gacccaacgaccacca

SEQ ID NO: 1043292 - RNA, 19 nt, Mycobacterium bovis subsp bovis AF2122/97
gacccaacgaccaccacca

SEQ ID NO: 1043293 - RNA, 21 nt, Mycobacterium bovis subsp bovis AF2122/97
gaccaccgccgaagcugcggg

SEQ ID NO: 1043294 - RNA, 12 nt, Mycobacterium bovis subsp bovis AF2122/97
gaccaccgccgg

SEQ ID NO: 1043295 - RNA, 20 nt, Mycobacterium bovis subsp bovis AF2122/97
gaccaccgcgucgggccgca

SEQ ID NO: 1043296 - RNA, 18 nt, Mycobacterium bovis subsp bovis AF2122/97
gaccaccgauauggccgg

SEQ ID NO: 1043297 - RNA, 21 nt, Mycobacterium bovis subsp bovis AF2122/97
gaccacccgguccugcucgca

SEQ ID NO: 1043298 - RNA, 23 nt, Mycobacterium bovis subsp bovis AF2122/97
gaccaccgcgaaagcaccgagca

SEQ ID NO: 1043299 - RNA, 14 nt, Mycobacterium bovis subsp bovis AF2122/97
gaccaccccggcca

SEQ ID NO: 1043300 - RNA, 16 nt, Mycobacterium bovis subsp bovis AF2122/97
gaccacccggcgcgaa

SEQ ID NO: 1043301 - RNA, 22 nt, Mycobacterium bovis subsp bovis AF2122/97
gaccaccagcgcuccagcaccc

SEQ ID NO: 1043302 - RNA, 20 nt, Mycobacterium bovis subsp bovis AF2122/97
gaccaaugucagugccccgc

SEQ ID NO: 1043303 - RNA, 21 nt, Mycobacterium bovis subsp bovis AF2122/97
gaccaaugucagugccccgcc

SEQ ID NO: 1043304 - RNA, 16 nt, Mycobacterium bovis subsp bovis AF2122/97
gaccaauucgaccgcg

SEQ ID NO: 1043305 - RNA, 18 nt, Mycobacterium bovis subsp bovis AF2122/97
gacgacgggcgccaacgg

SEQ ID NO: 1043306 - RNA, 14 nt, Mycobacterium bovis subsp bovis AF2122/97
gacgacgccgacga

SEQ ID NO: 1043307 - RNA, 15 nt, Mycobacterium bovis subsp bovis AF2122/97
gacgacgccgacgau

SEQ ID NO: 1043308 - RNA, 13 nt, Mycobacterium bovis subsp bovis AF2122/97
gacgaacgcgccg

SEQ ID NO: 1043309 - RNA, 19 nt, Mycobacterium bovis subsp bovis AF2122/97
gacgacgccaaugccgcgg

SEQ ID NO: 1043310 - RNA, 14 nt, Mycobacterium bovis subsp bovis AF2122/97
gacgaccgugcugg

SEQ ID NO: 1043311 - RNA, 23 nt, Mycobacterium bovis subsp bovis AF2122/97
gacgaccgugcugggcgccgcgc

SEQ ID NO: 1043312 - RNA, 12 nt, Mycobacterium bovis subsp bovis AF2122/97
gacgacgaccgg

SEQ ID NO: 1043313 - RNA, 13 nt, Mycobacterium bovis subsp bovis AF2122/97
gacgacgaccggc

SEQ ID NO: 1043314 - RNA, 19 nt, Mycobacterium bovis subsp bovis AF2122/97
gacgacgagggccagcagc

SEQ ID NO: 1043315 - RNA, 18 nt, Mycobacterium bovis subsp bovis AF2122/97
gacgagauacggccacca

SEQ ID NO: 1043316 - RNA, 19 nt, Mycobacterium bovis subsp bovis AF2122/97
gacgagauacggccaccag

SEQ ID NO: 1043317 - RNA, 17 nt, Mycobacterium bovis subsp bovis AF2122/97
gacgagaucagccucgc

SEQ ID NO: 1043318 - RNA, 17 nt, Mycobacterium bovis subsp bovis AF2122/97
gacgagcacaugcucga

SEQ ID NO: 1043319 - RNA, 19 nt, Mycobacterium bovis subsp bovis AF2122/97
gacgagcaccgcgccgcgc

SEQ ID NO: 1043320 - RNA, 19 nt, Mycobacterium bovis subsp bovis AF2122/97
gacgagcaucuucgcgcag

SEQ ID NO: 1043321 - RNA, 12 nt, Mycobacterium bovis subsp bovis AF2122/97
gacgagccacca

SEQ ID NO: 1043322 - RNA, 15 nt, Mycobacterium bovis subsp bovis AF2122/97
gacgagccaccaccg

SEQ ID NO: 1043323 - RNA, 21 nt, Mycobacterium bovis subsp bovis AF2122/97
gacgagccaccaccgccgacc

SEQ ID NO: 1043324 - RNA, 23 nt, Mycobacterium bovis subsp bovis AF2122/97
gacgagauugccgggccgccgag

SEQ ID NO: 1043325 - RNA, 18 nt, Mycobacterium bovis subsp bovis AF2122/97
gacgagcaacgccacccg

SEQ ID NO: 1043326 - RNA, 13 nt, Mycobacterium bovis subsp bovis AF2122/97
gacgagccgcggu

SEQ ID NO: 1043327 - RNA, 19 nt, Mycobacterium bovis subsp bovis AF2122/97
gacgagccgcggucggcgu

SEQ ID NO: 1043328 - RNA, 16 nt, Mycobacterium bovis subsp bovis AF2122/97
gacgacgucgcgcauc

SEQ ID NO: 1043329 - RNA, 17 nt, Mycobacterium bovis subsp bovis AF2122/97
gacgacgucgccgccgc

SEQ ID NO: 1043330 - RNA, 13 nt, Mycobacterium bovis subsp bovis AF2122/97
gacgacgucgcgc

SEQ ID NO: 1043331 - RNA, 17 nt, Mycobacterium bovis subsp bovis AF2122/97
gacgacuccggcaagca

SEQ ID NO: 1043332 - RNA, 16 nt, Mycobacterium bovis subsp bovis AF2122/97
gacgagaagacaccgc

SEQ ID NO: 1043333 - RNA, 17 nt, Mycobacterium bovis subsp bovis AF2122/97
gacgagaagacaccgcg

SEQ ID NO: 1043334 - RNA, 18 nt, Mycobacterium bovis subsp bovis AF2122/97
gacgacugggcgcccaag

SEQ ID NO: 1043335 - RNA, 22 nt, Mycobacterium bovis subsp bovis AF2122/97
gaccugcccgucccgcucgagc

SEQ ID NO: 1043336 - RNA, 16 nt, Mycobacterium bovis subsp bovis AF2122/97
gaccuggguggcgucg

SEQ ID NO: 1043337 - RNA, 21 nt, Mycobacterium bovis subsp bovis AF2122/97
gaccugguuauucgacucggc

SEQ ID NO: 1043338 - RNA, 18 nt, Mycobacterium bovis subsp bovis AF2122/97
gaccugguucccgacguc

SEQ ID NO: 1043339 - RNA, 16 nt, Mycobacterium bovis subsp bovis AF2122/97
gaccuggucgcuggug

SEQ ID NO: 1043340 - RNA, 23 nt, Mycobacterium bovis subsp bovis AF2122/97
gaccuguagaucagcagcggcga

SEQ ID NO: 1043341 - RNA, 14 nt, Mycobacterium bovis subsp bovis AF2122/97
gacgaacgcgccgg

SEQ ID NO: 1043342 - RNA, 21 nt, Mycobacterium bovis subsp bovis AF2122/97
gacgaacgccgucgacgcggc

SEQ ID NO: 1043343 - RNA, 22 nt, Mycobacterium bovis subsp bovis AF2122/97
gacgaacgccucaccgacgucg

SEQ ID NO: 1043344 - RNA, 18 nt, Mycobacterium bovis subsp bovis AF2122/97
gacgaacccgacaauggc

SEQ ID NO: 1043345 - RNA, 20 nt, Mycobacterium bovis subsp bovis AF2122/97
gacgaaccggaucaucgccg

SEQ ID NO: 1043346 - RNA, 16 nt, Mycobacterium bovis subsp bovis AF2122/97
gaccuucaccuggaag

SEQ ID NO: 1043347 - RNA, 18 nt, Mycobacterium bovis subsp bovis AF2122/97
gacgaccggcuaccggcg

SEQ ID NO: 1043348 - RNA, 15 nt, Mycobacterium bovis subsp bovis AF2122/97
gacgaccgucggcuc

SEQ ID NO: 1043349 - RNA, 16 nt, Mycobacterium bovis subsp bovis AF2122/97
gacgaccgcgcggcac

SEQ ID NO: 1043350 - RNA, 18 nt, Mycobacterium bovis subsp bovis AF2122/97
gacgacccgggucggcac

SEQ ID NO: 1043351 - RNA, 20 nt, Mycobacterium bovis subsp bovis AF2122/97
gacgacccgguuguguuggg

SEQ ID NO: 1043352 - RNA, 17 nt, Mycobacterium bovis subsp bovis AF2122/97
gacgaccgcgcggcacu

SEQ ID NO: 1043353 - RNA, 17 nt, Mycobacterium bovis subsp bovis AF2122/97
gacgacccgggucggca

SEQ ID NO: 1043354 - RNA, 15 nt, Mycobacterium bovis subsp bovis AF2122/97
gacgaccagccccgc

SEQ ID NO: 1043355 - RNA, 20 nt, Mycobacterium bovis subsp bovis AF2122/97
gacgaccgcauugaacagcg

SEQ ID NO: 1043356 - RNA, 19 nt, Mycobacterium bovis subsp bovis AF2122/97
gacgaccaugccgaucggc

SEQ ID NO: 1043357 - RNA, 17 nt, Mycobacterium bovis subsp bovis AF2122/97
gacgacauugggcgcgg

SEQ ID NO: 1043358 - RNA, 21 nt, Mycobacterium bovis subsp bovis AF2122/97
gacgaagaucuucaccggccg

SEQ ID NO: 1043359 - RNA, 22 nt, Mycobacterium bovis subsp bovis AF2122/97
gacgaagaucuucaccggccgg

SEQ ID NO: 1043360 - RNA, 15 nt, Mycobacterium bovis subsp bovis AF2122/97
gacgaacgcugucgu

SEQ ID NO: 1043361 - RNA, 20 nt, Mycobacterium bovis subsp bovis AF2122/97
gacgaacuagguucagcgac

SEQ ID NO: 1043362 - RNA, 23 nt, Mycobacterium bovis subsp bovis AF2122/97
gacgaacugcugaugaaacgccg

SEQ ID NO: 1043363 - RNA, 15 nt, Mycobacterium bovis subsp bovis AF2122/97
gacgaacucgccguc

SEQ ID NO: 1043364 - RNA, 14 nt, Mycobacterium bovis subsp bovis AF2122/97
gaccggcaggccgg

SEQ ID NO: 1043365 - RNA, 20 nt, Mycobacterium bovis subsp bovis AF2122/97
gaccggcaggccggcgucga

SEQ ID NO: 1043366 - RNA, 22 nt, Mycobacterium bovis subsp bovis AF2122/97
gaccggcaggccggcgucgauc

SEQ ID NO: 1043367 - RNA, 19 nt, Mycobacterium bovis subsp bovis AF2122/97
gaccggccaacgccgccgc

SEQ ID NO: 1043368 - RNA, 16 nt, Mycobacterium bovis subsp bovis AF2122/97
gaccggccacgaccuc

SEQ ID NO: 1043369 - RNA, 15 nt, Mycobacterium bovis subsp bovis AF2122/97
gaccguccaccgacg

SEQ ID NO: 1043370 - RNA, 16 nt, Mycobacterium bovis subsp bovis AF2122/97
gaccguccaccgacgu

SEQ ID NO: 1043371 - RNA, 12 nt, Mycobacterium bovis subsp bovis AF2122/97
gaccgucagccc

SEQ ID NO: 1043372 - RNA, 15 nt, Mycobacterium bovis subsp bovis AF2122/97
gaccguugccgucgg

SEQ ID NO: 1043373 - RNA, 17 nt, Mycobacterium bovis subsp bovis AF2122/97
gaccguugccgucggug

SEQ ID NO: 1043374 - RNA, 17 nt, Mycobacterium bovis subsp bovis AF2122/97
gaccgucugcgacccgg

SEQ ID NO: 1043375 - RNA, 14 nt, Mycobacterium bovis subsp bovis AF2122/97
gaccgucgucaccg

SEQ ID NO: 1043376 - RNA, 17 nt, Mycobacterium bovis subsp bovis AF2122/97
gaccgucgucgugcagg

SEQ ID NO: 1043377 - RNA, 18 nt, Mycobacterium bovis subsp bovis AF2122/97
gaccgucgcgcugccggc

SEQ ID NO: 1043378 - RNA, 20 nt, Mycobacterium bovis subsp bovis AF2122/97
gaccgucgauccgucggcgg

SEQ ID NO: 1043379 - RNA, 22 nt, Mycobacterium bovis subsp bovis AF2122/97
gaccgucgauuucgacgaccac

SEQ ID NO: 1043380 - RNA, 13 nt, Mycobacterium bovis subsp bovis AF2122/97
gaccguccgacgg

SEQ ID NO: 1043381 - RNA, 13 nt, Mycobacterium bovis subsp bovis AF2122/97
gaccgucgcaccc

SEQ ID NO: 1043382 - RNA, 16 nt, Mycobacterium bovis subsp bovis AF2122/97
gaccgucccagcgccg

SEQ ID NO: 1043383 - RNA, 16 nt, Mycobacterium bovis subsp bovis AF2122/97
gaccgcgucggcggcc

SEQ ID NO: 1043384 - RNA, 18 nt, Mycobacterium bovis subsp bovis AF2122/97
gaccgcgugagcagacgc

SEQ ID NO: 1043385 - RNA, 22 nt, Mycobacterium bovis subsp bovis AF2122/97
gaccgcgugcucgagcaccucg

SEQ ID NO: 1043386 - RNA, 19 nt, Mycobacterium bovis subsp bovis AF2122/97
gaccgcguggucggcgaac

SEQ ID NO: 1043387 - RNA, 19 nt, Mycobacterium bovis subsp bovis AF2122/97
gaccgcguuguccgcggcc

SEQ ID NO: 1043388 - RNA, 23 nt, Mycobacterium bovis subsp bovis AF2122/97
gaccgcguuguccgcggccaacg

SEQ ID NO: 1043389 - RNA, 22 nt, Mycobacterium bovis subsp bovis AF2122/97
gaccgcguuuugcaggcccgag

SEQ ID NO: 1043390 - RNA, 15 nt, Mycobacterium bovis subsp bovis AF2122/97
gaccgcugccugccg

SEQ ID NO: 1043391 - RNA, 17 nt, Mycobacterium bovis subsp bovis AF2122/97
gaccgcugccugccgcg

SEQ ID NO: 1043392 - RNA, 19 nt, Mycobacterium bovis subsp bovis AF2122/97
gaccgcuucgacgucguug

SEQ ID NO: 1043393 - RNA, 21 nt, Mycobacterium bovis subsp bovis AF2122/97
gaccgcuaccagcugggcgac

SEQ ID NO: 1043394 - RNA, 18 nt, Mycobacterium bovis subsp bovis AF2122/97
gaccgcucgucgccggug

SEQ ID NO: 1043395 - RNA, 21 nt, Mycobacterium bovis subsp bovis AF2122/97
gaccgcucgucgccgguggca

SEQ ID NO: 1043396 - RNA, 21 nt, Mycobacterium bovis subsp bovis AF2122/97
gaccgcucugcggccacgccg

SEQ ID NO: 1043397 - RNA, 19 nt, Mycobacterium bovis subsp bovis AF2122/97
gaccggaucugacggcgcc

SEQ ID NO: 1043398 - RNA, 17 nt, Mycobacterium bovis subsp bovis AF2122/97
gaccggaucugacggcg

SEQ ID NO: 1043399 - RNA, 23 nt, Mycobacterium bovis subsp bovis AF2122/97
gaccggcaauuuucugcugcuga

SEQ ID NO: 1043400 - RNA, 18 nt, Mycobacterium bovis subsp bovis AF2122/97
gaccggaguucagugcgc

SEQ ID NO: 1043401 - RNA, 19 nt, Mycobacterium bovis subsp bovis AF2122/97
gaccggaacuguggugccu

SEQ ID NO: 1043402 - RNA, 14 nt, Mycobacterium bovis subsp bovis AF2122/97
gaccgcuugcccgc

SEQ ID NO: 1043403 - RNA, 22 nt, Mycobacterium bovis subsp bovis AF2122/97
gaccgcugagguauugggcgcg

SEQ ID NO: 1043404 - RNA, 14 nt, Mycobacterium bovis subsp bovis AF2122/97
gaccggaaaccaca

SEQ ID NO: 1043405 - RNA, 21 nt, Mycobacterium bovis subsp bovis AF2122/97
gaccggaaaugucuccuccgg

SEQ ID NO: 1043406 - RNA, 17 nt, Mycobacterium bovis subsp bovis AF2122/97
gaccucgccgcgcguga

SEQ ID NO: 1043407 - RNA, 17 nt, Mycobacterium bovis subsp bovis AF2122/97
gaccucgccgcggcgga

SEQ ID NO: 1043408 - RNA, 13 nt, Mycobacterium bovis subsp bovis AF2122/97
gaccucgccggug

SEQ ID NO: 1043409 - RNA, 16 nt, Mycobacterium bovis subsp bovis AF2122/97
gaccucgccgcgcgug

SEQ ID NO: 1043410 - RNA, 21 nt, Mycobacterium bovis subsp bovis AF2122/97
gaccugauccggccgguuggc

SEQ ID NO: 1043411 - RNA, 24 nt, Mycobacterium bovis subsp bovis AF2122/97
gaccugaucgaguuccgcaucggc

SEQ ID NO: 1043412 - RNA, 15 nt, Mycobacterium bovis subsp bovis AF2122/97
gaccuccucgcccau

SEQ ID NO: 1043413 - RNA, 11 nt, Mycobacterium bovis subsp bovis AF2122/97
gaccugcagcg

SEQ ID NO: 1043414 - RNA, 21 nt, Mycobacterium bovis subsp bovis AF2122/97
gaccugcagcgcauccgguuu

SEQ ID NO: 1043415 - RNA, 14 nt, Mycobacterium bovis subsp bovis AF2122/97
gaccugccggaccg

SEQ ID NO: 1043416 - RNA, 16 nt, Mycobacterium bovis subsp bovis AF2122/97
gaccugccggaccgcg

SEQ ID NO: 1043417 - RNA, 14 nt, Mycobacterium bovis subsp bovis AF2122/97
gaccugcgccggug

SEQ ID NO: 1043418 - RNA, 16 nt, Mycobacterium bovis subsp bovis AF2122/97
gaccugcgggaucgcc

SEQ ID NO: 1043419 - RNA, 20 nt, Mycobacterium bovis subsp bovis AF2122/97
gaccucgagcuugccgucgc

SEQ ID NO: 1043420 - RNA, 11 nt, Mycobacterium bovis subsp bovis AF2122/97
gaccucgacgu

SEQ ID NO: 1043421 - RNA, 16 nt, Mycobacterium bovis subsp bovis AF2122/97
gaccucgacguugggc

SEQ ID NO: 1043422 - RNA, 23 nt, Mycobacterium bovis subsp bovis AF2122/97
gaccucgagcuugccgucgcuga

SEQ ID NO: 1043423 - RNA, 15 nt, Mycobacterium bovis subsp bovis AF2122/97
gaccucgacgcccca

SEQ ID NO: 1043424 - RNA, 16 nt, Mycobacterium bovis subsp bovis AF2122/97
gaccucgaagcccagc

SEQ ID NO: 1043425 - RNA, 23 nt, Mycobacterium bovis subsp bovis AF2122/97
gaccuccggauaacccagcggcg

SEQ ID NO: 1043426 - RNA, 16 nt, Mycobacterium bovis subsp bovis AF2122/97
gaccucauguccgccg

SEQ ID NO: 1043427 - RNA, 17 nt, Mycobacterium bovis subsp bovis AF2122/97
gaccuccagugcggccu

SEQ ID NO: 1043428 - RNA, 16 nt, Mycobacterium bovis subsp bovis AF2122/97
gaccuagcaccgcgcc

SEQ ID NO: 1043429 - RNA, 18 nt, Mycobacterium bovis subsp bovis AF2122/97
gaccuagcaccgcgccga

SEQ ID NO: 1043430 - RNA, 21 nt, Mycobacterium bovis subsp bovis AF2122/97
gaccuagcagggugccggcgc

SEQ ID NO: 1043431 - RNA, 19 nt, Mycobacterium bovis subsp bovis AF2122/97
gaccuauuggucgcucgcg

SEQ ID NO: 1043432 - RNA, 21 nt, Mycobacterium bovis subsp bovis AF2122/97
gaccuaccgucgaccacuagc

SEQ ID NO: 1043433 - RNA, 23 nt, Mycobacterium bovis subsp bovis AF2122/97
gaccuauuggucgcucgcgguca

SEQ ID NO: 1043434 - RNA, 23 nt, Mycobacterium bovis subsp bovis AF2122/97
gaccucaauguuuguguucgccg

SEQ ID NO: 1043435 - RNA, 21 nt, Mycobacterium bovis subsp bovis AF2122/97
gaccucaauuggcucggcguc

SEQ ID NO: 1043436 - RNA, 15 nt, Mycobacterium bovis subsp bovis AF2122/97
gacgaucgcggcggg

SEQ ID NO: 1043437 - RNA, 19 nt, Mycobacterium bovis subsp bovis AF2122/97
gacgaucgcggcgggcccg

SEQ ID NO: 1043438 - RNA, 19 nt, Mycobacterium bovis subsp bovis AF2122/97
gacgaucgcgucgggcucg

SEQ ID NO: 1043439 - RNA, 23 nt, Mycobacterium bovis subsp bovis AF2122/97
gacgaucgcgucgggcucggcga

SEQ ID NO: 1043440 - RNA, 22 nt, Mycobacterium bovis subsp bovis AF2122/97
gacgaucauugcacccaccccg

SEQ ID NO: 1043441 - RNA, 15 nt, Mycobacterium bovis subsp bovis AF2122/97
gacgauccggucggc

SEQ ID NO: 1043442 - RNA, 12 nt, Mycobacterium bovis subsp bovis AF2122/97
gacgaucgacgc

SEQ ID NO: 1043443 - RNA, 15 nt, Mycobacterium bovis subsp bovis AF2122/97
gacgauccacggcga

SEQ ID NO: 1043444 - RNA, 22 nt, Mycobacterium bovis subsp bovis AF2122/97
gacgaucaguccgauugguguc

SEQ ID NO: 1043445 - RNA, 19 nt, Mycobacterium bovis subsp bovis AF2122/97
gacgaucauauggccgccg

SEQ ID NO: 1043446 - RNA, 20 nt, Mycobacterium bovis subsp bovis AF2122/97
gacgaucauauggccgccga

SEQ ID NO: 1043447 - RNA, 18 nt, Mycobacterium bovis subsp bovis AF2122/97
gacgaucaggccgucgcc

SEQ ID NO: 1043448 - RNA, 23 nt, Mycobacterium bovis subsp bovis AF2122/97
gacgaucaggccgucgccggagu

SEQ ID NO: 1043449 - RNA, 22 nt, Mycobacterium bovis subsp bovis AF2122/97
gacgaucagggugucgaagagc

SEQ ID NO: 1043450 - RNA, 18 nt, Mycobacterium bovis subsp bovis AF2122/97
gacgaucaggucgccgag

SEQ ID NO: 1043451 - RNA, 20 nt, Mycobacterium bovis subsp bovis AF2122/97
gacgaucaggucgccgagac

SEQ ID NO: 1043452 - RNA, 15 nt, Mycobacterium bovis subsp bovis AF2122/97
gacgaucggcggcgc

SEQ ID NO: 1043453 - RNA, 21 nt, Mycobacterium bovis subsp bovis AF2122/97
gacgaucggcggcgcgccgau

SEQ ID NO: 1043454 - RNA, 18 nt, Mycobacterium bovis subsp bovis AF2122/97
gacgaucguagccguagc

SEQ ID NO: 1043455 - RNA, 16 nt, Mycobacterium bovis subsp bovis AF2122/97
gacgaucuccgccaac

SEQ ID NO: 1043456 - RNA, 17 nt, Mycobacterium bovis subsp bovis AF2122/97
gacgaucucgccgccag

SEQ ID NO: 1043457 - RNA, 18 nt, Mycobacterium bovis subsp bovis AF2122/97
gacgaucucgccgccagc

SEQ ID NO: 1043458 - RNA, 18 nt, Mycobacterium bovis subsp bovis AF2122/97
gacgaucucgccggcgaa

SEQ ID NO: 1043459 - RNA, 20 nt, Mycobacterium bovis subsp bovis AF2122/97
gacgauccagcccaacucgg

SEQ ID NO: 1043460 - RNA, 20 nt, Mycobacterium bovis subsp bovis AF2122/97
gacgaucucgccggcgaaga

SEQ ID NO: 1043461 - RNA, 17 nt, Mycobacterium bovis subsp bovis AF2122/97
gacgaucuggcagccga

SEQ ID NO: 1043462 - RNA, 14 nt, Mycobacterium bovis subsp bovis AF2122/97
gacgaucucggcgg

SEQ ID NO: 1043463 - RNA, 14 nt, Mycobacterium bovis subsp bovis AF2122/97
gacgaucagcgagu

SEQ ID NO: 1043464 - RNA, 21 nt, Mycobacterium bovis subsp bovis AF2122/97
gacgaucaacggaacaucguc

SEQ ID NO: 1043465 - RNA, 18 nt, Mycobacterium bovis subsp bovis AF2122/97
gacgaucaagcuggcccg

SEQ ID NO: 1043466 - RNA, 13 nt, Mycobacterium bovis subsp bovis AF2122/97
gacgaucaccccg

SEQ ID NO: 1043467 - RNA, 16 nt, Mycobacterium bovis subsp bovis AF2122/97
gacgaguucgcugacc

SEQ ID NO: 1043468 - RNA, 18 nt, Mycobacterium bovis subsp bovis AF2122/97
gacgauagcggcccgauc

SEQ ID NO: 1043469 - RNA, 17 nt, Mycobacterium bovis subsp bovis AF2122/97
gacgaggggcgcgggug

SEQ ID NO: 1043470 - RNA, 23 nt, Mycobacterium bovis subsp bovis AF2122/97
gacgagcgccucaagcucgccgg

SEQ ID NO: 1043471 - RNA, 15 nt, Mycobacterium bovis subsp bovis AF2122/97
gacgaggaugucgau

SEQ ID NO: 1043472 - RNA, 19 nt, Mycobacterium bovis subsp bovis AF2122/97
gacgaggaugucgaugacc

SEQ ID NO: 1043473 - RNA, 20 nt, Mycobacterium bovis subsp bovis AF2122/97
gacgaggcaaugcgagcacc

SEQ ID NO: 1043474 - RNA, 16 nt, Mycobacterium bovis subsp bovis AF2122/97
gacgagucgccgcggg

SEQ ID NO: 1043475 - RNA, 23 nt, Mycobacterium bovis subsp bovis AF2122/97
gacgagucgccgcgggcagcgaa

SEQ ID NO: 1043476 - RNA, 17 nt, Mycobacterium bovis subsp bovis AF2122/97
gacgaggucagcgguug

SEQ ID NO: 1043477 - RNA, 21 nt, Mycobacterium bovis subsp bovis AF2122/97
gacgagugguccggcggccgg

SEQ ID NO: 1043478 - RNA, 16 nt, Mycobacterium bovis subsp bovis AF2122/97
gacgaggccacgggga

SEQ ID NO: 1043479 - RNA, 16 nt, Mycobacterium bovis subsp bovis AF2122/97
gacgagggccagcagc

SEQ ID NO: 1043480 - RNA, 21 nt, Mycobacterium bovis subsp bovis AF2122/97
gacgaugacagacaucgcgac

SEQ ID NO: 1043481 - RNA, 16 nt, Mycobacterium bovis subsp bovis AF2122/97
gacgaugaaccgggca

SEQ ID NO: 1043482 - RNA, 15 nt, Mycobacterium bovis subsp bovis AF2122/97
gacgauggcgucggc

SEQ ID NO: 1043483 - RNA, 22 nt, Mycobacterium bovis subsp bovis AF2122/97
gacgaugguguacugcugcuug

SEQ ID NO: 1043484 - RNA, 14 nt, Mycobacterium bovis subsp bovis AF2122/97
gacgauguccugga

SEQ ID NO: 1043485 - RNA, 23 nt, Mycobacterium bovis subsp bovis AF2122/97
gacgauucccgcggacagcccgg

SEQ ID NO: 1043486 - RNA, 15 nt, Mycobacterium bovis subsp bovis AF2122/97
gacgauucggcggcc

SEQ ID NO: 1043487 - RNA, 15 nt, Mycobacterium bovis subsp bovis AF2122/97
gacgauucucgaguc

SEQ ID NO: 1043488 - RNA, 16 nt, Mycobacterium bovis subsp bovis AF2122/97
gacgcacugccccgca

SEQ ID NO: 1043489 - RNA, 18 nt, Mycobacterium bovis subsp bovis AF2122/97
gacgcagaagcccccaaa

SEQ ID NO: 1043490 - RNA, 15 nt, Mycobacterium bovis subsp bovis AF2122/97
gacgcagaaucgcac

SEQ ID NO: 1043491 - RNA, 19 nt, Mycobacterium bovis subsp bovis AF2122/97
gacgcagaaucgcacgcgg

SEQ ID NO: 1043492 - RNA, 15 nt, Mycobacterium bovis subsp bovis AF2122/97
gacgcagaaucgcau

SEQ ID NO: 1043493 - RNA, 14 nt, Mycobacterium bovis subsp bovis AF2122/97
gacgcacgauccgc

SEQ ID NO: 1043494 - RNA, 15 nt, Mycobacterium bovis subsp bovis AF2122/97
gacgcacggccaccg

SEQ ID NO: 1043495 - RNA, 16 nt, Mycobacterium bovis subsp bovis AF2122/97
gacgcacggccaccgc

SEQ ID NO: 1043496 - RNA, 17 nt, Mycobacterium bovis subsp bovis AF2122/97
gacgcacggccaccgcg

SEQ ID NO: 1043497 - RNA, 16 nt, Mycobacterium bovis subsp bovis AF2122/97
gacgcagagucaacag

SEQ ID NO: 1043498 - RNA, 15 nt, Mycobacterium bovis subsp bovis AF2122/97
gacgccaacgccagc

SEQ ID NO: 1043499 - RNA, 19 nt, Mycobacterium bovis subsp bovis AF2122/97
gacgcaaaagcuccuaaau

SEQ ID NO: 1043500 - RNA, 16 nt, Mycobacterium bovis subsp bovis AF2122/97
gacgcaaaaucgccca

SEQ ID NO: 1043501 - RNA, 20 nt, Mycobacterium bovis subsp bovis AF2122/97
gacgcaaaaucgcccaauuu

SEQ ID NO: 1043502 - RNA, 19 nt, Mycobacterium bovis subsp bovis AF2122/97
gacgcaaaaucgcccauuu

SEQ ID NO: 1043503 - RNA, 16 nt, Mycobacterium bovis subsp bovis AF2122/97
gacgcaaaaucgcccg

SEQ ID NO: 1043504 - RNA, 20 nt, Mycobacterium bovis subsp bovis AF2122/97
gacgcaaaagcccccuaaac

SEQ ID NO: 1043505 - RNA, 14 nt, Mycobacterium bovis subsp bovis AF2122/97
gacgauuaccagcg

SEQ ID NO: 1043506 - RNA, 16 nt, Mycobacterium bovis subsp bovis AF2122/97
gacgcaccuaugguca

SEQ ID NO: 1043507 - RNA, 13 nt, Mycobacterium bovis subsp bovis AF2122/97
gacgcacagcagc

SEQ ID NO: 1043508 - RNA, 14 nt, Mycobacterium bovis subsp bovis AF2122/97
gacgcacagcagca

SEQ ID NO: 1043509 - RNA, 20 nt, Mycobacterium bovis subsp bovis AF2122/97
gacgcacagcagcaccgcga

SEQ ID NO: 1043510 - RNA, 14 nt, Mycobacterium bovis subsp bovis AF2122/97
gacgcaaagcagcg

SEQ ID NO: 1043511 - RNA, 15 nt, Mycobacterium bovis subsp bovis AF2122/97
gacgcaaagcagcgc

SEQ ID NO: 1043512 - RNA, 13 nt, Mycobacterium bovis subsp bovis AF2122/97
gacgcaacacccg

SEQ ID NO: 1043513 - RNA, 22 nt, Mycobacterium bovis subsp bovis AF2122/97
gacgcggccggccgcccgcucg

SEQ ID NO: 1043514 - RNA, 15 nt, Mycobacterium bovis subsp bovis AF2122/97
gacgcggccgggcgu

SEQ ID NO: 1043515 - RNA, 16 nt, Mycobacterium bovis subsp bovis AF2122/97
gacgcggcaggccggu

SEQ ID NO: 1043516 - RNA, 19 nt, Mycobacterium bovis subsp bovis AF2122/97
gacgcggccaauggccgcg

SEQ ID NO: 1043517 - RNA, 20 nt, Mycobacterium bovis subsp bovis AF2122/97
gacgcggccaauggccgcgg

SEQ ID NO: 1043518 - RNA, 21 nt, Mycobacterium bovis subsp bovis AF2122/97
gacgcggccacauaccaccac

SEQ ID NO: 1043519 - RNA, 19 nt, Mycobacterium bovis subsp bovis AF2122/97
gacgcggaaucgcaccgug

SEQ ID NO: 1043520 - RNA, 12 nt, Mycobacterium bovis subsp bovis AF2122/97
gacgcgcucgcg

SEQ ID NO: 1043521 - RNA, 20 nt, Mycobacterium bovis subsp bovis AF2122/97
gacgcgccguaacagccggc

SEQ ID NO: 1043522 - RNA, 12 nt, Mycobacterium bovis subsp bovis AF2122/97
gacgcgcucggc

SEQ ID NO: 1043523 - RNA, 15 nt, Mycobacterium bovis subsp bovis AF2122/97
gacgcgcggauggcc

SEQ ID NO: 1043524 - RNA, 19 nt, Mycobacterium bovis subsp bovis AF2122/97
gacgcgcggauggccucgg

SEQ ID NO: 1043525 - RNA, 18 nt, Mycobacterium bovis subsp bovis AF2122/97
gacgcgcggauuucgccg

SEQ ID NO: 1043526 - RNA, 12 nt, Mycobacterium bovis subsp bovis AF2122/97
gacgcgcggcca

SEQ ID NO: 1043527 - RNA, 16 nt, Mycobacterium bovis subsp bovis AF2122/97
gacgcgacacgccggc

SEQ ID NO: 1043528 - RNA, 18 nt, Mycobacterium bovis subsp bovis AF2122/97
gacgcgacacgccggcgg

SEQ ID NO: 1043529 - RNA, 20 nt, Mycobacterium bovis subsp bovis AF2122/97
gacgcgaacgcggccaccac

SEQ ID NO: 1043530 - RNA, 18 nt, Mycobacterium bovis subsp bovis AF2122/97
gacgcgacacacgccgcc

SEQ ID NO: 1043531 - RNA, 21 nt, Mycobacterium bovis subsp bovis AF2122/97
gacgcgacacacgccgccggu

SEQ ID NO: 1043532 - RNA, 15 nt, Mycobacterium bovis subsp bovis AF2122/97
gacgcgacacgccga

SEQ ID NO: 1043533 - RNA, 14 nt, Mycobacterium bovis subsp bovis AF2122/97
gacgcgacgagccg

SEQ ID NO: 1043534 - RNA, 22 nt, Mycobacterium bovis subsp bovis AF2122/97
gacgcgacucggcggucuuggc

SEQ ID NO: 1043535 - RNA, 17 nt, Mycobacterium bovis subsp bovis AF2122/97
gacgcgcgagaacaccc

SEQ ID NO: 1043536 - RNA, 19 nt, Mycobacterium bovis subsp bovis AF2122/97
gacgcgcaacgccgccagc

SEQ ID NO: 1043537 - RNA, 13 nt, Mycobacterium bovis subsp bovis AF2122/97
gacgcgaucggcg

SEQ ID NO: 1043538 - RNA, 14 nt, Mycobacterium bovis subsp bovis AF2122/97
gacgcgaucggcgu

SEQ ID NO: 1043539 - RNA, 15 nt, Mycobacterium bovis subsp bovis AF2122/97
gacgcgaucuguccg

SEQ ID NO: 1043540 - RNA, 17 nt, Mycobacterium bovis subsp bovis AF2122/97
gacgcgaugaccgcacc

SEQ ID NO: 1043541 - RNA, 20 nt, Mycobacterium bovis subsp bovis AF2122/97
gacgcgcaacgccgccagcc

SEQ ID NO: 1043542 - RNA, 19 nt, Mycobacterium bovis subsp bovis AF2122/97
gacgcgccccaguucgacg

SEQ ID NO: 1043543 - RNA, 17 nt, Mycobacterium bovis subsp bovis AF2122/97
gacgccguugccgccgu

SEQ ID NO: 1043544 - RNA, 15 nt, Mycobacterium bovis subsp bovis AF2122/97
gacgccguugccgcc

SEQ ID NO: 1043545 - RNA, 17 nt, Mycobacterium bovis subsp bovis AF2122/97
gacgccguugccaccgu

SEQ ID NO: 1043546 - RNA, 19 nt, Mycobacterium bovis subsp bovis AF2122/97
gacgccuuccagcccgagc

SEQ ID NO: 1043547 - RNA, 21 nt, Mycobacterium bovis subsp bovis AF2122/97
gacgccuuccagcccgagcag

SEQ ID NO: 1043548 - RNA, 21 nt, Mycobacterium bovis subsp bovis AF2122/97
gacgcgaaaucccccgacacg

SEQ ID NO: 1043549 - RNA, 20 nt, Mycobacterium bovis subsp bovis AF2122/97
gacgccgucggacaccgcau

SEQ ID NO: 1043550 - RNA, 13 nt, Mycobacterium bovis subsp bovis AF2122/97
gacgccgucggcg

SEQ ID NO: 1043551 - RNA, 14 nt, Mycobacterium bovis subsp bovis AF2122/97
gacgccgucggcgc

SEQ ID NO: 1043552 - RNA, 17 nt, Mycobacterium bovis subsp bovis AF2122/97
gacgccgucgacgucga

SEQ ID NO: 1043553 - RNA, 19 nt, Mycobacterium bovis subsp bovis AF2122/97
gacgccgucggcgccggca

SEQ ID NO: 1043554 - RNA, 17 nt, Mycobacterium bovis subsp bovis AF2122/97
gacgccgucggcgcgca

SEQ ID NO: 1043555 - RNA, 19 nt, Mycobacterium bovis subsp bovis AF2122/97
gacgccgucggcgcgcacc

SEQ ID NO: 1043556 - RNA, 16 nt, Mycobacterium bovis subsp bovis AF2122/97
gacgccgcggcgccgg

SEQ ID NO: 1043557 - RNA, 15 nt, Mycobacterium bovis subsp bovis AF2122/97
gacgccgcggucgug

SEQ ID NO: 1043558 - RNA, 16 nt, Mycobacterium bovis subsp bovis AF2122/97
gacgccgccgcugccg

SEQ ID NO: 1043559 - RNA, 19 nt, Mycobacterium bovis subsp bovis AF2122/97
gacgccgccggccccgccg

SEQ ID NO: 1043560 - RNA, 16 nt, Mycobacterium bovis subsp bovis AF2122/97
gacgccgccggcgcca

SEQ ID NO: 1043561 - RNA, 19 nt, Mycobacterium bovis subsp bovis AF2122/97
gacgccgccggcgccaccg

SEQ ID NO: 1043562 - RNA, 11 nt, Mycobacterium bovis subsp bovis AF2122/97
gacgccgccgu

SEQ ID NO: 1043563 - RNA, 16 nt, Mycobacterium bovis subsp bovis AF2122/97
gacgccgcgcagccgg

SEQ ID NO: 1043564 - RNA, 20 nt, Mycobacterium bovis subsp bovis AF2122/97
gacgccgcgcagccggcccg

SEQ ID NO: 1043565 - RNA, 13 nt, Mycobacterium bovis subsp bovis AF2122/97
gacgccaccgcga

SEQ ID NO: 1043566 - RNA, 18 nt, Mycobacterium bovis subsp bovis AF2122/97
gacgccaccgccaccacc

SEQ ID NO: 1043567 - RNA, 12 nt, Mycobacterium bovis subsp bovis AF2122/97
gacgccaccgcg

SEQ ID NO: 1043568 - RNA, 20 nt, Mycobacterium bovis subsp bovis AF2122/97
gacgccaccugacgugcggc

SEQ ID NO: 1043569 - RNA, 17 nt, Mycobacterium bovis subsp bovis AF2122/97
gacgccaaugccgcgga

SEQ ID NO: 1043570 - RNA, 21 nt, Mycobacterium bovis subsp bovis AF2122/97
gacgccaccugacgugcggcg

SEQ ID NO: 1043571 - RNA, 22 nt, Mycobacterium bovis subsp bovis AF2122/97
gacgccacgcgucuucggucgc

SEQ ID NO: 1043572 - RNA, 23 nt, Mycobacterium bovis subsp bovis AF2122/97
gacgccacgcgucuucggucgcg

SEQ ID NO: 1043573 - RNA, 20 nt, Mycobacterium bovis subsp bovis AF2122/97
gacgccagcaaugcccgcac

SEQ ID NO: 1043574 - RNA, 21 nt, Mycobacterium bovis subsp bovis AF2122/97
gacgccagcaaugcccgcacc

SEQ ID NO: 1043575 - RNA, 22 nt, Mycobacterium bovis subsp bovis AF2122/97
gacgccagcaaugcccgcaccg

SEQ ID NO: 1043576 - RNA, 15 nt, Mycobacterium bovis subsp bovis AF2122/97
gacggcgacggcgcc

SEQ ID NO: 1043577 - RNA, 16 nt, Mycobacterium bovis subsp bovis AF2122/97
gacggcgacggcgccc

SEQ ID NO: 1043578 - RNA, 21 nt, Mycobacterium bovis subsp bovis AF2122/97
gacggcgaaucgguggucgau

SEQ ID NO: 1043579 - RNA, 17 nt, Mycobacterium bovis subsp bovis AF2122/97
gacggcgauauaggacg

SEQ ID NO: 1043580 - RNA, 19 nt, Mycobacterium bovis subsp bovis AF2122/97
gacggcgaacccgccgaug

SEQ ID NO: 1043581 - RNA, 21 nt, Mycobacterium bovis subsp bovis AF2122/97
gacggccgacaacccggccgg

SEQ ID NO: 1043582 - RNA, 19 nt, Mycobacterium bovis subsp bovis AF2122/97
gacggccuggggcagccgg

SEQ ID NO: 1043583 - RNA, 21 nt, Mycobacterium bovis subsp bovis AF2122/97
gacggccuggggcagccgggc

SEQ ID NO: 1043584 - RNA, 17 nt, Mycobacterium bovis subsp bovis AF2122/97
gacggcgaaaaucccgc

SEQ ID NO: 1043585 - RNA, 22 nt, Mycobacterium bovis subsp bovis AF2122/97
gacggcgaaaaucccgcucccc

SEQ ID NO: 1043586 - RNA, 20 nt, Mycobacterium bovis subsp bovis AF2122/97
gacggcccucgagcagcgug

SEQ ID NO: 1043587 - RNA, 18 nt, Mycobacterium bovis subsp bovis AF2122/97
gacggccgacaacccggc

SEQ ID NO: 1043588 - RNA, 22 nt, Mycobacterium bovis subsp bovis AF2122/97
gacggccgccagcagcuucucg

SEQ ID NO: 1043589 - RNA, 15 nt, Mycobacterium bovis subsp bovis AF2122/97
gacggccggcaagca

SEQ ID NO: 1043590 - RNA, 14 nt, Mycobacterium bovis subsp bovis AF2122/97
gacggccgucgccc

SEQ ID NO: 1043591 - RNA, 20 nt, Mycobacterium bovis subsp bovis AF2122/97
gacggccguggaaagccggc

SEQ ID NO: 1043592 - RNA, 16 nt, Mycobacterium bovis subsp bovis AF2122/97
gacggccggccgcggu

SEQ ID NO: 1043593 - RNA, 16 nt, Mycobacterium bovis subsp bovis AF2122/97
gacggcgccgucgaaa

SEQ ID NO: 1043594 - RNA, 12 nt, Mycobacterium bovis subsp bovis AF2122/97
gacggcgcucgg

SEQ ID NO: 1043595 - RNA, 14 nt, Mycobacterium bovis subsp bovis AF2122/97
gacggcgcucggcg

SEQ ID NO: 1043596 - RNA, 17 nt, Mycobacterium bovis subsp bovis AF2122/97
gacggcgcccgcccgag

SEQ ID NO: 1043597 - RNA, 13 nt, Mycobacterium bovis subsp bovis AF2122/97
gacggcgccaggc

SEQ ID NO: 1043598 - RNA, 18 nt, Mycobacterium bovis subsp bovis AF2122/97
gacggcgccaggcaccac

SEQ ID NO: 1043599 - RNA, 14 nt, Mycobacterium bovis subsp bovis AF2122/97
gacggcgccgaacc

SEQ ID NO: 1043600 - RNA, 14 nt, Mycobacterium bovis subsp bovis AF2122/97
gacggcgauggcgc

SEQ ID NO: 1043601 - RNA, 16 nt, Mycobacterium bovis subsp bovis AF2122/97
gacggcgauggcgcgc

SEQ ID NO: 1043602 - RNA, 16 nt, Mycobacterium bovis subsp bovis AF2122/97
gacgggauagacgacc

SEQ ID NO: 1043603 - RNA, 19 nt, Mycobacterium bovis subsp bovis AF2122/97
gacgggauagccguucggc

SEQ ID NO: 1043604 - RNA, 15 nt, Mycobacterium bovis subsp bovis AF2122/97
gacgggacaacccgu

SEQ ID NO: 1043605 - RNA, 15 nt, Mycobacterium bovis subsp bovis AF2122/97
gacggcuucggcagc

SEQ ID NO: 1043606 - RNA, 16 nt, Mycobacterium bovis subsp bovis AF2122/97
gacggcuucggcagcc

SEQ ID NO: 1043607 - RNA, 17 nt, Mycobacterium bovis subsp bovis AF2122/97
gacggcgcucggcgagc

SEQ ID NO: 1043608 - RNA, 22 nt, Mycobacterium bovis subsp bovis AF2122/97
gacggcuuccaacucggcggcc

SEQ ID NO: 1043609 - RNA, 17 nt, Mycobacterium bovis subsp bovis AF2122/97
gacggcagccaccagcg

SEQ ID NO: 1043610 - RNA, 15 nt, Mycobacterium bovis subsp bovis AF2122/97
gacggcagccagcca

SEQ ID NO: 1043611 - RNA, 19 nt, Mycobacterium bovis subsp bovis AF2122/97
gacggcagccagccaccgg

SEQ ID NO: 1043612 - RNA, 14 nt, Mycobacterium bovis subsp bovis AF2122/97
gacggcagccgggc

SEQ ID NO: 1043613 - RNA, 18 nt, Mycobacterium bovis subsp bovis AF2122/97
gacggcagccgggcggca

SEQ ID NO: 1043614 - RNA, 20 nt, Mycobacterium bovis subsp bovis AF2122/97
gacggccagcaagacgauga

SEQ ID NO: 1043615 - RNA, 18 nt, Mycobacterium bovis subsp bovis AF2122/97
gacggccaagaucggcgc

SEQ ID NO: 1043616 - RNA, 17 nt, Mycobacterium bovis subsp bovis AF2122/97
gacggccaccccgucgg

SEQ ID NO: 1043617 - RNA, 13 nt, Mycobacterium bovis subsp bovis AF2122/97
gacggccaccggg

SEQ ID NO: 1043618 - RNA, 21 nt, Mycobacterium bovis subsp bovis AF2122/97
gacggccacgguggagcgcgc

SEQ ID NO: 1043619 - RNA, 12 nt, Mycobacterium bovis subsp bovis AF2122/97
gacggcccgauc

SEQ ID NO: 1043620 - RNA, 15 nt, Mycobacterium bovis subsp bovis AF2122/97
gacggcccgccgucc

SEQ ID NO: 1043621 - RNA, 22 nt, Mycobacterium bovis subsp bovis AF2122/97
gacggcccgccguccggcgccc

SEQ ID NO: 1043622 - RNA, 16 nt, Mycobacterium bovis subsp bovis AF2122/97
gacggccagcccagca

SEQ ID NO: 1043623 - RNA, 21 nt, Mycobacterium bovis subsp bovis AF2122/97
gacggccaguugguagccgcc

SEQ ID NO: 1043624 - RNA, 17 nt, Mycobacterium bovis subsp bovis AF2122/97
gacggccaucgccagcc

SEQ ID NO: 1043625 - RNA, 14 nt, Mycobacterium bovis subsp bovis AF2122/97
gacgcguuucgucg

SEQ ID NO: 1043626 - RNA, 16 nt, Mycobacterium bovis subsp bovis AF2122/97
gacgcguuucgucgac

SEQ ID NO: 1043627 - RNA, 21 nt, Mycobacterium bovis subsp bovis AF2122/97
gacgcguuucgucgaccgcgc

SEQ ID NO: 1043628 - RNA, 15 nt, Mycobacterium bovis subsp bovis AF2122/97
gacggcagccaccag

SEQ ID NO: 1043629 - RNA, 16 nt, Mycobacterium bovis subsp bovis AF2122/97
gacggcagccaccagc

SEQ ID NO: 1043630 - RNA, 16 nt, Mycobacterium bovis subsp bovis AF2122/97
gacgcguugcucgaaa

SEQ ID NO: 1043631 - RNA, 17 nt, Mycobacterium bovis subsp bovis AF2122/97
gacgcuaaguccccgcu

SEQ ID NO: 1043632 - RNA, 14 nt, Mycobacterium bovis subsp bovis AF2122/97
gacgcggcgccgcc

SEQ ID NO: 1043633 - RNA, 17 nt, Mycobacterium bovis subsp bovis AF2122/97
gacgcguccggugcacc

SEQ ID NO: 1043634 - RNA, 14 nt, Mycobacterium bovis subsp bovis AF2122/97
gacgcgucgccggc

SEQ ID NO: 1043635 - RNA, 13 nt, Mycobacterium bovis subsp bovis AF2122/97
gacgcgucggcga

SEQ ID NO: 1043636 - RNA, 18 nt, Mycobacterium bovis subsp bovis AF2122/97
gacgcgucguggucggcg

SEQ ID NO: 1043637 - RNA, 20 nt, Mycobacterium bovis subsp bovis AF2122/97
gacgcguggcauccagcagc

SEQ ID NO: 1043638 - RNA, 16 nt, Mycobacterium bovis subsp bovis AF2122/97
gacggggaagcccggc

SEQ ID NO: 1043639 - RNA, 15 nt, Mycobacterium bovis subsp bovis AF2122/97
gacggggcggucggc

SEQ ID NO: 1043640 - RNA, 20 nt, Mycobacterium bovis subsp bovis AF2122/97
gacggggcaaaggagccguu

SEQ ID NO: 1043641 - RNA, 22 nt, Mycobacterium bovis subsp bovis AF2122/97
gacgggcgcguccucgccgcac

SEQ ID NO: 1043642 - RNA, 15 nt, Mycobacterium bovis subsp bovis AF2122/97
gacgggcgcgucggc

SEQ ID NO: 1043643 - RNA, 13 nt, Mycobacterium bovis subsp bovis AF2122/97
gacgggcucggca

SEQ ID NO: 1043644 - RNA, 13 nt, Mycobacterium bovis subsp bovis AF2122/97
gacgggcacccga

SEQ ID NO: 1043645 - RNA, 20 nt, Mycobacterium bovis subsp bovis AF2122/97
gacgggcacccgagccgcac

SEQ ID NO: 1043646 - RNA, 18 nt, Mycobacterium bovis subsp bovis AF2122/97
gacgggauauccggucgc

SEQ ID NO: 1043647 - RNA, 17 nt, Mycobacterium bovis subsp bovis AF2122/97
gacgggaucgcccaggc

SEQ ID NO: 1043648 - RNA, 16 nt, Mycobacterium bovis subsp bovis AF2122/97
gacgggcacgcggcga

SEQ ID NO: 1043649 - RNA, 22 nt, Mycobacterium bovis subsp bovis AF2122/97
gacgggccacgaugcgcacacc

SEQ ID NO: 1043650 - RNA, 14 nt, Mycobacterium bovis subsp bovis AF2122/97
gacguaggcggcgg

SEQ ID NO: 1043651 - RNA, 21 nt, Mycobacterium bovis subsp bovis AF2122/97
gacguaggcggcggcccgcag

SEQ ID NO: 1043652 - RNA, 19 nt, Mycobacterium bovis subsp bovis AF2122/97
gacguaggcaccccggugc

SEQ ID NO: 1043653 - RNA, 20 nt, Mycobacterium bovis subsp bovis AF2122/97
gacggugcgggcuaggcggc

SEQ ID NO: 1043654 - RNA, 16 nt, Mycobacterium bovis subsp bovis AF2122/97
gacggugccgaccgcg

SEQ ID NO: 1043655 - RNA, 18 nt, Mycobacterium bovis subsp bovis AF2122/97
gacggugccgaccgcguu

SEQ ID NO: 1043656 - RNA, 12 nt, Mycobacterium bovis subsp bovis AF2122/97
gacggggcgagc

SEQ ID NO: 1043657 - RNA, 22 nt, Mycobacterium bovis subsp bovis AF2122/97
gacggucuggcccgcgacaucg

SEQ ID NO: 1043658 - RNA, 14 nt, Mycobacterium bovis subsp bovis AF2122/97
gacggugccaccgc

SEQ ID NO: 1043659 - RNA, 24 nt, Mycobacterium bovis subsp bovis AF2122/97
gacggugcagcuccccgccggaac

SEQ ID NO: 1043660 - RNA, 15 nt, Mycobacterium bovis subsp bovis AF2122/97
gacggugcaggacca

SEQ ID NO: 1043661 - RNA, 16 nt, Mycobacterium bovis subsp bovis AF2122/97
gacggugacgaccacg

SEQ ID NO: 1043662 - RNA, 22 nt, Mycobacterium bovis subsp bovis AF2122/97
gacggugacgaucaggccgucg

SEQ ID NO: 1043663 - RNA, 18 nt, Mycobacterium bovis subsp bovis AF2122/97
gacgucgaccacugcccg

SEQ ID NO: 1043664 - RNA, 23 nt, Mycobacterium bovis subsp bovis AF2122/97
gacgucgaccacugcccgggguc

SEQ ID NO: 1043665 - RNA, 14 nt, Mycobacterium bovis subsp bovis AF2122/97
gacgucgaccgugu

SEQ ID NO: 1043666 - RNA, 13 nt, Mycobacterium bovis subsp bovis AF2122/97
gacgucgaccugu

SEQ ID NO: 1043667 - RNA, 20 nt, Mycobacterium bovis subsp bovis AF2122/97
gacguccucgacgaucagca

SEQ ID NO: 1043668 - RNA, 14 nt, Mycobacterium bovis subsp bovis AF2122/97
gacguauuggcgca

SEQ ID NO: 1043669 - RNA, 13 nt, Mycobacterium bovis subsp bovis AF2122/97
gacguccgcgacu

SEQ ID NO: 1043670 - RNA, 18 nt, Mycobacterium bovis subsp bovis AF2122/97
gacgucgagcagcgccac

SEQ ID NO: 1043671 - RNA, 18 nt, Mycobacterium bovis subsp bovis AF2122/97
gacguccuucgcugguau

SEQ ID NO: 1043672 - RNA, 14 nt, Mycobacterium bovis subsp bovis AF2122/97
gacgucgacggcga

SEQ ID NO: 1043673 - RNA, 17 nt, Mycobacterium bovis subsp bovis AF2122/97
gacgucgauuucggcga

SEQ ID NO: 1043674 - RNA, 18 nt, Mycobacterium bovis subsp bovis AF2122/97
gacgucgauuucggcgac

SEQ ID NO: 1043675 - RNA, 16 nt, Mycobacterium bovis subsp bovis AF2122/97
gacgucggcguggucg

SEQ ID NO: 1043676 - RNA, 15 nt, Mycobacterium bovis subsp bovis AF2122/97
gacgucggcuucacc

SEQ ID NO: 1043677 - RNA, 13 nt, Mycobacterium bovis subsp bovis AF2122/97
gacgucgggaucg

SEQ ID NO: 1043678 - RNA, 16 nt, Mycobacterium bovis subsp bovis AF2122/97
gacgucgggaucgcca

SEQ ID NO: 1043679 - RNA, 20 nt, Mycobacterium bovis subsp bovis AF2122/97
gacgucggugaacgcgucgu

SEQ ID NO: 1043680 - RNA, 22 nt, Mycobacterium bovis subsp bovis AF2122/97
gacguccagggccacgaucugu

SEQ ID NO: 1043681 - RNA, 19 nt, Mycobacterium bovis subsp bovis AF2122/97
gacguccaucccggcgccg

SEQ ID NO: 1043682 - RNA, 20 nt, Mycobacterium bovis subsp bovis AF2122/97
gacguccaucccggcgccgc

SEQ ID NO: 1043683 - RNA, 13 nt, Mycobacterium bovis subsp bovis AF2122/97
gacgucaggcagc

SEQ ID NO: 1043684 - RNA, 13 nt, Mycobacterium bovis subsp bovis AF2122/97
gacguccaccagc

SEQ ID NO: 1043685 - RNA, 14 nt, Mycobacterium bovis subsp bovis AF2122/97
gacguccaccagcc

SEQ ID NO: 1043686 - RNA, 18 nt, Mycobacterium bovis subsp bovis AF2122/97
gacgucaugcggauagca

SEQ ID NO: 1043687 - RNA, 13 nt, Mycobacterium bovis subsp bovis AF2122/97
gacguccaacagc

SEQ ID NO: 1043688 - RNA, 14 nt, Mycobacterium bovis subsp bovis AF2122/97
gacguccaacagcg

SEQ ID NO: 1043689 - RNA, 15 nt, Mycobacterium bovis subsp bovis AF2122/97
gacguccaacagcgc

SEQ ID NO: 1043690 - RNA, 15 nt, Mycobacterium bovis subsp bovis AF2122/97
gacgucaucgccgac

SEQ ID NO: 1043691 - RNA, 16 nt, Mycobacterium bovis subsp bovis AF2122/97
gacgucaccguucuug

SEQ ID NO: 1043692 - RNA, 15 nt, Mycobacterium bovis subsp bovis AF2122/97
gacgucacguucggc

SEQ ID NO: 1043693 - RNA, 17 nt, Mycobacterium bovis subsp bovis AF2122/97
gacgucacguucggcgc

SEQ ID NO: 1043694 - RNA, 15 nt, Mycobacterium bovis subsp bovis AF2122/97
gacguagucgcgcac

SEQ ID NO: 1043695 - RNA, 23 nt, Mycobacterium bovis subsp bovis AF2122/97
gacguaguugccggcuucggcga

SEQ ID NO: 1043696 - RNA, 12 nt, Mycobacterium bovis subsp bovis AF2122/97
gacguaucgccg

SEQ ID NO: 1043697 - RNA, 23 nt, Mycobacterium bovis subsp bovis AF2122/97
gacgucaaacgcaaagacagcgc

SEQ ID NO: 1043698 - RNA, 19 nt, Mycobacterium bovis subsp bovis AF2122/97
gacguaucgccgcgggcga

SEQ ID NO: 1043699 - RNA, 17 nt, Mycobacterium bovis subsp bovis AF2122/97
gacgucaccacgaucgc

SEQ ID NO: 1043700 - RNA, 16 nt, Mycobacterium bovis subsp bovis AF2122/97
gaacguaggguggccg

SEQ ID NO: 1043701 - RNA, 22 nt, Mycobacterium bovis subsp bovis AF2122/97
gaacgucauacccagcucgucg

SEQ ID NO: 1043702 - RNA, 19 nt, Mycobacterium bovis subsp bovis AF2122/97
gaacgucacguggucggcc

SEQ ID NO: 1043703 - RNA, 20 nt, Mycobacterium bovis subsp bovis AF2122/97
gaacgugaacugagggcgga

SEQ ID NO: 1043704 - RNA, 13 nt, Mycobacterium bovis subsp bovis AF2122/97
gaacgugacgguc

SEQ ID NO: 1043705 - RNA, 20 nt, Mycobacterium bovis subsp bovis AF2122/97
gaacguccagccguggcggc

SEQ ID NO: 1043706 - RNA, 16 nt, Mycobacterium bovis subsp bovis AF2122/97
gaacgucgcggccagc

SEQ ID NO: 1043707 - RNA, 18 nt, Mycobacterium bovis subsp bovis AF2122/97
gaacgugccccggcggua

SEQ ID NO: 1043708 - RNA, 20 nt, Mycobacterium bovis subsp bovis AF2122/97
gaacgugcaaccacggcggc

SEQ ID NO: 1043709 - RNA, 16 nt, Mycobacterium bovis subsp bovis AF2122/97
gaacugguuggugacg

SEQ ID NO: 1043710 - RNA, 17 nt, Mycobacterium bovis subsp bovis AF2122/97
gaacugguuucgcaccg

SEQ ID NO: 1043711 - RNA, 18 nt, Mycobacterium bovis subsp bovis AF2122/97
gaacugguuucgcaccgu

SEQ ID NO: 1043712 - RNA, 18 nt, Mycobacterium bovis subsp bovis AF2122/97
gaacuggucgacgccgag

SEQ ID NO: 1043713 - RNA, 15 nt, Mycobacterium bovis subsp bovis AF2122/97
gaacuggucgacguc

SEQ ID NO: 1043714 - RNA, 14 nt, Mycobacterium bovis subsp bovis AF2122/97
gaacugguagcccg

SEQ ID NO: 1043715 - RNA, 19 nt, Mycobacterium bovis subsp bovis AF2122/97
gaacugggggccggcacug

SEQ ID NO: 1043716 - RNA, 14 nt, Mycobacterium bovis subsp bovis AF2122/97
gaacugggccucag

SEQ ID NO: 1043717 - RNA, 15 nt, Mycobacterium bovis subsp bovis AF2122/97
gaacguggcucggcg

SEQ ID NO: 1043718 - RNA, 16 nt, Mycobacterium bovis subsp bovis AF2122/97
gaacguggcucggcgg

SEQ ID NO: 1043719 - RNA, 23 nt, Mycobacterium bovis subsp bovis AF2122/97
gaacgugaugcggucgcggacaa

SEQ ID NO: 1043720 - RNA, 24 nt, Mycobacterium bovis subsp bovis AF2122/97
gaacgugugggccauguggacggc

SEQ ID NO: 1043721 - RNA, 20 nt, Mycobacterium bovis subsp bovis AF2122/97
gaacuucugguaggcggcca

SEQ ID NO: 1043722 - RNA, 18 nt, Mycobacterium bovis subsp bovis AF2122/97
gaacuucuccaccagcgu

SEQ ID NO: 1043723 - RNA, 22 nt, Mycobacterium bovis subsp bovis AF2122/97
gaacuugccggugcgcaccagc

SEQ ID NO: 1043724 - RNA, 13 nt, Mycobacterium bovis subsp bovis AF2122/97
gaacuucgccgaa

SEQ ID NO: 1043725 - RNA, 20 nt, Mycobacterium bovis subsp bovis AF2122/97
gaacugggcgaucgacaccg

SEQ ID NO: 1043726 - RNA, 20 nt, Mycobacterium bovis subsp bovis AF2122/97
gaacuugugccgggcgaugc

SEQ ID NO: 1043727 - RNA, 14 nt, Mycobacterium bovis subsp bovis AF2122/97
gaagaaccugagca

SEQ ID NO: 1043728 - RNA, 16 nt, Mycobacterium bovis subsp bovis AF2122/97
gaagaacgcgucguag

SEQ ID NO: 1043729 - RNA, 18 nt, Mycobacterium bovis subsp bovis AF2122/97
gaagaacucggcgucgug

SEQ ID NO: 1043730 - RNA, 14 nt, Mycobacterium bovis subsp bovis AF2122/97
gaagaacucggugc

SEQ ID NO: 1043731 - RNA, 17 nt, Mycobacterium bovis subsp bovis AF2122/97
gaagaagaugaucgcga

SEQ ID NO: 1043732 - RNA, 18 nt, Mycobacterium bovis subsp bovis AF2122/97
gaagaacugggcaaugac

SEQ ID NO: 1043733 - RNA, 18 nt, Mycobacterium bovis subsp bovis AF2122/97
gaagaagaacucggcguc

SEQ ID NO: 1043734 - RNA, 22 nt, Mycobacterium bovis subsp bovis AF2122/97
gaagaacaguugcccgacgccg

SEQ ID NO: 1043735 - RNA, 17 nt, Mycobacterium bovis subsp bovis AF2122/97
gaagaacaucaccucga

SEQ ID NO: 1043736 - RNA, 18 nt, Mycobacterium bovis subsp bovis AF2122/97
gaagauccagcgcaccgg

SEQ ID NO: 1043737 - RNA, 14 nt, Mycobacterium bovis subsp bovis AF2122/97
gaagaucgcugcga

SEQ ID NO: 1043738 - RNA, 17 nt, Mycobacterium bovis subsp bovis AF2122/97
gaagaugauuucgccga

SEQ ID NO: 1043739 - RNA, 15 nt, Mycobacterium bovis subsp bovis AF2122/97
gaagaugaucgcgaa

SEQ ID NO: 1043740 - RNA, 18 nt, Mycobacterium bovis subsp bovis AF2122/97
gaagaucgagccgacccg

SEQ ID NO: 1043741 - RNA, 22 nt, Mycobacterium bovis subsp bovis AF2122/97
gaagaucaccucccgcggcacc

SEQ ID NO: 1043742 - RNA, 16 nt, Mycobacterium bovis subsp bovis AF2122/97
gaagagcuccgucgcg

SEQ ID NO: 1043743 - RNA, 18 nt, Mycobacterium bovis subsp bovis AF2122/97
gaagagcuccgucgcggc

SEQ ID NO: 1043744 - RNA, 15 nt, Mycobacterium bovis subsp bovis AF2122/97
gaagagcaauggcgc

SEQ ID NO: 1043745 - RNA, 23 nt, Mycobacterium bovis subsp bovis AF2122/97
gaagagcacguugcacagcuugg

SEQ ID NO: 1043746 - RNA, 13 nt, Mycobacterium bovis subsp bovis AF2122/97
gaagacggugcgg

SEQ ID NO: 1043747 - RNA, 15 nt, Mycobacterium bovis subsp bovis AF2122/97
gaagacggugcgggc

SEQ ID NO: 1043748 - RNA, 23 nt, Mycobacterium bovis subsp bovis AF2122/97
gaagaguguccccccgcgcagau

SEQ ID NO: 1043749 - RNA, 17 nt, Mycobacterium bovis subsp bovis AF2122/97
gaagacgucgggaucgc

SEQ ID NO: 1043750 - RNA, 15 nt, Mycobacterium bovis subsp bovis AF2122/97
gaagacgugccggcu

SEQ ID NO: 1043751 - RNA, 16 nt, Mycobacterium bovis subsp bovis AF2122/97
gaagacggccaccggg

SEQ ID NO: 1043752 - RNA, 23 nt, Mycobacterium bovis subsp bovis AF2122/97
gaagaccuggcggugccggcggc

SEQ ID NO: 1043753 - RNA, 21 nt, Mycobacterium bovis subsp bovis AF2122/97
gaagaccucgucgcgucgcca

SEQ ID NO: 1043754 - RNA, 15 nt, Mycobacterium bovis subsp bovis AF2122/97
gaagaccgccgggau

SEQ ID NO: 1043755 - RNA, 14 nt, Mycobacterium bovis subsp bovis AF2122/97
gaagaccggaucgc

SEQ ID NO: 1043756 - RNA, 14 nt, Mycobacterium bovis subsp bovis AF2122/97
gaagaccucgucgc

SEQ ID NO: 1043757 - RNA, 15 nt, Mycobacterium bovis subsp bovis AF2122/97
gaagaccucgucgcg

SEQ ID NO: 1043758 - RNA, 17 nt, Mycobacterium bovis subsp bovis AF2122/97
gaagaccucgucgcguc

SEQ ID NO: 1043759 - RNA, 23 nt, Mycobacterium bovis subsp bovis AF2122/97
gaagaauccggcccaccggucgc

SEQ ID NO: 1043760 - RNA, 12 nt, Mycobacterium bovis subsp bovis AF2122/97
gaagacaccagg

SEQ ID NO: 1043761 - RNA, 16 nt, Mycobacterium bovis subsp bovis AF2122/97
gaagaagcccgaagac

SEQ ID NO: 1043762 - RNA, 16 nt, Mycobacterium bovis subsp bovis AF2122/97
gaagaaugccgucuga

SEQ ID NO: 1043763 - RNA, 22 nt, Mycobacterium bovis subsp bovis AF2122/97
gaagaaugggauggcaccaccc

SEQ ID NO: 1043764 - RNA, 15 nt, Mycobacterium bovis subsp bovis AF2122/97
gaagacaccaggccc

SEQ ID NO: 1043765 - RNA, 16 nt, Mycobacterium bovis subsp bovis AF2122/97
gaagacaccggcgucg

SEQ ID NO: 1043766 - RNA, 21 nt, Mycobacterium bovis subsp bovis AF2122/97
gaacgccacggcaucggccac

SEQ ID NO: 1043767 - RNA, 17 nt, Mycobacterium bovis subsp bovis AF2122/97
gaacgcguagagccgau

SEQ ID NO: 1043768 - RNA, 23 nt, Mycobacterium bovis subsp bovis AF2122/97
gaacgcgucgccgacgccggugg

SEQ ID NO: 1043769 - RNA, 22 nt, Mycobacterium bovis subsp bovis AF2122/97
gaacgcguagucgcgggugcgg

SEQ ID NO: 1043770 - RNA, 23 nt, Mycobacterium bovis subsp bovis AF2122/97
gaacgcguccagcgcggccuugg

SEQ ID NO: 1043771 - RNA, 23 nt, Mycobacterium bovis subsp bovis AF2122/97
gaacgcggcgucgauaaccuggc

SEQ ID NO: 1043772 - RNA, 22 nt, Mycobacterium bovis subsp bovis AF2122/97
gaacgccaccaccuccgcgucg

SEQ ID NO: 1043773 - RNA, 19 nt, Mycobacterium bovis subsp bovis AF2122/97
gaacgcauacagcgcccgg

SEQ ID NO: 1043774 - RNA, 24 nt, Mycobacterium bovis subsp bovis AF2122/97
gaacgcaugcgagaacgucgagac

SEQ ID NO: 1043775 - RNA, 20 nt, Mycobacterium bovis subsp bovis AF2122/97
gaacgcaccgaaacgccgac

SEQ ID NO: 1043776 - RNA, 14 nt, Mycobacterium bovis subsp bovis AF2122/97
gaacgcaccgaaac

SEQ ID NO: 1043777 - RNA, 19 nt, Mycobacterium bovis subsp bovis AF2122/97
gaacgcaccgaaacgccga

SEQ ID NO: 1043778 - RNA, 20 nt, Mycobacterium bovis subsp bovis AF2122/97
gaacgcacgucgaggcggca

SEQ ID NO: 1043779 - RNA, 22 nt, Mycobacterium bovis subsp bovis AF2122/97
gaacgcacucaucgccggaccg

SEQ ID NO: 1043780 - RNA, 23 nt, Mycobacterium bovis subsp bovis AF2122/97
gaacgcacucaucgccggaccgg

SEQ ID NO: 1043781 - RNA, 15 nt, Mycobacterium bovis subsp bovis AF2122/97
gaacgcagccagcgc

SEQ ID NO: 1043782 - RNA, 18 nt, Mycobacterium bovis subsp bovis AF2122/97
gaacgcagccagcgccau

SEQ ID NO: 1043783 - RNA, 17 nt, Mycobacterium bovis subsp bovis AF2122/97
gaacgcuuuccggcggu

SEQ ID NO: 1043784 - RNA, 17 nt, Mycobacterium bovis subsp bovis AF2122/97
gaacggcucggccggag

SEQ ID NO: 1043785 - RNA, 23 nt, Mycobacterium bovis subsp bovis AF2122/97
gaacggcucgggaacuucgccga

SEQ ID NO: 1043786 - RNA, 14 nt, Mycobacterium bovis subsp bovis AF2122/97
gaacggcgucgaau

SEQ ID NO: 1043787 - RNA, 17 nt, Mycobacterium bovis subsp bovis AF2122/97
gaacggcgcgggccacc

SEQ ID NO: 1043788 - RNA, 16 nt, Mycobacterium bovis subsp bovis AF2122/97
gaacgcugcccaacgg

SEQ ID NO: 1043789 - RNA, 20 nt, Mycobacterium bovis subsp bovis AF2122/97
gaacgcuguaagcaugccgu

SEQ ID NO: 1043790 - RNA, 20 nt, Mycobacterium bovis subsp bovis AF2122/97
gaacgcuucaccucgucgac

SEQ ID NO: 1043791 - RNA, 20 nt, Mycobacterium bovis subsp bovis AF2122/97
gaacgcguugaccaucacgc

SEQ ID NO: 1043792 - RNA, 22 nt, Mycobacterium bovis subsp bovis AF2122/97
gaacgcuaggcgauccagacgg

SEQ ID NO: 1043793 - RNA, 14 nt, Mycobacterium bovis subsp bovis AF2122/97
gaacgcucgucgac

SEQ ID NO: 1043794 - RNA, 14 nt, Mycobacterium bovis subsp bovis AF2122/97
gaacgcugacgccc

SEQ ID NO: 1043795 - RNA, 14 nt, Mycobacterium bovis subsp bovis AF2122/97
gaacguagcgccca

SEQ ID NO: 1043796 - RNA, 17 nt, Mycobacterium bovis subsp bovis AF2122/97
gaacgggucggcgacca

SEQ ID NO: 1043797 - RNA, 19 nt, Mycobacterium bovis subsp bovis AF2122/97
gaacgggucgggacgcugc

SEQ ID NO: 1043798 - RNA, 20 nt, Mycobacterium bovis subsp bovis AF2122/97
gaacgggucguugccggaca

SEQ ID NO: 1043799 - RNA, 21 nt, Mycobacterium bovis subsp bovis AF2122/97
gaacgggaucgacccgcccau

SEQ ID NO: 1043800 - RNA, 21 nt, Mycobacterium bovis subsp bovis AF2122/97
gaacgaguuugauuucgcacg

SEQ ID NO: 1043801 - RNA, 23 nt, Mycobacterium bovis subsp bovis AF2122/97
gaacgaguagccggucggcacca

SEQ ID NO: 1043802 - RNA, 22 nt, Mycobacterium bovis subsp bovis AF2122/97
gaacgaucccgccgaucgaacc

SEQ ID NO: 1043803 - RNA, 19 nt, Mycobacterium bovis subsp bovis AF2122/97
gaacgaucggaccaccagg

SEQ ID NO: 1043804 - RNA, 15 nt, Mycobacterium bovis subsp bovis AF2122/97
gaacgaugccgccgg

SEQ ID NO: 1043805 - RNA, 16 nt, Mycobacterium bovis subsp bovis AF2122/97
gaacgaugccgccggc

SEQ ID NO: 1043806 - RNA, 15 nt, Mycobacterium bovis subsp bovis AF2122/97
gaacgcaagcagcgc

SEQ ID NO: 1043807 - RNA, 18 nt, Mycobacterium bovis subsp bovis AF2122/97
gaacgauguccgcgcgaa

SEQ ID NO: 1043808 - RNA, 13 nt, Mycobacterium bovis subsp bovis AF2122/97
gaacgcaccgaaa

SEQ ID NO: 1043809 - RNA, 15 nt, Mycobacterium bovis subsp bovis AF2122/97
gaacgagcggccgcg

SEQ ID NO: 1043810 - RNA, 15 nt, Mycobacterium bovis subsp bovis AF2122/97
gaacgacucgacgua

SEQ ID NO: 1043811 - RNA, 17 nt, Mycobacterium bovis subsp bovis AF2122/97
gaaacgguacgccgccg

SEQ ID NO: 1043812 - RNA, 18 nt, Mycobacterium bovis subsp bovis AF2122/97
gaaacgguacgccgccgc

SEQ ID NO: 1043813 - RNA, 14 nt, Mycobacterium bovis subsp bovis AF2122/97
gaacgacucgacgu

SEQ ID NO: 1043814 - RNA, 21 nt, Mycobacterium bovis subsp bovis AF2122/97
gaaacggaccuccucgcccau

SEQ ID NO: 1043815 - RNA, 16 nt, Mycobacterium bovis subsp bovis AF2122/97
gaaacggaccuccucg

SEQ ID NO: 1043816 - RNA, 14 nt, Mycobacterium bovis subsp bovis AF2122/97
gaaacgccgucgcc

SEQ ID NO: 1043817 - RNA, 16 nt, Mycobacterium bovis subsp bovis AF2122/97
gaaacgccgagcgcca

SEQ ID NO: 1043818 - RNA, 13 nt, Mycobacterium bovis subsp bovis AF2122/97
gaaacgccaccgu

SEQ ID NO: 1043819 - RNA, 18 nt, Mycobacterium bovis subsp bovis AF2122/97
gaaacgccauacgucgcc

SEQ ID NO: 1043820 - RNA, 21 nt, Mycobacterium bovis subsp bovis AF2122/97
gaagcgggcuugagcgccgau

SEQ ID NO: 1043821 - RNA, 20 nt, Mycobacterium bovis subsp bovis AF2122/97
gaagcgggcuugagcgccga

SEQ ID NO: 1043822 - RNA, 21 nt, Mycobacterium bovis subsp bovis AF2122/97
gaagcggcugcugcgcggugc

SEQ ID NO: 1043823 - RNA, 19 nt, Mycobacterium bovis subsp bovis AF2122/97
gaagcggccaccgccgccg

SEQ ID NO: 1043824 - RNA, 15 nt, Mycobacterium bovis subsp bovis AF2122/97
gaagcggaccagcga

SEQ ID NO: 1043825 - RNA, 23 nt, Mycobacterium bovis subsp bovis AF2122/97
gaagcggacccgacagccgcugc

SEQ ID NO: 1043826 - RNA, 18 nt, Mycobacterium bovis subsp bovis AF2122/97
gaagcgcgguuucggcga

SEQ ID NO: 1043827 - RNA, 17 nt, Mycobacterium bovis subsp bovis AF2122/97
gaagcgcguccaaccaa

SEQ ID NO: 1043828 - RNA, 17 nt, Mycobacterium bovis subsp bovis AF2122/97
gaagcgcucggcagccg

SEQ ID NO: 1043829 - RNA, 15 nt, Mycobacterium bovis subsp bovis AF2122/97
gaagcgucgggucgc

SEQ ID NO: 1043830 - RNA, 14 nt, Mycobacterium bovis subsp bovis AF2122/97
gaagcgucguugcu

SEQ ID NO: 1043831 - RNA, 17 nt, Mycobacterium bovis subsp bovis AF2122/97
gaagcgucguugcucgg

SEQ ID NO: 1043832 - RNA, 21 nt, Mycobacterium bovis subsp bovis AF2122/97
gaagcgucuggucagccgcgg

SEQ ID NO: 1043833 - RNA, 16 nt, Mycobacterium bovis subsp bovis AF2122/97
gaagcgugcggucguu

SEQ ID NO: 1043834 - RNA, 20 nt, Mycobacterium bovis subsp bovis AF2122/97
gaagcgucgcuucggcaccg

SEQ ID NO: 1043835 - RNA, 16 nt, Mycobacterium bovis subsp bovis AF2122/97
gaagcgguguugccgg

SEQ ID NO: 1043836 - RNA, 22 nt, Mycobacterium bovis subsp bovis AF2122/97
gaagcucaucaccggcgcaccg

SEQ ID NO: 1043837 - RNA, 15 nt, Mycobacterium bovis subsp bovis AF2122/97
gaagcugcccaaccg

SEQ ID NO: 1043838 - RNA, 15 nt, Mycobacterium bovis subsp bovis AF2122/97
gaagcugaccagaca

SEQ ID NO: 1043839 - RNA, 15 nt, Mycobacterium bovis subsp bovis AF2122/97
gaaggcggcgauacc

SEQ ID NO: 1043840 - RNA, 16 nt, Mycobacterium bovis subsp bovis AF2122/97
gaaggcggcuccaccg

SEQ ID NO: 1043841 - RNA, 17 nt, Mycobacterium bovis subsp bovis AF2122/97
gaaggcggccaggugca

SEQ ID NO: 1043842 - RNA, 13 nt, Mycobacterium bovis subsp bovis AF2122/97
gaaggcgacauca

SEQ ID NO: 1043843 - RNA, 22 nt, Mycobacterium bovis subsp bovis AF2122/97
gaaggcgacaucaccaccgacc

SEQ ID NO: 1043844 - RNA, 13 nt, Mycobacterium bovis subsp bovis AF2122/97
gaaggcgacccgc

SEQ ID NO: 1043845 - RNA, 16 nt, Mycobacterium bovis subsp bovis AF2122/97
gaaggcgauggcaccg

SEQ ID NO: 1043846 - RNA, 18 nt, Mycobacterium bovis subsp bovis AF2122/97
gaaggccccgccgguggc

SEQ ID NO: 1043847 - RNA, 23 nt, Mycobacterium bovis subsp bovis AF2122/97
gaaggagaucccccaggcgaaca

SEQ ID NO: 1043848 - RNA, 22 nt, Mycobacterium bovis subsp bovis AF2122/97
gaaggauuuggagcuuuuugcg

SEQ ID NO: 1043849 - RNA, 16 nt, Mycobacterium bovis subsp bovis AF2122/97
gaaggcaaacaccagc

SEQ ID NO: 1043850 - RNA, 20 nt, Mycobacterium bovis subsp bovis AF2122/97
gaaggcaaacaccagcccgg

SEQ ID NO: 1043851 - RNA, 19 nt, Mycobacterium bovis subsp bovis AF2122/97
gaaggcauugcccacaaag

SEQ ID NO: 1043852 - RNA, 23 nt, Mycobacterium bovis subsp bovis AF2122/97
gaaggcaccgaaaaacaccagcg

SEQ ID NO: 1043853 - RNA, 17 nt, Mycobacterium bovis subsp bovis AF2122/97
gaaggccagcgaaucgc

SEQ ID NO: 1043854 - RNA, 14 nt, Mycobacterium bovis subsp bovis AF2122/97
gaaggccagcgcgc

SEQ ID NO: 1043855 - RNA, 16 nt, Mycobacterium bovis subsp bovis AF2122/97
gaaggccagcgcgccc

SEQ ID NO: 1043856 - RNA, 19 nt, Mycobacterium bovis subsp bovis AF2122/97
gaaggccagcgcgcccgcg

SEQ ID NO: 1043857 - RNA, 15 nt, Mycobacterium bovis subsp bovis AF2122/97
gaagcuggccaccgc

SEQ ID NO: 1043858 - RNA, 17 nt, Mycobacterium bovis subsp bovis AF2122/97
gaagcuggccaccgcau

SEQ ID NO: 1043859 - RNA, 17 nt, Mycobacterium bovis subsp bovis AF2122/97
gaagcuguagaccuggc

SEQ ID NO: 1043860 - RNA, 20 nt, Mycobacterium bovis subsp bovis AF2122/97
gaagcugugccuucgccucg

SEQ ID NO: 1043861 - RNA, 15 nt, Mycobacterium bovis subsp bovis AF2122/97
gaaggaccgcucguc

SEQ ID NO: 1043862 - RNA, 20 nt, Mycobacterium bovis subsp bovis AF2122/97
gaagccgacgauccacggcg

SEQ ID NO: 1043863 - RNA, 23 nt, Mycobacterium bovis subsp bovis AF2122/97
gaagccgauguccgacgccaccg

SEQ ID NO: 1043864 - RNA, 14 nt, Mycobacterium bovis subsp bovis AF2122/97
gaagccgcaccgcu

SEQ ID NO: 1043865 - RNA, 13 nt, Mycobacterium bovis subsp bovis AF2122/97
gaagccgcccgag

SEQ ID NO: 1043866 - RNA, 11 nt, Mycobacterium bovis subsp bovis AF2122/97
gaagccgccgg

SEQ ID NO: 1043867 - RNA, 14 nt, Mycobacterium bovis subsp bovis AF2122/97
gaagccgcgcugcg

SEQ ID NO: 1043868 - RNA, 22 nt, Mycobacterium bovis subsp bovis AF2122/97
gaagccggccgggaaccucgcg

SEQ ID NO: 1043869 - RNA, 14 nt, Mycobacterium bovis subsp bovis AF2122/97
gaagccggcgccgg

SEQ ID NO: 1043870 - RNA, 16 nt, Mycobacterium bovis subsp bovis AF2122/97
gaagccggcgcucgca

SEQ ID NO: 1043871 - RNA, 16 nt, Mycobacterium bovis subsp bovis AF2122/97
gaagccguuugcgcug

SEQ ID NO: 1043872 - RNA, 23 nt, Mycobacterium bovis subsp bovis AF2122/97
gaagccucggcaugcagccccac

SEQ ID NO: 1043873 - RNA, 17 nt, Mycobacterium bovis subsp bovis AF2122/97
gaagcgcaaugcgcgac

SEQ ID NO: 1043874 - RNA, 21 nt, Mycobacterium bovis subsp bovis AF2122/97
gaagcgauccggcugcgggaa

SEQ ID NO: 1043875 - RNA, 22 nt, Mycobacterium bovis subsp bovis AF2122/97
gaagcgaugagggugcucguca

SEQ ID NO: 1043876 - RNA, 17 nt, Mycobacterium bovis subsp bovis AF2122/97
gaagccuugcagcgccc

SEQ ID NO: 1043877 - RNA, 13 nt, Mycobacterium bovis subsp bovis AF2122/97
gaagcgaccgucg

SEQ ID NO: 1043878 - RNA, 12 nt, Mycobacterium bovis subsp bovis AF2122/97
gaagccgacguu

SEQ ID NO: 1043879 - RNA, 15 nt, Mycobacterium bovis subsp bovis AF2122/97
gaagccgagaccacg

SEQ ID NO: 1043880 - RNA, 22 nt, Mycobacterium bovis subsp bovis AF2122/97
gaagccgaaggggaacgcgccc

SEQ ID NO: 1043881 - RNA, 20 nt, Mycobacterium bovis subsp bovis AF2122/97
gaagccgacauugcugcucg

SEQ ID NO: 1043882 - RNA, 18 nt, Mycobacterium bovis subsp bovis AF2122/97
gaagccgaccaccgccgg

SEQ ID NO: 1043883 - RNA, 16 nt, Mycobacterium bovis subsp bovis AF2122/97
gaagcccggccacagg

SEQ ID NO: 1043884 - RNA, 19 nt, Mycobacterium bovis subsp bovis AF2122/97
gaagcccccaaaccggcgg

SEQ ID NO: 1043885 - RNA, 19 nt, Mycobacterium bovis subsp bovis AF2122/97
gaagccccccgagcugugg

SEQ ID NO: 1043886 - RNA, 20 nt, Mycobacterium bovis subsp bovis AF2122/97
gaagcccccgacguugcugg

SEQ ID NO: 1043887 - RNA, 22 nt, Mycobacterium bovis subsp bovis AF2122/97
gaagcccccgacguugcuggcu

SEQ ID NO: 1043888 - RNA, 18 nt, Mycobacterium bovis subsp bovis AF2122/97
gaagcaugauuggcucgg

SEQ ID NO: 1043889 - RNA, 13 nt, Mycobacterium bovis subsp bovis AF2122/97
gaagccaccaggu

SEQ ID NO: 1043890 - RNA, 16 nt, Mycobacterium bovis subsp bovis AF2122/97
gaagccaaaugcgcug

SEQ ID NO: 1043891 - RNA, 12 nt, Mycobacterium bovis subsp bovis AF2122/97
gaagccagcgca

SEQ ID NO: 1043892 - RNA, 13 nt, Mycobacterium bovis subsp bovis AF2122/97
gaagaugcccuuc

SEQ ID NO: 1043893 - RNA, 23 nt, Mycobacterium bovis subsp bovis AF2122/97
gaagaugcccuucgucggcauga

SEQ ID NO: 1043894 - RNA, 19 nt, Mycobacterium bovis subsp bovis AF2122/97
gaagaugccuggaaucgcg

SEQ ID NO: 1043895 - RNA, 22 nt, Mycobacterium bovis subsp bovis AF2122/97
gaagauggccagcgcggcgucg

SEQ ID NO: 1043896 - RNA, 20 nt, Mycobacterium bovis subsp bovis AF2122/97
gaagaugucgucaccguggg

SEQ ID NO: 1043897 - RNA, 14 nt, Mycobacterium bovis subsp bovis AF2122/97
gaagcacgucgucg

SEQ ID NO: 1043898 - RNA, 18 nt, Mycobacterium bovis subsp bovis AF2122/97
gacauugacgaggcgagc

SEQ ID NO: 1043899 - RNA, 15 nt, Mycobacterium bovis subsp bovis AF2122/97
gacauuuccaccacg

SEQ ID NO: 1043900 - RNA, 22 nt, Mycobacterium bovis subsp bovis AF2122/97
gaccaacacgucgagcagccgc

SEQ ID NO: 1043901 - RNA, 21 nt, Mycobacterium bovis subsp bovis AF2122/97
gaccaacauguugucgucgcc

SEQ ID NO: 1043902 - RNA, 13 nt, Mycobacterium bovis subsp bovis AF2122/97
gaccaacccggcu

SEQ ID NO: 1043903 - RNA, 14 nt, Mycobacterium bovis subsp bovis AF2122/97
gaccaacccggcuc

SEQ ID NO: 1043904 - RNA, 16 nt, Mycobacterium bovis subsp bovis AF2122/97
gaccaacccucgccgg

SEQ ID NO: 1043905 - RNA, 16 nt, Mycobacterium bovis subsp bovis AF2122/97
gaccaacggugcucgu

SEQ ID NO: 1043906 - RNA, 23 nt, Mycobacterium bovis subsp bovis AF2122/97
gaccaacgucgacuucagcggcc

SEQ ID NO: 1043907 - RNA, 16 nt, Mycobacterium bovis subsp bovis AF2122/97
gaccaacgucgcuccg

SEQ ID NO: 1043908 - RNA, 22 nt, Mycobacterium bovis subsp bovis AF2122/97
gaccaagucaugcccacgcugc

SEQ ID NO: 1043909 - RNA, 22 nt, Mycobacterium bovis subsp bovis AF2122/97
gaccaaguccggucgcggcggu

SEQ ID NO: 1043910 - RNA, 20 nt, Mycobacterium bovis subsp bovis AF2122/97
gaccaagugucgccgcucgg

SEQ ID NO: 1043911 - RNA, 17 nt, Mycobacterium bovis subsp bovis AF2122/97
gacaucguugacccggc

SEQ ID NO: 1043912 - RNA, 14 nt, Mycobacterium bovis subsp bovis AF2122/97
gacaucggccggcg

SEQ ID NO: 1043913 - RNA, 17 nt, Mycobacterium bovis subsp bovis AF2122/97
gacaucgucaucagcgc

SEQ ID NO: 1043914 - RNA, 14 nt, Mycobacterium bovis subsp bovis AF2122/97
gacaucgucgacga

SEQ ID NO: 1043915 - RNA, 16 nt, Mycobacterium bovis subsp bovis AF2122/97
gacaugacagccccgc

SEQ ID NO: 1043916 - RNA, 19 nt, Mycobacterium bovis subsp bovis AF2122/97
gacaugagcgccacgccga

SEQ ID NO: 1043917 - RNA, 20 nt, Mycobacterium bovis subsp bovis AF2122/97
gacaugagcgccacgccgag

SEQ ID NO: 1043918 - RNA, 17 nt, Mycobacterium bovis subsp bovis AF2122/97
gacaugucaggccguca

SEQ ID NO: 1043919 - RNA, 15 nt, Mycobacterium bovis subsp bovis AF2122/97
gacaugucgcugccg

SEQ ID NO: 1043920 - RNA, 19 nt, Mycobacterium bovis subsp bovis AF2122/97
gacaugucgcugccgccgc

SEQ ID NO: 1043921 - RNA, 17 nt, Mycobacterium bovis subsp bovis AF2122/97
gacagcuuucuuggcgg

SEQ ID NO: 1043922 - RNA, 19 nt, Mycobacterium bovis subsp bovis AF2122/97
gacagcuuucuuggcgggc

SEQ ID NO: 1043923 - RNA, 14 nt, Mycobacterium bovis subsp bovis AF2122/97
gacaggacgucggc

SEQ ID NO: 1043924 - RNA, 16 nt, Mycobacterium bovis subsp bovis AF2122/97
gacaggacgucggcga

SEQ ID NO: 1043925 - RNA, 14 nt, Mycobacterium bovis subsp bovis AF2122/97
gacagccguggcgc

SEQ ID NO: 1043926 - RNA, 15 nt, Mycobacterium bovis subsp bovis AF2122/97
gacagccguggcgcg

SEQ ID NO: 1043927 - RNA, 19 nt, Mycobacterium bovis subsp bovis AF2122/97
gacagcgggcuaaugcgac

SEQ ID NO: 1043928 - RNA, 15 nt, Mycobacterium bovis subsp bovis AF2122/97
gacagccccgccgcc

SEQ ID NO: 1043929 - RNA, 16 nt, Mycobacterium bovis subsp bovis AF2122/97
gacagccccgccgccc

SEQ ID NO: 1043930 - RNA, 14 nt, Mycobacterium bovis subsp bovis AF2122/97
gacagccccgcggc

SEQ ID NO: 1043931 - RNA, 18 nt, Mycobacterium bovis subsp bovis AF2122/97
gacagcccgaacgaggcg

SEQ ID NO: 1043932 - RNA, 20 nt, Mycobacterium bovis subsp bovis AF2122/97
gacagccccaucaccaccgg

SEQ ID NO: 1043933 - RNA, 16 nt, Mycobacterium bovis subsp bovis AF2122/97
gacagcccgccggcgu

SEQ ID NO: 1043934 - RNA, 18 nt, Mycobacterium bovis subsp bovis AF2122/97
gacagcccgccggcgugu

SEQ ID NO: 1043935 - RNA, 15 nt, Mycobacterium bovis subsp bovis AF2122/97
gacaucaccaccgcc

SEQ ID NO: 1043936 - RNA, 13 nt, Mycobacterium bovis subsp bovis AF2122/97
gacauaugacggg

SEQ ID NO: 1043937 - RNA, 18 nt, Mycobacterium bovis subsp bovis AF2122/97
gacaucaccaccgaccug

SEQ ID NO: 1043938 - RNA, 16 nt, Mycobacterium bovis subsp bovis AF2122/97
gacaucgguggcccgg

SEQ ID NO: 1043939 - RNA, 21 nt, Mycobacterium bovis subsp bovis AF2122/97
gacaucgguggcggccuccga

SEQ ID NO: 1043940 - RNA, 15 nt, Mycobacterium bovis subsp bovis AF2122/97
gacaucgggccgccg

SEQ ID NO: 1043941 - RNA, 16 nt, Mycobacterium bovis subsp bovis AF2122/97
gacaucgggccgccga

SEQ ID NO: 1043942 - RNA, 18 nt, Mycobacterium bovis subsp bovis AF2122/97
gacaucgggccgccgagc

SEQ ID NO: 1043943 - RNA, 17 nt, Mycobacterium bovis subsp bovis AF2122/97
gacaucgggcggcaccg

SEQ ID NO: 1043944 - RNA, 17 nt, Mycobacterium bovis subsp bovis AF2122/97
gacaucaccgaccaacg

SEQ ID NO: 1043945 - RNA, 12 nt, Mycobacterium bovis subsp bovis AF2122/97
gacaucaccgaa

SEQ ID NO: 1043946 - RNA, 13 nt, Mycobacterium bovis subsp bovis AF2122/97
gacaucaccgaac

SEQ ID NO: 1043947 - RNA, 16 nt, Mycobacterium bovis subsp bovis AF2122/97
gacaguugcgccagcg

SEQ ID NO: 1043948 - RNA, 17 nt, Mycobacterium bovis subsp bovis AF2122/97
gacaguuggcagcgcug

SEQ ID NO: 1043949 - RNA, 16 nt, Mycobacterium bovis subsp bovis AF2122/97
gacaguuuucaccgcg

SEQ ID NO: 1043950 - RNA, 18 nt, Mycobacterium bovis subsp bovis AF2122/97
gacaguuuucaccgcgaa

SEQ ID NO: 1043951 - RNA, 19 nt, Mycobacterium bovis subsp bovis AF2122/97
gacauacagcgggcgcugu

SEQ ID NO: 1043952 - RNA, 21 nt, Mycobacterium bovis subsp bovis AF2122/97
gacagugugaagaccaccgcc

SEQ ID NO: 1043953 - RNA, 17 nt, Mycobacterium bovis subsp bovis AF2122/97
gacaguuacgcuggcac

SEQ ID NO: 1043954 - RNA, 23 nt, Mycobacterium bovis subsp bovis AF2122/97
gacagugcugccuugggaccgcg

SEQ ID NO: 1043955 - RNA, 17 nt, Mycobacterium bovis subsp bovis AF2122/97
gacagccccaucaccac

SEQ ID NO: 1043956 - RNA, 12 nt, Mycobacterium bovis subsp bovis AF2122/97
gacagccaccgc

SEQ ID NO: 1043957 - RNA, 14 nt, Mycobacterium bovis subsp bovis AF2122/97
gacagccaccucga

SEQ ID NO: 1043958 - RNA, 17 nt, Mycobacterium bovis subsp bovis AF2122/97
gacagccaccucgacgg

SEQ ID NO: 1043959 - RNA, 13 nt, Mycobacterium bovis subsp bovis AF2122/97
gacagccacgcac

SEQ ID NO: 1043960 - RNA, 16 nt, Mycobacterium bovis subsp bovis AF2122/97
gacagccacgcacaau

SEQ ID NO: 1043961 - RNA, 19 nt, Mycobacterium bovis subsp bovis AF2122/97
gacagauagacuagccgau

SEQ ID NO: 1043962 - RNA, 17 nt, Mycobacterium bovis subsp bovis AF2122/97
gacagaucaacgcgaac

SEQ ID NO: 1043963 - RNA, 16 nt, Mycobacterium bovis subsp bovis AF2122/97
gacagauggcggccga

SEQ ID NO: 1043964 - RNA, 21 nt, Mycobacterium bovis subsp bovis AF2122/97
gacagaccgggcccggcgaac

SEQ ID NO: 1043965 - RNA, 19 nt, Mycobacterium bovis subsp bovis AF2122/97
gacagagcggguucgacgu

SEQ ID NO: 1043966 - RNA, 19 nt, Mycobacterium bovis subsp bovis AF2122/97
gacagacaucgcgacgauc

SEQ ID NO: 1043967 - RNA, 16 nt, Mycobacterium bovis subsp bovis AF2122/97
gacagacacagcaccg

SEQ ID NO: 1043968 - RNA, 18 nt, Mycobacterium bovis subsp bovis AF2122/97
gacagacagcaccgccgg

SEQ ID NO: 1043969 - RNA, 19 nt, Mycobacterium bovis subsp bovis AF2122/97
gacagacagcaccgccggu

SEQ ID NO: 1043970 - RNA, 15 nt, Mycobacterium bovis subsp bovis AF2122/97
gacacguuggcggau

SEQ ID NO: 1043971 - RNA, 24 nt, Mycobacterium bovis subsp bovis AF2122/97
gacacguugacccaucucgucguc

SEQ ID NO: 1043972 - RNA, 17 nt, Mycobacterium bovis subsp bovis AF2122/97
gacacgucuaucggcga

SEQ ID NO: 1043973 - RNA, 23 nt, Mycobacterium bovis subsp bovis AF2122/97
gacacguugacccaucucgucgu

SEQ ID NO: 1043974 - RNA, 22 nt, Mycobacterium bovis subsp bovis AF2122/97
gacacguuguucaccgacgcga

SEQ ID NO: 1043975 - RNA, 23 nt, Mycobacterium bovis subsp bovis AF2122/97
gacacguuucacguggucggcau

SEQ ID NO: 1043976 - RNA, 14 nt, Mycobacterium bovis subsp bovis AF2122/97
gacacuggccgucg

SEQ ID NO: 1043977 - RNA, 15 nt, Mycobacterium bovis subsp bovis AF2122/97
gacacuggccgucgg

SEQ ID NO: 1043978 - RNA, 17 nt, Mycobacterium bovis subsp bovis AF2122/97
gacacuggccgucggcg

SEQ ID NO: 1043979 - RNA, 19 nt, Mycobacterium bovis subsp bovis AF2122/97
gacacuggggugcugcgcg

SEQ ID NO: 1043980 - RNA, 20 nt, Mycobacterium bovis subsp bovis AF2122/97
gacacuggggugcugcgcgc

SEQ ID NO: 1043981 - RNA, 19 nt, Mycobacterium bovis subsp bovis AF2122/97
gacacuggucgcggcgcug

SEQ ID NO: 1043982 - RNA, 18 nt, Mycobacterium bovis subsp bovis AF2122/97
gacacugugcgccugcgu

SEQ ID NO: 1043983 - RNA, 22 nt, Mycobacterium bovis subsp bovis AF2122/97
gacacggccauccguaucacgg

SEQ ID NO: 1043984 - RNA, 22 nt, Mycobacterium bovis subsp bovis AF2122/97
gacacgucgcgccaggcgcgau

SEQ ID NO: 1043985 - RNA, 13 nt, Mycobacterium bovis subsp bovis AF2122/97
gacacgccgaacg

SEQ ID NO: 1043986 - RNA, 20 nt, Mycobacterium bovis subsp bovis AF2122/97
gacacgcugcaggcggccga

SEQ ID NO: 1043987 - RNA, 14 nt, Mycobacterium bovis subsp bovis AF2122/97
gacaccggccugcg

SEQ ID NO: 1043988 - RNA, 15 nt, Mycobacterium bovis subsp bovis AF2122/97
gacaccggccugcgc

SEQ ID NO: 1043989 - RNA, 20 nt, Mycobacterium bovis subsp bovis AF2122/97
gacaccggccugcgcgaccg

SEQ ID NO: 1043990 - RNA, 12 nt, Mycobacterium bovis subsp bovis AF2122/97
gacaccggcggc

SEQ ID NO: 1043991 - RNA, 19 nt, Mycobacterium bovis subsp bovis AF2122/97
gacaccggccgcgacggau

SEQ ID NO: 1043992 - RNA, 15 nt, Mycobacterium bovis subsp bovis AF2122/97
gacaccggcggcauc

SEQ ID NO: 1043993 - RNA, 16 nt, Mycobacterium bovis subsp bovis AF2122/97
gacaccggcggcaucg

SEQ ID NO: 1043994 - RNA, 22 nt, Mycobacterium bovis subsp bovis AF2122/97
gacaccggugcgaccaacacgg

SEQ ID NO: 1043995 - RNA, 23 nt, Mycobacterium bovis subsp bovis AF2122/97
gacaccggcuauaucccgccccg

SEQ ID NO: 1043996 - RNA, 17 nt, Mycobacterium bovis subsp bovis AF2122/97
gacaccgucaugccguu

SEQ ID NO: 1043997 - RNA, 13 nt, Mycobacterium bovis subsp bovis AF2122/97
gacaccgugaccg

SEQ ID NO: 1043998 - RNA, 17 nt, Mycobacterium bovis subsp bovis AF2122/97
gacaccgugaccgccgc

SEQ ID NO: 1043999 - RNA, 18 nt, Mycobacterium bovis subsp bovis AF2122/97
gacaccgugucgccggcg

SEQ ID NO: 1044000 - RNA, 15 nt, Mycobacterium bovis subsp bovis AF2122/97
gacaccuaccgagau

SEQ ID NO: 1044001 - RNA, 22 nt, Mycobacterium bovis subsp bovis AF2122/97
gacaccugcugcaccgucagcc

SEQ ID NO: 1044002 - RNA, 21 nt, Mycobacterium bovis subsp bovis AF2122/97
gacaccuugcguccguagcga

SEQ ID NO: 1044003 - RNA, 22 nt, Mycobacterium bovis subsp bovis AF2122/97
gacaccuccgucagcgccgcgc

SEQ ID NO: 1044004 - RNA, 23 nt, Mycobacterium bovis subsp bovis AF2122/97
gacaccuccgucagcgccgcgcg

SEQ ID NO: 1044005 - RNA, 20 nt, Mycobacterium bovis subsp bovis AF2122/97
gacaccgugaccgccgcgcc

SEQ ID NO: 1044006 - RNA, 20 nt, Mycobacterium bovis subsp bovis AF2122/97
gacaccguggaucggcagcc

SEQ ID NO: 1044007 - RNA, 23 nt, Mycobacterium bovis subsp bovis AF2122/97
gacaccguggaucggcagcccgg

SEQ ID NO: 1044008 - RNA, 17 nt, Mycobacterium bovis subsp bovis AF2122/97
gacacgaugcccggcau

SEQ ID NO: 1044009 - RNA, 13 nt, Mycobacterium bovis subsp bovis AF2122/97
gacacgaucaguc

SEQ ID NO: 1044010 - RNA, 18 nt, Mycobacterium bovis subsp bovis AF2122/97
gacacgaucgcgucggcu

SEQ ID NO: 1044011 - RNA, 13 nt, Mycobacterium bovis subsp bovis AF2122/97
gacaccggccacc

SEQ ID NO: 1044012 - RNA, 14 nt, Mycobacterium bovis subsp bovis AF2122/97
gacaccggccacca

SEQ ID NO: 1044013 - RNA, 15 nt, Mycobacterium bovis subsp bovis AF2122/97
gacaccggccaccag

SEQ ID NO: 1044014 - RNA, 14 nt, Mycobacterium bovis subsp bovis AF2122/97
gacaccggccgcga

SEQ ID NO: 1044015 - RNA, 15 nt, Mycobacterium bovis subsp bovis AF2122/97
gacaccggccgcgac

SEQ ID NO: 1044016 - RNA, 13 nt, Mycobacterium bovis subsp bovis AF2122/97
gacaccgcuugug

SEQ ID NO: 1044017 - RNA, 19 nt, Mycobacterium bovis subsp bovis AF2122/97
gacaccgcggcgaucugcg

SEQ ID NO: 1044018 - RNA, 16 nt, Mycobacterium bovis subsp bovis AF2122/97
gacaccgcggugcccc

SEQ ID NO: 1044019 - RNA, 18 nt, Mycobacterium bovis subsp bovis AF2122/97
gacaacagagucaccgcg

SEQ ID NO: 1044020 - RNA, 18 nt, Mycobacterium bovis subsp bovis AF2122/97
gacaacccgcucggcggu

SEQ ID NO: 1044021 - RNA, 21 nt, Mycobacterium bovis subsp bovis AF2122/97
gacaacaucgaaucagcucgc

SEQ ID NO: 1044022 - RNA, 17 nt, Mycobacterium bovis subsp bovis AF2122/97
gacaacagccgcucgca

SEQ ID NO: 1044023 - RNA, 14 nt, Mycobacterium bovis subsp bovis AF2122/97
gacaacacggcgaa

SEQ ID NO: 1044024 - RNA, 16 nt, Mycobacterium bovis subsp bovis AF2122/97
gacaacacgccgucga

SEQ ID NO: 1044025 - RNA, 23 nt, Mycobacterium bovis subsp bovis AF2122/97
gacaaacggcgacccagcgguau

SEQ ID NO: 1044026 - RNA, 21 nt, Mycobacterium bovis subsp bovis AF2122/97
gacaaagaaguggucggcccg

SEQ ID NO: 1044027 - RNA, 16 nt, Mycobacterium bovis subsp bovis AF2122/97
gacaaagccgucgcga

SEQ ID NO: 1044028 - RNA, 19 nt, Mycobacterium bovis subsp bovis AF2122/97
gacaaaucgaugaccgucg

SEQ ID NO: 1044029 - RNA, 17 nt, Mycobacterium bovis subsp bovis AF2122/97
gacaaaucggucgacga

SEQ ID NO: 1044030 - RNA, 22 nt, Mycobacterium bovis subsp bovis AF2122/97
gaagguccgugccgaugccggc

SEQ ID NO: 1044031 - RNA, 23 nt, Mycobacterium bovis subsp bovis AF2122/97
gaaggucgaaucgcugccgccga

SEQ ID NO: 1044032 - RNA, 16 nt, Mycobacterium bovis subsp bovis AF2122/97
gaaggucagcagggcc

SEQ ID NO: 1044033 - RNA, 22 nt, Mycobacterium bovis subsp bovis AF2122/97
gaaggucagcgacuugcggugc

SEQ ID NO: 1044034 - RNA, 19 nt, Mycobacterium bovis subsp bovis AF2122/97
gaaggggcucagcgguggc

SEQ ID NO: 1044035 - RNA, 17 nt, Mycobacterium bovis subsp bovis AF2122/97
gaagggcuugucgccgg

SEQ ID NO: 1044036 - RNA, 19 nt, Mycobacterium bovis subsp bovis AF2122/97
gaagggcuaucguggcggc

SEQ ID NO: 1044037 - RNA, 16 nt, Mycobacterium bovis subsp bovis AF2122/97
gaaggcguucgacucg

SEQ ID NO: 1044038 - RNA, 20 nt, Mycobacterium bovis subsp bovis AF2122/97
gaaggcguucgacucgaccg

SEQ ID NO: 1044039 - RNA, 20 nt, Mycobacterium bovis subsp bovis AF2122/97
gaaggucucgaaagccgcgg

SEQ ID NO: 1044040 - RNA, 18 nt, Mycobacterium bovis subsp bovis AF2122/97
gaagguggcgaacccggu

SEQ ID NO: 1044041 - RNA, 16 nt, Mycobacterium bovis subsp bovis AF2122/97
gaaggugcugcgcggg

SEQ ID NO: 1044042 - RNA, 22 nt, Mycobacterium bovis subsp bovis AF2122/97
gaaggugaccaggcggacgccg

SEQ ID NO: 1044043 - RNA, 12 nt, Mycobacterium bovis subsp bovis AF2122/97
gaaggugacgac

SEQ ID NO: 1044044 - RNA, 14 nt, Mycobacterium bovis subsp bovis AF2122/97
gaaguacacggcgg

SEQ ID NO: 1044045 - RNA, 15 nt, Mycobacterium bovis subsp bovis AF2122/97
gaaguacacggcggc

SEQ ID NO: 1044046 - RNA, 20 nt, Mycobacterium bovis subsp bovis AF2122/97
gaaggugguggcguuggcga

SEQ ID NO: 1044047 - RNA, 20 nt, Mycobacterium bovis subsp bovis AF2122/97
gaagguucgaucgcggugac

SEQ ID NO: 1044048 - RNA, 19 nt, Mycobacterium bovis subsp bovis AF2122/97
gaagucgucgaggucacgc

SEQ ID NO: 1044049 - RNA, 15 nt, Mycobacterium bovis subsp bovis AF2122/97
gaagucgucggccau

SEQ ID NO: 1044050 - RNA, 20 nt, Mycobacterium bovis subsp bovis AF2122/97
gaagucccgggcaccgucgg

SEQ ID NO: 1044051 - RNA, 16 nt, Mycobacterium bovis subsp bovis AF2122/97
gaaguccagcuggccg

SEQ ID NO: 1044052 - RNA, 19 nt, Mycobacterium bovis subsp bovis AF2122/97
gaaguccagcuggccgggu

SEQ ID NO: 1044053 - RNA, 21 nt, Mycobacterium bovis subsp bovis AF2122/97
gaaguagccgacgucgccgga

SEQ ID NO: 1044054 - RNA, 14 nt, Mycobacterium bovis subsp bovis AF2122/97
gaaguagucggcgc

SEQ ID NO: 1044055 - RNA, 19 nt, Mycobacterium bovis subsp bovis AF2122/97
gaaguggaucuggcgcagc

SEQ ID NO: 1044056 - RNA, 22 nt, Mycobacterium bovis subsp bovis AF2122/97
gaagugggcguuggcggcaagg

SEQ ID NO: 1044057 - RNA, 17 nt, Mycobacterium bovis subsp bovis AF2122/97
gaaguggugaccgacgc

SEQ ID NO: 1044058 - RNA, 20 nt, Mycobacterium bovis subsp bovis AF2122/97
gaagugcggugagauggcgg

SEQ ID NO: 1044059 - RNA, 15 nt, Mycobacterium bovis subsp bovis AF2122/97
gaagugcacugcgaa

SEQ ID NO: 1044060 - RNA, 13 nt, Mycobacterium bovis subsp bovis AF2122/97
gaagucucgcggc

SEQ ID NO: 1044061 - RNA, 20 nt, Mycobacterium bovis subsp bovis AF2122/97
gaagugaaagacaguggcgc

SEQ ID NO: 1044062 - RNA, 14 nt, Mycobacterium bovis subsp bovis AF2122/97
gaagucgaucgccg

SEQ ID NO: 1044063 - RNA, 16 nt, Mycobacterium bovis subsp bovis AF2122/97
gaagucguugcgcggu

SEQ ID NO: 1044064 - RNA, 17 nt, Mycobacterium bovis subsp bovis AF2122/97
gaaguucgggcaacggc

SEQ ID NO: 1044065 - RNA, 14 nt, Mycobacterium bovis subsp bovis AF2122/97
gaaguucucggugc

SEQ ID NO: 1044066 - RNA, 23 nt, Mycobacterium bovis subsp bovis AF2122/97
gaagugugauuccgggucggcga

SEQ ID NO: 1044067 - RNA, 18 nt, Mycobacterium bovis subsp bovis AF2122/97
gaaguuggcugagcagcg

SEQ ID NO: 1044068 - RNA, 20 nt, Mycobacterium bovis subsp bovis AF2122/97
gaaguugggaagugcgguga

SEQ ID NO: 1044069 - RNA, 18 nt, Mycobacterium bovis subsp bovis AF2122/97
gaaucgguuucgaccugc

SEQ ID NO: 1044070 - RNA, 14 nt, Mycobacterium bovis subsp bovis AF2122/97
gaaucgguucggcc

SEQ ID NO: 1044071 - RNA, 14 nt, Mycobacterium bovis subsp bovis AF2122/97
gaaucggcucagca

SEQ ID NO: 1044072 - RNA, 17 nt, Mycobacterium bovis subsp bovis AF2122/97
gaaucgccuaccggccu

SEQ ID NO: 1044073 - RNA, 21 nt, Mycobacterium bovis subsp bovis AF2122/97
gaaucgcgucgagcgccggcc

SEQ ID NO: 1044074 - RNA, 16 nt, Mycobacterium bovis subsp bovis AF2122/97
gaaucgacuccggaug

SEQ ID NO: 1044075 - RNA, 14 nt, Mycobacterium bovis subsp bovis AF2122/97
gaaucgagacggcc

SEQ ID NO: 1044076 - RNA, 16 nt, Mycobacterium bovis subsp bovis AF2122/97
gaaucgagacggccac

SEQ ID NO: 1044077 - RNA, 22 nt, Mycobacterium bovis subsp bovis AF2122/97
gaaucgagacgguagccaagcg

SEQ ID NO: 1044078 - RNA, 14 nt, Mycobacterium bovis subsp bovis AF2122/97
gaaucgagcaccgc

SEQ ID NO: 1044079 - RNA, 16 nt, Mycobacterium bovis subsp bovis AF2122/97
gaaucgcacgacgcga

SEQ ID NO: 1044080 - RNA, 17 nt, Mycobacterium bovis subsp bovis AF2122/97
gaaucgcacgacgcgac

SEQ ID NO: 1044081 - RNA, 14 nt, Mycobacterium bovis subsp bovis AF2122/97
gaaucgacaccgcc

SEQ ID NO: 1044082 - RNA, 19 nt, Mycobacterium bovis subsp bovis AF2122/97
gaaucgacaccgcccgacc

SEQ ID NO: 1044083 - RNA, 16 nt, Mycobacterium bovis subsp bovis AF2122/97
gaaucgaccgccgcua

SEQ ID NO: 1044084 - RNA, 23 nt, Mycobacterium bovis subsp bovis AF2122/97
gaaguuggugacauagaccucgc

SEQ ID NO: 1044085 - RNA, 17 nt, Mycobacterium bovis subsp bovis AF2122/97
gaauauggcggccgggu

SEQ ID NO: 1044086 - RNA, 23 nt, Mycobacterium bovis subsp bovis AF2122/97
gaauucggcgucguggcuuccgg

SEQ ID NO: 1044087 - RNA, 15 nt, Mycobacterium bovis subsp bovis AF2122/97
gaauugcguucgccg

SEQ ID NO: 1044088 - RNA, 13 nt, Mycobacterium bovis subsp bovis AF2122/97
gaauugcgcgccc

SEQ ID NO: 1044089 - RNA, 20 nt, Mycobacterium bovis subsp bovis AF2122/97
gaauugccgggcgcacgccc

SEQ ID NO: 1044090 - RNA, 14 nt, Mycobacterium bovis subsp bovis AF2122/97
gaauucaugccggu

SEQ ID NO: 1044091 - RNA, 13 nt, Mycobacterium bovis subsp bovis AF2122/97
gaauucggcgucg

SEQ ID NO: 1044092 - RNA, 14 nt, Mycobacterium bovis subsp bovis AF2122/97
gaauucggcgucgu

SEQ ID NO: 1044093 - RNA, 16 nt, Mycobacterium bovis subsp bovis AF2122/97
gaauguugccgccgcg

SEQ ID NO: 1044094 - RNA, 18 nt, Mycobacterium bovis subsp bovis AF2122/97
gaauguugguuugccggc

SEQ ID NO: 1044095 - RNA, 23 nt, Mycobacterium bovis subsp bovis AF2122/97
gaauuacgcaccgaggccgccga

SEQ ID NO: 1044096 - RNA, 18 nt, Mycobacterium bovis subsp bovis AF2122/97
gaaugcgggucugcgguc

SEQ ID NO: 1044097 - RNA, 19 nt, Mycobacterium bovis subsp bovis AF2122/97
gaaugccauaaccgguggg

SEQ ID NO: 1044098 - RNA, 22 nt, Mycobacterium bovis subsp bovis AF2122/97
gaaugcauuggcggugcgcacc

SEQ ID NO: 1044099 - RNA, 15 nt, Mycobacterium bovis subsp bovis AF2122/97
gaaugaucggcgucc

SEQ ID NO: 1044100 - RNA, 19 nt, Mycobacterium bovis subsp bovis AF2122/97
gaaugaucguuccgauccg

SEQ ID NO: 1044101 - RNA, 20 nt, Mycobacterium bovis subsp bovis AF2122/97
gaaugaucguuccgauccgg

SEQ ID NO: 1044102 - RNA, 17 nt, Mycobacterium bovis subsp bovis AF2122/97
gaaugccuggcccgucg

SEQ ID NO: 1044103 - RNA, 12 nt, Mycobacterium bovis subsp bovis AF2122/97
gaaugccgccga

SEQ ID NO: 1044104 - RNA, 15 nt, Mycobacterium bovis subsp bovis AF2122/97
gaaugccgccgacgg

SEQ ID NO: 1044105 - RNA, 12 nt, Mycobacterium bovis subsp bovis AF2122/97
gaaugccgcggg

SEQ ID NO: 1044106 - RNA, 20 nt, Mycobacterium bovis subsp bovis AF2122/97
gaaugccgcggggaucagcg

SEQ ID NO: 1044107 - RNA, 19 nt, Mycobacterium bovis subsp bovis AF2122/97
gaggacgccggcgccgcca

SEQ ID NO: 1044108 - RNA, 21 nt, Mycobacterium bovis subsp bovis AF2122/97
gaggacgccggcgccgccauu

SEQ ID NO: 1044109 - RNA, 16 nt, Mycobacterium bovis subsp bovis AF2122/97
gaggaccugcucgggc

SEQ ID NO: 1044110 - RNA, 22 nt, Mycobacterium bovis subsp bovis AF2122/97
gaggaccagaggcgcuucgcca

SEQ ID NO: 1044111 - RNA, 20 nt, Mycobacterium bovis subsp bovis AF2122/97
gaggacccgugcacgaucgc

SEQ ID NO: 1044112 - RNA, 12 nt, Mycobacterium bovis subsp bovis AF2122/97
gaggacuugcac

SEQ ID NO: 1044113 - RNA, 13 nt, Mycobacterium bovis subsp bovis AF2122/97
gaggacgcugauc

SEQ ID NO: 1044114 - RNA, 18 nt, Mycobacterium bovis subsp bovis AF2122/97
gaggagaugccgacgaac

SEQ ID NO: 1044115 - RNA, 19 nt, Mycobacterium bovis subsp bovis AF2122/97
gaggacuugcacgucggcu

SEQ ID NO: 1044116 - RNA, 17 nt, Mycobacterium bovis subsp bovis AF2122/97
gaggaagaucaccuccc

SEQ ID NO: 1044117 - RNA, 22 nt, Mycobacterium bovis subsp bovis AF2122/97
gaggaagccguuggcgacguug

SEQ ID NO: 1044118 - RNA, 13 nt, Mycobacterium bovis subsp bovis AF2122/97
gaggaaguccagc

SEQ ID NO: 1044119 - RNA, 22 nt, Mycobacterium bovis subsp bovis AF2122/97
gaggaaggucgaaucgcugccg

SEQ ID NO: 1044120 - RNA, 23 nt, Mycobacterium bovis subsp bovis AF2122/97
gaggaauacagcuugaucgccga

SEQ ID NO: 1044121 - RNA, 15 nt, Mycobacterium bovis subsp bovis AF2122/97
gaggaaucguucggg

SEQ ID NO: 1044122 - RNA, 16 nt, Mycobacterium bovis subsp bovis AF2122/97
gaggaauucgaucugg

SEQ ID NO: 1044123 - RNA, 18 nt, Mycobacterium bovis subsp bovis AF2122/97
gaggauguugugccgauc

SEQ ID NO: 1044124 - RNA, 14 nt, Mycobacterium bovis subsp bovis AF2122/97
gaggaucucggcgu

SEQ ID NO: 1044125 - RNA, 14 nt, Mycobacterium bovis subsp bovis AF2122/97
gaggaugccgaacc

SEQ ID NO: 1044126 - RNA, 19 nt, Mycobacterium bovis subsp bovis AF2122/97
gaggaucgcguccgccucg

SEQ ID NO: 1044127 - RNA, 21 nt, Mycobacterium bovis subsp bovis AF2122/97
gaggaucauguccaucgcgcg

SEQ ID NO: 1044128 - RNA, 17 nt, Mycobacterium bovis subsp bovis AF2122/97
gaggaucccgcugcacg

SEQ ID NO: 1044129 - RNA, 17 nt, Mycobacterium bovis subsp bovis AF2122/97
gaggauccgcaccacgc

SEQ ID NO: 1044130 - RNA, 19 nt, Mycobacterium bovis subsp bovis AF2122/97
gaggauccgcaccacgccc

SEQ ID NO: 1044131 - RNA, 19 nt, Mycobacterium bovis subsp bovis AF2122/97
gaggauccgcugcggcccg

SEQ ID NO: 1044132 - RNA, 19 nt, Mycobacterium bovis subsp bovis AF2122/97
gaggaggcuuacaugcccu

SEQ ID NO: 1044133 - RNA, 22 nt, Mycobacterium bovis subsp bovis AF2122/97
gaggauauggaucaacgcacgg

SEQ ID NO: 1044134 - RNA, 12 nt, Mycobacterium bovis subsp bovis AF2122/97
gagcugcucgcc

SEQ ID NO: 1044135 - RNA, 15 nt, Mycobacterium bovis subsp bovis AF2122/97
gagcuggaccuccga

SEQ ID NO: 1044136 - RNA, 13 nt, Mycobacterium bovis subsp bovis AF2122/97
gagcugcucgccg

SEQ ID NO: 1044137 - RNA, 18 nt, Mycobacterium bovis subsp bovis AF2122/97
gagcuggcaacgccgcgc

SEQ ID NO: 1044138 - RNA, 13 nt, Mycobacterium bovis subsp bovis AF2122/97
gagcuggcagcuc

SEQ ID NO: 1044139 - RNA, 16 nt, Mycobacterium bovis subsp bovis AF2122/97
gagcugcggcggccau

SEQ ID NO: 1044140 - RNA, 21 nt, Mycobacterium bovis subsp bovis AF2122/97
gagcugccgagcggucaacga

SEQ ID NO: 1044141 - RNA, 15 nt, Mycobacterium bovis subsp bovis AF2122/97
gagcugccaacgccc

SEQ ID NO: 1044142 - RNA, 20 nt, Mycobacterium bovis subsp bovis AF2122/97
gagcuggccgucagcgucgg

SEQ ID NO: 1044143 - RNA, 14 nt, Mycobacterium bovis subsp bovis AF2122/97
gagcuggcgcgcgg

SEQ ID NO: 1044144 - RNA, 15 nt, Mycobacterium bovis subsp bovis AF2122/97
gagcuggcgaccugg

SEQ ID NO: 1044145 - RNA, 14 nt, Mycobacterium bovis subsp bovis AF2122/97
gagcuucgccgcgc

SEQ ID NO: 1044146 - RNA, 14 nt, Mycobacterium bovis subsp bovis AF2122/97
gagcuugccgucgc

SEQ ID NO: 1044147 - RNA, 15 nt, Mycobacterium bovis subsp bovis AF2122/97
gagcuuggcccagcg

SEQ ID NO: 1044148 - RNA, 16 nt, Mycobacterium bovis subsp bovis AF2122/97
gagcugguugacggcg

SEQ ID NO: 1044149 - RNA, 16 nt, Mycobacterium bovis subsp bovis AF2122/97
gagcuuccacgccgga

SEQ ID NO: 1044150 - RNA, 14 nt, Mycobacterium bovis subsp bovis AF2122/97
gagcuuggccgccg

SEQ ID NO: 1044151 - RNA, 23 nt, Mycobacterium bovis subsp bovis AF2122/97
gaggaaauacuuuggaugcccgu

SEQ ID NO: 1044152 - RNA, 17 nt, Mycobacterium bovis subsp bovis AF2122/97
gaggaaagucaccgucc

SEQ ID NO: 1044153 - RNA, 20 nt, Mycobacterium bovis subsp bovis AF2122/97
gagcuuuuugcgucuguucg

SEQ ID NO: 1044154 - RNA, 15 nt, Mycobacterium bovis subsp bovis AF2122/97
gagcuuggucgccau

SEQ ID NO: 1044155 - RNA, 13 nt, Mycobacterium bovis subsp bovis AF2122/97
gagcuuggucgcc

SEQ ID NO: 1044156 - RNA, 15 nt, Mycobacterium bovis subsp bovis AF2122/97
gagcuuggucgccgg

SEQ ID NO: 1044157 - RNA, 14 nt, Mycobacterium bovis subsp bovis AF2122/97
gagggggacgcuga

SEQ ID NO: 1044158 - RNA, 23 nt, Mycobacterium bovis subsp bovis AF2122/97
gagggcuguugacgccacgacgc

SEQ ID NO: 1044159 - RNA, 20 nt, Mycobacterium bovis subsp bovis AF2122/97
gagggcuuuagugucugcuc

SEQ ID NO: 1044160 - RNA, 21 nt, Mycobacterium bovis subsp bovis AF2122/97
gagggcuuuagugucugcucg

SEQ ID NO: 1044161 - RNA, 22 nt, Mycobacterium bovis subsp bovis AF2122/97
gaggcuuucgauauagccgccg

SEQ ID NO: 1044162 - RNA, 19 nt, Mycobacterium bovis subsp bovis AF2122/97
gaggggacccagcggcggu

SEQ ID NO: 1044163 - RNA, 17 nt, Mycobacterium bovis subsp bovis AF2122/97
gagggcuaccggcgccg

SEQ ID NO: 1044164 - RNA, 23 nt, Mycobacterium bovis subsp bovis AF2122/97
gagggcuaccggcgccgcgcggc

SEQ ID NO: 1044165 - RNA, 18 nt, Mycobacterium bovis subsp bovis AF2122/97
gaggcuuacaugcccugc

SEQ ID NO: 1044166 - RNA, 17 nt, Mycobacterium bovis subsp bovis AF2122/97
gaggcugccgaaguuga

SEQ ID NO: 1044167 - RNA, 15 nt, Mycobacterium bovis subsp bovis AF2122/97
gaggcuggcaucccg

SEQ ID NO: 1044168 - RNA, 17 nt, Mycobacterium bovis subsp bovis AF2122/97
gaggcugaccguggcgc

SEQ ID NO: 1044169 - RNA, 20 nt, Mycobacterium bovis subsp bovis AF2122/97
gaggcucguggcgacggcgu

SEQ ID NO: 1044170 - RNA, 16 nt, Mycobacterium bovis subsp bovis AF2122/97
gaggcuccuggucgcc

SEQ ID NO: 1044171 - RNA, 18 nt, Mycobacterium bovis subsp bovis AF2122/97
gaggcuccuggucgccgu

SEQ ID NO: 1044172 - RNA, 16 nt, Mycobacterium bovis subsp bovis AF2122/97
gaggcgagcggccagu

SEQ ID NO: 1044173 - RNA, 15 nt, Mycobacterium bovis subsp bovis AF2122/97
gaggcgaccccggcc

SEQ ID NO: 1044174 - RNA, 14 nt, Mycobacterium bovis subsp bovis AF2122/97
gaggcgaucaccgc

SEQ ID NO: 1044175 - RNA, 20 nt, Mycobacterium bovis subsp bovis AF2122/97
gaggcgcaagaaugccgccg

SEQ ID NO: 1044176 - RNA, 15 nt, Mycobacterium bovis subsp bovis AF2122/97
gaggcguucaccacg

SEQ ID NO: 1044177 - RNA, 21 nt, Mycobacterium bovis subsp bovis AF2122/97
gaggccuaccaggcgcggccc

SEQ ID NO: 1044178 - RNA, 16 nt, Mycobacterium bovis subsp bovis AF2122/97
gaggcacaaucaccgc

SEQ ID NO: 1044179 - RNA, 12 nt, Mycobacterium bovis subsp bovis AF2122/97
gaggcaaccagg

SEQ ID NO: 1044180 - RNA, 17 nt, Mycobacterium bovis subsp bovis AF2122/97
gaggcaauccgaucugg

SEQ ID NO: 1044181 - RNA, 17 nt, Mycobacterium bovis subsp bovis AF2122/97
gaggcgaaaaacaccua

SEQ ID NO: 1044182 - RNA, 16 nt, Mycobacterium bovis subsp bovis AF2122/97
gaggccuucgccgacu

SEQ ID NO: 1044183 - RNA, 19 nt, Mycobacterium bovis subsp bovis AF2122/97
gaggcgaccacgucggcga

SEQ ID NO: 1044184 - RNA, 21 nt, Mycobacterium bovis subsp bovis AF2122/97
gaguacggccugccgcucgcc

SEQ ID NO: 1044185 - RNA, 18 nt, Mycobacterium bovis subsp bovis AF2122/97
gaguagccgcagcugagc

SEQ ID NO: 1044186 - RNA, 15 nt, Mycobacterium bovis subsp bovis AF2122/97
gaguagccggucggc

SEQ ID NO: 1044187 - RNA, 19 nt, Mycobacterium bovis subsp bovis AF2122/97
gaguagccguagccgccgu

SEQ ID NO: 1044188 - RNA, 15 nt, Mycobacterium bovis subsp bovis AF2122/97
gaguacaaaccucgg

SEQ ID NO: 1044189 - RNA, 20 nt, Mycobacterium bovis subsp bovis AF2122/97
gaguaccagcccaccggcgc

SEQ ID NO: 1044190 - RNA, 20 nt, Mycobacterium bovis subsp bovis AF2122/97
gagucacccggccguugggc

SEQ ID NO: 1044191 - RNA, 15 nt, Mycobacterium bovis subsp bovis AF2122/97
gaguagucgcuggcc

SEQ ID NO: 1044192 - RNA, 22 nt, Mycobacterium bovis subsp bovis AF2122/97
gaguagugcggugucacaacgc

SEQ ID NO: 1044193 - RNA, 21 nt, Mycobacterium bovis subsp bovis AF2122/97
gaguaguucgucgacgucggc

SEQ ID NO: 1044194 - RNA, 19 nt, Mycobacterium bovis subsp bovis AF2122/97
gaguagaucccaccaccgg

SEQ ID NO: 1044195 - RNA, 17 nt, Mycobacterium bovis subsp bovis AF2122/97
gaggguaccaggcgccg

SEQ ID NO: 1044196 - RNA, 20 nt, Mycobacterium bovis subsp bovis AF2122/97
gagggucccacggcgguugc

SEQ ID NO: 1044197 - RNA, 15 nt, Mycobacterium bovis subsp bovis AF2122/97
gaggggguggucgaa

SEQ ID NO: 1044198 - RNA, 23 nt, Mycobacterium bovis subsp bovis AF2122/97
gagggucaugucgaucagcgcga

SEQ ID NO: 1044199 - RNA, 17 nt, Mycobacterium bovis subsp bovis AF2122/97
gaggucgccaacccgau

SEQ ID NO: 1044200 - RNA, 14 nt, Mycobacterium bovis subsp bovis AF2122/97
gagguacacgccga

SEQ ID NO: 1044201 - RNA, 12 nt, Mycobacterium bovis subsp bovis AF2122/97
gagggugucgcc

SEQ ID NO: 1044202 - RNA, 14 nt, Mycobacterium bovis subsp bovis AF2122/97
gaggucggcggcgc

SEQ ID NO: 1044203 - RNA, 19 nt, Mycobacterium bovis subsp bovis AF2122/97
gaggucgccgcaucggcgg

SEQ ID NO: 1044204 - RNA, 22 nt, Mycobacterium bovis subsp bovis AF2122/97
gaggucgguucggccggagccg

SEQ ID NO: 1044205 - RNA, 20 nt, Mycobacterium bovis subsp bovis AF2122/97
gaggucuuugcucucggucu

SEQ ID NO: 1044206 - RNA, 19 nt, Mycobacterium bovis subsp bovis AF2122/97
gaggucguugaugucggua

SEQ ID NO: 1044207 - RNA, 17 nt, Mycobacterium bovis subsp bovis AF2122/97
gaucacaccccaggcac

SEQ ID NO: 1044208 - RNA, 13 nt, Mycobacterium bovis subsp bovis AF2122/97
gaucaacgugcgc

SEQ ID NO: 1044209 - RNA, 14 nt, Mycobacterium bovis subsp bovis AF2122/97
gaucaacgcgucgc

SEQ ID NO: 1044210 - RNA, 22 nt, Mycobacterium bovis subsp bovis AF2122/97
gaucaagcgcacaaacgacucg

SEQ ID NO: 1044211 - RNA, 20 nt, Mycobacterium bovis subsp bovis AF2122/97
gaucaacucgggcagcgcgg

SEQ ID NO: 1044212 - RNA, 22 nt, Mycobacterium bovis subsp bovis AF2122/97
gaucaacucgggcagcgcggcc

SEQ ID NO: 1044213 - RNA, 18 nt, Mycobacterium bovis subsp bovis AF2122/97
gaucaacucgugcgggca

SEQ ID NO: 1044214 - RNA, 19 nt, Mycobacterium bovis subsp bovis AF2122/97
gaucaacuuccgcagcgcc

SEQ ID NO: 1044215 - RNA, 17 nt, Mycobacterium bovis subsp bovis AF2122/97
gaucaccagucgcugau

SEQ ID NO: 1044216 - RNA, 22 nt, Mycobacterium bovis subsp bovis AF2122/97
gaucaccauccagcccaucccg

SEQ ID NO: 1044217 - RNA, 13 nt, Mycobacterium bovis subsp bovis AF2122/97
gaucaccaucgcc

SEQ ID NO: 1044218 - RNA, 15 nt, Mycobacterium bovis subsp bovis AF2122/97
gaucaccaucgccgc

SEQ ID NO: 1044219 - RNA, 21 nt, Mycobacterium bovis subsp bovis AF2122/97
gaucaccaucgccgccgcgcg

SEQ ID NO: 1044220 - RNA, 15 nt, Mycobacterium bovis subsp bovis AF2122/97
gaucaccaugaucag

SEQ ID NO: 1044221 - RNA, 14 nt, Mycobacterium bovis subsp bovis AF2122/97
gaucacccacucga

SEQ ID NO: 1044222 - RNA, 16 nt, Mycobacterium bovis subsp bovis AF2122/97
gaucacccacucgacg

SEQ ID NO: 1044223 - RNA, 17 nt, Mycobacterium bovis subsp bovis AF2122/97
gaucacccacucgacgu

SEQ ID NO: 1044224 - RNA, 14 nt, Mycobacterium bovis subsp bovis AF2122/97
gaucacacuggccu

SEQ ID NO: 1044225 - RNA, 14 nt, Mycobacterium bovis subsp bovis AF2122/97
gaucaccaccggca

SEQ ID NO: 1044226 - RNA, 17 nt, Mycobacterium bovis subsp bovis AF2122/97
gaucaccaccggcagau

SEQ ID NO: 1044227 - RNA, 17 nt, Mycobacterium bovis subsp bovis AF2122/97
gauaucgggagcggcug

SEQ ID NO: 1044228 - RNA, 16 nt, Mycobacterium bovis subsp bovis AF2122/97
gauaucgggcucagcg

SEQ ID NO: 1044229 - RNA, 20 nt, Mycobacterium bovis subsp bovis AF2122/97
gauaucgggcucagcggcga

SEQ ID NO: 1044230 - RNA, 23 nt, Mycobacterium bovis subsp bovis AF2122/97
gauaucgggcucagcggcgaccg

SEQ ID NO: 1044231 - RNA, 18 nt, Mycobacterium bovis subsp bovis AF2122/97
gauauccuuugccgccga

SEQ ID NO: 1044232 - RNA, 15 nt, Mycobacterium bovis subsp bovis AF2122/97
gauaucgcccggaac

SEQ ID NO: 1044233 - RNA, 21 nt, Mycobacterium bovis subsp bovis AF2122/97
gauaucguuggcgaccaccgc

SEQ ID NO: 1044234 - RNA, 23 nt, Mycobacterium bovis subsp bovis AF2122/97
gaucaacaccaacgacagcgacg

SEQ ID NO: 1044235 - RNA, 18 nt, Mycobacterium bovis subsp bovis AF2122/97
gaucaacaggccggcucg

SEQ ID NO: 1044236 - RNA, 12 nt, Mycobacterium bovis subsp bovis AF2122/97
gaucaacccggc

SEQ ID NO: 1044237 - RNA, 17 nt, Mycobacterium bovis subsp bovis AF2122/97
gaucaacccgguccagc

SEQ ID NO: 1044238 - RNA, 13 nt, Mycobacterium bovis subsp bovis AF2122/97
gaucaaccggguc

SEQ ID NO: 1044239 - RNA, 15 nt, Mycobacterium bovis subsp bovis AF2122/97
gaucaaaccggcggc

SEQ ID NO: 1044240 - RNA, 21 nt, Mycobacterium bovis subsp bovis AF2122/97
gaucaaaaaccacgcgucgcu

SEQ ID NO: 1044241 - RNA, 15 nt, Mycobacterium bovis subsp bovis AF2122/97
gauagcggucgguca

SEQ ID NO: 1044242 - RNA, 23 nt, Mycobacterium bovis subsp bovis AF2122/97
gauagcggucggucaccauggcg

SEQ ID NO: 1044243 - RNA, 16 nt, Mycobacterium bovis subsp bovis AF2122/97
gauagcggugccguca

SEQ ID NO: 1044244 - RNA, 19 nt, Mycobacterium bovis subsp bovis AF2122/97
gauacgcgcaccguggcgg

SEQ ID NO: 1044245 - RNA, 23 nt, Mycobacterium bovis subsp bovis AF2122/97
gauaauggccgaguccggcaaga

SEQ ID NO: 1044246 - RNA, 15 nt, Mycobacterium bovis subsp bovis AF2122/97
gauacgggccaccgu

SEQ ID NO: 1044247 - RNA, 16 nt, Mycobacterium bovis subsp bovis AF2122/97
gauacgcgucgaucaa

SEQ ID NO: 1044248 - RNA, 14 nt, Mycobacterium bovis subsp bovis AF2122/97
gauagucggccggc

SEQ ID NO: 1044249 - RNA, 17 nt, Mycobacterium bovis subsp bovis AF2122/97
gauaucgaucggaucga

SEQ ID NO: 1044250 - RNA, 18 nt, Mycobacterium bovis subsp bovis AF2122/97
gauaucgaugcggcgacc

SEQ ID NO: 1044251 - RNA, 15 nt, Mycobacterium bovis subsp bovis AF2122/97
gauaggugcucgcga

SEQ ID NO: 1044252 - RNA, 21 nt, Mycobacterium bovis subsp bovis AF2122/97
gauaggccaaccgguucgucg

SEQ ID NO: 1044253 - RNA, 20 nt, Mycobacterium bovis subsp bovis AF2122/97
gauaggcccggucuugggcg

SEQ ID NO: 1044254 - RNA, 14 nt, Mycobacterium bovis subsp bovis AF2122/97
gauaggccgcgcgg

SEQ ID NO: 1044255 - RNA, 19 nt, Mycobacterium bovis subsp bovis AF2122/97
gaguucucgcugaucagca

SEQ ID NO: 1044256 - RNA, 17 nt, Mycobacterium bovis subsp bovis AF2122/97
gaguugaauggcgcuga

SEQ ID NO: 1044257 - RNA, 15 nt, Mycobacterium bovis subsp bovis AF2122/97
gaguugagcugucgc

SEQ ID NO: 1044258 - RNA, 14 nt, Mycobacterium bovis subsp bovis AF2122/97
gaguugcagucgcg

SEQ ID NO: 1044259 - RNA, 20 nt, Mycobacterium bovis subsp bovis AF2122/97
gaguugcagucgcgagguga

SEQ ID NO: 1044260 - RNA, 17 nt, Mycobacterium bovis subsp bovis AF2122/97
gauaacccagcggcgcc

SEQ ID NO: 1044261 - RNA, 15 nt, Mycobacterium bovis subsp bovis AF2122/97
gauaacccagcacca

SEQ ID NO: 1044262 - RNA, 22 nt, Mycobacterium bovis subsp bovis AF2122/97
gauaaccgcgaccagcuggccg

SEQ ID NO: 1044263 - RNA, 16 nt, Mycobacterium bovis subsp bovis AF2122/97
gauaacggcgaccgcc

SEQ ID NO: 1044264 - RNA, 19 nt, Mycobacterium bovis subsp bovis AF2122/97
gaguucggggugcgcccag

SEQ ID NO: 1044265 - RNA, 12 nt, Mycobacterium bovis subsp bovis AF2122/97
gaguucggugcu

SEQ ID NO: 1044266 - RNA, 17 nt, Mycobacterium bovis subsp bovis AF2122/97
gaguucgguugccccca

SEQ ID NO: 1044267 - RNA, 20 nt, Mycobacterium bovis subsp bovis AF2122/97
gaguucgguguagaucagca

SEQ ID NO: 1044268 - RNA, 23 nt, Mycobacterium bovis subsp bovis AF2122/97
gaguucgucaccguuggccgcgc

SEQ ID NO: 1044269 - RNA, 20 nt, Mycobacterium bovis subsp bovis AF2122/97
gaguugaagaagccgguguu

SEQ ID NO: 1044270 - RNA, 22 nt, Mycobacterium bovis subsp bovis AF2122/97
gaguugaagaaucccgggcucu

SEQ ID NO: 1044271 - RNA, 22 nt, Mycobacterium bovis subsp bovis AF2122/97
gaguucggcguagaugcgcccg

SEQ ID NO: 1044272 - RNA, 17 nt, Mycobacterium bovis subsp bovis AF2122/97
gaguucgggcugcggca

SEQ ID NO: 1044273 - RNA, 15 nt, Mycobacterium bovis subsp bovis AF2122/97
gagucgacggccagu

SEQ ID NO: 1044274 - RNA, 22 nt, Mycobacterium bovis subsp bovis AF2122/97
gaguucggcagcgggcuccccg

SEQ ID NO: 1044275 - RNA, 14 nt, Mycobacterium bovis subsp bovis AF2122/97
gaguucgcgcgccg

SEQ ID NO: 1044276 - RNA, 16 nt, Mycobacterium bovis subsp bovis AF2122/97
gaguucgcgcgccgcg

SEQ ID NO: 1044277 - RNA, 23 nt, Mycobacterium bovis subsp bovis AF2122/97
gaguccggcucauccgacgggau

SEQ ID NO: 1044278 - RNA, 21 nt, Mycobacterium bovis subsp bovis AF2122/97
gagucccgucacucaccccaa

SEQ ID NO: 1044279 - RNA, 18 nt, Mycobacterium bovis subsp bovis AF2122/97
gaguccaacucggccaac

SEQ ID NO: 1044280 - RNA, 22 nt, Mycobacterium bovis subsp bovis AF2122/97
gaguccacaaguaccgcaucga

SEQ ID NO: 1044281 - RNA, 17 nt, Mycobacterium bovis subsp bovis AF2122/97
gaguccaggccggcagc

SEQ ID NO: 1044282 - RNA, 19 nt, Mycobacterium bovis subsp bovis AF2122/97
gaguccaggcugaucccga

SEQ ID NO: 1044283 - RNA, 18 nt, Mycobacterium bovis subsp bovis AF2122/97
gaguccgguagcuguggu

SEQ ID NO: 1044284 - RNA, 17 nt, Mycobacterium bovis subsp bovis AF2122/97
gaguccuuaaacgucgu

SEQ ID NO: 1044285 - RNA, 17 nt, Mycobacterium bovis subsp bovis AF2122/97
gagucgaacaucaccgg

SEQ ID NO: 1044286 - RNA, 19 nt, Mycobacterium bovis subsp bovis AF2122/97
gagucccacgccagcgcga

SEQ ID NO: 1044287 - RNA, 18 nt, Mycobacterium bovis subsp bovis AF2122/97
gagucgaaaacagcgauc

SEQ ID NO: 1044288 - RNA, 14 nt, Mycobacterium bovis subsp bovis AF2122/97
gagucgaucagcuu

SEQ ID NO: 1044289 - RNA, 16 nt, Mycobacterium bovis subsp bovis AF2122/97
gauaaggaugcaucgc

SEQ ID NO: 1044290 - RNA, 21 nt, Mycobacterium bovis subsp bovis AF2122/97
gauaaucauccgagcgguggu

SEQ ID NO: 1044291 - RNA, 16 nt, Mycobacterium bovis subsp bovis AF2122/97
gauaaugaucucggca

SEQ ID NO: 1044292 - RNA, 16 nt, Mycobacterium bovis subsp bovis AF2122/97
gagccgcagcucgccg

SEQ ID NO: 1044293 - RNA, 16 nt, Mycobacterium bovis subsp bovis AF2122/97
gagccgcccaagccgc

SEQ ID NO: 1044294 - RNA, 12 nt, Mycobacterium bovis subsp bovis AF2122/97
gagccgccaggu

SEQ ID NO: 1044295 - RNA, 21 nt, Mycobacterium bovis subsp bovis AF2122/97
gagccgagccagcuccggcgc

SEQ ID NO: 1044296 - RNA, 21 nt, Mycobacterium bovis subsp bovis AF2122/97
gagccgaggaauacucucgcg

SEQ ID NO: 1044297 - RNA, 23 nt, Mycobacterium bovis subsp bovis AF2122/97
gagccgaggaauacucucgcgac

SEQ ID NO: 1044298 - RNA, 13 nt, Mycobacterium bovis subsp bovis AF2122/97
gagccgagccgau

SEQ ID NO: 1044299 - RNA, 18 nt, Mycobacterium bovis subsp bovis AF2122/97
gagccgcacaaacgggcg

SEQ ID NO: 1044300 - RNA, 19 nt, Mycobacterium bovis subsp bovis AF2122/97
gagccgauauaccagggca

SEQ ID NO: 1044301 - RNA, 11 nt, Mycobacterium bovis subsp bovis AF2122/97
gagccgccgga

SEQ ID NO: 1044302 - RNA, 12 nt, Mycobacterium bovis subsp bovis AF2122/97
gagccgccccgg

SEQ ID NO: 1044303 - RNA, 19 nt, Mycobacterium bovis subsp bovis AF2122/97
gagccgccguggaacacga

SEQ ID NO: 1044304 - RNA, 15 nt, Mycobacterium bovis subsp bovis AF2122/97
gagccgcggucggcg

SEQ ID NO: 1044305 - RNA, 14 nt, Mycobacterium bovis subsp bovis AF2122/97
gagccgcguucgcg

SEQ ID NO: 1044306 - RNA, 17 nt, Mycobacterium bovis subsp bovis AF2122/97
gagccgcuaggacggcg

SEQ ID NO: 1044307 - RNA, 19 nt, Mycobacterium bovis subsp bovis AF2122/97
gagccgccguugccgccgg

SEQ ID NO: 1044308 - RNA, 22 nt, Mycobacterium bovis subsp bovis AF2122/97
gagccgcuaggacggcgcgagc

SEQ ID NO: 1044309 - RNA, 14 nt, Mycobacterium bovis subsp bovis AF2122/97
gagccgcgcgccgg

SEQ ID NO: 1044310 - RNA, 16 nt, Mycobacterium bovis subsp bovis AF2122/97
gagccgcgcgccgguu

SEQ ID NO: 1044311 - RNA, 18 nt, Mycobacterium bovis subsp bovis AF2122/97
gagccgacgugcggcggc

SEQ ID NO: 1044312 - RNA, 15 nt, Mycobacterium bovis subsp bovis AF2122/97
gagccgaccggcggc

SEQ ID NO: 1044313 - RNA, 15 nt, Mycobacterium bovis subsp bovis AF2122/97
gagcccuccagggcc

SEQ ID NO: 1044314 - RNA, 13 nt, Mycobacterium bovis subsp bovis AF2122/97
gagcccgaucgcg

SEQ ID NO: 1044315 - RNA, 16 nt, Mycobacterium bovis subsp bovis AF2122/97
gagcccugcgccucgg

SEQ ID NO: 1044316 - RNA, 15 nt, Mycobacterium bovis subsp bovis AF2122/97
gagccgacaacgacg

SEQ ID NO: 1044317 - RNA, 13 nt, Mycobacterium bovis subsp bovis AF2122/97
gagcccgagcucg

SEQ ID NO: 1044318 - RNA, 16 nt, Mycobacterium bovis subsp bovis AF2122/97
gagcccgagcucgccg

SEQ ID NO: 1044319 - RNA, 12 nt, Mycobacterium bovis subsp bovis AF2122/97
gagcccgcugcg

SEQ ID NO: 1044320 - RNA, 16 nt, Mycobacterium bovis subsp bovis AF2122/97
gagcccgcugcgccgg

SEQ ID NO: 1044321 - RNA, 14 nt, Mycobacterium bovis subsp bovis AF2122/97
gagccccggcaagc

SEQ ID NO: 1044322 - RNA, 16 nt, Mycobacterium bovis subsp bovis AF2122/97
gagccccugucaacgc

SEQ ID NO: 1044323 - RNA, 13 nt, Mycobacterium bovis subsp bovis AF2122/97
gagcccgcaucgc

SEQ ID NO: 1044324 - RNA, 13 nt, Mycobacterium bovis subsp bovis AF2122/97
gagcccgccgggu

SEQ ID NO: 1044325 - RNA, 12 nt, Mycobacterium bovis subsp bovis AF2122/97
gagccggcgccg

SEQ ID NO: 1044326 - RNA, 13 nt, Mycobacterium bovis subsp bovis AF2122/97
gagccggcgccgg

SEQ ID NO: 1044327 - RNA, 15 nt, Mycobacterium bovis subsp bovis AF2122/97
gagccggcgccgggu

SEQ ID NO: 1044328 - RNA, 14 nt, Mycobacterium bovis subsp bovis AF2122/97
gagccggcgcgcaa

SEQ ID NO: 1044329 - RNA, 21 nt, Mycobacterium bovis subsp bovis AF2122/97
gagccggcgcgcaagugcugg

SEQ ID NO: 1044330 - RNA, 21 nt, Mycobacterium bovis subsp bovis AF2122/97
gagccggcccugcucgccguc

SEQ ID NO: 1044331 - RNA, 18 nt, Mycobacterium bovis subsp bovis AF2122/97
gagccgggaccauagucg

SEQ ID NO: 1044332 - RNA, 17 nt, Mycobacterium bovis subsp bovis AF2122/97
gagccgggcaaccagca

SEQ ID NO: 1044333 - RNA, 14 nt, Mycobacterium bovis subsp bovis AF2122/97
gagccgcugcggca

SEQ ID NO: 1044334 - RNA, 12 nt, Mycobacterium bovis subsp bovis AF2122/97
gagccggcaacc

SEQ ID NO: 1044335 - RNA, 18 nt, Mycobacterium bovis subsp bovis AF2122/97
gagccggcacgcgcgcuu

SEQ ID NO: 1044336 - RNA, 16 nt, Mycobacterium bovis subsp bovis AF2122/97
gagccggccaccucgg

SEQ ID NO: 1044337 - RNA, 22 nt, Mycobacterium bovis subsp bovis AF2122/97
gagccgcugcgacaaaucggcg

SEQ ID NO: 1044338 - RNA, 18 nt, Mycobacterium bovis subsp bovis AF2122/97
gagccgguggcccgccgg

SEQ ID NO: 1044339 - RNA, 19 nt, Mycobacterium bovis subsp bovis AF2122/97
gagccgguggcccgccggc

SEQ ID NO: 1044340 - RNA, 16 nt, Mycobacterium bovis subsp bovis AF2122/97
gagccggugccgacgg

SEQ ID NO: 1044341 - RNA, 19 nt, Mycobacterium bovis subsp bovis AF2122/97
gagccggugccgacggcgc

SEQ ID NO: 1044342 - RNA, 15 nt, Mycobacterium bovis subsp bovis AF2122/97
gagccggugccgcgg

SEQ ID NO: 1044343 - RNA, 16 nt, Mycobacterium bovis subsp bovis AF2122/97
gagccggugccgcggu

SEQ ID NO: 1044344 - RNA, 20 nt, Mycobacterium bovis subsp bovis AF2122/97
gagccggucuugcaucgcca

SEQ ID NO: 1044345 - RNA, 20 nt, Mycobacterium bovis subsp bovis AF2122/97
gagccggugauccggucgua

SEQ ID NO: 1044346 - RNA, 18 nt, Mycobacterium bovis subsp bovis AF2122/97
gagccgggcuggccgacu

SEQ ID NO: 1044347 - RNA, 22 nt, Mycobacterium bovis subsp bovis AF2122/97
gagccgggugcgagcgacaccg

SEQ ID NO: 1044348 - RNA, 18 nt, Mycobacterium bovis subsp bovis AF2122/97
gagccgguauacccggcc

SEQ ID NO: 1044349 - RNA, 16 nt, Mycobacterium bovis subsp bovis AF2122/97
gagccgugccgccagc

SEQ ID NO: 1044350 - RNA, 16 nt, Mycobacterium bovis subsp bovis AF2122/97
gagccgugcggucgcg

SEQ ID NO: 1044351 - RNA, 17 nt, Mycobacterium bovis subsp bovis AF2122/97
gagccgugcggucgcgc

SEQ ID NO: 1044352 - RNA, 22 nt, Mycobacterium bovis subsp bovis AF2122/97
gagccgugcuacccauucggcg

SEQ ID NO: 1044353 - RNA, 20 nt, Mycobacterium bovis subsp bovis AF2122/97
gagccgugucaaccggucgg

SEQ ID NO: 1044354 - RNA, 18 nt, Mycobacterium bovis subsp bovis AF2122/97
gagccuccagcgcaccgg

SEQ ID NO: 1044355 - RNA, 20 nt, Mycobacterium bovis subsp bovis AF2122/97
gagccucggccaucugcucg

SEQ ID NO: 1044356 - RNA, 18 nt, Mycobacterium bovis subsp bovis AF2122/97
gagccguccgaccaggga

SEQ ID NO: 1044357 - RNA, 17 nt, Mycobacterium bovis subsp bovis AF2122/97
gagccguagugucggcg

SEQ ID NO: 1044358 - RNA, 19 nt, Mycobacterium bovis subsp bovis AF2122/97
gagccguagugucggcguc

SEQ ID NO: 1044359 - RNA, 16 nt, Mycobacterium bovis subsp bovis AF2122/97
gagccgucaccgacug

SEQ ID NO: 1044360 - RNA, 17 nt, Mycobacterium bovis subsp bovis AF2122/97
gagccgucacgccggau

SEQ ID NO: 1044361 - RNA, 19 nt, Mycobacterium bovis subsp bovis AF2122/97
gagcagguguugcacgagc

SEQ ID NO: 1044362 - RNA, 16 nt, Mycobacterium bovis subsp bovis AF2122/97
gagcagggccggcacc

SEQ ID NO: 1044363 - RNA, 19 nt, Mycobacterium bovis subsp bovis AF2122/97
gagcagggccggcaccgca

SEQ ID NO: 1044364 - RNA, 16 nt, Mycobacterium bovis subsp bovis AF2122/97
gagcagcgcggccaga

SEQ ID NO: 1044365 - RNA, 14 nt, Mycobacterium bovis subsp bovis AF2122/97
gagcagccgaaccg

SEQ ID NO: 1044366 - RNA, 22 nt, Mycobacterium bovis subsp bovis AF2122/97
gagcagccgaaccggcaccagc

SEQ ID NO: 1044367 - RNA, 18 nt, Mycobacterium bovis subsp bovis AF2122/97
gagcaggcgcaccaggcg

SEQ ID NO: 1044368 - RNA, 18 nt, Mycobacterium bovis subsp bovis AF2122/97
gagcagcccggcgaauac

SEQ ID NO: 1044369 - RNA, 22 nt, Mycobacterium bovis subsp bovis AF2122/97
gacgucgugaccggcgggaccg

SEQ ID NO: 1044370 - RNA, 13 nt, Mycobacterium bovis subsp bovis AF2122/97
gagcagcccgcgg

SEQ ID NO: 1044371 - RNA, 20 nt, Mycobacterium bovis subsp bovis AF2122/97
gacgucguucuuugucggga

SEQ ID NO: 1044372 - RNA, 14 nt, Mycobacterium bovis subsp bovis AF2122/97
gagcagcacgucga

SEQ ID NO: 1044373 - RNA, 14 nt, Mycobacterium bovis subsp bovis AF2122/97
gacgucugccaggc

SEQ ID NO: 1044374 - RNA, 15 nt, Mycobacterium bovis subsp bovis AF2122/97
gacgucguuacugga

SEQ ID NO: 1044375 - RNA, 19 nt, Mycobacterium bovis subsp bovis AF2122/97
gacgucgucgccgccgaaa

SEQ ID NO: 1044376 - RNA, 20 nt, Mycobacterium bovis subsp bovis AF2122/97
gacgucguagacaccuucga

SEQ ID NO: 1044377 - RNA, 16 nt, Mycobacterium bovis subsp bovis AF2122/97
gacgucggugaccucg

SEQ ID NO: 1044378 - RNA, 20 nt, Mycobacterium bovis subsp bovis AF2122/97
gacgucggugaccucggcga

SEQ ID NO: 1044379 - RNA, 16 nt, Mycobacterium bovis subsp bovis AF2122/97
gagccagcuugcgcaa

SEQ ID NO: 1044380 - RNA, 15 nt, Mycobacterium bovis subsp bovis AF2122/97
gagccaggacgacgc

SEQ ID NO: 1044381 - RNA, 17 nt, Mycobacterium bovis subsp bovis AF2122/97
gagccagaucggauugc

SEQ ID NO: 1044382 - RNA, 16 nt, Mycobacterium bovis subsp bovis AF2122/97
gagccacguucgcggc

SEQ ID NO: 1044383 - RNA, 16 nt, Mycobacterium bovis subsp bovis AF2122/97
gagccacucggcccgg

SEQ ID NO: 1044384 - RNA, 16 nt, Mycobacterium bovis subsp bovis AF2122/97
gagccacugcggcaug

SEQ ID NO: 1044385 - RNA, 23 nt, Mycobacterium bovis subsp bovis AF2122/97
gagccaccccggguacgccgggc

SEQ ID NO: 1044386 - RNA, 12 nt, Mycobacterium bovis subsp bovis AF2122/97
gagccaccggcg

SEQ ID NO: 1044387 - RNA, 13 nt, Mycobacterium bovis subsp bovis AF2122/97
gagccaccggcgu

SEQ ID NO: 1044388 - RNA, 21 nt, Mycobacterium bovis subsp bovis AF2122/97
gagccaccggcgucgacgucg

SEQ ID NO: 1044389 - RNA, 18 nt, Mycobacterium bovis subsp bovis AF2122/97
gagccacaaaggcgccgg

SEQ ID NO: 1044390 - RNA, 16 nt, Mycobacterium bovis subsp bovis AF2122/97
gagcccaguaagccac

SEQ ID NO: 1044391 - RNA, 13 nt, Mycobacterium bovis subsp bovis AF2122/97
gagccagcggcac

SEQ ID NO: 1044392 - RNA, 15 nt, Mycobacterium bovis subsp bovis AF2122/97
gagccaugccgcucg

SEQ ID NO: 1044393 - RNA, 18 nt, Mycobacterium bovis subsp bovis AF2122/97
gagccaugccgcucggca

SEQ ID NO: 1044394 - RNA, 16 nt, Mycobacterium bovis subsp bovis AF2122/97
gagcaugccgcccgcg

SEQ ID NO: 1044395 - RNA, 22 nt, Mycobacterium bovis subsp bovis AF2122/97
gagcaugccgcccgcgccgccg

SEQ ID NO: 1044396 - RNA, 17 nt, Mycobacterium bovis subsp bovis AF2122/97
gagcaugcgacgucagg

SEQ ID NO: 1044397 - RNA, 22 nt, Mycobacterium bovis subsp bovis AF2122/97
gagcaugcgauacacggcggcg

SEQ ID NO: 1044398 - RNA, 19 nt, Mycobacterium bovis subsp bovis AF2122/97
gagcaugcccagcgcacgg

SEQ ID NO: 1044399 - RNA, 18 nt, Mycobacterium bovis subsp bovis AF2122/97
gagccaaacuacccgccc

SEQ ID NO: 1044400 - RNA, 17 nt, Mycobacterium bovis subsp bovis AF2122/97
gagcauggcuagggcga

SEQ ID NO: 1044401 - RNA, 24 nt, Mycobacterium bovis subsp bovis AF2122/97
gagcauaccgccgcugccaugcgg

SEQ ID NO: 1044402 - RNA, 14 nt, Mycobacterium bovis subsp bovis AF2122/97
gagcagugccucgg

SEQ ID NO: 1044403 - RNA, 17 nt, Mycobacterium bovis subsp bovis AF2122/97
gagcagugccucggcga

SEQ ID NO: 1044404 - RNA, 16 nt, Mycobacterium bovis subsp bovis AF2122/97
gagcaguggccgccgg

SEQ ID NO: 1044405 - RNA, 17 nt, Mycobacterium bovis subsp bovis AF2122/97
gagcaguggccgccggg

SEQ ID NO: 1044406 - RNA, 18 nt, Mycobacterium bovis subsp bovis AF2122/97
gagcaguggccgccgggc

SEQ ID NO: 1044407 - RNA, 16 nt, Mycobacterium bovis subsp bovis AF2122/97
gagcaguuccagcucg

SEQ ID NO: 1044408 - RNA, 20 nt, Mycobacterium bovis subsp bovis AF2122/97
gagcagucgcaaaagccccc

SEQ ID NO: 1044409 - RNA, 13 nt, Mycobacterium bovis subsp bovis AF2122/97
gagcgcggcaacc

SEQ ID NO: 1044410 - RNA, 16 nt, Mycobacterium bovis subsp bovis AF2122/97
gagcgcgcuggccagc

SEQ ID NO: 1044411 - RNA, 14 nt, Mycobacterium bovis subsp bovis AF2122/97
gagcgcggccacca

SEQ ID NO: 1044412 - RNA, 19 nt, Mycobacterium bovis subsp bovis AF2122/97
gagcgcggguggcagcggc

SEQ ID NO: 1044413 - RNA, 13 nt, Mycobacterium bovis subsp bovis AF2122/97
gagcgcuucgucg

SEQ ID NO: 1044414 - RNA, 15 nt, Mycobacterium bovis subsp bovis AF2122/97
gagcgcuucgucgcc

SEQ ID NO: 1044415 - RNA, 15 nt, Mycobacterium bovis subsp bovis AF2122/97
gagcggaaaaucacc

SEQ ID NO: 1044416 - RNA, 20 nt, Mycobacterium bovis subsp bovis AF2122/97
gagcggacacauaagccccc

SEQ ID NO: 1044417 - RNA, 13 nt, Mycobacterium bovis subsp bovis AF2122/97
gagcggaccaccg

SEQ ID NO: 1044418 - RNA, 15 nt, Mycobacterium bovis subsp bovis AF2122/97
gagcggagccgccga

SEQ ID NO: 1044419 - RNA, 14 nt, Mycobacterium bovis subsp bovis AF2122/97
gagcgcugcucccg

SEQ ID NO: 1044420 - RNA, 23 nt, Mycobacterium bovis subsp bovis AF2122/97
gagcgcugcucccgaaaagcgcc

SEQ ID NO: 1044421 - RNA, 15 nt, Mycobacterium bovis subsp bovis AF2122/97
gagcgcucgggcaac

SEQ ID NO: 1044422 - RNA, 20 nt, Mycobacterium bovis subsp bovis AF2122/97
gagcgcucgggcaaccggag

SEQ ID NO: 1044423 - RNA, 17 nt, Mycobacterium bovis subsp bovis AF2122/97
gagcgcuaucaccgccu

SEQ ID NO: 1044424 - RNA, 19 nt, Mycobacterium bovis subsp bovis AF2122/97
gagcgcucgaucacggcgg

SEQ ID NO: 1044425 - RNA, 18 nt, Mycobacterium bovis subsp bovis AF2122/97
gagcgcgccucgcccagc

SEQ ID NO: 1044426 - RNA, 18 nt, Mycobacterium bovis subsp bovis AF2122/97
gagcgcgaugaccucggc

SEQ ID NO: 1044427 - RNA, 18 nt, Mycobacterium bovis subsp bovis AF2122/97
gagcgcgccgaaggccgc

SEQ ID NO: 1044428 - RNA, 19 nt, Mycobacterium bovis subsp bovis AF2122/97
gagcgcgcccaaccuggga

SEQ ID NO: 1044429 - RNA, 21 nt, Mycobacterium bovis subsp bovis AF2122/97
gagcgccucgggaggcagcgc

SEQ ID NO: 1044430 - RNA, 19 nt, Mycobacterium bovis subsp bovis AF2122/97
gagcgccuuucggucacgc

SEQ ID NO: 1044431 - RNA, 12 nt, Mycobacterium bovis subsp bovis AF2122/97
gagcgccgcggc

SEQ ID NO: 1044432 - RNA, 20 nt, Mycobacterium bovis subsp bovis AF2122/97
gagcgccgagcucggcgccc

SEQ ID NO: 1044433 - RNA, 21 nt, Mycobacterium bovis subsp bovis AF2122/97
gagcgccgcggcggauggcgu

SEQ ID NO: 1044434 - RNA, 23 nt, Mycobacterium bovis subsp bovis AF2122/97
gagcgccggcaucgcgcaaccgg

SEQ ID NO: 1044435 - RNA, 20 nt, Mycobacterium bovis subsp bovis AF2122/97
gagcgccggccgcgggucgc

SEQ ID NO: 1044436 - RNA, 15 nt, Mycobacterium bovis subsp bovis AF2122/97
gagcgauacgucguc

SEQ ID NO: 1044437 - RNA, 13 nt, Mycobacterium bovis subsp bovis AF2122/97
gagcgaucaacgg

SEQ ID NO: 1044438 - RNA, 15 nt, Mycobacterium bovis subsp bovis AF2122/97
gagcgagcgcgcgua

SEQ ID NO: 1044439 - RNA, 18 nt, Mycobacterium bovis subsp bovis AF2122/97
gagcgacguuaaugacgc

SEQ ID NO: 1044440 - RNA, 22 nt, Mycobacterium bovis subsp bovis AF2122/97
gagcgaccccacacgccgaacg

SEQ ID NO: 1044441 - RNA, 23 nt, Mycobacterium bovis subsp bovis AF2122/97
gagcgaccgucccagcgccgcag

SEQ ID NO: 1044442 - RNA, 16 nt, Mycobacterium bovis subsp bovis AF2122/97
gagcgaacggcgcagu

SEQ ID NO: 1044443 - RNA, 18 nt, Mycobacterium bovis subsp bovis AF2122/97
gagcgaacccccgccgcg

SEQ ID NO: 1044444 - RNA, 17 nt, Mycobacterium bovis subsp bovis AF2122/97
gagccugguguccgagc

SEQ ID NO: 1044445 - RNA, 13 nt, Mycobacterium bovis subsp bovis AF2122/97
gagccugcucgca

SEQ ID NO: 1044446 - RNA, 12 nt, Mycobacterium bovis subsp bovis AF2122/97
gagccucggcga

SEQ ID NO: 1044447 - RNA, 14 nt, Mycobacterium bovis subsp bovis AF2122/97
gagccucggcgagc

SEQ ID NO: 1044448 - RNA, 20 nt, Mycobacterium bovis subsp bovis AF2122/97
gagccugauaaagcccggcg

SEQ ID NO: 1044449 - RNA, 22 nt, Mycobacterium bovis subsp bovis AF2122/97
gagccugauaaagcccggcggc

SEQ ID NO: 1044450 - RNA, 16 nt, Mycobacterium bovis subsp bovis AF2122/97
gagccugcaggccgcc

SEQ ID NO: 1044451 - RNA, 20 nt, Mycobacterium bovis subsp bovis AF2122/97
gagcgccagccgcugccaca

SEQ ID NO: 1044452 - RNA, 18 nt, Mycobacterium bovis subsp bovis AF2122/97
gagcgcaucggccaacac

SEQ ID NO: 1044453 - RNA, 15 nt, Mycobacterium bovis subsp bovis AF2122/97
gagcgccaggccgca

SEQ ID NO: 1044454 - RNA, 15 nt, Mycobacterium bovis subsp bovis AF2122/97
gagcgcacucaccuu

SEQ ID NO: 1044455 - RNA, 19 nt, Mycobacterium bovis subsp bovis AF2122/97
gagcgcagcuugaucccau

SEQ ID NO: 1044456 - RNA, 16 nt, Mycobacterium bovis subsp bovis AF2122/97
gagcgcaucgauggcc

SEQ ID NO: 1044457 - RNA, 14 nt, Mycobacterium bovis subsp bovis AF2122/97
gagcgcaucggcca

SEQ ID NO: 1044458 - RNA, 15 nt, Mycobacterium bovis subsp bovis AF2122/97
gagcgaucgggugca

SEQ ID NO: 1044459 - RNA, 17 nt, Mycobacterium bovis subsp bovis AF2122/97
gagcgcaccacggcggu

SEQ ID NO: 1044460 - RNA, 20 nt, Mycobacterium bovis subsp bovis AF2122/97
gagcgcaacucccagcacgg

SEQ ID NO: 1044461 - RNA, 18 nt, Mycobacterium bovis subsp bovis AF2122/97
gagcgagaaucacgguca

SEQ ID NO: 1044462 - RNA, 23 nt, Mycobacterium bovis subsp bovis AF2122/97
gagcgcaaccagcaaugccgacu

SEQ ID NO: 1044463 - RNA, 14 nt, Mycobacterium bovis subsp bovis AF2122/97
gagcgggccagcac

SEQ ID NO: 1044464 - RNA, 22 nt, Mycobacterium bovis subsp bovis AF2122/97
gagcgggcgggccugcgcgauc

SEQ ID NO: 1044465 - RNA, 16 nt, Mycobacterium bovis subsp bovis AF2122/97
gagcgggcuccggcuc

SEQ ID NO: 1044466 - RNA, 20 nt, Mycobacterium bovis subsp bovis AF2122/97
gagcgggugcauucgcaugu

SEQ ID NO: 1044467 - RNA, 12 nt, Mycobacterium bovis subsp bovis AF2122/97
gagcggugccga

SEQ ID NO: 1044468 - RNA, 15 nt, Mycobacterium bovis subsp bovis AF2122/97
gagcggugccgacgg

SEQ ID NO: 1044469 - RNA, 19 nt, Mycobacterium bovis subsp bovis AF2122/97
gagcggugccgacggugau

SEQ ID NO: 1044470 - RNA, 16 nt, Mycobacterium bovis subsp bovis AF2122/97
gagcggucgacguguu

SEQ ID NO: 1044471 - RNA, 15 nt, Mycobacterium bovis subsp bovis AF2122/97
gagcgguacccccca

SEQ ID NO: 1044472 - RNA, 17 nt, Mycobacterium bovis subsp bovis AF2122/97
gagcguaacgguaaccg

SEQ ID NO: 1044473 - RNA, 21 nt, Mycobacterium bovis subsp bovis AF2122/97
gagcgguugccuucuuggcgg

SEQ ID NO: 1044474 - RNA, 18 nt, Mycobacterium bovis subsp bovis AF2122/97
gagcggucagcgucgauc

SEQ ID NO: 1044475 - RNA, 15 nt, Mycobacterium bovis subsp bovis AF2122/97
gagcgguugaucgcg

SEQ ID NO: 1044476 - RNA, 13 nt, Mycobacterium bovis subsp bovis AF2122/97
gagcggcaccaga

SEQ ID NO: 1044477 - RNA, 18 nt, Mycobacterium bovis subsp bovis AF2122/97
gagcggcaccagaucaac

SEQ ID NO: 1044478 - RNA, 13 nt, Mycobacterium bovis subsp bovis AF2122/97
gagcggaucgucg

SEQ ID NO: 1044479 - RNA, 22 nt, Mycobacterium bovis subsp bovis AF2122/97
gagcgcgucgcgggauugcgcg

SEQ ID NO: 1044480 - RNA, 15 nt, Mycobacterium bovis subsp bovis AF2122/97
gagcggagccggcgc

SEQ ID NO: 1044481 - RNA, 18 nt, Mycobacterium bovis subsp bovis AF2122/97
gagcggauccgugucgca

SEQ ID NO: 1044482 - RNA, 13 nt, Mycobacterium bovis subsp bovis AF2122/97
gagcggccgccgc

SEQ ID NO: 1044483 - RNA, 22 nt, Mycobacterium bovis subsp bovis AF2122/97
gagcggcaucggucaccgcggc

SEQ ID NO: 1044484 - RNA, 13 nt, Mycobacterium bovis subsp bovis AF2122/97
gagcggcgcggca

SEQ ID NO: 1044485 - RNA, 11 nt, Mycobacterium bovis subsp bovis AF2122/97
gagcggcggca

SEQ ID NO: 1044486 - RNA, 13 nt, Mycobacterium bovis subsp bovis AF2122/97
gagcguaggccag

SEQ ID NO: 1044487 - RNA, 22 nt, Mycobacterium bovis subsp bovis AF2122/97
gagcguaaugcugcugcagcaa

SEQ ID NO: 1044488 - RNA, 14 nt, Mycobacterium bovis subsp bovis AF2122/97
gagcguaggccagc

SEQ ID NO: 1044489 - RNA, 19 nt, Mycobacterium bovis subsp bovis AF2122/97
gagcgucaaccacggccgc

SEQ ID NO: 1044490 - RNA, 20 nt, Mycobacterium bovis subsp bovis AF2122/97
gagcgucaaccacggccgcc

SEQ ID NO: 1044491 - RNA, 21 nt, Mycobacterium bovis subsp bovis AF2122/97
gagcgucaaccacggccgccg

SEQ ID NO: 1044492 - RNA, 22 nt, Mycobacterium bovis subsp bovis AF2122/97
gagcgugaaccuggcgacgcga

SEQ ID NO: 1044493 - RNA, 14 nt, Mycobacterium bovis subsp bovis AF2122/97
gagcguccgguggu

SEQ ID NO: 1044494 - RNA, 16 nt, Mycobacterium bovis subsp bovis AF2122/97
gagcguggcaacgagc

SEQ ID NO: 1044495 - RNA, 21 nt, Mycobacterium bovis subsp bovis AF2122/97
gagcguggccaauccggcggc

SEQ ID NO: 1044496 - RNA, 22 nt, Mycobacterium bovis subsp bovis AF2122/97
gagcguggccaauccggcggcg

SEQ ID NO: 1044497 - RNA, 12 nt, Mycobacterium bovis subsp bovis AF2122/97
gagcgugccgca

SEQ ID NO: 1044498 - RNA, 22 nt, Mycobacterium bovis subsp bovis AF2122/97
gagcgugccgcagcggcggcaa

SEQ ID NO: 1044499 - RNA, 20 nt, Mycobacterium bovis subsp bovis AF2122/97
gagcgugcgcugguggcggc

SEQ ID NO: 1044500 - RNA, 19 nt, Mycobacterium bovis subsp bovis AF2122/97
gagcgugaagucacggcgg

SEQ ID NO: 1044501 - RNA, 21 nt, Mycobacterium bovis subsp bovis AF2122/97
gagcgugaagucacggcggcu

SEQ ID NO: 1044502 - RNA, 17 nt, Mycobacterium bovis subsp bovis AF2122/97
gagcgugcccgucucgu

SEQ ID NO: 1044503 - RNA, 20 nt, Mycobacterium bovis subsp bovis AF2122/97
gagcgugagccaugccgcuc

SEQ ID NO: 1044504 - RNA, 14 nt, Mycobacterium bovis subsp bovis AF2122/97
gagcgugagcgccg

SEQ ID NO: 1044505 - RNA, 14 nt, Mycobacterium bovis subsp bovis AF2122/97
gagcguucagcacg

SEQ ID NO: 1044506 - RNA, 17 nt, Mycobacterium bovis subsp bovis AF2122/97
gagcguggcguuggcgg

SEQ ID NO: 1044507 - RNA, 13 nt, Mycobacterium bovis subsp bovis AF2122/97
gagcguguugaaa

SEQ ID NO: 1044508 - RNA, 17 nt, Mycobacterium bovis subsp bovis AF2122/97
gagcucggcugcucgac

SEQ ID NO: 1044509 - RNA, 16 nt, Mycobacterium bovis subsp bovis AF2122/97
gagcucggucaccacg

SEQ ID NO: 1044510 - RNA, 21 nt, Mycobacterium bovis subsp bovis AF2122/97
gagcugauccggguggcguca

SEQ ID NO: 1044511 - RNA, 16 nt, Mycobacterium bovis subsp bovis AF2122/97
gagcugaaggcccguu

SEQ ID NO: 1044512 - RNA, 22 nt, Mycobacterium bovis subsp bovis AF2122/97
gagcucuugcgggcagccgccc

SEQ ID NO: 1044513 - RNA, 16 nt, Mycobacterium bovis subsp bovis AF2122/97
gagcucaucuucgguc

SEQ ID NO: 1044514 - RNA, 22 nt, Mycobacterium bovis subsp bovis AF2122/97
gagcuccgucgcggccgagacg

SEQ ID NO: 1044515 - RNA, 21 nt, Mycobacterium bovis subsp bovis AF2122/97
gagcucgaugucagcggccgc

SEQ ID NO: 1044516 - RNA, 14 nt, Mycobacterium bovis subsp bovis AF2122/97
gagcuccgucgcgg

SEQ ID NO: 1044517 - RNA, 13 nt, Mycobacterium bovis subsp bovis AF2122/97
gagcucccgccgg

SEQ ID NO: 1044518 - RNA, 15 nt, Mycobacterium bovis subsp bovis AF2122/97
gagcucccgccggga

SEQ ID NO: 1044519 - RNA, 14 nt, Mycobacterium bovis subsp bovis AF2122/97
gagcuccgcggcga

SEQ ID NO: 1044520 - RNA, 22 nt, Mycobacterium bovis subsp bovis AF2122/97
gagcuauucggugucgccaccc

SEQ ID NO: 1044521 - RNA, 14 nt, Mycobacterium bovis subsp bovis AF2122/97
gagcucaccgcaca

SEQ ID NO: 1044522 - RNA, 13 nt, Mycobacterium bovis subsp bovis AF2122/97
gagcucaccgggg

SEQ ID NO: 1044523 - RNA, 20 nt, Mycobacterium bovis subsp bovis AF2122/97
gagcucacuucacgccgccc

SEQ ID NO: 1044524 - RNA, 19 nt, Mycobacterium bovis subsp bovis AF2122/97
gagcucagcaaguucgucg

SEQ ID NO: 1044525 - RNA, 18 nt, Mycobacterium bovis subsp bovis AF2122/97
gagcuagccguucggcug

SEQ ID NO: 1044526 - RNA, 19 nt, Mycobacterium bovis subsp bovis AF2122/97
gagcuagccguucggcugc

SEQ ID NO: 1044527 - RNA, 18 nt, Mycobacterium bovis subsp bovis AF2122/97
gagcuauucggugucgcc

SEQ ID NO: 1044528 - RNA, 20 nt, Mycobacterium bovis subsp bovis AF2122/97
gagcuauucggugucgccac

SEQ ID NO: 1044529 - RNA, 14 nt, Mycobacterium bovis subsp bovis AF2122/97
gaugaugccgucgu

SEQ ID NO: 1044530 - RNA, 12 nt, Mycobacterium bovis subsp bovis AF2122/97
gaugaugccgga

SEQ ID NO: 1044531 - RNA, 14 nt, Mycobacterium bovis subsp bovis AF2122/97
gaugaugccggcgu

SEQ ID NO: 1044532 - RNA, 16 nt, Mycobacterium bovis subsp bovis AF2122/97
gaugaugccggcguug

SEQ ID NO: 1044533 - RNA, 16 nt, Mycobacterium bovis subsp bovis AF2122/97
gaugaugcgcucggcc

SEQ ID NO: 1044534 - RNA, 20 nt, Mycobacterium bovis subsp bovis AF2122/97
gaugaugcucgacaaccacg

SEQ ID NO: 1044535 - RNA, 13 nt, Mycobacterium bovis subsp bovis AF2122/97
gaugaugcugccg

SEQ ID NO: 1044536 - RNA, 16 nt, Mycobacterium bovis subsp bovis AF2122/97
gaugaugugcggugac

SEQ ID NO: 1044537 - RNA, 22 nt, Mycobacterium bovis subsp bovis AF2122/97
gaugauguggugugccugcguc

SEQ ID NO: 1044538 - RNA, 15 nt, Mycobacterium bovis subsp bovis AF2122/97
gaugaugugcgguga

SEQ ID NO: 1044539 - RNA, 13 nt, Mycobacterium bovis subsp bovis AF2122/97
gaugaugaccgcc

SEQ ID NO: 1044540 - RNA, 18 nt, Mycobacterium bovis subsp bovis AF2122/97
gaugaucgguaccgacgg

SEQ ID NO: 1044541 - RNA, 18 nt, Mycobacterium bovis subsp bovis AF2122/97
gaugaucccaagcgucgc

SEQ ID NO: 1044542 - RNA, 19 nt, Mycobacterium bovis subsp bovis AF2122/97
gaugcaacucgaauccggc

SEQ ID NO: 1044543 - RNA, 12 nt, Mycobacterium bovis subsp bovis AF2122/97
gaugcagcgcgc

SEQ ID NO: 1044544 - RNA, 14 nt, Mycobacterium bovis subsp bovis AF2122/97
gaugcagcgcgccc

SEQ ID NO: 1044545 - RNA, 18 nt, Mycobacterium bovis subsp bovis AF2122/97
gaugcagcgggucgccgg

SEQ ID NO: 1044546 - RNA, 19 nt, Mycobacterium bovis subsp bovis AF2122/97
gaugcagcugcccggcgug

SEQ ID NO: 1044547 - RNA, 18 nt, Mycobacterium bovis subsp bovis AF2122/97
gaugcauccagcugcugc

SEQ ID NO: 1044548 - RNA, 20 nt, Mycobacterium bovis subsp bovis AF2122/97
gaugcauccagcugcugccg

SEQ ID NO: 1044549 - RNA, 22 nt, Mycobacterium bovis subsp bovis AF2122/97
gaugcaucggugcagcccgccg

SEQ ID NO: 1044550 - RNA, 16 nt, Mycobacterium bovis subsp bovis AF2122/97
gaugcagugcgacccg

SEQ ID NO: 1044551 - RNA, 21 nt, Mycobacterium bovis subsp bovis AF2122/97
gaugaugccggacagcucgcg

SEQ ID NO: 1044552 - RNA, 15 nt, Mycobacterium bovis subsp bovis AF2122/97
gaugcaacgccaaaa

SEQ ID NO: 1044553 - RNA, 16 nt, Mycobacterium bovis subsp bovis AF2122/97
gaugcaacgccaaaau

SEQ ID NO: 1044554 - RNA, 19 nt, Mycobacterium bovis subsp bovis AF2122/97
gaugauguuuuccccgccc

SEQ ID NO: 1044555 - RNA, 16 nt, Mycobacterium bovis subsp bovis AF2122/97
gaugauuucgccgagc

SEQ ID NO: 1044556 - RNA, 15 nt, Mycobacterium bovis subsp bovis AF2122/97
gaugcaacccgguga

SEQ ID NO: 1044557 - RNA, 19 nt, Mycobacterium bovis subsp bovis AF2122/97
gaugcacaaccgcugcugc

SEQ ID NO: 1044558 - RNA, 16 nt, Mycobacterium bovis subsp bovis AF2122/97
gaugaccucggcgaug

SEQ ID NO: 1044559 - RNA, 15 nt, Mycobacterium bovis subsp bovis AF2122/97
gaugaccucgucaag

SEQ ID NO: 1044560 - RNA, 14 nt, Mycobacterium bovis subsp bovis AF2122/97
gaugacgaugcccu

SEQ ID NO: 1044561 - RNA, 17 nt, Mycobacterium bovis subsp bovis AF2122/97
gaugacgaugccgccga

SEQ ID NO: 1044562 - RNA, 18 nt, Mycobacterium bovis subsp bovis AF2122/97
gaugacgaucggcggcgc

SEQ ID NO: 1044563 - RNA, 13 nt, Mycobacterium bovis subsp bovis AF2122/97
gaugacgaucugg

SEQ ID NO: 1044564 - RNA, 12 nt, Mycobacterium bovis subsp bovis AF2122/97
gaugaccgucgc

SEQ ID NO: 1044565 - RNA, 14 nt, Mycobacterium bovis subsp bovis AF2122/97
gaugaccgucgcac

SEQ ID NO: 1044566 - RNA, 21 nt, Mycobacterium bovis subsp bovis AF2122/97
gaugaccgguauuaccgccgu

SEQ ID NO: 1044567 - RNA, 24 nt, Mycobacterium bovis subsp bovis AF2122/97
gaugaccgguauuaccgccguggc

SEQ ID NO: 1044568 - RNA, 14 nt, Mycobacterium bovis subsp bovis AF2122/97
gaugaaacgccguc

SEQ ID NO: 1044569 - RNA, 13 nt, Mycobacterium bovis subsp bovis AF2122/97
gaugaaacgccgu

SEQ ID NO: 1044570 - RNA, 14 nt, Mycobacterium bovis subsp bovis AF2122/97
gaugacggugccga

SEQ ID NO: 1044571 - RNA, 20 nt, Mycobacterium bovis subsp bovis AF2122/97
gaugacgcccagggcgucgg

SEQ ID NO: 1044572 - RNA, 23 nt, Mycobacterium bovis subsp bovis AF2122/97
gaugacgccgucagcggccaagu

SEQ ID NO: 1044573 - RNA, 19 nt, Mycobacterium bovis subsp bovis AF2122/97
gaugacgccgucggcgcgc

SEQ ID NO: 1044574 - RNA, 21 nt, Mycobacterium bovis subsp bovis AF2122/97
gaugacgccgucggcgcgcac

SEQ ID NO: 1044575 - RNA, 18 nt, Mycobacterium bovis subsp bovis AF2122/97
gaugaccuugggaccacc

SEQ ID NO: 1044576 - RNA, 21 nt, Mycobacterium bovis subsp bovis AF2122/97
gaugaccuugggaccaccggg

SEQ ID NO: 1044577 - RNA, 13 nt, Mycobacterium bovis subsp bovis AF2122/97
gaugagcgcgacu

SEQ ID NO: 1044578 - RNA, 16 nt, Mycobacterium bovis subsp bovis AF2122/97
gaugacgguggugacg

SEQ ID NO: 1044579 - RNA, 19 nt, Mycobacterium bovis subsp bovis AF2122/97
gaugagcaacgccacgccg

SEQ ID NO: 1044580 - RNA, 17 nt, Mycobacterium bovis subsp bovis AF2122/97
gaugagccugcaggccg

SEQ ID NO: 1044581 - RNA, 12 nt, Mycobacterium bovis subsp bovis AF2122/97
gaugagaucauc

SEQ ID NO: 1044582 - RNA, 14 nt, Mycobacterium bovis subsp bovis AF2122/97
gaugacggcgucga

SEQ ID NO: 1044583 - RNA, 14 nt, Mycobacterium bovis subsp bovis AF2122/97
gaugagguggccgc

SEQ ID NO: 1044584 - RNA, 15 nt, Mycobacterium bovis subsp bovis AF2122/97
gaugagugacggucc

SEQ ID NO: 1044585 - RNA, 22 nt, Mycobacterium bovis subsp bovis AF2122/97
gaugaggaucgcguccgccucg

SEQ ID NO: 1044586 - RNA, 16 nt, Mycobacterium bovis subsp bovis AF2122/97
gaugagcgcggcgaca

SEQ ID NO: 1044587 - RNA, 14 nt, Mycobacterium bovis subsp bovis AF2122/97
gaugagcggcgcgg

SEQ ID NO: 1044588 - RNA, 23 nt, Mycobacterium bovis subsp bovis AF2122/97
gaugagcgguaccccccagcgac

SEQ ID NO: 1044589 - RNA, 17 nt, Mycobacterium bovis subsp bovis AF2122/97
gaugagcgugccgcagc

SEQ ID NO: 1044590 - RNA, 21 nt, Mycobacterium bovis subsp bovis AF2122/97
gaugagcgugccgcagcggcg

SEQ ID NO: 1044591 - RNA, 14 nt, Mycobacterium bovis subsp bovis AF2122/97
gaucucgccggcga

SEQ ID NO: 1044592 - RNA, 15 nt, Mycobacterium bovis subsp bovis AF2122/97
gaucucgccgccagc

SEQ ID NO: 1044593 - RNA, 16 nt, Mycobacterium bovis subsp bovis AF2122/97
gaucucgccgccagcg

SEQ ID NO: 1044594 - RNA, 13 nt, Mycobacterium bovis subsp bovis AF2122/97
gaucucggcgucg

SEQ ID NO: 1044595 - RNA, 15 nt, Mycobacterium bovis subsp bovis AF2122/97
gaucucggcggccgc

SEQ ID NO: 1044596 - RNA, 13 nt, Mycobacterium bovis subsp bovis AF2122/97
gaucucggcgagc

SEQ ID NO: 1044597 - RNA, 17 nt, Mycobacterium bovis subsp bovis AF2122/97
gaucucgcgcgcggcga

SEQ ID NO: 1044598 - RNA, 22 nt, Mycobacterium bovis subsp bovis AF2122/97
gaucugcuccucggucagcggg

SEQ ID NO: 1044599 - RNA, 15 nt, Mycobacterium bovis subsp bovis AF2122/97
gaucugcguugcggc

SEQ ID NO: 1044600 - RNA, 21 nt, Mycobacterium bovis subsp bovis AF2122/97
gaucugcguuugggucaucga

SEQ ID NO: 1044601 - RNA, 14 nt, Mycobacterium bovis subsp bovis AF2122/97
gaucugcgccgcgc

SEQ ID NO: 1044602 - RNA, 14 nt, Mycobacterium bovis subsp bovis AF2122/97
gaucugcggcgccc

SEQ ID NO: 1044603 - RNA, 14 nt, Mycobacterium bovis subsp bovis AF2122/97
gaucuugccgcccu

SEQ ID NO: 1044604 - RNA, 16 nt, Mycobacterium bovis subsp bovis AF2122/97
gaucuugccgcuggug

SEQ ID NO: 1044605 - RNA, 21 nt, Mycobacterium bovis subsp bovis AF2122/97
gaucuggcguagugcucgccg

SEQ ID NO: 1044606 - RNA, 19 nt, Mycobacterium bovis subsp bovis AF2122/97
gaucuugcagugcgccagc

SEQ ID NO: 1044607 - RNA, 16 nt, Mycobacterium bovis subsp bovis AF2122/97
gaucuuggccaccgcc

SEQ ID NO: 1044608 - RNA, 14 nt, Mycobacterium bovis subsp bovis AF2122/97
gaucuuggccagca

SEQ ID NO: 1044609 - RNA, 20 nt, Mycobacterium bovis subsp bovis AF2122/97
gaucuuggcgcccgccggca

SEQ ID NO: 1044610 - RNA, 22 nt, Mycobacterium bovis subsp bovis AF2122/97
gaucuugucgagcagcucgcac

SEQ ID NO: 1044611 - RNA, 18 nt, Mycobacterium bovis subsp bovis AF2122/97
gaucuugucgcguucggc

SEQ ID NO: 1044612 - RNA, 22 nt, Mycobacterium bovis subsp bovis AF2122/97
gaucugggcuuucgcgugcggc

SEQ ID NO: 1044613 - RNA, 14 nt, Mycobacterium bovis subsp bovis AF2122/97
gaucuucggccgca

SEQ ID NO: 1044614 - RNA, 16 nt, Mycobacterium bovis subsp bovis AF2122/97
gaucuggcguucagcg

SEQ ID NO: 1044615 - RNA, 14 nt, Mycobacterium bovis subsp bovis AF2122/97
gaucuggcagccga

SEQ ID NO: 1044616 - RNA, 16 nt, Mycobacterium bovis subsp bovis AF2122/97
gaucugcugggcaaga

SEQ ID NO: 1044617 - RNA, 16 nt, Mycobacterium bovis subsp bovis AF2122/97
gaucugcuuggugacc

SEQ ID NO: 1044618 - RNA, 23 nt, Mycobacterium bovis subsp bovis AF2122/97
gaucgucgugcacggcggccagg

SEQ ID NO: 1044619 - RNA, 13 nt, Mycobacterium bovis subsp bovis AF2122/97
gaucggcgcggcc

SEQ ID NO: 1044620 - RNA, 17 nt, Mycobacterium bovis subsp bovis AF2122/97
gaucgugaacacgucgc

SEQ ID NO: 1044621 - RNA, 19 nt, Mycobacterium bovis subsp bovis AF2122/97
gaucggcgaggucccggcc

SEQ ID NO: 1044622 - RNA, 23 nt, Mycobacterium bovis subsp bovis AF2122/97
gaucggccuguccaccgaugcca

SEQ ID NO: 1044623 - RNA, 23 nt, Mycobacterium bovis subsp bovis AF2122/97
gaucgugugaggccuucgccgac

SEQ ID NO: 1044624 - RNA, 14 nt, Mycobacterium bovis subsp bovis AF2122/97
gaucguggcgacca

SEQ ID NO: 1044625 - RNA, 15 nt, Mycobacterium bovis subsp bovis AF2122/97
gaucguggcgaccac

SEQ ID NO: 1044626 - RNA, 17 nt, Mycobacterium bovis subsp bovis AF2122/97
gaucguggcgaccacga

SEQ ID NO: 1044627 - RNA, 13 nt, Mycobacterium bovis subsp bovis AF2122/97
gaucgugcuggcg

SEQ ID NO: 1044628 - RNA, 23 nt, Mycobacterium bovis subsp bovis AF2122/97
gaucgugcuggugguaucggcgu

SEQ ID NO: 1044629 - RNA, 20 nt, Mycobacterium bovis subsp bovis AF2122/97
gaucgugccgggaccggugu

SEQ ID NO: 1044630 - RNA, 23 nt, Mycobacterium bovis subsp bovis AF2122/97
gaucgucuuccauuucggaacgc

SEQ ID NO: 1044631 - RNA, 17 nt, Mycobacterium bovis subsp bovis AF2122/97
gaucgugaucgaccgga

SEQ ID NO: 1044632 - RNA, 19 nt, Mycobacterium bovis subsp bovis AF2122/97
gaucgugcacaaucgguug

SEQ ID NO: 1044633 - RNA, 15 nt, Mycobacterium bovis subsp bovis AF2122/97
gaucgugccgggacc

SEQ ID NO: 1044634 - RNA, 13 nt, Mycobacterium bovis subsp bovis AF2122/97
gaucgugccggcg

SEQ ID NO: 1044635 - RNA, 14 nt, Mycobacterium bovis subsp bovis AF2122/97
gaucgugccggcga

SEQ ID NO: 1044636 - RNA, 23 nt, Mycobacterium bovis subsp bovis AF2122/97
gaucuccaccuucugguccagca

SEQ ID NO: 1044637 - RNA, 23 nt, Mycobacterium bovis subsp bovis AF2122/97
gaucuccacccgccggccgucgg

SEQ ID NO: 1044638 - RNA, 17 nt, Mycobacterium bovis subsp bovis AF2122/97
gaucuccaccggcgauc

SEQ ID NO: 1044639 - RNA, 16 nt, Mycobacterium bovis subsp bovis AF2122/97
gaucucgccccagugc

SEQ ID NO: 1044640 - RNA, 18 nt, Mycobacterium bovis subsp bovis AF2122/97
gaucucgcccagcgagcg

SEQ ID NO: 1044641 - RNA, 19 nt, Mycobacterium bovis subsp bovis AF2122/97
gaucucgcccagcgagcgc

SEQ ID NO: 1044642 - RNA, 22 nt, Mycobacterium bovis subsp bovis AF2122/97
gaucucgcccagcgagcgccag

SEQ ID NO: 1044643 - RNA, 23 nt, Mycobacterium bovis subsp bovis AF2122/97
gaucucgcccagcgagcgccagg

SEQ ID NO: 1044644 - RNA, 15 nt, Mycobacterium bovis subsp bovis AF2122/97
gaucucaucgggcca

SEQ ID NO: 1044645 - RNA, 23 nt, Mycobacterium bovis subsp bovis AF2122/97
gaucucacccagcucgcgcaccc

SEQ ID NO: 1044646 - RNA, 20 nt, Mycobacterium bovis subsp bovis AF2122/97
gaucuagaggcggcccccgg

SEQ ID NO: 1044647 - RNA, 20 nt, Mycobacterium bovis subsp bovis AF2122/97
gaucucacccagcucgcgca

SEQ ID NO: 1044648 - RNA, 16 nt, Mycobacterium bovis subsp bovis AF2122/97
gaucguugccucgucg

SEQ ID NO: 1044649 - RNA, 19 nt, Mycobacterium bovis subsp bovis AF2122/97
gaucguuccgauccggugg

SEQ ID NO: 1044650 - RNA, 20 nt, Mycobacterium bovis subsp bovis AF2122/97
gaucguuaugaccucgacgu

SEQ ID NO: 1044651 - RNA, 22 nt, Mycobacterium bovis subsp bovis AF2122/97
gaucguuaugaccucgacgucg

SEQ ID NO: 1044652 - RNA, 20 nt, Mycobacterium bovis subsp bovis AF2122/97
gaucguuccaggccgcgucg

SEQ ID NO: 1044653 - RNA, 20 nt, Mycobacterium bovis subsp bovis AF2122/97
gaucguugccucgucgccgc

SEQ ID NO: 1044654 - RNA, 13 nt, Mycobacterium bovis subsp bovis AF2122/97
gaucccgccgcgg

SEQ ID NO: 1044655 - RNA, 23 nt, Mycobacterium bovis subsp bovis AF2122/97
gaucccgccgcugccgccggugc

SEQ ID NO: 1044656 - RNA, 16 nt, Mycobacterium bovis subsp bovis AF2122/97
gaucccgaugcuggca

SEQ ID NO: 1044657 - RNA, 14 nt, Mycobacterium bovis subsp bovis AF2122/97
gaucccgaugguca

SEQ ID NO: 1044658 - RNA, 16 nt, Mycobacterium bovis subsp bovis AF2122/97
gaucccgaucgaucag

SEQ ID NO: 1044659 - RNA, 13 nt, Mycobacterium bovis subsp bovis AF2122/97
gaucccgaucgcg

SEQ ID NO: 1044660 - RNA, 18 nt, Mycobacterium bovis subsp bovis AF2122/97
gaucccgaucgcgcuggg

SEQ ID NO: 1044661 - RNA, 21 nt, Mycobacterium bovis subsp bovis AF2122/97
gaucccgcugaccuggggugu

SEQ ID NO: 1044662 - RNA, 13 nt, Mycobacterium bovis subsp bovis AF2122/97
gaucccggccagc

SEQ ID NO: 1044663 - RNA, 19 nt, Mycobacterium bovis subsp bovis AF2122/97
gaucccggccaggccgaca

SEQ ID NO: 1044664 - RNA, 15 nt, Mycobacterium bovis subsp bovis AF2122/97
gauccgggcguggug

SEQ ID NO: 1044665 - RNA, 16 nt, Mycobacterium bovis subsp bovis AF2122/97
gaucccguccgcgccc

SEQ ID NO: 1044666 - RNA, 13 nt, Mycobacterium bovis subsp bovis AF2122/97
gaucccgucgggc

SEQ ID NO: 1044667 - RNA, 19 nt, Mycobacterium bovis subsp bovis AF2122/97
gaucccgucgggcacaccg

SEQ ID NO: 1044668 - RNA, 14 nt, Mycobacterium bovis subsp bovis AF2122/97
gauccggucggcca

SEQ ID NO: 1044669 - RNA, 14 nt, Mycobacterium bovis subsp bovis AF2122/97
gauccgucggcgga

SEQ ID NO: 1044670 - RNA, 20 nt, Mycobacterium bovis subsp bovis AF2122/97
gauccggugccgcgaucgcg

SEQ ID NO: 1044671 - RNA, 21 nt, Mycobacterium bovis subsp bovis AF2122/97
gauccgguggcuggccgccac

SEQ ID NO: 1044672 - RNA, 20 nt, Mycobacterium bovis subsp bovis AF2122/97
gauccggucguagcuuccgg

SEQ ID NO: 1044673 - RNA, 23 nt, Mycobacterium bovis subsp bovis AF2122/97
gauccucgaugacaucggucagc

SEQ ID NO: 1044674 - RNA, 15 nt, Mycobacterium bovis subsp bovis AF2122/97
gauccugaccagcca

SEQ ID NO: 1044675 - RNA, 22 nt, Mycobacterium bovis subsp bovis AF2122/97
gaucgacagccccgcggccagc

SEQ ID NO: 1044676 - RNA, 20 nt, Mycobacterium bovis subsp bovis AF2122/97
gaucgacaccgagccacgac

SEQ ID NO: 1044677 - RNA, 23 nt, Mycobacterium bovis subsp bovis AF2122/97
gaucgacaccgugaccgccgcgc

SEQ ID NO: 1044678 - RNA, 22 nt, Mycobacterium bovis subsp bovis AF2122/97
gaucgacgccgccacccggcgg

SEQ ID NO: 1044679 - RNA, 14 nt, Mycobacterium bovis subsp bovis AF2122/97
gaucgacgcucggc

SEQ ID NO: 1044680 - RNA, 15 nt, Mycobacterium bovis subsp bovis AF2122/97
gaucgacgcucggcu

SEQ ID NO: 1044681 - RNA, 17 nt, Mycobacterium bovis subsp bovis AF2122/97
gaucgacccggucgacg

SEQ ID NO: 1044682 - RNA, 14 nt, Mycobacterium bovis subsp bovis AF2122/97
gaucgaccgccagc

SEQ ID NO: 1044683 - RNA, 21 nt, Mycobacterium bovis subsp bovis AF2122/97
gaucgaccgccuccucgauag

SEQ ID NO: 1044684 - RNA, 18 nt, Mycobacterium bovis subsp bovis AF2122/97
gaucgaccgcuggaucgc

SEQ ID NO: 1044685 - RNA, 13 nt, Mycobacterium bovis subsp bovis AF2122/97
gaucgacccgccc

SEQ ID NO: 1044686 - RNA, 18 nt, Mycobacterium bovis subsp bovis AF2122/97
gaucgacaguugcgccag

SEQ ID NO: 1044687 - RNA, 19 nt, Mycobacterium bovis subsp bovis AF2122/97
gaucgacaguugcgccagc

SEQ ID NO: 1044688 - RNA, 18 nt, Mycobacterium bovis subsp bovis AF2122/97
gaucgacaucaccaccgc

SEQ ID NO: 1044689 - RNA, 21 nt, Mycobacterium bovis subsp bovis AF2122/97
gaucgacaucaccaccgccgg

SEQ ID NO: 1044690 - RNA, 22 nt, Mycobacterium bovis subsp bovis AF2122/97
gaucgacaucaccaccgccggg

SEQ ID NO: 1044691 - RNA, 16 nt, Mycobacterium bovis subsp bovis AF2122/97
gaucaccccggccggc

SEQ ID NO: 1044692 - RNA, 23 nt, Mycobacterium bovis subsp bovis AF2122/97
gaucacccgcacuccacgaucgg

SEQ ID NO: 1044693 - RNA, 19 nt, Mycobacterium bovis subsp bovis AF2122/97
gaucacccgcaucggcacg

SEQ ID NO: 1044694 - RNA, 21 nt, Mycobacterium bovis subsp bovis AF2122/97
gaucacccgcaucggcacgcc

SEQ ID NO: 1044695 - RNA, 22 nt, Mycobacterium bovis subsp bovis AF2122/97
gaucacccgccgcgugcugcgg

SEQ ID NO: 1044696 - RNA, 15 nt, Mycobacterium bovis subsp bovis AF2122/97
gaucacaccgcugcu

SEQ ID NO: 1044697 - RNA, 22 nt, Mycobacterium bovis subsp bovis AF2122/97
gaucacccacucgacgucgucg

SEQ ID NO: 1044698 - RNA, 14 nt, Mycobacterium bovis subsp bovis AF2122/97
gaucaccgacaccg

SEQ ID NO: 1044699 - RNA, 14 nt, Mycobacterium bovis subsp bovis AF2122/97
gaucaccgcgcccg

SEQ ID NO: 1044700 - RNA, 13 nt, Mycobacterium bovis subsp bovis AF2122/97
gaucaccgcgccg

SEQ ID NO: 1044701 - RNA, 20 nt, Mycobacterium bovis subsp bovis AF2122/97
gaucaccgagucgacggcca

SEQ ID NO: 1044702 - RNA, 18 nt, Mycobacterium bovis subsp bovis AF2122/97
gaucaccgacaccgugcc

SEQ ID NO: 1044703 - RNA, 19 nt, Mycobacterium bovis subsp bovis AF2122/97
gaucaccgacaccgugccg

SEQ ID NO: 1044704 - RNA, 20 nt, Mycobacterium bovis subsp bovis AF2122/97
gaucaccuucgucgcggccg

SEQ ID NO: 1044705 - RNA, 17 nt, Mycobacterium bovis subsp bovis AF2122/97
gaucaccuucgucgcgg

SEQ ID NO: 1044706 - RNA, 23 nt, Mycobacterium bovis subsp bovis AF2122/97
gaucacgaugcgguucucgagcu

SEQ ID NO: 1044707 - RNA, 15 nt, Mycobacterium bovis subsp bovis AF2122/97
gaucacgccgggcga

SEQ ID NO: 1044708 - RNA, 18 nt, Mycobacterium bovis subsp bovis AF2122/97
gaucacgcgucgugccac

SEQ ID NO: 1044709 - RNA, 17 nt, Mycobacterium bovis subsp bovis AF2122/97
gaucacgccgccggcga

SEQ ID NO: 1044710 - RNA, 19 nt, Mycobacterium bovis subsp bovis AF2122/97
gaucacgccgccggcgaag

SEQ ID NO: 1044711 - RNA, 15 nt, Mycobacterium bovis subsp bovis AF2122/97
gaucacgccgacgau

SEQ ID NO: 1044712 - RNA, 12 nt, Mycobacterium bovis subsp bovis AF2122/97
gaucacggcggc

SEQ ID NO: 1044713 - RNA, 14 nt, Mycobacterium bovis subsp bovis AF2122/97
gaucacggucggcg

SEQ ID NO: 1044714 - RNA, 22 nt, Mycobacterium bovis subsp bovis AF2122/97
gaucacgucggauccgcccgcc

SEQ ID NO: 1044715 - RNA, 18 nt, Mycobacterium bovis subsp bovis AF2122/97
gaucacguacgccgccga

SEQ ID NO: 1044716 - RNA, 23 nt, Mycobacterium bovis subsp bovis AF2122/97
gaucacguacgccgccgaucacc

SEQ ID NO: 1044717 - RNA, 16 nt, Mycobacterium bovis subsp bovis AF2122/97
gaucacgucggcguug

SEQ ID NO: 1044718 - RNA, 16 nt, Mycobacterium bovis subsp bovis AF2122/97
gauccagggccgacgc

SEQ ID NO: 1044719 - RNA, 19 nt, Mycobacterium bovis subsp bovis AF2122/97
gauccagggccgacgcgaa

SEQ ID NO: 1044720 - RNA, 21 nt, Mycobacterium bovis subsp bovis AF2122/97
gauccagugguaggccgccgg

SEQ ID NO: 1044721 - RNA, 17 nt, Mycobacterium bovis subsp bovis AF2122/97
gauccaguucaccgcgc

SEQ ID NO: 1044722 - RNA, 13 nt, Mycobacterium bovis subsp bovis AF2122/97
gauccccgcguuc

SEQ ID NO: 1044723 - RNA, 17 nt, Mycobacterium bovis subsp bovis AF2122/97
gauccccgcguucggcg

SEQ ID NO: 1044724 - RNA, 20 nt, Mycobacterium bovis subsp bovis AF2122/97
gauccccgcguucggcggcg

SEQ ID NO: 1044725 - RNA, 14 nt, Mycobacterium bovis subsp bovis AF2122/97
gaucccccaggcga

SEQ ID NO: 1044726 - RNA, 18 nt, Mycobacterium bovis subsp bovis AF2122/97
gauccccgccaccgaacg

SEQ ID NO: 1044727 - RNA, 21 nt, Mycobacterium bovis subsp bovis AF2122/97
gauccccgccaccgaacgcac

SEQ ID NO: 1044728 - RNA, 13 nt, Mycobacterium bovis subsp bovis AF2122/97
gaucccagcccga

SEQ ID NO: 1044729 - RNA, 15 nt, Mycobacterium bovis subsp bovis AF2122/97
gaucccagcgcagcg

SEQ ID NO: 1044730 - RNA, 15 nt, Mycobacterium bovis subsp bovis AF2122/97
gaucccaacgcccgg

SEQ ID NO: 1044731 - RNA, 16 nt, Mycobacterium bovis subsp bovis AF2122/97
gaucccaacgcccggg

SEQ ID NO: 1044732 - RNA, 17 nt, Mycobacterium bovis subsp bovis AF2122/97
gaucccaacgcccgggc

SEQ ID NO: 1044733 - RNA, 15 nt, Mycobacterium bovis subsp bovis AF2122/97
gaucccaccaccgcu

SEQ ID NO: 1044734 - RNA, 20 nt, Mycobacterium bovis subsp bovis AF2122/97
gaucccaccaccgcucgucg

SEQ ID NO: 1044735 - RNA, 13 nt, Mycobacterium bovis subsp bovis AF2122/97
gaucccaccggcu

SEQ ID NO: 1044736 - RNA, 22 nt, Mycobacterium bovis subsp bovis AF2122/97
gaucccaccggcuaugcuggcg

SEQ ID NO: 1044737 - RNA, 14 nt, Mycobacterium bovis subsp bovis AF2122/97
gaucccacgaaucc

SEQ ID NO: 1044738 - RNA, 13 nt, Mycobacterium bovis subsp bovis AF2122/97
gaucggccggaua

SEQ ID NO: 1044739 - RNA, 20 nt, Mycobacterium bovis subsp bovis AF2122/97
gaucggccgguauuucggcg

SEQ ID NO: 1044740 - RNA, 23 nt, Mycobacterium bovis subsp bovis AF2122/97
gaucggccgguauuucggcgacu

SEQ ID NO: 1044741 - RNA, 21 nt, Mycobacterium bovis subsp bovis AF2122/97
gaucggccgccgaauuggcgg

SEQ ID NO: 1044742 - RNA, 22 nt, Mycobacterium bovis subsp bovis AF2122/97
gaucggccgccgaauuggcgga

SEQ ID NO: 1044743 - RNA, 17 nt, Mycobacterium bovis subsp bovis AF2122/97
gaucggacagguaacgc

SEQ ID NO: 1044744 - RNA, 22 nt, Mycobacterium bovis subsp bovis AF2122/97
gaucgcgugcggugccguggug

SEQ ID NO: 1044745 - RNA, 13 nt, Mycobacterium bovis subsp bovis AF2122/97
gaucgcguggcgc

SEQ ID NO: 1044746 - RNA, 22 nt, Mycobacterium bovis subsp bovis AF2122/97
gaucgcguggcgcaccaccgcc

SEQ ID NO: 1044747 - RNA, 14 nt, Mycobacterium bovis subsp bovis AF2122/97
gaucgcuacgucga

SEQ ID NO: 1044748 - RNA, 15 nt, Mycobacterium bovis subsp bovis AF2122/97
gaucgcuccgcggcg

SEQ ID NO: 1044749 - RNA, 23 nt, Mycobacterium bovis subsp bovis AF2122/97
gaucgcuccggcccugccgccgg

SEQ ID NO: 1044750 - RNA, 13 nt, Mycobacterium bovis subsp bovis AF2122/97
gaucgcuugcccc

SEQ ID NO: 1044751 - RNA, 19 nt, Mycobacterium bovis subsp bovis AF2122/97
gaucgcuugccccgccgag

SEQ ID NO: 1044752 - RNA, 22 nt, Mycobacterium bovis subsp bovis AF2122/97
gaucgcuucccggaagcgccgg

SEQ ID NO: 1044753 - RNA, 16 nt, Mycobacterium bovis subsp bovis AF2122/97
gaucgcuuccucguag

SEQ ID NO: 1044754 - RNA, 17 nt, Mycobacterium bovis subsp bovis AF2122/97
gaucgcuaggaccgcgg

SEQ ID NO: 1044755 - RNA, 17 nt, Mycobacterium bovis subsp bovis AF2122/97
gaucgcugccagcggcc

SEQ ID NO: 1044756 - RNA, 16 nt, Mycobacterium bovis subsp bovis AF2122/97
gaucgcugcgaagccg

SEQ ID NO: 1044757 - RNA, 14 nt, Mycobacterium bovis subsp bovis AF2122/97
gaucgcgccgucgg

SEQ ID NO: 1044758 - RNA, 14 nt, Mycobacterium bovis subsp bovis AF2122/97
gaucgcgcgcaccg

SEQ ID NO: 1044759 - RNA, 12 nt, Mycobacterium bovis subsp bovis AF2122/97
gaucgcgccguc

SEQ ID NO: 1044760 - RNA, 13 nt, Mycobacterium bovis subsp bovis AF2122/97
gaucgcgccuauc

SEQ ID NO: 1044761 - RNA, 16 nt, Mycobacterium bovis subsp bovis AF2122/97
gaucgcguagcuggcc

SEQ ID NO: 1044762 - RNA, 13 nt, Mycobacterium bovis subsp bovis AF2122/97
gaucgcgcugcgg

SEQ ID NO: 1044763 - RNA, 15 nt, Mycobacterium bovis subsp bovis AF2122/97
gaucgcgugcggugc

SEQ ID NO: 1044764 - RNA, 23 nt, Mycobacterium bovis subsp bovis AF2122/97
gaucgcgcccugagccaccccgg

SEQ ID NO: 1044765 - RNA, 23 nt, Mycobacterium bovis subsp bovis AF2122/97
gaucgcgcccugcggaucggaca

SEQ ID NO: 1044766 - RNA, 16 nt, Mycobacterium bovis subsp bovis AF2122/97
gaucgcgccaggccac

SEQ ID NO: 1044767 - RNA, 13 nt, Mycobacterium bovis subsp bovis AF2122/97
gaucgccucgacg

SEQ ID NO: 1044768 - RNA, 22 nt, Mycobacterium bovis subsp bovis AF2122/97
gaucgccucggacacggcagcc

SEQ ID NO: 1044769 - RNA, 15 nt, Mycobacterium bovis subsp bovis AF2122/97
gaucgccguccagca

SEQ ID NO: 1044770 - RNA, 20 nt, Mycobacterium bovis subsp bovis AF2122/97
gaucgccgcuaacgcaccug

SEQ ID NO: 1044771 - RNA, 14 nt, Mycobacterium bovis subsp bovis AF2122/97
gaucgccggccugc

SEQ ID NO: 1044772 - RNA, 22 nt, Mycobacterium bovis subsp bovis AF2122/97
gaucgccggccugcucggcgag

SEQ ID NO: 1044773 - RNA, 22 nt, Mycobacterium bovis subsp bovis AF2122/97
gaucgccgggcuuggccgcgcc

SEQ ID NO: 1044774 - RNA, 21 nt, Mycobacterium bovis subsp bovis AF2122/97
gaucgccggggacgccgcggc

SEQ ID NO: 1044775 - RNA, 17 nt, Mycobacterium bovis subsp bovis AF2122/97
gaucgccggcuucgccc

SEQ ID NO: 1044776 - RNA, 20 nt, Mycobacterium bovis subsp bovis AF2122/97
gaucgccugggcuuggcgac

SEQ ID NO: 1044777 - RNA, 21 nt, Mycobacterium bovis subsp bovis AF2122/97
gaucgcgacccgaucgcgcca

SEQ ID NO: 1044778 - RNA, 18 nt, Mycobacterium bovis subsp bovis AF2122/97
gaucgcgacacggccauc

SEQ ID NO: 1044779 - RNA, 19 nt, Mycobacterium bovis subsp bovis AF2122/97
gaucgccuuggcgcccgcg

SEQ ID NO: 1044780 - RNA, 19 nt, Mycobacterium bovis subsp bovis AF2122/97
gaucgcgaacaucgccagc

SEQ ID NO: 1044781 - RNA, 13 nt, Mycobacterium bovis subsp bovis AF2122/97
gaucgcgagcgcc

SEQ ID NO: 1044782 - RNA, 19 nt, Mycobacterium bovis subsp bovis AF2122/97
gaucgcgagcgcggcggag

SEQ ID NO: 1044783 - RNA, 12 nt, Mycobacterium bovis subsp bovis AF2122/97
gaucgcgaucca

SEQ ID NO: 1044784 - RNA, 20 nt, Mycobacterium bovis subsp bovis AF2122/97
gaucgcgauccacccggcau

SEQ ID NO: 1044785 - RNA, 16 nt, Mycobacterium bovis subsp bovis AF2122/97
gaucgcgacgaugccc

SEQ ID NO: 1044786 - RNA, 17 nt, Mycobacterium bovis subsp bovis AF2122/97
gaucgccgcgauggcgg

SEQ ID NO: 1044787 - RNA, 20 nt, Mycobacterium bovis subsp bovis AF2122/97
gaucgagggggacgcugauc

SEQ ID NO: 1044788 - RNA, 24 nt, Mycobacterium bovis subsp bovis AF2122/97
gaucgaggugacggugacgaucag

SEQ ID NO: 1044789 - RNA, 18 nt, Mycobacterium bovis subsp bovis AF2122/97
gaucgagguugacgucag

SEQ ID NO: 1044790 - RNA, 23 nt, Mycobacterium bovis subsp bovis AF2122/97
gaucgaggaguuggugcagcgac

SEQ ID NO: 1044791 - RNA, 22 nt, Mycobacterium bovis subsp bovis AF2122/97
gaucgaggcgucggcaacccac

SEQ ID NO: 1044792 - RNA, 19 nt, Mycobacterium bovis subsp bovis AF2122/97
gaucgagggggacgcugau

SEQ ID NO: 1044793 - RNA, 17 nt, Mycobacterium bovis subsp bovis AF2122/97
gaucgagagccgaccgg

SEQ ID NO: 1044794 - RNA, 14 nt, Mycobacterium bovis subsp bovis AF2122/97
gaucgagcaggagg

SEQ ID NO: 1044795 - RNA, 17 nt, Mycobacterium bovis subsp bovis AF2122/97
gaucgagcaggccgccc

SEQ ID NO: 1044796 - RNA, 17 nt, Mycobacterium bovis subsp bovis AF2122/97
gaucgagcagggugacc

SEQ ID NO: 1044797 - RNA, 12 nt, Mycobacterium bovis subsp bovis AF2122/97
gaucgacggcca

SEQ ID NO: 1044798 - RNA, 22 nt, Mycobacterium bovis subsp bovis AF2122/97
gaucgacggccaucgugcggca

SEQ ID NO: 1044799 - RNA, 14 nt, Mycobacterium bovis subsp bovis AF2122/97
gaucgacggucguu

SEQ ID NO: 1044800 - RNA, 12 nt, Mycobacterium bovis subsp bovis AF2122/97
gaucgacggugu

SEQ ID NO: 1044801 - RNA, 13 nt, Mycobacterium bovis subsp bovis AF2122/97
gaucgacgguguc

SEQ ID NO: 1044802 - RNA, 18 nt, Mycobacterium bovis subsp bovis AF2122/97
gaucgacuucggcgucgg

SEQ ID NO: 1044803 - RNA, 14 nt, Mycobacterium bovis subsp bovis AF2122/97
gaugcccgcaacgc

SEQ ID NO: 1044804 - RNA, 20 nt, Mycobacterium bovis subsp bovis AF2122/97
gaugccccuucaaagcggcc

SEQ ID NO: 1044805 - RNA, 14 nt, Mycobacterium bovis subsp bovis AF2122/97
gaugcccgacaccg

SEQ ID NO: 1044806 - RNA, 15 nt, Mycobacterium bovis subsp bovis AF2122/97
gaugcccggcaucgc

SEQ ID NO: 1044807 - RNA, 14 nt, Mycobacterium bovis subsp bovis AF2122/97
gaugcccgucgaac

SEQ ID NO: 1044808 - RNA, 23 nt, Mycobacterium bovis subsp bovis AF2122/97
gaugcccgucgaaccagagguca

SEQ ID NO: 1044809 - RNA, 22 nt, Mycobacterium bovis subsp bovis AF2122/97
gaugcccuggggguggcagcgc

SEQ ID NO: 1044810 - RNA, 19 nt, Mycobacterium bovis subsp bovis AF2122/97
gaugcccuccucgaccgcg

SEQ ID NO: 1044811 - RNA, 16 nt, Mycobacterium bovis subsp bovis AF2122/97
gaugcccucgauggcc

SEQ ID NO: 1044812 - RNA, 14 nt, Mycobacterium bovis subsp bovis AF2122/97
gaugccgacgaacg

SEQ ID NO: 1044813 - RNA, 22 nt, Mycobacterium bovis subsp bovis AF2122/97
gaugccgacgaacgaaccgccg

SEQ ID NO: 1044814 - RNA, 13 nt, Mycobacterium bovis subsp bovis AF2122/97
gaugccgacggcg

SEQ ID NO: 1044815 - RNA, 14 nt, Mycobacterium bovis subsp bovis AF2122/97
gaugccgacggcgc

SEQ ID NO: 1044816 - RNA, 21 nt, Mycobacterium bovis subsp bovis AF2122/97
gaugcccacgcacagcaacgc

SEQ ID NO: 1044817 - RNA, 18 nt, Mycobacterium bovis subsp bovis AF2122/97
gaugcccacggugccggc

SEQ ID NO: 1044818 - RNA, 16 nt, Mycobacterium bovis subsp bovis AF2122/97
gaugcccauccggccg

SEQ ID NO: 1044819 - RNA, 22 nt, Mycobacterium bovis subsp bovis AF2122/97
gaugcccauccggccgucgggc

SEQ ID NO: 1044820 - RNA, 15 nt, Mycobacterium bovis subsp bovis AF2122/97
gaugccacggcgucg

SEQ ID NO: 1044821 - RNA, 18 nt, Mycobacterium bovis subsp bovis AF2122/97
gaugccacgucccaggac

SEQ ID NO: 1044822 - RNA, 18 nt, Mycobacterium bovis subsp bovis AF2122/97
gaugccacccaacagcgc

SEQ ID NO: 1044823 - RNA, 18 nt, Mycobacterium bovis subsp bovis AF2122/97
gaugccacccucgguguc

SEQ ID NO: 1044824 - RNA, 19 nt, Mycobacterium bovis subsp bovis AF2122/97
gaugccaucaacgacuucg

SEQ ID NO: 1044825 - RNA, 17 nt, Mycobacterium bovis subsp bovis AF2122/97
gaugccgaggaucgcgc

SEQ ID NO: 1044826 - RNA, 18 nt, Mycobacterium bovis subsp bovis AF2122/97
gaugccgaggaucgcgcc

SEQ ID NO: 1044827 - RNA, 13 nt, Mycobacterium bovis subsp bovis AF2122/97
gaugccgaugacc

SEQ ID NO: 1044828 - RNA, 22 nt, Mycobacterium bovis subsp bovis AF2122/97
gaugccgaugcgacgcagaccg

SEQ ID NO: 1044829 - RNA, 13 nt, Mycobacterium bovis subsp bovis AF2122/97
gaugccggcgagc

SEQ ID NO: 1044830 - RNA, 19 nt, Mycobacterium bovis subsp bovis AF2122/97
gaugccggcgagcaggccg

SEQ ID NO: 1044831 - RNA, 14 nt, Mycobacterium bovis subsp bovis AF2122/97
gaugccggcuggcg

SEQ ID NO: 1044832 - RNA, 18 nt, Mycobacterium bovis subsp bovis AF2122/97
gaugccggcugccgcacc

SEQ ID NO: 1044833 - RNA, 14 nt, Mycobacterium bovis subsp bovis AF2122/97
gaugcgcaccagcg

SEQ ID NO: 1044834 - RNA, 17 nt, Mycobacterium bovis subsp bovis AF2122/97
gaugcgcaccagcggcu

SEQ ID NO: 1044835 - RNA, 23 nt, Mycobacterium bovis subsp bovis AF2122/97
gaugcgcaacuucuucagcagcg

SEQ ID NO: 1044836 - RNA, 20 nt, Mycobacterium bovis subsp bovis AF2122/97
gaugcgcacaccgacccgcu

SEQ ID NO: 1044837 - RNA, 22 nt, Mycobacterium bovis subsp bovis AF2122/97
gaugcgcacucccggcucggcc

SEQ ID NO: 1044838 - RNA, 15 nt, Mycobacterium bovis subsp bovis AF2122/97
gaugcgccaccggcg

SEQ ID NO: 1044839 - RNA, 21 nt, Mycobacterium bovis subsp bovis AF2122/97
gaugcgcagugcaccgcgucg

SEQ ID NO: 1044840 - RNA, 23 nt, Mycobacterium bovis subsp bovis AF2122/97
gaugcgcacucccggcucggcca

SEQ ID NO: 1044841 - RNA, 20 nt, Mycobacterium bovis subsp bovis AF2122/97
gaugcgcagcccgucggugg

SEQ ID NO: 1044842 - RNA, 20 nt, Mycobacterium bovis subsp bovis AF2122/97
gaugcgauucugcgucugcu

SEQ ID NO: 1044843 - RNA, 16 nt, Mycobacterium bovis subsp bovis AF2122/97
gaugcgaugcgcgccg

SEQ ID NO: 1044844 - RNA, 17 nt, Mycobacterium bovis subsp bovis AF2122/97
gaugcgauggccgacgc

SEQ ID NO: 1044845 - RNA, 21 nt, Mycobacterium bovis subsp bovis AF2122/97
gaugcgauggccgacgcugcu

SEQ ID NO: 1044846 - RNA, 18 nt, Mycobacterium bovis subsp bovis AF2122/97
gaugcgauuccgcgucug

SEQ ID NO: 1044847 - RNA, 20 nt, Mycobacterium bovis subsp bovis AF2122/97
gaugcgauuccgcgucugcu

SEQ ID NO: 1044848 - RNA, 22 nt, Mycobacterium bovis subsp bovis AF2122/97
gaugccgggcugaggcggcgac

SEQ ID NO: 1044849 - RNA, 16 nt, Mycobacterium bovis subsp bovis AF2122/97
gaugccggucggcguc

SEQ ID NO: 1044850 - RNA, 22 nt, Mycobacterium bovis subsp bovis AF2122/97
gauggaaaacgccaugccggga

SEQ ID NO: 1044851 - RNA, 22 nt, Mycobacterium bovis subsp bovis AF2122/97
gaugcuggcggccucgccggcg

SEQ ID NO: 1044852 - RNA, 21 nt, Mycobacterium bovis subsp bovis AF2122/97
gaugcugucagacggcgucug

SEQ ID NO: 1044853 - RNA, 15 nt, Mycobacterium bovis subsp bovis AF2122/97
gaugcuggucggcga

SEQ ID NO: 1044854 - RNA, 17 nt, Mycobacterium bovis subsp bovis AF2122/97
gaugcuggucggcgaug

SEQ ID NO: 1044855 - RNA, 16 nt, Mycobacterium bovis subsp bovis AF2122/97
gaugcguccgcccagc

SEQ ID NO: 1044856 - RNA, 16 nt, Mycobacterium bovis subsp bovis AF2122/97
gaugcgcucggccugc

SEQ ID NO: 1044857 - RNA, 21 nt, Mycobacterium bovis subsp bovis AF2122/97
gaugcgugaccagucgcggcg

SEQ ID NO: 1044858 - RNA, 12 nt, Mycobacterium bovis subsp bovis AF2122/97
gaugcguucggc

SEQ ID NO: 1044859 - RNA, 22 nt, Mycobacterium bovis subsp bovis AF2122/97
gaugcggugguaggacgccagc

SEQ ID NO: 1044860 - RNA, 18 nt, Mycobacterium bovis subsp bovis AF2122/97
gaugcgguaucggucgac

SEQ ID NO: 1044861 - RNA, 17 nt, Mycobacterium bovis subsp bovis AF2122/97
gaugcgguauugcccgg

SEQ ID NO: 1044862 - RNA, 23 nt, Mycobacterium bovis subsp bovis AF2122/97
gaugcgguuccgauagccgacca

SEQ ID NO: 1044863 - RNA, 19 nt, Mycobacterium bovis subsp bovis AF2122/97
gaugcgguucucgagcucg

SEQ ID NO: 1044864 - RNA, 18 nt, Mycobacterium bovis subsp bovis AF2122/97
gaugcgcuuccaucgcca

SEQ ID NO: 1044865 - RNA, 23 nt, Mycobacterium bovis subsp bovis AF2122/97
gaugcgcuuccaucgccacuguu

SEQ ID NO: 1044866 - RNA, 17 nt, Mycobacterium bovis subsp bovis AF2122/97
gaugcgcgucucgagcg

SEQ ID NO: 1044867 - RNA, 21 nt, Mycobacterium bovis subsp bovis AF2122/97
gaugcgcguuacccaucgcca

SEQ ID NO: 1044868 - RNA, 15 nt, Mycobacterium bovis subsp bovis AF2122/97
gaugcggucggccac

SEQ ID NO: 1044869 - RNA, 16 nt, Mycobacterium bovis subsp bovis AF2122/97
gaugcggucgucacgg

SEQ ID NO: 1044870 - RNA, 22 nt, Mycobacterium bovis subsp bovis AF2122/97
gaugcggucgacgggcucguca

SEQ ID NO: 1044871 - RNA, 21 nt, Mycobacterium bovis subsp bovis AF2122/97
gaugcggaugucgucgaccag

SEQ ID NO: 1044872 - RNA, 17 nt, Mycobacterium bovis subsp bovis AF2122/97
gaugcggaacgccgagc

SEQ ID NO: 1044873 - RNA, 18 nt, Mycobacterium bovis subsp bovis AF2122/97
gaugcggaacgccgagca

SEQ ID NO: 1044874 - RNA, 15 nt, Mycobacterium bovis subsp bovis AF2122/97
gaugcggaccacacc

SEQ ID NO: 1044875 - RNA, 22 nt, Mycobacterium bovis subsp bovis AF2122/97
gaugcggaccacaccgucaccg

SEQ ID NO: 1044876 - RNA, 12 nt, Mycobacterium bovis subsp bovis AF2122/97
gauggcgguggg

SEQ ID NO: 1044877 - RNA, 20 nt, Mycobacterium bovis subsp bovis AF2122/97
gauggcgguggugccgcggc

SEQ ID NO: 1044878 - RNA, 23 nt, Mycobacterium bovis subsp bovis AF2122/97
gauggcgguggugccgcggccac

SEQ ID NO: 1044879 - RNA, 24 nt, Mycobacterium bovis subsp bovis AF2122/97
gauggcgguggugccgcggccacc

SEQ ID NO: 1044880 - RNA, 16 nt, Mycobacterium bovis subsp bovis AF2122/97
gauggcggcgacccgu

SEQ ID NO: 1044881 - RNA, 15 nt, Mycobacterium bovis subsp bovis AF2122/97
gauggcgcugcaccg

SEQ ID NO: 1044882 - RNA, 15 nt, Mycobacterium bovis subsp bovis AF2122/97
gauggcggccaccag

SEQ ID NO: 1044883 - RNA, 20 nt, Mycobacterium bovis subsp bovis AF2122/97
gauggcggccaccagcgccu

SEQ ID NO: 1044884 - RNA, 14 nt, Mycobacterium bovis subsp bovis AF2122/97
gauggcggccaccg

SEQ ID NO: 1044885 - RNA, 13 nt, Mycobacterium bovis subsp bovis AF2122/97
gauggcggccgag

SEQ ID NO: 1044886 - RNA, 15 nt, Mycobacterium bovis subsp bovis AF2122/97
gauggccgacgcugc

SEQ ID NO: 1044887 - RNA, 21 nt, Mycobacterium bovis subsp bovis AF2122/97
gauggcccccaagaccaagug

SEQ ID NO: 1044888 - RNA, 13 nt, Mycobacterium bovis subsp bovis AF2122/97
gauggccgccgac

SEQ ID NO: 1044889 - RNA, 23 nt, Mycobacterium bovis subsp bovis AF2122/97
gauggccgccgcgaggaugcuga

SEQ ID NO: 1044890 - RNA, 13 nt, Mycobacterium bovis subsp bovis AF2122/97
gauggccgcgccc

SEQ ID NO: 1044891 - RNA, 14 nt, Mycobacterium bovis subsp bovis AF2122/97
gauggccgccaggc

SEQ ID NO: 1044892 - RNA, 21 nt, Mycobacterium bovis subsp bovis AF2122/97
gauggccgaacccaccacgaa

SEQ ID NO: 1044893 - RNA, 19 nt, Mycobacterium bovis subsp bovis AF2122/97
gauggccaucuggccgcgg

SEQ ID NO: 1044894 - RNA, 21 nt, Mycobacterium bovis subsp bovis AF2122/97
gauggccaucuggccgcgggc

SEQ ID NO: 1044895 - RNA, 15 nt, Mycobacterium bovis subsp bovis AF2122/97
gauggccaucaucga

SEQ ID NO: 1044896 - RNA, 14 nt, Mycobacterium bovis subsp bovis AF2122/97
gauggacggcagcc

SEQ ID NO: 1044897 - RNA, 14 nt, Mycobacterium bovis subsp bovis AF2122/97
gauggagccgguga

SEQ ID NO: 1044898 - RNA, 15 nt, Mycobacterium bovis subsp bovis AF2122/97
gaugucggcucggcc

SEQ ID NO: 1044899 - RNA, 19 nt, Mycobacterium bovis subsp bovis AF2122/97
gaugucgggaaggugacgc

SEQ ID NO: 1044900 - RNA, 13 nt, Mycobacterium bovis subsp bovis AF2122/97
gaugucggggccg

SEQ ID NO: 1044901 - RNA, 23 nt, Mycobacterium bovis subsp bovis AF2122/97
gaugucggggccgucgucgguca

SEQ ID NO: 1044902 - RNA, 17 nt, Mycobacterium bovis subsp bovis AF2122/97
gaugucgucgacaucaa

SEQ ID NO: 1044903 - RNA, 20 nt, Mycobacterium bovis subsp bovis AF2122/97
gaugucggucggaucggcgc

SEQ ID NO: 1044904 - RNA, 15 nt, Mycobacterium bovis subsp bovis AF2122/97
gaugucggugcgucc

SEQ ID NO: 1044905 - RNA, 19 nt, Mycobacterium bovis subsp bovis AF2122/97
gaugucgcggucgaggucc

SEQ ID NO: 1044906 - RNA, 14 nt, Mycobacterium bovis subsp bovis AF2122/97
gaugucggcaggua

SEQ ID NO: 1044907 - RNA, 14 nt, Mycobacterium bovis subsp bovis AF2122/97
gaugucgcgcgcua

SEQ ID NO: 1044908 - RNA, 16 nt, Mycobacterium bovis subsp bovis AF2122/97
gaugucgccggcgacc

SEQ ID NO: 1044909 - RNA, 15 nt, Mycobacterium bovis subsp bovis AF2122/97
gaugucgaucagccg

SEQ ID NO: 1044910 - RNA, 17 nt, Mycobacterium bovis subsp bovis AF2122/97
gaugucgaugccgcgca

SEQ ID NO: 1044911 - RNA, 20 nt, Mycobacterium bovis subsp bovis AF2122/97
gaugucggugcguccggugc

SEQ ID NO: 1044912 - RNA, 19 nt, Mycobacterium bovis subsp bovis AF2122/97
gaugugacuuauccggcca

SEQ ID NO: 1044913 - RNA, 15 nt, Mycobacterium bovis subsp bovis AF2122/97
gaugugaguccagcc

SEQ ID NO: 1044914 - RNA, 16 nt, Mycobacterium bovis subsp bovis AF2122/97
gaugucucggcaccac

SEQ ID NO: 1044915 - RNA, 20 nt, Mycobacterium bovis subsp bovis AF2122/97
gaugucguuggccaccucgg

SEQ ID NO: 1044916 - RNA, 20 nt, Mycobacterium bovis subsp bovis AF2122/97
gaugucuaccaacaccgccc

SEQ ID NO: 1044917 - RNA, 20 nt, Mycobacterium bovis subsp bovis AF2122/97
gauguugcagaacucgcgua

SEQ ID NO: 1044918 - RNA, 17 nt, Mycobacterium bovis subsp bovis AF2122/97
gauguugccggaguuga

SEQ ID NO: 1044919 - RNA, 22 nt, Mycobacterium bovis subsp bovis AF2122/97
gauguugugccgaucggccaac

SEQ ID NO: 1044920 - RNA, 18 nt, Mycobacterium bovis subsp bovis AF2122/97
gauguuuuuggccgcggu

SEQ ID NO: 1044921 - RNA, 18 nt, Mycobacterium bovis subsp bovis AF2122/97
gauuaagucggcggccuu

SEQ ID NO: 1044922 - RNA, 14 nt, Mycobacterium bovis subsp bovis AF2122/97
gauggcgucgacca

SEQ ID NO: 1044923 - RNA, 14 nt, Mycobacterium bovis subsp bovis AF2122/97
gauggcgucggcca

SEQ ID NO: 1044924 - RNA, 19 nt, Mycobacterium bovis subsp bovis AF2122/97
gauggcgucaagcacacug

SEQ ID NO: 1044925 - RNA, 13 nt, Mycobacterium bovis subsp bovis AF2122/97
gauggugucgcgc

SEQ ID NO: 1044926 - RNA, 22 nt, Mycobacterium bovis subsp bovis AF2122/97
gauggcgucggugaaugccguc

SEQ ID NO: 1044927 - RNA, 20 nt, Mycobacterium bovis subsp bovis AF2122/97
gauggcguuugccggccgau

SEQ ID NO: 1044928 - RNA, 22 nt, Mycobacterium bovis subsp bovis AF2122/97
gauguagcggcguuccgggccg

SEQ ID NO: 1044929 - RNA, 15 nt, Mycobacterium bovis subsp bovis AF2122/97
gauguagcgcugcgg

SEQ ID NO: 1044930 - RNA, 17 nt, Mycobacterium bovis subsp bovis AF2122/97
gauguacccggcgacgu

SEQ ID NO: 1044931 - RNA, 23 nt, Mycobacterium bovis subsp bovis AF2122/97
gauguacugugccgcccccggca

SEQ ID NO: 1044932 - RNA, 19 nt, Mycobacterium bovis subsp bovis AF2122/97
gauguagagcucaccgucg

SEQ ID NO: 1044933 - RNA, 22 nt, Mycobacterium bovis subsp bovis AF2122/97
gaugguucaugaacaucggccg

SEQ ID NO: 1044934 - RNA, 15 nt, Mycobacterium bovis subsp bovis AF2122/97
gaugguugcgacggc

SEQ ID NO: 1044935 - RNA, 21 nt, Mycobacterium bovis subsp bovis AF2122/97
gaugguugcucgagcgguggc

SEQ ID NO: 1044936 - RNA, 16 nt, Mycobacterium bovis subsp bovis AF2122/97
gaugguuggaucgcca

SEQ ID NO: 1044937 - RNA, 18 nt, Mycobacterium bovis subsp bovis AF2122/97
gauguacaccgugcgccg

SEQ ID NO: 1044938 - RNA, 17 nt, Mycobacterium bovis subsp bovis AF2122/97
gauguacagcgggaucc

SEQ ID NO: 1044939 - RNA, 14 nt, Mycobacterium bovis subsp bovis AF2122/97
gauguaaugcgggc

SEQ ID NO: 1044940 - RNA, 23 nt, Mycobacterium bovis subsp bovis AF2122/97
gauguccccgacggacuccggcc

SEQ ID NO: 1044941 - RNA, 15 nt, Mycobacterium bovis subsp bovis AF2122/97
gauguccgcacaacg

SEQ ID NO: 1044942 - RNA, 19 nt, Mycobacterium bovis subsp bovis AF2122/97
gauguccgcagcaccgucg

SEQ ID NO: 1044943 - RNA, 22 nt, Mycobacterium bovis subsp bovis AF2122/97
gauguccgcagcaccgucgggc

SEQ ID NO: 1044944 - RNA, 18 nt, Mycobacterium bovis subsp bovis AF2122/97
gauguccgguccgccagc

SEQ ID NO: 1044945 - RNA, 16 nt, Mycobacterium bovis subsp bovis AF2122/97
gauguccucgacaccc

SEQ ID NO: 1044946 - RNA, 15 nt, Mycobacterium bovis subsp bovis AF2122/97
gaugucccgagcccg

SEQ ID NO: 1044947 - RNA, 16 nt, Mycobacterium bovis subsp bovis AF2122/97
gauguccgacgcacca

SEQ ID NO: 1044948 - RNA, 17 nt, Mycobacterium bovis subsp bovis AF2122/97
gauguccgcggccacca

SEQ ID NO: 1044949 - RNA, 16 nt, Mycobacterium bovis subsp bovis AF2122/97
gaugucgagcacaccg

SEQ ID NO: 1044950 - RNA, 19 nt, Mycobacterium bovis subsp bovis AF2122/97
gaugucgagcacaccgucg

SEQ ID NO: 1044951 - RNA, 16 nt, Mycobacterium bovis subsp bovis AF2122/97
gaugucgagcccgucg

SEQ ID NO: 1044952 - RNA, 15 nt, Mycobacterium bovis subsp bovis AF2122/97
gauguccuugcgguc

SEQ ID NO: 1044953 - RNA, 14 nt, Mycobacterium bovis subsp bovis AF2122/97
gauguccucgagca

SEQ ID NO: 1044954 - RNA, 16 nt, Mycobacterium bovis subsp bovis AF2122/97
gauguccucgagcacc

SEQ ID NO: 1044955 - RNA, 18 nt, Mycobacterium bovis subsp bovis AF2122/97
gauguccucgaugcgggc

SEQ ID NO: 1044956 - RNA, 19 nt, Mycobacterium bovis subsp bovis AF2122/97
gauguccaggagugcgggc

SEQ ID NO: 1044957 - RNA, 16 nt, Mycobacterium bovis subsp bovis AF2122/97
gauguccccgacggac

SEQ ID NO: 1044958 - RNA, 13 nt, Mycobacterium bovis subsp bovis AF2122/97
gaugucagcggcc

SEQ ID NO: 1044959 - RNA, 15 nt, Mycobacterium bovis subsp bovis AF2122/97
gaugucagcggccgc

SEQ ID NO: 1044960 - RNA, 16 nt, Mycobacterium bovis subsp bovis AF2122/97
gaugucagcggccgcg

SEQ ID NO: 1044961 - RNA, 12 nt, Mycobacterium bovis subsp bovis AF2122/97
gauguagcggcg

SEQ ID NO: 1044962 - RNA, 16 nt, Mycobacterium bovis subsp bovis AF2122/97
gauguagugcugcucg

SEQ ID NO: 1044963 - RNA, 21 nt, Mycobacterium bovis subsp bovis AF2122/97
gauguaguuggugaugccgau

SEQ ID NO: 1044964 - RNA, 16 nt, Mycobacterium bovis subsp bovis AF2122/97
gauguaugacagguca

SEQ ID NO: 1044965 - RNA, 16 nt, Mycobacterium bovis subsp bovis AF2122/97
gaugucaacgugguca

SEQ ID NO: 1044966 - RNA, 23 nt, Mycobacterium bovis subsp bovis AF2122/97
gcaaaccgcgcagaacgaucgcg

SEQ ID NO: 1044967 - RNA, 22 nt, Mycobacterium bovis subsp bovis AF2122/97
gcaaaccgcugcgcgaaucgcg

SEQ ID NO: 1044968 - RNA, 18 nt, Mycobacterium bovis subsp bovis AF2122/97
gcaaaccgaucaauccgc

SEQ ID NO: 1044969 - RNA, 23 nt, Mycobacterium bovis subsp bovis AF2122/97
gcaaaccgaucaauccgcccuug

SEQ ID NO: 1044970 - RNA, 15 nt, Mycobacterium bovis subsp bovis AF2122/97
gcaaaagccaccgca

SEQ ID NO: 1044971 - RNA, 21 nt, Mycobacterium bovis subsp bovis AF2122/97
gcaaaacccgcuccaccccua

SEQ ID NO: 1044972 - RNA, 20 nt, Mycobacterium bovis subsp bovis AF2122/97
gcaaaaucgaugacgguccu

SEQ ID NO: 1044973 - RNA, 15 nt, Mycobacterium bovis subsp bovis AF2122/97
gcaaaaucgcccaau

SEQ ID NO: 1044974 - RNA, 19 nt, Mycobacterium bovis subsp bovis AF2122/97
gcaaaaucgcccaauucgg

SEQ ID NO: 1044975 - RNA, 18 nt, Mycobacterium bovis subsp bovis AF2122/97
gcaaaaucgucagcgccg

SEQ ID NO: 1044976 - RNA, 21 nt, Mycobacterium bovis subsp bovis AF2122/97
gauuuugcgucgcgccugccc

SEQ ID NO: 1044977 - RNA, 18 nt, Mycobacterium bovis subsp bovis AF2122/97
gauuuugcgucugcucgc

SEQ ID NO: 1044978 - RNA, 20 nt, Mycobacterium bovis subsp bovis AF2122/97
gauuuugcgucugcucgccg

SEQ ID NO: 1044979 - RNA, 19 nt, Mycobacterium bovis subsp bovis AF2122/97
gauuuugcgucugcucgcg

SEQ ID NO: 1044980 - RNA, 20 nt, Mycobacterium bovis subsp bovis AF2122/97
gauuuugcgucugcucgcgc

SEQ ID NO: 1044981 - RNA, 20 nt, Mycobacterium bovis subsp bovis AF2122/97
gauuuugcgucugcucggcg

SEQ ID NO: 1044982 - RNA, 17 nt, Mycobacterium bovis subsp bovis AF2122/97
gauuuugugucugcucg

SEQ ID NO: 1044983 - RNA, 19 nt, Mycobacterium bovis subsp bovis AF2122/97
gauuuggaucggcugcgcg

SEQ ID NO: 1044984 - RNA, 19 nt, Mycobacterium bovis subsp bovis AF2122/97
gauuuuccgccuguacggc

SEQ ID NO: 1044985 - RNA, 14 nt, Mycobacterium bovis subsp bovis AF2122/97
gauuggcugcgccg

SEQ ID NO: 1044986 - RNA, 19 nt, Mycobacterium bovis subsp bovis AF2122/97
gauuggcgaucuugcgacg

SEQ ID NO: 1044987 - RNA, 15 nt, Mycobacterium bovis subsp bovis AF2122/97
gauuggcucgccgaa

SEQ ID NO: 1044988 - RNA, 13 nt, Mycobacterium bovis subsp bovis AF2122/97
gauugcgaccgcg

SEQ ID NO: 1044989 - RNA, 16 nt, Mycobacterium bovis subsp bovis AF2122/97
gauuggcagaccggug

SEQ ID NO: 1044990 - RNA, 19 nt, Mycobacterium bovis subsp bovis AF2122/97
gauuggccaaccccauggc

SEQ ID NO: 1044991 - RNA, 23 nt, Mycobacterium bovis subsp bovis AF2122/97
gauuggccaaccccauggccagc

SEQ ID NO: 1044992 - RNA, 12 nt, Mycobacterium bovis subsp bovis AF2122/97
gauuggcgcugc

SEQ ID NO: 1044993 - RNA, 18 nt, Mycobacterium bovis subsp bovis AF2122/97
gauuggcgcugcccgccg

SEQ ID NO: 1044994 - RNA, 13 nt, Mycobacterium bovis subsp bovis AF2122/97
gauuggccgcugc

SEQ ID NO: 1044995 - RNA, 16 nt, Mycobacterium bovis subsp bovis AF2122/97
gauucccgcggacagc

SEQ ID NO: 1044996 - RNA, 18 nt, Mycobacterium bovis subsp bovis AF2122/97
gauucccggcgcgguggc

SEQ ID NO: 1044997 - RNA, 13 nt, Mycobacterium bovis subsp bovis AF2122/97
gauucccgagacu

SEQ ID NO: 1044998 - RNA, 13 nt, Mycobacterium bovis subsp bovis AF2122/97
gauuccggcggcc

SEQ ID NO: 1044999 - RNA, 22 nt, Mycobacterium bovis subsp bovis AF2122/97
gauuccggcggccacgccggcg

SEQ ID NO: 1045000 - RNA, 14 nt, Mycobacterium bovis subsp bovis AF2122/97
gauuccggcucguc

SEQ ID NO: 1045001 - RNA, 23 nt, Mycobacterium bovis subsp bovis AF2122/97
gauuccgcccacaugcgcucgcg

SEQ ID NO: 1045002 - RNA, 13 nt, Mycobacterium bovis subsp bovis AF2122/97
gauuccgccgcac

SEQ ID NO: 1045003 - RNA, 22 nt, Mycobacterium bovis subsp bovis AF2122/97
gauuccgcucacgaagaccgcg

SEQ ID NO: 1045004 - RNA, 22 nt, Mycobacterium bovis subsp bovis AF2122/97
gauugaccaacccucgccgguc

SEQ ID NO: 1045005 - RNA, 16 nt, Mycobacterium bovis subsp bovis AF2122/97
gauugaccugcuggcg

SEQ ID NO: 1045006 - RNA, 20 nt, Mycobacterium bovis subsp bovis AF2122/97
gauugaccugcuggcgcacg

SEQ ID NO: 1045007 - RNA, 15 nt, Mycobacterium bovis subsp bovis AF2122/97
gauuaccagcggcac

SEQ ID NO: 1045008 - RNA, 23 nt, Mycobacterium bovis subsp bovis AF2122/97
gauuccagcagccugcgccgcgc

SEQ ID NO: 1045009 - RNA, 22 nt, Mycobacterium bovis subsp bovis AF2122/97
gauuccaauugggcgaugcggc

SEQ ID NO: 1045010 - RNA, 19 nt, Mycobacterium bovis subsp bovis AF2122/97
gauugcgcgggcaucgucg

SEQ ID NO: 1045011 - RNA, 20 nt, Mycobacterium bovis subsp bovis AF2122/97
gauugcgcgcugagcucgau

SEQ ID NO: 1045012 - RNA, 20 nt, Mycobacterium bovis subsp bovis AF2122/97
gauugcggcacggaugcgau

SEQ ID NO: 1045013 - RNA, 14 nt, Mycobacterium bovis subsp bovis AF2122/97
gauugcggccgccg

SEQ ID NO: 1045014 - RNA, 15 nt, Mycobacterium bovis subsp bovis AF2122/97
gauugcggccgccga

SEQ ID NO: 1045015 - RNA, 18 nt, Mycobacterium bovis subsp bovis AF2122/97
gauugcgggacuugucgg

SEQ ID NO: 1045016 - RNA, 19 nt, Mycobacterium bovis subsp bovis AF2122/97
gauugcuguacugcggugc

SEQ ID NO: 1045017 - RNA, 18 nt, Mycobacterium bovis subsp bovis AF2122/97
gauugccaggaccgcgcc

SEQ ID NO: 1045018 - RNA, 19 nt, Mycobacterium bovis subsp bovis AF2122/97
gauugccgcguagguggcc

SEQ ID NO: 1045019 - RNA, 16 nt, Mycobacterium bovis subsp bovis AF2122/97
gauugccgucgguggu

SEQ ID NO: 1045020 - RNA, 20 nt, Mycobacterium bovis subsp bovis AF2122/97
gauugccgucgugaucggcg

SEQ ID NO: 1045021 - RNA, 13 nt, Mycobacterium bovis subsp bovis AF2122/97
gauugcgcacacc

SEQ ID NO: 1045022 - RNA, 14 nt, Mycobacterium bovis subsp bovis AF2122/97
gauugcgcacaccc

SEQ ID NO: 1045023 - RNA, 22 nt, Mycobacterium bovis subsp bovis AF2122/97
gauugcgccaggagcgcggccc

SEQ ID NO: 1045024 - RNA, 23 nt, Mycobacterium bovis subsp bovis AF2122/97
gauugcgccaggagcgcggcccg

SEQ ID NO: 1045025 - RNA, 12 nt, Mycobacterium bovis subsp bovis AF2122/97
gauugccugggc

SEQ ID NO: 1045026 - RNA, 23 nt, Mycobacterium bovis subsp bovis AF2122/97
gauugcgaagggcaccggcgauc

SEQ ID NO: 1045027 - RNA, 13 nt, Mycobacterium bovis subsp bovis AF2122/97
gauugccccgcau

SEQ ID NO: 1045028 - RNA, 17 nt, Mycobacterium bovis subsp bovis AF2122/97
gauugcccgcgcucgca

SEQ ID NO: 1045029 - RNA, 21 nt, Mycobacterium bovis subsp bovis AF2122/97
gauugaugcgugguuggccau

SEQ ID NO: 1045030 - RNA, 21 nt, Mycobacterium bovis subsp bovis AF2122/97
gauugaggcuggucugcaggc

SEQ ID NO: 1045031 - RNA, 15 nt, Mycobacterium bovis subsp bovis AF2122/97
gcagcgcgaugucgc

SEQ ID NO: 1045032 - RNA, 20 nt, Mycobacterium bovis subsp bovis AF2122/97
gcagcgcgaugucgccggcg

SEQ ID NO: 1045033 - RNA, 22 nt, Mycobacterium bovis subsp bovis AF2122/97
gcagcgcgaugucgccggcgac

SEQ ID NO: 1045034 - RNA, 14 nt, Mycobacterium bovis subsp bovis AF2122/97
gcagcgcgauggcc

SEQ ID NO: 1045035 - RNA, 16 nt, Mycobacterium bovis subsp bovis AF2122/97
gcagcgccucgauccg

SEQ ID NO: 1045036 - RNA, 17 nt, Mycobacterium bovis subsp bovis AF2122/97
gcagcgccuaccagcac

SEQ ID NO: 1045037 - RNA, 15 nt, Mycobacterium bovis subsp bovis AF2122/97
gcagcgccgccaccc

SEQ ID NO: 1045038 - RNA, 21 nt, Mycobacterium bovis subsp bovis AF2122/97
gcagcgccgcguggcuggcgg

SEQ ID NO: 1045039 - RNA, 14 nt, Mycobacterium bovis subsp bovis AF2122/97
gcagcgccgucagc

SEQ ID NO: 1045040 - RNA, 12 nt, Mycobacterium bovis subsp bovis AF2122/97
gcagcgcgcccg

SEQ ID NO: 1045041 - RNA, 13 nt, Mycobacterium bovis subsp bovis AF2122/97
gcagcgcgcccga

SEQ ID NO: 1045042 - RNA, 18 nt, Mycobacterium bovis subsp bovis AF2122/97
gcagcgcgcccgacaccc

SEQ ID NO: 1045043 - RNA, 18 nt, Mycobacterium bovis subsp bovis AF2122/97
gcagcgcgcccugcgcgu

SEQ ID NO: 1045044 - RNA, 19 nt, Mycobacterium bovis subsp bovis AF2122/97
gcagcgcgccguucgccug

SEQ ID NO: 1045045 - RNA, 15 nt, Mycobacterium bovis subsp bovis AF2122/97
gcagcgcgcggaugg

SEQ ID NO: 1045046 - RNA, 14 nt, Mycobacterium bovis subsp bovis AF2122/97
gcagcgcggccacc

SEQ ID NO: 1045047 - RNA, 16 nt, Mycobacterium bovis subsp bovis AF2122/97
gcagcgcggccacccg

SEQ ID NO: 1045048 - RNA, 14 nt, Mycobacterium bovis subsp bovis AF2122/97
gcagcgccaggccg

SEQ ID NO: 1045049 - RNA, 15 nt, Mycobacterium bovis subsp bovis AF2122/97
gcagcgccaggccgu

SEQ ID NO: 1045050 - RNA, 21 nt, Mycobacterium bovis subsp bovis AF2122/97
gcagcgauaucacaacugccc

SEQ ID NO: 1045051 - RNA, 20 nt, Mycobacterium bovis subsp bovis AF2122/97
gcagcgcccuuggacgcgau

SEQ ID NO: 1045052 - RNA, 12 nt, Mycobacterium bovis subsp bovis AF2122/97
gcagcgccgcca

SEQ ID NO: 1045053 - RNA, 14 nt, Mycobacterium bovis subsp bovis AF2122/97
gcagcgccgacagc

SEQ ID NO: 1045054 - RNA, 15 nt, Mycobacterium bovis subsp bovis AF2122/97
gcagcgccgacagcc

SEQ ID NO: 1045055 - RNA, 16 nt, Mycobacterium bovis subsp bovis AF2122/97
gcagcgccgacagccg

SEQ ID NO: 1045056 - RNA, 22 nt, Mycobacterium bovis subsp bovis AF2122/97
gcagcgccgacagccgauccga

SEQ ID NO: 1045057 - RNA, 12 nt, Mycobacterium bovis subsp bovis AF2122/97
gcagcgccgcgc

SEQ ID NO: 1045058 - RNA, 19 nt, Mycobacterium bovis subsp bovis AF2122/97
gcagcgacgggaaagccac

SEQ ID NO: 1045059 - RNA, 17 nt, Mycobacterium bovis subsp bovis AF2122/97
gcagccugccgaugacg

SEQ ID NO: 1045060 - RNA, 18 nt, Mycobacterium bovis subsp bovis AF2122/97
gcagccuggucgcgcagc

SEQ ID NO: 1045061 - RNA, 15 nt, Mycobacterium bovis subsp bovis AF2122/97
gcagccugcgccgcg

SEQ ID NO: 1045062 - RNA, 16 nt, Mycobacterium bovis subsp bovis AF2122/97
gcagccugcgccgcgc

SEQ ID NO: 1045063 - RNA, 16 nt, Mycobacterium bovis subsp bovis AF2122/97
gcagccaggagccgau

SEQ ID NO: 1045064 - RNA, 16 nt, Mycobacterium bovis subsp bovis AF2122/97
gcagccagcggcgaag

SEQ ID NO: 1045065 - RNA, 18 nt, Mycobacterium bovis subsp bovis AF2122/97
gcagccaggugucgucga

SEQ ID NO: 1045066 - RNA, 22 nt, Mycobacterium bovis subsp bovis AF2122/97
gcagccaggugucgucgaucgc

SEQ ID NO: 1045067 - RNA, 23 nt, Mycobacterium bovis subsp bovis AF2122/97
gcagccaggugucgucgaucgcg

SEQ ID NO: 1045068 - RNA, 14 nt, Mycobacterium bovis subsp bovis AF2122/97
gcagccagcgucca

SEQ ID NO: 1045069 - RNA, 18 nt, Mycobacterium bovis subsp bovis AF2122/97
gcagccaggcugcggaua

SEQ ID NO: 1045070 - RNA, 14 nt, Mycobacterium bovis subsp bovis AF2122/97
gcagccagcccagc

SEQ ID NO: 1045071 - RNA, 17 nt, Mycobacterium bovis subsp bovis AF2122/97
gcagccagggcgccgaa

SEQ ID NO: 1045072 - RNA, 17 nt, Mycobacterium bovis subsp bovis AF2122/97
gcagcggugcagcccgc

SEQ ID NO: 1045073 - RNA, 19 nt, Mycobacterium bovis subsp bovis AF2122/97
gcagcgguccagacaucag

SEQ ID NO: 1045074 - RNA, 22 nt, Mycobacterium bovis subsp bovis AF2122/97
gcagcgguugaugcggccgcgg

SEQ ID NO: 1045075 - RNA, 18 nt, Mycobacterium bovis subsp bovis AF2122/97
gcagcguagugcugcgcg

SEQ ID NO: 1045076 - RNA, 16 nt, Mycobacterium bovis subsp bovis AF2122/97
gcagcguccgaaccac

SEQ ID NO: 1045077 - RNA, 17 nt, Mycobacterium bovis subsp bovis AF2122/97
gcagcguccgaaccacc

SEQ ID NO: 1045078 - RNA, 22 nt, Mycobacterium bovis subsp bovis AF2122/97
gcagcguccgcggaugcauguc

SEQ ID NO: 1045079 - RNA, 22 nt, Mycobacterium bovis subsp bovis AF2122/97
gcagcgugugcucgugggcgac

SEQ ID NO: 1045080 - RNA, 14 nt, Mycobacterium bovis subsp bovis AF2122/97
gcagcgugggcagc

SEQ ID NO: 1045081 - RNA, 15 nt, Mycobacterium bovis subsp bovis AF2122/97
gcagcggcauccagc

SEQ ID NO: 1045082 - RNA, 19 nt, Mycobacterium bovis subsp bovis AF2122/97
gcagcggguuugccgggcg

SEQ ID NO: 1045083 - RNA, 16 nt, Mycobacterium bovis subsp bovis AF2122/97
gcagcgcggauucggu

SEQ ID NO: 1045084 - RNA, 13 nt, Mycobacterium bovis subsp bovis AF2122/97
gcagcgcggcacc

SEQ ID NO: 1045085 - RNA, 19 nt, Mycobacterium bovis subsp bovis AF2122/97
gcagcucguugaugcggcu

SEQ ID NO: 1045086 - RNA, 20 nt, Mycobacterium bovis subsp bovis AF2122/97
gcagcucgccggcacgcagc

SEQ ID NO: 1045087 - RNA, 17 nt, Mycobacterium bovis subsp bovis AF2122/97
gcagcucggccgaggcg

SEQ ID NO: 1045088 - RNA, 14 nt, Mycobacterium bovis subsp bovis AF2122/97
gcagcucggggcga

SEQ ID NO: 1045089 - RNA, 19 nt, Mycobacterium bovis subsp bovis AF2122/97
gcagcugcgauauggucac

SEQ ID NO: 1045090 - RNA, 16 nt, Mycobacterium bovis subsp bovis AF2122/97
gcagcugagccguguc

SEQ ID NO: 1045091 - RNA, 22 nt, Mycobacterium bovis subsp bovis AF2122/97
gcagcugcgauauggucaccaa

SEQ ID NO: 1045092 - RNA, 17 nt, Mycobacterium bovis subsp bovis AF2122/97
gcagcugcucggucagg

SEQ ID NO: 1045093 - RNA, 20 nt, Mycobacterium bovis subsp bovis AF2122/97
gcagcugcucuccgucgcgc

SEQ ID NO: 1045094 - RNA, 13 nt, Mycobacterium bovis subsp bovis AF2122/97
gcagcugcccggc

SEQ ID NO: 1045095 - RNA, 15 nt, Mycobacterium bovis subsp bovis AF2122/97
gcagcugacgucacc

SEQ ID NO: 1045096 - RNA, 19 nt, Mycobacterium bovis subsp bovis AF2122/97
gcagcugacgucaccacga

SEQ ID NO: 1045097 - RNA, 14 nt, Mycobacterium bovis subsp bovis AF2122/97
gcagcucgcacucg

SEQ ID NO: 1045098 - RNA, 11 nt, Mycobacterium bovis subsp bovis AF2122/97
gcagcucgccg

SEQ ID NO: 1045099 - RNA, 13 nt, Mycobacterium bovis subsp bovis AF2122/97
gcagcucgccgag

SEQ ID NO: 1045100 - RNA, 14 nt, Mycobacterium bovis subsp bovis AF2122/97
gcagcuccguggug

SEQ ID NO: 1045101 - RNA, 15 nt, Mycobacterium bovis subsp bovis AF2122/97
gcagcuccgccgccg

SEQ ID NO: 1045102 - RNA, 16 nt, Mycobacterium bovis subsp bovis AF2122/97
gcagcuccgccgccga

SEQ ID NO: 1045103 - RNA, 21 nt, Mycobacterium bovis subsp bovis AF2122/97
gcagcggccagcccagccggg

SEQ ID NO: 1045104 - RNA, 22 nt, Mycobacterium bovis subsp bovis AF2122/97
gcagcucccgccacgucgccgg

SEQ ID NO: 1045105 - RNA, 19 nt, Mycobacterium bovis subsp bovis AF2122/97
gcagcucccgccacgucgc

SEQ ID NO: 1045106 - RNA, 21 nt, Mycobacterium bovis subsp bovis AF2122/97
gcagcucaccgacggagaucg

SEQ ID NO: 1045107 - RNA, 14 nt, Mycobacterium bovis subsp bovis AF2122/97
gcagcucacuggug

SEQ ID NO: 1045108 - RNA, 21 nt, Mycobacterium bovis subsp bovis AF2122/97
gcagcucaucgcgcacgcccu

SEQ ID NO: 1045109 - RNA, 14 nt, Mycobacterium bovis subsp bovis AF2122/97
gcagcuccaccagg

SEQ ID NO: 1045110 - RNA, 14 nt, Mycobacterium bovis subsp bovis AF2122/97
gcagcguuggccgc

SEQ ID NO: 1045111 - RNA, 16 nt, Mycobacterium bovis subsp bovis AF2122/97
gcagcuauuucgcgac

SEQ ID NO: 1045112 - RNA, 22 nt, Mycobacterium bovis subsp bovis AF2122/97
gcagcguugacggcggggcggc

SEQ ID NO: 1045113 - RNA, 16 nt, Mycobacterium bovis subsp bovis AF2122/97
gcagcguugacgguca

SEQ ID NO: 1045114 - RNA, 15 nt, Mycobacterium bovis subsp bovis AF2122/97
gcagcucaccgacgg

SEQ ID NO: 1045115 - RNA, 17 nt, Mycobacterium bovis subsp bovis AF2122/97
gcagagcguuccgcucg

SEQ ID NO: 1045116 - RNA, 18 nt, Mycobacterium bovis subsp bovis AF2122/97
gcagagcggcacgcacgc

SEQ ID NO: 1045117 - RNA, 19 nt, Mycobacterium bovis subsp bovis AF2122/97
gcagagcggcacgcacgcg

SEQ ID NO: 1045118 - RNA, 15 nt, Mycobacterium bovis subsp bovis AF2122/97
gcagagccgccguug

SEQ ID NO: 1045119 - RNA, 21 nt, Mycobacterium bovis subsp bovis AF2122/97
gcagagccgccguugccgccg

SEQ ID NO: 1045120 - RNA, 14 nt, Mycobacterium bovis subsp bovis AF2122/97
gcacucggcgcccu

SEQ ID NO: 1045121 - RNA, 17 nt, Mycobacterium bovis subsp bovis AF2122/97
gcacucggcgguuccgg

SEQ ID NO: 1045122 - RNA, 20 nt, Mycobacterium bovis subsp bovis AF2122/97
gcacucgggauucggcagcg

SEQ ID NO: 1045123 - RNA, 15 nt, Mycobacterium bovis subsp bovis AF2122/97
gcacucggccacgac

SEQ ID NO: 1045124 - RNA, 18 nt, Mycobacterium bovis subsp bovis AF2122/97
gcacucggccacgacgac

SEQ ID NO: 1045125 - RNA, 16 nt, Mycobacterium bovis subsp bovis AF2122/97
gcacucggcccggccc

SEQ ID NO: 1045126 - RNA, 22 nt, Mycobacterium bovis subsp bovis AF2122/97
gcacucgaagaugucgucaccg

SEQ ID NO: 1045127 - RNA, 19 nt, Mycobacterium bovis subsp bovis AF2122/97
gcacucgaccaggaccggc

SEQ ID NO: 1045128 - RNA, 19 nt, Mycobacterium bovis subsp bovis AF2122/97
gcagaguauucagcgguug

SEQ ID NO: 1045129 - RNA, 20 nt, Mycobacterium bovis subsp bovis AF2122/97
gcagagucgcacugcgccgg

SEQ ID NO: 1045130 - RNA, 23 nt, Mycobacterium bovis subsp bovis AF2122/97
gcagagucgcacugcgccggccg

SEQ ID NO: 1045131 - RNA, 14 nt, Mycobacterium bovis subsp bovis AF2122/97
gcagaucgauaccg

SEQ ID NO: 1045132 - RNA, 18 nt, Mycobacterium bovis subsp bovis AF2122/97
gcagauauuccucgucgg

SEQ ID NO: 1045133 - RNA, 22 nt, Mycobacterium bovis subsp bovis AF2122/97
gcagaucagcacguugauucgg

SEQ ID NO: 1045134 - RNA, 20 nt, Mycobacterium bovis subsp bovis AF2122/97
gcagaucaggacgcgaucgg

SEQ ID NO: 1045135 - RNA, 16 nt, Mycobacterium bovis subsp bovis AF2122/97
gcagauacgagcugua

SEQ ID NO: 1045136 - RNA, 20 nt, Mycobacterium bovis subsp bovis AF2122/97
gcagauacuccgcgguuguu

SEQ ID NO: 1045137 - RNA, 22 nt, Mycobacterium bovis subsp bovis AF2122/97
gcagcacccacaucagccgcac

SEQ ID NO: 1045138 - RNA, 22 nt, Mycobacterium bovis subsp bovis AF2122/97
gcagcaccgcacggaggcggac

SEQ ID NO: 1045139 - RNA, 15 nt, Mycobacterium bovis subsp bovis AF2122/97
gcagcacccgcacgg

SEQ ID NO: 1045140 - RNA, 13 nt, Mycobacterium bovis subsp bovis AF2122/97
gcagcacccgcgc

SEQ ID NO: 1045141 - RNA, 16 nt, Mycobacterium bovis subsp bovis AF2122/97
gcagcaaucagccgcc

SEQ ID NO: 1045142 - RNA, 18 nt, Mycobacterium bovis subsp bovis AF2122/97
gcagcaaugcgguaccaa

SEQ ID NO: 1045143 - RNA, 21 nt, Mycobacterium bovis subsp bovis AF2122/97
gcagcacaggcuggcgauggc

SEQ ID NO: 1045144 - RNA, 15 nt, Mycobacterium bovis subsp bovis AF2122/97
gcagaugaugccguu

SEQ ID NO: 1045145 - RNA, 14 nt, Mycobacterium bovis subsp bovis AF2122/97
gcagaugaugccgu

SEQ ID NO: 1045146 - RNA, 20 nt, Mycobacterium bovis subsp bovis AF2122/97
gcagaugaauugccgggcgc

SEQ ID NO: 1045147 - RNA, 18 nt, Mycobacterium bovis subsp bovis AF2122/97
gcagaucuuccgagcacu

SEQ ID NO: 1045148 - RNA, 22 nt, Mycobacterium bovis subsp bovis AF2122/97
gcagaucaggguggcgcgguac

SEQ ID NO: 1045149 - RNA, 20 nt, Mycobacterium bovis subsp bovis AF2122/97
gcagaucggcucaccgaacg

SEQ ID NO: 1045150 - RNA, 12 nt, Mycobacterium bovis subsp bovis AF2122/97
gcagaucgcccc

SEQ ID NO: 1045151 - RNA, 17 nt, Mycobacterium bovis subsp bovis AF2122/97
gcagauccccgccaccg

SEQ ID NO: 1045152 - RNA, 19 nt, Mycobacterium bovis subsp bovis AF2122/97
gcagauccccgccaccgaa

SEQ ID NO: 1045153 - RNA, 20 nt, Mycobacterium bovis subsp bovis AF2122/97
gcagauccccgccaccgaac

SEQ ID NO: 1045154 - RNA, 15 nt, Mycobacterium bovis subsp bovis AF2122/97
gcagaucgauaccgu

SEQ ID NO: 1045155 - RNA, 16 nt, Mycobacterium bovis subsp bovis AF2122/97
gcagcaucggcgacag

SEQ ID NO: 1045156 - RNA, 14 nt, Mycobacterium bovis subsp bovis AF2122/97
gcagcaucgucgcc

SEQ ID NO: 1045157 - RNA, 19 nt, Mycobacterium bovis subsp bovis AF2122/97
gcagcaucggucacaccga

SEQ ID NO: 1045158 - RNA, 23 nt, Mycobacterium bovis subsp bovis AF2122/97
gcagcaucggcacgucguugggc

SEQ ID NO: 1045159 - RNA, 21 nt, Mycobacterium bovis subsp bovis AF2122/97
gcagcauccccgcagcgucca

SEQ ID NO: 1045160 - RNA, 16 nt, Mycobacterium bovis subsp bovis AF2122/97
gcagcaucacguccgc

SEQ ID NO: 1045161 - RNA, 16 nt, Mycobacterium bovis subsp bovis AF2122/97
gcagcaucaacaccgg

SEQ ID NO: 1045162 - RNA, 13 nt, Mycobacterium bovis subsp bovis AF2122/97
gcagcauauccgc

SEQ ID NO: 1045163 - RNA, 14 nt, Mycobacterium bovis subsp bovis AF2122/97
gcagcauauccgcc

SEQ ID NO: 1045164 - RNA, 16 nt, Mycobacterium bovis subsp bovis AF2122/97
gcagcaguuggucgcg

SEQ ID NO: 1045165 - RNA, 15 nt, Mycobacterium bovis subsp bovis AF2122/97
gcagcauggccaucg

SEQ ID NO: 1045166 - RNA, 18 nt, Mycobacterium bovis subsp bovis AF2122/97
gcagcauggcccuggcga

SEQ ID NO: 1045167 - RNA, 23 nt, Mycobacterium bovis subsp bovis AF2122/97
gcagcaucuggggguagccgccg

SEQ ID NO: 1045168 - RNA, 17 nt, Mycobacterium bovis subsp bovis AF2122/97
gcagcauguggccgccg

SEQ ID NO: 1045169 - RNA, 18 nt, Mycobacterium bovis subsp bovis AF2122/97
gcagcauguggccgccgu

SEQ ID NO: 1045170 - RNA, 18 nt, Mycobacterium bovis subsp bovis AF2122/97
gcagcauggugcggcggc

SEQ ID NO: 1045171 - RNA, 19 nt, Mycobacterium bovis subsp bovis AF2122/97
gcagcauggugcggcggcg

SEQ ID NO: 1045172 - RNA, 18 nt, Mycobacterium bovis subsp bovis AF2122/97
gcagcauguccgcagcgg

SEQ ID NO: 1045173 - RNA, 21 nt, Mycobacterium bovis subsp bovis AF2122/97
gcagcauguccgcagcggugc

SEQ ID NO: 1045174 - RNA, 20 nt, Mycobacterium bovis subsp bovis AF2122/97
gcagcaugucguaguagcgg

SEQ ID NO: 1045175 - RNA, 22 nt, Mycobacterium bovis subsp bovis AF2122/97
gcagccaccgucaugccgacga

SEQ ID NO: 1045176 - RNA, 15 nt, Mycobacterium bovis subsp bovis AF2122/97
gcagccagccaccga

SEQ ID NO: 1045177 - RNA, 19 nt, Mycobacterium bovis subsp bovis AF2122/97
gcagccaccagcgacgacc

SEQ ID NO: 1045178 - RNA, 13 nt, Mycobacterium bovis subsp bovis AF2122/97
gcagccacccgac

SEQ ID NO: 1045179 - RNA, 15 nt, Mycobacterium bovis subsp bovis AF2122/97
gcagccaccagcgac

SEQ ID NO: 1045180 - RNA, 17 nt, Mycobacterium bovis subsp bovis AF2122/97
gcagcaggcgaugcgcc

SEQ ID NO: 1045181 - RNA, 18 nt, Mycobacterium bovis subsp bovis AF2122/97
gcagcaggggacgaccau

SEQ ID NO: 1045182 - RNA, 21 nt, Mycobacterium bovis subsp bovis AF2122/97
gcagcaggugcaucgccacag

SEQ ID NO: 1045183 - RNA, 22 nt, Mycobacterium bovis subsp bovis AF2122/97
gcagcagugcgaacucaucgug

SEQ ID NO: 1045184 - RNA, 14 nt, Mycobacterium bovis subsp bovis AF2122/97
gcagcagugccacc

SEQ ID NO: 1045185 - RNA, 16 nt, Mycobacterium bovis subsp bovis AF2122/97
gcagcagugccaccgg

SEQ ID NO: 1045186 - RNA, 21 nt, Mycobacterium bovis subsp bovis AF2122/97
gcagcagguuguaguccgcgc

SEQ ID NO: 1045187 - RNA, 15 nt, Mycobacterium bovis subsp bovis AF2122/97
gcagcagacccggug

SEQ ID NO: 1045188 - RNA, 20 nt, Mycobacterium bovis subsp bovis AF2122/97
gcagcacuuggccagcuugg

SEQ ID NO: 1045189 - RNA, 16 nt, Mycobacterium bovis subsp bovis AF2122/97
gcagcagaaacggcga

SEQ ID NO: 1045190 - RNA, 17 nt, Mycobacterium bovis subsp bovis AF2122/97
gcagcagaaacggcgac

SEQ ID NO: 1045191 - RNA, 18 nt, Mycobacterium bovis subsp bovis AF2122/97
gcagcagaaacggcgacu

SEQ ID NO: 1045192 - RNA, 20 nt, Mycobacterium bovis subsp bovis AF2122/97
gcagcagaaacggcgacucg

SEQ ID NO: 1045193 - RNA, 17 nt, Mycobacterium bovis subsp bovis AF2122/97
gcagcagacccgguggc

SEQ ID NO: 1045194 - RNA, 18 nt, Mycobacterium bovis subsp bovis AF2122/97
gcagcagacccgguggcg

SEQ ID NO: 1045195 - RNA, 17 nt, Mycobacterium bovis subsp bovis AF2122/97
gcagcagauccuggccg

SEQ ID NO: 1045196 - RNA, 13 nt, Mycobacterium bovis subsp bovis AF2122/97
gcagcacguccgc

SEQ ID NO: 1045197 - RNA, 14 nt, Mycobacterium bovis subsp bovis AF2122/97
gcagcaccgucggc

SEQ ID NO: 1045198 - RNA, 21 nt, Mycobacterium bovis subsp bovis AF2122/97
gcagcaccgucggcaccagca

SEQ ID NO: 1045199 - RNA, 23 nt, Mycobacterium bovis subsp bovis AF2122/97
gcagcaccgucgggcccagccgg

SEQ ID NO: 1045200 - RNA, 23 nt, Mycobacterium bovis subsp bovis AF2122/97
gcagcaccucagaaaguccccgc

SEQ ID NO: 1045201 - RNA, 13 nt, Mycobacterium bovis subsp bovis AF2122/97
gcagcaccgucgg

SEQ ID NO: 1045202 - RNA, 13 nt, Mycobacterium bovis subsp bovis AF2122/97
gcagcacgucgaa

SEQ ID NO: 1045203 - RNA, 16 nt, Mycobacterium bovis subsp bovis AF2122/97
gcagcacuccggcgac

SEQ ID NO: 1045204 - RNA, 19 nt, Mycobacterium bovis subsp bovis AF2122/97
gcagcacuccggcgacgau

SEQ ID NO: 1045205 - RNA, 20 nt, Mycobacterium bovis subsp bovis AF2122/97
gcagcacuuccaagccgacc

SEQ ID NO: 1045206 - RNA, 22 nt, Mycobacterium bovis subsp bovis AF2122/97
gcagcacuuccaagccgaccug

SEQ ID NO: 1045207 - RNA, 18 nt, Mycobacterium bovis subsp bovis AF2122/97
gcaggaaugccgcgggga

SEQ ID NO: 1045208 - RNA, 19 nt, Mycobacterium bovis subsp bovis AF2122/97
gcaggaaugggugaucgaa

SEQ ID NO: 1045209 - RNA, 22 nt, Mycobacterium bovis subsp bovis AF2122/97
gcaggaagaaaccgcagucgcg

SEQ ID NO: 1045210 - RNA, 17 nt, Mycobacterium bovis subsp bovis AF2122/97
gcaggaccagcaccgcc

SEQ ID NO: 1045211 - RNA, 20 nt, Mycobacterium bovis subsp bovis AF2122/97
gcaggacgaugaugaucacc

SEQ ID NO: 1045212 - RNA, 19 nt, Mycobacterium bovis subsp bovis AF2122/97
gcaggaccugcgucaucgc

SEQ ID NO: 1045213 - RNA, 21 nt, Mycobacterium bovis subsp bovis AF2122/97
gcaggacggugaagcacacug

SEQ ID NO: 1045214 - RNA, 18 nt, Mycobacterium bovis subsp bovis AF2122/97
gcaggagcagcacgucga

SEQ ID NO: 1045215 - RNA, 20 nt, Mycobacterium bovis subsp bovis AF2122/97
gcaggagcagcacgucgaac

SEQ ID NO: 1045216 - RNA, 11 nt, Mycobacterium bovis subsp bovis AF2122/97
gcaggagccgg

SEQ ID NO: 1045217 - RNA, 20 nt, Mycobacterium bovis subsp bovis AF2122/97
gcaggacguuugagacccca

SEQ ID NO: 1045218 - RNA, 23 nt, Mycobacterium bovis subsp bovis AF2122/97
gcaggagaacacauccgcuugcg

SEQ ID NO: 1045219 - RNA, 21 nt, Mycobacterium bovis subsp bovis AF2122/97
gcaggauucccaguccaggac

SEQ ID NO: 1045220 - RNA, 15 nt, Mycobacterium bovis subsp bovis AF2122/97
gcaggauucccucga

SEQ ID NO: 1045221 - RNA, 13 nt, Mycobacterium bovis subsp bovis AF2122/97
gcaggacgcccac

SEQ ID NO: 1045222 - RNA, 20 nt, Mycobacterium bovis subsp bovis AF2122/97
gcaggaugcgaucgucacgc

SEQ ID NO: 1045223 - RNA, 16 nt, Mycobacterium bovis subsp bovis AF2122/97
gcaggaugaugaccgc

SEQ ID NO: 1045224 - RNA, 17 nt, Mycobacterium bovis subsp bovis AF2122/97
gcaggauaccgaaauca

SEQ ID NO: 1045225 - RNA, 19 nt, Mycobacterium bovis subsp bovis AF2122/97
gcaggaucgaggcgucggc

SEQ ID NO: 1045226 - RNA, 21 nt, Mycobacterium bovis subsp bovis AF2122/97
gcaggaucacgccgccggcga

SEQ ID NO: 1045227 - RNA, 15 nt, Mycobacterium bovis subsp bovis AF2122/97
gcaggaucggcagca

SEQ ID NO: 1045228 - RNA, 23 nt, Mycobacterium bovis subsp bovis AF2122/97
gcaggaucggcggauagucgcgg

SEQ ID NO: 1045229 - RNA, 16 nt, Mycobacterium bovis subsp bovis AF2122/97
gcaggaggcguccggc

SEQ ID NO: 1045230 - RNA, 20 nt, Mycobacterium bovis subsp bovis AF2122/97
gcaggagguugggaacagcc

SEQ ID NO: 1045231 - RNA, 14 nt, Mycobacterium bovis subsp bovis AF2122/97
gcaggaacgccgug

SEQ ID NO: 1045232 - RNA, 18 nt, Mycobacterium bovis subsp bovis AF2122/97
gcagcuugaucccaucca

SEQ ID NO: 1045233 - RNA, 23 nt, Mycobacterium bovis subsp bovis AF2122/97
gcaggaacacccauaccuucggc

SEQ ID NO: 1045234 - RNA, 22 nt, Mycobacterium bovis subsp bovis AF2122/97
gcagcuuugacgcccucggcga

SEQ ID NO: 1045235 - RNA, 16 nt, Mycobacterium bovis subsp bovis AF2122/97
gcaggaaaaccccggc

SEQ ID NO: 1045236 - RNA, 19 nt, Mycobacterium bovis subsp bovis AF2122/97
gcaggaaaaccccggccac

SEQ ID NO: 1045237 - RNA, 20 nt, Mycobacterium bovis subsp bovis AF2122/97
gcaggaaaaccccggccacc

SEQ ID NO: 1045238 - RNA, 21 nt, Mycobacterium bovis subsp bovis AF2122/97
gcagcuuggcauugaccaccg

SEQ ID NO: 1045239 - RNA, 16 nt, Mycobacterium bovis subsp bovis AF2122/97
gcagcuuggccucagc

SEQ ID NO: 1045240 - RNA, 21 nt, Mycobacterium bovis subsp bovis AF2122/97
gcagcuuggccucagccaccg

SEQ ID NO: 1045241 - RNA, 18 nt, Mycobacterium bovis subsp bovis AF2122/97
gcagcuugccaaucaccg

SEQ ID NO: 1045242 - RNA, 15 nt, Mycobacterium bovis subsp bovis AF2122/97
gcagcuugguggcgu

SEQ ID NO: 1045243 - RNA, 21 nt, Mycobacterium bovis subsp bovis AF2122/97
gcagcugcuggaugucgucga

SEQ ID NO: 1045244 - RNA, 14 nt, Mycobacterium bovis subsp bovis AF2122/97
gcagcuggaccacc

SEQ ID NO: 1045245 - RNA, 18 nt, Mycobacterium bovis subsp bovis AF2122/97
gcagcuggcgcagccugc

SEQ ID NO: 1045246 - RNA, 14 nt, Mycobacterium bovis subsp bovis AF2122/97
gcagcuggcgcagc

SEQ ID NO: 1045247 - RNA, 12 nt, Mycobacterium bovis subsp bovis AF2122/97
gcagcuggcgac

SEQ ID NO: 1045248 - RNA, 14 nt, Mycobacterium bovis subsp bovis AF2122/97
gcagcuguggccca

SEQ ID NO: 1045249 - RNA, 14 nt, Mycobacterium bovis subsp bovis AF2122/97
gcagcuguucggcc

SEQ ID NO: 1045250 - RNA, 17 nt, Mycobacterium bovis subsp bovis AF2122/97
gcagcuggucgugggcc

SEQ ID NO: 1045251 - RNA, 18 nt, Mycobacterium bovis subsp bovis AF2122/97
gcagcugguuugcggugc

SEQ ID NO: 1045252 - RNA, 21 nt, Mycobacterium bovis subsp bovis AF2122/97
gcagcugggcaucaccgccgc

SEQ ID NO: 1045253 - RNA, 14 nt, Mycobacterium bovis subsp bovis AF2122/97
gcagcugguagcgc

SEQ ID NO: 1045254 - RNA, 18 nt, Mycobacterium bovis subsp bovis AF2122/97
gcagcuugacaucgguca

SEQ ID NO: 1045255 - RNA, 15 nt, Mycobacterium bovis subsp bovis AF2122/97
gcagcuucucgccga

SEQ ID NO: 1045256 - RNA, 16 nt, Mycobacterium bovis subsp bovis AF2122/97
gcagcuuagucagggc

SEQ ID NO: 1045257 - RNA, 22 nt, Mycobacterium bovis subsp bovis AF2122/97
gcagcuucaacaccggcaucgg

SEQ ID NO: 1045258 - RNA, 16 nt, Mycobacterium bovis subsp bovis AF2122/97
gcagcuguuggcgugg

SEQ ID NO: 1045259 - RNA, 15 nt, Mycobacterium bovis subsp bovis AF2122/97
gcagggccggcaccg

SEQ ID NO: 1045260 - RNA, 17 nt, Mycobacterium bovis subsp bovis AF2122/97
gcagggccagcggcagc

SEQ ID NO: 1045261 - RNA, 17 nt, Mycobacterium bovis subsp bovis AF2122/97
gcagggccgccgcgaac

SEQ ID NO: 1045262 - RNA, 23 nt, Mycobacterium bovis subsp bovis AF2122/97
gcagggauucuggaugccggugg

SEQ ID NO: 1045263 - RNA, 19 nt, Mycobacterium bovis subsp bovis AF2122/97
gcagggcauugcggcccgc

SEQ ID NO: 1045264 - RNA, 21 nt, Mycobacterium bovis subsp bovis AF2122/97
gcagggcauugcggcccgcga

SEQ ID NO: 1045265 - RNA, 13 nt, Mycobacterium bovis subsp bovis AF2122/97
gcagggccaccac

SEQ ID NO: 1045266 - RNA, 15 nt, Mycobacterium bovis subsp bovis AF2122/97
gcagggccaccacca

SEQ ID NO: 1045267 - RNA, 19 nt, Mycobacterium bovis subsp bovis AF2122/97
gcagggccaccaccacggc

SEQ ID NO: 1045268 - RNA, 20 nt, Mycobacterium bovis subsp bovis AF2122/97
gcagggccaccaccacggcc

SEQ ID NO: 1045269 - RNA, 14 nt, Mycobacterium bovis subsp bovis AF2122/97
gcaggcuuccccga

SEQ ID NO: 1045270 - RNA, 22 nt, Mycobacterium bovis subsp bovis AF2122/97
gcagggaucaccccggccggcu

SEQ ID NO: 1045271 - RNA, 20 nt, Mycobacterium bovis subsp bovis AF2122/97
gcagggacugugggggcgca

SEQ ID NO: 1045272 - RNA, 22 nt, Mycobacterium bovis subsp bovis AF2122/97
gcagggacugugggggcgcacc

SEQ ID NO: 1045273 - RNA, 14 nt, Mycobacterium bovis subsp bovis AF2122/97
gcaggcggccgagc

SEQ ID NO: 1045274 - RNA, 21 nt, Mycobacterium bovis subsp bovis AF2122/97
gcaggcggccuugccgggccg

SEQ ID NO: 1045275 - RNA, 21 nt, Mycobacterium bovis subsp bovis AF2122/97
gcaggcgggaacgaucgauga

SEQ ID NO: 1045276 - RNA, 16 nt, Mycobacterium bovis subsp bovis AF2122/97
gcaggcggcugaacgg

SEQ ID NO: 1045277 - RNA, 19 nt, Mycobacterium bovis subsp bovis AF2122/97
gcaggcgggggaucggugg

SEQ ID NO: 1045278 - RNA, 18 nt, Mycobacterium bovis subsp bovis AF2122/97
gcaggcugucaauccgcc

SEQ ID NO: 1045279 - RNA, 12 nt, Mycobacterium bovis subsp bovis AF2122/97
gcaggcugucga

SEQ ID NO: 1045280 - RNA, 13 nt, Mycobacterium bovis subsp bovis AF2122/97
gcaggcgcaaggu

SEQ ID NO: 1045281 - RNA, 23 nt, Mycobacterium bovis subsp bovis AF2122/97
gcaggcgaguuaggccgccagcc

SEQ ID NO: 1045282 - RNA, 20 nt, Mycobacterium bovis subsp bovis AF2122/97
gcaggcgaaggcggcuucgc

SEQ ID NO: 1045283 - RNA, 16 nt, Mycobacterium bovis subsp bovis AF2122/97
gcaggcgcaccaggcg

SEQ ID NO: 1045284 - RNA, 17 nt, Mycobacterium bovis subsp bovis AF2122/97
gcaggcgcaccaggcgg

SEQ ID NO: 1045285 - RNA, 17 nt, Mycobacterium bovis subsp bovis AF2122/97
gcaggcggccagcgaac

SEQ ID NO: 1045286 - RNA, 18 nt, Mycobacterium bovis subsp bovis AF2122/97
gcaggccuccaagcccgc

SEQ ID NO: 1045287 - RNA, 19 nt, Mycobacterium bovis subsp bovis AF2122/97
gcaggccucggcgccgccc

SEQ ID NO: 1045288 - RNA, 22 nt, Mycobacterium bovis subsp bovis AF2122/97
gcaggccucggcgccgcccagc

SEQ ID NO: 1045289 - RNA, 12 nt, Mycobacterium bovis subsp bovis AF2122/97
gcaggcccagcg

SEQ ID NO: 1045290 - RNA, 15 nt, Mycobacterium bovis subsp bovis AF2122/97
gcaggcccgacggcg

SEQ ID NO: 1045291 - RNA, 16 nt, Mycobacterium bovis subsp bovis AF2122/97
gcaggcccgacggcgc

SEQ ID NO: 1045292 - RNA, 19 nt, Mycobacterium bovis subsp bovis AF2122/97
gcaggcccgacggcgccca

SEQ ID NO: 1045293 - RNA, 17 nt, Mycobacterium bovis subsp bovis AF2122/97
gcaggcccacccgggcg

SEQ ID NO: 1045294 - RNA, 17 nt, Mycobacterium bovis subsp bovis AF2122/97
gcaggcccgccaucaug

SEQ ID NO: 1045295 - RNA, 20 nt, Mycobacterium bovis subsp bovis AF2122/97
gcaggcaccccgaucacccg

SEQ ID NO: 1045296 - RNA, 14 nt, Mycobacterium bovis subsp bovis AF2122/97
gcaggcccaacgcg

SEQ ID NO: 1045297 - RNA, 16 nt, Mycobacterium bovis subsp bovis AF2122/97
gcaggcacaucgcgaa

SEQ ID NO: 1045298 - RNA, 13 nt, Mycobacterium bovis subsp bovis AF2122/97
gcaggcaccccga

SEQ ID NO: 1045299 - RNA, 22 nt, Mycobacterium bovis subsp bovis AF2122/97
gcaggcaccccgaucacccgca

SEQ ID NO: 1045300 - RNA, 22 nt, Mycobacterium bovis subsp bovis AF2122/97
gcaguauucacagucgcucgcu

SEQ ID NO: 1045301 - RNA, 23 nt, Mycobacterium bovis subsp bovis AF2122/97
gcagucaggccuagcgcggcgac

SEQ ID NO: 1045302 - RNA, 22 nt, Mycobacterium bovis subsp bovis AF2122/97
gcaguccaccgcgcggcgcagc

SEQ ID NO: 1045303 - RNA, 15 nt, Mycobacterium bovis subsp bovis AF2122/97
gcaguccacgagcac

SEQ ID NO: 1045304 - RNA, 16 nt, Mycobacterium bovis subsp bovis AF2122/97
gcaguccacgagcacg

SEQ ID NO: 1045305 - RNA, 21 nt, Mycobacterium bovis subsp bovis AF2122/97
gcaguaucaucggcgcuggca

SEQ ID NO: 1045306 - RNA, 20 nt, Mycobacterium bovis subsp bovis AF2122/97
gcaguagugaucgaucgcgg

SEQ ID NO: 1045307 - RNA, 13 nt, Mycobacterium bovis subsp bovis AF2122/97
gcaguacugggcu

SEQ ID NO: 1045308 - RNA, 22 nt, Mycobacterium bovis subsp bovis AF2122/97
gcaguacuugaccguccaccga

SEQ ID NO: 1045309 - RNA, 15 nt, Mycobacterium bovis subsp bovis AF2122/97
gcaguaacgucgucg

SEQ ID NO: 1045310 - RNA, 17 nt, Mycobacterium bovis subsp bovis AF2122/97
gcaguaacgucgucgcg

SEQ ID NO: 1045311 - RNA, 19 nt, Mycobacterium bovis subsp bovis AF2122/97
gcaguacuaacaacaccac

SEQ ID NO: 1045312 - RNA, 17 nt, Mycobacterium bovis subsp bovis AF2122/97
gcaguacaccgcccggc

SEQ ID NO: 1045313 - RNA, 17 nt, Mycobacterium bovis subsp bovis AF2122/97
gcaguacaccggcgugc

SEQ ID NO: 1045314 - RNA, 21 nt, Mycobacterium bovis subsp bovis AF2122/97
gcagguuguaguccgcgccga

SEQ ID NO: 1045315 - RNA, 17 nt, Mycobacterium bovis subsp bovis AF2122/97
gcagguuggccaccgcc

SEQ ID NO: 1045316 - RNA, 14 nt, Mycobacterium bovis subsp bovis AF2122/97
gcagguuggcgagc

SEQ ID NO: 1045317 - RNA, 23 nt, Mycobacterium bovis subsp bovis AF2122/97
gcagggggacccggaccuucggc

SEQ ID NO: 1045318 - RNA, 13 nt, Mycobacterium bovis subsp bovis AF2122/97
gcaggggcggcgu

SEQ ID NO: 1045319 - RNA, 12 nt, Mycobacterium bovis subsp bovis AF2122/97
gcagucgcacgg

SEQ ID NO: 1045320 - RNA, 19 nt, Mycobacterium bovis subsp bovis AF2122/97
gcagucgcaaaagccccca

SEQ ID NO: 1045321 - RNA, 19 nt, Mycobacterium bovis subsp bovis AF2122/97
gcaguccgguuacgcucgc

SEQ ID NO: 1045322 - RNA, 17 nt, Mycobacterium bovis subsp bovis AF2122/97
gcagucgcggcagacgc

SEQ ID NO: 1045323 - RNA, 15 nt, Mycobacterium bovis subsp bovis AF2122/97
gcaguccgagcuugg

SEQ ID NO: 1045324 - RNA, 22 nt, Mycobacterium bovis subsp bovis AF2122/97
gcaguccgagcuuggccgccgc

SEQ ID NO: 1045325 - RNA, 23 nt, Mycobacterium bovis subsp bovis AF2122/97
gcaguccgagcuuggccgccgcc

SEQ ID NO: 1045326 - RNA, 23 nt, Mycobacterium bovis subsp bovis AF2122/97
gcaguccagccgggugccggcau

SEQ ID NO: 1045327 - RNA, 20 nt, Mycobacterium bovis subsp bovis AF2122/97
gcagucgagcaucucgucgg

SEQ ID NO: 1045328 - RNA, 23 nt, Mycobacterium bovis subsp bovis AF2122/97
gcagucgagcaucucgucgguga

SEQ ID NO: 1045329 - RNA, 23 nt, Mycobacterium bovis subsp bovis AF2122/97
gcagucguugaugcuucgaaccg

SEQ ID NO: 1045330 - RNA, 20 nt, Mycobacterium bovis subsp bovis AF2122/97
gcagugaaauugccgccgcc

SEQ ID NO: 1045331 - RNA, 16 nt, Mycobacterium bovis subsp bovis AF2122/97
gcagugaccgcuggug

SEQ ID NO: 1045332 - RNA, 17 nt, Mycobacterium bovis subsp bovis AF2122/97
gcagugaccucgucggc

SEQ ID NO: 1045333 - RNA, 19 nt, Mycobacterium bovis subsp bovis AF2122/97
gcagugaccucgucggcga

SEQ ID NO: 1045334 - RNA, 23 nt, Mycobacterium bovis subsp bovis AF2122/97
gcagugacgccucgacacccagc

SEQ ID NO: 1045335 - RNA, 19 nt, Mycobacterium bovis subsp bovis AF2122/97
gcagugacguuccgcucgc

SEQ ID NO: 1045336 - RNA, 20 nt, Mycobacterium bovis subsp bovis AF2122/97
gcagugacguuccgcucgcc

SEQ ID NO: 1045337 - RNA, 21 nt, Mycobacterium bovis subsp bovis AF2122/97
gcagugacguuccgcucgccg

SEQ ID NO: 1045338 - RNA, 15 nt, Mycobacterium bovis subsp bovis AF2122/97
gcagugagcagccgg

SEQ ID NO: 1045339 - RNA, 15 nt, Mycobacterium bovis subsp bovis AF2122/97
gcagugagucgguga

SEQ ID NO: 1045340 - RNA, 16 nt, Mycobacterium bovis subsp bovis AF2122/97
gcaguggcgcggcgag

SEQ ID NO: 1045341 - RNA, 19 nt, Mycobacterium bovis subsp bovis AF2122/97
gcaguggcguuacgcucgg

SEQ ID NO: 1045342 - RNA, 20 nt, Mycobacterium bovis subsp bovis AF2122/97
gcaguggcguuacgcucggc

SEQ ID NO: 1045343 - RNA, 13 nt, Mycobacterium bovis subsp bovis AF2122/97
gcaguucgccgcg

SEQ ID NO: 1045344 - RNA, 14 nt, Mycobacterium bovis subsp bovis AF2122/97
gcaguucgccgcgc

SEQ ID NO: 1045345 - RNA, 18 nt, Mycobacterium bovis subsp bovis AF2122/97
gcaguucgccgcgcagcg

SEQ ID NO: 1045346 - RNA, 13 nt, Mycobacterium bovis subsp bovis AF2122/97
gcauacagcgccc

SEQ ID NO: 1045347 - RNA, 14 nt, Mycobacterium bovis subsp bovis AF2122/97
gcauacagcgcccg

SEQ ID NO: 1045348 - RNA, 15 nt, Mycobacterium bovis subsp bovis AF2122/97
gcauacagcgcccgg

SEQ ID NO: 1045349 - RNA, 16 nt, Mycobacterium bovis subsp bovis AF2122/97
gcaguuccagcucgcg

SEQ ID NO: 1045350 - RNA, 13 nt, Mycobacterium bovis subsp bovis AF2122/97
gcauacaucgccu

SEQ ID NO: 1045351 - RNA, 16 nt, Mycobacterium bovis subsp bovis AF2122/97
gcaguucgcggccauc

SEQ ID NO: 1045352 - RNA, 19 nt, Mycobacterium bovis subsp bovis AF2122/97
gcauacgcggcuuugacgc

SEQ ID NO: 1045353 - RNA, 23 nt, Mycobacterium bovis subsp bovis AF2122/97
gcauacgcccacuccagcagcuc

SEQ ID NO: 1045354 - RNA, 18 nt, Mycobacterium bovis subsp bovis AF2122/97
gcauaucaaccccggugc

SEQ ID NO: 1045355 - RNA, 15 nt, Mycobacterium bovis subsp bovis AF2122/97
gcauaucaaccccgg

SEQ ID NO: 1045356 - RNA, 17 nt, Mycobacterium bovis subsp bovis AF2122/97
gcauauccgccggcgac

SEQ ID NO: 1045357 - RNA, 15 nt, Mycobacterium bovis subsp bovis AF2122/97
gcaucaacgcgggcg

SEQ ID NO: 1045358 - RNA, 19 nt, Mycobacterium bovis subsp bovis AF2122/97
gcaucagcuuuugcaccgg

SEQ ID NO: 1045359 - RNA, 12 nt, Mycobacterium bovis subsp bovis AF2122/97
gcaucagcggcg

SEQ ID NO: 1045360 - RNA, 22 nt, Mycobacterium bovis subsp bovis AF2122/97
gcaucagcggcgccaguauggc

SEQ ID NO: 1045361 - RNA, 15 nt, Mycobacterium bovis subsp bovis AF2122/97
gcaucagcgccagcg

SEQ ID NO: 1045362 - RNA, 16 nt, Mycobacterium bovis subsp bovis AF2122/97
gcaucagcccggcgcu

SEQ ID NO: 1045363 - RNA, 13 nt, Mycobacterium bovis subsp bovis AF2122/97
gcaucaucgccca

SEQ ID NO: 1045364 - RNA, 15 nt, Mycobacterium bovis subsp bovis AF2122/97
gcaucaucagcggcg

SEQ ID NO: 1045365 - RNA, 16 nt, Mycobacterium bovis subsp bovis AF2122/97
gcaucaucagcggcgc

SEQ ID NO: 1045366 - RNA, 24 nt, Mycobacterium bovis subsp bovis AF2122/97
gcaucauagacagggccgcucgcc

SEQ ID NO: 1045367 - RNA, 15 nt, Mycobacterium bovis subsp bovis AF2122/97
gcaucaugccgccca

SEQ ID NO: 1045368 - RNA, 24 nt, Mycobacterium bovis subsp bovis AF2122/97
gcauccacccauagacccggcuga

SEQ ID NO: 1045369 - RNA, 14 nt, Mycobacterium bovis subsp bovis AF2122/97
gcauccaaaaucgc

SEQ ID NO: 1045370 - RNA, 16 nt, Mycobacterium bovis subsp bovis AF2122/97
gcauccaacgcggcgc

SEQ ID NO: 1045371 - RNA, 16 nt, Mycobacterium bovis subsp bovis AF2122/97
gcauccaauaucgcuu

SEQ ID NO: 1045372 - RNA, 22 nt, Mycobacterium bovis subsp bovis AF2122/97
gcauccagaaguaggcgaccgc

SEQ ID NO: 1045373 - RNA, 14 nt, Mycobacterium bovis subsp bovis AF2122/97
gcauccagcagcgc

SEQ ID NO: 1045374 - RNA, 16 nt, Mycobacterium bovis subsp bovis AF2122/97
gcauccagcagcgccu

SEQ ID NO: 1045375 - RNA, 21 nt, Mycobacterium bovis subsp bovis AF2122/97
gcacccuggguauccaccgcg

SEQ ID NO: 1045376 - RNA, 22 nt, Mycobacterium bovis subsp bovis AF2122/97
gcacccuggguauccaccgcga

SEQ ID NO: 1045377 - RNA, 18 nt, Mycobacterium bovis subsp bovis AF2122/97
gcacccgcucggccgccg

SEQ ID NO: 1045378 - RNA, 15 nt, Mycobacterium bovis subsp bovis AF2122/97
gcacccgccagggcg

SEQ ID NO: 1045379 - RNA, 13 nt, Mycobacterium bovis subsp bovis AF2122/97
gcacccgcggcga

SEQ ID NO: 1045380 - RNA, 22 nt, Mycobacterium bovis subsp bovis AF2122/97
gcacccgcuccauaucgucggg

SEQ ID NO: 1045381 - RNA, 22 nt, Mycobacterium bovis subsp bovis AF2122/97
gcaccgaacuccuuaucgucga

SEQ ID NO: 1045382 - RNA, 19 nt, Mycobacterium bovis subsp bovis AF2122/97
gcaccgaagauggccagcg

SEQ ID NO: 1045383 - RNA, 23 nt, Mycobacterium bovis subsp bovis AF2122/97
gcaccgaagauggccagcgcggc

SEQ ID NO: 1045384 - RNA, 15 nt, Mycobacterium bovis subsp bovis AF2122/97
gcaccgacaccggcc

SEQ ID NO: 1045385 - RNA, 17 nt, Mycobacterium bovis subsp bovis AF2122/97
gcaccgacaccggccgc

SEQ ID NO: 1045386 - RNA, 20 nt, Mycobacterium bovis subsp bovis AF2122/97
gcaccgacaccggccgcgac

SEQ ID NO: 1045387 - RNA, 14 nt, Mycobacterium bovis subsp bovis AF2122/97
gcaccgaacccgcc

SEQ ID NO: 1045388 - RNA, 17 nt, Mycobacterium bovis subsp bovis AF2122/97
gcaccgaacccgccacc

SEQ ID NO: 1045389 - RNA, 20 nt, Mycobacterium bovis subsp bovis AF2122/97
gcaccgaacccgccaccgcg

SEQ ID NO: 1045390 - RNA, 19 nt, Mycobacterium bovis subsp bovis AF2122/97
gcaccgaaaaacaccagcg

SEQ ID NO: 1045391 - RNA, 13 nt, Mycobacterium bovis subsp bovis AF2122/97
gcacccgcucccg

SEQ ID NO: 1045392 - RNA, 17 nt, Mycobacterium bovis subsp bovis AF2122/97
gcaccgaggccgccgag

SEQ ID NO: 1045393 - RNA, 18 nt, Mycobacterium bovis subsp bovis AF2122/97
gcaccgaggccgccgaga

SEQ ID NO: 1045394 - RNA, 20 nt, Mycobacterium bovis subsp bovis AF2122/97
gcaccgaggccgccgagaug

SEQ ID NO: 1045395 - RNA, 18 nt, Mycobacterium bovis subsp bovis AF2122/97
gcaccgacuucagcaacg

SEQ ID NO: 1045396 - RNA, 21 nt, Mycobacterium bovis subsp bovis AF2122/97
gcaccgacuucagcaacgcau

SEQ ID NO: 1045397 - RNA, 22 nt, Mycobacterium bovis subsp bovis AF2122/97
gcaccgagcaucucgucgucga

SEQ ID NO: 1045398 - RNA, 15 nt, Mycobacterium bovis subsp bovis AF2122/97
gcaccgaggccgccg

SEQ ID NO: 1045399 - RNA, 16 nt, Mycobacterium bovis subsp bovis AF2122/97
gcaccgaggccgccga

SEQ ID NO: 1045400 - RNA, 19 nt, Mycobacterium bovis subsp bovis AF2122/97
gcaccgagcugagcggcca

SEQ ID NO: 1045401 - RNA, 15 nt, Mycobacterium bovis subsp bovis AF2122/97
gcaccgacugcuguc

SEQ ID NO: 1045402 - RNA, 21 nt, Mycobacterium bovis subsp bovis AF2122/97
gcaccgacugcugucaccgca

SEQ ID NO: 1045403 - RNA, 20 nt, Mycobacterium bovis subsp bovis AF2122/97
gcaccgacgugauggugacu

SEQ ID NO: 1045404 - RNA, 18 nt, Mycobacterium bovis subsp bovis AF2122/97
gcaccgacaucgucaucc

SEQ ID NO: 1045405 - RNA, 18 nt, Mycobacterium bovis subsp bovis AF2122/97
gcaccgaauuacgcaccg

SEQ ID NO: 1045406 - RNA, 14 nt, Mycobacterium bovis subsp bovis AF2122/97
gcaccgaccgcacc

SEQ ID NO: 1045407 - RNA, 14 nt, Mycobacterium bovis subsp bovis AF2122/97
gcaccccggccgcg

SEQ ID NO: 1045408 - RNA, 15 nt, Mycobacterium bovis subsp bovis AF2122/97
gcaccccggcggcgu

SEQ ID NO: 1045409 - RNA, 17 nt, Mycobacterium bovis subsp bovis AF2122/97
gcaccccggcggcgucc

SEQ ID NO: 1045410 - RNA, 21 nt, Mycobacterium bovis subsp bovis AF2122/97
gcacccgaauuugucggcgaa

SEQ ID NO: 1045411 - RNA, 13 nt, Mycobacterium bovis subsp bovis AF2122/97
gcaccccgaccac

SEQ ID NO: 1045412 - RNA, 22 nt, Mycobacterium bovis subsp bovis AF2122/97
gcacccgaauuugucggcgaag

SEQ ID NO: 1045413 - RNA, 24 nt, Mycobacterium bovis subsp bovis AF2122/97
gcacccgacccgaugcgucucgcg

SEQ ID NO: 1045414 - RNA, 16 nt, Mycobacterium bovis subsp bovis AF2122/97
gcacccgagcgaugcg

SEQ ID NO: 1045415 - RNA, 23 nt, Mycobacterium bovis subsp bovis AF2122/97
gcacccgaguuauagaagccgac

SEQ ID NO: 1045416 - RNA, 18 nt, Mycobacterium bovis subsp bovis AF2122/97
gcacccgagccgcacagc

SEQ ID NO: 1045417 - RNA, 15 nt, Mycobacterium bovis subsp bovis AF2122/97
gcacccgacucgucg

SEQ ID NO: 1045418 - RNA, 16 nt, Mycobacterium bovis subsp bovis AF2122/97
gcacccgaucgacgac

SEQ ID NO: 1045419 - RNA, 13 nt, Mycobacterium bovis subsp bovis AF2122/97
gcacccgcaccgg

SEQ ID NO: 1045420 - RNA, 16 nt, Mycobacterium bovis subsp bovis AF2122/97
gcacccgcaccgguga

SEQ ID NO: 1045421 - RNA, 17 nt, Mycobacterium bovis subsp bovis AF2122/97
gcacccgcagccgcgag

SEQ ID NO: 1045422 - RNA, 12 nt, Mycobacterium bovis subsp bovis AF2122/97
gcacccgcagcc

SEQ ID NO: 1045423 - RNA, 16 nt, Mycobacterium bovis subsp bovis AF2122/97
gcacccgcaguggucg

SEQ ID NO: 1045424 - RNA, 20 nt, Mycobacterium bovis subsp bovis AF2122/97
gcacccaggugucgcugcug

SEQ ID NO: 1045425 - RNA, 15 nt, Mycobacterium bovis subsp bovis AF2122/97
gcacccagccgugcc

SEQ ID NO: 1045426 - RNA, 14 nt, Mycobacterium bovis subsp bovis AF2122/97
gcacccagccgugc

SEQ ID NO: 1045427 - RNA, 20 nt, Mycobacterium bovis subsp bovis AF2122/97
gcaccccgcgguagccgacc

SEQ ID NO: 1045428 - RNA, 21 nt, Mycobacterium bovis subsp bovis AF2122/97
gcaccccgcuugcgcggcuug

SEQ ID NO: 1045429 - RNA, 12 nt, Mycobacterium bovis subsp bovis AF2122/97
gcaccccggcau

SEQ ID NO: 1045430 - RNA, 17 nt, Mycobacterium bovis subsp bovis AF2122/97
gcacccccucggcuucg

SEQ ID NO: 1045431 - RNA, 18 nt, Mycobacterium bovis subsp bovis AF2122/97
gcacccccgucgccaccg

SEQ ID NO: 1045432 - RNA, 19 nt, Mycobacterium bovis subsp bovis AF2122/97
gcacccccgucgccaccga

SEQ ID NO: 1045433 - RNA, 19 nt, Mycobacterium bovis subsp bovis AF2122/97
gcacccccgucgaucagcg

SEQ ID NO: 1045434 - RNA, 14 nt, Mycobacterium bovis subsp bovis AF2122/97
gcacccccgucgcc

SEQ ID NO: 1045435 - RNA, 16 nt, Mycobacterium bovis subsp bovis AF2122/97
gcacccccgucgccac

SEQ ID NO: 1045436 - RNA, 17 nt, Mycobacterium bovis subsp bovis AF2122/97
gcacccccgucgccacc

SEQ ID NO: 1045437 - RNA, 16 nt, Mycobacterium bovis subsp bovis AF2122/97
gcaccccauggccacc

SEQ ID NO: 1045438 - RNA, 18 nt, Mycobacterium bovis subsp bovis AF2122/97
gcaccccauggccaccga

SEQ ID NO: 1045439 - RNA, 19 nt, Mycobacterium bovis subsp bovis AF2122/97
gcaccccauggccaccgaa

SEQ ID NO: 1045440 - RNA, 18 nt, Mycobacterium bovis subsp bovis AF2122/97
gcaccccauacucggcgg

SEQ ID NO: 1045441 - RNA, 23 nt, Mycobacterium bovis subsp bovis AF2122/97
gcacccauacggcaauacccgcc

SEQ ID NO: 1045442 - RNA, 15 nt, Mycobacterium bovis subsp bovis AF2122/97
gcacccagucggcgc

SEQ ID NO: 1045443 - RNA, 16 nt, Mycobacterium bovis subsp bovis AF2122/97
gcacccagucggcgcc

SEQ ID NO: 1045444 - RNA, 17 nt, Mycobacterium bovis subsp bovis AF2122/97
gcacccagucggcgccg

SEQ ID NO: 1045445 - RNA, 23 nt, Mycobacterium bovis subsp bovis AF2122/97
gcaccgucgggauggacggcagc

SEQ ID NO: 1045446 - RNA, 17 nt, Mycobacterium bovis subsp bovis AF2122/97
gcaccgucgggcccagc

SEQ ID NO: 1045447 - RNA, 18 nt, Mycobacterium bovis subsp bovis AF2122/97
gcaccgucgggcccagcc

SEQ ID NO: 1045448 - RNA, 13 nt, Mycobacterium bovis subsp bovis AF2122/97
gcaccgucggcac

SEQ ID NO: 1045449 - RNA, 17 nt, Mycobacterium bovis subsp bovis AF2122/97
gcaccgucggcaccagc

SEQ ID NO: 1045450 - RNA, 21 nt, Mycobacterium bovis subsp bovis AF2122/97
gcaccgucguuaagacggcga

SEQ ID NO: 1045451 - RNA, 15 nt, Mycobacterium bovis subsp bovis AF2122/97
gcaccucguguccgg

SEQ ID NO: 1045452 - RNA, 14 nt, Mycobacterium bovis subsp bovis AF2122/97
gcaccucggccuug

SEQ ID NO: 1045453 - RNA, 12 nt, Mycobacterium bovis subsp bovis AF2122/97
gcaccgucacgu

SEQ ID NO: 1045454 - RNA, 18 nt, Mycobacterium bovis subsp bovis AF2122/97
gcaccgucagaccaucca

SEQ ID NO: 1045455 - RNA, 23 nt, Mycobacterium bovis subsp bovis AF2122/97
gcaccgucagcccgacguugcgu

SEQ ID NO: 1045456 - RNA, 18 nt, Mycobacterium bovis subsp bovis AF2122/97
gcaccgucccagugugcg

SEQ ID NO: 1045457 - RNA, 18 nt, Mycobacterium bovis subsp bovis AF2122/97
gcaccgguuuucgccggc

SEQ ID NO: 1045458 - RNA, 15 nt, Mycobacterium bovis subsp bovis AF2122/97
gcaccguacggcggu

SEQ ID NO: 1045459 - RNA, 20 nt, Mycobacterium bovis subsp bovis AF2122/97
gcaccguagagcaugccgcc

SEQ ID NO: 1045460 - RNA, 12 nt, Mycobacterium bovis subsp bovis AF2122/97
gcaccggugcuc

SEQ ID NO: 1045461 - RNA, 17 nt, Mycobacterium bovis subsp bovis AF2122/97
gcaccggugcucgucga

SEQ ID NO: 1045462 - RNA, 18 nt, Mycobacterium bovis subsp bovis AF2122/97
gcaccggugauggugacc

SEQ ID NO: 1045463 - RNA, 16 nt, Mycobacterium bovis subsp bovis AF2122/97
gcaccgguuugacguc

SEQ ID NO: 1045464 - RNA, 20 nt, Mycobacterium bovis subsp bovis AF2122/97
gcaccggguugagccgccgc

SEQ ID NO: 1045465 - RNA, 13 nt, Mycobacterium bovis subsp bovis AF2122/97
gcaccggggcugc

SEQ ID NO: 1045466 - RNA, 15 nt, Mycobacterium bovis subsp bovis AF2122/97
gcaccggugcccacc

SEQ ID NO: 1045467 - RNA, 20 nt, Mycobacterium bovis subsp bovis AF2122/97
gcaccggugcccaccaccga

SEQ ID NO: 1045468 - RNA, 15 nt, Mycobacterium bovis subsp bovis AF2122/97
gcaccggugacgcac

SEQ ID NO: 1045469 - RNA, 18 nt, Mycobacterium bovis subsp bovis AF2122/97
gcaccggugacgcacagc

SEQ ID NO: 1045470 - RNA, 17 nt, Mycobacterium bovis subsp bovis AF2122/97
gcaccggugauggugac

SEQ ID NO: 1045471 - RNA, 13 nt, Mycobacterium bovis subsp bovis AF2122/97
gcaccggcgcggg

SEQ ID NO: 1045472 - RNA, 20 nt, Mycobacterium bovis subsp bovis AF2122/97
gcaccggggugugcgggcgg

SEQ ID NO: 1045473 - RNA, 17 nt, Mycobacterium bovis subsp bovis AF2122/97
gcaccgguauguucggc

SEQ ID NO: 1045474 - RNA, 17 nt, Mycobacterium bovis subsp bovis AF2122/97
gcaccgcugaccgcaac

SEQ ID NO: 1045475 - RNA, 14 nt, Mycobacterium bovis subsp bovis AF2122/97
gcaccgcugccgcu

SEQ ID NO: 1045476 - RNA, 22 nt, Mycobacterium bovis subsp bovis AF2122/97
gcaccgcugccgcugccgaagc

SEQ ID NO: 1045477 - RNA, 15 nt, Mycobacterium bovis subsp bovis AF2122/97
gcaccgcuacgacca

SEQ ID NO: 1045478 - RNA, 20 nt, Mycobacterium bovis subsp bovis AF2122/97
gcaccgcguugaugaccgcc

SEQ ID NO: 1045479 - RNA, 20 nt, Mycobacterium bovis subsp bovis AF2122/97
gcaccgcugaccccggcagc

SEQ ID NO: 1045480 - RNA, 17 nt, Mycobacterium bovis subsp bovis AF2122/97
gcaccggcggcgacggu

SEQ ID NO: 1045481 - RNA, 19 nt, Mycobacterium bovis subsp bovis AF2122/97
gcaccggcggcgacggugc

SEQ ID NO: 1045482 - RNA, 19 nt, Mycobacterium bovis subsp bovis AF2122/97
gcaccgggaugugcggcug

SEQ ID NO: 1045483 - RNA, 21 nt, Mycobacterium bovis subsp bovis AF2122/97
gcaccggcuugggccaggccc

SEQ ID NO: 1045484 - RNA, 22 nt, Mycobacterium bovis subsp bovis AF2122/97
gcaccggcuggcccagcgacca

SEQ ID NO: 1045485 - RNA, 17 nt, Mycobacterium bovis subsp bovis AF2122/97
gcaccggcgugguagac

SEQ ID NO: 1045486 - RNA, 16 nt, Mycobacterium bovis subsp bovis AF2122/97
gcaccggcgucggcgc

SEQ ID NO: 1045487 - RNA, 13 nt, Mycobacterium bovis subsp bovis AF2122/97
gcaccgccgcgcg

SEQ ID NO: 1045488 - RNA, 17 nt, Mycobacterium bovis subsp bovis AF2122/97
gcaccgcgguacgccgg

SEQ ID NO: 1045489 - RNA, 21 nt, Mycobacterium bovis subsp bovis AF2122/97
gcaccgcgguggggucgacgc

SEQ ID NO: 1045490 - RNA, 20 nt, Mycobacterium bovis subsp bovis AF2122/97
gcaccgcguaauucgacuuc

SEQ ID NO: 1045491 - RNA, 21 nt, Mycobacterium bovis subsp bovis AF2122/97
gcaccgcgguacgccggucgg

SEQ ID NO: 1045492 - RNA, 16 nt, Mycobacterium bovis subsp bovis AF2122/97
gcaccgcgucguagcc

SEQ ID NO: 1045493 - RNA, 14 nt, Mycobacterium bovis subsp bovis AF2122/97
gcaccgcgucguag

SEQ ID NO: 1045494 - RNA, 20 nt, Mycobacterium bovis subsp bovis AF2122/97
gcaccgccgauguggucggc

SEQ ID NO: 1045495 - RNA, 18 nt, Mycobacterium bovis subsp bovis AF2122/97
gcaccgccgagcagacgc

SEQ ID NO: 1045496 - RNA, 14 nt, Mycobacterium bovis subsp bovis AF2122/97
gcaccgccgagcag

SEQ ID NO: 1045497 - RNA, 15 nt, Mycobacterium bovis subsp bovis AF2122/97
gcaccgccgagcaga

SEQ ID NO: 1045498 - RNA, 12 nt, Mycobacterium bovis subsp bovis AF2122/97
gcaccgcccgcc

SEQ ID NO: 1045499 - RNA, 17 nt, Mycobacterium bovis subsp bovis AF2122/97
gcaccgcccgccgaacg

SEQ ID NO: 1045500 - RNA, 15 nt, Mycobacterium bovis subsp bovis AF2122/97
gcaccgccccgccgu

SEQ ID NO: 1045501 - RNA, 16 nt, Mycobacterium bovis subsp bovis AF2122/97
gcaccgccagccacca

SEQ ID NO: 1045502 - RNA, 18 nt, Mycobacterium bovis subsp bovis AF2122/97
gcaccgccagccaccaca

SEQ ID NO: 1045503 - RNA, 15 nt, Mycobacterium bovis subsp bovis AF2122/97
gcaccgcccccgucg

SEQ ID NO: 1045504 - RNA, 14 nt, Mycobacterium bovis subsp bovis AF2122/97
gcacggcggcccac

SEQ ID NO: 1045505 - RNA, 23 nt, Mycobacterium bovis subsp bovis AF2122/97
gcacgggaucgaucugcggaggc

SEQ ID NO: 1045506 - RNA, 22 nt, Mycobacterium bovis subsp bovis AF2122/97
gcacgggcagauacgccaaccg

SEQ ID NO: 1045507 - RNA, 13 nt, Mycobacterium bovis subsp bovis AF2122/97
gcacgggccacca

SEQ ID NO: 1045508 - RNA, 18 nt, Mycobacterium bovis subsp bovis AF2122/97
gcacggcuugggucuccg

SEQ ID NO: 1045509 - RNA, 20 nt, Mycobacterium bovis subsp bovis AF2122/97
gcacggcuuuucgacgcugu

SEQ ID NO: 1045510 - RNA, 18 nt, Mycobacterium bovis subsp bovis AF2122/97
gcacgggaaucgcucgcg

SEQ ID NO: 1045511 - RNA, 18 nt, Mycobacterium bovis subsp bovis AF2122/97
gcacgggcacgaucgucg

SEQ ID NO: 1045512 - RNA, 15 nt, Mycobacterium bovis subsp bovis AF2122/97
gcacggugccgccgu

SEQ ID NO: 1045513 - RNA, 14 nt, Mycobacterium bovis subsp bovis AF2122/97
gcacggugagccgg

SEQ ID NO: 1045514 - RNA, 17 nt, Mycobacterium bovis subsp bovis AF2122/97
gcacggugagccggugg

SEQ ID NO: 1045515 - RNA, 18 nt, Mycobacterium bovis subsp bovis AF2122/97
gcacggugagccgguggc

SEQ ID NO: 1045516 - RNA, 16 nt, Mycobacterium bovis subsp bovis AF2122/97
gcacggcuucggcgag

SEQ ID NO: 1045517 - RNA, 13 nt, Mycobacterium bovis subsp bovis AF2122/97
gcacggcggugug

SEQ ID NO: 1045518 - RNA, 18 nt, Mycobacterium bovis subsp bovis AF2122/97
gcacggcgucggccaccg

SEQ ID NO: 1045519 - RNA, 19 nt, Mycobacterium bovis subsp bovis AF2122/97
gcacggcgucggccaccgc

SEQ ID NO: 1045520 - RNA, 20 nt, Mycobacterium bovis subsp bovis AF2122/97
gcacggcgugucgagggcuu

SEQ ID NO: 1045521 - RNA, 23 nt, Mycobacterium bovis subsp bovis AF2122/97
gcacggcggccacguccucagcc

SEQ ID NO: 1045522 - RNA, 23 nt, Mycobacterium bovis subsp bovis AF2122/97
gcacggcaaccagcgagcccagc

SEQ ID NO: 1045523 - RNA, 13 nt, Mycobacterium bovis subsp bovis AF2122/97
gcacggaugucgc

SEQ ID NO: 1045524 - RNA, 21 nt, Mycobacterium bovis subsp bovis AF2122/97
gcacggauuuucgcaguccgg

SEQ ID NO: 1045525 - RNA, 14 nt, Mycobacterium bovis subsp bovis AF2122/97
gcacgcugucgauc

SEQ ID NO: 1045526 - RNA, 22 nt, Mycobacterium bovis subsp bovis AF2122/97
gcacgcuggcgggcacucagca

SEQ ID NO: 1045527 - RNA, 16 nt, Mycobacterium bovis subsp bovis AF2122/97
gcacggaccaucgcca

SEQ ID NO: 1045528 - RNA, 17 nt, Mycobacterium bovis subsp bovis AF2122/97
gcacggaaggcccggcg

SEQ ID NO: 1045529 - RNA, 18 nt, Mycobacterium bovis subsp bovis AF2122/97
gcacggaaggcccggcgc

SEQ ID NO: 1045530 - RNA, 22 nt, Mycobacterium bovis subsp bovis AF2122/97
gcacggaaggcccggcgcggcc

SEQ ID NO: 1045531 - RNA, 18 nt, Mycobacterium bovis subsp bovis AF2122/97
gcacggaaguacuccacc

SEQ ID NO: 1045532 - RNA, 18 nt, Mycobacterium bovis subsp bovis AF2122/97
gcacggaugcgauggccg

SEQ ID NO: 1045533 - RNA, 17 nt, Mycobacterium bovis subsp bovis AF2122/97
gcacggagccgccggcg

SEQ ID NO: 1045534 - RNA, 19 nt, Mycobacterium bovis subsp bovis AF2122/97
gcacggagccgccggcggu

SEQ ID NO: 1045535 - RNA, 14 nt, Mycobacterium bovis subsp bovis AF2122/97
gcacgcuagccgac

SEQ ID NO: 1045536 - RNA, 17 nt, Mycobacterium bovis subsp bovis AF2122/97
gcacgcuagccgacagc

SEQ ID NO: 1045537 - RNA, 16 nt, Mycobacterium bovis subsp bovis AF2122/97
gcacgcgugccgcaac

SEQ ID NO: 1045538 - RNA, 13 nt, Mycobacterium bovis subsp bovis AF2122/97
gcacgcgugccgc

SEQ ID NO: 1045539 - RNA, 21 nt, Mycobacterium bovis subsp bovis AF2122/97
gcacgcucaugaccgcucgga

SEQ ID NO: 1045540 - RNA, 19 nt, Mycobacterium bovis subsp bovis AF2122/97
gcacgcuccagcucggcca

SEQ ID NO: 1045541 - RNA, 23 nt, Mycobacterium bovis subsp bovis AF2122/97
gcacgcuggcguuguugacgauc

SEQ ID NO: 1045542 - RNA, 19 nt, Mycobacterium bovis subsp bovis AF2122/97
gcacgcucgcgcacccugc

SEQ ID NO: 1045543 - RNA, 18 nt, Mycobacterium bovis subsp bovis AF2122/97
gcacgucaucggcuggcc

SEQ ID NO: 1045544 - RNA, 19 nt, Mycobacterium bovis subsp bovis AF2122/97
gcacgucaucggcuggccg

SEQ ID NO: 1045545 - RNA, 15 nt, Mycobacterium bovis subsp bovis AF2122/97
gcacguccgaucggc

SEQ ID NO: 1045546 - RNA, 18 nt, Mycobacterium bovis subsp bovis AF2122/97
gcacgucgaggcggcagu

SEQ ID NO: 1045547 - RNA, 16 nt, Mycobacterium bovis subsp bovis AF2122/97
gcacgucgcggccgug

SEQ ID NO: 1045548 - RNA, 18 nt, Mycobacterium bovis subsp bovis AF2122/97
gcacgucgcggccgugga

SEQ ID NO: 1045549 - RNA, 14 nt, Mycobacterium bovis subsp bovis AF2122/97
gcacucccggcucg

SEQ ID NO: 1045550 - RNA, 18 nt, Mycobacterium bovis subsp bovis AF2122/97
gcacgucguugugcagau

SEQ ID NO: 1045551 - RNA, 24 nt, Mycobacterium bovis subsp bovis AF2122/97
gcacgucuugcugcacgcucugcg

SEQ ID NO: 1045552 - RNA, 19 nt, Mycobacterium bovis subsp bovis AF2122/97
gcacgucgaccucggcaac

SEQ ID NO: 1045553 - RNA, 13 nt, Mycobacterium bovis subsp bovis AF2122/97
gcacucccgagcc

SEQ ID NO: 1045554 - RNA, 14 nt, Mycobacterium bovis subsp bovis AF2122/97
gcacuccggcgacg

SEQ ID NO: 1045555 - RNA, 22 nt, Mycobacterium bovis subsp bovis AF2122/97
gcacuccgggcucggcgucgcc

SEQ ID NO: 1045556 - RNA, 15 nt, Mycobacterium bovis subsp bovis AF2122/97
gcacgucggcgggcg

SEQ ID NO: 1045557 - RNA, 17 nt, Mycobacterium bovis subsp bovis AF2122/97
gcacgucgggcccgaug

SEQ ID NO: 1045558 - RNA, 12 nt, Mycobacterium bovis subsp bovis AF2122/97
gcacgucggcgg

SEQ ID NO: 1045559 - RNA, 16 nt, Mycobacterium bovis subsp bovis AF2122/97
gcacgucacgcgcggc

SEQ ID NO: 1045560 - RNA, 17 nt, Mycobacterium bovis subsp bovis AF2122/97
gcacgucacgcgcggcg

SEQ ID NO: 1045561 - RNA, 18 nt, Mycobacterium bovis subsp bovis AF2122/97
gcacgucacgcgcggcgg

SEQ ID NO: 1045562 - RNA, 23 nt, Mycobacterium bovis subsp bovis AF2122/97
gcacgucacgcgcggcggcgucc

SEQ ID NO: 1045563 - RNA, 17 nt, Mycobacterium bovis subsp bovis AF2122/97
gcacgucacgcggaaac

SEQ ID NO: 1045564 - RNA, 22 nt, Mycobacterium bovis subsp bovis AF2122/97
gcacgguguacgcccgcucgga

SEQ ID NO: 1045565 - RNA, 14 nt, Mycobacterium bovis subsp bovis AF2122/97
gcacguagacggug

SEQ ID NO: 1045566 - RNA, 22 nt, Mycobacterium bovis subsp bovis AF2122/97
gcacguagaaguaggcggcgac

SEQ ID NO: 1045567 - RNA, 14 nt, Mycobacterium bovis subsp bovis AF2122/97
gcacguaacgccgc

SEQ ID NO: 1045568 - RNA, 15 nt, Mycobacterium bovis subsp bovis AF2122/97
gcacguaacgccgcu

SEQ ID NO: 1045569 - RNA, 21 nt, Mycobacterium bovis subsp bovis AF2122/97
gcacgguguauccgacuggcc

SEQ ID NO: 1045570 - RNA, 18 nt, Mycobacterium bovis subsp bovis AF2122/97
gcacggugucgcgcgacc

SEQ ID NO: 1045571 - RNA, 12 nt, Mycobacterium bovis subsp bovis AF2122/97
gcacggugugcg

SEQ ID NO: 1045572 - RNA, 17 nt, Mycobacterium bovis subsp bovis AF2122/97
gcacgguguugcgcacc

SEQ ID NO: 1045573 - RNA, 20 nt, Mycobacterium bovis subsp bovis AF2122/97
gcacgguguugcgcacccgc

SEQ ID NO: 1045574 - RNA, 18 nt, Mycobacterium bovis subsp bovis AF2122/97
gcacgguucuuggcgucu

SEQ ID NO: 1045575 - RNA, 22 nt, Mycobacterium bovis subsp bovis AF2122/97
gcacgguuguuguagaucugcg

SEQ ID NO: 1045576 - RNA, 23 nt, Mycobacterium bovis subsp bovis AF2122/97
gcacgguugccgucagggucagc

SEQ ID NO: 1045577 - RNA, 15 nt, Mycobacterium bovis subsp bovis AF2122/97
gcacgguggccgagc

SEQ ID NO: 1045578 - RNA, 21 nt, Mycobacterium bovis subsp bovis AF2122/97
gcacggugcugaucgguccgg

SEQ ID NO: 1045579 - RNA, 18 nt, Mycobacterium bovis subsp bovis AF2122/97
gcacggugggcgcugggu

SEQ ID NO: 1045580 - RNA, 13 nt, Mycobacterium bovis subsp bovis AF2122/97
gcacgccgccgac

SEQ ID NO: 1045581 - RNA, 12 nt, Mycobacterium bovis subsp bovis AF2122/97
gcacgccggcau

SEQ ID NO: 1045582 - RNA, 19 nt, Mycobacterium bovis subsp bovis AF2122/97
gcacgccgaccgguggcac

SEQ ID NO: 1045583 - RNA, 18 nt, Mycobacterium bovis subsp bovis AF2122/97
gcacgccggcaugccagc

SEQ ID NO: 1045584 - RNA, 12 nt, Mycobacterium bovis subsp bovis AF2122/97
gcacgccggcgg

SEQ ID NO: 1045585 - RNA, 14 nt, Mycobacterium bovis subsp bovis AF2122/97
gcacgccggcgcug

SEQ ID NO: 1045586 - RNA, 15 nt, Mycobacterium bovis subsp bovis AF2122/97
gcacgccggcgcugg

SEQ ID NO: 1045587 - RNA, 17 nt, Mycobacterium bovis subsp bovis AF2122/97
gcacgccggcgcuggag

SEQ ID NO: 1045588 - RNA, 13 nt, Mycobacterium bovis subsp bovis AF2122/97
gcacgcgcucgcg

SEQ ID NO: 1045589 - RNA, 13 nt, Mycobacterium bovis subsp bovis AF2122/97
gcacgcggacaug

SEQ ID NO: 1045590 - RNA, 22 nt, Mycobacterium bovis subsp bovis AF2122/97
gcacgcggacaugacagccccg

SEQ ID NO: 1045591 - RNA, 20 nt, Mycobacterium bovis subsp bovis AF2122/97
gcacgcgggagguaccccca

SEQ ID NO: 1045592 - RNA, 13 nt, Mycobacterium bovis subsp bovis AF2122/97
gcacgcgggaagu

SEQ ID NO: 1045593 - RNA, 18 nt, Mycobacterium bovis subsp bovis AF2122/97
gcacgcgggaagugcacc

SEQ ID NO: 1045594 - RNA, 13 nt, Mycobacterium bovis subsp bovis AF2122/97
gcacgauggccgu

SEQ ID NO: 1045595 - RNA, 17 nt, Mycobacterium bovis subsp bovis AF2122/97
gcacgcaacaccgccaa

SEQ ID NO: 1045596 - RNA, 13 nt, Mycobacterium bovis subsp bovis AF2122/97
gcacgcacgcggu

SEQ ID NO: 1045597 - RNA, 17 nt, Mycobacterium bovis subsp bovis AF2122/97
gcacgaugucgaugccg

SEQ ID NO: 1045598 - RNA, 16 nt, Mycobacterium bovis subsp bovis AF2122/97
gcacgcagccgauaca

SEQ ID NO: 1045599 - RNA, 24 nt, Mycobacterium bovis subsp bovis AF2122/97
gcacgccgaccggcccgcauccgc

SEQ ID NO: 1045600 - RNA, 15 nt, Mycobacterium bovis subsp bovis AF2122/97
gcacgccgagcccgc

SEQ ID NO: 1045601 - RNA, 20 nt, Mycobacterium bovis subsp bovis AF2122/97
gcacgccauaccggcuggcc

SEQ ID NO: 1045602 - RNA, 12 nt, Mycobacterium bovis subsp bovis AF2122/97
gcaccucgucga

SEQ ID NO: 1045603 - RNA, 20 nt, Mycobacterium bovis subsp bovis AF2122/97
gcaccucgucgaucgccgcg

SEQ ID NO: 1045604 - RNA, 18 nt, Mycobacterium bovis subsp bovis AF2122/97
gcaccucgguggcugcca

SEQ ID NO: 1045605 - RNA, 21 nt, Mycobacterium bovis subsp bovis AF2122/97
gcaccugguuccagaggcccg

SEQ ID NO: 1045606 - RNA, 18 nt, Mycobacterium bovis subsp bovis AF2122/97
gcaccugggcugccggcc

SEQ ID NO: 1045607 - RNA, 17 nt, Mycobacterium bovis subsp bovis AF2122/97
gcaccugggucgacgag

SEQ ID NO: 1045608 - RNA, 18 nt, Mycobacterium bovis subsp bovis AF2122/97
gcaccugggcgcgcuggc

SEQ ID NO: 1045609 - RNA, 19 nt, Mycobacterium bovis subsp bovis AF2122/97
gcaccugggcgcgcuggcg

SEQ ID NO: 1045610 - RNA, 15 nt, Mycobacterium bovis subsp bovis AF2122/97
gcaccugggcggcgc

SEQ ID NO: 1045611 - RNA, 15 nt, Mycobacterium bovis subsp bovis AF2122/97
gcacgacgcgacacg

SEQ ID NO: 1045612 - RNA, 17 nt, Mycobacterium bovis subsp bovis AF2122/97
gcacgacgugcgucggc

SEQ ID NO: 1045613 - RNA, 18 nt, Mycobacterium bovis subsp bovis AF2122/97
gcacgacgugcgucggcc

SEQ ID NO: 1045614 - RNA, 20 nt, Mycobacterium bovis subsp bovis AF2122/97
gcacgacgugcgucggcccg

SEQ ID NO: 1045615 - RNA, 13 nt, Mycobacterium bovis subsp bovis AF2122/97
gcaccuugaccgu

SEQ ID NO: 1045616 - RNA, 15 nt, Mycobacterium bovis subsp bovis AF2122/97
gcacgagugcggcga

SEQ ID NO: 1045617 - RNA, 17 nt, Mycobacterium bovis subsp bovis AF2122/97
gcacgaguuaccggugg

SEQ ID NO: 1045618 - RNA, 17 nt, Mycobacterium bovis subsp bovis AF2122/97
gcacgauagccaccgac

SEQ ID NO: 1045619 - RNA, 19 nt, Mycobacterium bovis subsp bovis AF2122/97
gcacgauagccaccgacga

SEQ ID NO: 1045620 - RNA, 21 nt, Mycobacterium bovis subsp bovis AF2122/97
gcacgauagccaccgacgaca

SEQ ID NO: 1045621 - RNA, 15 nt, Mycobacterium bovis subsp bovis AF2122/97
gcacgauagccgaaa

SEQ ID NO: 1045622 - RNA, 19 nt, Mycobacterium bovis subsp bovis AF2122/97
gcaccuugcgauugcgcac

SEQ ID NO: 1045623 - RNA, 16 nt, Mycobacterium bovis subsp bovis AF2122/97
gcacgacgcgacacgc

SEQ ID NO: 1045624 - RNA, 20 nt, Mycobacterium bovis subsp bovis AF2122/97
gcacgacgcgacacgccggc

SEQ ID NO: 1045625 - RNA, 21 nt, Mycobacterium bovis subsp bovis AF2122/97
gcacgacgcgacacgccggcg

SEQ ID NO: 1045626 - RNA, 23 nt, Mycobacterium bovis subsp bovis AF2122/97
gcacgacgcgacacgccggcggg

SEQ ID NO: 1045627 - RNA, 21 nt, Mycobacterium bovis subsp bovis AF2122/97
gcacgacugugcgccgcagcc

SEQ ID NO: 1045628 - RNA, 14 nt, Mycobacterium bovis subsp bovis AF2122/97
gcacgaucgcggug

SEQ ID NO: 1045629 - RNA, 22 nt, Mycobacterium bovis subsp bovis AF2122/97
gcacgaucaucgggguggccac

SEQ ID NO: 1045630 - RNA, 12 nt, Mycobacterium bovis subsp bovis AF2122/97
gcacgaucgcca

SEQ ID NO: 1045631 - RNA, 13 nt, Mycobacterium bovis subsp bovis AF2122/97
gcacgaucgccau

SEQ ID NO: 1045632 - RNA, 13 nt, Mycobacterium bovis subsp bovis AF2122/97
gcacgaucgcccg

SEQ ID NO: 1045633 - RNA, 18 nt, Mycobacterium bovis subsp bovis AF2122/97
gcaccagggagccguuca

SEQ ID NO: 1045634 - RNA, 23 nt, Mycobacterium bovis subsp bovis AF2122/97
gcaccagcgggucggcggugccg

SEQ ID NO: 1045635 - RNA, 20 nt, Mycobacterium bovis subsp bovis AF2122/97
gcaccaggggcgcgucaugg

SEQ ID NO: 1045636 - RNA, 18 nt, Mycobacterium bovis subsp bovis AF2122/97
gcaccagguugccgaggu

SEQ ID NO: 1045637 - RNA, 17 nt, Mycobacterium bovis subsp bovis AF2122/97
gcaccaguccagcgggc

SEQ ID NO: 1045638 - RNA, 23 nt, Mycobacterium bovis subsp bovis AF2122/97
gcaccaggggcgcgucauggcga

SEQ ID NO: 1045639 - RNA, 20 nt, Mycobacterium bovis subsp bovis AF2122/97
gcaccaggguggcccgggga

SEQ ID NO: 1045640 - RNA, 22 nt, Mycobacterium bovis subsp bovis AF2122/97
gcaccaggguggcccggggacg

SEQ ID NO: 1045641 - RNA, 15 nt, Mycobacterium bovis subsp bovis AF2122/97
gcaccagucgucgcg

SEQ ID NO: 1045642 - RNA, 20 nt, Mycobacterium bovis subsp bovis AF2122/97
gcaccaguguggcgaugacc

SEQ ID NO: 1045643 - RNA, 17 nt, Mycobacterium bovis subsp bovis AF2122/97
gcaccauacucaccgac

SEQ ID NO: 1045644 - RNA, 18 nt, Mycobacterium bovis subsp bovis AF2122/97
gcaccauacucaccgacg

SEQ ID NO: 1045645 - RNA, 22 nt, Mycobacterium bovis subsp bovis AF2122/97
gcaccauacucaccgacgcgcc

SEQ ID NO: 1045646 - RNA, 13 nt, Mycobacterium bovis subsp bovis AF2122/97
gcaccaucggcga

SEQ ID NO: 1045647 - RNA, 14 nt, Mycobacterium bovis subsp bovis AF2122/97
gcacccacgccggu

SEQ ID NO: 1045648 - RNA, 18 nt, Mycobacterium bovis subsp bovis AF2122/97
gcacccaaugccaccgcg

SEQ ID NO: 1045649 - RNA, 21 nt, Mycobacterium bovis subsp bovis AF2122/97
gcacccaaugccaccgcggcc

SEQ ID NO: 1045650 - RNA, 22 nt, Mycobacterium bovis subsp bovis AF2122/97
gcacccaaugccaccgcggccg

SEQ ID NO: 1045651 - RNA, 23 nt, Mycobacterium bovis subsp bovis AF2122/97
gcacccaaugccaccgcggccgc

SEQ ID NO: 1045652 - RNA, 17 nt, Mycobacterium bovis subsp bovis AF2122/97
gcacccaccacaccaag

SEQ ID NO: 1045653 - RNA, 14 nt, Mycobacterium bovis subsp bovis AF2122/97
gcacccaccccgaa

SEQ ID NO: 1045654 - RNA, 14 nt, Mycobacterium bovis subsp bovis AF2122/97
gcacccaccgaacc

SEQ ID NO: 1045655 - RNA, 18 nt, Mycobacterium bovis subsp bovis AF2122/97
gcacccaaccaggccgcg

SEQ ID NO: 1045656 - RNA, 19 nt, Mycobacterium bovis subsp bovis AF2122/97
gcacccaaccaggccgcga

SEQ ID NO: 1045657 - RNA, 14 nt, Mycobacterium bovis subsp bovis AF2122/97
gcacccaacccggc

SEQ ID NO: 1045658 - RNA, 21 nt, Mycobacterium bovis subsp bovis AF2122/97
gcaccauccggucccgccgug

SEQ ID NO: 1045659 - RNA, 21 nt, Mycobacterium bovis subsp bovis AF2122/97
gcaccauuguuccguccccga

SEQ ID NO: 1045660 - RNA, 16 nt, Mycobacterium bovis subsp bovis AF2122/97
gcaccagcgcgcgccg

SEQ ID NO: 1045661 - RNA, 18 nt, Mycobacterium bovis subsp bovis AF2122/97
gcaccagcgcgcgccgag

SEQ ID NO: 1045662 - RNA, 21 nt, Mycobacterium bovis subsp bovis AF2122/97
gcaccagcgccuugaccagca

SEQ ID NO: 1045663 - RNA, 20 nt, Mycobacterium bovis subsp bovis AF2122/97
gcaccagcgucgcggccacg

SEQ ID NO: 1045664 - RNA, 13 nt, Mycobacterium bovis subsp bovis AF2122/97
gcaccagcggcac

SEQ ID NO: 1045665 - RNA, 20 nt, Mycobacterium bovis subsp bovis AF2122/97
gcaccagcggcaccgcggcc

SEQ ID NO: 1045666 - RNA, 13 nt, Mycobacterium bovis subsp bovis AF2122/97
gcaccagcggcug

SEQ ID NO: 1045667 - RNA, 12 nt, Mycobacterium bovis subsp bovis AF2122/97
gcaccagcgggu

SEQ ID NO: 1045668 - RNA, 22 nt, Mycobacterium bovis subsp bovis AF2122/97
gcaccagcucggugaucaccau

SEQ ID NO: 1045669 - RNA, 14 nt, Mycobacterium bovis subsp bovis AF2122/97
gcaccagcugucgg

SEQ ID NO: 1045670 - RNA, 21 nt, Mycobacterium bovis subsp bovis AF2122/97
gcaccagcacggcaaccagcg

SEQ ID NO: 1045671 - RNA, 18 nt, Mycobacterium bovis subsp bovis AF2122/97
gcaccagcauucucgccg

SEQ ID NO: 1045672 - RNA, 22 nt, Mycobacterium bovis subsp bovis AF2122/97
gcaccagcauucucgccgacgg

SEQ ID NO: 1045673 - RNA, 23 nt, Mycobacterium bovis subsp bovis AF2122/97
gcaccagccccuggaggggcaac

SEQ ID NO: 1045674 - RNA, 16 nt, Mycobacterium bovis subsp bovis AF2122/97
gcaccagccggugagc

SEQ ID NO: 1045675 - RNA, 14 nt, Mycobacterium bovis subsp bovis AF2122/97
gcaccaaccaccga

SEQ ID NO: 1045676 - RNA, 16 nt, Mycobacterium bovis subsp bovis AF2122/97
gcaccaaccaccgacu

SEQ ID NO: 1045677 - RNA, 19 nt, Mycobacterium bovis subsp bovis AF2122/97
gcaccaaaugccccgaacc

SEQ ID NO: 1045678 - RNA, 21 nt, Mycobacterium bovis subsp bovis AF2122/97
gcacauugguguccaccaccg

SEQ ID NO: 1045679 - RNA, 21 nt, Mycobacterium bovis subsp bovis AF2122/97
gcacauugaucgacggccagc

SEQ ID NO: 1045680 - RNA, 15 nt, Mycobacterium bovis subsp bovis AF2122/97
gcacauucagcgccg

SEQ ID NO: 1045681 - RNA, 22 nt, Mycobacterium bovis subsp bovis AF2122/97
gcacaucugcgggacgucgucg

SEQ ID NO: 1045682 - RNA, 19 nt, Mycobacterium bovis subsp bovis AF2122/97
gcacaucugcgggacgucg

SEQ ID NO: 1045683 - RNA, 18 nt, Mycobacterium bovis subsp bovis AF2122/97
gcacaugcgcguccagcu

SEQ ID NO: 1045684 - RNA, 16 nt, Mycobacterium bovis subsp bovis AF2122/97
gcacaugcucggccug

SEQ ID NO: 1045685 - RNA, 17 nt, Mycobacterium bovis subsp bovis AF2122/97
gcacaugcugccgcugc

SEQ ID NO: 1045686 - RNA, 21 nt, Mycobacterium bovis subsp bovis AF2122/97
gcacauggugggucgacgauc

SEQ ID NO: 1045687 - RNA, 19 nt, Mycobacterium bovis subsp bovis AF2122/97
gcaccacauuggcgaucag

SEQ ID NO: 1045688 - RNA, 18 nt, Mycobacterium bovis subsp bovis AF2122/97
gcaccacaucggugccac

SEQ ID NO: 1045689 - RNA, 22 nt, Mycobacterium bovis subsp bovis AF2122/97
gcaccacagugaaauccgagcc

SEQ ID NO: 1045690 - RNA, 12 nt, Mycobacterium bovis subsp bovis AF2122/97
gcaccacaucgg

SEQ ID NO: 1045691 - RNA, 20 nt, Mycobacterium bovis subsp bovis AF2122/97
gcaccacaacgucggcaccg

SEQ ID NO: 1045692 - RNA, 17 nt, Mycobacterium bovis subsp bovis AF2122/97
gcaccacaauccacgca

SEQ ID NO: 1045693 - RNA, 23 nt, Mycobacterium bovis subsp bovis AF2122/97
gcaccacaauccacgcacucguc

SEQ ID NO: 1045694 - RNA, 14 nt, Mycobacterium bovis subsp bovis AF2122/97
gcaccaccacaccg

SEQ ID NO: 1045695 - RNA, 13 nt, Mycobacterium bovis subsp bovis AF2122/97
gcaccaacgccac

SEQ ID NO: 1045696 - RNA, 14 nt, Mycobacterium bovis subsp bovis AF2122/97
gcaccaacgccacc

SEQ ID NO: 1045697 - RNA, 16 nt, Mycobacterium bovis subsp bovis AF2122/97
gcaccaacgcgaucag

SEQ ID NO: 1045698 - RNA, 19 nt, Mycobacterium bovis subsp bovis AF2122/97
gcaccaacgccaccgucgc

SEQ ID NO: 1045699 - RNA, 16 nt, Mycobacterium bovis subsp bovis AF2122/97
gcaccaauaccgcacc

SEQ ID NO: 1045700 - RNA, 16 nt, Mycobacterium bovis subsp bovis AF2122/97
gcaccaagacgccacc

SEQ ID NO: 1045701 - RNA, 15 nt, Mycobacterium bovis subsp bovis AF2122/97
gcaccaaggccgccu

SEQ ID NO: 1045702 - RNA, 16 nt, Mycobacterium bovis subsp bovis AF2122/97
gcaccaaggccgccug

SEQ ID NO: 1045703 - RNA, 23 nt, Mycobacterium bovis subsp bovis AF2122/97
gcaccaagguacuugcgcaaccg

SEQ ID NO: 1045704 - RNA, 23 nt, Mycobacterium bovis subsp bovis AF2122/97
gcaccaaggucuucaggccgcgc

SEQ ID NO: 1045705 - RNA, 14 nt, Mycobacterium bovis subsp bovis AF2122/97
gcaccaaugcggug

SEQ ID NO: 1045706 - RNA, 18 nt, Mycobacterium bovis subsp bovis AF2122/97
gcaccacaacgucggcac

SEQ ID NO: 1045707 - RNA, 15 nt, Mycobacterium bovis subsp bovis AF2122/97
gcaccaacucucgcg

SEQ ID NO: 1045708 - RNA, 15 nt, Mycobacterium bovis subsp bovis AF2122/97
gcaccaccgcggugu

SEQ ID NO: 1045709 - RNA, 19 nt, Mycobacterium bovis subsp bovis AF2122/97
gcaccaccgcgaccucgcg

SEQ ID NO: 1045710 - RNA, 12 nt, Mycobacterium bovis subsp bovis AF2122/97
gcaccaccgccc

SEQ ID NO: 1045711 - RNA, 22 nt, Mycobacterium bovis subsp bovis AF2122/97
gcaccaccgccccgcgcccaac

SEQ ID NO: 1045712 - RNA, 13 nt, Mycobacterium bovis subsp bovis AF2122/97
gcaccacccgggc

SEQ ID NO: 1045713 - RNA, 13 nt, Mycobacterium bovis subsp bovis AF2122/97
gcaccaccgagcc

SEQ ID NO: 1045714 - RNA, 14 nt, Mycobacterium bovis subsp bovis AF2122/97
gcaccaccgagccg

SEQ ID NO: 1045715 - RNA, 16 nt, Mycobacterium bovis subsp bovis AF2122/97
gcaccaccccgaggcc

SEQ ID NO: 1045716 - RNA, 12 nt, Mycobacterium bovis subsp bovis AF2122/97
gcaccacccgau

SEQ ID NO: 1045717 - RNA, 14 nt, Mycobacterium bovis subsp bovis AF2122/97
gcaccacccgggcc

SEQ ID NO: 1045718 - RNA, 17 nt, Mycobacterium bovis subsp bovis AF2122/97
gcaccacccgggccucg

SEQ ID NO: 1045719 - RNA, 21 nt, Mycobacterium bovis subsp bovis AF2122/97
gcaccacccgggccucggcgc

SEQ ID NO: 1045720 - RNA, 23 nt, Mycobacterium bovis subsp bovis AF2122/97
gcaccacccgggccucggcgccg

SEQ ID NO: 1045721 - RNA, 15 nt, Mycobacterium bovis subsp bovis AF2122/97
gcaccacgagcagcc

SEQ ID NO: 1045722 - RNA, 18 nt, Mycobacterium bovis subsp bovis AF2122/97
gcaccacgagcagccgau

SEQ ID NO: 1045723 - RNA, 13 nt, Mycobacterium bovis subsp bovis AF2122/97
gcaccacgaccga

SEQ ID NO: 1045724 - RNA, 14 nt, Mycobacterium bovis subsp bovis AF2122/97
gcaccacgaccgac

SEQ ID NO: 1045725 - RNA, 24 nt, Mycobacterium bovis subsp bovis AF2122/97
gcaccaccgucucgccgcgcaccg

SEQ ID NO: 1045726 - RNA, 13 nt, Mycobacterium bovis subsp bovis AF2122/97
gcaccacgcugug

SEQ ID NO: 1045727 - RNA, 16 nt, Mycobacterium bovis subsp bovis AF2122/97
gcaccacggcgcgcgc

SEQ ID NO: 1045728 - RNA, 20 nt, Mycobacterium bovis subsp bovis AF2122/97
gcaccacggcgcgcgcgccg

SEQ ID NO: 1045729 - RNA, 16 nt, Mycobacterium bovis subsp bovis AF2122/97
gcaccacgugcgccac

SEQ ID NO: 1045730 - RNA, 15 nt, Mycobacterium bovis subsp bovis AF2122/97
gcaccacggcggcca

SEQ ID NO: 1045731 - RNA, 15 nt, Mycobacterium bovis subsp bovis AF2122/97
gcaccaccggcccca

SEQ ID NO: 1045732 - RNA, 23 nt, Mycobacterium bovis subsp bovis AF2122/97
gcaccagauagaucgugaucgac

SEQ ID NO: 1045733 - RNA, 13 nt, Mycobacterium bovis subsp bovis AF2122/97
gcaccagcaccgu

SEQ ID NO: 1045734 - RNA, 21 nt, Mycobacterium bovis subsp bovis AF2122/97
gcaccagauagaucgugaucg

SEQ ID NO: 1045735 - RNA, 23 nt, Mycobacterium bovis subsp bovis AF2122/97
gcacagcuugcaauugcgcggcc

SEQ ID NO: 1045736 - RNA, 15 nt, Mycobacterium bovis subsp bovis AF2122/97
gcacaggcgacggcc

SEQ ID NO: 1045737 - RNA, 15 nt, Mycobacterium bovis subsp bovis AF2122/97
gcacaggcgcgaucg

SEQ ID NO: 1045738 - RNA, 22 nt, Mycobacterium bovis subsp bovis AF2122/97
gcacaggaagcccauccccgcu

SEQ ID NO: 1045739 - RNA, 19 nt, Mycobacterium bovis subsp bovis AF2122/97
gcacaggaucacccacucg

SEQ ID NO: 1045740 - RNA, 14 nt, Mycobacterium bovis subsp bovis AF2122/97
gcacagcggcaucg

SEQ ID NO: 1045741 - RNA, 16 nt, Mycobacterium bovis subsp bovis AF2122/97
gcacagcggcaucgcg

SEQ ID NO: 1045742 - RNA, 21 nt, Mycobacterium bovis subsp bovis AF2122/97
gcacagcggcaucgcgggcgg

SEQ ID NO: 1045743 - RNA, 21 nt, Mycobacterium bovis subsp bovis AF2122/97
gcacagcgcaggguucgucgg

SEQ ID NO: 1045744 - RNA, 15 nt, Mycobacterium bovis subsp bovis AF2122/97
gcacagcgacgagau

SEQ ID NO: 1045745 - RNA, 14 nt, Mycobacterium bovis subsp bovis AF2122/97
gcacagcccggcga

SEQ ID NO: 1045746 - RNA, 18 nt, Mycobacterium bovis subsp bovis AF2122/97
gcacagcccggcgacgac

SEQ ID NO: 1045747 - RNA, 16 nt, Mycobacterium bovis subsp bovis AF2122/97
gcacagcccgaugccg

SEQ ID NO: 1045748 - RNA, 15 nt, Mycobacterium bovis subsp bovis AF2122/97
gcacauaggcgaucg

SEQ ID NO: 1045749 - RNA, 13 nt, Mycobacterium bovis subsp bovis AF2122/97
gcacaucggcgag

SEQ ID NO: 1045750 - RNA, 18 nt, Mycobacterium bovis subsp bovis AF2122/97
gcacauaugugcccggcg

SEQ ID NO: 1045751 - RNA, 21 nt, Mycobacterium bovis subsp bovis AF2122/97
gcacaucaugggcgcugccaa

SEQ ID NO: 1045752 - RNA, 20 nt, Mycobacterium bovis subsp bovis AF2122/97
gcacauacgauuucgacgac

SEQ ID NO: 1045753 - RNA, 20 nt, Mycobacterium bovis subsp bovis AF2122/97
gcacaggcaucguccgccgg

SEQ ID NO: 1045754 - RNA, 17 nt, Mycobacterium bovis subsp bovis AF2122/97
gcacagugcggccccga

SEQ ID NO: 1045755 - RNA, 23 nt, Mycobacterium bovis subsp bovis AF2122/97
gcacaggucagcgcugccaccgc

SEQ ID NO: 1045756 - RNA, 17 nt, Mycobacterium bovis subsp bovis AF2122/97
gcacaggcuggcgaugg

SEQ ID NO: 1045757 - RNA, 19 nt, Mycobacterium bovis subsp bovis AF2122/97
gcacaggcuggcgauggcc

SEQ ID NO: 1045758 - RNA, 22 nt, Mycobacterium bovis subsp bovis AF2122/97
gcacacuguuacuccgacggcc

SEQ ID NO: 1045759 - RNA, 22 nt, Mycobacterium bovis subsp bovis AF2122/97
gcacacugucgauuugaucgac

SEQ ID NO: 1045760 - RNA, 19 nt, Mycobacterium bovis subsp bovis AF2122/97
gcacacugaccccgccgcc

SEQ ID NO: 1045761 - RNA, 19 nt, Mycobacterium bovis subsp bovis AF2122/97
gcacacuggccacaaucgc

SEQ ID NO: 1045762 - RNA, 19 nt, Mycobacterium bovis subsp bovis AF2122/97
gcacagcaccacgugcgag

SEQ ID NO: 1045763 - RNA, 16 nt, Mycobacterium bovis subsp bovis AF2122/97
gcacagcaccacgugc

SEQ ID NO: 1045764 - RNA, 18 nt, Mycobacterium bovis subsp bovis AF2122/97
gcacagaaaacgauggug

SEQ ID NO: 1045765 - RNA, 17 nt, Mycobacterium bovis subsp bovis AF2122/97
gcacagacacggcagcu

SEQ ID NO: 1045766 - RNA, 20 nt, Mycobacterium bovis subsp bovis AF2122/97
gcacagagugaggcgcuggc

SEQ ID NO: 1045767 - RNA, 18 nt, Mycobacterium bovis subsp bovis AF2122/97
gcacagccauggugggcc

SEQ ID NO: 1045768 - RNA, 16 nt, Mycobacterium bovis subsp bovis AF2122/97
gcacagcaugauccgc

SEQ ID NO: 1045769 - RNA, 19 nt, Mycobacterium bovis subsp bovis AF2122/97
gcacagcagcaacgcggug

SEQ ID NO: 1045770 - RNA, 21 nt, Mycobacterium bovis subsp bovis AF2122/97
gcacagcagcaacgcggugcc

SEQ ID NO: 1045771 - RNA, 15 nt, Mycobacterium bovis subsp bovis AF2122/97
gcacagcagcaccgc

SEQ ID NO: 1045772 - RNA, 16 nt, Mycobacterium bovis subsp bovis AF2122/97
gcacagcagcaccgcg

SEQ ID NO: 1045773 - RNA, 17 nt, Mycobacterium bovis subsp bovis AF2122/97
gcacagcagcaccgcga

SEQ ID NO: 1045774 - RNA, 18 nt, Mycobacterium bovis subsp bovis AF2122/97
gcacagcagcaccgcgac

SEQ ID NO: 1045775 - RNA, 16 nt, Mycobacterium bovis subsp bovis AF2122/97
gcacaacgcgacgccg

SEQ ID NO: 1045776 - RNA, 17 nt, Mycobacterium bovis subsp bovis AF2122/97
gcacaacgcgacgccgc

SEQ ID NO: 1045777 - RNA, 22 nt, Mycobacterium bovis subsp bovis AF2122/97
gcacaacgcgacgccgcucccg

SEQ ID NO: 1045778 - RNA, 23 nt, Mycobacterium bovis subsp bovis AF2122/97
gcacaacgcgacgccgcucccgc

SEQ ID NO: 1045779 - RNA, 18 nt, Mycobacterium bovis subsp bovis AF2122/97
gcacaacccgugcaggau

SEQ ID NO: 1045780 - RNA, 18 nt, Mycobacterium bovis subsp bovis AF2122/97
gcacaagauccgccacgc

SEQ ID NO: 1045781 - RNA, 14 nt, Mycobacterium bovis subsp bovis AF2122/97
gcacaacgcccacc

SEQ ID NO: 1045782 - RNA, 17 nt, Mycobacterium bovis subsp bovis AF2122/97
gcacaacaucgccgcag

SEQ ID NO: 1045783 - RNA, 13 nt, Mycobacterium bovis subsp bovis AF2122/97
gcacaacccgugc

SEQ ID NO: 1045784 - RNA, 17 nt, Mycobacterium bovis subsp bovis AF2122/97
gcacaaccgcugcugcu

SEQ ID NO: 1045785 - RNA, 19 nt, Mycobacterium bovis subsp bovis AF2122/97
gcacacgccuaccgcgacg

SEQ ID NO: 1045786 - RNA, 18 nt, Mycobacterium bovis subsp bovis AF2122/97
gcacaccugcgcggcgug

SEQ ID NO: 1045787 - RNA, 20 nt, Mycobacterium bovis subsp bovis AF2122/97
gcacacggucaccggcacgu

SEQ ID NO: 1045788 - RNA, 13 nt, Mycobacterium bovis subsp bovis AF2122/97
gcacacguccggc

SEQ ID NO: 1045789 - RNA, 22 nt, Mycobacterium bovis subsp bovis AF2122/97
gcacacuaccgccgcgaccgcg

SEQ ID NO: 1045790 - RNA, 15 nt, Mycobacterium bovis subsp bovis AF2122/97
gcacacguccggcga

SEQ ID NO: 1045791 - RNA, 16 nt, Mycobacterium bovis subsp bovis AF2122/97
gcacacguccggcgau

SEQ ID NO: 1045792 - RNA, 23 nt, Mycobacterium bovis subsp bovis AF2122/97
gcaauacguagucgccgaucgag

SEQ ID NO: 1045793 - RNA, 16 nt, Mycobacterium bovis subsp bovis AF2122/97
gcaauaccggcaucga

SEQ ID NO: 1045794 - RNA, 20 nt, Mycobacterium bovis subsp bovis AF2122/97
gcaauaccugagcgcgcgcg

SEQ ID NO: 1045795 - RNA, 21 nt, Mycobacterium bovis subsp bovis AF2122/97
gcaaucacaucaaagucggcg

SEQ ID NO: 1045796 - RNA, 14 nt, Mycobacterium bovis subsp bovis AF2122/97
gcaaucaccgccgg

SEQ ID NO: 1045797 - RNA, 18 nt, Mycobacterium bovis subsp bovis AF2122/97
gcaaucaccgccggcggc

SEQ ID NO: 1045798 - RNA, 19 nt, Mycobacterium bovis subsp bovis AF2122/97
gcaaucaccgccggcggcg

SEQ ID NO: 1045799 - RNA, 21 nt, Mycobacterium bovis subsp bovis AF2122/97
gcaauauccgggagugcgccg

SEQ ID NO: 1045800 - RNA, 18 nt, Mycobacterium bovis subsp bovis AF2122/97
gcaaaccgguccgggucg

SEQ ID NO: 1045801 - RNA, 17 nt, Mycobacterium bovis subsp bovis AF2122/97
gcaaaccugaguccggc

SEQ ID NO: 1045802 - RNA, 19 nt, Mycobacterium bovis subsp bovis AF2122/97
gcaauaccgaaccggugua

SEQ ID NO: 1045803 - RNA, 21 nt, Mycobacterium bovis subsp bovis AF2122/97
gcaauaccgccagcgccaccg

SEQ ID NO: 1045804 - RNA, 19 nt, Mycobacterium bovis subsp bovis AF2122/97
gcaaaaucgucagcgccgc

SEQ ID NO: 1045805 - RNA, 20 nt, Mycobacterium bovis subsp bovis AF2122/97
gcaaacguaccgucauggcg

SEQ ID NO: 1045806 - RNA, 16 nt, Mycobacterium bovis subsp bovis AF2122/97
gcaaucgcgggcgaug

SEQ ID NO: 1045807 - RNA, 21 nt, Mycobacterium bovis subsp bovis AF2122/97
gcaaucggauacccagccggc

SEQ ID NO: 1045808 - RNA, 18 nt, Mycobacterium bovis subsp bovis AF2122/97
gcaaucgcgacggggucg

SEQ ID NO: 1045809 - RNA, 17 nt, Mycobacterium bovis subsp bovis AF2122/97
gcaaucgcgggcgaugg

SEQ ID NO: 1045810 - RNA, 19 nt, Mycobacterium bovis subsp bovis AF2122/97
gcaaucgcucugugucgcc

SEQ ID NO: 1045811 - RNA, 22 nt, Mycobacterium bovis subsp bovis AF2122/97
gcaaucgcucugugucgccgau

SEQ ID NO: 1045812 - RNA, 16 nt, Mycobacterium bovis subsp bovis AF2122/97
gcaaucgugguucggc

SEQ ID NO: 1045813 - RNA, 17 nt, Mycobacterium bovis subsp bovis AF2122/97
gcaaugccgacgccaac

SEQ ID NO: 1045814 - RNA, 23 nt, Mycobacterium bovis subsp bovis AF2122/97
gcaaucgaggaaggugugcgucu

SEQ ID NO: 1045815 - RNA, 16 nt, Mycobacterium bovis subsp bovis AF2122/97
gcaauccggucagcgc

SEQ ID NO: 1045816 - RNA, 16 nt, Mycobacterium bovis subsp bovis AF2122/97
gcaaugccucgaccac

SEQ ID NO: 1045817 - RNA, 15 nt, Mycobacterium bovis subsp bovis AF2122/97
gcaaugcgagcgcgc

SEQ ID NO: 1045818 - RNA, 18 nt, Mycobacterium bovis subsp bovis AF2122/97
gcaaugcgcgcgauggcg

SEQ ID NO: 1045819 - RNA, 13 nt, Mycobacterium bovis subsp bovis AF2122/97
gcaaugcggcccg

SEQ ID NO: 1045820 - RNA, 21 nt, Mycobacterium bovis subsp bovis AF2122/97
gcaaugcggggcaauccccug

SEQ ID NO: 1045821 - RNA, 22 nt, Mycobacterium bovis subsp bovis AF2122/97
gcaaugcgguaccaaccugcgc

SEQ ID NO: 1045822 - RNA, 16 nt, Mycobacterium bovis subsp bovis AF2122/97
gcaaugcccgcaccgc

SEQ ID NO: 1045823 - RNA, 21 nt, Mycobacterium bovis subsp bovis AF2122/97
gcaauggaccgaacgacucga

SEQ ID NO: 1045824 - RNA, 16 nt, Mycobacterium bovis subsp bovis AF2122/97
gcaaugcuggcggcgc

SEQ ID NO: 1045825 - RNA, 14 nt, Mycobacterium bovis subsp bovis AF2122/97
gcaauggcggccuu

SEQ ID NO: 1045826 - RNA, 17 nt, Mycobacterium bovis subsp bovis AF2122/97
gcacaaacauacgccac

SEQ ID NO: 1045827 - RNA, 15 nt, Mycobacterium bovis subsp bovis AF2122/97
gcaauuuucugcugc

SEQ ID NO: 1045828 - RNA, 15 nt, Mycobacterium bovis subsp bovis AF2122/97
gcacaacaucgccgc

SEQ ID NO: 1045829 - RNA, 17 nt, Mycobacterium bovis subsp bovis AF2122/97
gcaaugucgacaccggc

SEQ ID NO: 1045830 - RNA, 19 nt, Mycobacterium bovis subsp bovis AF2122/97
gcaaugucgacaccggcgc

SEQ ID NO: 1045831 - RNA, 14 nt, Mycobacterium bovis subsp bovis AF2122/97
gccgccuuggucgc

SEQ ID NO: 1045832 - RNA, 17 nt, Mycobacterium bovis subsp bovis AF2122/97
gccgccuuugcccccgg

SEQ ID NO: 1045833 - RNA, 18 nt, Mycobacterium bovis subsp bovis AF2122/97
gccgccuuuuuucgccgc

SEQ ID NO: 1045834 - RNA, 13 nt, Mycobacterium bovis subsp bovis AF2122/97
gccgccuuggccc

SEQ ID NO: 1045835 - RNA, 16 nt, Mycobacterium bovis subsp bovis AF2122/97
gccgccuucucgcgaa

SEQ ID NO: 1045836 - RNA, 17 nt, Mycobacterium bovis subsp bovis AF2122/97
gccgccuucuuggcggc

SEQ ID NO: 1045837 - RNA, 21 nt, Mycobacterium bovis subsp bovis AF2122/97
gccgccuugaggcccugcggc

SEQ ID NO: 1045838 - RNA, 15 nt, Mycobacterium bovis subsp bovis AF2122/97
gccgccuucuccggc

SEQ ID NO: 1045839 - RNA, 16 nt, Mycobacterium bovis subsp bovis AF2122/97
gccgccuucuccggcg

SEQ ID NO: 1045840 - RNA, 13 nt, Mycobacterium bovis subsp bovis AF2122/97
gccgccuucucgc

SEQ ID NO: 1045841 - RNA, 18 nt, Mycobacterium bovis subsp bovis AF2122/97
gccgccuuccuggcgggc

SEQ ID NO: 1045842 - RNA, 19 nt, Mycobacterium bovis subsp bovis AF2122/97
gccgccuuccuggcgggcg

SEQ ID NO: 1045843 - RNA, 15 nt, Mycobacterium bovis subsp bovis AF2122/97
gccgccugugcgcgg

SEQ ID NO: 1045844 - RNA, 16 nt, Mycobacterium bovis subsp bovis AF2122/97
gccgccugugcgcggu

SEQ ID NO: 1045845 - RNA, 19 nt, Mycobacterium bovis subsp bovis AF2122/97
gccgccuggguugaccgcc

SEQ ID NO: 1045846 - RNA, 22 nt, Mycobacterium bovis subsp bovis AF2122/97
gccgccuggguugaccgccacc

SEQ ID NO: 1045847 - RNA, 20 nt, Mycobacterium bovis subsp bovis AF2122/97
gccgccugguaccgcggugu

SEQ ID NO: 1045848 - RNA, 21 nt, Mycobacterium bovis subsp bovis AF2122/97
gccgccugcuccucggccagc

SEQ ID NO: 1045849 - RNA, 19 nt, Mycobacterium bovis subsp bovis AF2122/97
gccgccuggacgccgccgg

SEQ ID NO: 1045850 - RNA, 22 nt, Mycobacterium bovis subsp bovis AF2122/97
gccgccucguacggaccgucgc

SEQ ID NO: 1045851 - RNA, 13 nt, Mycobacterium bovis subsp bovis AF2122/97
gccgccggcgccg

SEQ ID NO: 1045852 - RNA, 17 nt, Mycobacterium bovis subsp bovis AF2122/97
gccgccugcccggcccg

SEQ ID NO: 1045853 - RNA, 17 nt, Mycobacterium bovis subsp bovis AF2122/97
gccgcgaugagcggcgc

SEQ ID NO: 1045854 - RNA, 21 nt, Mycobacterium bovis subsp bovis AF2122/97
gccgcgaugagcggcgcggca

SEQ ID NO: 1045855 - RNA, 17 nt, Mycobacterium bovis subsp bovis AF2122/97
gccgcgcaccgaccgca

SEQ ID NO: 1045856 - RNA, 20 nt, Mycobacterium bovis subsp bovis AF2122/97
gccgcgcaccgaccgcaccg

SEQ ID NO: 1045857 - RNA, 13 nt, Mycobacterium bovis subsp bovis AF2122/97
gccgcgcaccgcg

SEQ ID NO: 1045858 - RNA, 12 nt, Mycobacterium bovis subsp bovis AF2122/97
gccgcgauggcg

SEQ ID NO: 1045859 - RNA, 21 nt, Mycobacterium bovis subsp bovis AF2122/97
gccgcgauggcgguccaccgg

SEQ ID NO: 1045860 - RNA, 15 nt, Mycobacterium bovis subsp bovis AF2122/97
gccgcgauggcguag

SEQ ID NO: 1045861 - RNA, 16 nt, Mycobacterium bovis subsp bovis AF2122/97
gccgcgauggcguagc

SEQ ID NO: 1045862 - RNA, 16 nt, Mycobacterium bovis subsp bovis AF2122/97
gccgcgaccacgcacc

SEQ ID NO: 1045863 - RNA, 17 nt, Mycobacterium bovis subsp bovis AF2122/97
gccgcgaccacgcaccg

SEQ ID NO: 1045864 - RNA, 20 nt, Mycobacterium bovis subsp bovis AF2122/97
gccgcgacccgcgcaaucag

SEQ ID NO: 1045865 - RNA, 12 nt, Mycobacterium bovis subsp bovis AF2122/97
gccgcgaucggg

SEQ ID NO: 1045866 - RNA, 20 nt, Mycobacterium bovis subsp bovis AF2122/97
gccgcgaucuccuuggccgu

SEQ ID NO: 1045867 - RNA, 22 nt, Mycobacterium bovis subsp bovis AF2122/97
gccgcgaugacgaccgaucggc

SEQ ID NO: 1045868 - RNA, 16 nt, Mycobacterium bovis subsp bovis AF2122/97
gccgcgaugacggugc

SEQ ID NO: 1045869 - RNA, 19 nt, Mycobacterium bovis subsp bovis AF2122/97
gccgcgaugacggugccga

SEQ ID NO: 1045870 - RNA, 20 nt, Mycobacterium bovis subsp bovis AF2122/97
gccgcgaugacggugccgac

SEQ ID NO: 1045871 - RNA, 23 nt, Mycobacterium bovis subsp bovis AF2122/97
gccgcgaucuccuuggccguucg

SEQ ID NO: 1045872 - RNA, 22 nt, Mycobacterium bovis subsp bovis AF2122/97
gccgcgaucgaggagaugccga

SEQ ID NO: 1045873 - RNA, 23 nt, Mycobacterium bovis subsp bovis AF2122/97
gccgcgaccgcagcuggggcgga

SEQ ID NO: 1045874 - RNA, 12 nt, Mycobacterium bovis subsp bovis AF2122/97
gccgcgaccgcc

SEQ ID NO: 1045875 - RNA, 20 nt, Mycobacterium bovis subsp bovis AF2122/97
gccgcgaccgccucgccgua

SEQ ID NO: 1045876 - RNA, 14 nt, Mycobacterium bovis subsp bovis AF2122/97
gccgcgaccgcgac

SEQ ID NO: 1045877 - RNA, 14 nt, Mycobacterium bovis subsp bovis AF2122/97
gccgcgaucccggc

SEQ ID NO: 1045878 - RNA, 22 nt, Mycobacterium bovis subsp bovis AF2122/97
gccgcgaucccggccgucgccg

SEQ ID NO: 1045879 - RNA, 22 nt, Mycobacterium bovis subsp bovis AF2122/97
gccgcgaaggggugcccggcgg

SEQ ID NO: 1045880 - RNA, 23 nt, Mycobacterium bovis subsp bovis AF2122/97
gccgcgaaggggugcccggcggc

SEQ ID NO: 1045881 - RNA, 23 nt, Mycobacterium bovis subsp bovis AF2122/97
gccgcgaaugaagcccucgucgg

SEQ ID NO: 1045882 - RNA, 18 nt, Mycobacterium bovis subsp bovis AF2122/97
gccgcgaacuccagcagc

SEQ ID NO: 1045883 - RNA, 22 nt, Mycobacterium bovis subsp bovis AF2122/97
gccgcgaacuccagcagcccgg

SEQ ID NO: 1045884 - RNA, 14 nt, Mycobacterium bovis subsp bovis AF2122/97
gccgcgccggcacg

SEQ ID NO: 1045885 - RNA, 12 nt, Mycobacterium bovis subsp bovis AF2122/97
gccgcgccggcg

SEQ ID NO: 1045886 - RNA, 15 nt, Mycobacterium bovis subsp bovis AF2122/97
gccgcgccggcacgg

SEQ ID NO: 1045887 - RNA, 15 nt, Mycobacterium bovis subsp bovis AF2122/97
gccgcgccggcggcc

SEQ ID NO: 1045888 - RNA, 17 nt, Mycobacterium bovis subsp bovis AF2122/97
gccgcgccggcggccac

SEQ ID NO: 1045889 - RNA, 16 nt, Mycobacterium bovis subsp bovis AF2122/97
gccgcgccggguccgc

SEQ ID NO: 1045890 - RNA, 14 nt, Mycobacterium bovis subsp bovis AF2122/97
gccgcgccggucgu

SEQ ID NO: 1045891 - RNA, 15 nt, Mycobacterium bovis subsp bovis AF2122/97
gccgcgccucggucu

SEQ ID NO: 1045892 - RNA, 15 nt, Mycobacterium bovis subsp bovis AF2122/97
gccgcgcgacaaccc

SEQ ID NO: 1045893 - RNA, 17 nt, Mycobacterium bovis subsp bovis AF2122/97
gccgcgcgacaacccgg

SEQ ID NO: 1045894 - RNA, 23 nt, Mycobacterium bovis subsp bovis AF2122/97
gccgcgcgacaacccggcgucga

SEQ ID NO: 1045895 - RNA, 16 nt, Mycobacterium bovis subsp bovis AF2122/97
gccgcgccgcagagca

SEQ ID NO: 1045896 - RNA, 16 nt, Mycobacterium bovis subsp bovis AF2122/97
gccgcgcccggcgcaa

SEQ ID NO: 1045897 - RNA, 14 nt, Mycobacterium bovis subsp bovis AF2122/97
gccgcgcccggcgc

SEQ ID NO: 1045898 - RNA, 21 nt, Mycobacterium bovis subsp bovis AF2122/97
gccgcgcccuguccuuggcga

SEQ ID NO: 1045899 - RNA, 12 nt, Mycobacterium bovis subsp bovis AF2122/97
gccgcgccgacc

SEQ ID NO: 1045900 - RNA, 20 nt, Mycobacterium bovis subsp bovis AF2122/97
gccgcgccgaaucgcgggcu

SEQ ID NO: 1045901 - RNA, 16 nt, Mycobacterium bovis subsp bovis AF2122/97
gccgcgcccgccucga

SEQ ID NO: 1045902 - RNA, 17 nt, Mycobacterium bovis subsp bovis AF2122/97
gccgcgcagccgcucga

SEQ ID NO: 1045903 - RNA, 13 nt, Mycobacterium bovis subsp bovis AF2122/97
gccgcgcagccgg

SEQ ID NO: 1045904 - RNA, 14 nt, Mycobacterium bovis subsp bovis AF2122/97
gccgcgcagccggc

SEQ ID NO: 1045905 - RNA, 12 nt, Mycobacterium bovis subsp bovis AF2122/97
gccgcgcagcug

SEQ ID NO: 1045906 - RNA, 21 nt, Mycobacterium bovis subsp bovis AF2122/97
gccgcgcagcgcggcggcauc

SEQ ID NO: 1045907 - RNA, 14 nt, Mycobacterium bovis subsp bovis AF2122/97
gccgcgcagcgcgg

SEQ ID NO: 1045908 - RNA, 13 nt, Mycobacterium bovis subsp bovis AF2122/97
gccgcgcagcgug

SEQ ID NO: 1045909 - RNA, 20 nt, Mycobacterium bovis subsp bovis AF2122/97
gccgcgcaggcuuccagcca

SEQ ID NO: 1045910 - RNA, 21 nt, Mycobacterium bovis subsp bovis AF2122/97
gccgcgcaggcuuccagccac

SEQ ID NO: 1045911 - RNA, 17 nt, Mycobacterium bovis subsp bovis AF2122/97
gccgccgacagggaccc

SEQ ID NO: 1045912 - RNA, 16 nt, Mycobacterium bovis subsp bovis AF2122/97
gccgccgacaccaccg

SEQ ID NO: 1045913 - RNA, 20 nt, Mycobacterium bovis subsp bovis AF2122/97
gccgccgacaccaccggcgc

SEQ ID NO: 1045914 - RNA, 20 nt, Mycobacterium bovis subsp bovis AF2122/97
gccgccgacaaucaccaacg

SEQ ID NO: 1045915 - RNA, 13 nt, Mycobacterium bovis subsp bovis AF2122/97
gccgccgacacca

SEQ ID NO: 1045916 - RNA, 17 nt, Mycobacterium bovis subsp bovis AF2122/97
gccgccgacucggcacc

SEQ ID NO: 1045917 - RNA, 21 nt, Mycobacterium bovis subsp bovis AF2122/97
gccgccgacuuccgcgucgcc

SEQ ID NO: 1045918 - RNA, 20 nt, Mycobacterium bovis subsp bovis AF2122/97
gccgccgacuugauuucgau

SEQ ID NO: 1045919 - RNA, 21 nt, Mycobacterium bovis subsp bovis AF2122/97
gccgccgacuugauuucgauc

SEQ ID NO: 1045920 - RNA, 22 nt, Mycobacterium bovis subsp bovis AF2122/97
gccgccgacguuggggaugguc

SEQ ID NO: 1045921 - RNA, 16 nt, Mycobacterium bovis subsp bovis AF2122/97
gccgccgacgccgccg

SEQ ID NO: 1045922 - RNA, 21 nt, Mycobacterium bovis subsp bovis AF2122/97
gccgccgagcucggucaccac

SEQ ID NO: 1045923 - RNA, 13 nt, Mycobacterium bovis subsp bovis AF2122/97
gccgccgagcugg

SEQ ID NO: 1045924 - RNA, 15 nt, Mycobacterium bovis subsp bovis AF2122/97
gccgccgagcuggcg

SEQ ID NO: 1045925 - RNA, 15 nt, Mycobacterium bovis subsp bovis AF2122/97
gccgccgagacgacc

SEQ ID NO: 1045926 - RNA, 18 nt, Mycobacterium bovis subsp bovis AF2122/97
gccgccgagacgaccucc

SEQ ID NO: 1045927 - RNA, 19 nt, Mycobacterium bovis subsp bovis AF2122/97
gccgccgaugaugugcggu

SEQ ID NO: 1045928 - RNA, 15 nt, Mycobacterium bovis subsp bovis AF2122/97
gccgccgaucccguc

SEQ ID NO: 1045929 - RNA, 21 nt, Mycobacterium bovis subsp bovis AF2122/97
gccgccgagcggaccaccgcu

SEQ ID NO: 1045930 - RNA, 14 nt, Mycobacterium bovis subsp bovis AF2122/97
gccgccgauaccgc

SEQ ID NO: 1045931 - RNA, 16 nt, Mycobacterium bovis subsp bovis AF2122/97
gccgccgagggcgccg

SEQ ID NO: 1045932 - RNA, 17 nt, Mycobacterium bovis subsp bovis AF2122/97
gccgccgagggcgccgg

SEQ ID NO: 1045933 - RNA, 16 nt, Mycobacterium bovis subsp bovis AF2122/97
gccgccgagcuggcgc

SEQ ID NO: 1045934 - RNA, 16 nt, Mycobacterium bovis subsp bovis AF2122/97
gccgccgccccggcgc

SEQ ID NO: 1045935 - RNA, 20 nt, Mycobacterium bovis subsp bovis AF2122/97
gccgccgccaucgccgauga

SEQ ID NO: 1045936 - RNA, 17 nt, Mycobacterium bovis subsp bovis AF2122/97
gccgccgaucgacaccc

SEQ ID NO: 1045937 - RNA, 23 nt, Mycobacterium bovis subsp bovis AF2122/97
gccgccgaucgacacccgcucgg

SEQ ID NO: 1045938 - RNA, 15 nt, Mycobacterium bovis subsp bovis AF2122/97
gccgccgaugccacc

SEQ ID NO: 1045939 - RNA, 16 nt, Mycobacterium bovis subsp bovis AF2122/97
gccgccgaugccaccg

SEQ ID NO: 1045940 - RNA, 17 nt, Mycobacterium bovis subsp bovis AF2122/97
gccgccgccaucgccga

SEQ ID NO: 1045941 - RNA, 16 nt, Mycobacterium bovis subsp bovis AF2122/97
gccgccgccgacgccg

SEQ ID NO: 1045942 - RNA, 13 nt, Mycobacterium bovis subsp bovis AF2122/97
gccgccgccgacg

SEQ ID NO: 1045943 - RNA, 13 nt, Mycobacterium bovis subsp bovis AF2122/97
gccgccgcccggg

SEQ ID NO: 1045944 - RNA, 10 nt, Mycobacterium bovis subsp bovis AF2122/97
gccgccgccg

SEQ ID NO: 1045945 - RNA, 15 nt, Mycobacterium bovis subsp bovis AF2122/97
gccgccgccggcgcc

SEQ ID NO: 1045946 - RNA, 17 nt, Mycobacterium bovis subsp bovis AF2122/97
gccgccgccggcgccca

SEQ ID NO: 1045947 - RNA, 12 nt, Mycobacterium bovis subsp bovis AF2122/97
gccgccgccggg

SEQ ID NO: 1045948 - RNA, 14 nt, Mycobacterium bovis subsp bovis AF2122/97
gccgccgccggcgg

SEQ ID NO: 1045949 - RNA, 15 nt, Mycobacterium bovis subsp bovis AF2122/97
gccgccgccgccauc

SEQ ID NO: 1045950 - RNA, 17 nt, Mycobacterium bovis subsp bovis AF2122/97
gccgccgccgucggcga

SEQ ID NO: 1045951 - RNA, 12 nt, Mycobacterium bovis subsp bovis AF2122/97
gccgccgcggcg

SEQ ID NO: 1045952 - RNA, 12 nt, Mycobacterium bovis subsp bovis AF2122/97
gccgccgcggcu

SEQ ID NO: 1045953 - RNA, 13 nt, Mycobacterium bovis subsp bovis AF2122/97
gccgccgcgggac

SEQ ID NO: 1045954 - RNA, 12 nt, Mycobacterium bovis subsp bovis AF2122/97
gccgccgcgguc

SEQ ID NO: 1045955 - RNA, 18 nt, Mycobacterium bovis subsp bovis AF2122/97
gccgccgcggccaccacc

SEQ ID NO: 1045956 - RNA, 21 nt, Mycobacterium bovis subsp bovis AF2122/97
gccgccgcggccaccaccgcc

SEQ ID NO: 1045957 - RNA, 23 nt, Mycobacterium bovis subsp bovis AF2122/97
gccgccgcggccaccaccgccgc

SEQ ID NO: 1045958 - RNA, 15 nt, Mycobacterium bovis subsp bovis AF2122/97
gccgccgcggccacc

SEQ ID NO: 1045959 - RNA, 20 nt, Mycobacterium bovis subsp bovis AF2122/97
gccgccgcguuucggucguu

SEQ ID NO: 1045960 - RNA, 18 nt, Mycobacterium bovis subsp bovis AF2122/97
gccgccgcuacccccgau

SEQ ID NO: 1045961 - RNA, 19 nt, Mycobacterium bovis subsp bovis AF2122/97
gccgccgcuaccgccgggg

SEQ ID NO: 1045962 - RNA, 13 nt, Mycobacterium bovis subsp bovis AF2122/97
gccgccggccagu

SEQ ID NO: 1045963 - RNA, 12 nt, Mycobacterium bovis subsp bovis AF2122/97
gccgccggccau

SEQ ID NO: 1045964 - RNA, 17 nt, Mycobacterium bovis subsp bovis AF2122/97
gccgccggccccgccag

SEQ ID NO: 1045965 - RNA, 17 nt, Mycobacterium bovis subsp bovis AF2122/97
gccgccggccccgccga

SEQ ID NO: 1045966 - RNA, 17 nt, Mycobacterium bovis subsp bovis AF2122/97
gccgccggccccgccgc

SEQ ID NO: 1045967 - RNA, 22 nt, Mycobacterium bovis subsp bovis AF2122/97
gccgccgcggccggcgcucgcg

SEQ ID NO: 1045968 - RNA, 13 nt, Mycobacterium bovis subsp bovis AF2122/97
gccgccgcuggug

SEQ ID NO: 1045969 - RNA, 23 nt, Mycobacterium bovis subsp bovis AF2122/97
gccgccggccccgccguuuccgc

SEQ ID NO: 1045970 - RNA, 14 nt, Mycobacterium bovis subsp bovis AF2122/97
gccgccggccgcgc

SEQ ID NO: 1045971 - RNA, 18 nt, Mycobacterium bovis subsp bovis AF2122/97
gccgccggccgccagcgc

SEQ ID NO: 1045972 - RNA, 19 nt, Mycobacterium bovis subsp bovis AF2122/97
gccgccggccgccagcgca

SEQ ID NO: 1045973 - RNA, 16 nt, Mycobacterium bovis subsp bovis AF2122/97
gccgccggccgcgcag

SEQ ID NO: 1045974 - RNA, 18 nt, Mycobacterium bovis subsp bovis AF2122/97
gccgccggccggcauccg

SEQ ID NO: 1045975 - RNA, 22 nt, Mycobacterium bovis subsp bovis AF2122/97
gccgccggcgaagcgugcgccg

SEQ ID NO: 1045976 - RNA, 12 nt, Mycobacterium bovis subsp bovis AF2122/97
gccgccggcgcc

SEQ ID NO: 1045977 - RNA, 13 nt, Mycobacterium bovis subsp bovis AF2122/97
gccgccggcgcca

SEQ ID NO: 1045978 - RNA, 14 nt, Mycobacterium bovis subsp bovis AF2122/97
gccgccggcgccac

SEQ ID NO: 1045979 - RNA, 15 nt, Mycobacterium bovis subsp bovis AF2122/97
gccgccggcgccacc

SEQ ID NO: 1045980 - RNA, 12 nt, Mycobacterium bovis subsp bovis AF2122/97
gccgccgggcag

SEQ ID NO: 1045981 - RNA, 13 nt, Mycobacterium bovis subsp bovis AF2122/97
gccgccgggcauc

SEQ ID NO: 1045982 - RNA, 16 nt, Mycobacterium bovis subsp bovis AF2122/97
gccgccggcgccaccc

SEQ ID NO: 1045983 - RNA, 18 nt, Mycobacterium bovis subsp bovis AF2122/97
gccgccggcgccaccguu

SEQ ID NO: 1045984 - RNA, 15 nt, Mycobacterium bovis subsp bovis AF2122/97
gccgccggcgcccag

SEQ ID NO: 1045985 - RNA, 15 nt, Mycobacterium bovis subsp bovis AF2122/97
gccgccagccggcgc

SEQ ID NO: 1045986 - RNA, 17 nt, Mycobacterium bovis subsp bovis AF2122/97
gccgccagccggcgcac

SEQ ID NO: 1045987 - RNA, 14 nt, Mycobacterium bovis subsp bovis AF2122/97
gccgcagccugcaa

SEQ ID NO: 1045988 - RNA, 18 nt, Mycobacterium bovis subsp bovis AF2122/97
gccgccagcgccgccggc

SEQ ID NO: 1045989 - RNA, 19 nt, Mycobacterium bovis subsp bovis AF2122/97
gccgccagcgccgccggcg

SEQ ID NO: 1045990 - RNA, 20 nt, Mycobacterium bovis subsp bovis AF2122/97
gccgccagcgccgccggcgc

SEQ ID NO: 1045991 - RNA, 22 nt, Mycobacterium bovis subsp bovis AF2122/97
gccgccagcgccgccggcgccg

SEQ ID NO: 1045992 - RNA, 13 nt, Mycobacterium bovis subsp bovis AF2122/97
gccgccagcgcgg

SEQ ID NO: 1045993 - RNA, 12 nt, Mycobacterium bovis subsp bovis AF2122/97
gccgcagcaggg

SEQ ID NO: 1045994 - RNA, 14 nt, Mycobacterium bovis subsp bovis AF2122/97
gccgcagcaccucg

SEQ ID NO: 1045995 - RNA, 23 nt, Mycobacterium bovis subsp bovis AF2122/97
gccgcagcgaaaacccggucggc

SEQ ID NO: 1045996 - RNA, 19 nt, Mycobacterium bovis subsp bovis AF2122/97
gccgcagcaggggacgacc

SEQ ID NO: 1045997 - RNA, 17 nt, Mycobacterium bovis subsp bovis AF2122/97
gccgccagcugcgcagc

SEQ ID NO: 1045998 - RNA, 14 nt, Mycobacterium bovis subsp bovis AF2122/97
gccgccagcgcggu

SEQ ID NO: 1045999 - RNA, 14 nt, Mycobacterium bovis subsp bovis AF2122/97
gccgccagcggcga

SEQ ID NO: 1046000 - RNA, 20 nt, Mycobacterium bovis subsp bovis AF2122/97
gccgccaucaacaaggggca

SEQ ID NO: 1046001 - RNA, 17 nt, Mycobacterium bovis subsp bovis AF2122/97
gccgccaucaccgccgu

SEQ ID NO: 1046002 - RNA, 14 nt, Mycobacterium bovis subsp bovis AF2122/97
gccgccaucgccgc

SEQ ID NO: 1046003 - RNA, 17 nt, Mycobacterium bovis subsp bovis AF2122/97
gccgccaucgccgccgg

SEQ ID NO: 1046004 - RNA, 13 nt, Mycobacterium bovis subsp bovis AF2122/97
gccgcccgggcga

SEQ ID NO: 1046005 - RNA, 21 nt, Mycobacterium bovis subsp bovis AF2122/97
gccgccgaaacucaccagcac

SEQ ID NO: 1046006 - RNA, 23 nt, Mycobacterium bovis subsp bovis AF2122/97
gccgccgaaacucaccagcaccc

SEQ ID NO: 1046007 - RNA, 21 nt, Mycobacterium bovis subsp bovis AF2122/97
gccgccgaacgccucugcgau

SEQ ID NO: 1046008 - RNA, 19 nt, Mycobacterium bovis subsp bovis AF2122/97
gccgccgaaacucaccagc

SEQ ID NO: 1046009 - RNA, 12 nt, Mycobacterium bovis subsp bovis AF2122/97
gccgccgaaucc

SEQ ID NO: 1046010 - RNA, 20 nt, Mycobacterium bovis subsp bovis AF2122/97
gccgccgaauccgacgucga

SEQ ID NO: 1046011 - RNA, 23 nt, Mycobacterium bovis subsp bovis AF2122/97
gccgccgaauccgacgucgacga

SEQ ID NO: 1046012 - RNA, 14 nt, Mycobacterium bovis subsp bovis AF2122/97
gccgccgaagccgc

SEQ ID NO: 1046013 - RNA, 15 nt, Mycobacterium bovis subsp bovis AF2122/97
gccgccgaagccgac

SEQ ID NO: 1046014 - RNA, 16 nt, Mycobacterium bovis subsp bovis AF2122/97
gccgccgaagccgacg

SEQ ID NO: 1046015 - RNA, 17 nt, Mycobacterium bovis subsp bovis AF2122/97
gccgccgaagccgacga

SEQ ID NO: 1046016 - RNA, 13 nt, Mycobacterium bovis subsp bovis AF2122/97
gccgcccgcugcg

SEQ ID NO: 1046017 - RNA, 20 nt, Mycobacterium bovis subsp bovis AF2122/97
gccgcccgcuccgccgucgc

SEQ ID NO: 1046018 - RNA, 22 nt, Mycobacterium bovis subsp bovis AF2122/97
gccgcccgcuccgccgucgccg

SEQ ID NO: 1046019 - RNA, 18 nt, Mycobacterium bovis subsp bovis AF2122/97
gccgcccgcuccuccggc

SEQ ID NO: 1046020 - RNA, 16 nt, Mycobacterium bovis subsp bovis AF2122/97
gccgcccagcaucucg

SEQ ID NO: 1046021 - RNA, 13 nt, Mycobacterium bovis subsp bovis AF2122/97
gccgcccagcgga

SEQ ID NO: 1046022 - RNA, 14 nt, Mycobacterium bovis subsp bovis AF2122/97
gccgccaucgccga

SEQ ID NO: 1046023 - RNA, 18 nt, Mycobacterium bovis subsp bovis AF2122/97
gccgcccagaccgccgac

SEQ ID NO: 1046024 - RNA, 15 nt, Mycobacterium bovis subsp bovis AF2122/97
gccgcgcgcaccggu

SEQ ID NO: 1046025 - RNA, 13 nt, Mycobacterium bovis subsp bovis AF2122/97
gccgcgcgccauc

SEQ ID NO: 1046026 - RNA, 14 nt, Mycobacterium bovis subsp bovis AF2122/97
gccgcgcgccaucg

SEQ ID NO: 1046027 - RNA, 22 nt, Mycobacterium bovis subsp bovis AF2122/97
gccgcgcgcccgccucaucggc

SEQ ID NO: 1046028 - RNA, 15 nt, Mycobacterium bovis subsp bovis AF2122/97
gccgcgcgccggcca

SEQ ID NO: 1046029 - RNA, 13 nt, Mycobacterium bovis subsp bovis AF2122/97
gccgcgcugagca

SEQ ID NO: 1046030 - RNA, 15 nt, Mycobacterium bovis subsp bovis AF2122/97
gccgcgcuggucaac

SEQ ID NO: 1046031 - RNA, 13 nt, Mycobacterium bovis subsp bovis AF2122/97
gccgcgcuggucg

SEQ ID NO: 1046032 - RNA, 12 nt, Mycobacterium bovis subsp bovis AF2122/97
gccgcgcuggug

SEQ ID NO: 1046033 - RNA, 22 nt, Mycobacterium bovis subsp bovis AF2122/97
gccgcgcuggugauucgcagcc

SEQ ID NO: 1046034 - RNA, 16 nt, Mycobacterium bovis subsp bovis AF2122/97
gccgcgcucgucgaag

SEQ ID NO: 1046035 - RNA, 20 nt, Mycobacterium bovis subsp bovis AF2122/97
gccgcgcuugcgaucgccgc

SEQ ID NO: 1046036 - RNA, 21 nt, Mycobacterium bovis subsp bovis AF2122/97
gccgcgcuugcgaucgccgcu

SEQ ID NO: 1046037 - RNA, 18 nt, Mycobacterium bovis subsp bovis AF2122/97
gccgcgcuugcgaucggc

SEQ ID NO: 1046038 - RNA, 19 nt, Mycobacterium bovis subsp bovis AF2122/97
gccgcgcuugcgaucggca

SEQ ID NO: 1046039 - RNA, 16 nt, Mycobacterium bovis subsp bovis AF2122/97
gccgcggcaacaccac

SEQ ID NO: 1046040 - RNA, 21 nt, Mycobacterium bovis subsp bovis AF2122/97
gccgcggcaacaccaccucga

SEQ ID NO: 1046041 - RNA, 21 nt, Mycobacterium bovis subsp bovis AF2122/97
gccgcgcuugcgaucggcacu

SEQ ID NO: 1046042 - RNA, 12 nt, Mycobacterium bovis subsp bovis AF2122/97
gccgcggcaccg

SEQ ID NO: 1046043 - RNA, 17 nt, Mycobacterium bovis subsp bovis AF2122/97
gccgcggcaccgccccg

SEQ ID NO: 1046044 - RNA, 16 nt, Mycobacterium bovis subsp bovis AF2122/97
gccgcggcaccgccga

SEQ ID NO: 1046045 - RNA, 17 nt, Mycobacterium bovis subsp bovis AF2122/97
gccgcggcaccgccgag

SEQ ID NO: 1046046 - RNA, 20 nt, Mycobacterium bovis subsp bovis AF2122/97
gccgcggcaccgccgagcag

SEQ ID NO: 1046047 - RNA, 23 nt, Mycobacterium bovis subsp bovis AF2122/97
gccgcggcaccgccgagcagacg

SEQ ID NO: 1046048 - RNA, 14 nt, Mycobacterium bovis subsp bovis AF2122/97
gccgcggccaccac

SEQ ID NO: 1046049 - RNA, 16 nt, Mycobacterium bovis subsp bovis AF2122/97
gccgcggccaccaccg

SEQ ID NO: 1046050 - RNA, 20 nt, Mycobacterium bovis subsp bovis AF2122/97
gccgcggcagcauccucgac

SEQ ID NO: 1046051 - RNA, 14 nt, Mycobacterium bovis subsp bovis AF2122/97
gccgcggcagcgga

SEQ ID NO: 1046052 - RNA, 15 nt, Mycobacterium bovis subsp bovis AF2122/97
gccgcggccaccgcc

SEQ ID NO: 1046053 - RNA, 21 nt, Mycobacterium bovis subsp bovis AF2122/97
gccgcggcagggcggugccau

SEQ ID NO: 1046054 - RNA, 14 nt, Mycobacterium bovis subsp bovis AF2122/97
gccgcggccacaac

SEQ ID NO: 1046055 - RNA, 19 nt, Mycobacterium bovis subsp bovis AF2122/97
gccgcggccacaaccucgu

SEQ ID NO: 1046056 - RNA, 23 nt, Mycobacterium bovis subsp bovis AF2122/97
gccgcggccacaucgccagcagc

SEQ ID NO: 1046057 - RNA, 13 nt, Mycobacterium bovis subsp bovis AF2122/97
gccgcggcccgcg

SEQ ID NO: 1046058 - RNA, 19 nt, Mycobacterium bovis subsp bovis AF2122/97
gccgcggccaguacgucga

SEQ ID NO: 1046059 - RNA, 13 nt, Mycobacterium bovis subsp bovis AF2122/97
gccgcggccgccg

SEQ ID NO: 1046060 - RNA, 13 nt, Mycobacterium bovis subsp bovis AF2122/97
gccgcggccggcg

SEQ ID NO: 1046061 - RNA, 14 nt, Mycobacterium bovis subsp bovis AF2122/97
gccgcggccggcgu

SEQ ID NO: 1046062 - RNA, 14 nt, Mycobacterium bovis subsp bovis AF2122/97
gccgcggccggcgc

SEQ ID NO: 1046063 - RNA, 14 nt, Mycobacterium bovis subsp bovis AF2122/97
gccgcggccgccgu

SEQ ID NO: 1046064 - RNA, 15 nt, Mycobacterium bovis subsp bovis AF2122/97
gccgcgggacaccac

SEQ ID NO: 1046065 - RNA, 23 nt, Mycobacterium bovis subsp bovis AF2122/97
gccgcgggacagauggcggccga

SEQ ID NO: 1046066 - RNA, 19 nt, Mycobacterium bovis subsp bovis AF2122/97
gccgcgggcgccgguuacc

SEQ ID NO: 1046067 - RNA, 16 nt, Mycobacterium bovis subsp bovis AF2122/97
gccgcgggucgcgcga

SEQ ID NO: 1046068 - RNA, 13 nt, Mycobacterium bovis subsp bovis AF2122/97
gccgcgggccgcg

SEQ ID NO: 1046069 - RNA, 22 nt, Mycobacterium bovis subsp bovis AF2122/97
gccgcgguggaugcgaugcgcg

SEQ ID NO: 1046070 - RNA, 20 nt, Mycobacterium bovis subsp bovis AF2122/97
gccgcgguguagaagcgggc

SEQ ID NO: 1046071 - RNA, 17 nt, Mycobacterium bovis subsp bovis AF2122/97
gccgcgguguauccgac

SEQ ID NO: 1046072 - RNA, 19 nt, Mycobacterium bovis subsp bovis AF2122/97
gccgcgguuaucgccgaga

SEQ ID NO: 1046073 - RNA, 17 nt, Mycobacterium bovis subsp bovis AF2122/97
gccgcucguuacgccga

SEQ ID NO: 1046074 - RNA, 20 nt, Mycobacterium bovis subsp bovis AF2122/97
gccgcucguuacgccgagca

SEQ ID NO: 1046075 - RNA, 22 nt, Mycobacterium bovis subsp bovis AF2122/97
gccgcucguuacgccgagcaca

SEQ ID NO: 1046076 - RNA, 21 nt, Mycobacterium bovis subsp bovis AF2122/97
gccgcugauguacccggcgac

SEQ ID NO: 1046077 - RNA, 18 nt, Mycobacterium bovis subsp bovis AF2122/97
gccgcugcacguggccac

SEQ ID NO: 1046078 - RNA, 22 nt, Mycobacterium bovis subsp bovis AF2122/97
gccgcugcacguggccacggca

SEQ ID NO: 1046079 - RNA, 23 nt, Mycobacterium bovis subsp bovis AF2122/97
gccgcugcauccgcagcaccaag

SEQ ID NO: 1046080 - RNA, 19 nt, Mycobacterium bovis subsp bovis AF2122/97
gccgcucgguccccgcagc

SEQ ID NO: 1046081 - RNA, 21 nt, Mycobacterium bovis subsp bovis AF2122/97
gccgcugccagggugcgccgg

SEQ ID NO: 1046082 - RNA, 18 nt, Mycobacterium bovis subsp bovis AF2122/97
gccgcugccaugcgggug

SEQ ID NO: 1046083 - RNA, 20 nt, Mycobacterium bovis subsp bovis AF2122/97
gccgcugccgcccuugccgc

SEQ ID NO: 1046084 - RNA, 17 nt, Mycobacterium bovis subsp bovis AF2122/97
gccgcugccgccgagcu

SEQ ID NO: 1046085 - RNA, 12 nt, Mycobacterium bovis subsp bovis AF2122/97
gccgcugccgaa

SEQ ID NO: 1046086 - RNA, 21 nt, Mycobacterium bovis subsp bovis AF2122/97
gccgcugccgaagcggccacc

SEQ ID NO: 1046087 - RNA, 20 nt, Mycobacterium bovis subsp bovis AF2122/97
gccgcugccgaucaguccgg

SEQ ID NO: 1046088 - RNA, 15 nt, Mycobacterium bovis subsp bovis AF2122/97
gccgcugccgguggc

SEQ ID NO: 1046089 - RNA, 16 nt, Mycobacterium bovis subsp bovis AF2122/97
gccgcugccgguggcg

SEQ ID NO: 1046090 - RNA, 16 nt, Mycobacterium bovis subsp bovis AF2122/97
gccgcugccgcgcggc

SEQ ID NO: 1046091 - RNA, 13 nt, Mycobacterium bovis subsp bovis AF2122/97
gccgcucggcaac

SEQ ID NO: 1046092 - RNA, 13 nt, Mycobacterium bovis subsp bovis AF2122/97
gccgcucacccgg

SEQ ID NO: 1046093 - RNA, 18 nt, Mycobacterium bovis subsp bovis AF2122/97
gccgcucgccucgauggc

SEQ ID NO: 1046094 - RNA, 18 nt, Mycobacterium bovis subsp bovis AF2122/97
gccgcguucguggaucuc

SEQ ID NO: 1046095 - RNA, 18 nt, Mycobacterium bovis subsp bovis AF2122/97
gccgcuaggaucggaugg

SEQ ID NO: 1046096 - RNA, 21 nt, Mycobacterium bovis subsp bovis AF2122/97
gccgcuaggaucggauggcgg

SEQ ID NO: 1046097 - RNA, 22 nt, Mycobacterium bovis subsp bovis AF2122/97
gccgcuaggugacgccgccagc

SEQ ID NO: 1046098 - RNA, 11 nt, Mycobacterium bovis subsp bovis AF2122/97
gccgcguucgc

SEQ ID NO: 1046099 - RNA, 22 nt, Mycobacterium bovis subsp bovis AF2122/97
gccgcuaucgaggaggcggucg

SEQ ID NO: 1046100 - RNA, 15 nt, Mycobacterium bovis subsp bovis AF2122/97
gccgcuauggcccgg

SEQ ID NO: 1046101 - RNA, 18 nt, Mycobacterium bovis subsp bovis AF2122/97
gccgcuauggcccgggcc

SEQ ID NO: 1046102 - RNA, 14 nt, Mycobacterium bovis subsp bovis AF2122/97
gccgcgugcugcgg

SEQ ID NO: 1046103 - RNA, 19 nt, Mycobacterium bovis subsp bovis AF2122/97
gccgcguggcuggcggcga

SEQ ID NO: 1046104 - RNA, 15 nt, Mycobacterium bovis subsp bovis AF2122/97
gccgcguucacgcaa

SEQ ID NO: 1046105 - RNA, 23 nt, Mycobacterium bovis subsp bovis AF2122/97
gccgcguucacgcaauuggccgu

SEQ ID NO: 1046106 - RNA, 20 nt, Mycobacterium bovis subsp bovis AF2122/97
gccgcgugguuccggcgugc

SEQ ID NO: 1046107 - RNA, 16 nt, Mycobacterium bovis subsp bovis AF2122/97
gccgcgugcucgccgu

SEQ ID NO: 1046108 - RNA, 15 nt, Mycobacterium bovis subsp bovis AF2122/97
gccgcgugccgcaac

SEQ ID NO: 1046109 - RNA, 17 nt, Mycobacterium bovis subsp bovis AF2122/97
gccgcgugccgcccgcc

SEQ ID NO: 1046110 - RNA, 15 nt, Mycobacterium bovis subsp bovis AF2122/97
gccgcguggcuggcg

SEQ ID NO: 1046111 - RNA, 17 nt, Mycobacterium bovis subsp bovis AF2122/97
gccgcguggcuggcggc

SEQ ID NO: 1046112 - RNA, 14 nt, Mycobacterium bovis subsp bovis AF2122/97
gccgcguacgaccc

SEQ ID NO: 1046113 - RNA, 17 nt, Mycobacterium bovis subsp bovis AF2122/97
gccgcgguuuggcgacg

SEQ ID NO: 1046114 - RNA, 17 nt, Mycobacterium bovis subsp bovis AF2122/97
gccgcgguuuucgccgg

SEQ ID NO: 1046115 - RNA, 17 nt, Mycobacterium bovis subsp bovis AF2122/97
gccgcguaaaccggcug

SEQ ID NO: 1046116 - RNA, 20 nt, Mycobacterium bovis subsp bovis AF2122/97
gccgcguaaaccggcugacc

SEQ ID NO: 1046117 - RNA, 24 nt, Mycobacterium bovis subsp bovis AF2122/97
gccgcguaccaauucccgcgcggc

SEQ ID NO: 1046118 - RNA, 12 nt, Mycobacterium bovis subsp bovis AF2122/97
gccgcgugccgc

SEQ ID NO: 1046119 - RNA, 16 nt, Mycobacterium bovis subsp bovis AF2122/97
gccgcgugcagcccca

SEQ ID NO: 1046120 - RNA, 17 nt, Mycobacterium bovis subsp bovis AF2122/97
gccgcgugcagccccaa

SEQ ID NO: 1046121 - RNA, 21 nt, Mycobacterium bovis subsp bovis AF2122/97
gccgcgucuuggugcgcguca

SEQ ID NO: 1046122 - RNA, 22 nt, Mycobacterium bovis subsp bovis AF2122/97
gccgcgucucggugcagcagcg

SEQ ID NO: 1046123 - RNA, 17 nt, Mycobacterium bovis subsp bovis AF2122/97
gccgcgucucggugcag

SEQ ID NO: 1046124 - RNA, 21 nt, Mycobacterium bovis subsp bovis AF2122/97
gccgcgucucggugcagcagc

SEQ ID NO: 1046125 - RNA, 15 nt, Mycobacterium bovis subsp bovis AF2122/97
gccgcuggaggcggc

SEQ ID NO: 1046126 - RNA, 17 nt, Mycobacterium bovis subsp bovis AF2122/97
gccgcuggaggcggcgc

SEQ ID NO: 1046127 - RNA, 14 nt, Mycobacterium bovis subsp bovis AF2122/97
gccgcugccgccgg

SEQ ID NO: 1046128 - RNA, 23 nt, Mycobacterium bovis subsp bovis AF2122/97
gccgcuggagaucacgccgacga

SEQ ID NO: 1046129 - RNA, 22 nt, Mycobacterium bovis subsp bovis AF2122/97
gccgcugggauucugggcgaaa

SEQ ID NO: 1046130 - RNA, 17 nt, Mycobacterium bovis subsp bovis AF2122/97
gccgcuggggcgcccga

SEQ ID NO: 1046131 - RNA, 21 nt, Mycobacterium bovis subsp bovis AF2122/97
gccgcuggggcgcccgagacc

SEQ ID NO: 1046132 - RNA, 20 nt, Mycobacterium bovis subsp bovis AF2122/97
gccgcugugagcuuggucgc

SEQ ID NO: 1046133 - RNA, 16 nt, Mycobacterium bovis subsp bovis AF2122/97
gccgcugucguaccgc

SEQ ID NO: 1046134 - RNA, 21 nt, Mycobacterium bovis subsp bovis AF2122/97
gccgcugucguaccgcucggc

SEQ ID NO: 1046135 - RNA, 23 nt, Mycobacterium bovis subsp bovis AF2122/97
gccgcugucguaccgcucggcgg

SEQ ID NO: 1046136 - RNA, 16 nt, Mycobacterium bovis subsp bovis AF2122/97
gccgcuuggcccggca

SEQ ID NO: 1046137 - RNA, 22 nt, Mycobacterium bovis subsp bovis AF2122/97
gccgcuugggccugggccgcac

SEQ ID NO: 1046138 - RNA, 23 nt, Mycobacterium bovis subsp bovis AF2122/97
gccgcuugccccgccuuggccac

SEQ ID NO: 1046139 - RNA, 16 nt, Mycobacterium bovis subsp bovis AF2122/97
gccgcuugacgcagcu

SEQ ID NO: 1046140 - RNA, 16 nt, Mycobacterium bovis subsp bovis AF2122/97
gccggacagcucgcgc

SEQ ID NO: 1046141 - RNA, 21 nt, Mycobacterium bovis subsp bovis AF2122/97
gccggacagaucaacgcgaac

SEQ ID NO: 1046142 - RNA, 15 nt, Mycobacterium bovis subsp bovis AF2122/97
gccggacagccacgc

SEQ ID NO: 1046143 - RNA, 13 nt, Mycobacterium bovis subsp bovis AF2122/97
gccggacccgccc

SEQ ID NO: 1046144 - RNA, 19 nt, Mycobacterium bovis subsp bovis AF2122/97
gccggacccauuggaccga

SEQ ID NO: 1046145 - RNA, 17 nt, Mycobacterium bovis subsp bovis AF2122/97
gccggacagccacgcac

SEQ ID NO: 1046146 - RNA, 24 nt, Mycobacterium bovis subsp bovis AF2122/97
gccggaccagcuccugcaugccgg

SEQ ID NO: 1046147 - RNA, 19 nt, Mycobacterium bovis subsp bovis AF2122/97
gccggaccaucagcgucga

SEQ ID NO: 1046148 - RNA, 19 nt, Mycobacterium bovis subsp bovis AF2122/97
gccggaccgguguggcgca

SEQ ID NO: 1046149 - RNA, 19 nt, Mycobacterium bovis subsp bovis AF2122/97
gccggaccguguacuggua

SEQ ID NO: 1046150 - RNA, 13 nt, Mycobacterium bovis subsp bovis AF2122/97
gccggaccgcgac

SEQ ID NO: 1046151 - RNA, 18 nt, Mycobacterium bovis subsp bovis AF2122/97
gccggaccgcgacggcgc

SEQ ID NO: 1046152 - RNA, 22 nt, Mycobacterium bovis subsp bovis AF2122/97
gccggaccgcgacggcgccggc

SEQ ID NO: 1046153 - RNA, 19 nt, Mycobacterium bovis subsp bovis AF2122/97
gccggacgccaugcccgca

SEQ ID NO: 1046154 - RNA, 22 nt, Mycobacterium bovis subsp bovis AF2122/97
gccggacgccaugcccgcacgc

SEQ ID NO: 1046155 - RNA, 18 nt, Mycobacterium bovis subsp bovis AF2122/97
gccggaccuuguuggcca

SEQ ID NO: 1046156 - RNA, 23 nt, Mycobacterium bovis subsp bovis AF2122/97
gccggacgacaacaggccgucga

SEQ ID NO: 1046157 - RNA, 12 nt, Mycobacterium bovis subsp bovis AF2122/97
gccggagucgac

SEQ ID NO: 1046158 - RNA, 23 nt, Mycobacterium bovis subsp bovis AF2122/97
gccggagucgacccugcccagca

SEQ ID NO: 1046159 - RNA, 13 nt, Mycobacterium bovis subsp bovis AF2122/97
gccggagucgauc

SEQ ID NO: 1046160 - RNA, 15 nt, Mycobacterium bovis subsp bovis AF2122/97
gccggagucgaucag

SEQ ID NO: 1046161 - RNA, 23 nt, Mycobacterium bovis subsp bovis AF2122/97
gccggagucgaucagcuugggca

SEQ ID NO: 1046162 - RNA, 13 nt, Mycobacterium bovis subsp bovis AF2122/97
gccggaggcggcg

SEQ ID NO: 1046163 - RNA, 14 nt, Mycobacterium bovis subsp bovis AF2122/97
gccggaggcaagca

SEQ ID NO: 1046164 - RNA, 19 nt, Mycobacterium bovis subsp bovis AF2122/97
gccggaggcaagcaaccgg

SEQ ID NO: 1046165 - RNA, 20 nt, Mycobacterium bovis subsp bovis AF2122/97
gccggaggcaagcaaccggu

SEQ ID NO: 1046166 - RNA, 17 nt, Mycobacterium bovis subsp bovis AF2122/97
gccggagacacccgcca

SEQ ID NO: 1046167 - RNA, 13 nt, Mycobacterium bovis subsp bovis AF2122/97
gccggacuaccgc

SEQ ID NO: 1046168 - RNA, 20 nt, Mycobacterium bovis subsp bovis AF2122/97
gccggacuaccgccggcggc

SEQ ID NO: 1046169 - RNA, 22 nt, Mycobacterium bovis subsp bovis AF2122/97
gccggacuaccgccggcggcgg

SEQ ID NO: 1046170 - RNA, 23 nt, Mycobacterium bovis subsp bovis AF2122/97
gccggacuaccgccggcggcggc

SEQ ID NO: 1046171 - RNA, 17 nt, Mycobacterium bovis subsp bovis AF2122/97
gccggcaucgacguagc

SEQ ID NO: 1046172 - RNA, 13 nt, Mycobacterium bovis subsp bovis AF2122/97
gccggcagcggcg

SEQ ID NO: 1046173 - RNA, 21 nt, Mycobacterium bovis subsp bovis AF2122/97
gccggcaugcuggcgaucgcg

SEQ ID NO: 1046174 - RNA, 16 nt, Mycobacterium bovis subsp bovis AF2122/97
gccggcaucuccaccg

SEQ ID NO: 1046175 - RNA, 16 nt, Mycobacterium bovis subsp bovis AF2122/97
gccggcauggcggcau

SEQ ID NO: 1046176 - RNA, 14 nt, Mycobacterium bovis subsp bovis AF2122/97
gccggcaugccagc

SEQ ID NO: 1046177 - RNA, 15 nt, Mycobacterium bovis subsp bovis AF2122/97
gccggcaugccagcc

SEQ ID NO: 1046178 - RNA, 16 nt, Mycobacterium bovis subsp bovis AF2122/97
gccggcaucgcgcaac

SEQ ID NO: 1046179 - RNA, 16 nt, Mycobacterium bovis subsp bovis AF2122/97
gccggcaucgcgcgcg

SEQ ID NO: 1046180 - RNA, 23 nt, Mycobacterium bovis subsp bovis AF2122/97
gccggcaucgcgcgcggcuccgu

SEQ ID NO: 1046181 - RNA, 15 nt, Mycobacterium bovis subsp bovis AF2122/97
gccggcaucgucgac

SEQ ID NO: 1046182 - RNA, 15 nt, Mycobacterium bovis subsp bovis AF2122/97
gccggcaucgcgcaa

SEQ ID NO: 1046183 - RNA, 20 nt, Mycobacterium bovis subsp bovis AF2122/97
gccggcaucgucgacgcccg

SEQ ID NO: 1046184 - RNA, 18 nt, Mycobacterium bovis subsp bovis AF2122/97
gccggcaucgucggguca

SEQ ID NO: 1046185 - RNA, 18 nt, Mycobacterium bovis subsp bovis AF2122/97
gccggcccaccaggccca

SEQ ID NO: 1046186 - RNA, 20 nt, Mycobacterium bovis subsp bovis AF2122/97
gccggcaagaccgaacagcg

SEQ ID NO: 1046187 - RNA, 18 nt, Mycobacterium bovis subsp bovis AF2122/97
gccggcaacgcggcucgu

SEQ ID NO: 1046188 - RNA, 13 nt, Mycobacterium bovis subsp bovis AF2122/97
gccggcaacggcg

SEQ ID NO: 1046189 - RNA, 16 nt, Mycobacterium bovis subsp bovis AF2122/97
gccggcaacggcgcgc

SEQ ID NO: 1046190 - RNA, 16 nt, Mycobacterium bovis subsp bovis AF2122/97
gccggcaccccacggc

SEQ ID NO: 1046191 - RNA, 17 nt, Mycobacterium bovis subsp bovis AF2122/97
gccggcaccccacggcc

SEQ ID NO: 1046192 - RNA, 18 nt, Mycobacterium bovis subsp bovis AF2122/97
gccggcaccaaccaccga

SEQ ID NO: 1046193 - RNA, 17 nt, Mycobacterium bovis subsp bovis AF2122/97
gccggcaaugccgcggc

SEQ ID NO: 1046194 - RNA, 16 nt, Mycobacterium bovis subsp bovis AF2122/97
gccggcacccgccgug

SEQ ID NO: 1046195 - RNA, 14 nt, Mycobacterium bovis subsp bovis AF2122/97
gccggcaccgccag

SEQ ID NO: 1046196 - RNA, 13 nt, Mycobacterium bovis subsp bovis AF2122/97
gccggcaccgccg

SEQ ID NO: 1046197 - RNA, 16 nt, Mycobacterium bovis subsp bovis AF2122/97
gccggcaccgccgccc

SEQ ID NO: 1046198 - RNA, 14 nt, Mycobacterium bovis subsp bovis AF2122/97
gccggcaccgccgg

SEQ ID NO: 1046199 - RNA, 19 nt, Mycobacterium bovis subsp bovis AF2122/97
gccggcagcaucggcaccc

SEQ ID NO: 1046200 - RNA, 20 nt, Mycobacterium bovis subsp bovis AF2122/97
gccggcagcagcgggcgcgc

SEQ ID NO: 1046201 - RNA, 16 nt, Mycobacterium bovis subsp bovis AF2122/97
gccggcaccgcagcgg

SEQ ID NO: 1046202 - RNA, 20 nt, Mycobacterium bovis subsp bovis AF2122/97
gccggcaccgcagcggaacu

SEQ ID NO: 1046203 - RNA, 12 nt, Mycobacterium bovis subsp bovis AF2122/97
gccggcacgggc

SEQ ID NO: 1046204 - RNA, 23 nt, Mycobacterium bovis subsp bovis AF2122/97
gccggcacgggcgucgucgguaa

SEQ ID NO: 1046205 - RNA, 17 nt, Mycobacterium bovis subsp bovis AF2122/97
gccggaugaugucgguc

SEQ ID NO: 1046206 - RNA, 16 nt, Mycobacterium bovis subsp bovis AF2122/97
gccggcaaccgggagg

SEQ ID NO: 1046207 - RNA, 22 nt, Mycobacterium bovis subsp bovis AF2122/97
gccggcaaccgggaggccaccg

SEQ ID NO: 1046208 - RNA, 16 nt, Mycobacterium bovis subsp bovis AF2122/97
gccggaugacgcccag

SEQ ID NO: 1046209 - RNA, 20 nt, Mycobacterium bovis subsp bovis AF2122/97
gccggaugagcgaacgccag

SEQ ID NO: 1046210 - RNA, 17 nt, Mycobacterium bovis subsp bovis AF2122/97
gccggaugacaccgacc

SEQ ID NO: 1046211 - RNA, 19 nt, Mycobacterium bovis subsp bovis AF2122/97
gccggaugacaccgaccgg

SEQ ID NO: 1046212 - RNA, 20 nt, Mycobacterium bovis subsp bovis AF2122/97
gccggaugacaccgaccggg

SEQ ID NO: 1046213 - RNA, 14 nt, Mycobacterium bovis subsp bovis AF2122/97
gccggaucguucgc

SEQ ID NO: 1046214 - RNA, 15 nt, Mycobacterium bovis subsp bovis AF2122/97
gccggaguugucgac

SEQ ID NO: 1046215 - RNA, 13 nt, Mycobacterium bovis subsp bovis AF2122/97
gccggaguuccgc

SEQ ID NO: 1046216 - RNA, 21 nt, Mycobacterium bovis subsp bovis AF2122/97
gccggaguucuguaccggcug

SEQ ID NO: 1046217 - RNA, 21 nt, Mycobacterium bovis subsp bovis AF2122/97
gccgaaggggaacgcgcccac

SEQ ID NO: 1046218 - RNA, 23 nt, Mycobacterium bovis subsp bovis AF2122/97
gccgaaggccgccacaaacccga

SEQ ID NO: 1046219 - RNA, 18 nt, Mycobacterium bovis subsp bovis AF2122/97
gccgaaguagccgaccgg

SEQ ID NO: 1046220 - RNA, 15 nt, Mycobacterium bovis subsp bovis AF2122/97
gccgaaguggcgccu

SEQ ID NO: 1046221 - RNA, 21 nt, Mycobacterium bovis subsp bovis AF2122/97
gccgaaguuccagccgacggc

SEQ ID NO: 1046222 - RNA, 18 nt, Mycobacterium bovis subsp bovis AF2122/97
gccgacaacccggccggg

SEQ ID NO: 1046223 - RNA, 20 nt, Mycobacterium bovis subsp bovis AF2122/97
gccgacaacccggccgggcc

SEQ ID NO: 1046224 - RNA, 22 nt, Mycobacterium bovis subsp bovis AF2122/97
gccgacaacccggccgggccug

SEQ ID NO: 1046225 - RNA, 15 nt, Mycobacterium bovis subsp bovis AF2122/97
gccgacacgccgaug

SEQ ID NO: 1046226 - RNA, 22 nt, Mycobacterium bovis subsp bovis AF2122/97
gccgacaccgccaccacgccgu

SEQ ID NO: 1046227 - RNA, 14 nt, Mycobacterium bovis subsp bovis AF2122/97
gccgacaccggcug

SEQ ID NO: 1046228 - RNA, 17 nt, Mycobacterium bovis subsp bovis AF2122/97
gccgacaccggcugacc

SEQ ID NO: 1046229 - RNA, 15 nt, Mycobacterium bovis subsp bovis AF2122/97
gccgacaucggcggc

SEQ ID NO: 1046230 - RNA, 13 nt, Mycobacterium bovis subsp bovis AF2122/97
gccgacauggcgg

SEQ ID NO: 1046231 - RNA, 16 nt, Mycobacterium bovis subsp bovis AF2122/97
gccgacauggcggugc

SEQ ID NO: 1046232 - RNA, 17 nt, Mycobacterium bovis subsp bovis AF2122/97
gccgacauggcggugcg

SEQ ID NO: 1046233 - RNA, 21 nt, Mycobacterium bovis subsp bovis AF2122/97
gccgacauggcggugcgcagc

SEQ ID NO: 1046234 - RNA, 17 nt, Mycobacterium bovis subsp bovis AF2122/97
gccgacauugcugcucg

SEQ ID NO: 1046235 - RNA, 18 nt, Mycobacterium bovis subsp bovis AF2122/97
gccgacauugcugcucgu

SEQ ID NO: 1046236 - RNA, 13 nt, Mycobacterium bovis subsp bovis AF2122/97
gccgacaccgcca

SEQ ID NO: 1046237 - RNA, 18 nt, Mycobacterium bovis subsp bovis AF2122/97
gccgacaccgccaccacg

SEQ ID NO: 1046238 - RNA, 16 nt, Mycobacterium bovis subsp bovis AF2122/97
gccgacaccaccggcg

SEQ ID NO: 1046239 - RNA, 18 nt, Mycobacterium bovis subsp bovis AF2122/97
gccgacaccaccggcgcc

SEQ ID NO: 1046240 - RNA, 17 nt, Mycobacterium bovis subsp bovis AF2122/97
gccgacaacgacgucgc

SEQ ID NO: 1046241 - RNA, 17 nt, Mycobacterium bovis subsp bovis AF2122/97
gccgacaaccuuggcga

SEQ ID NO: 1046242 - RNA, 18 nt, Mycobacterium bovis subsp bovis AF2122/97
gccgacaaccuuggcgac

SEQ ID NO: 1046243 - RNA, 21 nt, Mycobacterium bovis subsp bovis AF2122/97
gccgacaacgacgucgccgac

SEQ ID NO: 1046244 - RNA, 22 nt, Mycobacterium bovis subsp bovis AF2122/97
gccgacaacgacgucgccgacc

SEQ ID NO: 1046245 - RNA, 18 nt, Mycobacterium bovis subsp bovis AF2122/97
gccgacaaugucggcgau

SEQ ID NO: 1046246 - RNA, 23 nt, Mycobacterium bovis subsp bovis AF2122/97
gccgaccgacaccaccaggucca

SEQ ID NO: 1046247 - RNA, 16 nt, Mycobacterium bovis subsp bovis AF2122/97
gccgaccggcagcgau

SEQ ID NO: 1046248 - RNA, 17 nt, Mycobacterium bovis subsp bovis AF2122/97
gccgaccggcggcaaac

SEQ ID NO: 1046249 - RNA, 20 nt, Mycobacterium bovis subsp bovis AF2122/97
gccgaccggcccgcauccgc

SEQ ID NO: 1046250 - RNA, 19 nt, Mycobacterium bovis subsp bovis AF2122/97
gccgaccgguggcaccggc

SEQ ID NO: 1046251 - RNA, 21 nt, Mycobacterium bovis subsp bovis AF2122/97
gccgaccgguggcaccggcgg

SEQ ID NO: 1046252 - RNA, 19 nt, Mycobacterium bovis subsp bovis AF2122/97
gccgaccguuucuccgccg

SEQ ID NO: 1046253 - RNA, 16 nt, Mycobacterium bovis subsp bovis AF2122/97
gccgaccuagcucgcg

SEQ ID NO: 1046254 - RNA, 17 nt, Mycobacterium bovis subsp bovis AF2122/97
gccgaccucaucggcac

SEQ ID NO: 1046255 - RNA, 14 nt, Mycobacterium bovis subsp bovis AF2122/97
gccgacgaccagca

SEQ ID NO: 1046256 - RNA, 16 nt, Mycobacterium bovis subsp bovis AF2122/97
gccgacgaccagcaga

SEQ ID NO: 1046257 - RNA, 19 nt, Mycobacterium bovis subsp bovis AF2122/97
gccgacgaaggauugcgga

SEQ ID NO: 1046258 - RNA, 17 nt, Mycobacterium bovis subsp bovis AF2122/97
gccgacgacaacagcca

SEQ ID NO: 1046259 - RNA, 19 nt, Mycobacterium bovis subsp bovis AF2122/97
gccgacgacaacagccagc

SEQ ID NO: 1046260 - RNA, 18 nt, Mycobacterium bovis subsp bovis AF2122/97
gccgacgacauugggcgc

SEQ ID NO: 1046261 - RNA, 16 nt, Mycobacterium bovis subsp bovis AF2122/97
gccgaccucguucguc

SEQ ID NO: 1046262 - RNA, 16 nt, Mycobacterium bovis subsp bovis AF2122/97
gccgaccucggcaacg

SEQ ID NO: 1046263 - RNA, 13 nt, Mycobacterium bovis subsp bovis AF2122/97
gccgaccucgagu

SEQ ID NO: 1046264 - RNA, 14 nt, Mycobacterium bovis subsp bovis AF2122/97
gccgacccgccgcg

SEQ ID NO: 1046265 - RNA, 20 nt, Mycobacterium bovis subsp bovis AF2122/97
gccgacccgccgcgcccggc

SEQ ID NO: 1046266 - RNA, 17 nt, Mycobacterium bovis subsp bovis AF2122/97
gccgacccgccgcggac

SEQ ID NO: 1046267 - RNA, 18 nt, Mycobacterium bovis subsp bovis AF2122/97
gccgacccgccgcggaca

SEQ ID NO: 1046268 - RNA, 15 nt, Mycobacterium bovis subsp bovis AF2122/97
gccgacccgcgcgcc

SEQ ID NO: 1046269 - RNA, 16 nt, Mycobacterium bovis subsp bovis AF2122/97
gccgacccgcgcgccg

SEQ ID NO: 1046270 - RNA, 21 nt, Mycobacterium bovis subsp bovis AF2122/97
gccgacccgcgcgccggcgac

SEQ ID NO: 1046271 - RNA, 21 nt, Mycobacterium bovis subsp bovis AF2122/97
gccgacccuagauaugcaccc

SEQ ID NO: 1046272 - RNA, 15 nt, Mycobacterium bovis subsp bovis AF2122/97
gccgaccgaaucagc

SEQ ID NO: 1046273 - RNA, 17 nt, Mycobacterium bovis subsp bovis AF2122/97
gccgaccggcacccgcg

SEQ ID NO: 1046274 - RNA, 22 nt, Mycobacterium bovis subsp bovis AF2122/97
gccgaccggcacccgcggcgaa

SEQ ID NO: 1046275 - RNA, 14 nt, Mycobacterium bovis subsp bovis AF2122/97
gccgaccgacacca

SEQ ID NO: 1046276 - RNA, 16 nt, Mycobacterium bovis subsp bovis AF2122/97
gccgaccgacaccacc

SEQ ID NO: 1046277 - RNA, 18 nt, Mycobacterium bovis subsp bovis AF2122/97
gccgaccgacaccaccag

SEQ ID NO: 1046278 - RNA, 20 nt, Mycobacterium bovis subsp bovis AF2122/97
gccgacauugcugcucguga

SEQ ID NO: 1046279 - RNA, 17 nt, Mycobacterium bovis subsp bovis AF2122/97
gccgacccaacccgauc

SEQ ID NO: 1046280 - RNA, 20 nt, Mycobacterium bovis subsp bovis AF2122/97
gccgacccgccacaucgugg

SEQ ID NO: 1046281 - RNA, 23 nt, Mycobacterium bovis subsp bovis AF2122/97
gccgacccgacgcuggucggcgg

SEQ ID NO: 1046282 - RNA, 24 nt, Mycobacterium bovis subsp bovis AF2122/97
gccgacccgccacaucguggcguc

SEQ ID NO: 1046283 - RNA, 16 nt, Mycobacterium bovis subsp bovis AF2122/97
gccgaccaccgccggg

SEQ ID NO: 1046284 - RNA, 16 nt, Mycobacterium bovis subsp bovis AF2122/97
gccgaccaccgcugcg

SEQ ID NO: 1046285 - RNA, 20 nt, Mycobacterium bovis subsp bovis AF2122/97
gccgaccagagcuucgccgc

SEQ ID NO: 1046286 - RNA, 22 nt, Mycobacterium bovis subsp bovis AF2122/97
gccgaccagagcuucgccgcgc

SEQ ID NO: 1046287 - RNA, 19 nt, Mycobacterium bovis subsp bovis AF2122/97
gccgagcaacaccgucggc

SEQ ID NO: 1046288 - RNA, 21 nt, Mycobacterium bovis subsp bovis AF2122/97
gccgagccgauauaccagggc

SEQ ID NO: 1046289 - RNA, 15 nt, Mycobacterium bovis subsp bovis AF2122/97
gccgagccgcgguca

SEQ ID NO: 1046290 - RNA, 17 nt, Mycobacterium bovis subsp bovis AF2122/97
gccgagccgcggucacc

SEQ ID NO: 1046291 - RNA, 18 nt, Mycobacterium bovis subsp bovis AF2122/97
gccgagccgcccgcccgg

SEQ ID NO: 1046292 - RNA, 22 nt, Mycobacterium bovis subsp bovis AF2122/97
gccgagccucgcucuccauggc

SEQ ID NO: 1046293 - RNA, 18 nt, Mycobacterium bovis subsp bovis AF2122/97
gccgagcgugaaccuggc

SEQ ID NO: 1046294 - RNA, 17 nt, Mycobacterium bovis subsp bovis AF2122/97
gccgagcggugccggcg

SEQ ID NO: 1046295 - RNA, 14 nt, Mycobacterium bovis subsp bovis AF2122/97
gccgagcgguugcc

SEQ ID NO: 1046296 - RNA, 21 nt, Mycobacterium bovis subsp bovis AF2122/97
gccgagcgugaaccuggcgac

SEQ ID NO: 1046297 - RNA, 15 nt, Mycobacterium bovis subsp bovis AF2122/97
gccgagcggucaacg

SEQ ID NO: 1046298 - RNA, 18 nt, Mycobacterium bovis subsp bovis AF2122/97
gccgagcgagaaucacgg

SEQ ID NO: 1046299 - RNA, 23 nt, Mycobacterium bovis subsp bovis AF2122/97
gccgagcgagaaucacggucauc

SEQ ID NO: 1046300 - RNA, 22 nt, Mycobacterium bovis subsp bovis AF2122/97
gccgagcgcaacucccagcacg

SEQ ID NO: 1046301 - RNA, 13 nt, Mycobacterium bovis subsp bovis AF2122/97
gccgacucagguc

SEQ ID NO: 1046302 - RNA, 18 nt, Mycobacterium bovis subsp bovis AF2122/97
gccgacucaucggccgcg

SEQ ID NO: 1046303 - RNA, 21 nt, Mycobacterium bovis subsp bovis AF2122/97
gccgacucaucggccgcgguc

SEQ ID NO: 1046304 - RNA, 23 nt, Mycobacterium bovis subsp bovis AF2122/97
gccgacucaucggccgcggucgg

SEQ ID NO: 1046305 - RNA, 14 nt, Mycobacterium bovis subsp bovis AF2122/97
gccgagauccacgc

SEQ ID NO: 1046306 - RNA, 19 nt, Mycobacterium bovis subsp bovis AF2122/97
gccgacuuccgcgucgccg

SEQ ID NO: 1046307 - RNA, 21 nt, Mycobacterium bovis subsp bovis AF2122/97
gccgacuuccgcgucgccggc

SEQ ID NO: 1046308 - RNA, 23 nt, Mycobacterium bovis subsp bovis AF2122/97
gccgacuuccgcgucgccggccu

SEQ ID NO: 1046309 - RNA, 19 nt, Mycobacterium bovis subsp bovis AF2122/97
gccgagaugcugcacccgg

SEQ ID NO: 1046310 - RNA, 19 nt, Mycobacterium bovis subsp bovis AF2122/97
gccgagauccacgccagag

SEQ ID NO: 1046311 - RNA, 20 nt, Mycobacterium bovis subsp bovis AF2122/97
gccgagaucccagcgggaca

SEQ ID NO: 1046312 - RNA, 21 nt, Mycobacterium bovis subsp bovis AF2122/97
gccgagaucccagcgggacaa

SEQ ID NO: 1046313 - RNA, 17 nt, Mycobacterium bovis subsp bovis AF2122/97
gccgagauccgcgcuug

SEQ ID NO: 1046314 - RNA, 21 nt, Mycobacterium bovis subsp bovis AF2122/97
gccgagaugcuggucggcgau

SEQ ID NO: 1046315 - RNA, 15 nt, Mycobacterium bovis subsp bovis AF2122/97
gccgacgacuccggc

SEQ ID NO: 1046316 - RNA, 24 nt, Mycobacterium bovis subsp bovis AF2122/97
gccgacgacuccggcaagcacacc

SEQ ID NO: 1046317 - RNA, 15 nt, Mycobacterium bovis subsp bovis AF2122/97
gccgacgaucgacgc

SEQ ID NO: 1046318 - RNA, 20 nt, Mycobacterium bovis subsp bovis AF2122/97
gccgacgaucauauggccgc

SEQ ID NO: 1046319 - RNA, 21 nt, Mycobacterium bovis subsp bovis AF2122/97
gccgacgaucauauggccgcc

SEQ ID NO: 1046320 - RNA, 19 nt, Mycobacterium bovis subsp bovis AF2122/97
gccgaccgggcucuggcca

SEQ ID NO: 1046321 - RNA, 22 nt, Mycobacterium bovis subsp bovis AF2122/97
gccgacgaucgacgccgccacc

SEQ ID NO: 1046322 - RNA, 13 nt, Mycobacterium bovis subsp bovis AF2122/97
gccgacgccccga

SEQ ID NO: 1046323 - RNA, 21 nt, Mycobacterium bovis subsp bovis AF2122/97
gccgacgccccgaucggccac

SEQ ID NO: 1046324 - RNA, 17 nt, Mycobacterium bovis subsp bovis AF2122/97
gccgacgauuaccagcg

SEQ ID NO: 1046325 - RNA, 19 nt, Mycobacterium bovis subsp bovis AF2122/97
gccgacgauuaccagcggc

SEQ ID NO: 1046326 - RNA, 21 nt, Mycobacterium bovis subsp bovis AF2122/97
gccgacgauuaccagcggcac

SEQ ID NO: 1046327 - RNA, 23 nt, Mycobacterium bovis subsp bovis AF2122/97
gccgacgauuaccagcggcaccg

SEQ ID NO: 1046328 - RNA, 16 nt, Mycobacterium bovis subsp bovis AF2122/97
gccgacgaugacgcgc

SEQ ID NO: 1046329 - RNA, 15 nt, Mycobacterium bovis subsp bovis AF2122/97
gccgacggugggcga

SEQ ID NO: 1046330 - RNA, 13 nt, Mycobacterium bovis subsp bovis AF2122/97
gccgacgggacaa

SEQ ID NO: 1046331 - RNA, 18 nt, Mycobacterium bovis subsp bovis AF2122/97
gccgacuagcugggguca

SEQ ID NO: 1046332 - RNA, 14 nt, Mycobacterium bovis subsp bovis AF2122/97
gccgacgggcgcaa

SEQ ID NO: 1046333 - RNA, 15 nt, Mycobacterium bovis subsp bovis AF2122/97
gccgacgggcgcaac

SEQ ID NO: 1046334 - RNA, 15 nt, Mycobacterium bovis subsp bovis AF2122/97
gccgacuaucggccg

SEQ ID NO: 1046335 - RNA, 16 nt, Mycobacterium bovis subsp bovis AF2122/97
gccgacuaucggccgc

SEQ ID NO: 1046336 - RNA, 21 nt, Mycobacterium bovis subsp bovis AF2122/97
gccgacuaucggccgccggau

SEQ ID NO: 1046337 - RNA, 12 nt, Mycobacterium bovis subsp bovis AF2122/97
gccgacgggaac

SEQ ID NO: 1046338 - RNA, 14 nt, Mycobacterium bovis subsp bovis AF2122/97
gccgacggcgcccc

SEQ ID NO: 1046339 - RNA, 16 nt, Mycobacterium bovis subsp bovis AF2122/97
gccgacggccagcagg

SEQ ID NO: 1046340 - RNA, 15 nt, Mycobacterium bovis subsp bovis AF2122/97
gccgacggccagcag

SEQ ID NO: 1046341 - RNA, 17 nt, Mycobacterium bovis subsp bovis AF2122/97
gccgacgccgccggccc

SEQ ID NO: 1046342 - RNA, 16 nt, Mycobacterium bovis subsp bovis AF2122/97
gccgacgccgccggcg

SEQ ID NO: 1046343 - RNA, 12 nt, Mycobacterium bovis subsp bovis AF2122/97
gccgacggcgac

SEQ ID NO: 1046344 - RNA, 17 nt, Mycobacterium bovis subsp bovis AF2122/97
gccgacggcgaccaccg

SEQ ID NO: 1046345 - RNA, 12 nt, Mycobacterium bovis subsp bovis AF2122/97
gccgacgcccag

SEQ ID NO: 1046346 - RNA, 13 nt, Mycobacterium bovis subsp bovis AF2122/97
gccgacgcccgac

SEQ ID NO: 1046347 - RNA, 16 nt, Mycobacterium bovis subsp bovis AF2122/97
gccgacgccgccggca

SEQ ID NO: 1046348 - RNA, 23 nt, Mycobacterium bovis subsp bovis AF2122/97
gccgacgccgccggcaccguaga

SEQ ID NO: 1046349 - RNA, 17 nt, Mycobacterium bovis subsp bovis AF2122/97
gccgagcuucagcgcgc

SEQ ID NO: 1046350 - RNA, 22 nt, Mycobacterium bovis subsp bovis AF2122/97
gccgaggccuaccaggcgcggc

SEQ ID NO: 1046351 - RNA, 17 nt, Mycobacterium bovis subsp bovis AF2122/97
gccgaggcuagcagaga

SEQ ID NO: 1046352 - RNA, 22 nt, Mycobacterium bovis subsp bovis AF2122/97
gccgaggcggucuuguccagga

SEQ ID NO: 1046353 - RNA, 14 nt, Mycobacterium bovis subsp bovis AF2122/97
gccgaggucgguuc

SEQ ID NO: 1046354 - RNA, 17 nt, Mycobacterium bovis subsp bovis AF2122/97
gccgaggucgguucggc

SEQ ID NO: 1046355 - RNA, 20 nt, Mycobacterium bovis subsp bovis AF2122/97
gccgaggucgguucggccgg

SEQ ID NO: 1046356 - RNA, 22 nt, Mycobacterium bovis subsp bovis AF2122/97
gccgaggucuccggugcgcagc

SEQ ID NO: 1046357 - RNA, 14 nt, Mycobacterium bovis subsp bovis AF2122/97
gccgagguugcgga

SEQ ID NO: 1046358 - RNA, 20 nt, Mycobacterium bovis subsp bovis AF2122/97
gccgagucgauugccaccga

SEQ ID NO: 1046359 - RNA, 15 nt, Mycobacterium bovis subsp bovis AF2122/97
gccgaguaccggcca

SEQ ID NO: 1046360 - RNA, 22 nt, Mycobacterium bovis subsp bovis AF2122/97
gccgaguaccggccagccgcgg

SEQ ID NO: 1046361 - RNA, 23 nt, Mycobacterium bovis subsp bovis AF2122/97
gccgaguaccggccagccgcggc

SEQ ID NO: 1046362 - RNA, 21 nt, Mycobacterium bovis subsp bovis AF2122/97
gccgaguaccagcccaccggc

SEQ ID NO: 1046363 - RNA, 16 nt, Mycobacterium bovis subsp bovis AF2122/97
gccgaggccucggcca

SEQ ID NO: 1046364 - RNA, 18 nt, Mycobacterium bovis subsp bovis AF2122/97
gccgaggccucggccagc

SEQ ID NO: 1046365 - RNA, 20 nt, Mycobacterium bovis subsp bovis AF2122/97
gccgaggccuaccaggcgcg

SEQ ID NO: 1046366 - RNA, 16 nt, Mycobacterium bovis subsp bovis AF2122/97
gccgaggccgccguug

SEQ ID NO: 1046367 - RNA, 12 nt, Mycobacterium bovis subsp bovis AF2122/97
gccgagcugguu

SEQ ID NO: 1046368 - RNA, 18 nt, Mycobacterium bovis subsp bovis AF2122/97
gccgagcugugcgcagac

SEQ ID NO: 1046369 - RNA, 19 nt, Mycobacterium bovis subsp bovis AF2122/97
gccgaggcagcgucgucga

SEQ ID NO: 1046370 - RNA, 20 nt, Mycobacterium bovis subsp bovis AF2122/97
gccgaggcagcgucgucgac

SEQ ID NO: 1046371 - RNA, 16 nt, Mycobacterium bovis subsp bovis AF2122/97
gccgagcucguugacc

SEQ ID NO: 1046372 - RNA, 23 nt, Mycobacterium bovis subsp bovis AF2122/97
gccgagcucguugaccaggaaug

SEQ ID NO: 1046373 - RNA, 21 nt, Mycobacterium bovis subsp bovis AF2122/97
gccgagcucguugcuggcggc

SEQ ID NO: 1046374 - RNA, 21 nt, Mycobacterium bovis subsp bovis AF2122/97
gccgagcuggcgcgcggggug

SEQ ID NO: 1046375 - RNA, 13 nt, Mycobacterium bovis subsp bovis AF2122/97
gccgagcguggcg

SEQ ID NO: 1046376 - RNA, 13 nt, Mycobacterium bovis subsp bovis AF2122/97
gccgagcuagauc

SEQ ID NO: 1046377 - RNA, 23 nt, Mycobacterium bovis subsp bovis AF2122/97
gccgagcgcaacucccagcacgg

SEQ ID NO: 1046378 - RNA, 23 nt, Mycobacterium bovis subsp bovis AF2122/97
gccgagcgugaagucacggcggc

SEQ ID NO: 1046379 - RNA, 17 nt, Mycobacterium bovis subsp bovis AF2122/97
gccgaucaucaccggca

SEQ ID NO: 1046380 - RNA, 15 nt, Mycobacterium bovis subsp bovis AF2122/97
gccgaucccaccggc

SEQ ID NO: 1046381 - RNA, 14 nt, Mycobacterium bovis subsp bovis AF2122/97
gccgaucccggcga

SEQ ID NO: 1046382 - RNA, 16 nt, Mycobacterium bovis subsp bovis AF2122/97
gccgaucccggcgagc

SEQ ID NO: 1046383 - RNA, 17 nt, Mycobacterium bovis subsp bovis AF2122/97
gccgaucccggcgagca

SEQ ID NO: 1046384 - RNA, 22 nt, Mycobacterium bovis subsp bovis AF2122/97
gccgaucccggcgagcacccgc

SEQ ID NO: 1046385 - RNA, 14 nt, Mycobacterium bovis subsp bovis AF2122/97
gccgaucccggcgg

SEQ ID NO: 1046386 - RNA, 14 nt, Mycobacterium bovis subsp bovis AF2122/97
gccgaucgacaccc

SEQ ID NO: 1046387 - RNA, 21 nt, Mycobacterium bovis subsp bovis AF2122/97
gccgaucgacacccgcucggc

SEQ ID NO: 1046388 - RNA, 23 nt, Mycobacterium bovis subsp bovis AF2122/97
gccgaucagcugcgcaucgccac

SEQ ID NO: 1046389 - RNA, 23 nt, Mycobacterium bovis subsp bovis AF2122/97
gccgaucaacagcaccguacggc

SEQ ID NO: 1046390 - RNA, 22 nt, Mycobacterium bovis subsp bovis AF2122/97
gccgauaugcgugagcugcucg

SEQ ID NO: 1046391 - RNA, 20 nt, Mycobacterium bovis subsp bovis AF2122/97
gccgauacuaaacaggccgc

SEQ ID NO: 1046392 - RNA, 13 nt, Mycobacterium bovis subsp bovis AF2122/97
gccgauagcgcgg

SEQ ID NO: 1046393 - RNA, 23 nt, Mycobacterium bovis subsp bovis AF2122/97
gccgaucaacaugccggucaucc

SEQ ID NO: 1046394 - RNA, 22 nt, Mycobacterium bovis subsp bovis AF2122/97
gccgauagcgcggcaccagcac

SEQ ID NO: 1046395 - RNA, 17 nt, Mycobacterium bovis subsp bovis AF2122/97
gccgauagggauggcga

SEQ ID NO: 1046396 - RNA, 16 nt, Mycobacterium bovis subsp bovis AF2122/97
gccgauauaccagggc

SEQ ID NO: 1046397 - RNA, 15 nt, Mycobacterium bovis subsp bovis AF2122/97
gccgauauaccaggg

SEQ ID NO: 1046398 - RNA, 15 nt, Mycobacterium bovis subsp bovis AF2122/97
gccgaugcgacgcag

SEQ ID NO: 1046399 - RNA, 14 nt, Mycobacterium bovis subsp bovis AF2122/97
gccgaugcggugcg

SEQ ID NO: 1046400 - RNA, 18 nt, Mycobacterium bovis subsp bovis AF2122/97
gccgaugcugccgccgcc

SEQ ID NO: 1046401 - RNA, 19 nt, Mycobacterium bovis subsp bovis AF2122/97
gccgaugcugccgccgccg

SEQ ID NO: 1046402 - RNA, 23 nt, Mycobacterium bovis subsp bovis AF2122/97
gccgaugcugccgccgccgccgg

SEQ ID NO: 1046403 - RNA, 14 nt, Mycobacterium bovis subsp bovis AF2122/97
gccgaugcugcggg

SEQ ID NO: 1046404 - RNA, 16 nt, Mycobacterium bovis subsp bovis AF2122/97
gccgaugcugcgggcg

SEQ ID NO: 1046405 - RNA, 17 nt, Mycobacterium bovis subsp bovis AF2122/97
gccgaugggaaccgaau

SEQ ID NO: 1046406 - RNA, 15 nt, Mycobacterium bovis subsp bovis AF2122/97
gccgaucgcggcggc

SEQ ID NO: 1046407 - RNA, 17 nt, Mycobacterium bovis subsp bovis AF2122/97
gccgaucgcggcggccu

SEQ ID NO: 1046408 - RNA, 17 nt, Mycobacterium bovis subsp bovis AF2122/97
gccgaugacgaugcccu

SEQ ID NO: 1046409 - RNA, 23 nt, Mycobacterium bovis subsp bovis AF2122/97
gccgaugacgaugccgccgaaga

SEQ ID NO: 1046410 - RNA, 20 nt, Mycobacterium bovis subsp bovis AF2122/97
gccgaugacgauggccgccg

SEQ ID NO: 1046411 - RNA, 15 nt, Mycobacterium bovis subsp bovis AF2122/97
gccgaugaccgaaga

SEQ ID NO: 1046412 - RNA, 19 nt, Mycobacterium bovis subsp bovis AF2122/97
gccgaucuucgcgcgcuca

SEQ ID NO: 1046413 - RNA, 22 nt, Mycobacterium bovis subsp bovis AF2122/97
gccgaugaccgccugcuggccg

SEQ ID NO: 1046414 - RNA, 14 nt, Mycobacterium bovis subsp bovis AF2122/97
gccgaugagcccag

SEQ ID NO: 1046415 - RNA, 18 nt, Mycobacterium bovis subsp bovis AF2122/97
gccgaugagcccagccgc

SEQ ID NO: 1046416 - RNA, 20 nt, Mycobacterium bovis subsp bovis AF2122/97
gccgaugagcccagccgcgg

SEQ ID NO: 1046417 - RNA, 16 nt, Mycobacterium bovis subsp bovis AF2122/97
gccgaugucgggcacg

SEQ ID NO: 1046418 - RNA, 12 nt, Mycobacterium bovis subsp bovis AF2122/97
gccgaugucgau

SEQ ID NO: 1046419 - RNA, 16 nt, Mycobacterium bovis subsp bovis AF2122/97
gccgcaaggcguguag

SEQ ID NO: 1046420 - RNA, 14 nt, Mycobacterium bovis subsp bovis AF2122/97
gccgcaauacccga

SEQ ID NO: 1046421 - RNA, 21 nt, Mycobacterium bovis subsp bovis AF2122/97
gccgcaagugucuccggcaac

SEQ ID NO: 1046422 - RNA, 15 nt, Mycobacterium bovis subsp bovis AF2122/97
gccgcaaugacgucg

SEQ ID NO: 1046423 - RNA, 18 nt, Mycobacterium bovis subsp bovis AF2122/97
gccgcaaugacgucgucg

SEQ ID NO: 1046424 - RNA, 22 nt, Mycobacterium bovis subsp bovis AF2122/97
gccgcacaaacgggcgugggcc

SEQ ID NO: 1046425 - RNA, 21 nt, Mycobacterium bovis subsp bovis AF2122/97
gccgcaaucagacggcgagua

SEQ ID NO: 1046426 - RNA, 15 nt, Mycobacterium bovis subsp bovis AF2122/97
gccgcaagccgcgag

SEQ ID NO: 1046427 - RNA, 19 nt, Mycobacterium bovis subsp bovis AF2122/97
gccgcaauggaccgaacga

SEQ ID NO: 1046428 - RNA, 17 nt, Mycobacterium bovis subsp bovis AF2122/97
gccgcacgggcccagga

SEQ ID NO: 1046429 - RNA, 16 nt, Mycobacterium bovis subsp bovis AF2122/97
gccgcacgccggccag

SEQ ID NO: 1046430 - RNA, 12 nt, Mycobacterium bovis subsp bovis AF2122/97
gccgcacgccga

SEQ ID NO: 1046431 - RNA, 22 nt, Mycobacterium bovis subsp bovis AF2122/97
gccgcacgccgaccggcccgca

SEQ ID NO: 1046432 - RNA, 20 nt, Mycobacterium bovis subsp bovis AF2122/97
gccgcacgauggccgucgau

SEQ ID NO: 1046433 - RNA, 13 nt, Mycobacterium bovis subsp bovis AF2122/97
gccgcacgccggc

SEQ ID NO: 1046434 - RNA, 17 nt, Mycobacterium bovis subsp bovis AF2122/97
gccgcacgccggcaugc

SEQ ID NO: 1046435 - RNA, 14 nt, Mycobacterium bovis subsp bovis AF2122/97
gccgcacgauggcc

SEQ ID NO: 1046436 - RNA, 16 nt, Mycobacterium bovis subsp bovis AF2122/97
gccgcacgauggccgu

SEQ ID NO: 1046437 - RNA, 18 nt, Mycobacterium bovis subsp bovis AF2122/97
gccgcacgauggccgucg

SEQ ID NO: 1046438 - RNA, 19 nt, Mycobacterium bovis subsp bovis AF2122/97
gccgcacgauggccgucga

SEQ ID NO: 1046439 - RNA, 13 nt, Mycobacterium bovis subsp bovis AF2122/97
gccgcaccggguc

SEQ ID NO: 1046440 - RNA, 23 nt, Mycobacterium bovis subsp bovis AF2122/97
gccgcacacgucaggcaacgaag

SEQ ID NO: 1046441 - RNA, 24 nt, Mycobacterium bovis subsp bovis AF2122/97
gccgcacacucucggugaacgccg

SEQ ID NO: 1046442 - RNA, 18 nt, Mycobacterium bovis subsp bovis AF2122/97
gccgcacaaguggucgau

SEQ ID NO: 1046443 - RNA, 16 nt, Mycobacterium bovis subsp bovis AF2122/97
gcccggucgcugaucc

SEQ ID NO: 1046444 - RNA, 21 nt, Mycobacterium bovis subsp bovis AF2122/97
gcccggucgcugauccgggcg

SEQ ID NO: 1046445 - RNA, 23 nt, Mycobacterium bovis subsp bovis AF2122/97
gcccgguccgccauuggcgccgu

SEQ ID NO: 1046446 - RNA, 15 nt, Mycobacterium bovis subsp bovis AF2122/97
gcccgccugaccgcc

SEQ ID NO: 1046447 - RNA, 15 nt, Mycobacterium bovis subsp bovis AF2122/97
gcccgccucggcggc

SEQ ID NO: 1046448 - RNA, 13 nt, Mycobacterium bovis subsp bovis AF2122/97
gcccgccucaucg

SEQ ID NO: 1046449 - RNA, 16 nt, Mycobacterium bovis subsp bovis AF2122/97
gcccgccucaucggca

SEQ ID NO: 1046450 - RNA, 16 nt, Mycobacterium bovis subsp bovis AF2122/97
gcccgccucgaccgcc

SEQ ID NO: 1046451 - RNA, 15 nt, Mycobacterium bovis subsp bovis AF2122/97
gcccgccucgcagcg

SEQ ID NO: 1046452 - RNA, 18 nt, Mycobacterium bovis subsp bovis AF2122/97
gcccgccugaccgccacc

SEQ ID NO: 1046453 - RNA, 18 nt, Mycobacterium bovis subsp bovis AF2122/97
gcccggucuacgccaccg

SEQ ID NO: 1046454 - RNA, 19 nt, Mycobacterium bovis subsp bovis AF2122/97
gcccggugauccacgcucg

SEQ ID NO: 1046455 - RNA, 19 nt, Mycobacterium bovis subsp bovis AF2122/97
gcccggucuuacggucggc

SEQ ID NO: 1046456 - RNA, 21 nt, Mycobacterium bovis subsp bovis AF2122/97
gcccggucuugggcgcgggug

SEQ ID NO: 1046457 - RNA, 20 nt, Mycobacterium bovis subsp bovis AF2122/97
gcccgguggcggcucacgac

SEQ ID NO: 1046458 - RNA, 15 nt, Mycobacterium bovis subsp bovis AF2122/97
gcccgguggucgucc

SEQ ID NO: 1046459 - RNA, 16 nt, Mycobacterium bovis subsp bovis AF2122/97
gcccgguggugcuguc

SEQ ID NO: 1046460 - RNA, 17 nt, Mycobacterium bovis subsp bovis AF2122/97
gcccgguggugcugucg

SEQ ID NO: 1046461 - RNA, 22 nt, Mycobacterium bovis subsp bovis AF2122/97
gcccggugcuaaccgacgcuga

SEQ ID NO: 1046462 - RNA, 16 nt, Mycobacterium bovis subsp bovis AF2122/97
gcccgucgugaccgac

SEQ ID NO: 1046463 - RNA, 16 nt, Mycobacterium bovis subsp bovis AF2122/97
gcccgucaccgcgggc

SEQ ID NO: 1046464 - RNA, 19 nt, Mycobacterium bovis subsp bovis AF2122/97
gcccgucgucgucgacacg

SEQ ID NO: 1046465 - RNA, 17 nt, Mycobacterium bovis subsp bovis AF2122/97
gcccguaucggcuucgu

SEQ ID NO: 1046466 - RNA, 13 nt, Mycobacterium bovis subsp bovis AF2122/97
gcccgucaccgcg

SEQ ID NO: 1046467 - RNA, 19 nt, Mycobacterium bovis subsp bovis AF2122/97
gcccgccggcgugucgcgu

SEQ ID NO: 1046468 - RNA, 20 nt, Mycobacterium bovis subsp bovis AF2122/97
gcccgguguucaucacgccg

SEQ ID NO: 1046469 - RNA, 15 nt, Mycobacterium bovis subsp bovis AF2122/97
gcccguagccgagcu

SEQ ID NO: 1046470 - RNA, 15 nt, Mycobacterium bovis subsp bovis AF2122/97
gcccguagacgccga

SEQ ID NO: 1046471 - RNA, 19 nt, Mycobacterium bovis subsp bovis AF2122/97
gcccgguuggaccacguga

SEQ ID NO: 1046472 - RNA, 21 nt, Mycobacterium bovis subsp bovis AF2122/97
gcccuccggguauggcggcga

SEQ ID NO: 1046473 - RNA, 22 nt, Mycobacterium bovis subsp bovis AF2122/97
gcccuccggguauggcggcgac

SEQ ID NO: 1046474 - RNA, 17 nt, Mycobacterium bovis subsp bovis AF2122/97
gcccucccgggcccgcu

SEQ ID NO: 1046475 - RNA, 22 nt, Mycobacterium bovis subsp bovis AF2122/97
gcccucccuggggccguccggc

SEQ ID NO: 1046476 - RNA, 15 nt, Mycobacterium bovis subsp bovis AF2122/97
gcccuccggcgcagc

SEQ ID NO: 1046477 - RNA, 14 nt, Mycobacterium bovis subsp bovis AF2122/97
gcccuccucgaccg

SEQ ID NO: 1046478 - RNA, 15 nt, Mycobacterium bovis subsp bovis AF2122/97
gcccuccucgaccgc

SEQ ID NO: 1046479 - RNA, 19 nt, Mycobacterium bovis subsp bovis AF2122/97
gcccuccucgaccgcggcc

SEQ ID NO: 1046480 - RNA, 22 nt, Mycobacterium bovis subsp bovis AF2122/97
gcccuccucgaugaggcgcagc

SEQ ID NO: 1046481 - RNA, 20 nt, Mycobacterium bovis subsp bovis AF2122/97
gcccguuguccagaacggcg

SEQ ID NO: 1046482 - RNA, 20 nt, Mycobacterium bovis subsp bovis AF2122/97
gcccguugcaggacgcccac

SEQ ID NO: 1046483 - RNA, 19 nt, Mycobacterium bovis subsp bovis AF2122/97
gcccuccacugcgagcgcc

SEQ ID NO: 1046484 - RNA, 22 nt, Mycobacterium bovis subsp bovis AF2122/97
gcccuccacugcgagcgccggc

SEQ ID NO: 1046485 - RNA, 19 nt, Mycobacterium bovis subsp bovis AF2122/97
gcccguuugccgguucggc

SEQ ID NO: 1046486 - RNA, 16 nt, Mycobacterium bovis subsp bovis AF2122/97
gcccuaaacaccgcga

SEQ ID NO: 1046487 - RNA, 15 nt, Mycobacterium bovis subsp bovis AF2122/97
gcccguucgugccgu

SEQ ID NO: 1046488 - RNA, 18 nt, Mycobacterium bovis subsp bovis AF2122/97
gcccguucaugcggcggc

SEQ ID NO: 1046489 - RNA, 19 nt, Mycobacterium bovis subsp bovis AF2122/97
gcccguucaugcggcggcg

SEQ ID NO: 1046490 - RNA, 20 nt, Mycobacterium bovis subsp bovis AF2122/97
gcccgugugcagccagccgg

SEQ ID NO: 1046491 - RNA, 16 nt, Mycobacterium bovis subsp bovis AF2122/97
gcccguggucgaucau

SEQ ID NO: 1046492 - RNA, 15 nt, Mycobacterium bovis subsp bovis AF2122/97
gcccgugcggcucgc

SEQ ID NO: 1046493 - RNA, 21 nt, Mycobacterium bovis subsp bovis AF2122/97
gcccgugcggcucgccggcgg

SEQ ID NO: 1046494 - RNA, 23 nt, Mycobacterium bovis subsp bovis AF2122/97
gcccgugcggcucgccggcggcc

SEQ ID NO: 1046495 - RNA, 19 nt, Mycobacterium bovis subsp bovis AF2122/97
gcccgugccuggccggugc

SEQ ID NO: 1046496 - RNA, 16 nt, Mycobacterium bovis subsp bovis AF2122/97
gcccgugccgcccgcg

SEQ ID NO: 1046497 - RNA, 22 nt, Mycobacterium bovis subsp bovis AF2122/97
gcccgugccacagcucgccgug

SEQ ID NO: 1046498 - RNA, 13 nt, Mycobacterium bovis subsp bovis AF2122/97
gcccucggguguc

SEQ ID NO: 1046499 - RNA, 15 nt, Mycobacterium bovis subsp bovis AF2122/97
gcccucggcgccgaa

SEQ ID NO: 1046500 - RNA, 21 nt, Mycobacterium bovis subsp bovis AF2122/97
gcccucgcuaauugcggccgc

SEQ ID NO: 1046501 - RNA, 23 nt, Mycobacterium bovis subsp bovis AF2122/97
gcccucgcuaauugcggccgccg

SEQ ID NO: 1046502 - RNA, 20 nt, Mycobacterium bovis subsp bovis AF2122/97
gcccucgaugccgcguagcu

SEQ ID NO: 1046503 - RNA, 17 nt, Mycobacterium bovis subsp bovis AF2122/97
gcccucgacgcgcucgg

SEQ ID NO: 1046504 - RNA, 18 nt, Mycobacterium bovis subsp bovis AF2122/97
gcccucgucgaucgccgc

SEQ ID NO: 1046505 - RNA, 17 nt, Mycobacterium bovis subsp bovis AF2122/97
gcccucguaauccacgc

SEQ ID NO: 1046506 - RNA, 17 nt, Mycobacterium bovis subsp bovis AF2122/97
gcccucguuaucgaccg

SEQ ID NO: 1046507 - RNA, 15 nt, Mycobacterium bovis subsp bovis AF2122/97
gcccucgucgggauc

SEQ ID NO: 1046508 - RNA, 18 nt, Mycobacterium bovis subsp bovis AF2122/97
gcccucguuaucgaccgc

SEQ ID NO: 1046509 - RNA, 13 nt, Mycobacterium bovis subsp bovis AF2122/97
gcccucuggcucg

SEQ ID NO: 1046510 - RNA, 20 nt, Mycobacterium bovis subsp bovis AF2122/97
gcccugacacccaucgaccg

SEQ ID NO: 1046511 - RNA, 20 nt, Mycobacterium bovis subsp bovis AF2122/97
gcccugacacaacaccggcg

SEQ ID NO: 1046512 - RNA, 21 nt, Mycobacterium bovis subsp bovis AF2122/97
gcccugacacaacaccggcgu

SEQ ID NO: 1046513 - RNA, 18 nt, Mycobacterium bovis subsp bovis AF2122/97
gcccugacccggagccgc

SEQ ID NO: 1046514 - RNA, 22 nt, Mycobacterium bovis subsp bovis AF2122/97
gcccugacccggagccgccagg

SEQ ID NO: 1046515 - RNA, 15 nt, Mycobacterium bovis subsp bovis AF2122/97
gcccugaauccucuc

SEQ ID NO: 1046516 - RNA, 19 nt, Mycobacterium bovis subsp bovis AF2122/97
gcccucgguagcauccagc

SEQ ID NO: 1046517 - RNA, 16 nt, Mycobacterium bovis subsp bovis AF2122/97
gcccugcuggugucgg

SEQ ID NO: 1046518 - RNA, 19 nt, Mycobacterium bovis subsp bovis AF2122/97
gcccugcuggugucggcuc

SEQ ID NO: 1046519 - RNA, 20 nt, Mycobacterium bovis subsp bovis AF2122/97
gcccugcuggugucggcucg

SEQ ID NO: 1046520 - RNA, 15 nt, Mycobacterium bovis subsp bovis AF2122/97
gcccugcucgccguc

SEQ ID NO: 1046521 - RNA, 19 nt, Mycobacterium bovis subsp bovis AF2122/97
gcccugcgccucggcggcc

SEQ ID NO: 1046522 - RNA, 14 nt, Mycobacterium bovis subsp bovis AF2122/97
gcccugcggccacg

SEQ ID NO: 1046523 - RNA, 15 nt, Mycobacterium bovis subsp bovis AF2122/97
gcccugcacagcagc

SEQ ID NO: 1046524 - RNA, 16 nt, Mycobacterium bovis subsp bovis AF2122/97
gcccugcgcagccgcc

SEQ ID NO: 1046525 - RNA, 19 nt, Mycobacterium bovis subsp bovis AF2122/97
gcccugccggcagcggcga

SEQ ID NO: 1046526 - RNA, 15 nt, Mycobacterium bovis subsp bovis AF2122/97
gcccugccgccggcc

SEQ ID NO: 1046527 - RNA, 18 nt, Mycobacterium bovis subsp bovis AF2122/97
gcccugccgccggccccg

SEQ ID NO: 1046528 - RNA, 20 nt, Mycobacterium bovis subsp bovis AF2122/97
gcccugagaacacguucggc

SEQ ID NO: 1046529 - RNA, 17 nt, Mycobacterium bovis subsp bovis AF2122/97
gcccugauugaagcccc

SEQ ID NO: 1046530 - RNA, 20 nt, Mycobacterium bovis subsp bovis AF2122/97
gcccugacgucacguucggc

SEQ ID NO: 1046531 - RNA, 21 nt, Mycobacterium bovis subsp bovis AF2122/97
gcccugacgucacguucggcg

SEQ ID NO: 1046532 - RNA, 21 nt, Mycobacterium bovis subsp bovis AF2122/97
gcccugagcagauggguaccc

SEQ ID NO: 1046533 - RNA, 20 nt, Mycobacterium bovis subsp bovis AF2122/97
gcccugagcgaagugucgcu

SEQ ID NO: 1046534 - RNA, 15 nt, Mycobacterium bovis subsp bovis AF2122/97
gcccugagcugccga

SEQ ID NO: 1046535 - RNA, 13 nt, Mycobacterium bovis subsp bovis AF2122/97
gccgaacgccacc

SEQ ID NO: 1046536 - RNA, 15 nt, Mycobacterium bovis subsp bovis AF2122/97
gccgaacgacggguc

SEQ ID NO: 1046537 - RNA, 20 nt, Mycobacterium bovis subsp bovis AF2122/97
gccgaaccggcaccagcggc

SEQ ID NO: 1046538 - RNA, 19 nt, Mycobacterium bovis subsp bovis AF2122/97
gccgaacgggucggcgacc

SEQ ID NO: 1046539 - RNA, 20 nt, Mycobacterium bovis subsp bovis AF2122/97
gccgaacgggucggcgacca

SEQ ID NO: 1046540 - RNA, 23 nt, Mycobacterium bovis subsp bovis AF2122/97
gccgaacgugcaaccacggcggc

SEQ ID NO: 1046541 - RNA, 20 nt, Mycobacterium bovis subsp bovis AF2122/97
gccgaacgugcaaccacggc

SEQ ID NO: 1046542 - RNA, 14 nt, Mycobacterium bovis subsp bovis AF2122/97
gccgaacgucgcgg

SEQ ID NO: 1046543 - RNA, 18 nt, Mycobacterium bovis subsp bovis AF2122/97
gccgaacgucgcggccag

SEQ ID NO: 1046544 - RNA, 19 nt, Mycobacterium bovis subsp bovis AF2122/97
gccgaacgugaacucacgg

SEQ ID NO: 1046545 - RNA, 20 nt, Mycobacterium bovis subsp bovis AF2122/97
gccgaacgugaacugagggc

SEQ ID NO: 1046546 - RNA, 17 nt, Mycobacterium bovis subsp bovis AF2122/97
gccgaacgggucggcga

SEQ ID NO: 1046547 - RNA, 12 nt, Mycobacterium bovis subsp bovis AF2122/97
gccgaacuccgc

SEQ ID NO: 1046548 - RNA, 16 nt, Mycobacterium bovis subsp bovis AF2122/97
gccgaacgugcggugg

SEQ ID NO: 1046549 - RNA, 20 nt, Mycobacterium bovis subsp bovis AF2122/97
gccgaacguguugaccaggc

SEQ ID NO: 1046550 - RNA, 16 nt, Mycobacterium bovis subsp bovis AF2122/97
gccgaacuaccgacgc

SEQ ID NO: 1046551 - RNA, 17 nt, Mycobacterium bovis subsp bovis AF2122/97
gccgaacuaucguugug

SEQ ID NO: 1046552 - RNA, 24 nt, Mycobacterium bovis subsp bovis AF2122/97
gccgaacucaacgacaccauaggc

SEQ ID NO: 1046553 - RNA, 13 nt, Mycobacterium bovis subsp bovis AF2122/97
gccgaagccgcgc

SEQ ID NO: 1046554 - RNA, 16 nt, Mycobacterium bovis subsp bovis AF2122/97
gccgaagccgcgcauc

SEQ ID NO: 1046555 - RNA, 23 nt, Mycobacterium bovis subsp bovis AF2122/97
gccgaagccuugcagcgcccccg

SEQ ID NO: 1046556 - RNA, 19 nt, Mycobacterium bovis subsp bovis AF2122/97
gccgaagcgaugccgugcu

SEQ ID NO: 1046557 - RNA, 18 nt, Mycobacterium bovis subsp bovis AF2122/97
gccgaagcgccgcuuggc

SEQ ID NO: 1046558 - RNA, 19 nt, Mycobacterium bovis subsp bovis AF2122/97
gccgaagcgccgcuuggcg

SEQ ID NO: 1046559 - RNA, 17 nt, Mycobacterium bovis subsp bovis AF2122/97
gccgaagcgggcccgca

SEQ ID NO: 1046560 - RNA, 14 nt, Mycobacterium bovis subsp bovis AF2122/97
gccgaagcggccac

SEQ ID NO: 1046561 - RNA, 17 nt, Mycobacterium bovis subsp bovis AF2122/97
gccgaagcggccaccgc

SEQ ID NO: 1046562 - RNA, 18 nt, Mycobacterium bovis subsp bovis AF2122/97
gccgaagcggccaccgcc

SEQ ID NO: 1046563 - RNA, 23 nt, Mycobacterium bovis subsp bovis AF2122/97
gccgaagcggccaccgccgccgc

SEQ ID NO: 1046564 - RNA, 17 nt, Mycobacterium bovis subsp bovis AF2122/97
gccgaagaaccggucgc

SEQ ID NO: 1046565 - RNA, 19 nt, Mycobacterium bovis subsp bovis AF2122/97
gccgaagaaccggucgcag

SEQ ID NO: 1046566 - RNA, 20 nt, Mycobacterium bovis subsp bovis AF2122/97
gccgaagaaccggucgcagu

SEQ ID NO: 1046567 - RNA, 16 nt, Mycobacterium bovis subsp bovis AF2122/97
gccgaagacgugccgg

SEQ ID NO: 1046568 - RNA, 16 nt, Mycobacterium bovis subsp bovis AF2122/97
gccgaaaucggccagc

SEQ ID NO: 1046569 - RNA, 22 nt, Mycobacterium bovis subsp bovis AF2122/97
gccgaacaccggcuccagcaug

SEQ ID NO: 1046570 - RNA, 14 nt, Mycobacterium bovis subsp bovis AF2122/97
gccgaacaccggua

SEQ ID NO: 1046571 - RNA, 12 nt, Mycobacterium bovis subsp bovis AF2122/97
gccgaacaccga

SEQ ID NO: 1046572 - RNA, 14 nt, Mycobacterium bovis subsp bovis AF2122/97
gccgaacaccgccg

SEQ ID NO: 1046573 - RNA, 22 nt, Mycobacterium bovis subsp bovis AF2122/97
gccgaacaccucggcacggacc

SEQ ID NO: 1046574 - RNA, 20 nt, Mycobacterium bovis subsp bovis AF2122/97
gccgaaacccgaguucgggc

SEQ ID NO: 1046575 - RNA, 13 nt, Mycobacterium bovis subsp bovis AF2122/97
gccgaaaccggga

SEQ ID NO: 1046576 - RNA, 14 nt, Mycobacterium bovis subsp bovis AF2122/97
gccgaaaaucgcag

SEQ ID NO: 1046577 - RNA, 15 nt, Mycobacterium bovis subsp bovis AF2122/97
gccgaaaaugccgcc

SEQ ID NO: 1046578 - RNA, 16 nt, Mycobacterium bovis subsp bovis AF2122/97
gccgaaaaagaccgac

SEQ ID NO: 1046579 - RNA, 22 nt, Mycobacterium bovis subsp bovis AF2122/97
gcccuuugcuguccccgccgag

SEQ ID NO: 1046580 - RNA, 22 nt, Mycobacterium bovis subsp bovis AF2122/97
gccgaaagccuugccgucgagc

SEQ ID NO: 1046581 - RNA, 18 nt, Mycobacterium bovis subsp bovis AF2122/97
gccgaaagggucgacgua

SEQ ID NO: 1046582 - RNA, 19 nt, Mycobacterium bovis subsp bovis AF2122/97
gccgaaauccuugacgcgc

SEQ ID NO: 1046583 - RNA, 15 nt, Mycobacterium bovis subsp bovis AF2122/97
gccgaaacgccgacc

SEQ ID NO: 1046584 - RNA, 18 nt, Mycobacterium bovis subsp bovis AF2122/97
gccgaaaaugccgcccag

SEQ ID NO: 1046585 - RNA, 17 nt, Mycobacterium bovis subsp bovis AF2122/97
gccgaaacucaccagca

SEQ ID NO: 1046586 - RNA, 15 nt, Mycobacterium bovis subsp bovis AF2122/97
gccgaaccacgcgcc

SEQ ID NO: 1046587 - RNA, 24 nt, Mycobacterium bovis subsp bovis AF2122/97
gccgaaccacgcgcccgcaccacc

SEQ ID NO: 1046588 - RNA, 14 nt, Mycobacterium bovis subsp bovis AF2122/97
gccgaaccagcgau

SEQ ID NO: 1046589 - RNA, 15 nt, Mycobacterium bovis subsp bovis AF2122/97
gccgaaccguucggc

SEQ ID NO: 1046590 - RNA, 20 nt, Mycobacterium bovis subsp bovis AF2122/97
gccgaaccguucggcgacag

SEQ ID NO: 1046591 - RNA, 15 nt, Mycobacterium bovis subsp bovis AF2122/97
gccgaacccggcgga

SEQ ID NO: 1046592 - RNA, 22 nt, Mycobacterium bovis subsp bovis AF2122/97
gccgaacccgguguugagcgaa

SEQ ID NO: 1046593 - RNA, 15 nt, Mycobacterium bovis subsp bovis AF2122/97
gccgaaccgcugcgg

SEQ ID NO: 1046594 - RNA, 23 nt, Mycobacterium bovis subsp bovis AF2122/97
gccgaaccgcgcguaauccgagc

SEQ ID NO: 1046595 - RNA, 15 nt, Mycobacterium bovis subsp bovis AF2122/97
gccgaacagcaggcc

SEQ ID NO: 1046596 - RNA, 13 nt, Mycobacterium bovis subsp bovis AF2122/97
gccgaacaggaug

SEQ ID NO: 1046597 - RNA, 15 nt, Mycobacterium bovis subsp bovis AF2122/97
gccgaacagccgagc

SEQ ID NO: 1046598 - RNA, 17 nt, Mycobacterium bovis subsp bovis AF2122/97
gccgaacagggaggucg

SEQ ID NO: 1046599 - RNA, 21 nt, Mycobacterium bovis subsp bovis AF2122/97
gccgaacagggaggucgccgc

SEQ ID NO: 1046600 - RNA, 20 nt, Mycobacterium bovis subsp bovis AF2122/97
gccgaacaguucggcgagca

SEQ ID NO: 1046601 - RNA, 16 nt, Mycobacterium bovis subsp bovis AF2122/97
gccgaacaguucggcg

SEQ ID NO: 1046602 - RNA, 17 nt, Mycobacterium bovis subsp bovis AF2122/97
gccgaacaguucggcga

SEQ ID NO: 1046603 - RNA, 18 nt, Mycobacterium bovis subsp bovis AF2122/97
gccgaacaguucggcgag

SEQ ID NO: 1046604 - RNA, 14 nt, Mycobacterium bovis subsp bovis AF2122/97
gcccuggaccagcg

SEQ ID NO: 1046605 - RNA, 19 nt, Mycobacterium bovis subsp bovis AF2122/97
gcccuggcaacgacacgcc

SEQ ID NO: 1046606 - RNA, 14 nt, Mycobacterium bovis subsp bovis AF2122/97
gcccuggccgccgg

SEQ ID NO: 1046607 - RNA, 19 nt, Mycobacterium bovis subsp bovis AF2122/97
gcccuggccgccggccccg

SEQ ID NO: 1046608 - RNA, 23 nt, Mycobacterium bovis subsp bovis AF2122/97
gcccuggccgcccagaccgccga

SEQ ID NO: 1046609 - RNA, 13 nt, Mycobacterium bovis subsp bovis AF2122/97
gcccuggccgccg

SEQ ID NO: 1046610 - RNA, 14 nt, Mycobacterium bovis subsp bovis AF2122/97
gcccuggccaccca

SEQ ID NO: 1046611 - RNA, 16 nt, Mycobacterium bovis subsp bovis AF2122/97
gcccuggccagcccga

SEQ ID NO: 1046612 - RNA, 16 nt, Mycobacterium bovis subsp bovis AF2122/97
gcccuggccgcgccgg

SEQ ID NO: 1046613 - RNA, 15 nt, Mycobacterium bovis subsp bovis AF2122/97
gcccuggcgaccagc

SEQ ID NO: 1046614 - RNA, 20 nt, Mycobacterium bovis subsp bovis AF2122/97
gcccuggcgaccagccgagc

SEQ ID NO: 1046615 - RNA, 20 nt, Mycobacterium bovis subsp bovis AF2122/97
gcccugguuggugacguaga

SEQ ID NO: 1046616 - RNA, 16 nt, Mycobacterium bovis subsp bovis AF2122/97
gcccuggugugccgcg

SEQ ID NO: 1046617 - RNA, 21 nt, Mycobacterium bovis subsp bovis AF2122/97
gcccugggugauggccgcgcc

SEQ ID NO: 1046618 - RNA, 22 nt, Mycobacterium bovis subsp bovis AF2122/97
gcccugggugguuccgcgcggc

SEQ ID NO: 1046619 - RNA, 16 nt, Mycobacterium bovis subsp bovis AF2122/97
gcccugguccaggccc

SEQ ID NO: 1046620 - RNA, 17 nt, Mycobacterium bovis subsp bovis AF2122/97
gcccuguccggcgccga

SEQ ID NO: 1046621 - RNA, 22 nt, Mycobacterium bovis subsp bovis AF2122/97
gcccuguccggguagcggcgcc

SEQ ID NO: 1046622 - RNA, 22 nt, Mycobacterium bovis subsp bovis AF2122/97
gcccuuccggccgacacgccga

SEQ ID NO: 1046623 - RNA, 19 nt, Mycobacterium bovis subsp bovis AF2122/97
gcccuucagcguccuggug

SEQ ID NO: 1046624 - RNA, 13 nt, Mycobacterium bovis subsp bovis AF2122/97
gcccuucagcacg

SEQ ID NO: 1046625 - RNA, 14 nt, Mycobacterium bovis subsp bovis AF2122/97
gcccuucagcacgg

SEQ ID NO: 1046626 - RNA, 17 nt, Mycobacterium bovis subsp bovis AF2122/97
gcccuucagcacgguga

SEQ ID NO: 1046627 - RNA, 18 nt, Mycobacterium bovis subsp bovis AF2122/97
gcccuucagcgaagccgg

SEQ ID NO: 1046628 - RNA, 13 nt, Mycobacterium bovis subsp bovis AF2122/97
gcccuucaccagc

SEQ ID NO: 1046629 - RNA, 18 nt, Mycobacterium bovis subsp bovis AF2122/97
gcccuucuucgaccgcga

SEQ ID NO: 1046630 - RNA, 13 nt, Mycobacterium bovis subsp bovis AF2122/97
gcccuucgucggc

SEQ ID NO: 1046631 - RNA, 15 nt, Mycobacterium bovis subsp bovis AF2122/97
gcccuucgucggcau

SEQ ID NO: 1046632 - RNA, 16 nt, Mycobacterium bovis subsp bovis AF2122/97
gcccuucuucgaccgc

SEQ ID NO: 1046633 - RNA, 17 nt, Mycobacterium bovis subsp bovis AF2122/97
gcccuucuucgaccgcg

SEQ ID NO: 1046634 - RNA, 13 nt, Mycobacterium bovis subsp bovis AF2122/97
gcccuugaugucc

SEQ ID NO: 1046635 - RNA, 22 nt, Mycobacterium bovis subsp bovis AF2122/97
gcccuugccgccagccccagcg

SEQ ID NO: 1046636 - RNA, 20 nt, Mycobacterium bovis subsp bovis AF2122/97
gcccuugccgcccgcuccgc

SEQ ID NO: 1046637 - RNA, 15 nt, Mycobacterium bovis subsp bovis AF2122/97
gcccuugccgccgag

SEQ ID NO: 1046638 - RNA, 16 nt, Mycobacterium bovis subsp bovis AF2122/97
gcccuugccgccgagg

SEQ ID NO: 1046639 - RNA, 15 nt, Mycobacterium bovis subsp bovis AF2122/97
gcccuugccgccggc

SEQ ID NO: 1046640 - RNA, 19 nt, Mycobacterium bovis subsp bovis AF2122/97
gcccuugccgccggccccg

SEQ ID NO: 1046641 - RNA, 14 nt, Mycobacterium bovis subsp bovis AF2122/97
gcccuugccgccuu

SEQ ID NO: 1046642 - RNA, 16 nt, Mycobacterium bovis subsp bovis AF2122/97
gcccuuggccagcagg

SEQ ID NO: 1046643 - RNA, 18 nt, Mycobacterium bovis subsp bovis AF2122/97
gcccuuguagcacaccga

SEQ ID NO: 1046644 - RNA, 20 nt, Mycobacterium bovis subsp bovis AF2122/97
gcccuuguagcacaccgaca

SEQ ID NO: 1046645 - RNA, 14 nt, Mycobacterium bovis subsp bovis AF2122/97
gcccuuguagcaca

SEQ ID NO: 1046646 - RNA, 20 nt, Mycobacterium bovis subsp bovis AF2122/97
gcccuuguggaguacggcga

SEQ ID NO: 1046647 - RNA, 14 nt, Mycobacterium bovis subsp bovis AF2122/97
gcccuuucgacuuc

SEQ ID NO: 1046648 - RNA, 16 nt, Mycobacterium bovis subsp bovis AF2122/97
gcccaggccgaucagc

SEQ ID NO: 1046649 - RNA, 17 nt, Mycobacterium bovis subsp bovis AF2122/97
gcccaggccgaucagcg

SEQ ID NO: 1046650 - RNA, 19 nt, Mycobacterium bovis subsp bovis AF2122/97
gcccaggcgaucgcccggc

SEQ ID NO: 1046651 - RNA, 21 nt, Mycobacterium bovis subsp bovis AF2122/97
gcccaggcgaucgcccggccc

SEQ ID NO: 1046652 - RNA, 18 nt, Mycobacterium bovis subsp bovis AF2122/97
gcccaggcgaccgcugag

SEQ ID NO: 1046653 - RNA, 14 nt, Mycobacterium bovis subsp bovis AF2122/97
gcccaggguguccg

SEQ ID NO: 1046654 - RNA, 20 nt, Mycobacterium bovis subsp bovis AF2122/97
gcccaggguguccgucgaac

SEQ ID NO: 1046655 - RNA, 20 nt, Mycobacterium bovis subsp bovis AF2122/97
gcccagcgugucuugucgcg

SEQ ID NO: 1046656 - RNA, 16 nt, Mycobacterium bovis subsp bovis AF2122/97
gcccagcucgauaccc

SEQ ID NO: 1046657 - RNA, 15 nt, Mycobacterium bovis subsp bovis AF2122/97
gcccagcucgauacc

SEQ ID NO: 1046658 - RNA, 20 nt, Mycobacterium bovis subsp bovis AF2122/97
gcccagcgacccggccagcg

SEQ ID NO: 1046659 - RNA, 22 nt, Mycobacterium bovis subsp bovis AF2122/97
gcccagccggaccgcgacggcg

SEQ ID NO: 1046660 - RNA, 19 nt, Mycobacterium bovis subsp bovis AF2122/97
gcccagccguucccgguga

SEQ ID NO: 1046661 - RNA, 16 nt, Mycobacterium bovis subsp bovis AF2122/97
gcccagccguucgucg

SEQ ID NO: 1046662 - RNA, 20 nt, Mycobacterium bovis subsp bovis AF2122/97
gcccagccguucgucgcggg

SEQ ID NO: 1046663 - RNA, 21 nt, Mycobacterium bovis subsp bovis AF2122/97
gcccaggugacgcccgcuccg

SEQ ID NO: 1046664 - RNA, 15 nt, Mycobacterium bovis subsp bovis AF2122/97
gcccaggugaucgcg

SEQ ID NO: 1046665 - RNA, 16 nt, Mycobacterium bovis subsp bovis AF2122/97
gcccaggugaucgcga

SEQ ID NO: 1046666 - RNA, 16 nt, Mycobacterium bovis subsp bovis AF2122/97
gcccagguguguggcg

SEQ ID NO: 1046667 - RNA, 19 nt, Mycobacterium bovis subsp bovis AF2122/97
gcccagguguguggcggcg

SEQ ID NO: 1046668 - RNA, 19 nt, Mycobacterium bovis subsp bovis AF2122/97
gcccagguugccuuggcgg

SEQ ID NO: 1046669 - RNA, 23 nt, Mycobacterium bovis subsp bovis AF2122/97
gcccagguugccuuggcggccaa

SEQ ID NO: 1046670 - RNA, 18 nt, Mycobacterium bovis subsp bovis AF2122/97
gcccaguugggccucagc

SEQ ID NO: 1046671 - RNA, 20 nt, Mycobacterium bovis subsp bovis AF2122/97
gcccaguaagccacgggcac

SEQ ID NO: 1046672 - RNA, 22 nt, Mycobacterium bovis subsp bovis AF2122/97
gcccauccggccgucgggcagc

SEQ ID NO: 1046673 - RNA, 20 nt, Mycobacterium bovis subsp bovis AF2122/97
gcccaucgcgacuagacgcc

SEQ ID NO: 1046674 - RNA, 21 nt, Mycobacterium bovis subsp bovis AF2122/97
gcccaucccgguuccggcgau

SEQ ID NO: 1046675 - RNA, 22 nt, Mycobacterium bovis subsp bovis AF2122/97
gcccaucccgguuccggcgauc

SEQ ID NO: 1046676 - RNA, 13 nt, Mycobacterium bovis subsp bovis AF2122/97
gcccaucacaccc

SEQ ID NO: 1046677 - RNA, 18 nt, Mycobacterium bovis subsp bovis AF2122/97
gcccauacgugccgccga

SEQ ID NO: 1046678 - RNA, 16 nt, Mycobacterium bovis subsp bovis AF2122/97
gcccagcucgucgagc

SEQ ID NO: 1046679 - RNA, 22 nt, Mycobacterium bovis subsp bovis AF2122/97
gcccauagccaggugugcggaa

SEQ ID NO: 1046680 - RNA, 15 nt, Mycobacterium bovis subsp bovis AF2122/97
gcccauagcugccgg

SEQ ID NO: 1046681 - RNA, 16 nt, Mycobacterium bovis subsp bovis AF2122/97
gcccauagcaccucga

SEQ ID NO: 1046682 - RNA, 14 nt, Mycobacterium bovis subsp bovis AF2122/97
gccccagacgcgca

SEQ ID NO: 1046683 - RNA, 17 nt, Mycobacterium bovis subsp bovis AF2122/97
gcccauggccaccaggg

SEQ ID NO: 1046684 - RNA, 22 nt, Mycobacterium bovis subsp bovis AF2122/97
gccccacuggugcagcgccgac

SEQ ID NO: 1046685 - RNA, 17 nt, Mycobacterium bovis subsp bovis AF2122/97
gccccacuucgggcgga

SEQ ID NO: 1046686 - RNA, 23 nt, Mycobacterium bovis subsp bovis AF2122/97
gcccaucgcgacuagacgccgcc

SEQ ID NO: 1046687 - RNA, 15 nt, Mycobacterium bovis subsp bovis AF2122/97
gcccaucucgggcag

SEQ ID NO: 1046688 - RNA, 15 nt, Mycobacterium bovis subsp bovis AF2122/97
gcccaucuugaccaa

SEQ ID NO: 1046689 - RNA, 18 nt, Mycobacterium bovis subsp bovis AF2122/97
gcccaugaucucggcgaa

SEQ ID NO: 1046690 - RNA, 18 nt, Mycobacterium bovis subsp bovis AF2122/97
gcccaugauggccgcggc

SEQ ID NO: 1046691 - RNA, 19 nt, Mycobacterium bovis subsp bovis AF2122/97
gcccaugauggccgcggcu

SEQ ID NO: 1046692 - RNA, 15 nt, Mycobacterium bovis subsp bovis AF2122/97
gccccaccggcccgg

SEQ ID NO: 1046693 - RNA, 17 nt, Mycobacterium bovis subsp bovis AF2122/97
gccccaccggcccggga

SEQ ID NO: 1046694 - RNA, 15 nt, Mycobacterium bovis subsp bovis AF2122/97
gccccaccggccgaa

SEQ ID NO: 1046695 - RNA, 18 nt, Mycobacterium bovis subsp bovis AF2122/97
gccccaccgguaccgcca

SEQ ID NO: 1046696 - RNA, 14 nt, Mycobacterium bovis subsp bovis AF2122/97
gccccaccggugcc

SEQ ID NO: 1046697 - RNA, 16 nt, Mycobacterium bovis subsp bovis AF2122/97
gcccaugcagcggcga

SEQ ID NO: 1046698 - RNA, 13 nt, Mycobacterium bovis subsp bovis AF2122/97
gcccaugcgccac

SEQ ID NO: 1046699 - RNA, 18 nt, Mycobacterium bovis subsp bovis AF2122/97
gcccaugcgccacgccac

SEQ ID NO: 1046700 - RNA, 16 nt, Mycobacterium bovis subsp bovis AF2122/97
gccccgaggaugccga

SEQ ID NO: 1046701 - RNA, 16 nt, Mycobacterium bovis subsp bovis AF2122/97
gccccgacugccgcgg

SEQ ID NO: 1046702 - RNA, 21 nt, Mycobacterium bovis subsp bovis AF2122/97
gccccgacugccgcgggcagc

SEQ ID NO: 1046703 - RNA, 16 nt, Mycobacterium bovis subsp bovis AF2122/97
gcccccgccacgccga

SEQ ID NO: 1046704 - RNA, 20 nt, Mycobacterium bovis subsp bovis AF2122/97
gcccccgcgggggcggccgg

SEQ ID NO: 1046705 - RNA, 16 nt, Mycobacterium bovis subsp bovis AF2122/97
gccccgacggucaacg

SEQ ID NO: 1046706 - RNA, 18 nt, Mycobacterium bovis subsp bovis AF2122/97
gccccgacggucaacgac

SEQ ID NO: 1046707 - RNA, 15 nt, Mycobacterium bovis subsp bovis AF2122/97
gccccgaccagcaga

SEQ ID NO: 1046708 - RNA, 22 nt, Mycobacterium bovis subsp bovis AF2122/97
gccccgauaaaaaccaccccca

SEQ ID NO: 1046709 - RNA, 19 nt, Mycobacterium bovis subsp bovis AF2122/97
gccccgaggaugccgaacc

SEQ ID NO: 1046710 - RNA, 13 nt, Mycobacterium bovis subsp bovis AF2122/97
gccccgaucccga

SEQ ID NO: 1046711 - RNA, 12 nt, Mycobacterium bovis subsp bovis AF2122/97
gccccgcaucgc

SEQ ID NO: 1046712 - RNA, 17 nt, Mycobacterium bovis subsp bovis AF2122/97
gcccccgacacgccgug

SEQ ID NO: 1046713 - RNA, 14 nt, Mycobacterium bovis subsp bovis AF2122/97
gcccccgacacgcc

SEQ ID NO: 1046714 - RNA, 17 nt, Mycobacterium bovis subsp bovis AF2122/97
gcccccgccauugccgc

SEQ ID NO: 1046715 - RNA, 20 nt, Mycobacterium bovis subsp bovis AF2122/97
gcccccgccauugccgccgg

SEQ ID NO: 1046716 - RNA, 21 nt, Mycobacterium bovis subsp bovis AF2122/97
gcccccgccauugccgccggc

SEQ ID NO: 1046717 - RNA, 23 nt, Mycobacterium bovis subsp bovis AF2122/97
gcccccgccauugccgccggcgc

SEQ ID NO: 1046718 - RNA, 17 nt, Mycobacterium bovis subsp bovis AF2122/97
gcccccgcacgcucggc

SEQ ID NO: 1046719 - RNA, 18 nt, Mycobacterium bovis subsp bovis AF2122/97
gcccccgcacgcucggcg

SEQ ID NO: 1046720 - RNA, 23 nt, Mycobacterium bovis subsp bovis AF2122/97
gccccagggggcgugccgccgca

SEQ ID NO: 1046721 - RNA, 19 nt, Mycobacterium bovis subsp bovis AF2122/97
gccccaggggcaccagcga

SEQ ID NO: 1046722 - RNA, 23 nt, Mycobacterium bovis subsp bovis AF2122/97
gccccauaaacucuguggugucg

SEQ ID NO: 1046723 - RNA, 18 nt, Mycobacterium bovis subsp bovis AF2122/97
gccccaucaccaccggca

SEQ ID NO: 1046724 - RNA, 16 nt, Mycobacterium bovis subsp bovis AF2122/97
gccccgccagcgccgg

SEQ ID NO: 1046725 - RNA, 15 nt, Mycobacterium bovis subsp bovis AF2122/97
gccccgccagcggca

SEQ ID NO: 1046726 - RNA, 18 nt, Mycobacterium bovis subsp bovis AF2122/97
gccccgccagcggcagcg

SEQ ID NO: 1046727 - RNA, 16 nt, Mycobacterium bovis subsp bovis AF2122/97
gccccgcaucgcccaa

SEQ ID NO: 1046728 - RNA, 14 nt, Mycobacterium bovis subsp bovis AF2122/97
gccccgcccgcacc

SEQ ID NO: 1046729 - RNA, 17 nt, Mycobacterium bovis subsp bovis AF2122/97
gccccgccgaugccgcc

SEQ ID NO: 1046730 - RNA, 18 nt, Mycobacterium bovis subsp bovis AF2122/97
gccccggucggcgacgua

SEQ ID NO: 1046731 - RNA, 20 nt, Mycobacterium bovis subsp bovis AF2122/97
gccccgccgaugccgccggc

SEQ ID NO: 1046732 - RNA, 21 nt, Mycobacterium bovis subsp bovis AF2122/97
gccccgugggccucgaucagc

SEQ ID NO: 1046733 - RNA, 22 nt, Mycobacterium bovis subsp bovis AF2122/97
gccccugaaggccagccaacgc

SEQ ID NO: 1046734 - RNA, 18 nt, Mycobacterium bovis subsp bovis AF2122/97
gccccgccaccucgccgg

SEQ ID NO: 1046735 - RNA, 17 nt, Mycobacterium bovis subsp bovis AF2122/97
gccccuggcaccucgcc

SEQ ID NO: 1046736 - RNA, 14 nt, Mycobacterium bovis subsp bovis AF2122/97
gccccuggccgccg

SEQ ID NO: 1046737 - RNA, 15 nt, Mycobacterium bovis subsp bovis AF2122/97
gccccugccgauccc

SEQ ID NO: 1046738 - RNA, 13 nt, Mycobacterium bovis subsp bovis AF2122/97
gccccugcacagc

SEQ ID NO: 1046739 - RNA, 14 nt, Mycobacterium bovis subsp bovis AF2122/97
gccccugcacagca

SEQ ID NO: 1046740 - RNA, 18 nt, Mycobacterium bovis subsp bovis AF2122/97
gccccugcacagcaggcu

SEQ ID NO: 1046741 - RNA, 21 nt, Mycobacterium bovis subsp bovis AF2122/97
gccccugcacagcaggcucga

SEQ ID NO: 1046742 - RNA, 18 nt, Mycobacterium bovis subsp bovis AF2122/97
gcccgagucgaaaccgcc

SEQ ID NO: 1046743 - RNA, 14 nt, Mycobacterium bovis subsp bovis AF2122/97
gcccgagcccagcc

SEQ ID NO: 1046744 - RNA, 23 nt, Mycobacterium bovis subsp bovis AF2122/97
gcccgagcccagccgggcacccu

SEQ ID NO: 1046745 - RNA, 15 nt, Mycobacterium bovis subsp bovis AF2122/97
gcccgagcccagcgc

SEQ ID NO: 1046746 - RNA, 13 nt, Mycobacterium bovis subsp bovis AF2122/97
gcccgagaucgcg

SEQ ID NO: 1046747 - RNA, 15 nt, Mycobacterium bovis subsp bovis AF2122/97
gcccgagcaccccag

SEQ ID NO: 1046748 - RNA, 14 nt, Mycobacterium bovis subsp bovis AF2122/97
gcccgagacggugu

SEQ ID NO: 1046749 - RNA, 19 nt, Mycobacterium bovis subsp bovis AF2122/97
gcccgacggguaucccguc

SEQ ID NO: 1046750 - RNA, 22 nt, Mycobacterium bovis subsp bovis AF2122/97
gcccgacugccguucagcggcg

SEQ ID NO: 1046751 - RNA, 16 nt, Mycobacterium bovis subsp bovis AF2122/97
gcccgaucccgaucga

SEQ ID NO: 1046752 - RNA, 15 nt, Mycobacterium bovis subsp bovis AF2122/97
gcccgaucaccagcc

SEQ ID NO: 1046753 - RNA, 16 nt, Mycobacterium bovis subsp bovis AF2122/97
gcccgaucaccagccc

SEQ ID NO: 1046754 - RNA, 16 nt, Mycobacterium bovis subsp bovis AF2122/97
gcccgagucucgucgg

SEQ ID NO: 1046755 - RNA, 21 nt, Mycobacterium bovis subsp bovis AF2122/97
gcccgagugugaaucgcacga

SEQ ID NO: 1046756 - RNA, 22 nt, Mycobacterium bovis subsp bovis AF2122/97
gcccgaguugaagaagccggug

SEQ ID NO: 1046757 - RNA, 15 nt, Mycobacterium bovis subsp bovis AF2122/97
gcccgaguuugacca

SEQ ID NO: 1046758 - RNA, 18 nt, Mycobacterium bovis subsp bovis AF2122/97
gcccgaguuugaccagcc

SEQ ID NO: 1046759 - RNA, 16 nt, Mycobacterium bovis subsp bovis AF2122/97
gcccgauaaaugccgc

SEQ ID NO: 1046760 - RNA, 14 nt, Mycobacterium bovis subsp bovis AF2122/97
gcccgauacgccac

SEQ ID NO: 1046761 - RNA, 18 nt, Mycobacterium bovis subsp bovis AF2122/97
gcccgauacgccaccggc

SEQ ID NO: 1046762 - RNA, 19 nt, Mycobacterium bovis subsp bovis AF2122/97
gccccugguccacccguga

SEQ ID NO: 1046763 - RNA, 20 nt, Mycobacterium bovis subsp bovis AF2122/97
gccccugucaacgccgcggu

SEQ ID NO: 1046764 - RNA, 20 nt, Mycobacterium bovis subsp bovis AF2122/97
gcccgaccggucuggcgaug

SEQ ID NO: 1046765 - RNA, 17 nt, Mycobacterium bovis subsp bovis AF2122/97
gcccgacgaggaugucg

SEQ ID NO: 1046766 - RNA, 13 nt, Mycobacterium bovis subsp bovis AF2122/97
gcccgacgacgac

SEQ ID NO: 1046767 - RNA, 22 nt, Mycobacterium bovis subsp bovis AF2122/97
gcccgacgugaagccaagcgac

SEQ ID NO: 1046768 - RNA, 15 nt, Mycobacterium bovis subsp bovis AF2122/97
gcccgacguugccga

SEQ ID NO: 1046769 - RNA, 22 nt, Mycobacterium bovis subsp bovis AF2122/97
gcccgacguugcguagcagguc

SEQ ID NO: 1046770 - RNA, 21 nt, Mycobacterium bovis subsp bovis AF2122/97
gcccgacucggccgugaccga

SEQ ID NO: 1046771 - RNA, 21 nt, Mycobacterium bovis subsp bovis AF2122/97
gcccgacugaacgucaccguu

SEQ ID NO: 1046772 - RNA, 16 nt, Mycobacterium bovis subsp bovis AF2122/97
gcccgacgccggucac

SEQ ID NO: 1046773 - RNA, 16 nt, Mycobacterium bovis subsp bovis AF2122/97
gcccgacggcgcccag

SEQ ID NO: 1046774 - RNA, 18 nt, Mycobacterium bovis subsp bovis AF2122/97
gcccgacggcgcccagcg

SEQ ID NO: 1046775 - RNA, 20 nt, Mycobacterium bovis subsp bovis AF2122/97
gcccgacgaugugcacggug

SEQ ID NO: 1046776 - RNA, 11 nt, Mycobacterium bovis subsp bovis AF2122/97
gcccgacgccg

SEQ ID NO: 1046777 - RNA, 15 nt, Mycobacterium bovis subsp bovis AF2122/97
gcccgacgagucgcc

SEQ ID NO: 1046778 - RNA, 24 nt, Mycobacterium bovis subsp bovis AF2122/97
gcccgacgagucgccgcgggcagc

SEQ ID NO: 1046779 - RNA, 20 nt, Mycobacterium bovis subsp bovis AF2122/97
gcccgccggcauagaugccg

SEQ ID NO: 1046780 - RNA, 14 nt, Mycobacterium bovis subsp bovis AF2122/97
gcccgccggccucu

SEQ ID NO: 1046781 - RNA, 15 nt, Mycobacterium bovis subsp bovis AF2122/97
gcccgccggguuggu

SEQ ID NO: 1046782 - RNA, 14 nt, Mycobacterium bovis subsp bovis AF2122/97
gcccgccgucaccg

SEQ ID NO: 1046783 - RNA, 15 nt, Mycobacterium bovis subsp bovis AF2122/97
gcccgccgucaccgc

SEQ ID NO: 1046784 - RNA, 17 nt, Mycobacterium bovis subsp bovis AF2122/97
gcccgccguagaccagc

SEQ ID NO: 1046785 - RNA, 23 nt, Mycobacterium bovis subsp bovis AF2122/97
gcccgccguagaccagccgucgu

SEQ ID NO: 1046786 - RNA, 13 nt, Mycobacterium bovis subsp bovis AF2122/97
gcccgccgucacc

SEQ ID NO: 1046787 - RNA, 15 nt, Mycobacterium bovis subsp bovis AF2122/97
gcccgccguagacca

SEQ ID NO: 1046788 - RNA, 17 nt, Mycobacterium bovis subsp bovis AF2122/97
gcccgccggcgcgagcc

SEQ ID NO: 1046789 - RNA, 18 nt, Mycobacterium bovis subsp bovis AF2122/97
gcccgccggcgcgagccg

SEQ ID NO: 1046790 - RNA, 14 nt, Mycobacterium bovis subsp bovis AF2122/97
gcccgccggugauc

SEQ ID NO: 1046791 - RNA, 20 nt, Mycobacterium bovis subsp bovis AF2122/97
gcccgccggugaucggcggc

SEQ ID NO: 1046792 - RNA, 13 nt, Mycobacterium bovis subsp bovis AF2122/97
gcccgccguccgg

SEQ ID NO: 1046793 - RNA, 17 nt, Mycobacterium bovis subsp bovis AF2122/97
gcccgccguccggcgcc

SEQ ID NO: 1046794 - RNA, 14 nt, Mycobacterium bovis subsp bovis AF2122/97
gcccgccguuacgg

SEQ ID NO: 1046795 - RNA, 15 nt, Mycobacterium bovis subsp bovis AF2122/97
gcccgccgcgucacc

SEQ ID NO: 1046796 - RNA, 21 nt, Mycobacterium bovis subsp bovis AF2122/97
gcccgccgcgaccacgcaccg

SEQ ID NO: 1046797 - RNA, 16 nt, Mycobacterium bovis subsp bovis AF2122/97
gcccgccgcgaccacg

SEQ ID NO: 1046798 - RNA, 15 nt, Mycobacterium bovis subsp bovis AF2122/97
gcccgccgcggcagc

SEQ ID NO: 1046799 - RNA, 19 nt, Mycobacterium bovis subsp bovis AF2122/97
gcccgcccaccucgaucgc

SEQ ID NO: 1046800 - RNA, 15 nt, Mycobacterium bovis subsp bovis AF2122/97
gcccgcccaccucga

SEQ ID NO: 1046801 - RNA, 14 nt, Mycobacterium bovis subsp bovis AF2122/97
gcccgcccagcccg

SEQ ID NO: 1046802 - RNA, 14 nt, Mycobacterium bovis subsp bovis AF2122/97
gcccgccgccacca

SEQ ID NO: 1046803 - RNA, 15 nt, Mycobacterium bovis subsp bovis AF2122/97
gcccgccgccaccag

SEQ ID NO: 1046804 - RNA, 17 nt, Mycobacterium bovis subsp bovis AF2122/97
gcccgccgccaccagcu

SEQ ID NO: 1046805 - RNA, 14 nt, Mycobacterium bovis subsp bovis AF2122/97
gcccgccagcccag

SEQ ID NO: 1046806 - RNA, 15 nt, Mycobacterium bovis subsp bovis AF2122/97
gcccgccagcccagc

SEQ ID NO: 1046807 - RNA, 16 nt, Mycobacterium bovis subsp bovis AF2122/97
gcccgccagcccagca

SEQ ID NO: 1046808 - RNA, 16 nt, Mycobacterium bovis subsp bovis AF2122/97
gcccgccagcgaucca

SEQ ID NO: 1046809 - RNA, 18 nt, Mycobacterium bovis subsp bovis AF2122/97
gcccgccagcgauccacc

SEQ ID NO: 1046810 - RNA, 23 nt, Mycobacterium bovis subsp bovis AF2122/97
gcccgccagcgccgccgcgagcg

SEQ ID NO: 1046811 - RNA, 15 nt, Mycobacterium bovis subsp bovis AF2122/97
gcccgcaugccggcg

SEQ ID NO: 1046812 - RNA, 16 nt, Mycobacterium bovis subsp bovis AF2122/97
gcccgcaugccggcgc

SEQ ID NO: 1046813 - RNA, 19 nt, Mycobacterium bovis subsp bovis AF2122/97
gcccgccaucagcccggcg

SEQ ID NO: 1046814 - RNA, 20 nt, Mycobacterium bovis subsp bovis AF2122/97
gcccgccaucagcccggcgc

SEQ ID NO: 1046815 - RNA, 22 nt, Mycobacterium bovis subsp bovis AF2122/97
gcccgcaucgccucgagguauu

SEQ ID NO: 1046816 - RNA, 15 nt, Mycobacterium bovis subsp bovis AF2122/97
gcccgcaucgcggca

SEQ ID NO: 1046817 - RNA, 17 nt, Mycobacterium bovis subsp bovis AF2122/97
gcccgcaucgcggcauc

SEQ ID NO: 1046818 - RNA, 20 nt, Mycobacterium bovis subsp bovis AF2122/97
gcccgcagggccgccgcgaa

SEQ ID NO: 1046819 - RNA, 13 nt, Mycobacterium bovis subsp bovis AF2122/97
gcccgcaaacagu

SEQ ID NO: 1046820 - RNA, 21 nt, Mycobacterium bovis subsp bovis AF2122/97
gcccgauucugauaucgucgg

SEQ ID NO: 1046821 - RNA, 22 nt, Mycobacterium bovis subsp bovis AF2122/97
gcccgcaacgcgucggucgcgg

SEQ ID NO: 1046822 - RNA, 17 nt, Mycobacterium bovis subsp bovis AF2122/97
gcccgcaauuguucgcg

SEQ ID NO: 1046823 - RNA, 19 nt, Mycobacterium bovis subsp bovis AF2122/97
gcccgcaacaucgggucgc

SEQ ID NO: 1046824 - RNA, 13 nt, Mycobacterium bovis subsp bovis AF2122/97
gcccgcaccacac

SEQ ID NO: 1046825 - RNA, 14 nt, Mycobacterium bovis subsp bovis AF2122/97
gcccgcaccacacc

SEQ ID NO: 1046826 - RNA, 22 nt, Mycobacterium bovis subsp bovis AF2122/97
gcccgcaccacaccgugggcga

SEQ ID NO: 1046827 - RNA, 15 nt, Mycobacterium bovis subsp bovis AF2122/97
gcccgaucgauaucg

SEQ ID NO: 1046828 - RNA, 23 nt, Mycobacterium bovis subsp bovis AF2122/97
gcccgaucgauaucggcaaucag

SEQ ID NO: 1046829 - RNA, 19 nt, Mycobacterium bovis subsp bovis AF2122/97
gcccgauucagcgccccau

SEQ ID NO: 1046830 - RNA, 20 nt, Mycobacterium bovis subsp bovis AF2122/97
gcccgaugguggugccgacc

SEQ ID NO: 1046831 - RNA, 20 nt, Mycobacterium bovis subsp bovis AF2122/97
gcccgauggugccgacccgc

SEQ ID NO: 1046832 - RNA, 21 nt, Mycobacterium bovis subsp bovis AF2122/97
gcccgauggugccgacccgcc

SEQ ID NO: 1046833 - RNA, 22 nt, Mycobacterium bovis subsp bovis AF2122/97
gcccgaugguacccgcgccgcg

SEQ ID NO: 1046834 - RNA, 14 nt, Mycobacterium bovis subsp bovis AF2122/97
gcccgauggugccg

SEQ ID NO: 1046835 - RNA, 17 nt, Mycobacterium bovis subsp bovis AF2122/97
gcccgauggugccgacc

SEQ ID NO: 1046836 - RNA, 16 nt, Mycobacterium bovis subsp bovis AF2122/97
gcccacaggcggcgcu

SEQ ID NO: 1046837 - RNA, 18 nt, Mycobacterium bovis subsp bovis AF2122/97
gcccacacggucgucgcg

SEQ ID NO: 1046838 - RNA, 22 nt, Mycobacterium bovis subsp bovis AF2122/97
gcccacacggucgucgcgagcg

SEQ ID NO: 1046839 - RNA, 24 nt, Mycobacterium bovis subsp bovis AF2122/97
gcccacacggucgucgcgagcgga

SEQ ID NO: 1046840 - RNA, 14 nt, Mycobacterium bovis subsp bovis AF2122/97
gcccacacuaggcc

SEQ ID NO: 1046841 - RNA, 22 nt, Mycobacterium bovis subsp bovis AF2122/97
gcccacagcugacgagccggug

SEQ ID NO: 1046842 - RNA, 16 nt, Mycobacterium bovis subsp bovis AF2122/97
gcccacaucgucggcg

SEQ ID NO: 1046843 - RNA, 15 nt, Mycobacterium bovis subsp bovis AF2122/97
gcccaccacacagcc

SEQ ID NO: 1046844 - RNA, 16 nt, Mycobacterium bovis subsp bovis AF2122/97
gcccacaugcgcucgc

SEQ ID NO: 1046845 - RNA, 17 nt, Mycobacterium bovis subsp bovis AF2122/97
gcccacaugcgcucgcg

SEQ ID NO: 1046846 - RNA, 18 nt, Mycobacterium bovis subsp bovis AF2122/97
gcccacaaugacucggcc

SEQ ID NO: 1046847 - RNA, 13 nt, Mycobacterium bovis subsp bovis AF2122/97
gcccacaccagcg

SEQ ID NO: 1046848 - RNA, 17 nt, Mycobacterium bovis subsp bovis AF2122/97
gcccacaccagcgcagc

SEQ ID NO: 1046849 - RNA, 16 nt, Mycobacterium bovis subsp bovis AF2122/97
gcccacacggucgucg

SEQ ID NO: 1046850 - RNA, 20 nt, Mycobacterium bovis subsp bovis AF2122/97
gcccacaaauauccugcggu

SEQ ID NO: 1046851 - RNA, 16 nt, Mycobacterium bovis subsp bovis AF2122/97
gccauggcccgugcgg

SEQ ID NO: 1046852 - RNA, 21 nt, Mycobacterium bovis subsp bovis AF2122/97
gccauggcccgugcgguuguu

SEQ ID NO: 1046853 - RNA, 21 nt, Mycobacterium bovis subsp bovis AF2122/97
gccaugcgcaccaguccagcg

SEQ ID NO: 1046854 - RNA, 20 nt, Mycobacterium bovis subsp bovis AF2122/97
gccaugcuaggaccaccagc

SEQ ID NO: 1046855 - RNA, 14 nt, Mycobacterium bovis subsp bovis AF2122/97
gccaugcggguguc

SEQ ID NO: 1046856 - RNA, 23 nt, Mycobacterium bovis subsp bovis AF2122/97
gccauggaagcagacuccggugu

SEQ ID NO: 1046857 - RNA, 20 nt, Mycobacterium bovis subsp bovis AF2122/97
gccaugcuggucagcggcgc

SEQ ID NO: 1046858 - RNA, 24 nt, Mycobacterium bovis subsp bovis AF2122/97
gccauggcacugccggcacgccga

SEQ ID NO: 1046859 - RNA, 19 nt, Mycobacterium bovis subsp bovis AF2122/97
gccaugcuggucagcggcg

SEQ ID NO: 1046860 - RNA, 13 nt, Mycobacterium bovis subsp bovis AF2122/97
gcccacccgcgcc

SEQ ID NO: 1046861 - RNA, 15 nt, Mycobacterium bovis subsp bovis AF2122/97
gcccaccccggccgc

SEQ ID NO: 1046862 - RNA, 16 nt, Mycobacterium bovis subsp bovis AF2122/97
gcccaccccggccgca

SEQ ID NO: 1046863 - RNA, 18 nt, Mycobacterium bovis subsp bovis AF2122/97
gcccaccccggccgcauc

SEQ ID NO: 1046864 - RNA, 14 nt, Mycobacterium bovis subsp bovis AF2122/97
gcccaccggcgccg

SEQ ID NO: 1046865 - RNA, 15 nt, Mycobacterium bovis subsp bovis AF2122/97
gcccaccggcgccgc

SEQ ID NO: 1046866 - RNA, 19 nt, Mycobacterium bovis subsp bovis AF2122/97
gcccaccggcgccgccggc

SEQ ID NO: 1046867 - RNA, 13 nt, Mycobacterium bovis subsp bovis AF2122/97
gcccaccggccac

SEQ ID NO: 1046868 - RNA, 12 nt, Mycobacterium bovis subsp bovis AF2122/97
gcccacgcgcag

SEQ ID NO: 1046869 - RNA, 13 nt, Mycobacterium bovis subsp bovis AF2122/97
gcccacggcagcg

SEQ ID NO: 1046870 - RNA, 15 nt, Mycobacterium bovis subsp bovis AF2122/97
gcccacggcgaccac

SEQ ID NO: 1046871 - RNA, 15 nt, Mycobacterium bovis subsp bovis AF2122/97
gcccaccgucugcug

SEQ ID NO: 1046872 - RNA, 23 nt, Mycobacterium bovis subsp bovis AF2122/97
gcccaccggucgccgcgaagggg

SEQ ID NO: 1046873 - RNA, 23 nt, Mycobacterium bovis subsp bovis AF2122/97
gcccaccuucaucaacgacacca

SEQ ID NO: 1046874 - RNA, 19 nt, Mycobacterium bovis subsp bovis AF2122/97
gcccaccucgaucgcgccg

SEQ ID NO: 1046875 - RNA, 15 nt, Mycobacterium bovis subsp bovis AF2122/97
gcccacgaucgcguc

SEQ ID NO: 1046876 - RNA, 16 nt, Mycobacterium bovis subsp bovis AF2122/97
gcccagcagcaccugc

SEQ ID NO: 1046877 - RNA, 20 nt, Mycobacterium bovis subsp bovis AF2122/97
gcccagcagcaccugcaccg

SEQ ID NO: 1046878 - RNA, 15 nt, Mycobacterium bovis subsp bovis AF2122/97
gcccagcacgcuggc

SEQ ID NO: 1046879 - RNA, 16 nt, Mycobacterium bovis subsp bovis AF2122/97
gcccagcacgcuggcg

SEQ ID NO: 1046880 - RNA, 16 nt, Mycobacterium bovis subsp bovis AF2122/97
gcccagcagcgcaacc

SEQ ID NO: 1046881 - RNA, 18 nt, Mycobacterium bovis subsp bovis AF2122/97
gcccagcaggucgucggc

SEQ ID NO: 1046882 - RNA, 21 nt, Mycobacterium bovis subsp bovis AF2122/97
gcccagcaucucggcggccaa

SEQ ID NO: 1046883 - RNA, 19 nt, Mycobacterium bovis subsp bovis AF2122/97
gcccagcaggucgucggcg

SEQ ID NO: 1046884 - RNA, 19 nt, Mycobacterium bovis subsp bovis AF2122/97
gcccagcagguuccacggc

SEQ ID NO: 1046885 - RNA, 22 nt, Mycobacterium bovis subsp bovis AF2122/97
gcccagcaucucggcggccaac

SEQ ID NO: 1046886 - RNA, 12 nt, Mycobacterium bovis subsp bovis AF2122/97
gcccagcccggc

SEQ ID NO: 1046887 - RNA, 12 nt, Mycobacterium bovis subsp bovis AF2122/97
gcccagcccgac

SEQ ID NO: 1046888 - RNA, 16 nt, Mycobacterium bovis subsp bovis AF2122/97
gcccagccgagcggcg

SEQ ID NO: 1046889 - RNA, 19 nt, Mycobacterium bovis subsp bovis AF2122/97
gcccagccgagcggcggca

SEQ ID NO: 1046890 - RNA, 21 nt, Mycobacterium bovis subsp bovis AF2122/97
gcccagccgagcggcggcacu

SEQ ID NO: 1046891 - RNA, 15 nt, Mycobacterium bovis subsp bovis AF2122/97
gcccagccgccagcc

SEQ ID NO: 1046892 - RNA, 19 nt, Mycobacterium bovis subsp bovis AF2122/97
gcccagccgagcguggcgu

SEQ ID NO: 1046893 - RNA, 16 nt, Mycobacterium bovis subsp bovis AF2122/97
gcccagccgcagcacc

SEQ ID NO: 1046894 - RNA, 15 nt, Mycobacterium bovis subsp bovis AF2122/97
gcccagccgcgggcc

SEQ ID NO: 1046895 - RNA, 21 nt, Mycobacterium bovis subsp bovis AF2122/97
gcccagaucgguugaucggcc

SEQ ID NO: 1046896 - RNA, 15 nt, Mycobacterium bovis subsp bovis AF2122/97
gcccagaucgccgag

SEQ ID NO: 1046897 - RNA, 17 nt, Mycobacterium bovis subsp bovis AF2122/97
gcccagauagagcuggu

SEQ ID NO: 1046898 - RNA, 15 nt, Mycobacterium bovis subsp bovis AF2122/97
gcccagagccgcugc

SEQ ID NO: 1046899 - RNA, 16 nt, Mycobacterium bovis subsp bovis AF2122/97
gcccagagccgcugcg

SEQ ID NO: 1046900 - RNA, 18 nt, Mycobacterium bovis subsp bovis AF2122/97
gcccagagccgcugcggc

SEQ ID NO: 1046901 - RNA, 22 nt, Mycobacterium bovis subsp bovis AF2122/97
gcccagagccgcugcggcaccg

SEQ ID NO: 1046902 - RNA, 17 nt, Mycobacterium bovis subsp bovis AF2122/97
gcccagcaaccgcucgg

SEQ ID NO: 1046903 - RNA, 18 nt, Mycobacterium bovis subsp bovis AF2122/97
gcccagcaaccgcucggc

SEQ ID NO: 1046904 - RNA, 19 nt, Mycobacterium bovis subsp bovis AF2122/97
gcccagcaaccgcucggcg

SEQ ID NO: 1046905 - RNA, 21 nt, Mycobacterium bovis subsp bovis AF2122/97
gcccagcaaccgcucggcgau

SEQ ID NO: 1046906 - RNA, 16 nt, Mycobacterium bovis subsp bovis AF2122/97
gcccacgggccggccg

SEQ ID NO: 1046907 - RNA, 16 nt, Mycobacterium bovis subsp bovis AF2122/97
gcccacggcgaccacg

SEQ ID NO: 1046908 - RNA, 12 nt, Mycobacterium bovis subsp bovis AF2122/97
gcccacggugcc

SEQ ID NO: 1046909 - RNA, 14 nt, Mycobacterium bovis subsp bovis AF2122/97
gcccacgguguccc

SEQ ID NO: 1046910 - RNA, 16 nt, Mycobacterium bovis subsp bovis AF2122/97
gcccacguugacggcg

SEQ ID NO: 1046911 - RNA, 23 nt, Mycobacterium bovis subsp bovis AF2122/97
gcccacguugacggcgaacccgc

SEQ ID NO: 1046912 - RNA, 22 nt, Mycobacterium bovis subsp bovis AF2122/97
gcccacuagcagggggacccgg

SEQ ID NO: 1046913 - RNA, 24 nt, Mycobacterium bovis subsp bovis AF2122/97
gcccacucacacaaccgacggguc

SEQ ID NO: 1046914 - RNA, 15 nt, Mycobacterium bovis subsp bovis AF2122/97
gcccacuccagcagc

SEQ ID NO: 1046915 - RNA, 21 nt, Mycobacterium bovis subsp bovis AF2122/97
gcccacucucgccacgccgug

SEQ ID NO: 1046916 - RNA, 18 nt, Mycobacterium bovis subsp bovis AF2122/97
gcccacggugucccgcga

SEQ ID NO: 1046917 - RNA, 23 nt, Mycobacterium bovis subsp bovis AF2122/97
gcccagaaaaccgccgcaaccgc

SEQ ID NO: 1046918 - RNA, 15 nt, Mycobacterium bovis subsp bovis AF2122/97
gccaggagccgauca

SEQ ID NO: 1046919 - RNA, 17 nt, Mycobacterium bovis subsp bovis AF2122/97
gccaggacgacgccgac

SEQ ID NO: 1046920 - RNA, 17 nt, Mycobacterium bovis subsp bovis AF2122/97
gccaggaacucggccca

SEQ ID NO: 1046921 - RNA, 23 nt, Mycobacterium bovis subsp bovis AF2122/97
gccaggaaucccucggccgcagg

SEQ ID NO: 1046922 - RNA, 15 nt, Mycobacterium bovis subsp bovis AF2122/97
gccaggaagcggugg

SEQ ID NO: 1046923 - RNA, 15 nt, Mycobacterium bovis subsp bovis AF2122/97
gccaggaagucccgg

SEQ ID NO: 1046924 - RNA, 13 nt, Mycobacterium bovis subsp bovis AF2122/97
gccaggaccgcgc

SEQ ID NO: 1046925 - RNA, 14 nt, Mycobacterium bovis subsp bovis AF2122/97
gccaggaccgcgcc

SEQ ID NO: 1046926 - RNA, 16 nt, Mycobacterium bovis subsp bovis AF2122/97
gccaggaccgcgccga

SEQ ID NO: 1046927 - RNA, 17 nt, Mycobacterium bovis subsp bovis AF2122/97
gccaggaccgcgccgau

SEQ ID NO: 1046928 - RNA, 17 nt, Mycobacterium bovis subsp bovis AF2122/97
gccaggacauucccgag

SEQ ID NO: 1046929 - RNA, 17 nt, Mycobacterium bovis subsp bovis AF2122/97
gccagucgccgaaaggg

SEQ ID NO: 1046930 - RNA, 17 nt, Mycobacterium bovis subsp bovis AF2122/97
gccagucgagcaccugc

SEQ ID NO: 1046931 - RNA, 14 nt, Mycobacterium bovis subsp bovis AF2122/97
gccagucgaucgcg

SEQ ID NO: 1046932 - RNA, 14 nt, Mycobacterium bovis subsp bovis AF2122/97
gccaguacgucgau

SEQ ID NO: 1046933 - RNA, 12 nt, Mycobacterium bovis subsp bovis AF2122/97
gccagucgccga

SEQ ID NO: 1046934 - RNA, 12 nt, Mycobacterium bovis subsp bovis AF2122/97
gccaguacgucg

SEQ ID NO: 1046935 - RNA, 16 nt, Mycobacterium bovis subsp bovis AF2122/97
gccagucgaaucguca

SEQ ID NO: 1046936 - RNA, 17 nt, Mycobacterium bovis subsp bovis AF2122/97
gccagguugccgucggc

SEQ ID NO: 1046937 - RNA, 22 nt, Mycobacterium bovis subsp bovis AF2122/97
gccagguugugugacagcccgc

SEQ ID NO: 1046938 - RNA, 16 nt, Mycobacterium bovis subsp bovis AF2122/97
gccagguuuugccgcg

SEQ ID NO: 1046939 - RNA, 22 nt, Mycobacterium bovis subsp bovis AF2122/97
gccagugccaccugggcgggcu

SEQ ID NO: 1046940 - RNA, 23 nt, Mycobacterium bovis subsp bovis AF2122/97
gccagugcccgcacugccgccgg

SEQ ID NO: 1046941 - RNA, 14 nt, Mycobacterium bovis subsp bovis AF2122/97
gccagugccgccca

SEQ ID NO: 1046942 - RNA, 19 nt, Mycobacterium bovis subsp bovis AF2122/97
gccagugccgcccaccaca

SEQ ID NO: 1046943 - RNA, 13 nt, Mycobacterium bovis subsp bovis AF2122/97
gccagugcgcagc

SEQ ID NO: 1046944 - RNA, 18 nt, Mycobacterium bovis subsp bovis AF2122/97
gccagugaaaccaccggc

SEQ ID NO: 1046945 - RNA, 19 nt, Mycobacterium bovis subsp bovis AF2122/97
gccagugaaaccaccggcc

SEQ ID NO: 1046946 - RNA, 20 nt, Mycobacterium bovis subsp bovis AF2122/97
gccagugacaaccguuguac

SEQ ID NO: 1046947 - RNA, 17 nt, Mycobacterium bovis subsp bovis AF2122/97
gccagugacucaccgug

SEQ ID NO: 1046948 - RNA, 16 nt, Mycobacterium bovis subsp bovis AF2122/97
gccagugaggaucaug

SEQ ID NO: 1046949 - RNA, 12 nt, Mycobacterium bovis subsp bovis AF2122/97
gccagugggccg

SEQ ID NO: 1046950 - RNA, 12 nt, Mycobacterium bovis subsp bovis AF2122/97
gccagugcgcgc

SEQ ID NO: 1046951 - RNA, 22 nt, Mycobacterium bovis subsp bovis AF2122/97
gccagugcucgcaaucguuggc

SEQ ID NO: 1046952 - RNA, 19 nt, Mycobacterium bovis subsp bovis AF2122/97
gccaguggccaccaucacc

SEQ ID NO: 1046953 - RNA, 17 nt, Mycobacterium bovis subsp bovis AF2122/97
gccagugcugcaccgau

SEQ ID NO: 1046954 - RNA, 17 nt, Mycobacterium bovis subsp bovis AF2122/97
gccagugucagcacgac

SEQ ID NO: 1046955 - RNA, 23 nt, Mycobacterium bovis subsp bovis AF2122/97
gccaguggucgauuucggcgcgu

SEQ ID NO: 1046956 - RNA, 18 nt, Mycobacterium bovis subsp bovis AF2122/97
gccaguggugcaccgauu

SEQ ID NO: 1046957 - RNA, 17 nt, Mycobacterium bovis subsp bovis AF2122/97
gccaguguugcgcugcg

SEQ ID NO: 1046958 - RNA, 14 nt, Mycobacterium bovis subsp bovis AF2122/97
gccaguucggcggc

SEQ ID NO: 1046959 - RNA, 20 nt, Mycobacterium bovis subsp bovis AF2122/97
gccaguucggcggccgccgc

SEQ ID NO: 1046960 - RNA, 22 nt, Mycobacterium bovis subsp bovis AF2122/97
gccaguucggcggccgccgcgu

SEQ ID NO: 1046961 - RNA, 19 nt, Mycobacterium bovis subsp bovis AF2122/97
gccaguugcacaucggugg

SEQ ID NO: 1046962 - RNA, 22 nt, Mycobacterium bovis subsp bovis AF2122/97
gccaguugaucaggccgaugcg

SEQ ID NO: 1046963 - RNA, 23 nt, Mycobacterium bovis subsp bovis AF2122/97
gccaguuugggauccuggccgau

SEQ ID NO: 1046964 - RNA, 15 nt, Mycobacterium bovis subsp bovis AF2122/97
gccaugccgcucggc

SEQ ID NO: 1046965 - RNA, 19 nt, Mycobacterium bovis subsp bovis AF2122/97
gccaugcccgcacgcucgg

SEQ ID NO: 1046966 - RNA, 22 nt, Mycobacterium bovis subsp bovis AF2122/97
gccaugcccgcacgcucggcgg

SEQ ID NO: 1046967 - RNA, 16 nt, Mycobacterium bovis subsp bovis AF2122/97
gccaugccaagcucca

SEQ ID NO: 1046968 - RNA, 19 nt, Mycobacterium bovis subsp bovis AF2122/97
gccaugccacaacgccucg

SEQ ID NO: 1046969 - RNA, 16 nt, Mycobacterium bovis subsp bovis AF2122/97
gccaugcccucggcgc

SEQ ID NO: 1046970 - RNA, 15 nt, Mycobacterium bovis subsp bovis AF2122/97
gccaucgagggcauc

SEQ ID NO: 1046971 - RNA, 13 nt, Mycobacterium bovis subsp bovis AF2122/97
gccaucgaggucg

SEQ ID NO: 1046972 - RNA, 19 nt, Mycobacterium bovis subsp bovis AF2122/97
gccaucgucaggaaccacc

SEQ ID NO: 1046973 - RNA, 21 nt, Mycobacterium bovis subsp bovis AF2122/97
gccaucgucaggaaccaccca

SEQ ID NO: 1046974 - RNA, 20 nt, Mycobacterium bovis subsp bovis AF2122/97
gccaucgggcgcgguaacca

SEQ ID NO: 1046975 - RNA, 20 nt, Mycobacterium bovis subsp bovis AF2122/97
gccaucggugcgcacggcgg

SEQ ID NO: 1046976 - RNA, 21 nt, Mycobacterium bovis subsp bovis AF2122/97
gccaucggugcgcacggcggc

SEQ ID NO: 1046977 - RNA, 22 nt, Mycobacterium bovis subsp bovis AF2122/97
gccaucggugcgcacggcggcc

SEQ ID NO: 1046978 - RNA, 17 nt, Mycobacterium bovis subsp bovis AF2122/97
gccaucggugguggcgu

SEQ ID NO: 1046979 - RNA, 21 nt, Mycobacterium bovis subsp bovis AF2122/97
gccaucgguugacccggcagc

SEQ ID NO: 1046980 - RNA, 24 nt, Mycobacterium bovis subsp bovis AF2122/97
gccaucgugguuuggaccgcugau

SEQ ID NO: 1046981 - RNA, 19 nt, Mycobacterium bovis subsp bovis AF2122/97
gccaucguuucacccgggc

SEQ ID NO: 1046982 - RNA, 13 nt, Mycobacterium bovis subsp bovis AF2122/97
gccaucgugcggc

SEQ ID NO: 1046983 - RNA, 16 nt, Mycobacterium bovis subsp bovis AF2122/97
gccaucgucgcgccgc

SEQ ID NO: 1046984 - RNA, 18 nt, Mycobacterium bovis subsp bovis AF2122/97
gccaucugauccggugcc

SEQ ID NO: 1046985 - RNA, 16 nt, Mycobacterium bovis subsp bovis AF2122/97
gccaucugccugccug

SEQ ID NO: 1046986 - RNA, 19 nt, Mycobacterium bovis subsp bovis AF2122/97
gccaucugccugccugcgg

SEQ ID NO: 1046987 - RNA, 20 nt, Mycobacterium bovis subsp bovis AF2122/97
gccauccuuaugcgcgguga

SEQ ID NO: 1046988 - RNA, 22 nt, Mycobacterium bovis subsp bovis AF2122/97
gccauccuuaugcgcggugacc

SEQ ID NO: 1046989 - RNA, 15 nt, Mycobacterium bovis subsp bovis AF2122/97
gccauccucgagcug

SEQ ID NO: 1046990 - RNA, 13 nt, Mycobacterium bovis subsp bovis AF2122/97
gccauccggcggc

SEQ ID NO: 1046991 - RNA, 22 nt, Mycobacterium bovis subsp bovis AF2122/97
gccauccgugaaucgagcaccg

SEQ ID NO: 1046992 - RNA, 23 nt, Mycobacterium bovis subsp bovis AF2122/97
gccauccggucggucucggcgag

SEQ ID NO: 1046993 - RNA, 14 nt, Mycobacterium bovis subsp bovis AF2122/97
gccauacgcgcgcg

SEQ ID NO: 1046994 - RNA, 14 nt, Mycobacterium bovis subsp bovis AF2122/97
gccauaccggccgc

SEQ ID NO: 1046995 - RNA, 19 nt, Mycobacterium bovis subsp bovis AF2122/97
gccauaccggccgccauca

SEQ ID NO: 1046996 - RNA, 15 nt, Mycobacterium bovis subsp bovis AF2122/97
gccauaccucggcga

SEQ ID NO: 1046997 - RNA, 16 nt, Mycobacterium bovis subsp bovis AF2122/97
gccauaccucggcgac

SEQ ID NO: 1046998 - RNA, 14 nt, Mycobacterium bovis subsp bovis AF2122/97
gccauccgauggcc

SEQ ID NO: 1046999 - RNA, 20 nt, Mycobacterium bovis subsp bovis AF2122/97
gccauaaaugcgcguucgac

SEQ ID NO: 1047000 - RNA, 21 nt, Mycobacterium bovis subsp bovis AF2122/97
gccauaauauugccgccuccg

SEQ ID NO: 1047001 - RNA, 21 nt, Mycobacterium bovis subsp bovis AF2122/97
gccauaauucgcccgcucgcg

SEQ ID NO: 1047002 - RNA, 13 nt, Mycobacterium bovis subsp bovis AF2122/97
gccagcaggccga

SEQ ID NO: 1047003 - RNA, 19 nt, Mycobacterium bovis subsp bovis AF2122/97
gccagcaggaacgccgugc

SEQ ID NO: 1047004 - RNA, 16 nt, Mycobacterium bovis subsp bovis AF2122/97
gccagcaggccgaaga

SEQ ID NO: 1047005 - RNA, 18 nt, Mycobacterium bovis subsp bovis AF2122/97
gccagcccguugcaggac

SEQ ID NO: 1047006 - RNA, 20 nt, Mycobacterium bovis subsp bovis AF2122/97
gccagcccgucaucgcguaa

SEQ ID NO: 1047007 - RNA, 22 nt, Mycobacterium bovis subsp bovis AF2122/97
gccagcccguccggcccccgag

SEQ ID NO: 1047008 - RNA, 15 nt, Mycobacterium bovis subsp bovis AF2122/97
gccagcccgcccaga

SEQ ID NO: 1047009 - RNA, 15 nt, Mycobacterium bovis subsp bovis AF2122/97
gccagcccgagcucg

SEQ ID NO: 1047010 - RNA, 17 nt, Mycobacterium bovis subsp bovis AF2122/97
gccagcagccguucacu

SEQ ID NO: 1047011 - RNA, 14 nt, Mycobacterium bovis subsp bovis AF2122/97
gccagcagccgcga

SEQ ID NO: 1047012 - RNA, 15 nt, Mycobacterium bovis subsp bovis AF2122/97
gccagcagccgcgac

SEQ ID NO: 1047013 - RNA, 16 nt, Mycobacterium bovis subsp bovis AF2122/97
gccagcagccgcgaca

SEQ ID NO: 1047014 - RNA, 23 nt, Mycobacterium bovis subsp bovis AF2122/97
gccagcagcaaccgccaucgucg

SEQ ID NO: 1047015 - RNA, 14 nt, Mycobacterium bovis subsp bovis AF2122/97
gccagcagcggcga

SEQ ID NO: 1047016 - RNA, 16 nt, Mycobacterium bovis subsp bovis AF2122/97
gccagcagcggcgagc

SEQ ID NO: 1047017 - RNA, 13 nt, Mycobacterium bovis subsp bovis AF2122/97
gccagcagcggcu

SEQ ID NO: 1047018 - RNA, 13 nt, Mycobacterium bovis subsp bovis AF2122/97
gccagccggcgca

SEQ ID NO: 1047019 - RNA, 14 nt, Mycobacterium bovis subsp bovis AF2122/97
gccagccggcgcac

SEQ ID NO: 1047020 - RNA, 16 nt, Mycobacterium bovis subsp bovis AF2122/97
gccagccgucaccgcg

SEQ ID NO: 1047021 - RNA, 18 nt, Mycobacterium bovis subsp bovis AF2122/97
gccagccgucaccgcgac

SEQ ID NO: 1047022 - RNA, 21 nt, Mycobacterium bovis subsp bovis AF2122/97
gccagccgucaccgcgacccc

SEQ ID NO: 1047023 - RNA, 23 nt, Mycobacterium bovis subsp bovis AF2122/97
gccagccgucgucagguggccaa

SEQ ID NO: 1047024 - RNA, 20 nt, Mycobacterium bovis subsp bovis AF2122/97
gccagccucaucugaggcuu

SEQ ID NO: 1047025 - RNA, 21 nt, Mycobacterium bovis subsp bovis AF2122/97
gccagccguuuuccugaucgc

SEQ ID NO: 1047026 - RNA, 14 nt, Mycobacterium bovis subsp bovis AF2122/97
gccagcgcacgaua

SEQ ID NO: 1047027 - RNA, 15 nt, Mycobacterium bovis subsp bovis AF2122/97
gccagcgcagcaccg

SEQ ID NO: 1047028 - RNA, 19 nt, Mycobacterium bovis subsp bovis AF2122/97
gccagcgcaagguugccaa

SEQ ID NO: 1047029 - RNA, 16 nt, Mycobacterium bovis subsp bovis AF2122/97
gccagcgcaccgccga

SEQ ID NO: 1047030 - RNA, 18 nt, Mycobacterium bovis subsp bovis AF2122/97
gccagcgauaucggcggc

SEQ ID NO: 1047031 - RNA, 22 nt, Mycobacterium bovis subsp bovis AF2122/97
gccagcgaugugaaccgggcac

SEQ ID NO: 1047032 - RNA, 11 nt, Mycobacterium bovis subsp bovis AF2122/97
gccagcgcccc

SEQ ID NO: 1047033 - RNA, 14 nt, Mycobacterium bovis subsp bovis AF2122/97
gccagcgccacugg

SEQ ID NO: 1047034 - RNA, 13 nt, Mycobacterium bovis subsp bovis AF2122/97
gccaggaacccgu

SEQ ID NO: 1047035 - RNA, 15 nt, Mycobacterium bovis subsp bovis AF2122/97
gccaggaacccgugg

SEQ ID NO: 1047036 - RNA, 20 nt, Mycobacterium bovis subsp bovis AF2122/97
gccagcuugucgggcaccgg

SEQ ID NO: 1047037 - RNA, 21 nt, Mycobacterium bovis subsp bovis AF2122/97
gccagcuugucgggcaccggu

SEQ ID NO: 1047038 - RNA, 12 nt, Mycobacterium bovis subsp bovis AF2122/97
gccaggaaccgc

SEQ ID NO: 1047039 - RNA, 22 nt, Mycobacterium bovis subsp bovis AF2122/97
gccagcuugagguccgucgcgc

SEQ ID NO: 1047040 - RNA, 16 nt, Mycobacterium bovis subsp bovis AF2122/97
gccagcuugcggagcc

SEQ ID NO: 1047041 - RNA, 13 nt, Mycobacterium bovis subsp bovis AF2122/97
gccagcugcggcu

SEQ ID NO: 1047042 - RNA, 15 nt, Mycobacterium bovis subsp bovis AF2122/97
gccagcugcgcagcg

SEQ ID NO: 1047043 - RNA, 17 nt, Mycobacterium bovis subsp bovis AF2122/97
gccagcugggcagccag

SEQ ID NO: 1047044 - RNA, 16 nt, Mycobacterium bovis subsp bovis AF2122/97
gccagcuggacuccgg

SEQ ID NO: 1047045 - RNA, 15 nt, Mycobacterium bovis subsp bovis AF2122/97
gccagcugcuccacc

SEQ ID NO: 1047046 - RNA, 18 nt, Mycobacterium bovis subsp bovis AF2122/97
gccagcuuagccgcagcu

SEQ ID NO: 1047047 - RNA, 15 nt, Mycobacterium bovis subsp bovis AF2122/97
gccagcugaacacga

SEQ ID NO: 1047048 - RNA, 15 nt, Mycobacterium bovis subsp bovis AF2122/97
gccagcugcagcaga

SEQ ID NO: 1047049 - RNA, 19 nt, Mycobacterium bovis subsp bovis AF2122/97
gccagcuccgugacaccgg

SEQ ID NO: 1047050 - RNA, 15 nt, Mycobacterium bovis subsp bovis AF2122/97
gccagcuccucagcc

SEQ ID NO: 1047051 - RNA, 23 nt, Mycobacterium bovis subsp bovis AF2122/97
gccagcucccgggcggcggccug

SEQ ID NO: 1047052 - RNA, 22 nt, Mycobacterium bovis subsp bovis AF2122/97
gccagcguuaggucgccggcug

SEQ ID NO: 1047053 - RNA, 12 nt, Mycobacterium bovis subsp bovis AF2122/97
gccagcguuggc

SEQ ID NO: 1047054 - RNA, 16 nt, Mycobacterium bovis subsp bovis AF2122/97
gccagcguuggcggcg

SEQ ID NO: 1047055 - RNA, 15 nt, Mycobacterium bovis subsp bovis AF2122/97
gccagcgggaacaca

SEQ ID NO: 1047056 - RNA, 18 nt, Mycobacterium bovis subsp bovis AF2122/97
gccagcgggaacacaccg

SEQ ID NO: 1047057 - RNA, 22 nt, Mycobacterium bovis subsp bovis AF2122/97
gccagcgggugaaucgacaccg

SEQ ID NO: 1047058 - RNA, 21 nt, Mycobacterium bovis subsp bovis AF2122/97
gccagcgguaaugccagcggc

SEQ ID NO: 1047059 - RNA, 20 nt, Mycobacterium bovis subsp bovis AF2122/97
gccagcgguaaugccagcgg

SEQ ID NO: 1047060 - RNA, 19 nt, Mycobacterium bovis subsp bovis AF2122/97
gccagcgggcuguaggcga

SEQ ID NO: 1047061 - RNA, 21 nt, Mycobacterium bovis subsp bovis AF2122/97
gccagcgguagcugcccagcg

SEQ ID NO: 1047062 - RNA, 19 nt, Mycobacterium bovis subsp bovis AF2122/97
gccagcgcgcgcgggugca

SEQ ID NO: 1047063 - RNA, 12 nt, Mycobacterium bovis subsp bovis AF2122/97
gccagcgggaac

SEQ ID NO: 1047064 - RNA, 13 nt, Mycobacterium bovis subsp bovis AF2122/97
gccagcgcccgca

SEQ ID NO: 1047065 - RNA, 16 nt, Mycobacterium bovis subsp bovis AF2122/97
gccagcgccgccaccg

SEQ ID NO: 1047066 - RNA, 13 nt, Mycobacterium bovis subsp bovis AF2122/97
gccagcgccgccg

SEQ ID NO: 1047067 - RNA, 15 nt, Mycobacterium bovis subsp bovis AF2122/97
gccagcgccgccgag

SEQ ID NO: 1047068 - RNA, 19 nt, Mycobacterium bovis subsp bovis AF2122/97
gccagcgccgccgaggucg

SEQ ID NO: 1047069 - RNA, 14 nt, Mycobacterium bovis subsp bovis AF2122/97
gccagcgccgccgc

SEQ ID NO: 1047070 - RNA, 15 nt, Mycobacterium bovis subsp bovis AF2122/97
gccagcgccgccgcc

SEQ ID NO: 1047071 - RNA, 16 nt, Mycobacterium bovis subsp bovis AF2122/97
gccagcgccgccggcg

SEQ ID NO: 1047072 - RNA, 18 nt, Mycobacterium bovis subsp bovis AF2122/97
gccagcgccgccggcgcc

SEQ ID NO: 1047073 - RNA, 20 nt, Mycobacterium bovis subsp bovis AF2122/97
gccagcgccgccggcgccgg

SEQ ID NO: 1047074 - RNA, 19 nt, Mycobacterium bovis subsp bovis AF2122/97
gccagcgcgcccgcggccg

SEQ ID NO: 1047075 - RNA, 13 nt, Mycobacterium bovis subsp bovis AF2122/97
gccagcagcagcg

SEQ ID NO: 1047076 - RNA, 19 nt, Mycobacterium bovis subsp bovis AF2122/97
gccagcagauuaccgagcu

SEQ ID NO: 1047077 - RNA, 16 nt, Mycobacterium bovis subsp bovis AF2122/97
gccagcagcaaccgcc

SEQ ID NO: 1047078 - RNA, 14 nt, Mycobacterium bovis subsp bovis AF2122/97
gccagcagcagcgc

SEQ ID NO: 1047079 - RNA, 18 nt, Mycobacterium bovis subsp bovis AF2122/97
gccagcagcagcgccgcg

SEQ ID NO: 1047080 - RNA, 21 nt, Mycobacterium bovis subsp bovis AF2122/97
gccagcaccuagucgcggccg

SEQ ID NO: 1047081 - RNA, 14 nt, Mycobacterium bovis subsp bovis AF2122/97
gccagcacggcgac

SEQ ID NO: 1047082 - RNA, 21 nt, Mycobacterium bovis subsp bovis AF2122/97
gccagcacuccaccgcuggcc

SEQ ID NO: 1047083 - RNA, 19 nt, Mycobacterium bovis subsp bovis AF2122/97
gccagcagaucuccggggc

SEQ ID NO: 1047084 - RNA, 19 nt, Mycobacterium bovis subsp bovis AF2122/97
gccagcagagcggcacgca

SEQ ID NO: 1047085 - RNA, 21 nt, Mycobacterium bovis subsp bovis AF2122/97
gccagcacccgcuccagcucg

SEQ ID NO: 1047086 - RNA, 18 nt, Mycobacterium bovis subsp bovis AF2122/97
gccagcaccucgaccgcc

SEQ ID NO: 1047087 - RNA, 15 nt, Mycobacterium bovis subsp bovis AF2122/97
gccagcacgccgccg

SEQ ID NO: 1047088 - RNA, 24 nt, Mycobacterium bovis subsp bovis AF2122/97
gccagcacgccgccggccgccagc

SEQ ID NO: 1047089 - RNA, 19 nt, Mycobacterium bovis subsp bovis AF2122/97
gccagauagguuccaccgg

SEQ ID NO: 1047090 - RNA, 20 nt, Mycobacterium bovis subsp bovis AF2122/97
gccagauuucugggagccgg

SEQ ID NO: 1047091 - RNA, 20 nt, Mycobacterium bovis subsp bovis AF2122/97
gccagauuugacgacaaacg

SEQ ID NO: 1047092 - RNA, 13 nt, Mycobacterium bovis subsp bovis AF2122/97
gccagcaccagcg

SEQ ID NO: 1047093 - RNA, 19 nt, Mycobacterium bovis subsp bovis AF2122/97
gccagcaacugccgcaccc

SEQ ID NO: 1047094 - RNA, 21 nt, Mycobacterium bovis subsp bovis AF2122/97
gccagcaacugccgcacccgg

SEQ ID NO: 1047095 - RNA, 15 nt, Mycobacterium bovis subsp bovis AF2122/97
gccagcaacgucggu

SEQ ID NO: 1047096 - RNA, 18 nt, Mycobacterium bovis subsp bovis AF2122/97
gccacuugaugccgcacc

SEQ ID NO: 1047097 - RNA, 22 nt, Mycobacterium bovis subsp bovis AF2122/97
gccacuugaugcucgaugcgac

SEQ ID NO: 1047098 - RNA, 20 nt, Mycobacterium bovis subsp bovis AF2122/97
gccacuucccccggguccgc

SEQ ID NO: 1047099 - RNA, 16 nt, Mycobacterium bovis subsp bovis AF2122/97
gccagagucgcccgca

SEQ ID NO: 1047100 - RNA, 16 nt, Mycobacterium bovis subsp bovis AF2122/97
gccagaguuaccaggu

SEQ ID NO: 1047101 - RNA, 18 nt, Mycobacterium bovis subsp bovis AF2122/97
gccagagcggaaaaucac

SEQ ID NO: 1047102 - RNA, 18 nt, Mycobacterium bovis subsp bovis AF2122/97
gccagagccgcgcgccgg

SEQ ID NO: 1047103 - RNA, 20 nt, Mycobacterium bovis subsp bovis AF2122/97
gccagagccgcgcgccgguu

SEQ ID NO: 1047104 - RNA, 12 nt, Mycobacterium bovis subsp bovis AF2122/97
gccacgcccgac

SEQ ID NO: 1047105 - RNA, 14 nt, Mycobacterium bovis subsp bovis AF2122/97
gccacgacaggucg

SEQ ID NO: 1047106 - RNA, 16 nt, Mycobacterium bovis subsp bovis AF2122/97
gccacgcccgacgcca

SEQ ID NO: 1047107 - RNA, 14 nt, Mycobacterium bovis subsp bovis AF2122/97
gccacgccgaugcg

SEQ ID NO: 1047108 - RNA, 23 nt, Mycobacterium bovis subsp bovis AF2122/97
gccacgcucggugcugcgccgau

SEQ ID NO: 1047109 - RNA, 15 nt, Mycobacterium bovis subsp bovis AF2122/97
gccacgccgauggga

SEQ ID NO: 1047110 - RNA, 20 nt, Mycobacterium bovis subsp bovis AF2122/97
gccacggaaguaucgccggc

SEQ ID NO: 1047111 - RNA, 17 nt, Mycobacterium bovis subsp bovis AF2122/97
gccacggaucgcggcgg

SEQ ID NO: 1047112 - RNA, 18 nt, Mycobacterium bovis subsp bovis AF2122/97
gccaccucuaccgguggu

SEQ ID NO: 1047113 - RNA, 14 nt, Mycobacterium bovis subsp bovis AF2122/97
gccaccucggcgcg

SEQ ID NO: 1047114 - RNA, 16 nt, Mycobacterium bovis subsp bovis AF2122/97
gccaccugacaaacgg

SEQ ID NO: 1047115 - RNA, 22 nt, Mycobacterium bovis subsp bovis AF2122/97
gccaccucggugcggaacaccg

SEQ ID NO: 1047116 - RNA, 23 nt, Mycobacterium bovis subsp bovis AF2122/97
gccaccucggugcggaacaccgc

SEQ ID NO: 1047117 - RNA, 13 nt, Mycobacterium bovis subsp bovis AF2122/97
gccaccucgccgg

SEQ ID NO: 1047118 - RNA, 14 nt, Mycobacterium bovis subsp bovis AF2122/97
gccaccucgccggc

SEQ ID NO: 1047119 - RNA, 18 nt, Mycobacterium bovis subsp bovis AF2122/97
gccaccucuucucggaca

SEQ ID NO: 1047120 - RNA, 20 nt, Mycobacterium bovis subsp bovis AF2122/97
gccaccuggucggcaugauc

SEQ ID NO: 1047121 - RNA, 22 nt, Mycobacterium bovis subsp bovis AF2122/97
gccaccuguugcccuugcgcaa

SEQ ID NO: 1047122 - RNA, 19 nt, Mycobacterium bovis subsp bovis AF2122/97
gccaccuuggucuucgccg

SEQ ID NO: 1047123 - RNA, 13 nt, Mycobacterium bovis subsp bovis AF2122/97
gccacgaaucgcc

SEQ ID NO: 1047124 - RNA, 20 nt, Mycobacterium bovis subsp bovis AF2122/97
gccacgaaucgcccaucgca

SEQ ID NO: 1047125 - RNA, 21 nt, Mycobacterium bovis subsp bovis AF2122/97
gccacgaacccucagccgcgc

SEQ ID NO: 1047126 - RNA, 22 nt, Mycobacterium bovis subsp bovis AF2122/97
gccacgaacccucagccgcgcc

SEQ ID NO: 1047127 - RNA, 17 nt, Mycobacterium bovis subsp bovis AF2122/97
gccacgguggcgcaagu

SEQ ID NO: 1047128 - RNA, 16 nt, Mycobacterium bovis subsp bovis AF2122/97
gccacggugucgcgau

SEQ ID NO: 1047129 - RNA, 15 nt, Mycobacterium bovis subsp bovis AF2122/97
gccacggucgccgac

SEQ ID NO: 1047130 - RNA, 23 nt, Mycobacterium bovis subsp bovis AF2122/97
gccacgguucgggcagcacccgc

SEQ ID NO: 1047131 - RNA, 17 nt, Mycobacterium bovis subsp bovis AF2122/97
gccacguacuccaccgc

SEQ ID NO: 1047132 - RNA, 18 nt, Mycobacterium bovis subsp bovis AF2122/97
gccacguacuccaccgcg

SEQ ID NO: 1047133 - RNA, 15 nt, Mycobacterium bovis subsp bovis AF2122/97
gccacgggugacgaa

SEQ ID NO: 1047134 - RNA, 17 nt, Mycobacterium bovis subsp bovis AF2122/97
gccacgggugacgaacc

SEQ ID NO: 1047135 - RNA, 22 nt, Mycobacterium bovis subsp bovis AF2122/97
gccacggguagcugccgcggcc

SEQ ID NO: 1047136 - RNA, 23 nt, Mycobacterium bovis subsp bovis AF2122/97
gccacggguagcugccgcggccg

SEQ ID NO: 1047137 - RNA, 14 nt, Mycobacterium bovis subsp bovis AF2122/97
gccacggucagcca

SEQ ID NO: 1047138 - RNA, 18 nt, Mycobacterium bovis subsp bovis AF2122/97
gccacggucauugggugu

SEQ ID NO: 1047139 - RNA, 16 nt, Mycobacterium bovis subsp bovis AF2122/97
gccacgguccggccca

SEQ ID NO: 1047140 - RNA, 22 nt, Mycobacterium bovis subsp bovis AF2122/97
gccacgguccggcccaccagcg

SEQ ID NO: 1047141 - RNA, 19 nt, Mycobacterium bovis subsp bovis AF2122/97
gccacggggcugccgguga

SEQ ID NO: 1047142 - RNA, 14 nt, Mycobacterium bovis subsp bovis AF2122/97
gccacggcaucggc

SEQ ID NO: 1047143 - RNA, 16 nt, Mycobacterium bovis subsp bovis AF2122/97
gccacggggauuggcg

SEQ ID NO: 1047144 - RNA, 19 nt, Mycobacterium bovis subsp bovis AF2122/97
gccacggggauuggcgacg

SEQ ID NO: 1047145 - RNA, 13 nt, Mycobacterium bovis subsp bovis AF2122/97
gccacggggcagg

SEQ ID NO: 1047146 - RNA, 20 nt, Mycobacterium bovis subsp bovis AF2122/97
gccacggcuuugcggcgcga

SEQ ID NO: 1047147 - RNA, 22 nt, Mycobacterium bovis subsp bovis AF2122/97
gccacggcuuugcggcgcgacc

SEQ ID NO: 1047148 - RNA, 17 nt, Mycobacterium bovis subsp bovis AF2122/97
gccacgggcggccaccg

SEQ ID NO: 1047149 - RNA, 19 nt, Mycobacterium bovis subsp bovis AF2122/97
gccacgggcggccaccgca

SEQ ID NO: 1047150 - RNA, 20 nt, Mycobacterium bovis subsp bovis AF2122/97
gccacgggcggccaccgcac

SEQ ID NO: 1047151 - RNA, 16 nt, Mycobacterium bovis subsp bovis AF2122/97
gccacggcaaucaacg

SEQ ID NO: 1047152 - RNA, 16 nt, Mycobacterium bovis subsp bovis AF2122/97
gccacggcagcgccca

SEQ ID NO: 1047153 - RNA, 18 nt, Mycobacterium bovis subsp bovis AF2122/97
gccacggcagcgcccaga

SEQ ID NO: 1047154 - RNA, 13 nt, Mycobacterium bovis subsp bovis AF2122/97
gccacucggcccg

SEQ ID NO: 1047155 - RNA, 14 nt, Mycobacterium bovis subsp bovis AF2122/97
gccacucgccacuc

SEQ ID NO: 1047156 - RNA, 18 nt, Mycobacterium bovis subsp bovis AF2122/97
gccacucgcccgauccgg

SEQ ID NO: 1047157 - RNA, 21 nt, Mycobacterium bovis subsp bovis AF2122/97
gccacguacuuggacgacccg

SEQ ID NO: 1047158 - RNA, 17 nt, Mycobacterium bovis subsp bovis AF2122/97
gccacucgcccgcugcc

SEQ ID NO: 1047159 - RNA, 21 nt, Mycobacterium bovis subsp bovis AF2122/97
gccacugaccgcgaucgccga

SEQ ID NO: 1047160 - RNA, 15 nt, Mycobacterium bovis subsp bovis AF2122/97
gccacugccguugcc

SEQ ID NO: 1047161 - RNA, 18 nt, Mycobacterium bovis subsp bovis AF2122/97
gccacugccguugccgcc

SEQ ID NO: 1047162 - RNA, 20 nt, Mycobacterium bovis subsp bovis AF2122/97
gccacugccguugccgccgg

SEQ ID NO: 1047163 - RNA, 14 nt, Mycobacterium bovis subsp bovis AF2122/97
gccacuggcgccgg

SEQ ID NO: 1047164 - RNA, 23 nt, Mycobacterium bovis subsp bovis AF2122/97
gccacuggcgccggugccgccgg

SEQ ID NO: 1047165 - RNA, 21 nt, Mycobacterium bovis subsp bovis AF2122/97
gccacugcguuccaucgccga

SEQ ID NO: 1047166 - RNA, 14 nt, Mycobacterium bovis subsp bovis AF2122/97
gccacugcugggcu

SEQ ID NO: 1047167 - RNA, 12 nt, Mycobacterium bovis subsp bovis AF2122/97
gccacugcggca

SEQ ID NO: 1047168 - RNA, 20 nt, Mycobacterium bovis subsp bovis AF2122/97
gccaccaccgcugccggcgc

SEQ ID NO: 1047169 - RNA, 21 nt, Mycobacterium bovis subsp bovis AF2122/97
gccaccaccgcugccggcgcc

SEQ ID NO: 1047170 - RNA, 15 nt, Mycobacterium bovis subsp bovis AF2122/97
gccaccaccggcgcc

SEQ ID NO: 1047171 - RNA, 21 nt, Mycobacterium bovis subsp bovis AF2122/97
gccaccaccggcgccuccggc

SEQ ID NO: 1047172 - RNA, 15 nt, Mycobacterium bovis subsp bovis AF2122/97
gccaccaccgcgccg

SEQ ID NO: 1047173 - RNA, 16 nt, Mycobacterium bovis subsp bovis AF2122/97
gccaccaccccgucga

SEQ ID NO: 1047174 - RNA, 12 nt, Mycobacterium bovis subsp bovis AF2122/97
gccaccaccgcc

SEQ ID NO: 1047175 - RNA, 14 nt, Mycobacterium bovis subsp bovis AF2122/97
gccaccaccgccgc

SEQ ID NO: 1047176 - RNA, 15 nt, Mycobacterium bovis subsp bovis AF2122/97
gccaccaccgccgcc

SEQ ID NO: 1047177 - RNA, 16 nt, Mycobacterium bovis subsp bovis AF2122/97
gccaccaccgccgccg

SEQ ID NO: 1047178 - RNA, 17 nt, Mycobacterium bovis subsp bovis AF2122/97
gccaccaccgccgccgg

SEQ ID NO: 1047179 - RNA, 18 nt, Mycobacterium bovis subsp bovis AF2122/97
gccaccaccgccgccggc

SEQ ID NO: 1047180 - RNA, 14 nt, Mycobacterium bovis subsp bovis AF2122/97
gccaccaccacggc

SEQ ID NO: 1047181 - RNA, 14 nt, Mycobacterium bovis subsp bovis AF2122/97
gccaccaccagggc

SEQ ID NO: 1047182 - RNA, 17 nt, Mycobacterium bovis subsp bovis AF2122/97
gccaccaccacggccag

SEQ ID NO: 1047183 - RNA, 23 nt, Mycobacterium bovis subsp bovis AF2122/97
gccaccaccagggcaacggccgc

SEQ ID NO: 1047184 - RNA, 16 nt, Mycobacterium bovis subsp bovis AF2122/97
gccaccaccuucgggu

SEQ ID NO: 1047185 - RNA, 15 nt, Mycobacterium bovis subsp bovis AF2122/97
gccaccacccggcgc

SEQ ID NO: 1047186 - RNA, 14 nt, Mycobacterium bovis subsp bovis AF2122/97
gccaccacgcgccg

SEQ ID NO: 1047187 - RNA, 20 nt, Mycobacterium bovis subsp bovis AF2122/97
gccaccacggucaagccggc

SEQ ID NO: 1047188 - RNA, 22 nt, Mycobacterium bovis subsp bovis AF2122/97
gccaccacggucaagccggcgc

SEQ ID NO: 1047189 - RNA, 18 nt, Mycobacterium bovis subsp bovis AF2122/97
gccaccagccgguccagc

SEQ ID NO: 1047190 - RNA, 16 nt, Mycobacterium bovis subsp bovis AF2122/97
gccaccagaaccagcg

SEQ ID NO: 1047191 - RNA, 14 nt, Mycobacterium bovis subsp bovis AF2122/97
gccaccagcaccgc

SEQ ID NO: 1047192 - RNA, 16 nt, Mycobacterium bovis subsp bovis AF2122/97
gccaccagcgucgcac

SEQ ID NO: 1047193 - RNA, 20 nt, Mycobacterium bovis subsp bovis AF2122/97
gccaccagcgucgcacgcgc

SEQ ID NO: 1047194 - RNA, 23 nt, Mycobacterium bovis subsp bovis AF2122/97
gccaccagcgucgcacgcgcgca

SEQ ID NO: 1047195 - RNA, 19 nt, Mycobacterium bovis subsp bovis AF2122/97
gccaccagcgcccggcccg

SEQ ID NO: 1047196 - RNA, 13 nt, Mycobacterium bovis subsp bovis AF2122/97
gccaccagcgcga

SEQ ID NO: 1047197 - RNA, 17 nt, Mycobacterium bovis subsp bovis AF2122/97
gccaccagcgcgagccc

SEQ ID NO: 1047198 - RNA, 14 nt, Mycobacterium bovis subsp bovis AF2122/97
gccaccagcggcau

SEQ ID NO: 1047199 - RNA, 20 nt, Mycobacterium bovis subsp bovis AF2122/97
gccacccgcaggucgcacca

SEQ ID NO: 1047200 - RNA, 15 nt, Mycobacterium bovis subsp bovis AF2122/97
gccacccgcagaccg

SEQ ID NO: 1047201 - RNA, 18 nt, Mycobacterium bovis subsp bovis AF2122/97
gccacccgcaggucgcac

SEQ ID NO: 1047202 - RNA, 23 nt, Mycobacterium bovis subsp bovis AF2122/97
gccaccccgcuuggaccguugcc

SEQ ID NO: 1047203 - RNA, 22 nt, Mycobacterium bovis subsp bovis AF2122/97
gccaccccggucggagcggugc

SEQ ID NO: 1047204 - RNA, 19 nt, Mycobacterium bovis subsp bovis AF2122/97
gccacccgacaugcgccga

SEQ ID NO: 1047205 - RNA, 13 nt, Mycobacterium bovis subsp bovis AF2122/97
gccacccgcgcga

SEQ ID NO: 1047206 - RNA, 21 nt, Mycobacterium bovis subsp bovis AF2122/97
gccacccgcggugccugcagc

SEQ ID NO: 1047207 - RNA, 16 nt, Mycobacterium bovis subsp bovis AF2122/97
gccacccggacauagc

SEQ ID NO: 1047208 - RNA, 13 nt, Mycobacterium bovis subsp bovis AF2122/97
gccacccggccag

SEQ ID NO: 1047209 - RNA, 21 nt, Mycobacterium bovis subsp bovis AF2122/97
gccacccagggccuucccgau

SEQ ID NO: 1047210 - RNA, 15 nt, Mycobacterium bovis subsp bovis AF2122/97
gccacccaccgacau

SEQ ID NO: 1047211 - RNA, 12 nt, Mycobacterium bovis subsp bovis AF2122/97
gccacccaucgc

SEQ ID NO: 1047212 - RNA, 15 nt, Mycobacterium bovis subsp bovis AF2122/97
gccaccccgagcuca

SEQ ID NO: 1047213 - RNA, 22 nt, Mycobacterium bovis subsp bovis AF2122/97
gccacccccaaccgccggccag

SEQ ID NO: 1047214 - RNA, 18 nt, Mycobacterium bovis subsp bovis AF2122/97
gccacccccaccgucgcg

SEQ ID NO: 1047215 - RNA, 19 nt, Mycobacterium bovis subsp bovis AF2122/97
gccacccccaccgucgcgg

SEQ ID NO: 1047216 - RNA, 19 nt, Mycobacterium bovis subsp bovis AF2122/97
gccaccccauacgcaccgg

SEQ ID NO: 1047217 - RNA, 20 nt, Mycobacterium bovis subsp bovis AF2122/97
gccacccccaaccgccggcc

SEQ ID NO: 1047218 - RNA, 13 nt, Mycobacterium bovis subsp bovis AF2122/97
gccaccaggcggu

SEQ ID NO: 1047219 - RNA, 17 nt, Mycobacterium bovis subsp bovis AF2122/97
gccaccagggccaccgc

SEQ ID NO: 1047220 - RNA, 20 nt, Mycobacterium bovis subsp bovis AF2122/97
gccaccagggccaccgcgcc

SEQ ID NO: 1047221 - RNA, 17 nt, Mycobacterium bovis subsp bovis AF2122/97
gccaccagggccgcagu

SEQ ID NO: 1047222 - RNA, 19 nt, Mycobacterium bovis subsp bovis AF2122/97
gccaccaggggaccgcggc

SEQ ID NO: 1047223 - RNA, 21 nt, Mycobacterium bovis subsp bovis AF2122/97
gccaccaggggaccgcggcgc

SEQ ID NO: 1047224 - RNA, 20 nt, Mycobacterium bovis subsp bovis AF2122/97
gccaccaucgccgccguugc

SEQ ID NO: 1047225 - RNA, 19 nt, Mycobacterium bovis subsp bovis AF2122/97
gccaccaucgccucggcgc

SEQ ID NO: 1047226 - RNA, 21 nt, Mycobacterium bovis subsp bovis AF2122/97
gccaccaucgccucggcgcug

SEQ ID NO: 1047227 - RNA, 19 nt, Mycobacterium bovis subsp bovis AF2122/97
gccaccaucggggaagggg

SEQ ID NO: 1047228 - RNA, 14 nt, Mycobacterium bovis subsp bovis AF2122/97
gccaccaucgcccc

SEQ ID NO: 1047229 - RNA, 17 nt, Mycobacterium bovis subsp bovis AF2122/97
gccaccaguccgauggg

SEQ ID NO: 1047230 - RNA, 21 nt, Mycobacterium bovis subsp bovis AF2122/97
gccaccgccgccgccaccggc

SEQ ID NO: 1047231 - RNA, 23 nt, Mycobacterium bovis subsp bovis AF2122/97
gccaccgccgccgccaccggcgc

SEQ ID NO: 1047232 - RNA, 14 nt, Mycobacterium bovis subsp bovis AF2122/97
gccaccgccgccgg

SEQ ID NO: 1047233 - RNA, 15 nt, Mycobacterium bovis subsp bovis AF2122/97
gccaccgccgccggu

SEQ ID NO: 1047234 - RNA, 21 nt, Mycobacterium bovis subsp bovis AF2122/97
gccaccgccgccugcccggcc

SEQ ID NO: 1047235 - RNA, 15 nt, Mycobacterium bovis subsp bovis AF2122/97
gccaccgccggcagc

SEQ ID NO: 1047236 - RNA, 18 nt, Mycobacterium bovis subsp bovis AF2122/97
gccaccgcgacggcaggc

SEQ ID NO: 1047237 - RNA, 23 nt, Mycobacterium bovis subsp bovis AF2122/97
gccaccgcgacaccccggaaucc

SEQ ID NO: 1047238 - RNA, 16 nt, Mycobacterium bovis subsp bovis AF2122/97
gccaccgcggucaccg

SEQ ID NO: 1047239 - RNA, 19 nt, Mycobacterium bovis subsp bovis AF2122/97
gccaccgcggucaccgacg

SEQ ID NO: 1047240 - RNA, 19 nt, Mycobacterium bovis subsp bovis AF2122/97
gccaccgcgggcggcaucg

SEQ ID NO: 1047241 - RNA, 22 nt, Mycobacterium bovis subsp bovis AF2122/97
gccaccgcgggcggcaucgccg

SEQ ID NO: 1047242 - RNA, 23 nt, Mycobacterium bovis subsp bovis AF2122/97
gccaccgcgggcggcaucgccga

SEQ ID NO: 1047243 - RNA, 16 nt, Mycobacterium bovis subsp bovis AF2122/97
gccaccgcgggcggca

SEQ ID NO: 1047244 - RNA, 17 nt, Mycobacterium bovis subsp bovis AF2122/97
gccaccgcgggcggcau

SEQ ID NO: 1047245 - RNA, 13 nt, Mycobacterium bovis subsp bovis AF2122/97
gccaccgcggccu

SEQ ID NO: 1047246 - RNA, 12 nt, Mycobacterium bovis subsp bovis AF2122/97
gccaccgcggcg

SEQ ID NO: 1047247 - RNA, 13 nt, Mycobacterium bovis subsp bovis AF2122/97
gccaccgcggcga

SEQ ID NO: 1047248 - RNA, 15 nt, Mycobacterium bovis subsp bovis AF2122/97
gccaccgcggcgauu

SEQ ID NO: 1047249 - RNA, 15 nt, Mycobacterium bovis subsp bovis AF2122/97
gccacccuugccgcc

SEQ ID NO: 1047250 - RNA, 20 nt, Mycobacterium bovis subsp bovis AF2122/97
gccacccuugccgccggugg

SEQ ID NO: 1047251 - RNA, 14 nt, Mycobacterium bovis subsp bovis AF2122/97
gccacccuuggccc

SEQ ID NO: 1047252 - RNA, 21 nt, Mycobacterium bovis subsp bovis AF2122/97
gccaccgaaauugcccuagca

SEQ ID NO: 1047253 - RNA, 16 nt, Mycobacterium bovis subsp bovis AF2122/97
gccaccgaacagucga

SEQ ID NO: 1047254 - RNA, 16 nt, Mycobacterium bovis subsp bovis AF2122/97
gccaccgaacgcaccg

SEQ ID NO: 1047255 - RNA, 18 nt, Mycobacterium bovis subsp bovis AF2122/97
gccaccgaacgcaccgaa

SEQ ID NO: 1047256 - RNA, 21 nt, Mycobacterium bovis subsp bovis AF2122/97
gccaccgagaucaugccggcg

SEQ ID NO: 1047257 - RNA, 13 nt, Mycobacterium bovis subsp bovis AF2122/97
gccaccgaccgca

SEQ ID NO: 1047258 - RNA, 14 nt, Mycobacterium bovis subsp bovis AF2122/97
gccaccgacgacau

SEQ ID NO: 1047259 - RNA, 17 nt, Mycobacterium bovis subsp bovis AF2122/97
gccaccgacgacaucgg

SEQ ID NO: 1047260 - RNA, 13 nt, Mycobacterium bovis subsp bovis AF2122/97
gccaccgauggcg

SEQ ID NO: 1047261 - RNA, 17 nt, Mycobacterium bovis subsp bovis AF2122/97
gccaccgcaacucgccg

SEQ ID NO: 1047262 - RNA, 18 nt, Mycobacterium bovis subsp bovis AF2122/97
gccaccgcaacucgccga

SEQ ID NO: 1047263 - RNA, 18 nt, Mycobacterium bovis subsp bovis AF2122/97
gccaccgcaagaaucagc

SEQ ID NO: 1047264 - RNA, 14 nt, Mycobacterium bovis subsp bovis AF2122/97
gccaccgauaccgu

SEQ ID NO: 1047265 - RNA, 12 nt, Mycobacterium bovis subsp bovis AF2122/97
gccaccgagucg

SEQ ID NO: 1047266 - RNA, 13 nt, Mycobacterium bovis subsp bovis AF2122/97
gccaccgcaucgc

SEQ ID NO: 1047267 - RNA, 21 nt, Mycobacterium bovis subsp bovis AF2122/97
gccaccgcaucgccgaacggg

SEQ ID NO: 1047268 - RNA, 19 nt, Mycobacterium bovis subsp bovis AF2122/97
gccaccgcaagaaucagca

SEQ ID NO: 1047269 - RNA, 17 nt, Mycobacterium bovis subsp bovis AF2122/97
gccaccgcacgcuggcg

SEQ ID NO: 1047270 - RNA, 18 nt, Mycobacterium bovis subsp bovis AF2122/97
gccaccgcacgcuggcgg

SEQ ID NO: 1047271 - RNA, 20 nt, Mycobacterium bovis subsp bovis AF2122/97
gccaccgcacgcuggcgggc

SEQ ID NO: 1047272 - RNA, 22 nt, Mycobacterium bovis subsp bovis AF2122/97
gccaccggggaagaucucggcc

SEQ ID NO: 1047273 - RNA, 15 nt, Mycobacterium bovis subsp bovis AF2122/97
gccaccgggcgugcg

SEQ ID NO: 1047274 - RNA, 17 nt, Mycobacterium bovis subsp bovis AF2122/97
gccaccgggcgugcggc

SEQ ID NO: 1047275 - RNA, 23 nt, Mycobacterium bovis subsp bovis AF2122/97
gccaccggcguuguugaccagca

SEQ ID NO: 1047276 - RNA, 17 nt, Mycobacterium bovis subsp bovis AF2122/97
gccaccggccggcgcag

SEQ ID NO: 1047277 - RNA, 22 nt, Mycobacterium bovis subsp bovis AF2122/97
gccaccggcgcgaccgcggcga

SEQ ID NO: 1047278 - RNA, 19 nt, Mycobacterium bovis subsp bovis AF2122/97
gccaccggcgucgacgucg

SEQ ID NO: 1047279 - RNA, 16 nt, Mycobacterium bovis subsp bovis AF2122/97
gccaccggcgucugcc

SEQ ID NO: 1047280 - RNA, 14 nt, Mycobacterium bovis subsp bovis AF2122/97
gccaccggcgaccg

SEQ ID NO: 1047281 - RNA, 21 nt, Mycobacterium bovis subsp bovis AF2122/97
gccaccggcgccgccgucgcc

SEQ ID NO: 1047282 - RNA, 12 nt, Mycobacterium bovis subsp bovis AF2122/97
gccaccggcgcg

SEQ ID NO: 1047283 - RNA, 17 nt, Mycobacterium bovis subsp bovis AF2122/97
gccaccggcgcgaccgc

SEQ ID NO: 1047284 - RNA, 13 nt, Mycobacterium bovis subsp bovis AF2122/97
gccaccggcgcca

SEQ ID NO: 1047285 - RNA, 22 nt, Mycobacterium bovis subsp bovis AF2122/97
gccaccggcgccaccggcgccg

SEQ ID NO: 1047286 - RNA, 13 nt, Mycobacterium bovis subsp bovis AF2122/97
gccaccggcgccg

SEQ ID NO: 1047287 - RNA, 14 nt, Mycobacterium bovis subsp bovis AF2122/97
gccaccggcgccgc

SEQ ID NO: 1047288 - RNA, 17 nt, Mycobacterium bovis subsp bovis AF2122/97
gccaccggcgccgccgu

SEQ ID NO: 1047289 - RNA, 20 nt, Mycobacterium bovis subsp bovis AF2122/97
gccaccggcgccgccgucgc

SEQ ID NO: 1047290 - RNA, 19 nt, Mycobacterium bovis subsp bovis AF2122/97
gccaccggaggugcgccgc

SEQ ID NO: 1047291 - RNA, 18 nt, Mycobacterium bovis subsp bovis AF2122/97
gccaccggcaaucggcgg

SEQ ID NO: 1047292 - RNA, 23 nt, Mycobacterium bovis subsp bovis AF2122/97
gccaccggcaaucggcggcaccc

SEQ ID NO: 1047293 - RNA, 14 nt, Mycobacterium bovis subsp bovis AF2122/97
gccaccggcaccgc

SEQ ID NO: 1047294 - RNA, 16 nt, Mycobacterium bovis subsp bovis AF2122/97
gccaccgcuugacccc

SEQ ID NO: 1047295 - RNA, 19 nt, Mycobacterium bovis subsp bovis AF2122/97
gccaccgcugccggcacgc

SEQ ID NO: 1047296 - RNA, 20 nt, Mycobacterium bovis subsp bovis AF2122/97
gccaccgcugccggcacgca

SEQ ID NO: 1047297 - RNA, 19 nt, Mycobacterium bovis subsp bovis AF2122/97
gccaccgcgguggcggcga

SEQ ID NO: 1047298 - RNA, 17 nt, Mycobacterium bovis subsp bovis AF2122/97
gccaccgcugccggcac

SEQ ID NO: 1047299 - RNA, 23 nt, Mycobacterium bovis subsp bovis AF2122/97
gccaccuccgaggccgccaucgc

SEQ ID NO: 1047300 - RNA, 17 nt, Mycobacterium bovis subsp bovis AF2122/97
gccaccucccacgccgc

SEQ ID NO: 1047301 - RNA, 23 nt, Mycobacterium bovis subsp bovis AF2122/97
gccaccucccacgccgccguugc

SEQ ID NO: 1047302 - RNA, 20 nt, Mycobacterium bovis subsp bovis AF2122/97
gccaccucccagggcucggc

SEQ ID NO: 1047303 - RNA, 23 nt, Mycobacterium bovis subsp bovis AF2122/97
gccaccucccagggcucggcggc

SEQ ID NO: 1047304 - RNA, 15 nt, Mycobacterium bovis subsp bovis AF2122/97
gccaccuccgacggg

SEQ ID NO: 1047305 - RNA, 18 nt, Mycobacterium bovis subsp bovis AF2122/97
gccaccguuugcgcaccg

SEQ ID NO: 1047306 - RNA, 14 nt, Mycobacterium bovis subsp bovis AF2122/97
gccaccuacgaagc

SEQ ID NO: 1047307 - RNA, 15 nt, Mycobacterium bovis subsp bovis AF2122/97
gccaccucaucgcca

SEQ ID NO: 1047308 - RNA, 17 nt, Mycobacterium bovis subsp bovis AF2122/97
gccaccguuaccgccgu

SEQ ID NO: 1047309 - RNA, 22 nt, Mycobacterium bovis subsp bovis AF2122/97
gccaccguugccgccguugccg

SEQ ID NO: 1047310 - RNA, 15 nt, Mycobacterium bovis subsp bovis AF2122/97
gccaccggcuggugc

SEQ ID NO: 1047311 - RNA, 17 nt, Mycobacterium bovis subsp bovis AF2122/97
gccaccgucgcggcggc

SEQ ID NO: 1047312 - RNA, 19 nt, Mycobacterium bovis subsp bovis AF2122/97
gccaccgucgcggcggcac

SEQ ID NO: 1047313 - RNA, 23 nt, Mycobacterium bovis subsp bovis AF2122/97
gccaccgugguggacgaccgcgc

SEQ ID NO: 1047314 - RNA, 20 nt, Mycobacterium bovis subsp bovis AF2122/97
gccaccgugucacgcgacca

SEQ ID NO: 1047315 - RNA, 13 nt, Mycobacterium bovis subsp bovis AF2122/97
gccaccgucgcgg

SEQ ID NO: 1047316 - RNA, 16 nt, Mycobacterium bovis subsp bovis AF2122/97
gccaccgucaugccga

SEQ ID NO: 1047317 - RNA, 18 nt, Mycobacterium bovis subsp bovis AF2122/97
gccaccgguaccgccggc

SEQ ID NO: 1047318 - RNA, 16 nt, Mycobacterium bovis subsp bovis AF2122/97
gccaccguagccagca

SEQ ID NO: 1047319 - RNA, 22 nt, Mycobacterium bovis subsp bovis AF2122/97
gccaccgucaccgccgucaccg

SEQ ID NO: 1047320 - RNA, 18 nt, Mycobacterium bovis subsp bovis AF2122/97
gccaccgucagcgcgacc

SEQ ID NO: 1047321 - RNA, 19 nt, Mycobacterium bovis subsp bovis AF2122/97
gccaccgucagcgcgaccg

SEQ ID NO: 1047322 - RNA, 21 nt, Mycobacterium bovis subsp bovis AF2122/97
gccaccgucagcgcgaccguc

SEQ ID NO: 1047323 - RNA, 19 nt, Mycobacterium bovis subsp bovis AF2122/97
gccaccgguaccgaucagc

SEQ ID NO: 1047324 - RNA, 20 nt, Mycobacterium bovis subsp bovis AF2122/97
gccaccggguucaccgaggu

SEQ ID NO: 1047325 - RNA, 22 nt, Mycobacterium bovis subsp bovis AF2122/97
gccaccgguaccgccggcuccg

SEQ ID NO: 1047326 - RNA, 16 nt, Mycobacterium bovis subsp bovis AF2122/97
gccaccgguaccggcg

SEQ ID NO: 1047327 - RNA, 18 nt, Mycobacterium bovis subsp bovis AF2122/97
gccaccgguaccggcgac

SEQ ID NO: 1047328 - RNA, 24 nt, Mycobacterium bovis subsp bovis AF2122/97
gccaccgguuuggagcucaucgac

SEQ ID NO: 1047329 - RNA, 18 nt, Mycobacterium bovis subsp bovis AF2122/97
gccaccggugccggcgac

SEQ ID NO: 1047330 - RNA, 16 nt, Mycobacterium bovis subsp bovis AF2122/97
gccaccaacucggcga

SEQ ID NO: 1047331 - RNA, 22 nt, Mycobacterium bovis subsp bovis AF2122/97
gccaccaaccucaucgcggucg

SEQ ID NO: 1047332 - RNA, 19 nt, Mycobacterium bovis subsp bovis AF2122/97
gccacauuucaccaccgug

SEQ ID NO: 1047333 - RNA, 21 nt, Mycobacterium bovis subsp bovis AF2122/97
gccacauuucaccaccguggc

SEQ ID NO: 1047334 - RNA, 17 nt, Mycobacterium bovis subsp bovis AF2122/97
gccaccacaucgcgggc

SEQ ID NO: 1047335 - RNA, 18 nt, Mycobacterium bovis subsp bovis AF2122/97
gccaccacaugcgagucg

SEQ ID NO: 1047336 - RNA, 10 nt, Mycobacterium bovis subsp bovis AF2122/97
gccaccacca

SEQ ID NO: 1047337 - RNA, 23 nt, Mycobacterium bovis subsp bovis AF2122/97
gccacauguugucgacggucggc

SEQ ID NO: 1047338 - RNA, 16 nt, Mycobacterium bovis subsp bovis AF2122/97
gccacaugccacagcg

SEQ ID NO: 1047339 - RNA, 17 nt, Mycobacterium bovis subsp bovis AF2122/97
gccacaucgccagcagc

SEQ ID NO: 1047340 - RNA, 17 nt, Mycobacterium bovis subsp bovis AF2122/97
gccacaucguggcgucg

SEQ ID NO: 1047341 - RNA, 15 nt, Mycobacterium bovis subsp bovis AF2122/97
gccacauccagcgcu

SEQ ID NO: 1047342 - RNA, 20 nt, Mycobacterium bovis subsp bovis AF2122/97
gccacauccagcgcuucggc

SEQ ID NO: 1047343 - RNA, 15 nt, Mycobacterium bovis subsp bovis AF2122/97
gccacauacaccggc

SEQ ID NO: 1047344 - RNA, 16 nt, Mycobacterium bovis subsp bovis AF2122/97
gccacauaccaccacg

SEQ ID NO: 1047345 - RNA, 13 nt, Mycobacterium bovis subsp bovis AF2122/97
gccacagcggcga

SEQ ID NO: 1047346 - RNA, 18 nt, Mycobacterium bovis subsp bovis AF2122/97
gccacagucgucgagcgc

SEQ ID NO: 1047347 - RNA, 20 nt, Mycobacterium bovis subsp bovis AF2122/97
gccacagugcauacgguuga

SEQ ID NO: 1047348 - RNA, 17 nt, Mycobacterium bovis subsp bovis AF2122/97
gccacaggcguuuccgc

SEQ ID NO: 1047349 - RNA, 19 nt, Mycobacterium bovis subsp bovis AF2122/97
gccacacggggccgccagc

SEQ ID NO: 1047350 - RNA, 17 nt, Mycobacterium bovis subsp bovis AF2122/97
gccacacucagcaccca

SEQ ID NO: 1047351 - RNA, 18 nt, Mycobacterium bovis subsp bovis AF2122/97
gccacagaccgaacagca

SEQ ID NO: 1047352 - RNA, 22 nt, Mycobacterium bovis subsp bovis AF2122/97
gccacagaccgaacagcaccga

SEQ ID NO: 1047353 - RNA, 17 nt, Mycobacterium bovis subsp bovis AF2122/97
gccacacucgccagggc

SEQ ID NO: 1047354 - RNA, 14 nt, Mycobacterium bovis subsp bovis AF2122/97
gccacagcacccac

SEQ ID NO: 1047355 - RNA, 16 nt, Mycobacterium bovis subsp bovis AF2122/97
gccacagcacccacgc

SEQ ID NO: 1047356 - RNA, 13 nt, Mycobacterium bovis subsp bovis AF2122/97
gccacagcccggc

SEQ ID NO: 1047357 - RNA, 14 nt, Mycobacterium bovis subsp bovis AF2122/97
gccacagcccggcg

SEQ ID NO: 1047358 - RNA, 15 nt, Mycobacterium bovis subsp bovis AF2122/97
gccacagcccggcga

SEQ ID NO: 1047359 - RNA, 16 nt, Mycobacterium bovis subsp bovis AF2122/97
gccacagcccggcggc

SEQ ID NO: 1047360 - RNA, 18 nt, Mycobacterium bovis subsp bovis AF2122/97
gccacagcccggcggcgg

SEQ ID NO: 1047361 - RNA, 17 nt, Mycobacterium bovis subsp bovis AF2122/97
gccacagcgacagcgug

SEQ ID NO: 1047362 - RNA, 13 nt, Mycobacterium bovis subsp bovis AF2122/97
gccacacccgugu

SEQ ID NO: 1047363 - RNA, 12 nt, Mycobacterium bovis subsp bovis AF2122/97
gccacaccauga

SEQ ID NO: 1047364 - RNA, 16 nt, Mycobacterium bovis subsp bovis AF2122/97
gccacacccgcgaacg

SEQ ID NO: 1047365 - RNA, 12 nt, Mycobacterium bovis subsp bovis AF2122/97
gccacacccggc

SEQ ID NO: 1047366 - RNA, 16 nt, Mycobacterium bovis subsp bovis AF2122/97
gccacaccugcgccac

SEQ ID NO: 1047367 - RNA, 13 nt, Mycobacterium bovis subsp bovis AF2122/97
gccacaccgccgc

SEQ ID NO: 1047368 - RNA, 20 nt, Mycobacterium bovis subsp bovis AF2122/97
gccacaccggggcggccgac

SEQ ID NO: 1047369 - RNA, 20 nt, Mycobacterium bovis subsp bovis AF2122/97
gccacaccgucacgccaccg

SEQ ID NO: 1047370 - RNA, 15 nt, Mycobacterium bovis subsp bovis AF2122/97
gccacacccggcaca

SEQ ID NO: 1047371 - RNA, 16 nt, Mycobacterium bovis subsp bovis AF2122/97
gccacaccuuggccgc

SEQ ID NO: 1047372 - RNA, 17 nt, Mycobacterium bovis subsp bovis AF2122/97
gccacaccuuggccgcc

SEQ ID NO: 1047373 - RNA, 21 nt, Mycobacterium bovis subsp bovis AF2122/97
gccacaccuuggccgccggcc

SEQ ID NO: 1047374 - RNA, 16 nt, Mycobacterium bovis subsp bovis AF2122/97
gccacaaaggcgccgg

SEQ ID NO: 1047375 - RNA, 20 nt, Mycobacterium bovis subsp bovis AF2122/97
gccacaacgccucgauggcg

SEQ ID NO: 1047376 - RNA, 21 nt, Mycobacterium bovis subsp bovis AF2122/97
gccacacaggcguccaucgcc

SEQ ID NO: 1047377 - RNA, 21 nt, Mycobacterium bovis subsp bovis AF2122/97
gccacaacguugcaccgagaa

SEQ ID NO: 1047378 - RNA, 15 nt, Mycobacterium bovis subsp bovis AF2122/97
gccacacacugccgg

SEQ ID NO: 1047379 - RNA, 21 nt, Mycobacterium bovis subsp bovis AF2122/97
gccaaucgccgucagcaccgc

SEQ ID NO: 1047380 - RNA, 16 nt, Mycobacterium bovis subsp bovis AF2122/97
gccaaugacgucgcgg

SEQ ID NO: 1047381 - RNA, 17 nt, Mycobacterium bovis subsp bovis AF2122/97
gccaaugacgucgcgga

SEQ ID NO: 1047382 - RNA, 19 nt, Mycobacterium bovis subsp bovis AF2122/97
gccaaugacuuggccagca

SEQ ID NO: 1047383 - RNA, 20 nt, Mycobacterium bovis subsp bovis AF2122/97
gccaaugacuuggccagcag

SEQ ID NO: 1047384 - RNA, 16 nt, Mycobacterium bovis subsp bovis AF2122/97
gccaaugauucggcac

SEQ ID NO: 1047385 - RNA, 20 nt, Mycobacterium bovis subsp bovis AF2122/97
gccaaugcccuuggccagca

SEQ ID NO: 1047386 - RNA, 23 nt, Mycobacterium bovis subsp bovis AF2122/97
gccaaugcccuuggccagcaggg

SEQ ID NO: 1047387 - RNA, 17 nt, Mycobacterium bovis subsp bovis AF2122/97
gccaauugugcugaccg

SEQ ID NO: 1047388 - RNA, 17 nt, Mycobacterium bovis subsp bovis AF2122/97
gccaauuccagcccccc

SEQ ID NO: 1047389 - RNA, 14 nt, Mycobacterium bovis subsp bovis AF2122/97
gccaauuacagcuu

SEQ ID NO: 1047390 - RNA, 20 nt, Mycobacterium bovis subsp bovis AF2122/97
gccaaugucuacgcaucccg

SEQ ID NO: 1047391 - RNA, 21 nt, Mycobacterium bovis subsp bovis AF2122/97
gccaaugucuacgcaucccga

SEQ ID NO: 1047392 - RNA, 13 nt, Mycobacterium bovis subsp bovis AF2122/97
gccaaugccgcgg

SEQ ID NO: 1047393 - RNA, 14 nt, Mycobacterium bovis subsp bovis AF2122/97
gccaaugccgcgga

SEQ ID NO: 1047394 - RNA, 15 nt, Mycobacterium bovis subsp bovis AF2122/97
gccaaugccgcggag

SEQ ID NO: 1047395 - RNA, 14 nt, Mycobacterium bovis subsp bovis AF2122/97
gccaauggccgcgg

SEQ ID NO: 1047396 - RNA, 15 nt, Mycobacterium bovis subsp bovis AF2122/97
gccaauggccgcggc

SEQ ID NO: 1047397 - RNA, 21 nt, Mycobacterium bovis subsp bovis AF2122/97
gccaauggccugcagcgcgac

SEQ ID NO: 1047398 - RNA, 20 nt, Mycobacterium bovis subsp bovis AF2122/97
gccaauggcgcgaauggcgg

SEQ ID NO: 1047399 - RNA, 15 nt, Mycobacterium bovis subsp bovis AF2122/97
gccaauggugggcga

SEQ ID NO: 1047400 - RNA, 23 nt, Mycobacterium bovis subsp bovis AF2122/97
gccaauggugucgcgcucagccg

SEQ ID NO: 1047401 - RNA, 24 nt, Mycobacterium bovis subsp bovis AF2122/97
gccaagcggguuguggcacccggc

SEQ ID NO: 1047402 - RNA, 20 nt, Mycobacterium bovis subsp bovis AF2122/97
gccaagcucggccaccagcg

SEQ ID NO: 1047403 - RNA, 23 nt, Mycobacterium bovis subsp bovis AF2122/97
gccaagcucggccaccagcgccc

SEQ ID NO: 1047404 - RNA, 17 nt, Mycobacterium bovis subsp bovis AF2122/97
gccaagcucggcccagc

SEQ ID NO: 1047405 - RNA, 13 nt, Mycobacterium bovis subsp bovis AF2122/97
gccaagcagcugg

SEQ ID NO: 1047406 - RNA, 13 nt, Mycobacterium bovis subsp bovis AF2122/97
gccaagccgcggc

SEQ ID NO: 1047407 - RNA, 12 nt, Mycobacterium bovis subsp bovis AF2122/97
gccaagccggcg

SEQ ID NO: 1047408 - RNA, 14 nt, Mycobacterium bovis subsp bovis AF2122/97
gccaagccggcgag

SEQ ID NO: 1047409 - RNA, 15 nt, Mycobacterium bovis subsp bovis AF2122/97
gccaagccggcgagu

SEQ ID NO: 1047410 - RNA, 21 nt, Mycobacterium bovis subsp bovis AF2122/97
gccaagcgacucgccggcgaa

SEQ ID NO: 1047411 - RNA, 14 nt, Mycobacterium bovis subsp bovis AF2122/97
gccaagccggagcc

SEQ ID NO: 1047412 - RNA, 13 nt, Mycobacterium bovis subsp bovis AF2122/97
gccaagcgccaac

SEQ ID NO: 1047413 - RNA, 15 nt, Mycobacterium bovis subsp bovis AF2122/97
gccaagguggccacc

SEQ ID NO: 1047414 - RNA, 14 nt, Mycobacterium bovis subsp bovis AF2122/97
gccaaguacgcgac

SEQ ID NO: 1047415 - RNA, 16 nt, Mycobacterium bovis subsp bovis AF2122/97
gccaaguacgcgaccg

SEQ ID NO: 1047416 - RNA, 23 nt, Mycobacterium bovis subsp bovis AF2122/97
gccaaggcuuccuccgacgcgau

SEQ ID NO: 1047417 - RNA, 15 nt, Mycobacterium bovis subsp bovis AF2122/97
gccaauccggcggcg

SEQ ID NO: 1047418 - RNA, 14 nt, Mycobacterium bovis subsp bovis AF2122/97
gccaaucagcccgc

SEQ ID NO: 1047419 - RNA, 13 nt, Mycobacterium bovis subsp bovis AF2122/97
gccaaucaccgua

SEQ ID NO: 1047420 - RNA, 16 nt, Mycobacterium bovis subsp bovis AF2122/97
gccaauccaccggugc

SEQ ID NO: 1047421 - RNA, 22 nt, Mycobacterium bovis subsp bovis AF2122/97
gccaauccaccggugccgcaga

SEQ ID NO: 1047422 - RNA, 18 nt, Mycobacterium bovis subsp bovis AF2122/97
gccaacugggccgagcgc

SEQ ID NO: 1047423 - RNA, 19 nt, Mycobacterium bovis subsp bovis AF2122/97
gccaacugggccgagcgcg

SEQ ID NO: 1047424 - RNA, 20 nt, Mycobacterium bovis subsp bovis AF2122/97
gccaacugggccgagcgcgc

SEQ ID NO: 1047425 - RNA, 16 nt, Mycobacterium bovis subsp bovis AF2122/97
gccaacugcgccguuc

SEQ ID NO: 1047426 - RNA, 19 nt, Mycobacterium bovis subsp bovis AF2122/97
gccaacguugcgccagcgg

SEQ ID NO: 1047427 - RNA, 17 nt, Mycobacterium bovis subsp bovis AF2122/97
gccaacucccgcgguac

SEQ ID NO: 1047428 - RNA, 14 nt, Mycobacterium bovis subsp bovis AF2122/97
gccaacucggcgau

SEQ ID NO: 1047429 - RNA, 22 nt, Mycobacterium bovis subsp bovis AF2122/97
gcaucgaacgcccugacggugg

SEQ ID NO: 1047430 - RNA, 18 nt, Mycobacterium bovis subsp bovis AF2122/97
gccaacguugcgccagcg

SEQ ID NO: 1047431 - RNA, 19 nt, Mycobacterium bovis subsp bovis AF2122/97
gcauccuucaccagcugcg

SEQ ID NO: 1047432 - RNA, 18 nt, Mycobacterium bovis subsp bovis AF2122/97
gcauccuugccaaucgcc

SEQ ID NO: 1047433 - RNA, 20 nt, Mycobacterium bovis subsp bovis AF2122/97
gccaagauggcgcgcugggc

SEQ ID NO: 1047434 - RNA, 15 nt, Mycobacterium bovis subsp bovis AF2122/97
gccaagacgucggcg

SEQ ID NO: 1047435 - RNA, 20 nt, Mycobacterium bovis subsp bovis AF2122/97
gccaagaaucacggccaacc

SEQ ID NO: 1047436 - RNA, 17 nt, Mycobacterium bovis subsp bovis AF2122/97
gccaacuuggcggccag

SEQ ID NO: 1047437 - RNA, 19 nt, Mycobacterium bovis subsp bovis AF2122/97
gccaacuggucgccaacgc

SEQ ID NO: 1047438 - RNA, 17 nt, Mycobacterium bovis subsp bovis AF2122/97
gccaacuucugcacgaa

SEQ ID NO: 1047439 - RNA, 16 nt, Mycobacterium bovis subsp bovis AF2122/97
gccaacuuggcggcca

SEQ ID NO: 1047440 - RNA, 18 nt, Mycobacterium bovis subsp bovis AF2122/97
gcauccccgcagcgucca

SEQ ID NO: 1047441 - RNA, 20 nt, Mycobacterium bovis subsp bovis AF2122/97
gcauccccgguacgucgagg

SEQ ID NO: 1047442 - RNA, 16 nt, Mycobacterium bovis subsp bovis AF2122/97
gcauccagccgugcgg

SEQ ID NO: 1047443 - RNA, 22 nt, Mycobacterium bovis subsp bovis AF2122/97
gcauccagccgugcggcggcug

SEQ ID NO: 1047444 - RNA, 20 nt, Mycobacterium bovis subsp bovis AF2122/97
gcauccaggcugucgcgggc

SEQ ID NO: 1047445 - RNA, 18 nt, Mycobacterium bovis subsp bovis AF2122/97
gcauccagcugcugccga

SEQ ID NO: 1047446 - RNA, 18 nt, Mycobacterium bovis subsp bovis AF2122/97
gcauccagcuucgcucgg

SEQ ID NO: 1047447 - RNA, 21 nt, Mycobacterium bovis subsp bovis AF2122/97
gcauccgguuuggucgccgcg

SEQ ID NO: 1047448 - RNA, 20 nt, Mycobacterium bovis subsp bovis AF2122/97
gcauccgucguacacgccau

SEQ ID NO: 1047449 - RNA, 22 nt, Mycobacterium bovis subsp bovis AF2122/97
cgcgcugcggcccacaccagcg

SEQ ID NO: 1047450 - RNA, 13 nt, Mycobacterium bovis subsp bovis AF2122/97
cgcgcugcggccc

SEQ ID NO: 1047451 - RNA, 19 nt, Mycobacterium bovis subsp bovis AF2122/97
cgcgcugcggcccacacca

SEQ ID NO: 1047452 - RNA, 21 nt, Mycobacterium bovis subsp bovis AF2122/97
cgcgcugcggcccacaccagc

SEQ ID NO: 1047453 - RNA, 19 nt, Mycobacterium bovis subsp bovis AF2122/97
cgcgcuggaucgugcuggu

SEQ ID NO: 1047454 - RNA, 20 nt, Mycobacterium bovis subsp bovis AF2122/97
cgcgcuggaucgugcuggug

SEQ ID NO: 1047455 - RNA, 12 nt, Mycobacterium bovis subsp bovis AF2122/97
cgcgcugcuguc

SEQ ID NO: 1047456 - RNA, 14 nt, Mycobacterium bovis subsp bovis AF2122/97
cgcgcugcugucga

SEQ ID NO: 1047457 - RNA, 15 nt, Mycobacterium bovis subsp bovis AF2122/97
cgcgcugcuucuucg

SEQ ID NO: 1047458 - RNA, 16 nt, Mycobacterium bovis subsp bovis AF2122/97
cgcgcugcuucuucgg

SEQ ID NO: 1047459 - RNA, 13 nt, Mycobacterium bovis subsp bovis AF2122/97
cgcgcuucacagc

SEQ ID NO: 1047460 - RNA, 13 nt, Mycobacterium bovis subsp bovis AF2122/97
cgcgcugugccgu

SEQ ID NO: 1047461 - RNA, 17 nt, Mycobacterium bovis subsp bovis AF2122/97
cgcgcugugccgugcga

SEQ ID NO: 1047462 - RNA, 20 nt, Mycobacterium bovis subsp bovis AF2122/97
cgcgcuucacagccaccagc

SEQ ID NO: 1047463 - RNA, 22 nt, Mycobacterium bovis subsp bovis AF2122/97
cgcgcuucacagccaccagccg

SEQ ID NO: 1047464 - RNA, 17 nt, Mycobacterium bovis subsp bovis AF2122/97
cgcgcuugcgaucgccg

SEQ ID NO: 1047465 - RNA, 15 nt, Mycobacterium bovis subsp bovis AF2122/97
cgcgcuugauccacc

SEQ ID NO: 1047466 - RNA, 20 nt, Mycobacterium bovis subsp bovis AF2122/97
cgcgcuugcgaucggcacuu

SEQ ID NO: 1047467 - RNA, 14 nt, Mycobacterium bovis subsp bovis AF2122/97
cgcgcuugcgccgc

SEQ ID NO: 1047468 - RNA, 14 nt, Mycobacterium bovis subsp bovis AF2122/97
cgcgcuugggcacu

SEQ ID NO: 1047469 - RNA, 21 nt, Mycobacterium bovis subsp bovis AF2122/97
cgcgcuugggcacuucggcga

SEQ ID NO: 1047470 - RNA, 22 nt, Mycobacterium bovis subsp bovis AF2122/97
cgcgcuugggguccggauggcc

SEQ ID NO: 1047471 - RNA, 16 nt, Mycobacterium bovis subsp bovis AF2122/97
cgcgcuugguguggcc

SEQ ID NO: 1047472 - RNA, 22 nt, Mycobacterium bovis subsp bovis AF2122/97
cgcgcuuggcuccacaauccug

SEQ ID NO: 1047473 - RNA, 21 nt, Mycobacterium bovis subsp bovis AF2122/97
cgcgcuugguccugcggucgc

SEQ ID NO: 1047474 - RNA, 15 nt, Mycobacterium bovis subsp bovis AF2122/97
cgcgcuugcgccgcc

SEQ ID NO: 1047475 - RNA, 20 nt, Mycobacterium bovis subsp bovis AF2122/97
cgcggaaaggcuuccgcgug

SEQ ID NO: 1047476 - RNA, 20 nt, Mycobacterium bovis subsp bovis AF2122/97
cgcggaaaccaucgccagcc

SEQ ID NO: 1047477 - RNA, 22 nt, Mycobacterium bovis subsp bovis AF2122/97
cgcggaaaccaucgccagccgg

SEQ ID NO: 1047478 - RNA, 19 nt, Mycobacterium bovis subsp bovis AF2122/97
cgcgcugaaucaccccggc

SEQ ID NO: 1047479 - RNA, 22 nt, Mycobacterium bovis subsp bovis AF2122/97
cgcgcugaaucaccccggcggc

SEQ ID NO: 1047480 - RNA, 14 nt, Mycobacterium bovis subsp bovis AF2122/97
cgcgcucgcccagg

SEQ ID NO: 1047481 - RNA, 17 nt, Mycobacterium bovis subsp bovis AF2122/97
cgcgcucgcucaccggc

SEQ ID NO: 1047482 - RNA, 18 nt, Mycobacterium bovis subsp bovis AF2122/97
cgcgcucgcucaccggcu

SEQ ID NO: 1047483 - RNA, 14 nt, Mycobacterium bovis subsp bovis AF2122/97
cgcgcucgcgcggu

SEQ ID NO: 1047484 - RNA, 16 nt, Mycobacterium bovis subsp bovis AF2122/97
cgcgcucgcgcgguag

SEQ ID NO: 1047485 - RNA, 16 nt, Mycobacterium bovis subsp bovis AF2122/97
cgcgcugagguggcgg

SEQ ID NO: 1047486 - RNA, 16 nt, Mycobacterium bovis subsp bovis AF2122/97
cgcgcugagcucgaug

SEQ ID NO: 1047487 - RNA, 14 nt, Mycobacterium bovis subsp bovis AF2122/97
cgcgcugagcgacu

SEQ ID NO: 1047488 - RNA, 16 nt, Mycobacterium bovis subsp bovis AF2122/97
cgcgcugagcgacugc

SEQ ID NO: 1047489 - RNA, 22 nt, Mycobacterium bovis subsp bovis AF2122/97
cgcgcugagcgacugcagcggc

SEQ ID NO: 1047490 - RNA, 13 nt, Mycobacterium bovis subsp bovis AF2122/97
cgcgcugagcgac

SEQ ID NO: 1047491 - RNA, 14 nt, Mycobacterium bovis subsp bovis AF2122/97
cgcgcugccggccg

SEQ ID NO: 1047492 - RNA, 16 nt, Mycobacterium bovis subsp bovis AF2122/97
cgcgcugccggccgcg

SEQ ID NO: 1047493 - RNA, 17 nt, Mycobacterium bovis subsp bovis AF2122/97
cgcgcugccggccgcgu

SEQ ID NO: 1047494 - RNA, 13 nt, Mycobacterium bovis subsp bovis AF2122/97
cgcgcugccgacu

SEQ ID NO: 1047495 - RNA, 15 nt, Mycobacterium bovis subsp bovis AF2122/97
cgcgcugcagcacgg

SEQ ID NO: 1047496 - RNA, 23 nt, Mycobacterium bovis subsp bovis AF2122/97
cgcgcucgaacuccccggucgcc

SEQ ID NO: 1047497 - RNA, 14 nt, Mycobacterium bovis subsp bovis AF2122/97
cgcgcuccagaugg

SEQ ID NO: 1047498 - RNA, 18 nt, Mycobacterium bovis subsp bovis AF2122/97
cgcgcucauugcaucugc

SEQ ID NO: 1047499 - RNA, 20 nt, Mycobacterium bovis subsp bovis AF2122/97
cgcgcucgauggcggccacc

SEQ ID NO: 1047500 - RNA, 13 nt, Mycobacterium bovis subsp bovis AF2122/97
cgcgcucgcgcaa

SEQ ID NO: 1047501 - RNA, 21 nt, Mycobacterium bovis subsp bovis AF2122/97
cgcgcucgauggcggccacca

SEQ ID NO: 1047502 - RNA, 18 nt, Mycobacterium bovis subsp bovis AF2122/97
cgcgcucgcacccgcucg

SEQ ID NO: 1047503 - RNA, 15 nt, Mycobacterium bovis subsp bovis AF2122/97
cgcgcgucgcccagu

SEQ ID NO: 1047504 - RNA, 19 nt, Mycobacterium bovis subsp bovis AF2122/97
cgcgcucaucgaccgcggc

SEQ ID NO: 1047505 - RNA, 18 nt, Mycobacterium bovis subsp bovis AF2122/97
cgcgcucaucgaccgggg

SEQ ID NO: 1047506 - RNA, 19 nt, Mycobacterium bovis subsp bovis AF2122/97
cgcgcucaucgaccggggc

SEQ ID NO: 1047507 - RNA, 15 nt, Mycobacterium bovis subsp bovis AF2122/97
cgcgcucaucgaccg

SEQ ID NO: 1047508 - RNA, 17 nt, Mycobacterium bovis subsp bovis AF2122/97
cgcgcguccgucggcga

SEQ ID NO: 1047509 - RNA, 18 nt, Mycobacterium bovis subsp bovis AF2122/97
cgcgcgguuuuucgcagu

SEQ ID NO: 1047510 - RNA, 14 nt, Mycobacterium bovis subsp bovis AF2122/97
cgcgcguacccgau

SEQ ID NO: 1047511 - RNA, 20 nt, Mycobacterium bovis subsp bovis AF2122/97
cgcgcgguuuuucgcagugg

SEQ ID NO: 1047512 - RNA, 22 nt, Mycobacterium bovis subsp bovis AF2122/97
cgcgcggucgagguggcgggcg

SEQ ID NO: 1047513 - RNA, 16 nt, Mycobacterium bovis subsp bovis AF2122/97
cgcgcgggccgccgca

SEQ ID NO: 1047514 - RNA, 20 nt, Mycobacterium bovis subsp bovis AF2122/97
cgcgcgguacugcgcagcgc

SEQ ID NO: 1047515 - RNA, 17 nt, Mycobacterium bovis subsp bovis AF2122/97
cgcgcggugcggccacu

SEQ ID NO: 1047516 - RNA, 23 nt, Mycobacterium bovis subsp bovis AF2122/97
cgcgcggugcggccacucgcccg

SEQ ID NO: 1047517 - RNA, 20 nt, Mycobacterium bovis subsp bovis AF2122/97
cgcgcgguggcggucgccac

SEQ ID NO: 1047518 - RNA, 14 nt, Mycobacterium bovis subsp bovis AF2122/97
cgcgcggcgucgug

SEQ ID NO: 1047519 - RNA, 15 nt, Mycobacterium bovis subsp bovis AF2122/97
cgcgcggcggccgcg

SEQ ID NO: 1047520 - RNA, 15 nt, Mycobacterium bovis subsp bovis AF2122/97
cgcgcggcgcgaucg

SEQ ID NO: 1047521 - RNA, 23 nt, Mycobacterium bovis subsp bovis AF2122/97
cgcgcggcuccguuguccagcgc

SEQ ID NO: 1047522 - RNA, 21 nt, Mycobacterium bovis subsp bovis AF2122/97
cgcgcggccaaucagcccgcc

SEQ ID NO: 1047523 - RNA, 14 nt, Mycobacterium bovis subsp bovis AF2122/97
cgcgcggcaccgau

SEQ ID NO: 1047524 - RNA, 13 nt, Mycobacterium bovis subsp bovis AF2122/97
cgcgcggcacuug

SEQ ID NO: 1047525 - RNA, 14 nt, Mycobacterium bovis subsp bovis AF2122/97
cgcgcggcccgccg

SEQ ID NO: 1047526 - RNA, 22 nt, Mycobacterium bovis subsp bovis AF2122/97
cgcgcggcgagagccucggcca

SEQ ID NO: 1047527 - RNA, 14 nt, Mycobacterium bovis subsp bovis AF2122/97
cgcgcggcgccgca

SEQ ID NO: 1047528 - RNA, 14 nt, Mycobacterium bovis subsp bovis AF2122/97
cgcgcggcgcagca

SEQ ID NO: 1047529 - RNA, 11 nt, Mycobacterium bovis subsp bovis AF2122/97
cgcgcggcgac

SEQ ID NO: 1047530 - RNA, 19 nt, Mycobacterium bovis subsp bovis AF2122/97
cgcgccguggcgucggugg

SEQ ID NO: 1047531 - RNA, 11 nt, Mycobacterium bovis subsp bovis AF2122/97
cgcgccggcgu

SEQ ID NO: 1047532 - RNA, 15 nt, Mycobacterium bovis subsp bovis AF2122/97
cgcgccguugccggc

SEQ ID NO: 1047533 - RNA, 19 nt, Mycobacterium bovis subsp bovis AF2122/97
cgcgccguugccggccacc

SEQ ID NO: 1047534 - RNA, 16 nt, Mycobacterium bovis subsp bovis AF2122/97
cgcgccguuggcgcca

SEQ ID NO: 1047535 - RNA, 21 nt, Mycobacterium bovis subsp bovis AF2122/97
cgcgccggcgguagucggcca

SEQ ID NO: 1047536 - RNA, 22 nt, Mycobacterium bovis subsp bovis AF2122/97
cgcgccguucgccuggucaccg

SEQ ID NO: 1047537 - RNA, 22 nt, Mycobacterium bovis subsp bovis AF2122/97
cgcgccuauccaaagaccccua

SEQ ID NO: 1047538 - RNA, 21 nt, Mycobacterium bovis subsp bovis AF2122/97
cgcgccuccguugcccccauu

SEQ ID NO: 1047539 - RNA, 14 nt, Mycobacterium bovis subsp bovis AF2122/97
cgcgcgcggcgacg

SEQ ID NO: 1047540 - RNA, 12 nt, Mycobacterium bovis subsp bovis AF2122/97
cgcgcgcgggug

SEQ ID NO: 1047541 - RNA, 13 nt, Mycobacterium bovis subsp bovis AF2122/97
cgcgcgcggucga

SEQ ID NO: 1047542 - RNA, 12 nt, Mycobacterium bovis subsp bovis AF2122/97
cgcgcgcucgag

SEQ ID NO: 1047543 - RNA, 17 nt, Mycobacterium bovis subsp bovis AF2122/97
cgcgcgcucgcucaccg

SEQ ID NO: 1047544 - RNA, 18 nt, Mycobacterium bovis subsp bovis AF2122/97
cgcgcgcggugcggccac

SEQ ID NO: 1047545 - RNA, 15 nt, Mycobacterium bovis subsp bovis AF2122/97
cgcgcgcuccagaug

SEQ ID NO: 1047546 - RNA, 20 nt, Mycobacterium bovis subsp bovis AF2122/97
cgcgcgcucgcucaccggcg

SEQ ID NO: 1047547 - RNA, 24 nt, Mycobacterium bovis subsp bovis AF2122/97
cgcgcgcucgcucaccggcgcggu

SEQ ID NO: 1047548 - RNA, 14 nt, Mycobacterium bovis subsp bovis AF2122/97
cgcgcgcugggcgc

SEQ ID NO: 1047549 - RNA, 13 nt, Mycobacterium bovis subsp bovis AF2122/97
cgcgcggaacacc

SEQ ID NO: 1047550 - RNA, 17 nt, Mycobacterium bovis subsp bovis AF2122/97
cgcgcggacccagcacc

SEQ ID NO: 1047551 - RNA, 13 nt, Mycobacterium bovis subsp bovis AF2122/97
cgcgcggauuucg

SEQ ID NO: 1047552 - RNA, 15 nt, Mycobacterium bovis subsp bovis AF2122/97
cgcgcggaucggcgg

SEQ ID NO: 1047553 - RNA, 21 nt, Mycobacterium bovis subsp bovis AF2122/97
cgcgcggaucggcggccgcga

SEQ ID NO: 1047554 - RNA, 21 nt, Mycobacterium bovis subsp bovis AF2122/97
cgcggccagagccgcgcgccg

SEQ ID NO: 1047555 - RNA, 15 nt, Mycobacterium bovis subsp bovis AF2122/97
cgcggccagcagcag

SEQ ID NO: 1047556 - RNA, 13 nt, Mycobacterium bovis subsp bovis AF2122/97
cgcggccagcagg

SEQ ID NO: 1047557 - RNA, 17 nt, Mycobacterium bovis subsp bovis AF2122/97
cgcggccagcccacucg

SEQ ID NO: 1047558 - RNA, 14 nt, Mycobacterium bovis subsp bovis AF2122/97
cgcggccaucgccg

SEQ ID NO: 1047559 - RNA, 16 nt, Mycobacterium bovis subsp bovis AF2122/97
cgcggccaucgccgac

SEQ ID NO: 1047560 - RNA, 19 nt, Mycobacterium bovis subsp bovis AF2122/97
cgcggccauuagcagcacc

SEQ ID NO: 1047561 - RNA, 14 nt, Mycobacterium bovis subsp bovis AF2122/97
cgcggccauggcag

SEQ ID NO: 1047562 - RNA, 16 nt, Mycobacterium bovis subsp bovis AF2122/97
cgcggcccaccucacc

SEQ ID NO: 1047563 - RNA, 23 nt, Mycobacterium bovis subsp bovis AF2122/97
cgcggcccacucucgccacgccg

SEQ ID NO: 1047564 - RNA, 19 nt, Mycobacterium bovis subsp bovis AF2122/97
cgcggccgagacggcguug

SEQ ID NO: 1047565 - RNA, 24 nt, Mycobacterium bovis subsp bovis AF2122/97
cgcggccgcaagccgcgagucgcc

SEQ ID NO: 1047566 - RNA, 13 nt, Mycobacterium bovis subsp bovis AF2122/97
cgcggccgcagcc

SEQ ID NO: 1047567 - RNA, 14 nt, Mycobacterium bovis subsp bovis AF2122/97
cgcggccgcagcca

SEQ ID NO: 1047568 - RNA, 17 nt, Mycobacterium bovis subsp bovis AF2122/97
cgcggccgcagccagca

SEQ ID NO: 1047569 - RNA, 22 nt, Mycobacterium bovis subsp bovis AF2122/97
cgcggccgaaagagccagcggc

SEQ ID NO: 1047570 - RNA, 19 nt, Mycobacterium bovis subsp bovis AF2122/97
cgcggccgccccaggcugg

SEQ ID NO: 1047571 - RNA, 16 nt, Mycobacterium bovis subsp bovis AF2122/97
cgcggccgccagcgga

SEQ ID NO: 1047572 - RNA, 13 nt, Mycobacterium bovis subsp bovis AF2122/97
cgcggccgccagc

SEQ ID NO: 1047573 - RNA, 14 nt, Mycobacterium bovis subsp bovis AF2122/97
cgcggccgccagcg

SEQ ID NO: 1047574 - RNA, 19 nt, Mycobacterium bovis subsp bovis AF2122/97
cgcggccugacgcugcagc

SEQ ID NO: 1047575 - RNA, 16 nt, Mycobacterium bovis subsp bovis AF2122/97
cgcggccuuggcggcc

SEQ ID NO: 1047576 - RNA, 16 nt, Mycobacterium bovis subsp bovis AF2122/97
cgcggcgaaccagcgc

SEQ ID NO: 1047577 - RNA, 18 nt, Mycobacterium bovis subsp bovis AF2122/97
cgcggcgaacaucaccgu

SEQ ID NO: 1047578 - RNA, 20 nt, Mycobacterium bovis subsp bovis AF2122/97
cgcggcgaacaucaccgucg

SEQ ID NO: 1047579 - RNA, 22 nt, Mycobacterium bovis subsp bovis AF2122/97
cgcggcgaagcaagugaauacc

SEQ ID NO: 1047580 - RNA, 15 nt, Mycobacterium bovis subsp bovis AF2122/97
cgcggcgacgacggc

SEQ ID NO: 1047581 - RNA, 16 nt, Mycobacterium bovis subsp bovis AF2122/97
cgcggcgacgacggcc

SEQ ID NO: 1047582 - RNA, 18 nt, Mycobacterium bovis subsp bovis AF2122/97
cgcggcgacgacggccug

SEQ ID NO: 1047583 - RNA, 23 nt, Mycobacterium bovis subsp bovis AF2122/97
cgcggcgacgacggccugcgagu

SEQ ID NO: 1047584 - RNA, 14 nt, Mycobacterium bovis subsp bovis AF2122/97
cgcggcgacccggu

SEQ ID NO: 1047585 - RNA, 21 nt, Mycobacterium bovis subsp bovis AF2122/97
cgcggcgacauccacaccgcg

SEQ ID NO: 1047586 - RNA, 15 nt, Mycobacterium bovis subsp bovis AF2122/97
cgcggcgagcaccac

SEQ ID NO: 1047587 - RNA, 13 nt, Mycobacterium bovis subsp bovis AF2122/97
cgcggcgagcacg

SEQ ID NO: 1047588 - RNA, 18 nt, Mycobacterium bovis subsp bovis AF2122/97
cgcggcgcccggcggauc

SEQ ID NO: 1047589 - RNA, 13 nt, Mycobacterium bovis subsp bovis AF2122/97
cgcggcgccgcca

SEQ ID NO: 1047590 - RNA, 14 nt, Mycobacterium bovis subsp bovis AF2122/97
cgcggcgccgccac

SEQ ID NO: 1047591 - RNA, 19 nt, Mycobacterium bovis subsp bovis AF2122/97
cgcggcgcccggcggaucc

SEQ ID NO: 1047592 - RNA, 17 nt, Mycobacterium bovis subsp bovis AF2122/97
cgcggcgcccuggccgc

SEQ ID NO: 1047593 - RNA, 16 nt, Mycobacterium bovis subsp bovis AF2122/97
cgcggacccgucggcg

SEQ ID NO: 1047594 - RNA, 18 nt, Mycobacterium bovis subsp bovis AF2122/97
cgcggacccgucggcgug

SEQ ID NO: 1047595 - RNA, 20 nt, Mycobacterium bovis subsp bovis AF2122/97
cgcggacccgucggcguggc

SEQ ID NO: 1047596 - RNA, 14 nt, Mycobacterium bovis subsp bovis AF2122/97
cgcggaccgcaacg

SEQ ID NO: 1047597 - RNA, 21 nt, Mycobacterium bovis subsp bovis AF2122/97
cgcggaccgcaacgacggccg

SEQ ID NO: 1047598 - RNA, 21 nt, Mycobacterium bovis subsp bovis AF2122/97
cgcggacagcccggacgcgcg

SEQ ID NO: 1047599 - RNA, 15 nt, Mycobacterium bovis subsp bovis AF2122/97
cgcggacccgcgcgu

SEQ ID NO: 1047600 - RNA, 17 nt, Mycobacterium bovis subsp bovis AF2122/97
cgcggacccgcagcugc

SEQ ID NO: 1047601 - RNA, 13 nt, Mycobacterium bovis subsp bovis AF2122/97
cgcggacccgccg

SEQ ID NO: 1047602 - RNA, 22 nt, Mycobacterium bovis subsp bovis AF2122/97
cgcggacauccgggccgagcgc

SEQ ID NO: 1047603 - RNA, 19 nt, Mycobacterium bovis subsp bovis AF2122/97
cgcggaccucgaagcccag

SEQ ID NO: 1047604 - RNA, 14 nt, Mycobacterium bovis subsp bovis AF2122/97
cgcggaccucggcg

SEQ ID NO: 1047605 - RNA, 19 nt, Mycobacterium bovis subsp bovis AF2122/97
cgcggcaaaguuggccgcc

SEQ ID NO: 1047606 - RNA, 21 nt, Mycobacterium bovis subsp bovis AF2122/97
cgcggcaaaguuggccgcccg

SEQ ID NO: 1047607 - RNA, 17 nt, Mycobacterium bovis subsp bovis AF2122/97
cgcggcaacaaagucgc

SEQ ID NO: 1047608 - RNA, 21 nt, Mycobacterium bovis subsp bovis AF2122/97
cgcgcuuucgagugcagcggc

SEQ ID NO: 1047609 - RNA, 18 nt, Mycobacterium bovis subsp bovis AF2122/97
cgcggcaacuccggucaa

SEQ ID NO: 1047610 - RNA, 19 nt, Mycobacterium bovis subsp bovis AF2122/97
cgcggcaagaguugccgga

SEQ ID NO: 1047611 - RNA, 22 nt, Mycobacterium bovis subsp bovis AF2122/97
cgcggcaaucucaugcccggga

SEQ ID NO: 1047612 - RNA, 18 nt, Mycobacterium bovis subsp bovis AF2122/97
cgcggcagcauccucgac

SEQ ID NO: 1047613 - RNA, 23 nt, Mycobacterium bovis subsp bovis AF2122/97
cgcggcacuuuguagcccgcgau

SEQ ID NO: 1047614 - RNA, 14 nt, Mycobacterium bovis subsp bovis AF2122/97
cgcggcagccggcg

SEQ ID NO: 1047615 - RNA, 17 nt, Mycobacterium bovis subsp bovis AF2122/97
cgcggcaaugaggccgu

SEQ ID NO: 1047616 - RNA, 12 nt, Mycobacterium bovis subsp bovis AF2122/97
cgcggcaccgcc

SEQ ID NO: 1047617 - RNA, 20 nt, Mycobacterium bovis subsp bovis AF2122/97
cgcggcacccaaccaggccg

SEQ ID NO: 1047618 - RNA, 20 nt, Mycobacterium bovis subsp bovis AF2122/97
cgcggcaccgauggcgcacc

SEQ ID NO: 1047619 - RNA, 16 nt, Mycobacterium bovis subsp bovis AF2122/97
cgcggcacgcuccagc

SEQ ID NO: 1047620 - RNA, 21 nt, Mycobacterium bovis subsp bovis AF2122/97
cgcggcacgaucaaccggguc

SEQ ID NO: 1047621 - RNA, 17 nt, Mycobacterium bovis subsp bovis AF2122/97
cgcggcacgcuccagcu

SEQ ID NO: 1047622 - RNA, 19 nt, Mycobacterium bovis subsp bovis AF2122/97
cgcggcacgcuccagcucg

SEQ ID NO: 1047623 - RNA, 12 nt, Mycobacterium bovis subsp bovis AF2122/97
cgcggcaccacg

SEQ ID NO: 1047624 - RNA, 15 nt, Mycobacterium bovis subsp bovis AF2122/97
cgcggcaccacgucg

SEQ ID NO: 1047625 - RNA, 16 nt, Mycobacterium bovis subsp bovis AF2122/97
cgcggcaccacgucga

SEQ ID NO: 1047626 - RNA, 17 nt, Mycobacterium bovis subsp bovis AF2122/97
cgcggcaccacgucgac

SEQ ID NO: 1047627 - RNA, 19 nt, Mycobacterium bovis subsp bovis AF2122/97
cgcggcaccacgucgacca

SEQ ID NO: 1047628 - RNA, 20 nt, Mycobacterium bovis subsp bovis AF2122/97
cgcggcaccagcaccgucgg

SEQ ID NO: 1047629 - RNA, 16 nt, Mycobacterium bovis subsp bovis AF2122/97
cgcggcacccaaccag

SEQ ID NO: 1047630 - RNA, 22 nt, Mycobacterium bovis subsp bovis AF2122/97
cgcggccaccaccgccgccggc

SEQ ID NO: 1047631 - RNA, 14 nt, Mycobacterium bovis subsp bovis AF2122/97
cgcggccaccaccg

SEQ ID NO: 1047632 - RNA, 15 nt, Mycobacterium bovis subsp bovis AF2122/97
cgcggccaccaccgc

SEQ ID NO: 1047633 - RNA, 18 nt, Mycobacterium bovis subsp bovis AF2122/97
cgcggccacauaccacca

SEQ ID NO: 1047634 - RNA, 22 nt, Mycobacterium bovis subsp bovis AF2122/97
cgcggccacauaccaccacgug

SEQ ID NO: 1047635 - RNA, 19 nt, Mycobacterium bovis subsp bovis AF2122/97
cgcggccacaucgccagca

SEQ ID NO: 1047636 - RNA, 21 nt, Mycobacterium bovis subsp bovis AF2122/97
cgcggccacaucgccagcagc

SEQ ID NO: 1047637 - RNA, 22 nt, Mycobacterium bovis subsp bovis AF2122/97
cgcggccaccacaacgccagga

SEQ ID NO: 1047638 - RNA, 14 nt, Mycobacterium bovis subsp bovis AF2122/97
cgcggccacccgcg

SEQ ID NO: 1047639 - RNA, 18 nt, Mycobacterium bovis subsp bovis AF2122/97
cgcggccacccgcgacga

SEQ ID NO: 1047640 - RNA, 15 nt, Mycobacterium bovis subsp bovis AF2122/97
cgcggccaccgaccg

SEQ ID NO: 1047641 - RNA, 16 nt, Mycobacterium bovis subsp bovis AF2122/97
cgcggccaccgaccgc

SEQ ID NO: 1047642 - RNA, 17 nt, Mycobacterium bovis subsp bovis AF2122/97
cgcggccaccgccgccg

SEQ ID NO: 1047643 - RNA, 22 nt, Mycobacterium bovis subsp bovis AF2122/97
cgcggccaccgccgccgccgac

SEQ ID NO: 1047644 - RNA, 22 nt, Mycobacterium bovis subsp bovis AF2122/97
cgcggccaccucaucgccaucg

SEQ ID NO: 1047645 - RNA, 15 nt, Mycobacterium bovis subsp bovis AF2122/97
cgcggccaccagauc

SEQ ID NO: 1047646 - RNA, 16 nt, Mycobacterium bovis subsp bovis AF2122/97
cgcggccacgccgauc

SEQ ID NO: 1047647 - RNA, 17 nt, Mycobacterium bovis subsp bovis AF2122/97
cgcggccacggucagcc

SEQ ID NO: 1047648 - RNA, 16 nt, Mycobacterium bovis subsp bovis AF2122/97
cgcggccagcaccggg

SEQ ID NO: 1047649 - RNA, 22 nt, Mycobacterium bovis subsp bovis AF2122/97
cgcggccaacgaacgugccccg

SEQ ID NO: 1047650 - RNA, 22 nt, Mycobacterium bovis subsp bovis AF2122/97
cgcggcauucucgagcacccgc

SEQ ID NO: 1047651 - RNA, 16 nt, Mycobacterium bovis subsp bovis AF2122/97
cgcggccaaucagccc

SEQ ID NO: 1047652 - RNA, 23 nt, Mycobacterium bovis subsp bovis AF2122/97
cgcggccacaaugcggccguucg

SEQ ID NO: 1047653 - RNA, 19 nt, Mycobacterium bovis subsp bovis AF2122/97
cgcggccacaaccucgucg

SEQ ID NO: 1047654 - RNA, 20 nt, Mycobacterium bovis subsp bovis AF2122/97
cgcggccacaaccucgucgu

SEQ ID NO: 1047655 - RNA, 17 nt, Mycobacterium bovis subsp bovis AF2122/97
cgcggccaauggccgcg

SEQ ID NO: 1047656 - RNA, 17 nt, Mycobacterium bovis subsp bovis AF2122/97
cgcggccaauugcgccg

SEQ ID NO: 1047657 - RNA, 19 nt, Mycobacterium bovis subsp bovis AF2122/97
cgcggccaauugcgccgcc

SEQ ID NO: 1047658 - RNA, 20 nt, Mycobacterium bovis subsp bovis AF2122/97
cgcggccaauugcgccgcca

SEQ ID NO: 1047659 - RNA, 22 nt, Mycobacterium bovis subsp bovis AF2122/97
cgcggccaauugcgccgccaac

SEQ ID NO: 1047660 - RNA, 22 nt, Mycobacterium bovis subsp bovis AF2122/97
cgcggcaucgaauuccagccag

SEQ ID NO: 1047661 - RNA, 16 nt, Mycobacterium bovis subsp bovis AF2122/97
cgcggcaggccuggcg

SEQ ID NO: 1047662 - RNA, 20 nt, Mycobacterium bovis subsp bovis AF2122/97
cgcggcaggccuggcgagcc

SEQ ID NO: 1047663 - RNA, 22 nt, Mycobacterium bovis subsp bovis AF2122/97
cgcggcaggccuggcgagccag

SEQ ID NO: 1047664 - RNA, 16 nt, Mycobacterium bovis subsp bovis AF2122/97
cgcggcaguggccaga

SEQ ID NO: 1047665 - RNA, 18 nt, Mycobacterium bovis subsp bovis AF2122/97
cgcggcaucccgccacac

SEQ ID NO: 1047666 - RNA, 13 nt, Mycobacterium bovis subsp bovis AF2122/97
cgcggcaucgacg

SEQ ID NO: 1047667 - RNA, 19 nt, Mycobacterium bovis subsp bovis AF2122/97
cgcgcacgcgugccgcaac

SEQ ID NO: 1047668 - RNA, 16 nt, Mycobacterium bovis subsp bovis AF2122/97
cgcgcacgccaccggg

SEQ ID NO: 1047669 - RNA, 14 nt, Mycobacterium bovis subsp bovis AF2122/97
cgcgcaccuggcgc

SEQ ID NO: 1047670 - RNA, 22 nt, Mycobacterium bovis subsp bovis AF2122/97
cgcgcaccuggcgcgcgcaacg

SEQ ID NO: 1047671 - RNA, 14 nt, Mycobacterium bovis subsp bovis AF2122/97
cgcgcacccagccc

SEQ ID NO: 1047672 - RNA, 15 nt, Mycobacterium bovis subsp bovis AF2122/97
cgcgcacccagccca

SEQ ID NO: 1047673 - RNA, 15 nt, Mycobacterium bovis subsp bovis AF2122/97
cgcgcaccgaccgca

SEQ ID NO: 1047674 - RNA, 19 nt, Mycobacterium bovis subsp bovis AF2122/97
cgcgcaccgaccgcaccgu

SEQ ID NO: 1047675 - RNA, 23 nt, Mycobacterium bovis subsp bovis AF2122/97
cgcgcaccggguugagccgccgc

SEQ ID NO: 1047676 - RNA, 20 nt, Mycobacterium bovis subsp bovis AF2122/97
cgcgcacuugcguggcguug

SEQ ID NO: 1047677 - RNA, 17 nt, Mycobacterium bovis subsp bovis AF2122/97
cgcgcacucgaccagga

SEQ ID NO: 1047678 - RNA, 23 nt, Mycobacterium bovis subsp bovis AF2122/97
cgcgcagaacgaucgcgcuggcg

SEQ ID NO: 1047679 - RNA, 12 nt, Mycobacterium bovis subsp bovis AF2122/97
cgcgcacgucgg

SEQ ID NO: 1047680 - RNA, 22 nt, Mycobacterium bovis subsp bovis AF2122/97
cgcgcacggcgucggccaccgc

SEQ ID NO: 1047681 - RNA, 14 nt, Mycobacterium bovis subsp bovis AF2122/97
cgcgcacggcguug

SEQ ID NO: 1047682 - RNA, 18 nt, Mycobacterium bovis subsp bovis AF2122/97
cgcgcacucgacgccaau

SEQ ID NO: 1047683 - RNA, 16 nt, Mycobacterium bovis subsp bovis AF2122/97
cgcgcagauucccggc

SEQ ID NO: 1047684 - RNA, 19 nt, Mycobacterium bovis subsp bovis AF2122/97
cgcgcagaugagcgcggcg

SEQ ID NO: 1047685 - RNA, 20 nt, Mycobacterium bovis subsp bovis AF2122/97
cgcgcagaucgaaaucagcc

SEQ ID NO: 1047686 - RNA, 15 nt, Mycobacterium bovis subsp bovis AF2122/97
cgcgcagaucgucca

SEQ ID NO: 1047687 - RNA, 21 nt, Mycobacterium bovis subsp bovis AF2122/97
cgcgcaccaacaccagcgcgu

SEQ ID NO: 1047688 - RNA, 14 nt, Mycobacterium bovis subsp bovis AF2122/97
cgcgcaccaccgcg

SEQ ID NO: 1047689 - RNA, 15 nt, Mycobacterium bovis subsp bovis AF2122/97
cgcgcaccaccgcgg

SEQ ID NO: 1047690 - RNA, 16 nt, Mycobacterium bovis subsp bovis AF2122/97
cgcgcaccaccgcggc

SEQ ID NO: 1047691 - RNA, 19 nt, Mycobacterium bovis subsp bovis AF2122/97
cgcgcaccaccgcggcggc

SEQ ID NO: 1047692 - RNA, 15 nt, Mycobacterium bovis subsp bovis AF2122/97
cgcgcaccaacacca

SEQ ID NO: 1047693 - RNA, 17 nt, Mycobacterium bovis subsp bovis AF2122/97
cgcgcaccaacaccagc

SEQ ID NO: 1047694 - RNA, 12 nt, Mycobacterium bovis subsp bovis AF2122/97
cgcgcaccaccg

SEQ ID NO: 1047695 - RNA, 13 nt, Mycobacterium bovis subsp bovis AF2122/97
cgcgcaccaccgc

SEQ ID NO: 1047696 - RNA, 12 nt, Mycobacterium bovis subsp bovis AF2122/97
cgcgcacacggc

SEQ ID NO: 1047697 - RNA, 18 nt, Mycobacterium bovis subsp bovis AF2122/97
cgcgcaauccugcgggac

SEQ ID NO: 1047698 - RNA, 23 nt, Mycobacterium bovis subsp bovis AF2122/97
cgcgcaaucaggaaccgcucguc

SEQ ID NO: 1047699 - RNA, 15 nt, Mycobacterium bovis subsp bovis AF2122/97
cgcgaccgcgcacgg

SEQ ID NO: 1047700 - RNA, 23 nt, Mycobacterium bovis subsp bovis AF2122/97
cgcgcaacuuccauuuucgccaa

SEQ ID NO: 1047701 - RNA, 15 nt, Mycobacterium bovis subsp bovis AF2122/97
cgcgcaagucgaugu

SEQ ID NO: 1047702 - RNA, 19 nt, Mycobacterium bovis subsp bovis AF2122/97
cgcgcaaggcgccgcaggg

SEQ ID NO: 1047703 - RNA, 20 nt, Mycobacterium bovis subsp bovis AF2122/97
cgcgcaacuuccauuuucgc

SEQ ID NO: 1047704 - RNA, 14 nt, Mycobacterium bovis subsp bovis AF2122/97
cgcgcaaggcgccg

SEQ ID NO: 1047705 - RNA, 16 nt, Mycobacterium bovis subsp bovis AF2122/97
cgcgcaaggcgccgca

SEQ ID NO: 1047706 - RNA, 12 nt, Mycobacterium bovis subsp bovis AF2122/97
cgcgcaagucga

SEQ ID NO: 1047707 - RNA, 17 nt, Mycobacterium bovis subsp bovis AF2122/97
cgcgacccgaucgcgcc

SEQ ID NO: 1047708 - RNA, 19 nt, Mycobacterium bovis subsp bovis AF2122/97
cgcgacccgaucgcgccag

SEQ ID NO: 1047709 - RNA, 22 nt, Mycobacterium bovis subsp bovis AF2122/97
cgcgacccgaucgcgccaggcc

SEQ ID NO: 1047710 - RNA, 21 nt, Mycobacterium bovis subsp bovis AF2122/97
cgcgaccgaccagccguggug

SEQ ID NO: 1047711 - RNA, 19 nt, Mycobacterium bovis subsp bovis AF2122/97
cgcgacccguagcuuggcg

SEQ ID NO: 1047712 - RNA, 14 nt, Mycobacterium bovis subsp bovis AF2122/97
cgcgacccggccca

SEQ ID NO: 1047713 - RNA, 15 nt, Mycobacterium bovis subsp bovis AF2122/97
cgcgacccggcccag

SEQ ID NO: 1047714 - RNA, 13 nt, Mycobacterium bovis subsp bovis AF2122/97
cgcgaccgcggcg

SEQ ID NO: 1047715 - RNA, 13 nt, Mycobacterium bovis subsp bovis AF2122/97
cgcgaccgcgggc

SEQ ID NO: 1047716 - RNA, 18 nt, Mycobacterium bovis subsp bovis AF2122/97
cgcgaccgcgggccgacg

SEQ ID NO: 1047717 - RNA, 19 nt, Mycobacterium bovis subsp bovis AF2122/97
cgcgcagaucguccaccgc

SEQ ID NO: 1047718 - RNA, 22 nt, Mycobacterium bovis subsp bovis AF2122/97
cgcgcagcaccggcucgacugc

SEQ ID NO: 1047719 - RNA, 16 nt, Mycobacterium bovis subsp bovis AF2122/97
cgcgcagcacugcggc

SEQ ID NO: 1047720 - RNA, 20 nt, Mycobacterium bovis subsp bovis AF2122/97
cgcgcagcacugcggcagcg

SEQ ID NO: 1047721 - RNA, 13 nt, Mycobacterium bovis subsp bovis AF2122/97
cgcgcagcagugc

SEQ ID NO: 1047722 - RNA, 12 nt, Mycobacterium bovis subsp bovis AF2122/97
cgcgcagcaguu

SEQ ID NO: 1047723 - RNA, 16 nt, Mycobacterium bovis subsp bovis AF2122/97
cgcgcagcaucggcga

SEQ ID NO: 1047724 - RNA, 14 nt, Mycobacterium bovis subsp bovis AF2122/97
cgcgcagccgggcc

SEQ ID NO: 1047725 - RNA, 20 nt, Mycobacterium bovis subsp bovis AF2122/97
cgcgcagccgggccaaccgg

SEQ ID NO: 1047726 - RNA, 20 nt, Mycobacterium bovis subsp bovis AF2122/97
cgcgcagcauggugcggcgg

SEQ ID NO: 1047727 - RNA, 21 nt, Mycobacterium bovis subsp bovis AF2122/97
cgcgcagcauggugcggcggc

SEQ ID NO: 1047728 - RNA, 15 nt, Mycobacterium bovis subsp bovis AF2122/97
cgcgcagccggcccg

SEQ ID NO: 1047729 - RNA, 16 nt, Mycobacterium bovis subsp bovis AF2122/97
cgcgcagcgcgaucgc

SEQ ID NO: 1047730 - RNA, 15 nt, Mycobacterium bovis subsp bovis AF2122/97
cgcgcagcgccgcca

SEQ ID NO: 1047731 - RNA, 20 nt, Mycobacterium bovis subsp bovis AF2122/97
cgcgcagcgcgaucgcgguc

SEQ ID NO: 1047732 - RNA, 15 nt, Mycobacterium bovis subsp bovis AF2122/97
cgcgcagcgcggcgg

SEQ ID NO: 1047733 - RNA, 15 nt, Mycobacterium bovis subsp bovis AF2122/97
cgcgcagcugacguc

SEQ ID NO: 1047734 - RNA, 18 nt, Mycobacterium bovis subsp bovis AF2122/97
cgcgcagcgugcgaugca

SEQ ID NO: 1047735 - RNA, 19 nt, Mycobacterium bovis subsp bovis AF2122/97
cgcgcagcugacgucacca

SEQ ID NO: 1047736 - RNA, 15 nt, Mycobacterium bovis subsp bovis AF2122/97
cgcgcagcugccgca

SEQ ID NO: 1047737 - RNA, 19 nt, Mycobacterium bovis subsp bovis AF2122/97
cgcgcaggaagccggcgug

SEQ ID NO: 1047738 - RNA, 20 nt, Mycobacterium bovis subsp bovis AF2122/97
cgcgcagcugccgcaccccc

SEQ ID NO: 1047739 - RNA, 12 nt, Mycobacterium bovis subsp bovis AF2122/97
cgcgcagcuugg

SEQ ID NO: 1047740 - RNA, 17 nt, Mycobacterium bovis subsp bovis AF2122/97
cgcgcagcugccgcacc

SEQ ID NO: 1047741 - RNA, 21 nt, Mycobacterium bovis subsp bovis AF2122/97
cgcgcagguagcgcucgauca

SEQ ID NO: 1047742 - RNA, 19 nt, Mycobacterium bovis subsp bovis AF2122/97
cgcgcagguagucgacgac

SEQ ID NO: 1047743 - RNA, 14 nt, Mycobacterium bovis subsp bovis AF2122/97
cgcgcagguagcgc

SEQ ID NO: 1047744 - RNA, 17 nt, Mycobacterium bovis subsp bovis AF2122/97
cgcgcagguagcgcucg

SEQ ID NO: 1047745 - RNA, 18 nt, Mycobacterium bovis subsp bovis AF2122/97
cgcgcagguagcgcucga

SEQ ID NO: 1047746 - RNA, 22 nt, Mycobacterium bovis subsp bovis AF2122/97
cgcgcaggcuuccagccacagc

SEQ ID NO: 1047747 - RNA, 17 nt, Mycobacterium bovis subsp bovis AF2122/97
cgcgcagggcgucggcg

SEQ ID NO: 1047748 - RNA, 20 nt, Mycobacterium bovis subsp bovis AF2122/97
cgcgcagggcgucggcgaau

SEQ ID NO: 1047749 - RNA, 17 nt, Mycobacterium bovis subsp bovis AF2122/97
cgcgcaggggcggcgug

SEQ ID NO: 1047750 - RNA, 21 nt, Mycobacterium bovis subsp bovis AF2122/97
cgcgcaggggcggcgugaagu

SEQ ID NO: 1047751 - RNA, 16 nt, Mycobacterium bovis subsp bovis AF2122/97
cgcgcagggaucgcag

SEQ ID NO: 1047752 - RNA, 18 nt, Mycobacterium bovis subsp bovis AF2122/97
cgcgcagggaucgcaggg

SEQ ID NO: 1047753 - RNA, 19 nt, Mycobacterium bovis subsp bovis AF2122/97
cgcgcaucgccuccucgac

SEQ ID NO: 1047754 - RNA, 23 nt, Mycobacterium bovis subsp bovis AF2122/97
cgcgcaucgcacgggccaccagc

SEQ ID NO: 1047755 - RNA, 13 nt, Mycobacterium bovis subsp bovis AF2122/97
cgcgcaucgcggc

SEQ ID NO: 1047756 - RNA, 20 nt, Mycobacterium bovis subsp bovis AF2122/97
cgcgcaucaucgcccaccgc

SEQ ID NO: 1047757 - RNA, 16 nt, Mycobacterium bovis subsp bovis AF2122/97
cgcgcauccgcagccc

SEQ ID NO: 1047758 - RNA, 18 nt, Mycobacterium bovis subsp bovis AF2122/97
cgcgcauccgcagcccaa

SEQ ID NO: 1047759 - RNA, 17 nt, Mycobacterium bovis subsp bovis AF2122/97
cgcgcaggugcugggcg

SEQ ID NO: 1047760 - RNA, 22 nt, Mycobacterium bovis subsp bovis AF2122/97
cgcgcaggugcugggcgaggug

SEQ ID NO: 1047761 - RNA, 19 nt, Mycobacterium bovis subsp bovis AF2122/97
cgcgcaguacuugaccguc

SEQ ID NO: 1047762 - RNA, 21 nt, Mycobacterium bovis subsp bovis AF2122/97
cgcgcaguacuugaccgucca

SEQ ID NO: 1047763 - RNA, 23 nt, Mycobacterium bovis subsp bovis AF2122/97
cgcgcaguacuugaccguccacc

SEQ ID NO: 1047764 - RNA, 18 nt, Mycobacterium bovis subsp bovis AF2122/97
cgcgcaguuuggcggcgc

SEQ ID NO: 1047765 - RNA, 14 nt, Mycobacterium bovis subsp bovis AF2122/97
cgcgcauucgccgg

SEQ ID NO: 1047766 - RNA, 15 nt, Mycobacterium bovis subsp bovis AF2122/97
cgcgcauucgccggg

SEQ ID NO: 1047767 - RNA, 16 nt, Mycobacterium bovis subsp bovis AF2122/97
cgcgcauucgccgggc

SEQ ID NO: 1047768 - RNA, 19 nt, Mycobacterium bovis subsp bovis AF2122/97
cgcgcauucgccgggcggc

SEQ ID NO: 1047769 - RNA, 20 nt, Mycobacterium bovis subsp bovis AF2122/97
cgcgcauucgccgggcggca

SEQ ID NO: 1047770 - RNA, 16 nt, Mycobacterium bovis subsp bovis AF2122/97
cgcgcauugcgcuucc

SEQ ID NO: 1047771 - RNA, 22 nt, Mycobacterium bovis subsp bovis AF2122/97
cgcgcauugcgcuuccaacacc

SEQ ID NO: 1047772 - RNA, 13 nt, Mycobacterium bovis subsp bovis AF2122/97
cgcgccaacaccu

SEQ ID NO: 1047773 - RNA, 17 nt, Mycobacterium bovis subsp bovis AF2122/97
cgcgccaaacaccccgg

SEQ ID NO: 1047774 - RNA, 22 nt, Mycobacterium bovis subsp bovis AF2122/97
cgcgccaaacaccccggccuug

SEQ ID NO: 1047775 - RNA, 21 nt, Mycobacterium bovis subsp bovis AF2122/97
cgcgcaucugucgcgcggcaa

SEQ ID NO: 1047776 - RNA, 15 nt, Mycobacterium bovis subsp bovis AF2122/97
cgcgcaugccccgac

SEQ ID NO: 1047777 - RNA, 12 nt, Mycobacterium bovis subsp bovis AF2122/97
cgcgccacccag

SEQ ID NO: 1047778 - RNA, 16 nt, Mycobacterium bovis subsp bovis AF2122/97
cgcgccaccggcaccg

SEQ ID NO: 1047779 - RNA, 19 nt, Mycobacterium bovis subsp bovis AF2122/97
cgcgccaccucccacgccg

SEQ ID NO: 1047780 - RNA, 23 nt, Mycobacterium bovis subsp bovis AF2122/97
cgcgccaccucccacgccgccgu

SEQ ID NO: 1047781 - RNA, 22 nt, Mycobacterium bovis subsp bovis AF2122/97
cgcgccagaacgacaccgcuug

SEQ ID NO: 1047782 - RNA, 19 nt, Mycobacterium bovis subsp bovis AF2122/97
cgcgccaccagcaccgccg

SEQ ID NO: 1047783 - RNA, 15 nt, Mycobacterium bovis subsp bovis AF2122/97
cgcgccaaucgccca

SEQ ID NO: 1047784 - RNA, 20 nt, Mycobacterium bovis subsp bovis AF2122/97
cgcgccaaguggcgcucgca

SEQ ID NO: 1047785 - RNA, 15 nt, Mycobacterium bovis subsp bovis AF2122/97
cgcgccaccagcacc

SEQ ID NO: 1047786 - RNA, 17 nt, Mycobacterium bovis subsp bovis AF2122/97
cgcgccagcucggcggc

SEQ ID NO: 1047787 - RNA, 17 nt, Mycobacterium bovis subsp bovis AF2122/97
cgcgccaggcuugcggc

SEQ ID NO: 1047788 - RNA, 20 nt, Mycobacterium bovis subsp bovis AF2122/97
cgcgccaggcuugcggcacc

SEQ ID NO: 1047789 - RNA, 14 nt, Mycobacterium bovis subsp bovis AF2122/97
cgcgccaggcucga

SEQ ID NO: 1047790 - RNA, 15 nt, Mycobacterium bovis subsp bovis AF2122/97
cgcgccaguguggug

SEQ ID NO: 1047791 - RNA, 17 nt, Mycobacterium bovis subsp bovis AF2122/97
cgcgccauacuggcggu

SEQ ID NO: 1047792 - RNA, 21 nt, Mycobacterium bovis subsp bovis AF2122/97
cgcgccagccuccaccagguc

SEQ ID NO: 1047793 - RNA, 21 nt, Mycobacterium bovis subsp bovis AF2122/97
cgcgccagacacaaccgcuuu

SEQ ID NO: 1047794 - RNA, 13 nt, Mycobacterium bovis subsp bovis AF2122/97
cgcgcccucagcc

SEQ ID NO: 1047795 - RNA, 23 nt, Mycobacterium bovis subsp bovis AF2122/97
cgcgcccgucccacugaccgaac

SEQ ID NO: 1047796 - RNA, 20 nt, Mycobacterium bovis subsp bovis AF2122/97
cgcgcccugcggaucggaca

SEQ ID NO: 1047797 - RNA, 21 nt, Mycobacterium bovis subsp bovis AF2122/97
cgcgccgcaccaucggcgagg

SEQ ID NO: 1047798 - RNA, 14 nt, Mycobacterium bovis subsp bovis AF2122/97
cgcgccgcacccgg

SEQ ID NO: 1047799 - RNA, 16 nt, Mycobacterium bovis subsp bovis AF2122/97
cgcgccgauuccaccg

SEQ ID NO: 1047800 - RNA, 19 nt, Mycobacterium bovis subsp bovis AF2122/97
cgcgccgaugaacguggcg

SEQ ID NO: 1047801 - RNA, 21 nt, Mycobacterium bovis subsp bovis AF2122/97
cgcgccgaacacgcacacgau

SEQ ID NO: 1047802 - RNA, 18 nt, Mycobacterium bovis subsp bovis AF2122/97
cgcgccgaaggccgccac

SEQ ID NO: 1047803 - RNA, 15 nt, Mycobacterium bovis subsp bovis AF2122/97
cgcgcccaccccggc

SEQ ID NO: 1047804 - RNA, 16 nt, Mycobacterium bovis subsp bovis AF2122/97
cgcgcccaccgggcgg

SEQ ID NO: 1047805 - RNA, 22 nt, Mycobacterium bovis subsp bovis AF2122/97
cgcgcccaccaugaucacaccg

SEQ ID NO: 1047806 - RNA, 16 nt, Mycobacterium bovis subsp bovis AF2122/97
cgcgcccagaccgacc

SEQ ID NO: 1047807 - RNA, 20 nt, Mycobacterium bovis subsp bovis AF2122/97
cgcgcccagaccgacccgca

SEQ ID NO: 1047808 - RNA, 19 nt, Mycobacterium bovis subsp bovis AF2122/97
cgcgcccacagcccgggcg

SEQ ID NO: 1047809 - RNA, 13 nt, Mycobacterium bovis subsp bovis AF2122/97
cgcgcccaccaug

SEQ ID NO: 1047810 - RNA, 13 nt, Mycobacterium bovis subsp bovis AF2122/97
cgcgcccaccagc

SEQ ID NO: 1047811 - RNA, 19 nt, Mycobacterium bovis subsp bovis AF2122/97
cgcgcccaccagcggcggc

SEQ ID NO: 1047812 - RNA, 21 nt, Mycobacterium bovis subsp bovis AF2122/97
cgcgccaucgucgcgccgcgu

SEQ ID NO: 1047813 - RNA, 21 nt, Mycobacterium bovis subsp bovis AF2122/97
cgcgccggcggaagcggcggc

SEQ ID NO: 1047814 - RNA, 16 nt, Mycobacterium bovis subsp bovis AF2122/97
cgcgccggcggccacc

SEQ ID NO: 1047815 - RNA, 14 nt, Mycobacterium bovis subsp bovis AF2122/97
cgcgccggcgguag

SEQ ID NO: 1047816 - RNA, 15 nt, Mycobacterium bovis subsp bovis AF2122/97
cgcgccggcgguagu

SEQ ID NO: 1047817 - RNA, 12 nt, Mycobacterium bovis subsp bovis AF2122/97
cgcgccggccgc

SEQ ID NO: 1047818 - RNA, 15 nt, Mycobacterium bovis subsp bovis AF2122/97
cgcgccggcgacccg

SEQ ID NO: 1047819 - RNA, 18 nt, Mycobacterium bovis subsp bovis AF2122/97
cgcgccggcgacccgggu

SEQ ID NO: 1047820 - RNA, 18 nt, Mycobacterium bovis subsp bovis AF2122/97
cgcgccggauguauucca

SEQ ID NO: 1047821 - RNA, 16 nt, Mycobacterium bovis subsp bovis AF2122/97
cgcgccggcacgggcg

SEQ ID NO: 1047822 - RNA, 21 nt, Mycobacterium bovis subsp bovis AF2122/97
cgcgccgcggcccgcuccacg

SEQ ID NO: 1047823 - RNA, 19 nt, Mycobacterium bovis subsp bovis AF2122/97
cgcgccgcgugguuccggc

SEQ ID NO: 1047824 - RNA, 15 nt, Mycobacterium bovis subsp bovis AF2122/97
cgcgccgcaucggcg

SEQ ID NO: 1047825 - RNA, 12 nt, Mycobacterium bovis subsp bovis AF2122/97
cgcgccgcccgc

SEQ ID NO: 1047826 - RNA, 13 nt, Mycobacterium bovis subsp bovis AF2122/97
cgcgccgcagcgc

SEQ ID NO: 1047827 - RNA, 22 nt, Mycobacterium bovis subsp bovis AF2122/97
cgcucccugcacccagccgugc

SEQ ID NO: 1047828 - RNA, 17 nt, Mycobacterium bovis subsp bovis AF2122/97
cgcucccgugcuggcgc

SEQ ID NO: 1047829 - RNA, 19 nt, Mycobacterium bovis subsp bovis AF2122/97
cgcucccgugcuggcgccg

SEQ ID NO: 1047830 - RNA, 18 nt, Mycobacterium bovis subsp bovis AF2122/97
cgcucccucuacacccgg

SEQ ID NO: 1047831 - RNA, 12 nt, Mycobacterium bovis subsp bovis AF2122/97
cgcucccccgcc

SEQ ID NO: 1047832 - RNA, 13 nt, Mycobacterium bovis subsp bovis AF2122/97
cgcucccccgcua

SEQ ID NO: 1047833 - RNA, 13 nt, Mycobacterium bovis subsp bovis AF2122/97
cgcuccgccgggu

SEQ ID NO: 1047834 - RNA, 18 nt, Mycobacterium bovis subsp bovis AF2122/97
cgcuccgccgucgccgcc

SEQ ID NO: 1047835 - RNA, 16 nt, Mycobacterium bovis subsp bovis AF2122/97
cgcuccgcggcgcagc

SEQ ID NO: 1047836 - RNA, 13 nt, Mycobacterium bovis subsp bovis AF2122/97
cgcuccgaccggu

SEQ ID NO: 1047837 - RNA, 15 nt, Mycobacterium bovis subsp bovis AF2122/97
cgcuccgaccggugg

SEQ ID NO: 1047838 - RNA, 21 nt, Mycobacterium bovis subsp bovis AF2122/97
cgcuccgaugugccgauuggc

SEQ ID NO: 1047839 - RNA, 19 nt, Mycobacterium bovis subsp bovis AF2122/97
cgcuccuccggcaccaacg

SEQ ID NO: 1047840 - RNA, 18 nt, Mycobacterium bovis subsp bovis AF2122/97
cgcuccggcccugccgcc

SEQ ID NO: 1047841 - RNA, 14 nt, Mycobacterium bovis subsp bovis AF2122/97
cgcuccugcucguc

SEQ ID NO: 1047842 - RNA, 16 nt, Mycobacterium bovis subsp bovis AF2122/97
cgcucgaaagcgucga

SEQ ID NO: 1047843 - RNA, 20 nt, Mycobacterium bovis subsp bovis AF2122/97
cgcucgaaauccugguggca

SEQ ID NO: 1047844 - RNA, 19 nt, Mycobacterium bovis subsp bovis AF2122/97
cgcuccuucagggcgucga

SEQ ID NO: 1047845 - RNA, 16 nt, Mycobacterium bovis subsp bovis AF2122/97
cgcucgacggcccgcc

SEQ ID NO: 1047846 - RNA, 21 nt, Mycobacterium bovis subsp bovis AF2122/97
cgcucgaccagacgcugccca

SEQ ID NO: 1047847 - RNA, 22 nt, Mycobacterium bovis subsp bovis AF2122/97
cgcuccuugugccugcuguucc

SEQ ID NO: 1047848 - RNA, 15 nt, Mycobacterium bovis subsp bovis AF2122/97
cgcucgaccagacgc

SEQ ID NO: 1047849 - RNA, 13 nt, Mycobacterium bovis subsp bovis AF2122/97
cgcuccagcaccc

SEQ ID NO: 1047850 - RNA, 19 nt, Mycobacterium bovis subsp bovis AF2122/97
cgcuccagcacccgcgcga

SEQ ID NO: 1047851 - RNA, 20 nt, Mycobacterium bovis subsp bovis AF2122/97
cgcuccagccgcgcguccgg

SEQ ID NO: 1047852 - RNA, 17 nt, Mycobacterium bovis subsp bovis AF2122/97
cgcuccagauggggcuc

SEQ ID NO: 1047853 - RNA, 18 nt, Mycobacterium bovis subsp bovis AF2122/97
cgcuccaccucggcguug

SEQ ID NO: 1047854 - RNA, 19 nt, Mycobacterium bovis subsp bovis AF2122/97
cgcuccaccacgaccgcga

SEQ ID NO: 1047855 - RNA, 23 nt, Mycobacterium bovis subsp bovis AF2122/97
cgcuccauaucgucgggcguccc

SEQ ID NO: 1047856 - RNA, 21 nt, Mycobacterium bovis subsp bovis AF2122/97
cgcuccaguggcgccagggcc

SEQ ID NO: 1047857 - RNA, 21 nt, Mycobacterium bovis subsp bovis AF2122/97
cgcuccagcucggccagugcc

SEQ ID NO: 1047858 - RNA, 19 nt, Mycobacterium bovis subsp bovis AF2122/97
cgcuccagcugagcggccg

SEQ ID NO: 1047859 - RNA, 20 nt, Mycobacterium bovis subsp bovis AF2122/97
cgcuccagcugagcggccgg

SEQ ID NO: 1047860 - RNA, 21 nt, Mycobacterium bovis subsp bovis AF2122/97
cgcuccagcugagcggccggc

SEQ ID NO: 1047861 - RNA, 18 nt, Mycobacterium bovis subsp bovis AF2122/97
cgcuccaacaacuccagc

SEQ ID NO: 1047862 - RNA, 20 nt, Mycobacterium bovis subsp bovis AF2122/97
cgcuccaacacccgccgguc

SEQ ID NO: 1047863 - RNA, 20 nt, Mycobacterium bovis subsp bovis AF2122/97
cgcuccaacgcacacaccgu

SEQ ID NO: 1047864 - RNA, 20 nt, Mycobacterium bovis subsp bovis AF2122/97
cgcucauguucucgaccgcg

SEQ ID NO: 1047865 - RNA, 22 nt, Mycobacterium bovis subsp bovis AF2122/97
cgcucauguucucgaccgcguc

SEQ ID NO: 1047866 - RNA, 17 nt, Mycobacterium bovis subsp bovis AF2122/97
cgcucaucgaccggggc

SEQ ID NO: 1047867 - RNA, 17 nt, Mycobacterium bovis subsp bovis AF2122/97
cgcucauaggccggcgg

SEQ ID NO: 1047868 - RNA, 12 nt, Mycobacterium bovis subsp bovis AF2122/97
cgcucaucgacc

SEQ ID NO: 1047869 - RNA, 20 nt, Mycobacterium bovis subsp bovis AF2122/97
cgcguuuugcaggcccgagu

SEQ ID NO: 1047870 - RNA, 20 nt, Mycobacterium bovis subsp bovis AF2122/97
cgcguuucacgaaacccagu

SEQ ID NO: 1047871 - RNA, 18 nt, Mycobacterium bovis subsp bovis AF2122/97
cgcuaaaacgccagucga

SEQ ID NO: 1047872 - RNA, 20 nt, Mycobacterium bovis subsp bovis AF2122/97
cgcguuuagucuccggcguc

SEQ ID NO: 1047873 - RNA, 15 nt, Mycobacterium bovis subsp bovis AF2122/97
cgcguuugcgaagcc

SEQ ID NO: 1047874 - RNA, 17 nt, Mycobacterium bovis subsp bovis AF2122/97
cgcguuugcgaagccca

SEQ ID NO: 1047875 - RNA, 23 nt, Mycobacterium bovis subsp bovis AF2122/97
cgcucugugucgccgaucaccgc

SEQ ID NO: 1047876 - RNA, 14 nt, Mycobacterium bovis subsp bovis AF2122/97
cgcucugugucgcc

SEQ ID NO: 1047877 - RNA, 14 nt, Mycobacterium bovis subsp bovis AF2122/97
cgcucgucgcggcc

SEQ ID NO: 1047878 - RNA, 13 nt, Mycobacterium bovis subsp bovis AF2122/97
cgcucugcggcca

SEQ ID NO: 1047879 - RNA, 16 nt, Mycobacterium bovis subsp bovis AF2122/97
cgcucugcggccacgc

SEQ ID NO: 1047880 - RNA, 23 nt, Mycobacterium bovis subsp bovis AF2122/97
cgcucuucuccagauguccgacg

SEQ ID NO: 1047881 - RNA, 13 nt, Mycobacterium bovis subsp bovis AF2122/97
cgcucuucgaugg

SEQ ID NO: 1047882 - RNA, 18 nt, Mycobacterium bovis subsp bovis AF2122/97
cgcucuucgauggguagc

SEQ ID NO: 1047883 - RNA, 15 nt, Mycobacterium bovis subsp bovis AF2122/97
cgcucgucguccggc

SEQ ID NO: 1047884 - RNA, 16 nt, Mycobacterium bovis subsp bovis AF2122/97
cgcucgucgucaccga

SEQ ID NO: 1047885 - RNA, 21 nt, Mycobacterium bovis subsp bovis AF2122/97
cgcucgucgaccggcccccgg

SEQ ID NO: 1047886 - RNA, 23 nt, Mycobacterium bovis subsp bovis AF2122/97
cgcucugcgccacagcagcguug

SEQ ID NO: 1047887 - RNA, 14 nt, Mycobacterium bovis subsp bovis AF2122/97
cgcucugcugaaau

SEQ ID NO: 1047888 - RNA, 21 nt, Mycobacterium bovis subsp bovis AF2122/97
cgcugaccuuguugaccacca

SEQ ID NO: 1047889 - RNA, 21 nt, Mycobacterium bovis subsp bovis AF2122/97
cgcugaccguuucgaucucga

SEQ ID NO: 1047890 - RNA, 14 nt, Mycobacterium bovis subsp bovis AF2122/97
cgcugaccguuucg

SEQ ID NO: 1047891 - RNA, 20 nt, Mycobacterium bovis subsp bovis AF2122/97
cgcugaccguuucgaucucg

SEQ ID NO: 1047892 - RNA, 19 nt, Mycobacterium bovis subsp bovis AF2122/97
cgcugacuagggucaccga

SEQ ID NO: 1047893 - RNA, 21 nt, Mycobacterium bovis subsp bovis AF2122/97
cgcugacuccugcggcaccgc

SEQ ID NO: 1047894 - RNA, 22 nt, Mycobacterium bovis subsp bovis AF2122/97
cgcugacuccugcggcaccgcu

SEQ ID NO: 1047895 - RNA, 15 nt, Mycobacterium bovis subsp bovis AF2122/97
cgcugaguccccagg

SEQ ID NO: 1047896 - RNA, 17 nt, Mycobacterium bovis subsp bovis AF2122/97
cgcugaguccccaggug

SEQ ID NO: 1047897 - RNA, 16 nt, Mycobacterium bovis subsp bovis AF2122/97
cgcugauagcggucgg

SEQ ID NO: 1047898 - RNA, 21 nt, Mycobacterium bovis subsp bovis AF2122/97
cgcucguagaaucggcucagc

SEQ ID NO: 1047899 - RNA, 22 nt, Mycobacterium bovis subsp bovis AF2122/97
cgcucggugcugcgccgauacg

SEQ ID NO: 1047900 - RNA, 19 nt, Mycobacterium bovis subsp bovis AF2122/97
cgcucgguucggagucacg

SEQ ID NO: 1047901 - RNA, 14 nt, Mycobacterium bovis subsp bovis AF2122/97
cgcucggugccgcc

SEQ ID NO: 1047902 - RNA, 19 nt, Mycobacterium bovis subsp bovis AF2122/97
cgcucggucuccaccaccg

SEQ ID NO: 1047903 - RNA, 22 nt, Mycobacterium bovis subsp bovis AF2122/97
cgcucggucgccaccgccggca

SEQ ID NO: 1047904 - RNA, 22 nt, Mycobacterium bovis subsp bovis AF2122/97
cgcucgggguugcucgcgaucg

SEQ ID NO: 1047905 - RNA, 13 nt, Mycobacterium bovis subsp bovis AF2122/97
cgcucggcguccg

SEQ ID NO: 1047906 - RNA, 19 nt, Mycobacterium bovis subsp bovis AF2122/97
cgcucgggcaacgccucga

SEQ ID NO: 1047907 - RNA, 15 nt, Mycobacterium bovis subsp bovis AF2122/97
cgcucgggcgcgagg

SEQ ID NO: 1047908 - RNA, 20 nt, Mycobacterium bovis subsp bovis AF2122/97
cgcucgggguggucggcucg

SEQ ID NO: 1047909 - RNA, 22 nt, Mycobacterium bovis subsp bovis AF2122/97
cgcucgggguggucggcucguc

SEQ ID NO: 1047910 - RNA, 18 nt, Mycobacterium bovis subsp bovis AF2122/97
cgcucgggguugcucgcg

SEQ ID NO: 1047911 - RNA, 19 nt, Mycobacterium bovis subsp bovis AF2122/97
cgcucgcacccgcucggcg

SEQ ID NO: 1047912 - RNA, 12 nt, Mycobacterium bovis subsp bovis AF2122/97
cgcucgcaccgc

SEQ ID NO: 1047913 - RNA, 18 nt, Mycobacterium bovis subsp bovis AF2122/97
cgcucgcaccgcccgccg

SEQ ID NO: 1047914 - RNA, 14 nt, Mycobacterium bovis subsp bovis AF2122/97
cgcucgcaggccgg

SEQ ID NO: 1047915 - RNA, 19 nt, Mycobacterium bovis subsp bovis AF2122/97
cgcucgaugucggucgggu

SEQ ID NO: 1047916 - RNA, 12 nt, Mycobacterium bovis subsp bovis AF2122/97
cgcucgcacagc

SEQ ID NO: 1047917 - RNA, 19 nt, Mycobacterium bovis subsp bovis AF2122/97
cgcucgauggcggccacca

SEQ ID NO: 1047918 - RNA, 15 nt, Mycobacterium bovis subsp bovis AF2122/97
cgcucgaucggcagc

SEQ ID NO: 1047919 - RNA, 24 nt, Mycobacterium bovis subsp bovis AF2122/97
cgcucgaucggcagccagggcgcc

SEQ ID NO: 1047920 - RNA, 13 nt, Mycobacterium bovis subsp bovis AF2122/97
cgcucgaucaggu

SEQ ID NO: 1047921 - RNA, 22 nt, Mycobacterium bovis subsp bovis AF2122/97
cgcucgcccgccgccaccagcu

SEQ ID NO: 1047922 - RNA, 13 nt, Mycobacterium bovis subsp bovis AF2122/97
cgcucgcccgccg

SEQ ID NO: 1047923 - RNA, 16 nt, Mycobacterium bovis subsp bovis AF2122/97
cgcucgcccgccgcca

SEQ ID NO: 1047924 - RNA, 21 nt, Mycobacterium bovis subsp bovis AF2122/97
cgcucgcccgccgccaccagc

SEQ ID NO: 1047925 - RNA, 18 nt, Mycobacterium bovis subsp bovis AF2122/97
cgcugcucagcaacggcg

SEQ ID NO: 1047926 - RNA, 22 nt, Mycobacterium bovis subsp bovis AF2122/97
cgcugcguugggaucccagcgc

SEQ ID NO: 1047927 - RNA, 15 nt, Mycobacterium bovis subsp bovis AF2122/97
cgcugcucacgcagc

SEQ ID NO: 1047928 - RNA, 13 nt, Mycobacterium bovis subsp bovis AF2122/97
cgcugcgucgugg

SEQ ID NO: 1047929 - RNA, 17 nt, Mycobacterium bovis subsp bovis AF2122/97
cgcugcggugccggccc

SEQ ID NO: 1047930 - RNA, 18 nt, Mycobacterium bovis subsp bovis AF2122/97
cgcugcggugggccaggu

SEQ ID NO: 1047931 - RNA, 20 nt, Mycobacterium bovis subsp bovis AF2122/97
cgcugcguugggaucccagc

SEQ ID NO: 1047932 - RNA, 17 nt, Mycobacterium bovis subsp bovis AF2122/97
cgcugcucagcaacggc

SEQ ID NO: 1047933 - RNA, 21 nt, Mycobacterium bovis subsp bovis AF2122/97
cgcugcuccucgcgguaguug

SEQ ID NO: 1047934 - RNA, 23 nt, Mycobacterium bovis subsp bovis AF2122/97
cgcugcucuuuuagccacaaucg

SEQ ID NO: 1047935 - RNA, 22 nt, Mycobacterium bovis subsp bovis AF2122/97
cgcugcugaacaaccagcaugg

SEQ ID NO: 1047936 - RNA, 21 nt, Mycobacterium bovis subsp bovis AF2122/97
cgcugcggaucguggcgcccg

SEQ ID NO: 1047937 - RNA, 18 nt, Mycobacterium bovis subsp bovis AF2122/97
cgcugcggcaggucgaug

SEQ ID NO: 1047938 - RNA, 15 nt, Mycobacterium bovis subsp bovis AF2122/97
cgcugcggccagcgc

SEQ ID NO: 1047939 - RNA, 16 nt, Mycobacterium bovis subsp bovis AF2122/97
cgcugcggccagcgcg

SEQ ID NO: 1047940 - RNA, 15 nt, Mycobacterium bovis subsp bovis AF2122/97
cgcugcggcccacac

SEQ ID NO: 1047941 - RNA, 12 nt, Mycobacterium bovis subsp bovis AF2122/97
cgcugcggcgcu

SEQ ID NO: 1047942 - RNA, 18 nt, Mycobacterium bovis subsp bovis AF2122/97
cgcugcggcgcuggccag

SEQ ID NO: 1047943 - RNA, 13 nt, Mycobacterium bovis subsp bovis AF2122/97
cgcugcggcggcu

SEQ ID NO: 1047944 - RNA, 16 nt, Mycobacterium bovis subsp bovis AF2122/97
cgcugcggcggcuuug

SEQ ID NO: 1047945 - RNA, 15 nt, Mycobacterium bovis subsp bovis AF2122/97
cgcugcggcgguaug

SEQ ID NO: 1047946 - RNA, 18 nt, Mycobacterium bovis subsp bovis AF2122/97
cgcugcggcgugccgggu

SEQ ID NO: 1047947 - RNA, 19 nt, Mycobacterium bovis subsp bovis AF2122/97
cgcugcggguagccgucga

SEQ ID NO: 1047948 - RNA, 15 nt, Mycobacterium bovis subsp bovis AF2122/97
cgcugcggcaccacc

SEQ ID NO: 1047949 - RNA, 17 nt, Mycobacterium bovis subsp bovis AF2122/97
cgcugcgcgccagacac

SEQ ID NO: 1047950 - RNA, 14 nt, Mycobacterium bovis subsp bovis AF2122/97
cgcugaucagccca

SEQ ID NO: 1047951 - RNA, 13 nt, Mycobacterium bovis subsp bovis AF2122/97
cgcugcccagugg

SEQ ID NO: 1047952 - RNA, 17 nt, Mycobacterium bovis subsp bovis AF2122/97
cgcugauccgggcgccg

SEQ ID NO: 1047953 - RNA, 20 nt, Mycobacterium bovis subsp bovis AF2122/97
cgcugaucagauccucgacu

SEQ ID NO: 1047954 - RNA, 15 nt, Mycobacterium bovis subsp bovis AF2122/97
cgcugauccacgaua

SEQ ID NO: 1047955 - RNA, 20 nt, Mycobacterium bovis subsp bovis AF2122/97
cgcugccgagaucccagcgg

SEQ ID NO: 1047956 - RNA, 15 nt, Mycobacterium bovis subsp bovis AF2122/97
cgcugcccgggcugc

SEQ ID NO: 1047957 - RNA, 16 nt, Mycobacterium bovis subsp bovis AF2122/97
cgcugccccgccgcca

SEQ ID NO: 1047958 - RNA, 18 nt, Mycobacterium bovis subsp bovis AF2122/97
cgcugccccuugggcucg

SEQ ID NO: 1047959 - RNA, 15 nt, Mycobacterium bovis subsp bovis AF2122/97
cgcugcccgccgccc

SEQ ID NO: 1047960 - RNA, 23 nt, Mycobacterium bovis subsp bovis AF2122/97
cgcugccgucggagaccagcucg

SEQ ID NO: 1047961 - RNA, 14 nt, Mycobacterium bovis subsp bovis AF2122/97
cgcugccgguggcg

SEQ ID NO: 1047962 - RNA, 16 nt, Mycobacterium bovis subsp bovis AF2122/97
cgcugccgguggcggc

SEQ ID NO: 1047963 - RNA, 14 nt, Mycobacterium bovis subsp bovis AF2122/97
cgcugccgguguug

SEQ ID NO: 1047964 - RNA, 17 nt, Mycobacterium bovis subsp bovis AF2122/97
cgcugccgaagcggcca

SEQ ID NO: 1047965 - RNA, 20 nt, Mycobacterium bovis subsp bovis AF2122/97
cgcugccgaagcggccaccg

SEQ ID NO: 1047966 - RNA, 22 nt, Mycobacterium bovis subsp bovis AF2122/97
cgcugccuggccgggaccgccc

SEQ ID NO: 1047967 - RNA, 19 nt, Mycobacterium bovis subsp bovis AF2122/97
cgcugccgccaggcucgag

SEQ ID NO: 1047968 - RNA, 21 nt, Mycobacterium bovis subsp bovis AF2122/97
cgcugccucuugcucggcgug

SEQ ID NO: 1047969 - RNA, 20 nt, Mycobacterium bovis subsp bovis AF2122/97
cgcugcgccgucgcagccag

SEQ ID NO: 1047970 - RNA, 23 nt, Mycobacterium bovis subsp bovis AF2122/97
cgcugcgacguugguugcguccg

SEQ ID NO: 1047971 - RNA, 18 nt, Mycobacterium bovis subsp bovis AF2122/97
cgcugcgagaucgcggcg

SEQ ID NO: 1047972 - RNA, 22 nt, Mycobacterium bovis subsp bovis AF2122/97
cgcugccucuugcucggcgugc

SEQ ID NO: 1047973 - RNA, 19 nt, Mycobacterium bovis subsp bovis AF2122/97
cgcugccuucuuugccggc

SEQ ID NO: 1047974 - RNA, 20 nt, Mycobacterium bovis subsp bovis AF2122/97
cgcugccuucuuugccggcg

SEQ ID NO: 1047975 - RNA, 22 nt, Mycobacterium bovis subsp bovis AF2122/97
cgcugccuucuuugccggcgcc

SEQ ID NO: 1047976 - RNA, 15 nt, Mycobacterium bovis subsp bovis AF2122/97
cgcugggaggcgcgg

SEQ ID NO: 1047977 - RNA, 15 nt, Mycobacterium bovis subsp bovis AF2122/97
cgcuggccggcaccg

SEQ ID NO: 1047978 - RNA, 20 nt, Mycobacterium bovis subsp bovis AF2122/97
cgcugggacgggcgcgucgg

SEQ ID NO: 1047979 - RNA, 22 nt, Mycobacterium bovis subsp bovis AF2122/97
cgcugggacgggcgcgucggcg

SEQ ID NO: 1047980 - RNA, 22 nt, Mycobacterium bovis subsp bovis AF2122/97
cgcugggacggucgcucggcau

SEQ ID NO: 1047981 - RNA, 15 nt, Mycobacterium bovis subsp bovis AF2122/97
cgcugggccagggug

SEQ ID NO: 1047982 - RNA, 16 nt, Mycobacterium bovis subsp bovis AF2122/97
cgcugggcccgagcgc

SEQ ID NO: 1047983 - RNA, 13 nt, Mycobacterium bovis subsp bovis AF2122/97
cgcugggccgacc

SEQ ID NO: 1047984 - RNA, 16 nt, Mycobacterium bovis subsp bovis AF2122/97
cgcugggccgaccgcc

SEQ ID NO: 1047985 - RNA, 20 nt, Mycobacterium bovis subsp bovis AF2122/97
cgcuggucggcuaccgccga

SEQ ID NO: 1047986 - RNA, 15 nt, Mycobacterium bovis subsp bovis AF2122/97
cgcuggucgucgagu

SEQ ID NO: 1047987 - RNA, 22 nt, Mycobacterium bovis subsp bovis AF2122/97
cgcugggcgcgcucaucgaccg

SEQ ID NO: 1047988 - RNA, 15 nt, Mycobacterium bovis subsp bovis AF2122/97
cgcugggcccaggag

SEQ ID NO: 1047989 - RNA, 13 nt, Mycobacterium bovis subsp bovis AF2122/97
cgcugggcgcaac

SEQ ID NO: 1047990 - RNA, 13 nt, Mycobacterium bovis subsp bovis AF2122/97
cgcuggccgucga

SEQ ID NO: 1047991 - RNA, 17 nt, Mycobacterium bovis subsp bovis AF2122/97
cgcuggccuccagcuug

SEQ ID NO: 1047992 - RNA, 23 nt, Mycobacterium bovis subsp bovis AF2122/97
cgcuggccaugguggcgccgacg

SEQ ID NO: 1047993 - RNA, 19 nt, Mycobacterium bovis subsp bovis AF2122/97
cgcuggcccaauugcgccg

SEQ ID NO: 1047994 - RNA, 19 nt, Mycobacterium bovis subsp bovis AF2122/97
cgcuggccacgauccgcgg

SEQ ID NO: 1047995 - RNA, 19 nt, Mycobacterium bovis subsp bovis AF2122/97
cgcugcugccgcaccggug

SEQ ID NO: 1047996 - RNA, 20 nt, Mycobacterium bovis subsp bovis AF2122/97
cgcugcugccgcaccggugc

SEQ ID NO: 1047997 - RNA, 16 nt, Mycobacterium bovis subsp bovis AF2122/97
cgcugcuggcagacca

SEQ ID NO: 1047998 - RNA, 19 nt, Mycobacterium bovis subsp bovis AF2122/97
cgcugcugccauugccgau

SEQ ID NO: 1047999 - RNA, 13 nt, Mycobacterium bovis subsp bovis AF2122/97
cgcugcugccgca

SEQ ID NO: 1048000 - RNA, 15 nt, Mycobacterium bovis subsp bovis AF2122/97
cgcugcugcgaucgc

SEQ ID NO: 1048001 - RNA, 16 nt, Mycobacterium bovis subsp bovis AF2122/97
cgcugcugcgaucgcc

SEQ ID NO: 1048002 - RNA, 23 nt, Mycobacterium bovis subsp bovis AF2122/97
cgcugcugcgaucgccgcgcugg

SEQ ID NO: 1048003 - RNA, 14 nt, Mycobacterium bovis subsp bovis AF2122/97
cgcugcugcgggug

SEQ ID NO: 1048004 - RNA, 22 nt, Mycobacterium bovis subsp bovis AF2122/97
cgcugcuugucgaggcgcaggu

SEQ ID NO: 1048005 - RNA, 23 nt, Mycobacterium bovis subsp bovis AF2122/97
cgcugcuugucgaggcgcagguc

SEQ ID NO: 1048006 - RNA, 21 nt, Mycobacterium bovis subsp bovis AF2122/97
cgcuggacaguuacgcuggca

SEQ ID NO: 1048007 - RNA, 22 nt, Mycobacterium bovis subsp bovis AF2122/97
cgcuggccagaaacgcgauggu

SEQ ID NO: 1048008 - RNA, 15 nt, Mycobacterium bovis subsp bovis AF2122/97
cgcuggcauaucccu

SEQ ID NO: 1048009 - RNA, 12 nt, Mycobacterium bovis subsp bovis AF2122/97
cgcuggccacga

SEQ ID NO: 1048010 - RNA, 18 nt, Mycobacterium bovis subsp bovis AF2122/97
cgcuggccacgauccgcg

SEQ ID NO: 1048011 - RNA, 20 nt, Mycobacterium bovis subsp bovis AF2122/97
cgcuggaugugggcgcucgc

SEQ ID NO: 1048012 - RNA, 21 nt, Mycobacterium bovis subsp bovis AF2122/97
cgcuggcaaucccgcggucga

SEQ ID NO: 1048013 - RNA, 19 nt, Mycobacterium bovis subsp bovis AF2122/97
cgcuggaucgacuucggug

SEQ ID NO: 1048014 - RNA, 17 nt, Mycobacterium bovis subsp bovis AF2122/97
cgcuggaucgugcuggu

SEQ ID NO: 1048015 - RNA, 12 nt, Mycobacterium bovis subsp bovis AF2122/97
cgcuggaggcga

SEQ ID NO: 1048016 - RNA, 15 nt, Mycobacterium bovis subsp bovis AF2122/97
cgcuggaggcggcgc

SEQ ID NO: 1048017 - RNA, 23 nt, Mycobacterium bovis subsp bovis AF2122/97
cgcuggaggcuccuggucgccgu

SEQ ID NO: 1048018 - RNA, 15 nt, Mycobacterium bovis subsp bovis AF2122/97
cgcuggaggccacca

SEQ ID NO: 1048019 - RNA, 17 nt, Mycobacterium bovis subsp bovis AF2122/97
cgcuggaucaacccggc

SEQ ID NO: 1048020 - RNA, 15 nt, Mycobacterium bovis subsp bovis AF2122/97
cgcuggagacguuga

SEQ ID NO: 1048021 - RNA, 21 nt, Mycobacterium bovis subsp bovis AF2122/97
cgcuggagaucacgccgacga

SEQ ID NO: 1048022 - RNA, 14 nt, Mycobacterium bovis subsp bovis AF2122/97
cgcuggacggaucu

SEQ ID NO: 1048023 - RNA, 14 nt, Mycobacterium bovis subsp bovis AF2122/97
cgcuggaccggguc

SEQ ID NO: 1048024 - RNA, 14 nt, Mycobacterium bovis subsp bovis AF2122/97
cgcuggaccugaug

SEQ ID NO: 1048025 - RNA, 19 nt, Mycobacterium bovis subsp bovis AF2122/97
cgcggucucagugcucgcc

SEQ ID NO: 1048026 - RNA, 17 nt, Mycobacterium bovis subsp bovis AF2122/97
cgcggugacgccagccu

SEQ ID NO: 1048027 - RNA, 22 nt, Mycobacterium bovis subsp bovis AF2122/97
cgcggucugcuccaggcgcgcc

SEQ ID NO: 1048028 - RNA, 14 nt, Mycobacterium bovis subsp bovis AF2122/97
cgcggugacgagcc

SEQ ID NO: 1048029 - RNA, 19 nt, Mycobacterium bovis subsp bovis AF2122/97
cgcggugacgagccaccac

SEQ ID NO: 1048030 - RNA, 12 nt, Mycobacterium bovis subsp bovis AF2122/97
cgcggugacgau

SEQ ID NO: 1048031 - RNA, 20 nt, Mycobacterium bovis subsp bovis AF2122/97
cgcggugacgauugccacca

SEQ ID NO: 1048032 - RNA, 23 nt, Mycobacterium bovis subsp bovis AF2122/97
cgcggugacgauugccaccaaug

SEQ ID NO: 1048033 - RNA, 20 nt, Mycobacterium bovis subsp bovis AF2122/97
cgcggugaccggcucggcgg

SEQ ID NO: 1048034 - RNA, 21 nt, Mycobacterium bovis subsp bovis AF2122/97
cgcggugaccggcucggcggu

SEQ ID NO: 1048035 - RNA, 23 nt, Mycobacterium bovis subsp bovis AF2122/97
cgcggucugcgccuucgccagcg

SEQ ID NO: 1048036 - RNA, 17 nt, Mycobacterium bovis subsp bovis AF2122/97
cgcggucugcgcgucgc

SEQ ID NO: 1048037 - RNA, 18 nt, Mycobacterium bovis subsp bovis AF2122/97
cgcggucgugaucagcag

SEQ ID NO: 1048038 - RNA, 19 nt, Mycobacterium bovis subsp bovis AF2122/97
cgcggucgugaucagcagg

SEQ ID NO: 1048039 - RNA, 13 nt, Mycobacterium bovis subsp bovis AF2122/97
cgcggucggcgug

SEQ ID NO: 1048040 - RNA, 14 nt, Mycobacterium bovis subsp bovis AF2122/97
cgcggucggcggcc

SEQ ID NO: 1048041 - RNA, 17 nt, Mycobacterium bovis subsp bovis AF2122/97
cgcggucggcggccgcc

SEQ ID NO: 1048042 - RNA, 18 nt, Mycobacterium bovis subsp bovis AF2122/97
cgcggucggcggccgcca

SEQ ID NO: 1048043 - RNA, 18 nt, Mycobacterium bovis subsp bovis AF2122/97
cgcggugaguucgccgga

SEQ ID NO: 1048044 - RNA, 13 nt, Mycobacterium bovis subsp bovis AF2122/97
cgcggugacggcg

SEQ ID NO: 1048045 - RNA, 16 nt, Mycobacterium bovis subsp bovis AF2122/97
cgcggugacggcggcu

SEQ ID NO: 1048046 - RNA, 21 nt, Mycobacterium bovis subsp bovis AF2122/97
cgcgguuguggcugaucccgg

SEQ ID NO: 1048047 - RNA, 20 nt, Mycobacterium bovis subsp bovis AF2122/97
cgcgguuggcaguggcgcgg

SEQ ID NO: 1048048 - RNA, 23 nt, Mycobacterium bovis subsp bovis AF2122/97
cgcgguuggcaguggcgcggcga

SEQ ID NO: 1048049 - RNA, 13 nt, Mycobacterium bovis subsp bovis AF2122/97
cgcgguuggcggc

SEQ ID NO: 1048050 - RNA, 14 nt, Mycobacterium bovis subsp bovis AF2122/97
cgcgguuggcggcg

SEQ ID NO: 1048051 - RNA, 21 nt, Mycobacterium bovis subsp bovis AF2122/97
cgcgguuggcugaugacgcgg

SEQ ID NO: 1048052 - RNA, 18 nt, Mycobacterium bovis subsp bovis AF2122/97
cgcguaacuugccgcaua

SEQ ID NO: 1048053 - RNA, 19 nt, Mycobacterium bovis subsp bovis AF2122/97
cgcgguuuuucgcaguggc

SEQ ID NO: 1048054 - RNA, 15 nt, Mycobacterium bovis subsp bovis AF2122/97
cgcgguuuucggcug

SEQ ID NO: 1048055 - RNA, 18 nt, Mycobacterium bovis subsp bovis AF2122/97
cgcgguuuucggcugccg

SEQ ID NO: 1048056 - RNA, 15 nt, Mycobacterium bovis subsp bovis AF2122/97
cgcgguuuucgccgg

SEQ ID NO: 1048057 - RNA, 18 nt, Mycobacterium bovis subsp bovis AF2122/97
cgcgguuugcacgucacg

SEQ ID NO: 1048058 - RNA, 20 nt, Mycobacterium bovis subsp bovis AF2122/97
cgcgguuuggcgacgucgac

SEQ ID NO: 1048059 - RNA, 14 nt, Mycobacterium bovis subsp bovis AF2122/97
cgcguacugaucuu

SEQ ID NO: 1048060 - RNA, 17 nt, Mycobacterium bovis subsp bovis AF2122/97
cgcguacaggccggcca

SEQ ID NO: 1048061 - RNA, 16 nt, Mycobacterium bovis subsp bovis AF2122/97
cgcguaguccgcaucc

SEQ ID NO: 1048062 - RNA, 20 nt, Mycobacterium bovis subsp bovis AF2122/97
cgcguaguaaugcucgacgu

SEQ ID NO: 1048063 - RNA, 12 nt, Mycobacterium bovis subsp bovis AF2122/97
cgcguaugccag

SEQ ID NO: 1048064 - RNA, 13 nt, Mycobacterium bovis subsp bovis AF2122/97
cgcguagucgcgg

SEQ ID NO: 1048065 - RNA, 17 nt, Mycobacterium bovis subsp bovis AF2122/97
cgcguauucggcaucgc

SEQ ID NO: 1048066 - RNA, 23 nt, Mycobacterium bovis subsp bovis AF2122/97
cgcgucaacgcuguugucgucca

SEQ ID NO: 1048067 - RNA, 19 nt, Mycobacterium bovis subsp bovis AF2122/97
cgcguauucggcaucgccg

SEQ ID NO: 1048068 - RNA, 22 nt, Mycobacterium bovis subsp bovis AF2122/97
cgcguagcuggccagguugccg

SEQ ID NO: 1048069 - RNA, 16 nt, Mycobacterium bovis subsp bovis AF2122/97
cgcguagggccagcgc

SEQ ID NO: 1048070 - RNA, 12 nt, Mycobacterium bovis subsp bovis AF2122/97
cgcguacgucgg

SEQ ID NO: 1048071 - RNA, 16 nt, Mycobacterium bovis subsp bovis AF2122/97
cgcguagagcagcagc

SEQ ID NO: 1048072 - RNA, 17 nt, Mycobacterium bovis subsp bovis AF2122/97
cgcguagagcagcagcg

SEQ ID NO: 1048073 - RNA, 20 nt, Mycobacterium bovis subsp bovis AF2122/97
cgcguagagccgaucaccgc

SEQ ID NO: 1048074 - RNA, 21 nt, Mycobacterium bovis subsp bovis AF2122/97
cgcguagagccgaucaccgcc

SEQ ID NO: 1048075 - RNA, 22 nt, Mycobacterium bovis subsp bovis AF2122/97
cgcggcggaacaccgacgacac

SEQ ID NO: 1048076 - RNA, 18 nt, Mycobacterium bovis subsp bovis AF2122/97
cgcggcgcugaugccguc

SEQ ID NO: 1048077 - RNA, 15 nt, Mycobacterium bovis subsp bovis AF2122/97
cgcgggcgucccgca

SEQ ID NO: 1048078 - RNA, 18 nt, Mycobacterium bovis subsp bovis AF2122/97
cgcgggcgucccgcauac

SEQ ID NO: 1048079 - RNA, 15 nt, Mycobacterium bovis subsp bovis AF2122/97
cgcgggcucgguggc

SEQ ID NO: 1048080 - RNA, 16 nt, Mycobacterium bovis subsp bovis AF2122/97
cgcgggcucgguggcg

SEQ ID NO: 1048081 - RNA, 12 nt, Mycobacterium bovis subsp bovis AF2122/97
cgcgggcucccc

SEQ ID NO: 1048082 - RNA, 22 nt, Mycobacterium bovis subsp bovis AF2122/97
cgcgggcuaucgguucagcugc

SEQ ID NO: 1048083 - RNA, 21 nt, Mycobacterium bovis subsp bovis AF2122/97
cgcgggcgugccgaccagcau

SEQ ID NO: 1048084 - RNA, 22 nt, Mycobacterium bovis subsp bovis AF2122/97
cgcgggcguugcugauggugcc

SEQ ID NO: 1048085 - RNA, 14 nt, Mycobacterium bovis subsp bovis AF2122/97
cgcggggcagcggg

SEQ ID NO: 1048086 - RNA, 19 nt, Mycobacterium bovis subsp bovis AF2122/97
cgcggggaugcgaccgccg

SEQ ID NO: 1048087 - RNA, 17 nt, Mycobacterium bovis subsp bovis AF2122/97
cgcgggugaucuccacc

SEQ ID NO: 1048088 - RNA, 21 nt, Mycobacterium bovis subsp bovis AF2122/97
cgcgggugaucuccaccggcg

SEQ ID NO: 1048089 - RNA, 22 nt, Mycobacterium bovis subsp bovis AF2122/97
cgcgggucuuggcacacagguc

SEQ ID NO: 1048090 - RNA, 13 nt, Mycobacterium bovis subsp bovis AF2122/97
cgcgggucggcga

SEQ ID NO: 1048091 - RNA, 13 nt, Mycobacterium bovis subsp bovis AF2122/97
cgcggguccagcc

SEQ ID NO: 1048092 - RNA, 22 nt, Mycobacterium bovis subsp bovis AF2122/97
cgcggguacuuacgggucgcgg

SEQ ID NO: 1048093 - RNA, 12 nt, Mycobacterium bovis subsp bovis AF2122/97
cgcggguagcgg

SEQ ID NO: 1048094 - RNA, 13 nt, Mycobacterium bovis subsp bovis AF2122/97
cgcggguagcggu

SEQ ID NO: 1048095 - RNA, 14 nt, Mycobacterium bovis subsp bovis AF2122/97
cgcgggucgcgcga

SEQ ID NO: 1048096 - RNA, 16 nt, Mycobacterium bovis subsp bovis AF2122/97
cgcgguacugcgcagc

SEQ ID NO: 1048097 - RNA, 17 nt, Mycobacterium bovis subsp bovis AF2122/97
cgcgguacugcgcagcg

SEQ ID NO: 1048098 - RNA, 14 nt, Mycobacterium bovis subsp bovis AF2122/97
cgcgguagacgccg

SEQ ID NO: 1048099 - RNA, 15 nt, Mycobacterium bovis subsp bovis AF2122/97
cgcgguagacgccgc

SEQ ID NO: 1048100 - RNA, 17 nt, Mycobacterium bovis subsp bovis AF2122/97
cgcgguagacgccgccg

SEQ ID NO: 1048101 - RNA, 17 nt, Mycobacterium bovis subsp bovis AF2122/97
cgcggguggcagcggcg

SEQ ID NO: 1048102 - RNA, 23 nt, Mycobacterium bovis subsp bovis AF2122/97
cgcgggugcuggucaacagcggc

SEQ ID NO: 1048103 - RNA, 19 nt, Mycobacterium bovis subsp bovis AF2122/97
cgcggguggaaguacuucg

SEQ ID NO: 1048104 - RNA, 23 nt, Mycobacterium bovis subsp bovis AF2122/97
cgcggguggauguuugcucggcc

SEQ ID NO: 1048105 - RNA, 19 nt, Mycobacterium bovis subsp bovis AF2122/97
cgcgggugaucugggcggu

SEQ ID NO: 1048106 - RNA, 21 nt, Mycobacterium bovis subsp bovis AF2122/97
cgcgggugaugacgccgucgg

SEQ ID NO: 1048107 - RNA, 16 nt, Mycobacterium bovis subsp bovis AF2122/97
cgcgggugaccaacac

SEQ ID NO: 1048108 - RNA, 18 nt, Mycobacterium bovis subsp bovis AF2122/97
cgcgggugaccaggcggc

SEQ ID NO: 1048109 - RNA, 19 nt, Mycobacterium bovis subsp bovis AF2122/97
cgcgggugaccaggcggcg

SEQ ID NO: 1048110 - RNA, 21 nt, Mycobacterium bovis subsp bovis AF2122/97
cgcgggugaccaggcggcgcg

SEQ ID NO: 1048111 - RNA, 18 nt, Mycobacterium bovis subsp bovis AF2122/97
cgcgggugcgcugcagcg

SEQ ID NO: 1048112 - RNA, 17 nt, Mycobacterium bovis subsp bovis AF2122/97
cgcgggugcggacaccg

SEQ ID NO: 1048113 - RNA, 17 nt, Mycobacterium bovis subsp bovis AF2122/97
cgcgguagccgcggcca

SEQ ID NO: 1048114 - RNA, 16 nt, Mycobacterium bovis subsp bovis AF2122/97
cgcgguagcucgucga

SEQ ID NO: 1048115 - RNA, 18 nt, Mycobacterium bovis subsp bovis AF2122/97
cgcgguagcucgucgagg

SEQ ID NO: 1048116 - RNA, 21 nt, Mycobacterium bovis subsp bovis AF2122/97
cgcgguaggugcaugucgaug

SEQ ID NO: 1048117 - RNA, 19 nt, Mycobacterium bovis subsp bovis AF2122/97
cgcgguagucguugccgau

SEQ ID NO: 1048118 - RNA, 22 nt, Mycobacterium bovis subsp bovis AF2122/97
cgcgguaguggaacagucgagg

SEQ ID NO: 1048119 - RNA, 19 nt, Mycobacterium bovis subsp bovis AF2122/97
cgcggucaaauccagcagc

SEQ ID NO: 1048120 - RNA, 18 nt, Mycobacterium bovis subsp bovis AF2122/97
cgcgguccaucccgagcu

SEQ ID NO: 1048121 - RNA, 12 nt, Mycobacterium bovis subsp bovis AF2122/97
cgcggucggcca

SEQ ID NO: 1048122 - RNA, 19 nt, Mycobacterium bovis subsp bovis AF2122/97
cgcggucggccaccaacuc

SEQ ID NO: 1048123 - RNA, 14 nt, Mycobacterium bovis subsp bovis AF2122/97
cgcggucccacggc

SEQ ID NO: 1048124 - RNA, 16 nt, Mycobacterium bovis subsp bovis AF2122/97
cgcggucccacggccg

SEQ ID NO: 1048125 - RNA, 18 nt, Mycobacterium bovis subsp bovis AF2122/97
cgcggucccacggccggc

SEQ ID NO: 1048126 - RNA, 17 nt, Mycobacterium bovis subsp bovis AF2122/97
cgcggucccacucgucg

SEQ ID NO: 1048127 - RNA, 15 nt, Mycobacterium bovis subsp bovis AF2122/97
cgcgguccaacagcg

SEQ ID NO: 1048128 - RNA, 17 nt, Mycobacterium bovis subsp bovis AF2122/97
cgcggucaucauggccg

SEQ ID NO: 1048129 - RNA, 19 nt, Mycobacterium bovis subsp bovis AF2122/97
cgcggucagcucggcagca

SEQ ID NO: 1048130 - RNA, 15 nt, Mycobacterium bovis subsp bovis AF2122/97
cgcggucagauccag

SEQ ID NO: 1048131 - RNA, 17 nt, Mycobacterium bovis subsp bovis AF2122/97
cgcggucagcgggucga

SEQ ID NO: 1048132 - RNA, 12 nt, Mycobacterium bovis subsp bovis AF2122/97
cgcggucagcgg

SEQ ID NO: 1048133 - RNA, 13 nt, Mycobacterium bovis subsp bovis AF2122/97
cgcggucagcggg

SEQ ID NO: 1048134 - RNA, 13 nt, Mycobacterium bovis subsp bovis AF2122/97
cgcggucaccccg

SEQ ID NO: 1048135 - RNA, 14 nt, Mycobacterium bovis subsp bovis AF2122/97
cgcggucaccgacg

SEQ ID NO: 1048136 - RNA, 17 nt, Mycobacterium bovis subsp bovis AF2122/97
cgcggucaccgacgcag

SEQ ID NO: 1048137 - RNA, 11 nt, Mycobacterium bovis subsp bovis AF2122/97
cgcguccgcga

SEQ ID NO: 1048138 - RNA, 16 nt, Mycobacterium bovis subsp bovis AF2122/97
cgcguccgcgcguugc

SEQ ID NO: 1048139 - RNA, 15 nt, Mycobacterium bovis subsp bovis AF2122/97
cgcguccgggcagcc

SEQ ID NO: 1048140 - RNA, 16 nt, Mycobacterium bovis subsp bovis AF2122/97
cgcguccgggcagccg

SEQ ID NO: 1048141 - RNA, 21 nt, Mycobacterium bovis subsp bovis AF2122/97
cgcguccgggcagccgcgccg

SEQ ID NO: 1048142 - RNA, 15 nt, Mycobacterium bovis subsp bovis AF2122/97
cgcguccucgccgca

SEQ ID NO: 1048143 - RNA, 23 nt, Mycobacterium bovis subsp bovis AF2122/97
cgcguccucgccgcacgccggca

SEQ ID NO: 1048144 - RNA, 20 nt, Mycobacterium bovis subsp bovis AF2122/97
cgcguccucggggaggucga

SEQ ID NO: 1048145 - RNA, 21 nt, Mycobacterium bovis subsp bovis AF2122/97
cgcgucgaauuccggcucacc

SEQ ID NO: 1048146 - RNA, 22 nt, Mycobacterium bovis subsp bovis AF2122/97
cgcgucgaauuccggcucaccg

SEQ ID NO: 1048147 - RNA, 19 nt, Mycobacterium bovis subsp bovis AF2122/97
cgcgucgaacugggcgccc

SEQ ID NO: 1048148 - RNA, 16 nt, Mycobacterium bovis subsp bovis AF2122/97
cgcgucgaagccgggg

SEQ ID NO: 1048149 - RNA, 23 nt, Mycobacterium bovis subsp bovis AF2122/97
cgcgucgagugccgccaccgcca

SEQ ID NO: 1048150 - RNA, 22 nt, Mycobacterium bovis subsp bovis AF2122/97
cgcgucgagcgacccccagcgc

SEQ ID NO: 1048151 - RNA, 15 nt, Mycobacterium bovis subsp bovis AF2122/97
cgcgucgagcgccgg

SEQ ID NO: 1048152 - RNA, 18 nt, Mycobacterium bovis subsp bovis AF2122/97
cgcgucgagcgccggccg

SEQ ID NO: 1048153 - RNA, 24 nt, Mycobacterium bovis subsp bovis AF2122/97
cgcgucgaucguuccgcuggacgg

SEQ ID NO: 1048154 - RNA, 23 nt, Mycobacterium bovis subsp bovis AF2122/97
cgcgucgaauuccggcucaccga

SEQ ID NO: 1048155 - RNA, 14 nt, Mycobacterium bovis subsp bovis AF2122/97
cgcgucgccaggcc

SEQ ID NO: 1048156 - RNA, 14 nt, Mycobacterium bovis subsp bovis AF2122/97
cgcgucgccgauga

SEQ ID NO: 1048157 - RNA, 13 nt, Mycobacterium bovis subsp bovis AF2122/97
cgcgucgccgacg

SEQ ID NO: 1048158 - RNA, 13 nt, Mycobacterium bovis subsp bovis AF2122/97
cgcgucgauaucg

SEQ ID NO: 1048159 - RNA, 14 nt, Mycobacterium bovis subsp bovis AF2122/97
cgcgucgccggccg

SEQ ID NO: 1048160 - RNA, 21 nt, Mycobacterium bovis subsp bovis AF2122/97
cgcgucgccggccuugagcac

SEQ ID NO: 1048161 - RNA, 14 nt, Mycobacterium bovis subsp bovis AF2122/97
cgcgucggagccgg

SEQ ID NO: 1048162 - RNA, 23 nt, Mycobacterium bovis subsp bovis AF2122/97
cgcguccagaccguagcggccgg

SEQ ID NO: 1048163 - RNA, 15 nt, Mycobacterium bovis subsp bovis AF2122/97
cgcguccaaggcgcg

SEQ ID NO: 1048164 - RNA, 23 nt, Mycobacterium bovis subsp bovis AF2122/97
cgcguccacccacgaucagcagc

SEQ ID NO: 1048165 - RNA, 20 nt, Mycobacterium bovis subsp bovis AF2122/97
cgcguccaggugcgccgugg

SEQ ID NO: 1048166 - RNA, 21 nt, Mycobacterium bovis subsp bovis AF2122/97
cgcguccaggugcgccguggc

SEQ ID NO: 1048167 - RNA, 20 nt, Mycobacterium bovis subsp bovis AF2122/97
cgcguccaaccaaggacgaa

SEQ ID NO: 1048168 - RNA, 14 nt, Mycobacterium bovis subsp bovis AF2122/97
cgcguccagcuggc

SEQ ID NO: 1048169 - RNA, 16 nt, Mycobacterium bovis subsp bovis AF2122/97
cgcguccagcgcggcc

SEQ ID NO: 1048170 - RNA, 14 nt, Mycobacterium bovis subsp bovis AF2122/97
cgcgucccgccgca

SEQ ID NO: 1048171 - RNA, 20 nt, Mycobacterium bovis subsp bovis AF2122/97
cgcgucccgccgcaccgccg

SEQ ID NO: 1048172 - RNA, 21 nt, Mycobacterium bovis subsp bovis AF2122/97
cgcguccccagcgccaccguu

SEQ ID NO: 1048173 - RNA, 23 nt, Mycobacterium bovis subsp bovis AF2122/97
cgcgucaguccucaucgagcgcg

SEQ ID NO: 1048174 - RNA, 17 nt, Mycobacterium bovis subsp bovis AF2122/97
cgcgucacggaccugga

SEQ ID NO: 1048175 - RNA, 14 nt, Mycobacterium bovis subsp bovis AF2122/97
cgcgucaucaccgg

SEQ ID NO: 1048176 - RNA, 22 nt, Mycobacterium bovis subsp bovis AF2122/97
cgcgucaucaccgguacugcga

SEQ ID NO: 1048177 - RNA, 23 nt, Mycobacterium bovis subsp bovis AF2122/97
cgcgucacauccgacagcagccg

SEQ ID NO: 1048178 - RNA, 23 nt, Mycobacterium bovis subsp bovis AF2122/97
cgcgucacaccagcgggcaucgc

SEQ ID NO: 1048179 - RNA, 14 nt, Mycobacterium bovis subsp bovis AF2122/97
cgcgucacaccagc

SEQ ID NO: 1048180 - RNA, 17 nt, Mycobacterium bovis subsp bovis AF2122/97
cgcgucacaccagcggg

SEQ ID NO: 1048181 - RNA, 19 nt, Mycobacterium bovis subsp bovis AF2122/97
cgcgucaccggaggccgcc

SEQ ID NO: 1048182 - RNA, 21 nt, Mycobacterium bovis subsp bovis AF2122/97
cgcgucaccggaggccgccgc

SEQ ID NO: 1048183 - RNA, 14 nt, Mycobacterium bovis subsp bovis AF2122/97
cgcgucaggccagc

SEQ ID NO: 1048184 - RNA, 16 nt, Mycobacterium bovis subsp bovis AF2122/97
cgcgucaggccagcgc

SEQ ID NO: 1048185 - RNA, 15 nt, Mycobacterium bovis subsp bovis AF2122/97
cgcgucagcggcgag

SEQ ID NO: 1048186 - RNA, 17 nt, Mycobacterium bovis subsp bovis AF2122/97
cgcgucagcggcgagca

SEQ ID NO: 1048187 - RNA, 22 nt, Mycobacterium bovis subsp bovis AF2122/97
cgcgucagccgcaccccgcccg

SEQ ID NO: 1048188 - RNA, 13 nt, Mycobacterium bovis subsp bovis AF2122/97
cgcguugcacagc

SEQ ID NO: 1048189 - RNA, 21 nt, Mycobacterium bovis subsp bovis AF2122/97
cgcguugaugaccgccgccgg

SEQ ID NO: 1048190 - RNA, 22 nt, Mycobacterium bovis subsp bovis AF2122/97
cgcguuggacaauucgacgaac

SEQ ID NO: 1048191 - RNA, 15 nt, Mycobacterium bovis subsp bovis AF2122/97
cgcguuguccgcggc

SEQ ID NO: 1048192 - RNA, 23 nt, Mycobacterium bovis subsp bovis AF2122/97
cgcguugggcaccuuggccagga

SEQ ID NO: 1048193 - RNA, 16 nt, Mycobacterium bovis subsp bovis AF2122/97
cgcguuaugccaggcg

SEQ ID NO: 1048194 - RNA, 17 nt, Mycobacterium bovis subsp bovis AF2122/97
cgcguucaggaugccag

SEQ ID NO: 1048195 - RNA, 21 nt, Mycobacterium bovis subsp bovis AF2122/97
cgcguggugcugaccgcgccg

SEQ ID NO: 1048196 - RNA, 20 nt, Mycobacterium bovis subsp bovis AF2122/97
cgcguggugccuacaccggc

SEQ ID NO: 1048197 - RNA, 17 nt, Mycobacterium bovis subsp bovis AF2122/97
cgcguggugcugaccgc

SEQ ID NO: 1048198 - RNA, 14 nt, Mycobacterium bovis subsp bovis AF2122/97
cgcgugguucgguc

SEQ ID NO: 1048199 - RNA, 18 nt, Mycobacterium bovis subsp bovis AF2122/97
cgcgugugcgucgcacga

SEQ ID NO: 1048200 - RNA, 15 nt, Mycobacterium bovis subsp bovis AF2122/97
cgcgugacgaccagc

SEQ ID NO: 1048201 - RNA, 16 nt, Mycobacterium bovis subsp bovis AF2122/97
cgcgugacguaccacg

SEQ ID NO: 1048202 - RNA, 15 nt, Mycobacterium bovis subsp bovis AF2122/97
cgcgucggagccggg

SEQ ID NO: 1048203 - RNA, 17 nt, Mycobacterium bovis subsp bovis AF2122/97
cgcgucggagccgggca

SEQ ID NO: 1048204 - RNA, 14 nt, Mycobacterium bovis subsp bovis AF2122/97
cgcgucggcgauga

SEQ ID NO: 1048205 - RNA, 17 nt, Mycobacterium bovis subsp bovis AF2122/97
cgcgucggaccguuucg

SEQ ID NO: 1048206 - RNA, 17 nt, Mycobacterium bovis subsp bovis AF2122/97
cgcgucggcguuggggc

SEQ ID NO: 1048207 - RNA, 13 nt, Mycobacterium bovis subsp bovis AF2122/97
cgcgucggcugcc

SEQ ID NO: 1048208 - RNA, 14 nt, Mycobacterium bovis subsp bovis AF2122/97
cgcgucggcugccg

SEQ ID NO: 1048209 - RNA, 13 nt, Mycobacterium bovis subsp bovis AF2122/97
cgcgucggcguug

SEQ ID NO: 1048210 - RNA, 13 nt, Mycobacterium bovis subsp bovis AF2122/97
cgcgucggcggcc

SEQ ID NO: 1048211 - RNA, 17 nt, Mycobacterium bovis subsp bovis AF2122/97
cgcgucggcggccagua

SEQ ID NO: 1048212 - RNA, 13 nt, Mycobacterium bovis subsp bovis AF2122/97
cgcgucggucacc

SEQ ID NO: 1048213 - RNA, 14 nt, Mycobacterium bovis subsp bovis AF2122/97
cgcgucggucaccg

SEQ ID NO: 1048214 - RNA, 16 nt, Mycobacterium bovis subsp bovis AF2122/97
cgcgucgggcucggcg

SEQ ID NO: 1048215 - RNA, 17 nt, Mycobacterium bovis subsp bovis AF2122/97
cgcgucgggcucggcga

SEQ ID NO: 1048216 - RNA, 21 nt, Mycobacterium bovis subsp bovis AF2122/97
cgcgucggcguuggggcucgu

SEQ ID NO: 1048217 - RNA, 12 nt, Mycobacterium bovis subsp bovis AF2122/97
cgcgucgggccg

SEQ ID NO: 1048218 - RNA, 14 nt, Mycobacterium bovis subsp bovis AF2122/97
cgcgucgggccgca

SEQ ID NO: 1048219 - RNA, 16 nt, Mycobacterium bovis subsp bovis AF2122/97
cgcgucguagcgcucg

SEQ ID NO: 1048220 - RNA, 17 nt, Mycobacterium bovis subsp bovis AF2122/97
cgcgucggugucgaugc

SEQ ID NO: 1048221 - RNA, 18 nt, Mycobacterium bovis subsp bovis AF2122/97
cgcgucggugucgaugcu

SEQ ID NO: 1048222 - RNA, 21 nt, Mycobacterium bovis subsp bovis AF2122/97
cgcgucgguugauugugccca

SEQ ID NO: 1048223 - RNA, 14 nt, Mycobacterium bovis subsp bovis AF2122/97
cgcgucgucccagu

SEQ ID NO: 1048224 - RNA, 12 nt, Mycobacterium bovis subsp bovis AF2122/97
cgcgucgucggu

SEQ ID NO: 1048225 - RNA, 16 nt, Mycobacterium bovis subsp bovis AF2122/97
cgcgucguggucggcg

SEQ ID NO: 1048226 - RNA, 23 nt, Mycobacterium bovis subsp bovis AF2122/97
cgcgucguugucgucgccggcgg

SEQ ID NO: 1048227 - RNA, 22 nt, Mycobacterium bovis subsp bovis AF2122/97
cgcgucguuugggugcgccguc

SEQ ID NO: 1048228 - RNA, 24 nt, Mycobacterium bovis subsp bovis AF2122/97
cgcgucucguugauacggcaugcg

SEQ ID NO: 1048229 - RNA, 14 nt, Mycobacterium bovis subsp bovis AF2122/97
cgcgucugcucgcg

SEQ ID NO: 1048230 - RNA, 15 nt, Mycobacterium bovis subsp bovis AF2122/97
cgcgucugcucggcg

SEQ ID NO: 1048231 - RNA, 17 nt, Mycobacterium bovis subsp bovis AF2122/97
cgcgucugcucgccagc

SEQ ID NO: 1048232 - RNA, 18 nt, Mycobacterium bovis subsp bovis AF2122/97
cgcgucugcucgccagcg

SEQ ID NO: 1048233 - RNA, 19 nt, Mycobacterium bovis subsp bovis AF2122/97
cgcgucugcucgccagcgg

SEQ ID NO: 1048234 - RNA, 17 nt, Mycobacterium bovis subsp bovis AF2122/97
cgcgucugggugcaggu

SEQ ID NO: 1048235 - RNA, 14 nt, Mycobacterium bovis subsp bovis AF2122/97
cgcgucugggugca

SEQ ID NO: 1048236 - RNA, 13 nt, Mycobacterium bovis subsp bovis AF2122/97
cgccggcgccgga

SEQ ID NO: 1048237 - RNA, 15 nt, Mycobacterium bovis subsp bovis AF2122/97
cgccggcgccucgug

SEQ ID NO: 1048238 - RNA, 13 nt, Mycobacterium bovis subsp bovis AF2122/97
cgccggcgccggu

SEQ ID NO: 1048239 - RNA, 16 nt, Mycobacterium bovis subsp bovis AF2122/97
cgccggcgccggugcc

SEQ ID NO: 1048240 - RNA, 14 nt, Mycobacterium bovis subsp bovis AF2122/97
cgccggcgcgcacc

SEQ ID NO: 1048241 - RNA, 20 nt, Mycobacterium bovis subsp bovis AF2122/97
cgccggcgccucgugcgugg

SEQ ID NO: 1048242 - RNA, 18 nt, Mycobacterium bovis subsp bovis AF2122/97
cgccggcgcgccgggcgg

SEQ ID NO: 1048243 - RNA, 13 nt, Mycobacterium bovis subsp bovis AF2122/97
cgccggcgcgccg

SEQ ID NO: 1048244 - RNA, 23 nt, Mycobacterium bovis subsp bovis AF2122/97
cgccggcgcugcugccauugccg

SEQ ID NO: 1048245 - RNA, 14 nt, Mycobacterium bovis subsp bovis AF2122/97
cgccggcgcugcca

SEQ ID NO: 1048246 - RNA, 14 nt, Mycobacterium bovis subsp bovis AF2122/97
cgccggcggccgcg

SEQ ID NO: 1048247 - RNA, 16 nt, Mycobacterium bovis subsp bovis AF2122/97
cgccggcggccaccuc

SEQ ID NO: 1048248 - RNA, 12 nt, Mycobacterium bovis subsp bovis AF2122/97
cgccggcggccc

SEQ ID NO: 1048249 - RNA, 14 nt, Mycobacterium bovis subsp bovis AF2122/97
cgccggcggaagcg

SEQ ID NO: 1048250 - RNA, 24 nt, Mycobacterium bovis subsp bovis AF2122/97
cgccggcggacgcccggcgcacca

SEQ ID NO: 1048251 - RNA, 14 nt, Mycobacterium bovis subsp bovis AF2122/97
cgccggcgacggcg

SEQ ID NO: 1048252 - RNA, 12 nt, Mycobacterium bovis subsp bovis AF2122/97
cgccggcgacgg

SEQ ID NO: 1048253 - RNA, 19 nt, Mycobacterium bovis subsp bovis AF2122/97
cgccggcgccaagucucgg

SEQ ID NO: 1048254 - RNA, 12 nt, Mycobacterium bovis subsp bovis AF2122/97
cgccggcgcccg

SEQ ID NO: 1048255 - RNA, 19 nt, Mycobacterium bovis subsp bovis AF2122/97
cgccggcgcccggggcggu

SEQ ID NO: 1048256 - RNA, 22 nt, Mycobacterium bovis subsp bovis AF2122/97
cgccggcgcccggggcgguggg

SEQ ID NO: 1048257 - RNA, 14 nt, Mycobacterium bovis subsp bovis AF2122/97
cgccggcgccgcca

SEQ ID NO: 1048258 - RNA, 18 nt, Mycobacterium bovis subsp bovis AF2122/97
cgccggcgccgccauugc

SEQ ID NO: 1048259 - RNA, 14 nt, Mycobacterium bovis subsp bovis AF2122/97
cgccggcgccgccg

SEQ ID NO: 1048260 - RNA, 19 nt, Mycobacterium bovis subsp bovis AF2122/97
cgccggcgccgccgaugcc

SEQ ID NO: 1048261 - RNA, 16 nt, Mycobacterium bovis subsp bovis AF2122/97
cgccggcgccgccggc

SEQ ID NO: 1048262 - RNA, 22 nt, Mycobacterium bovis subsp bovis AF2122/97
cgccggcgccgccggcgccgcc

SEQ ID NO: 1048263 - RNA, 19 nt, Mycobacterium bovis subsp bovis AF2122/97
cgccggcgccgccggugcc

SEQ ID NO: 1048264 - RNA, 22 nt, Mycobacterium bovis subsp bovis AF2122/97
cgccggcgccgccggugccacc

SEQ ID NO: 1048265 - RNA, 14 nt, Mycobacterium bovis subsp bovis AF2122/97
cgccggcgccaccc

SEQ ID NO: 1048266 - RNA, 16 nt, Mycobacterium bovis subsp bovis AF2122/97
cgccggcgccacccgc

SEQ ID NO: 1048267 - RNA, 17 nt, Mycobacterium bovis subsp bovis AF2122/97
cgccggcgccacccgcg

SEQ ID NO: 1048268 - RNA, 23 nt, Mycobacterium bovis subsp bovis AF2122/97
cgccggcgccacccgcgccgccc

SEQ ID NO: 1048269 - RNA, 16 nt, Mycobacterium bovis subsp bovis AF2122/97
cgccggcgccaccguc

SEQ ID NO: 1048270 - RNA, 23 nt, Mycobacterium bovis subsp bovis AF2122/97
cgccggcgccaccgucaccgccg

SEQ ID NO: 1048271 - RNA, 20 nt, Mycobacterium bovis subsp bovis AF2122/97
cgccggcgccaccgucgccg

SEQ ID NO: 1048272 - RNA, 15 nt, Mycobacterium bovis subsp bovis AF2122/97
cgccggcgccagcag

SEQ ID NO: 1048273 - RNA, 16 nt, Mycobacterium bovis subsp bovis AF2122/97
cgccggcgccagcgcc

SEQ ID NO: 1048274 - RNA, 22 nt, Mycobacterium bovis subsp bovis AF2122/97
cgccggcgccaucgggucaccc

SEQ ID NO: 1048275 - RNA, 13 nt, Mycobacterium bovis subsp bovis AF2122/97
cgccggcgcccag

SEQ ID NO: 1048276 - RNA, 18 nt, Mycobacterium bovis subsp bovis AF2122/97
cgccggcgcccaggccga

SEQ ID NO: 1048277 - RNA, 15 nt, Mycobacterium bovis subsp bovis AF2122/97
cgccggcggcggccg

SEQ ID NO: 1048278 - RNA, 17 nt, Mycobacterium bovis subsp bovis AF2122/97
cgccggcggcggccgca

SEQ ID NO: 1048279 - RNA, 13 nt, Mycobacterium bovis subsp bovis AF2122/97
cgccggcggcggu

SEQ ID NO: 1048280 - RNA, 14 nt, Mycobacterium bovis subsp bovis AF2122/97
cgccggcgggcugu

SEQ ID NO: 1048281 - RNA, 15 nt, Mycobacterium bovis subsp bovis AF2122/97
cgccggcggcggugc

SEQ ID NO: 1048282 - RNA, 14 nt, Mycobacterium bovis subsp bovis AF2122/97
cgccggcggugaug

SEQ ID NO: 1048283 - RNA, 21 nt, Mycobacterium bovis subsp bovis AF2122/97
cgccggcggugauguggaugc

SEQ ID NO: 1048284 - RNA, 13 nt, Mycobacterium bovis subsp bovis AF2122/97
cgccggcgguggc

SEQ ID NO: 1048285 - RNA, 16 nt, Mycobacterium bovis subsp bovis AF2122/97
cgccggcugcggaggc

SEQ ID NO: 1048286 - RNA, 16 nt, Mycobacterium bovis subsp bovis AF2122/97
cgccggcucgccggcg

SEQ ID NO: 1048287 - RNA, 20 nt, Mycobacterium bovis subsp bovis AF2122/97
cgccggcuccgccguugccg

SEQ ID NO: 1048288 - RNA, 22 nt, Mycobacterium bovis subsp bovis AF2122/97
cgccggcuccgccguugccgcc

SEQ ID NO: 1048289 - RNA, 23 nt, Mycobacterium bovis subsp bovis AF2122/97
cgccggcuccgccguugccgccg

SEQ ID NO: 1048290 - RNA, 13 nt, Mycobacterium bovis subsp bovis AF2122/97
cgccggcuccggc

SEQ ID NO: 1048291 - RNA, 20 nt, Mycobacterium bovis subsp bovis AF2122/97
cgccggcuucggguguucgc

SEQ ID NO: 1048292 - RNA, 16 nt, Mycobacterium bovis subsp bovis AF2122/97
cgccggcuuggauacc

SEQ ID NO: 1048293 - RNA, 16 nt, Mycobacterium bovis subsp bovis AF2122/97
cgccggcggcggugcg

SEQ ID NO: 1048294 - RNA, 13 nt, Mycobacterium bovis subsp bovis AF2122/97
cgccggcuccacc

SEQ ID NO: 1048295 - RNA, 14 nt, Mycobacterium bovis subsp bovis AF2122/97
cgccggcuccaccc

SEQ ID NO: 1048296 - RNA, 12 nt, Mycobacterium bovis subsp bovis AF2122/97
cgccggcuccgc

SEQ ID NO: 1048297 - RNA, 16 nt, Mycobacterium bovis subsp bovis AF2122/97
cgccggcuccgcagcg

SEQ ID NO: 1048298 - RNA, 14 nt, Mycobacterium bovis subsp bovis AF2122/97
cgccggcuccgcca

SEQ ID NO: 1048299 - RNA, 15 nt, Mycobacterium bovis subsp bovis AF2122/97
cgccggcuccgccac

SEQ ID NO: 1048300 - RNA, 19 nt, Mycobacterium bovis subsp bovis AF2122/97
cgccggcuccgccacuggc

SEQ ID NO: 1048301 - RNA, 20 nt, Mycobacterium bovis subsp bovis AF2122/97
cgccggcuccgccacuggcg

SEQ ID NO: 1048302 - RNA, 15 nt, Mycobacterium bovis subsp bovis AF2122/97
cgccggcgucggcgc

SEQ ID NO: 1048303 - RNA, 18 nt, Mycobacterium bovis subsp bovis AF2122/97
cgccggcgucggcgccca

SEQ ID NO: 1048304 - RNA, 19 nt, Mycobacterium bovis subsp bovis AF2122/97
cgccggcgugcaugagccg

SEQ ID NO: 1048305 - RNA, 22 nt, Mycobacterium bovis subsp bovis AF2122/97
cgccggcuagggcccuggcggc

SEQ ID NO: 1048306 - RNA, 20 nt, Mycobacterium bovis subsp bovis AF2122/97
cgccggcguuugggcaucau

SEQ ID NO: 1048307 - RNA, 12 nt, Mycobacterium bovis subsp bovis AF2122/97
cgccgggucacg

SEQ ID NO: 1048308 - RNA, 16 nt, Mycobacterium bovis subsp bovis AF2122/97
cgccgggucagcccgg

SEQ ID NO: 1048309 - RNA, 17 nt, Mycobacterium bovis subsp bovis AF2122/97
cgccgggucagcccggc

SEQ ID NO: 1048310 - RNA, 21 nt, Mycobacterium bovis subsp bovis AF2122/97
cgccgggucagcccggcgcga

SEQ ID NO: 1048311 - RNA, 17 nt, Mycobacterium bovis subsp bovis AF2122/97
cgccgggugcaacggcg

SEQ ID NO: 1048312 - RNA, 19 nt, Mycobacterium bovis subsp bovis AF2122/97
cgccgggugcaacggcguu

SEQ ID NO: 1048313 - RNA, 13 nt, Mycobacterium bovis subsp bovis AF2122/97
cgccggguccgcc

SEQ ID NO: 1048314 - RNA, 20 nt, Mycobacterium bovis subsp bovis AF2122/97
cgccggguccggaaccggua

SEQ ID NO: 1048315 - RNA, 16 nt, Mycobacterium bovis subsp bovis AF2122/97
cgccgggucgaugggu

SEQ ID NO: 1048316 - RNA, 19 nt, Mycobacterium bovis subsp bovis AF2122/97
cgccgguaggcggccagcg

SEQ ID NO: 1048317 - RNA, 20 nt, Mycobacterium bovis subsp bovis AF2122/97
cgccgguaggcggccagcgc

SEQ ID NO: 1048318 - RNA, 19 nt, Mycobacterium bovis subsp bovis AF2122/97
cgccgggucguacaacacg

SEQ ID NO: 1048319 - RNA, 14 nt, Mycobacterium bovis subsp bovis AF2122/97
cgccgggugcaggc

SEQ ID NO: 1048320 - RNA, 14 nt, Mycobacterium bovis subsp bovis AF2122/97
cgccgguaggcggc

SEQ ID NO: 1048321 - RNA, 19 nt, Mycobacterium bovis subsp bovis AF2122/97
cgccggucaaacugccauc

SEQ ID NO: 1048322 - RNA, 13 nt, Mycobacterium bovis subsp bovis AF2122/97
cgccggucacgac

SEQ ID NO: 1048323 - RNA, 13 nt, Mycobacterium bovis subsp bovis AF2122/97
cgccggugccgcc

SEQ ID NO: 1048324 - RNA, 15 nt, Mycobacterium bovis subsp bovis AF2122/97
cgccggugccgauga

SEQ ID NO: 1048325 - RNA, 14 nt, Mycobacterium bovis subsp bovis AF2122/97
cgccggugccgcca

SEQ ID NO: 1048326 - RNA, 14 nt, Mycobacterium bovis subsp bovis AF2122/97
cgccggugccgccc

SEQ ID NO: 1048327 - RNA, 23 nt, Mycobacterium bovis subsp bovis AF2122/97
cgccggugccgccggugccgcca

SEQ ID NO: 1048328 - RNA, 15 nt, Mycobacterium bovis subsp bovis AF2122/97
cgccggugccgccgu

SEQ ID NO: 1048329 - RNA, 19 nt, Mycobacterium bovis subsp bovis AF2122/97
cgccggugccgccgucgcc

SEQ ID NO: 1048330 - RNA, 20 nt, Mycobacterium bovis subsp bovis AF2122/97
cgccggugccgccgucgccg

SEQ ID NO: 1048331 - RNA, 17 nt, Mycobacterium bovis subsp bovis AF2122/97
cgccggucacgacgucc

SEQ ID NO: 1048332 - RNA, 13 nt, Mycobacterium bovis subsp bovis AF2122/97
cgccggugccgau

SEQ ID NO: 1048333 - RNA, 21 nt, Mycobacterium bovis subsp bovis AF2122/97
cgccggugccgaucagcagug

SEQ ID NO: 1048334 - RNA, 15 nt, Mycobacterium bovis subsp bovis AF2122/97
cgccggucaggccgc

SEQ ID NO: 1048335 - RNA, 16 nt, Mycobacterium bovis subsp bovis AF2122/97
cgccggucaggccgcc

SEQ ID NO: 1048336 - RNA, 17 nt, Mycobacterium bovis subsp bovis AF2122/97
cgccggucaggccgccg

SEQ ID NO: 1048337 - RNA, 14 nt, Mycobacterium bovis subsp bovis AF2122/97
cgccggugcugacg

SEQ ID NO: 1048338 - RNA, 21 nt, Mycobacterium bovis subsp bovis AF2122/97
cgccggugcgcaacuucgacu

SEQ ID NO: 1048339 - RNA, 22 nt, Mycobacterium bovis subsp bovis AF2122/97
cgccggugcgcuggaucuucga

SEQ ID NO: 1048340 - RNA, 14 nt, Mycobacterium bovis subsp bovis AF2122/97
cgccggugcggcca

SEQ ID NO: 1048341 - RNA, 22 nt, Mycobacterium bovis subsp bovis AF2122/97
cgccggugcggccaaugacguc

SEQ ID NO: 1048342 - RNA, 21 nt, Mycobacterium bovis subsp bovis AF2122/97
cgccgguggccgcgcugguca

SEQ ID NO: 1048343 - RNA, 15 nt, Mycobacterium bovis subsp bovis AF2122/97
cgccggugccggcca

SEQ ID NO: 1048344 - RNA, 19 nt, Mycobacterium bovis subsp bovis AF2122/97
cgccgguggcagagccgcc

SEQ ID NO: 1048345 - RNA, 16 nt, Mycobacterium bovis subsp bovis AF2122/97
cgccgggaagccgcau

SEQ ID NO: 1048346 - RNA, 15 nt, Mycobacterium bovis subsp bovis AF2122/97
cgccgggaaacaccg

SEQ ID NO: 1048347 - RNA, 19 nt, Mycobacterium bovis subsp bovis AF2122/97
cgccgggaaacaccggcuu

SEQ ID NO: 1048348 - RNA, 20 nt, Mycobacterium bovis subsp bovis AF2122/97
cgccgggaaauaucucggug

SEQ ID NO: 1048349 - RNA, 20 nt, Mycobacterium bovis subsp bovis AF2122/97
cgccgggcgaguacaggcgc

SEQ ID NO: 1048350 - RNA, 22 nt, Mycobacterium bovis subsp bovis AF2122/97
cgccgggcgaguacaggcgcag

SEQ ID NO: 1048351 - RNA, 17 nt, Mycobacterium bovis subsp bovis AF2122/97
cgccggguagcuguaca

SEQ ID NO: 1048352 - RNA, 18 nt, Mycobacterium bovis subsp bovis AF2122/97
cgccgggcuucagcacgc

SEQ ID NO: 1048353 - RNA, 18 nt, Mycobacterium bovis subsp bovis AF2122/97
cgccggggauaccgguca

SEQ ID NO: 1048354 - RNA, 14 nt, Mycobacterium bovis subsp bovis AF2122/97
cgccggggacgccg

SEQ ID NO: 1048355 - RNA, 17 nt, Mycobacterium bovis subsp bovis AF2122/97
cgccggggauaccgguc

SEQ ID NO: 1048356 - RNA, 23 nt, Mycobacterium bovis subsp bovis AF2122/97
cgccgggcuuggccgcgccgguc

SEQ ID NO: 1048357 - RNA, 19 nt, Mycobacterium bovis subsp bovis AF2122/97
cgccgggcguccgccggcg

SEQ ID NO: 1048358 - RNA, 12 nt, Mycobacterium bovis subsp bovis AF2122/97
cgccgggcugca

SEQ ID NO: 1048359 - RNA, 20 nt, Mycobacterium bovis subsp bovis AF2122/97
cgccggauacgucagcccga

SEQ ID NO: 1048360 - RNA, 16 nt, Mycobacterium bovis subsp bovis AF2122/97
cgccggauagcgcagc

SEQ ID NO: 1048361 - RNA, 15 nt, Mycobacterium bovis subsp bovis AF2122/97
cgccggauauggcag

SEQ ID NO: 1048362 - RNA, 20 nt, Mycobacterium bovis subsp bovis AF2122/97
cgccggaguucugcgaucac

SEQ ID NO: 1048363 - RNA, 13 nt, Mycobacterium bovis subsp bovis AF2122/97
cgccggagucgac

SEQ ID NO: 1048364 - RNA, 13 nt, Mycobacterium bovis subsp bovis AF2122/97
cgccggagccgcc

SEQ ID NO: 1048365 - RNA, 14 nt, Mycobacterium bovis subsp bovis AF2122/97
cgccggagccgccc

SEQ ID NO: 1048366 - RNA, 20 nt, Mycobacterium bovis subsp bovis AF2122/97
cgccggagccgcccaagccg

SEQ ID NO: 1048367 - RNA, 16 nt, Mycobacterium bovis subsp bovis AF2122/97
cgccggagccaacggc

SEQ ID NO: 1048368 - RNA, 14 nt, Mycobacterium bovis subsp bovis AF2122/97
cgccggaggcaagc

SEQ ID NO: 1048369 - RNA, 16 nt, Mycobacterium bovis subsp bovis AF2122/97
cgccggaggcaagcaa

SEQ ID NO: 1048370 - RNA, 21 nt, Mycobacterium bovis subsp bovis AF2122/97
cgccggaggcaagcaaccggu

SEQ ID NO: 1048371 - RNA, 22 nt, Mycobacterium bovis subsp bovis AF2122/97
cgccggaggcaagcaaccggug

SEQ ID NO: 1048372 - RNA, 15 nt, Mycobacterium bovis subsp bovis AF2122/97
cgccggaacugcgca

SEQ ID NO: 1048373 - RNA, 16 nt, Mycobacterium bovis subsp bovis AF2122/97
cgccggaacugcgcaa

SEQ ID NO: 1048374 - RNA, 16 nt, Mycobacterium bovis subsp bovis AF2122/97
cgccggacugcggccc

SEQ ID NO: 1048375 - RNA, 21 nt, Mycobacterium bovis subsp bovis AF2122/97
cgccggacugcggcccgaccc

SEQ ID NO: 1048376 - RNA, 23 nt, Mycobacterium bovis subsp bovis AF2122/97
cgccggacugcggcccgacccgg

SEQ ID NO: 1048377 - RNA, 18 nt, Mycobacterium bovis subsp bovis AF2122/97
cgccgcuuucuuggcggg

SEQ ID NO: 1048378 - RNA, 20 nt, Mycobacterium bovis subsp bovis AF2122/97
cgccgcuuucuuggcgggcg

SEQ ID NO: 1048379 - RNA, 21 nt, Mycobacterium bovis subsp bovis AF2122/97
cgccggaaagcccgucgucgg

SEQ ID NO: 1048380 - RNA, 14 nt, Mycobacterium bovis subsp bovis AF2122/97
cgccggagaugaca

SEQ ID NO: 1048381 - RNA, 13 nt, Mycobacterium bovis subsp bovis AF2122/97
cgccgcugccgau

SEQ ID NO: 1048382 - RNA, 14 nt, Mycobacterium bovis subsp bovis AF2122/97
cgccgcugccgauc

SEQ ID NO: 1048383 - RNA, 12 nt, Mycobacterium bovis subsp bovis AF2122/97
cgccgcugccgc

SEQ ID NO: 1048384 - RNA, 14 nt, Mycobacterium bovis subsp bovis AF2122/97
cgccgcugccgccg

SEQ ID NO: 1048385 - RNA, 18 nt, Mycobacterium bovis subsp bovis AF2122/97
cgccgcugccgccgagcu

SEQ ID NO: 1048386 - RNA, 13 nt, Mycobacterium bovis subsp bovis AF2122/97
cgccgcugccauc

SEQ ID NO: 1048387 - RNA, 13 nt, Mycobacterium bovis subsp bovis AF2122/97
cgccgcugccgcg

SEQ ID NO: 1048388 - RNA, 21 nt, Mycobacterium bovis subsp bovis AF2122/97
cgccgcugccgguagcacagc

SEQ ID NO: 1048389 - RNA, 14 nt, Mycobacterium bovis subsp bovis AF2122/97
cgccgcugccgcgc

SEQ ID NO: 1048390 - RNA, 24 nt, Mycobacterium bovis subsp bovis AF2122/97
cgccgcugccgcgcggcgagagcc

SEQ ID NO: 1048391 - RNA, 16 nt, Mycobacterium bovis subsp bovis AF2122/97
cgccgcuuggcccggc

SEQ ID NO: 1048392 - RNA, 19 nt, Mycobacterium bovis subsp bovis AF2122/97
cgccgcuuggcccggcaaa

SEQ ID NO: 1048393 - RNA, 14 nt, Mycobacterium bovis subsp bovis AF2122/97
cgccgcuuggcgau

SEQ ID NO: 1048394 - RNA, 14 nt, Mycobacterium bovis subsp bovis AF2122/97
cgccgccgucguac

SEQ ID NO: 1048395 - RNA, 14 nt, Mycobacterium bovis subsp bovis AF2122/97
cgccgccgucggcg

SEQ ID NO: 1048396 - RNA, 16 nt, Mycobacterium bovis subsp bovis AF2122/97
cgccgccggugccgcc

SEQ ID NO: 1048397 - RNA, 15 nt, Mycobacterium bovis subsp bovis AF2122/97
cgccgccgucaccgc

SEQ ID NO: 1048398 - RNA, 14 nt, Mycobacterium bovis subsp bovis AF2122/97
cgccgccguccagc

SEQ ID NO: 1048399 - RNA, 21 nt, Mycobacterium bovis subsp bovis AF2122/97
cgccgccguuaccgccggcgc

SEQ ID NO: 1048400 - RNA, 21 nt, Mycobacterium bovis subsp bovis AF2122/97
cgccgccguucccgccggcgc

SEQ ID NO: 1048401 - RNA, 12 nt, Mycobacterium bovis subsp bovis AF2122/97
cgccgccguugc

SEQ ID NO: 1048402 - RNA, 15 nt, Mycobacterium bovis subsp bovis AF2122/97
cgccgccguugccgc

SEQ ID NO: 1048403 - RNA, 16 nt, Mycobacterium bovis subsp bovis AF2122/97
cgccgccguugccgcc

SEQ ID NO: 1048404 - RNA, 17 nt, Mycobacterium bovis subsp bovis AF2122/97
cgccgccguugccgcca

SEQ ID NO: 1048405 - RNA, 18 nt, Mycobacterium bovis subsp bovis AF2122/97
cgccgccguugccgccgg

SEQ ID NO: 1048406 - RNA, 19 nt, Mycobacterium bovis subsp bovis AF2122/97
cgccgccguugccgccggc

SEQ ID NO: 1048407 - RNA, 18 nt, Mycobacterium bovis subsp bovis AF2122/97
cgccgccggugccaccga

SEQ ID NO: 1048408 - RNA, 18 nt, Mycobacterium bovis subsp bovis AF2122/97
cgccgccggugccaccgg

SEQ ID NO: 1048409 - RNA, 19 nt, Mycobacterium bovis subsp bovis AF2122/97
cgccgccggugccaccggc

SEQ ID NO: 1048410 - RNA, 14 nt, Mycobacterium bovis subsp bovis AF2122/97
cgccgccggccgcc

SEQ ID NO: 1048411 - RNA, 14 nt, Mycobacterium bovis subsp bovis AF2122/97
cgccgccggccccg

SEQ ID NO: 1048412 - RNA, 16 nt, Mycobacterium bovis subsp bovis AF2122/97
cgccgccggcaccgcc

SEQ ID NO: 1048413 - RNA, 18 nt, Mycobacterium bovis subsp bovis AF2122/97
cgccgccggcaccgccgg

SEQ ID NO: 1048414 - RNA, 13 nt, Mycobacterium bovis subsp bovis AF2122/97
cgccgccggcacc

SEQ ID NO: 1048415 - RNA, 14 nt, Mycobacterium bovis subsp bovis AF2122/97
cgccgccggcaccg

SEQ ID NO: 1048416 - RNA, 15 nt, Mycobacterium bovis subsp bovis AF2122/97
cgccgccggcaccgc

SEQ ID NO: 1048417 - RNA, 16 nt, Mycobacterium bovis subsp bovis AF2122/97
cgccgcguucagggca

SEQ ID NO: 1048418 - RNA, 19 nt, Mycobacterium bovis subsp bovis AF2122/97
cgccgcguuucggucguug

SEQ ID NO: 1048419 - RNA, 20 nt, Mycobacterium bovis subsp bovis AF2122/97
cgccgcguuucggucguugg

SEQ ID NO: 1048420 - RNA, 18 nt, Mycobacterium bovis subsp bovis AF2122/97
cgccgcuaacgcaccugc

SEQ ID NO: 1048421 - RNA, 19 nt, Mycobacterium bovis subsp bovis AF2122/97
cgccgcuaccccagccggc

SEQ ID NO: 1048422 - RNA, 15 nt, Mycobacterium bovis subsp bovis AF2122/97
cgccgcuacccccga

SEQ ID NO: 1048423 - RNA, 14 nt, Mycobacterium bovis subsp bovis AF2122/97
cgccgcuaccgccc

SEQ ID NO: 1048424 - RNA, 16 nt, Mycobacterium bovis subsp bovis AF2122/97
cgccgcuaccgcccgc

SEQ ID NO: 1048425 - RNA, 13 nt, Mycobacterium bovis subsp bovis AF2122/97
cgccgcuacgccg

SEQ ID NO: 1048426 - RNA, 14 nt, Mycobacterium bovis subsp bovis AF2122/97
cgccgcucgguccc

SEQ ID NO: 1048427 - RNA, 16 nt, Mycobacterium bovis subsp bovis AF2122/97
cgccgcucgguccccg

SEQ ID NO: 1048428 - RNA, 19 nt, Mycobacterium bovis subsp bovis AF2122/97
cgccgcuaauggauccagc

SEQ ID NO: 1048429 - RNA, 19 nt, Mycobacterium bovis subsp bovis AF2122/97
cgccgcuaggugacgccgc

SEQ ID NO: 1048430 - RNA, 13 nt, Mycobacterium bovis subsp bovis AF2122/97
cgccgcuacccca

SEQ ID NO: 1048431 - RNA, 21 nt, Mycobacterium bovis subsp bovis AF2122/97
cgccgccguugccgccguugc

SEQ ID NO: 1048432 - RNA, 18 nt, Mycobacterium bovis subsp bovis AF2122/97
cgccgccguuggcucgag

SEQ ID NO: 1048433 - RNA, 17 nt, Mycobacterium bovis subsp bovis AF2122/97
cgccgcgugcugcggcu

SEQ ID NO: 1048434 - RNA, 13 nt, Mycobacterium bovis subsp bovis AF2122/97
cgccggcccgacg

SEQ ID NO: 1048435 - RNA, 22 nt, Mycobacterium bovis subsp bovis AF2122/97
cgccggccccgccgucaccgcc

SEQ ID NO: 1048436 - RNA, 18 nt, Mycobacterium bovis subsp bovis AF2122/97
cgccggccccgccgucgc

SEQ ID NO: 1048437 - RNA, 19 nt, Mycobacterium bovis subsp bovis AF2122/97
cgccggccccgccgucgcc

SEQ ID NO: 1048438 - RNA, 20 nt, Mycobacterium bovis subsp bovis AF2122/97
cgccggccccgccgucgccg

SEQ ID NO: 1048439 - RNA, 22 nt, Mycobacterium bovis subsp bovis AF2122/97
cgccggccccgccguuaccgcc

SEQ ID NO: 1048440 - RNA, 18 nt, Mycobacterium bovis subsp bovis AF2122/97
cgccggccccgccagcgc

SEQ ID NO: 1048441 - RNA, 19 nt, Mycobacterium bovis subsp bovis AF2122/97
cgccggccccgccagcgcc

SEQ ID NO: 1048442 - RNA, 22 nt, Mycobacterium bovis subsp bovis AF2122/97
cgccggccccgccagcgccgcc

SEQ ID NO: 1048443 - RNA, 23 nt, Mycobacterium bovis subsp bovis AF2122/97
cgccggccccgccagcgccgccg

SEQ ID NO: 1048444 - RNA, 17 nt, Mycobacterium bovis subsp bovis AF2122/97
cgccggccccgccgaug

SEQ ID NO: 1048445 - RNA, 23 nt, Mycobacterium bovis subsp bovis AF2122/97
cgccggccccgccggccccgccg

SEQ ID NO: 1048446 - RNA, 17 nt, Mycobacterium bovis subsp bovis AF2122/97
cgccggccccgccggcg

SEQ ID NO: 1048447 - RNA, 20 nt, Mycobacterium bovis subsp bovis AF2122/97
cgccggccccgccggcgccg

SEQ ID NO: 1048448 - RNA, 17 nt, Mycobacterium bovis subsp bovis AF2122/97
cgccggcccggugauga

SEQ ID NO: 1048449 - RNA, 15 nt, Mycobacterium bovis subsp bovis AF2122/97
cgccggccgaucggc

SEQ ID NO: 1048450 - RNA, 17 nt, Mycobacterium bovis subsp bovis AF2122/97
cgccggccgaucggccg

SEQ ID NO: 1048451 - RNA, 13 nt, Mycobacterium bovis subsp bovis AF2122/97
cgccggccgcacg

SEQ ID NO: 1048452 - RNA, 14 nt, Mycobacterium bovis subsp bovis AF2122/97
cgccggccgcacgc

SEQ ID NO: 1048453 - RNA, 16 nt, Mycobacterium bovis subsp bovis AF2122/97
cgccggccgcacgccg

SEQ ID NO: 1048454 - RNA, 23 nt, Mycobacterium bovis subsp bovis AF2122/97
cgccggccgcacgccggccagcg

SEQ ID NO: 1048455 - RNA, 23 nt, Mycobacterium bovis subsp bovis AF2122/97
cgccggccccgccgucacccccg

SEQ ID NO: 1048456 - RNA, 20 nt, Mycobacterium bovis subsp bovis AF2122/97
cgccggccccgccgucaccg

SEQ ID NO: 1048457 - RNA, 12 nt, Mycobacterium bovis subsp bovis AF2122/97
cgccggccgcca

SEQ ID NO: 1048458 - RNA, 16 nt, Mycobacterium bovis subsp bovis AF2122/97
cgccggccgccagcgc

SEQ ID NO: 1048459 - RNA, 14 nt, Mycobacterium bovis subsp bovis AF2122/97
cgccggccggcccg

SEQ ID NO: 1048460 - RNA, 13 nt, Mycobacterium bovis subsp bovis AF2122/97
cgccggccggcgc

SEQ ID NO: 1048461 - RNA, 18 nt, Mycobacterium bovis subsp bovis AF2122/97
cgccggccggcgcagugc

SEQ ID NO: 1048462 - RNA, 21 nt, Mycobacterium bovis subsp bovis AF2122/97
cgccggccgcugccuuggcgc

SEQ ID NO: 1048463 - RNA, 18 nt, Mycobacterium bovis subsp bovis AF2122/97
cgccggccgcgccggccc

SEQ ID NO: 1048464 - RNA, 16 nt, Mycobacterium bovis subsp bovis AF2122/97
cgccggccgcggcggc

SEQ ID NO: 1048465 - RNA, 18 nt, Mycobacterium bovis subsp bovis AF2122/97
cgccggccgucgaucuuc

SEQ ID NO: 1048466 - RNA, 16 nt, Mycobacterium bovis subsp bovis AF2122/97
cgccggccgucggccg

SEQ ID NO: 1048467 - RNA, 17 nt, Mycobacterium bovis subsp bovis AF2122/97
cgccggccugcucggcg

SEQ ID NO: 1048468 - RNA, 22 nt, Mycobacterium bovis subsp bovis AF2122/97
cgccggccuugagcacccgaua

SEQ ID NO: 1048469 - RNA, 17 nt, Mycobacterium bovis subsp bovis AF2122/97
cgccggccuggccgcca

SEQ ID NO: 1048470 - RNA, 15 nt, Mycobacterium bovis subsp bovis AF2122/97
cgccggcgaacugau

SEQ ID NO: 1048471 - RNA, 18 nt, Mycobacterium bovis subsp bovis AF2122/97
cgccggcgaagaccgccg

SEQ ID NO: 1048472 - RNA, 23 nt, Mycobacterium bovis subsp bovis AF2122/97
cgccggcgaagcgugcgccgacu

SEQ ID NO: 1048473 - RNA, 15 nt, Mycobacterium bovis subsp bovis AF2122/97
cgccggcgacccggg

SEQ ID NO: 1048474 - RNA, 13 nt, Mycobacterium bovis subsp bovis AF2122/97
cgccggccagcca

SEQ ID NO: 1048475 - RNA, 21 nt, Mycobacterium bovis subsp bovis AF2122/97
cgccggccagccagcgaucca

SEQ ID NO: 1048476 - RNA, 23 nt, Mycobacterium bovis subsp bovis AF2122/97
cgccggccagcggccauccggcg

SEQ ID NO: 1048477 - RNA, 11 nt, Mycobacterium bovis subsp bovis AF2122/97
cgccggccagg

SEQ ID NO: 1048478 - RNA, 14 nt, Mycobacterium bovis subsp bovis AF2122/97
cgccggccagcggc

SEQ ID NO: 1048479 - RNA, 15 nt, Mycobacterium bovis subsp bovis AF2122/97
cgccggccaguccgc

SEQ ID NO: 1048480 - RNA, 13 nt, Mycobacterium bovis subsp bovis AF2122/97
cgccggccagucg

SEQ ID NO: 1048481 - RNA, 13 nt, Mycobacterium bovis subsp bovis AF2122/97
cgccggccaguuc

SEQ ID NO: 1048482 - RNA, 20 nt, Mycobacterium bovis subsp bovis AF2122/97
cgccggcccaguucugcagg

SEQ ID NO: 1048483 - RNA, 16 nt, Mycobacterium bovis subsp bovis AF2122/97
cgccggccccaccggu

SEQ ID NO: 1048484 - RNA, 20 nt, Mycobacterium bovis subsp bovis AF2122/97
cgccggccccaccgguaccg

SEQ ID NO: 1048485 - RNA, 23 nt, Mycobacterium bovis subsp bovis AF2122/97
cgccggccccaccggugccgccg

SEQ ID NO: 1048486 - RNA, 14 nt, Mycobacterium bovis subsp bovis AF2122/97
cgccggccccgcca

SEQ ID NO: 1048487 - RNA, 15 nt, Mycobacterium bovis subsp bovis AF2122/97
cgccggccccgccag

SEQ ID NO: 1048488 - RNA, 20 nt, Mycobacterium bovis subsp bovis AF2122/97
cgccggcaucuccaccgucg

SEQ ID NO: 1048489 - RNA, 16 nt, Mycobacterium bovis subsp bovis AF2122/97
cgccggauucgaugac

SEQ ID NO: 1048490 - RNA, 23 nt, Mycobacterium bovis subsp bovis AF2122/97
cgccggaugcugucagcagccca

SEQ ID NO: 1048491 - RNA, 21 nt, Mycobacterium bovis subsp bovis AF2122/97
cgccggauuauucgcgguagc

SEQ ID NO: 1048492 - RNA, 15 nt, Mycobacterium bovis subsp bovis AF2122/97
cgccggccaccagcc

SEQ ID NO: 1048493 - RNA, 21 nt, Mycobacterium bovis subsp bovis AF2122/97
cgccggccaccagccggucca

SEQ ID NO: 1048494 - RNA, 15 nt, Mycobacterium bovis subsp bovis AF2122/97
cgccggccacccgcg

SEQ ID NO: 1048495 - RNA, 13 nt, Mycobacterium bovis subsp bovis AF2122/97
cgccggccacgac

SEQ ID NO: 1048496 - RNA, 11 nt, Mycobacterium bovis subsp bovis AF2122/97
cgccggccacg

SEQ ID NO: 1048497 - RNA, 20 nt, Mycobacterium bovis subsp bovis AF2122/97
cgccggauucgcccgggcgu

SEQ ID NO: 1048498 - RNA, 17 nt, Mycobacterium bovis subsp bovis AF2122/97
cgccggccacccgcgcg

SEQ ID NO: 1048499 - RNA, 14 nt, Mycobacterium bovis subsp bovis AF2122/97
cgccggaugcuguc

SEQ ID NO: 1048500 - RNA, 15 nt, Mycobacterium bovis subsp bovis AF2122/97
cgccggaugcuguca

SEQ ID NO: 1048501 - RNA, 21 nt, Mycobacterium bovis subsp bovis AF2122/97
cgccggauggguggccagcaa

SEQ ID NO: 1048502 - RNA, 15 nt, Mycobacterium bovis subsp bovis AF2122/97
cgccggauggucggc

SEQ ID NO: 1048503 - RNA, 19 nt, Mycobacterium bovis subsp bovis AF2122/97
cgccggauggucggccacg

SEQ ID NO: 1048504 - RNA, 21 nt, Mycobacterium bovis subsp bovis AF2122/97
cgccggauggucggccacgcg

SEQ ID NO: 1048505 - RNA, 18 nt, Mycobacterium bovis subsp bovis AF2122/97
cgccggaugacaccgacc

SEQ ID NO: 1048506 - RNA, 19 nt, Mycobacterium bovis subsp bovis AF2122/97
cgccggaugacaccgaccg

SEQ ID NO: 1048507 - RNA, 15 nt, Mycobacterium bovis subsp bovis AF2122/97
cgccggauccgccag

SEQ ID NO: 1048508 - RNA, 20 nt, Mycobacterium bovis subsp bovis AF2122/97
cgccggaacgagcggccgcg

SEQ ID NO: 1048509 - RNA, 17 nt, Mycobacterium bovis subsp bovis AF2122/97
cgccggaucaggaucga

SEQ ID NO: 1048510 - RNA, 23 nt, Mycobacterium bovis subsp bovis AF2122/97
cgccucgggcaccuggucggccg

SEQ ID NO: 1048511 - RNA, 13 nt, Mycobacterium bovis subsp bovis AF2122/97
cgccucggcggcg

SEQ ID NO: 1048512 - RNA, 16 nt, Mycobacterium bovis subsp bovis AF2122/97
cgccucgggccggcgu

SEQ ID NO: 1048513 - RNA, 22 nt, Mycobacterium bovis subsp bovis AF2122/97
cgccucgguggucuuggcccgg

SEQ ID NO: 1048514 - RNA, 23 nt, Mycobacterium bovis subsp bovis AF2122/97
cgccucgguggucuuggcccggc

SEQ ID NO: 1048515 - RNA, 21 nt, Mycobacterium bovis subsp bovis AF2122/97
cgccucggcgcugcgcaccgc

SEQ ID NO: 1048516 - RNA, 13 nt, Mycobacterium bovis subsp bovis AF2122/97
cgccucgucgucg

SEQ ID NO: 1048517 - RNA, 16 nt, Mycobacterium bovis subsp bovis AF2122/97
cgccugaugcggccgg

SEQ ID NO: 1048518 - RNA, 14 nt, Mycobacterium bovis subsp bovis AF2122/97
cgccugaugcugcc

SEQ ID NO: 1048519 - RNA, 16 nt, Mycobacterium bovis subsp bovis AF2122/97
cgccugccaccggcgc

SEQ ID NO: 1048520 - RNA, 18 nt, Mycobacterium bovis subsp bovis AF2122/97
cgccugcgccgccagcgc

SEQ ID NO: 1048521 - RNA, 23 nt, Mycobacterium bovis subsp bovis AF2122/97
cgccugcgccuuggucgccggcg

SEQ ID NO: 1048522 - RNA, 16 nt, Mycobacterium bovis subsp bovis AF2122/97
cgccugcgcccagccg

SEQ ID NO: 1048523 - RNA, 13 nt, Mycobacterium bovis subsp bovis AF2122/97
cgccugcacccgg

SEQ ID NO: 1048524 - RNA, 18 nt, Mycobacterium bovis subsp bovis AF2122/97
cgccugcaccgccgccgc

SEQ ID NO: 1048525 - RNA, 19 nt, Mycobacterium bovis subsp bovis AF2122/97
cgccugcaacauccccaug

SEQ ID NO: 1048526 - RNA, 24 nt, Mycobacterium bovis subsp bovis AF2122/97
cgccugaugcugccagaucggucg

SEQ ID NO: 1048527 - RNA, 15 nt, Mycobacterium bovis subsp bovis AF2122/97
cgccguuuccgccgc

SEQ ID NO: 1048528 - RNA, 17 nt, Mycobacterium bovis subsp bovis AF2122/97
cgccguuuccgccgccg

SEQ ID NO: 1048529 - RNA, 14 nt, Mycobacterium bovis subsp bovis AF2122/97
cgccguuggcucga

SEQ ID NO: 1048530 - RNA, 22 nt, Mycobacterium bovis subsp bovis AF2122/97
cgccguuggcucgagccgcccg

SEQ ID NO: 1048531 - RNA, 23 nt, Mycobacterium bovis subsp bovis AF2122/97
cgccguuggcucgagccgcccgu

SEQ ID NO: 1048532 - RNA, 16 nt, Mycobacterium bovis subsp bovis AF2122/97
cgccguugggccgcgc

SEQ ID NO: 1048533 - RNA, 14 nt, Mycobacterium bovis subsp bovis AF2122/97
cgccguuggggccg

SEQ ID NO: 1048534 - RNA, 22 nt, Mycobacterium bovis subsp bovis AF2122/97
cgccguugucgaccuccucgac

SEQ ID NO: 1048535 - RNA, 15 nt, Mycobacterium bovis subsp bovis AF2122/97
cgccguugucggcgg

SEQ ID NO: 1048536 - RNA, 16 nt, Mycobacterium bovis subsp bovis AF2122/97
cgccguugucggcggu

SEQ ID NO: 1048537 - RNA, 18 nt, Mycobacterium bovis subsp bovis AF2122/97
cgccguugccgucgucgc

SEQ ID NO: 1048538 - RNA, 23 nt, Mycobacterium bovis subsp bovis AF2122/97
cgccguugccguuggugccgccu

SEQ ID NO: 1048539 - RNA, 13 nt, Mycobacterium bovis subsp bovis AF2122/97
cgccguuggcgcc

SEQ ID NO: 1048540 - RNA, 14 nt, Mycobacterium bovis subsp bovis AF2122/97
cgccguuggcgcca

SEQ ID NO: 1048541 - RNA, 15 nt, Mycobacterium bovis subsp bovis AF2122/97
cgccguuggcgccaa

SEQ ID NO: 1048542 - RNA, 14 nt, Mycobacterium bovis subsp bovis AF2122/97
cgccguuugcgccg

SEQ ID NO: 1048543 - RNA, 23 nt, Mycobacterium bovis subsp bovis AF2122/97
cgccuccagcagguccgcggccg

SEQ ID NO: 1048544 - RNA, 14 nt, Mycobacterium bovis subsp bovis AF2122/97
cgccuccagccggc

SEQ ID NO: 1048545 - RNA, 15 nt, Mycobacterium bovis subsp bovis AF2122/97
cgccuccaggcgcca

SEQ ID NO: 1048546 - RNA, 18 nt, Mycobacterium bovis subsp bovis AF2122/97
cgccuccaggcgccaccc

SEQ ID NO: 1048547 - RNA, 14 nt, Mycobacterium bovis subsp bovis AF2122/97
cgccuccgcucacg

SEQ ID NO: 1048548 - RNA, 19 nt, Mycobacterium bovis subsp bovis AF2122/97
cgccuccggcaccuccagc

SEQ ID NO: 1048549 - RNA, 13 nt, Mycobacterium bovis subsp bovis AF2122/97
cgccuccgccgag

SEQ ID NO: 1048550 - RNA, 12 nt, Mycobacterium bovis subsp bovis AF2122/97
cgccucggcgcu

SEQ ID NO: 1048551 - RNA, 18 nt, Mycobacterium bovis subsp bovis AF2122/97
cgccggugguaacggcgg

SEQ ID NO: 1048552 - RNA, 19 nt, Mycobacterium bovis subsp bovis AF2122/97
cgccggugguaacggcggc

SEQ ID NO: 1048553 - RNA, 21 nt, Mycobacterium bovis subsp bovis AF2122/97
cgccggugguaacggcggcca

SEQ ID NO: 1048554 - RNA, 23 nt, Mycobacterium bovis subsp bovis AF2122/97
cgccggugguaccggcggcgccg

SEQ ID NO: 1048555 - RNA, 14 nt, Mycobacterium bovis subsp bovis AF2122/97
cgccgguggucagg

SEQ ID NO: 1048556 - RNA, 19 nt, Mycobacterium bovis subsp bovis AF2122/97
cgccgguggugccggcgcc

SEQ ID NO: 1048557 - RNA, 20 nt, Mycobacterium bovis subsp bovis AF2122/97
cgccgguggugccggcgccg

SEQ ID NO: 1048558 - RNA, 23 nt, Mycobacterium bovis subsp bovis AF2122/97
cgccgguggugccggcgccgcca

SEQ ID NO: 1048559 - RNA, 18 nt, Mycobacterium bovis subsp bovis AF2122/97
cgccgguguaacccucga

SEQ ID NO: 1048560 - RNA, 20 nt, Mycobacterium bovis subsp bovis AF2122/97
cgccgguguaacccucgaac

SEQ ID NO: 1048561 - RNA, 14 nt, Mycobacterium bovis subsp bovis AF2122/97
cgccggugggcggu

SEQ ID NO: 1048562 - RNA, 20 nt, Mycobacterium bovis subsp bovis AF2122/97
cgccgguguccuuggccgcc

SEQ ID NO: 1048563 - RNA, 21 nt, Mycobacterium bovis subsp bovis AF2122/97
cgccgguguccuuggccgcca

SEQ ID NO: 1048564 - RNA, 15 nt, Mycobacterium bovis subsp bovis AF2122/97
cgccggugucggcug

SEQ ID NO: 1048565 - RNA, 19 nt, Mycobacterium bovis subsp bovis AF2122/97
cgccggugucggcuggucg

SEQ ID NO: 1048566 - RNA, 23 nt, Mycobacterium bovis subsp bovis AF2122/97
cgccggugucggcuggucgcugc

SEQ ID NO: 1048567 - RNA, 14 nt, Mycobacterium bovis subsp bovis AF2122/97
cgccggugucgggc

SEQ ID NO: 1048568 - RNA, 16 nt, Mycobacterium bovis subsp bovis AF2122/97
cgccgguggcgccggg

SEQ ID NO: 1048569 - RNA, 15 nt, Mycobacterium bovis subsp bovis AF2122/97
cgccggugugcccgc

SEQ ID NO: 1048570 - RNA, 16 nt, Mycobacterium bovis subsp bovis AF2122/97
cgccggugugcgcacc

SEQ ID NO: 1048571 - RNA, 15 nt, Mycobacterium bovis subsp bovis AF2122/97
cgccgucgccaccgg

SEQ ID NO: 1048572 - RNA, 14 nt, Mycobacterium bovis subsp bovis AF2122/97
cgccgucgccacca

SEQ ID NO: 1048573 - RNA, 18 nt, Mycobacterium bovis subsp bovis AF2122/97
cgccgucgauguggcgcu

SEQ ID NO: 1048574 - RNA, 21 nt, Mycobacterium bovis subsp bovis AF2122/97
cgccgguguuagugaggcccg

SEQ ID NO: 1048575 - RNA, 19 nt, Mycobacterium bovis subsp bovis AF2122/97
cgccgguuacccggaccgu

SEQ ID NO: 1048576 - RNA, 17 nt, Mycobacterium bovis subsp bovis AF2122/97
cgccgucgaugaccagc

SEQ ID NO: 1048577 - RNA, 12 nt, Mycobacterium bovis subsp bovis AF2122/97
cgccgucggcgg

SEQ ID NO: 1048578 - RNA, 15 nt, Mycobacterium bovis subsp bovis AF2122/97
cgccgucggcgauga

SEQ ID NO: 1048579 - RNA, 13 nt, Mycobacterium bovis subsp bovis AF2122/97
cgccgucggcgcc

SEQ ID NO: 1048580 - RNA, 15 nt, Mycobacterium bovis subsp bovis AF2122/97
cgccgucggacaccg

SEQ ID NO: 1048581 - RNA, 12 nt, Mycobacterium bovis subsp bovis AF2122/97
cgccgucggcga

SEQ ID NO: 1048582 - RNA, 16 nt, Mycobacterium bovis subsp bovis AF2122/97
cgccgucggcgagcag

SEQ ID NO: 1048583 - RNA, 18 nt, Mycobacterium bovis subsp bovis AF2122/97
cgccgucggccgagucga

SEQ ID NO: 1048584 - RNA, 21 nt, Mycobacterium bovis subsp bovis AF2122/97
cgccgucggagccggccaccu

SEQ ID NO: 1048585 - RNA, 23 nt, Mycobacterium bovis subsp bovis AF2122/97
cgccgucgcuagggugagcccgg

SEQ ID NO: 1048586 - RNA, 13 nt, Mycobacterium bovis subsp bovis AF2122/97
cgccgucgccguu

SEQ ID NO: 1048587 - RNA, 15 nt, Mycobacterium bovis subsp bovis AF2122/97
cgccgucgccguugg

SEQ ID NO: 1048588 - RNA, 19 nt, Mycobacterium bovis subsp bovis AF2122/97
cgccgucgcgaccgaugau

SEQ ID NO: 1048589 - RNA, 17 nt, Mycobacterium bovis subsp bovis AF2122/97
cgccgucgcggcacgcc

SEQ ID NO: 1048590 - RNA, 12 nt, Mycobacterium bovis subsp bovis AF2122/97
cgccgucgccgc

SEQ ID NO: 1048591 - RNA, 14 nt, Mycobacterium bovis subsp bovis AF2122/97
cgccgucgccgccg

SEQ ID NO: 1048592 - RNA, 17 nt, Mycobacterium bovis subsp bovis AF2122/97
cgccgucgccgccgcua

SEQ ID NO: 1048593 - RNA, 15 nt, Mycobacterium bovis subsp bovis AF2122/97
cgccgucgccgccgg

SEQ ID NO: 1048594 - RNA, 16 nt, Mycobacterium bovis subsp bovis AF2122/97
cgccgucgccgccggc

SEQ ID NO: 1048595 - RNA, 13 nt, Mycobacterium bovis subsp bovis AF2122/97
cgccgucgccgcc

SEQ ID NO: 1048596 - RNA, 20 nt, Mycobacterium bovis subsp bovis AF2122/97
cgccgucgccgccaaagccg

SEQ ID NO: 1048597 - RNA, 16 nt, Mycobacterium bovis subsp bovis AF2122/97
cgccgucgcagccagc

SEQ ID NO: 1048598 - RNA, 18 nt, Mycobacterium bovis subsp bovis AF2122/97
cgccgucgcagccagcug

SEQ ID NO: 1048599 - RNA, 16 nt, Mycobacterium bovis subsp bovis AF2122/97
cgccgucgccaccggu

SEQ ID NO: 1048600 - RNA, 16 nt, Mycobacterium bovis subsp bovis AF2122/97
cgccguugccggcgac

SEQ ID NO: 1048601 - RNA, 15 nt, Mycobacterium bovis subsp bovis AF2122/97
cgccguugccggcgu

SEQ ID NO: 1048602 - RNA, 18 nt, Mycobacterium bovis subsp bovis AF2122/97
cgccguugccggcuuggc

SEQ ID NO: 1048603 - RNA, 15 nt, Mycobacterium bovis subsp bovis AF2122/97
cgccguugccguaca

SEQ ID NO: 1048604 - RNA, 14 nt, Mycobacterium bovis subsp bovis AF2122/97
cgccguugccgucg

SEQ ID NO: 1048605 - RNA, 17 nt, Mycobacterium bovis subsp bovis AF2122/97
cgccguugccggccacc

SEQ ID NO: 1048606 - RNA, 17 nt, Mycobacterium bovis subsp bovis AF2122/97
cgccguugccgccgacg

SEQ ID NO: 1048607 - RNA, 21 nt, Mycobacterium bovis subsp bovis AF2122/97
cgccguugccgccgacgccgc

SEQ ID NO: 1048608 - RNA, 18 nt, Mycobacterium bovis subsp bovis AF2122/97
cgccguugccgccggcgc

SEQ ID NO: 1048609 - RNA, 20 nt, Mycobacterium bovis subsp bovis AF2122/97
cgccguugccgccggcgccg

SEQ ID NO: 1048610 - RNA, 20 nt, Mycobacterium bovis subsp bovis AF2122/97
cgccguugccgccgucaccg

SEQ ID NO: 1048611 - RNA, 23 nt, Mycobacterium bovis subsp bovis AF2122/97
cgccguugccaccguagccgagg

SEQ ID NO: 1048612 - RNA, 18 nt, Mycobacterium bovis subsp bovis AF2122/97
cgccguugcccccguugc

SEQ ID NO: 1048613 - RNA, 13 nt, Mycobacterium bovis subsp bovis AF2122/97
cgccguugccgau

SEQ ID NO: 1048614 - RNA, 19 nt, Mycobacterium bovis subsp bovis AF2122/97
cgccguugccgaucaccac

SEQ ID NO: 1048615 - RNA, 20 nt, Mycobacterium bovis subsp bovis AF2122/97
cgccguugccgaucaccacg

SEQ ID NO: 1048616 - RNA, 21 nt, Mycobacterium bovis subsp bovis AF2122/97
cgccguugccgaucaccacgg

SEQ ID NO: 1048617 - RNA, 20 nt, Mycobacterium bovis subsp bovis AF2122/97
cgccguugccgaucagcccg

SEQ ID NO: 1048618 - RNA, 21 nt, Mycobacterium bovis subsp bovis AF2122/97
cgccguugccgaucagcccgg

SEQ ID NO: 1048619 - RNA, 15 nt, Mycobacterium bovis subsp bovis AF2122/97
cgccguugccgaucc

SEQ ID NO: 1048620 - RNA, 17 nt, Mycobacterium bovis subsp bovis AF2122/97
cgccguugccgaucgcu

SEQ ID NO: 1048621 - RNA, 14 nt, Mycobacterium bovis subsp bovis AF2122/97
cgccguugccgccg

SEQ ID NO: 1048622 - RNA, 16 nt, Mycobacterium bovis subsp bovis AF2122/97
cgccguugccgccgaa

SEQ ID NO: 1048623 - RNA, 17 nt, Mycobacterium bovis subsp bovis AF2122/97
cgccguugccgccgaag

SEQ ID NO: 1048624 - RNA, 16 nt, Mycobacterium bovis subsp bovis AF2122/97
cgccguggcgucggcg

SEQ ID NO: 1048625 - RNA, 16 nt, Mycobacterium bovis subsp bovis AF2122/97
cgccguugccaagcag

SEQ ID NO: 1048626 - RNA, 16 nt, Mycobacterium bovis subsp bovis AF2122/97
cgccguugccaccggu

SEQ ID NO: 1048627 - RNA, 17 nt, Mycobacterium bovis subsp bovis AF2122/97
cgccguugccaccggug

SEQ ID NO: 1048628 - RNA, 17 nt, Mycobacterium bovis subsp bovis AF2122/97
cgccguugaugucggca

SEQ ID NO: 1048629 - RNA, 23 nt, Mycobacterium bovis subsp bovis AF2122/97
cgccguggcgcggucggagucga

SEQ ID NO: 1048630 - RNA, 21 nt, Mycobacterium bovis subsp bovis AF2122/97
cgccgugggccuguugcugcc

SEQ ID NO: 1048631 - RNA, 20 nt, Mycobacterium bovis subsp bovis AF2122/97
cgccgugguggaugagccgg

SEQ ID NO: 1048632 - RNA, 20 nt, Mycobacterium bovis subsp bovis AF2122/97
cgccgugguugcacguucgg

SEQ ID NO: 1048633 - RNA, 21 nt, Mycobacterium bovis subsp bovis AF2122/97
cgccgugguugcacguucggc

SEQ ID NO: 1048634 - RNA, 14 nt, Mycobacterium bovis subsp bovis AF2122/97
cgccgucgucgcgc

SEQ ID NO: 1048635 - RNA, 15 nt, Mycobacterium bovis subsp bovis AF2122/97
cgccgucgucgacca

SEQ ID NO: 1048636 - RNA, 19 nt, Mycobacterium bovis subsp bovis AF2122/97
cgccgucgucgaccacgac

SEQ ID NO: 1048637 - RNA, 20 nt, Mycobacterium bovis subsp bovis AF2122/97
cgccgucgucgaccacgacg

SEQ ID NO: 1048638 - RNA, 18 nt, Mycobacterium bovis subsp bovis AF2122/97
cgccgucggugccgccgc

SEQ ID NO: 1048639 - RNA, 14 nt, Mycobacterium bovis subsp bovis AF2122/97
cgccgucgucagcg

SEQ ID NO: 1048640 - RNA, 16 nt, Mycobacterium bovis subsp bovis AF2122/97
cgccgucgucagcggg

SEQ ID NO: 1048641 - RNA, 16 nt, Mycobacterium bovis subsp bovis AF2122/97
cgccgucggugccgcc

SEQ ID NO: 1048642 - RNA, 20 nt, Mycobacterium bovis subsp bovis AF2122/97
cgccgucggguugcgacgaa

SEQ ID NO: 1048643 - RNA, 21 nt, Mycobacterium bovis subsp bovis AF2122/97
cgccgucgguaaagggcucga

SEQ ID NO: 1048644 - RNA, 14 nt, Mycobacterium bovis subsp bovis AF2122/97
cgccgucucgaucg

SEQ ID NO: 1048645 - RNA, 15 nt, Mycobacterium bovis subsp bovis AF2122/97
cgccgucucgaucgc

SEQ ID NO: 1048646 - RNA, 17 nt, Mycobacterium bovis subsp bovis AF2122/97
cgccgucucgaucgcgg

SEQ ID NO: 1048647 - RNA, 17 nt, Mycobacterium bovis subsp bovis AF2122/97
cgccgucucgcggugcg

SEQ ID NO: 1048648 - RNA, 21 nt, Mycobacterium bovis subsp bovis AF2122/97
cgccgucucgcggugcggcaa

SEQ ID NO: 1048649 - RNA, 17 nt, Mycobacterium bovis subsp bovis AF2122/97
cgccgucguugcccgac

SEQ ID NO: 1048650 - RNA, 19 nt, Mycobacterium bovis subsp bovis AF2122/97
cgccguggcaucgccucca

SEQ ID NO: 1048651 - RNA, 20 nt, Mycobacterium bovis subsp bovis AF2122/97
cgccguggauacgcacggcg

SEQ ID NO: 1048652 - RNA, 18 nt, Mycobacterium bovis subsp bovis AF2122/97
cgccguggaucaucccga

SEQ ID NO: 1048653 - RNA, 19 nt, Mycobacterium bovis subsp bovis AF2122/97
cgccguggaucaucccgac

SEQ ID NO: 1048654 - RNA, 16 nt, Mycobacterium bovis subsp bovis AF2122/97
cgccuucgccagcggc

SEQ ID NO: 1048655 - RNA, 15 nt, Mycobacterium bovis subsp bovis AF2122/97
cgccuucacgcuggc

SEQ ID NO: 1048656 - RNA, 18 nt, Mycobacterium bovis subsp bovis AF2122/97
cgccugugccgccggcgc

SEQ ID NO: 1048657 - RNA, 16 nt, Mycobacterium bovis subsp bovis AF2122/97
cgccugugggugcuau

SEQ ID NO: 1048658 - RNA, 18 nt, Mycobacterium bovis subsp bovis AF2122/97
cgccugugggugcuaugc

SEQ ID NO: 1048659 - RNA, 13 nt, Mycobacterium bovis subsp bovis AF2122/97
cgccugugccgcc

SEQ ID NO: 1048660 - RNA, 14 nt, Mycobacterium bovis subsp bovis AF2122/97
cgccugugccaccg

SEQ ID NO: 1048661 - RNA, 15 nt, Mycobacterium bovis subsp bovis AF2122/97
cgccugugccaccgc

SEQ ID NO: 1048662 - RNA, 17 nt, Mycobacterium bovis subsp bovis AF2122/97
cgccugugccaccgcug

SEQ ID NO: 1048663 - RNA, 13 nt, Mycobacterium bovis subsp bovis AF2122/97
cgccugucccgcc

SEQ ID NO: 1048664 - RNA, 20 nt, Mycobacterium bovis subsp bovis AF2122/97
cgccugguguacacacccgc

SEQ ID NO: 1048665 - RNA, 14 nt, Mycobacterium bovis subsp bovis AF2122/97
cgccuguaccggcg

SEQ ID NO: 1048666 - RNA, 15 nt, Mycobacterium bovis subsp bovis AF2122/97
cgccuguaccggcgu

SEQ ID NO: 1048667 - RNA, 21 nt, Mycobacterium bovis subsp bovis AF2122/97
cgccuguucgggagcugauca

SEQ ID NO: 1048668 - RNA, 22 nt, Mycobacterium bovis subsp bovis AF2122/97
cgccuguucgggagcugaucac

SEQ ID NO: 1048669 - RNA, 16 nt, Mycobacterium bovis subsp bovis AF2122/97
cgccugggcggccagc

SEQ ID NO: 1048670 - RNA, 19 nt, Mycobacterium bovis subsp bovis AF2122/97
cgccugggcggccagcacg

SEQ ID NO: 1048671 - RNA, 14 nt, Mycobacterium bovis subsp bovis AF2122/97
cgccugggcggcca

SEQ ID NO: 1048672 - RNA, 14 nt, Mycobacterium bovis subsp bovis AF2122/97
cgccugggcgacga

SEQ ID NO: 1048673 - RNA, 17 nt, Mycobacterium bovis subsp bovis AF2122/97
cgccugggcgacgacgu

SEQ ID NO: 1048674 - RNA, 18 nt, Mycobacterium bovis subsp bovis AF2122/97
cgccuggcuggccagcug

SEQ ID NO: 1048675 - RNA, 19 nt, Mycobacterium bovis subsp bovis AF2122/97
cgccuggcuggccagcugc

SEQ ID NO: 1048676 - RNA, 22 nt, Mycobacterium bovis subsp bovis AF2122/97
cgccuggcuugucauccccgac

SEQ ID NO: 1048677 - RNA, 15 nt, Mycobacterium bovis subsp bovis AF2122/97
cgccuggcuacgcgc

SEQ ID NO: 1048678 - RNA, 17 nt, Mycobacterium bovis subsp bovis AF2122/97
cgccuggucaccgaaga

SEQ ID NO: 1048679 - RNA, 16 nt, Mycobacterium bovis subsp bovis AF2122/97
cgccugguaccgcggu

SEQ ID NO: 1048680 - RNA, 20 nt, Mycobacterium bovis subsp bovis AF2122/97
cgccuggggguucuggccgu

SEQ ID NO: 1048681 - RNA, 17 nt, Mycobacterium bovis subsp bovis AF2122/97
cgccuggguugaccgcc

SEQ ID NO: 1048682 - RNA, 20 nt, Mycobacterium bovis subsp bovis AF2122/97
cgccuggguugaccgccacc

SEQ ID NO: 1048683 - RNA, 20 nt, Mycobacterium bovis subsp bovis AF2122/97
cgccuggaucagcgcguuga

SEQ ID NO: 1048684 - RNA, 17 nt, Mycobacterium bovis subsp bovis AF2122/97
cgccuggaugccgaucg

SEQ ID NO: 1048685 - RNA, 20 nt, Mycobacterium bovis subsp bovis AF2122/97
cgccuggccggaauacccgc

SEQ ID NO: 1048686 - RNA, 15 nt, Mycobacterium bovis subsp bovis AF2122/97
cgccuggagcgaucu

SEQ ID NO: 1048687 - RNA, 16 nt, Mycobacterium bovis subsp bovis AF2122/97
cgccuggacgccgccg

SEQ ID NO: 1048688 - RNA, 20 nt, Mycobacterium bovis subsp bovis AF2122/97
cgccugcgggaacgcggcgg

SEQ ID NO: 1048689 - RNA, 15 nt, Mycobacterium bovis subsp bovis AF2122/97
cgcgacacgccggcg

SEQ ID NO: 1048690 - RNA, 13 nt, Mycobacterium bovis subsp bovis AF2122/97
cgcgacacgcggc

SEQ ID NO: 1048691 - RNA, 14 nt, Mycobacterium bovis subsp bovis AF2122/97
cgcgacacgcggcc

SEQ ID NO: 1048692 - RNA, 15 nt, Mycobacterium bovis subsp bovis AF2122/97
cgcgacacgcggccc

SEQ ID NO: 1048693 - RNA, 16 nt, Mycobacterium bovis subsp bovis AF2122/97
cgcgacacgcggcccg

SEQ ID NO: 1048694 - RNA, 22 nt, Mycobacterium bovis subsp bovis AF2122/97
cgcgacacgcggcccgaggcuc

SEQ ID NO: 1048695 - RNA, 19 nt, Mycobacterium bovis subsp bovis AF2122/97
cgcgacagacagcaccgcc

SEQ ID NO: 1048696 - RNA, 15 nt, Mycobacterium bovis subsp bovis AF2122/97
cgcgaccacgcaccg

SEQ ID NO: 1048697 - RNA, 16 nt, Mycobacterium bovis subsp bovis AF2122/97
cgcgaccacgcaccgc

SEQ ID NO: 1048698 - RNA, 14 nt, Mycobacterium bovis subsp bovis AF2122/97
cgcgaccaccgccg

SEQ ID NO: 1048699 - RNA, 18 nt, Mycobacterium bovis subsp bovis AF2122/97
cgcgaccaccgccgagcc

SEQ ID NO: 1048700 - RNA, 13 nt, Mycobacterium bovis subsp bovis AF2122/97
cgcgaccagcugg

SEQ ID NO: 1048701 - RNA, 17 nt, Mycobacterium bovis subsp bovis AF2122/97
cgcgaccacgcaccgcc

SEQ ID NO: 1048702 - RNA, 13 nt, Mycobacterium bovis subsp bovis AF2122/97
cgcgaccaggaag

SEQ ID NO: 1048703 - RNA, 17 nt, Mycobacterium bovis subsp bovis AF2122/97
cgcgaccaucucgacgu

SEQ ID NO: 1048704 - RNA, 24 nt, Mycobacterium bovis subsp bovis AF2122/97
cgcgaccauacccgcgcgcaccag

SEQ ID NO: 1048705 - RNA, 14 nt, Mycobacterium bovis subsp bovis AF2122/97
cgcgacccgaucgc

SEQ ID NO: 1048706 - RNA, 15 nt, Mycobacterium bovis subsp bovis AF2122/97
cgcgacaacccggcg

SEQ ID NO: 1048707 - RNA, 23 nt, Mycobacterium bovis subsp bovis AF2122/97
cgcgaaggggugcccggcggcca

SEQ ID NO: 1048708 - RNA, 14 nt, Mycobacterium bovis subsp bovis AF2122/97
cgcgaaggucucga

SEQ ID NO: 1048709 - RNA, 22 nt, Mycobacterium bovis subsp bovis AF2122/97
cgcgacaauggugcccaggaag

SEQ ID NO: 1048710 - RNA, 12 nt, Mycobacterium bovis subsp bovis AF2122/97
cgcgacaccccg

SEQ ID NO: 1048711 - RNA, 18 nt, Mycobacterium bovis subsp bovis AF2122/97
cgcgacacacgccgccgg

SEQ ID NO: 1048712 - RNA, 20 nt, Mycobacterium bovis subsp bovis AF2122/97
cgcgacacacgccgccggug

SEQ ID NO: 1048713 - RNA, 17 nt, Mycobacterium bovis subsp bovis AF2122/97
cgcgaaugucgcgcugu

SEQ ID NO: 1048714 - RNA, 16 nt, Mycobacterium bovis subsp bovis AF2122/97
cgcgaagcgcucggca

SEQ ID NO: 1048715 - RNA, 19 nt, Mycobacterium bovis subsp bovis AF2122/97
cgcgaagcgcucggcagcc

SEQ ID NO: 1048716 - RNA, 20 nt, Mycobacterium bovis subsp bovis AF2122/97
cgcgaagcgcucggcagccg

SEQ ID NO: 1048717 - RNA, 16 nt, Mycobacterium bovis subsp bovis AF2122/97
cgcgaagcugugcccg

SEQ ID NO: 1048718 - RNA, 19 nt, Mycobacterium bovis subsp bovis AF2122/97
cgcgaagcugugcccggcg

SEQ ID NO: 1048719 - RNA, 21 nt, Mycobacterium bovis subsp bovis AF2122/97
cgcgaagcugugcccggcgcc

SEQ ID NO: 1048720 - RNA, 23 nt, Mycobacterium bovis subsp bovis AF2122/97
cgcgaagcugugcccggcgcccg

SEQ ID NO: 1048721 - RNA, 21 nt, Mycobacterium bovis subsp bovis AF2122/97
cgcgaaggauuugauaggcgc

SEQ ID NO: 1048722 - RNA, 19 nt, Mycobacterium bovis subsp bovis AF2122/97
cgcgaacgauuucggccca

SEQ ID NO: 1048723 - RNA, 23 nt, Mycobacterium bovis subsp bovis AF2122/97
cgcgaacgaagucgacgaacucg

SEQ ID NO: 1048724 - RNA, 21 nt, Mycobacterium bovis subsp bovis AF2122/97
cgcgaaccgucucggcgaccg

SEQ ID NO: 1048725 - RNA, 15 nt, Mycobacterium bovis subsp bovis AF2122/97
cgcgaacccggcccu

SEQ ID NO: 1048726 - RNA, 19 nt, Mycobacterium bovis subsp bovis AF2122/97
cgcgaacccggcccugaac

SEQ ID NO: 1048727 - RNA, 19 nt, Mycobacterium bovis subsp bovis AF2122/97
cgcgaaccggccaucgacc

SEQ ID NO: 1048728 - RNA, 20 nt, Mycobacterium bovis subsp bovis AF2122/97
cgcgaagaacgacgccaccg

SEQ ID NO: 1048729 - RNA, 23 nt, Mycobacterium bovis subsp bovis AF2122/97
cgcgaagaacgacgccaccgcga

SEQ ID NO: 1048730 - RNA, 15 nt, Mycobacterium bovis subsp bovis AF2122/97
cgcgaagaucagcgg

SEQ ID NO: 1048731 - RNA, 13 nt, Mycobacterium bovis subsp bovis AF2122/97
cgcgaagccacca

SEQ ID NO: 1048732 - RNA, 20 nt, Mycobacterium bovis subsp bovis AF2122/97
cgcgaacagcgggggcagcg

SEQ ID NO: 1048733 - RNA, 17 nt, Mycobacterium bovis subsp bovis AF2122/97
cgcgaacaucgccagcg

SEQ ID NO: 1048734 - RNA, 18 nt, Mycobacterium bovis subsp bovis AF2122/97
cgcgaacaucgccagcgc

SEQ ID NO: 1048735 - RNA, 12 nt, Mycobacterium bovis subsp bovis AF2122/97
cgcgaacccgau

SEQ ID NO: 1048736 - RNA, 16 nt, Mycobacterium bovis subsp bovis AF2122/97
cgcgaacccgcgaggu

SEQ ID NO: 1048737 - RNA, 17 nt, Mycobacterium bovis subsp bovis AF2122/97
cgcgaacccgcgagguu

SEQ ID NO: 1048738 - RNA, 13 nt, Mycobacterium bovis subsp bovis AF2122/97
cgcgaacagcggg

SEQ ID NO: 1048739 - RNA, 15 nt, Mycobacterium bovis subsp bovis AF2122/97
cgcgaacaaccugcc

SEQ ID NO: 1048740 - RNA, 21 nt, Mycobacterium bovis subsp bovis AF2122/97
cgcgaaauuacuucggccaca

SEQ ID NO: 1048741 - RNA, 22 nt, Mycobacterium bovis subsp bovis AF2122/97
cgcgaaauuacuucggccacaa

SEQ ID NO: 1048742 - RNA, 16 nt, Mycobacterium bovis subsp bovis AF2122/97
cgccuugcccagcgac

SEQ ID NO: 1048743 - RNA, 21 nt, Mycobacterium bovis subsp bovis AF2122/97
cgccuugaggcccugcggcca

SEQ ID NO: 1048744 - RNA, 15 nt, Mycobacterium bovis subsp bovis AF2122/97
cgccuugcagcgcgu

SEQ ID NO: 1048745 - RNA, 17 nt, Mycobacterium bovis subsp bovis AF2122/97
cgccuucggggugcacg

SEQ ID NO: 1048746 - RNA, 19 nt, Mycobacterium bovis subsp bovis AF2122/97
cgccuucggggugcacgcg

SEQ ID NO: 1048747 - RNA, 18 nt, Mycobacterium bovis subsp bovis AF2122/97
cgccuucguaaccacgac

SEQ ID NO: 1048748 - RNA, 17 nt, Mycobacterium bovis subsp bovis AF2122/97
cgccuugaagcggugga

SEQ ID NO: 1048749 - RNA, 16 nt, Mycobacterium bovis subsp bovis AF2122/97
cgccgaucacugucgg

SEQ ID NO: 1048750 - RNA, 20 nt, Mycobacterium bovis subsp bovis AF2122/97
cgccgaggccucggccagcg

SEQ ID NO: 1048751 - RNA, 22 nt, Mycobacterium bovis subsp bovis AF2122/97
cgccgaucaccgcaucggugcc

SEQ ID NO: 1048752 - RNA, 14 nt, Mycobacterium bovis subsp bovis AF2122/97
cgccgaucaccgcu

SEQ ID NO: 1048753 - RNA, 21 nt, Mycobacterium bovis subsp bovis AF2122/97
cgccgaucagcgaaccaccgg

SEQ ID NO: 1048754 - RNA, 22 nt, Mycobacterium bovis subsp bovis AF2122/97
cgccgaugaugugcggugaccg

SEQ ID NO: 1048755 - RNA, 16 nt, Mycobacterium bovis subsp bovis AF2122/97
cgccgaugaccgcaac

SEQ ID NO: 1048756 - RNA, 16 nt, Mycobacterium bovis subsp bovis AF2122/97
cgccgaugccaccgcu

SEQ ID NO: 1048757 - RNA, 17 nt, Mycobacterium bovis subsp bovis AF2122/97
cgccgaugauggacacc

SEQ ID NO: 1048758 - RNA, 19 nt, Mycobacterium bovis subsp bovis AF2122/97
cgccgaugaccgcaaccgg

SEQ ID NO: 1048759 - RNA, 21 nt, Mycobacterium bovis subsp bovis AF2122/97
cgccgaugcccgacaccgccc

SEQ ID NO: 1048760 - RNA, 14 nt, Mycobacterium bovis subsp bovis AF2122/97
cgccgaugccgaac

SEQ ID NO: 1048761 - RNA, 14 nt, Mycobacterium bovis subsp bovis AF2122/97
cgccgaugccgccg

SEQ ID NO: 1048762 - RNA, 15 nt, Mycobacterium bovis subsp bovis AF2122/97
cgccgaugccggcca

SEQ ID NO: 1048763 - RNA, 14 nt, Mycobacterium bovis subsp bovis AF2122/97
cgccgaugcggugc

SEQ ID NO: 1048764 - RNA, 14 nt, Mycobacterium bovis subsp bovis AF2122/97
cgccgaugcugccg

SEQ ID NO: 1048765 - RNA, 17 nt, Mycobacterium bovis subsp bovis AF2122/97
cgccgaugcugccgccg

SEQ ID NO: 1048766 - RNA, 20 nt, Mycobacterium bovis subsp bovis AF2122/97
cgccgaugcugccgccgccg

SEQ ID NO: 1048767 - RNA, 15 nt, Mycobacterium bovis subsp bovis AF2122/97
cgccgaugccgaugc

SEQ ID NO: 1048768 - RNA, 23 nt, Mycobacterium bovis subsp bovis AF2122/97
cgccgcacauugguguccaccac

SEQ ID NO: 1048769 - RNA, 23 nt, Mycobacterium bovis subsp bovis AF2122/97
cgccgcaccaagcagcgaccagc

SEQ ID NO: 1048770 - RNA, 23 nt, Mycobacterium bovis subsp bovis AF2122/97
cgccgcacccacauaccggcgca

SEQ ID NO: 1048771 - RNA, 13 nt, Mycobacterium bovis subsp bovis AF2122/97
cgccgcaccgccg

SEQ ID NO: 1048772 - RNA, 14 nt, Mycobacterium bovis subsp bovis AF2122/97
cgccgcaccgccgc

SEQ ID NO: 1048773 - RNA, 18 nt, Mycobacterium bovis subsp bovis AF2122/97
cgccgcaccgccgcaucg

SEQ ID NO: 1048774 - RNA, 13 nt, Mycobacterium bovis subsp bovis AF2122/97
cgccgcaccggau

SEQ ID NO: 1048775 - RNA, 15 nt, Mycobacterium bovis subsp bovis AF2122/97
cgccgcaccggauca

SEQ ID NO: 1048776 - RNA, 19 nt, Mycobacterium bovis subsp bovis AF2122/97
cgccgcaccggaucaccgc

SEQ ID NO: 1048777 - RNA, 12 nt, Mycobacterium bovis subsp bovis AF2122/97
cgccgcacccgg

SEQ ID NO: 1048778 - RNA, 21 nt, Mycobacterium bovis subsp bovis AF2122/97
cgccgcacccgggacguuguc

SEQ ID NO: 1048779 - RNA, 16 nt, Mycobacterium bovis subsp bovis AF2122/97
cgccgcacgcuagccg

SEQ ID NO: 1048780 - RNA, 12 nt, Mycobacterium bovis subsp bovis AF2122/97
cgccgcacgccg

SEQ ID NO: 1048781 - RNA, 16 nt, Mycobacterium bovis subsp bovis AF2122/97
cgccgcacgccgaccg

SEQ ID NO: 1048782 - RNA, 21 nt, Mycobacterium bovis subsp bovis AF2122/97
cgccgcacgccgaccggcccg

SEQ ID NO: 1048783 - RNA, 15 nt, Mycobacterium bovis subsp bovis AF2122/97
cgccgcacgccggca

SEQ ID NO: 1048784 - RNA, 14 nt, Mycobacterium bovis subsp bovis AF2122/97
cgccgcagacgccg

SEQ ID NO: 1048785 - RNA, 17 nt, Mycobacterium bovis subsp bovis AF2122/97
cgccgcagacgccgacu

SEQ ID NO: 1048786 - RNA, 21 nt, Mycobacterium bovis subsp bovis AF2122/97
cgccgcagagcaccgcgaaca

SEQ ID NO: 1048787 - RNA, 19 nt, Mycobacterium bovis subsp bovis AF2122/97
cgccgcagaucaccgccag

SEQ ID NO: 1048788 - RNA, 13 nt, Mycobacterium bovis subsp bovis AF2122/97
cgccgcaaccgcc

SEQ ID NO: 1048789 - RNA, 21 nt, Mycobacterium bovis subsp bovis AF2122/97
cgccgauuuugggaucgugcc

SEQ ID NO: 1048790 - RNA, 16 nt, Mycobacterium bovis subsp bovis AF2122/97
cgccgcaaccgccgcg

SEQ ID NO: 1048791 - RNA, 17 nt, Mycobacterium bovis subsp bovis AF2122/97
cgccgcaaccgccgcgu

SEQ ID NO: 1048792 - RNA, 21 nt, Mycobacterium bovis subsp bovis AF2122/97
cgccgcaagugucuccggcaa

SEQ ID NO: 1048793 - RNA, 22 nt, Mycobacterium bovis subsp bovis AF2122/97
cgccgcaagugucuccggcaac

SEQ ID NO: 1048794 - RNA, 23 nt, Mycobacterium bovis subsp bovis AF2122/97
cgccgcaaguucacccaucaucg

SEQ ID NO: 1048795 - RNA, 19 nt, Mycobacterium bovis subsp bovis AF2122/97
cgccgcaaucagacggcga

SEQ ID NO: 1048796 - RNA, 20 nt, Mycobacterium bovis subsp bovis AF2122/97
cgccgcaaugacgucgucgg

SEQ ID NO: 1048797 - RNA, 21 nt, Mycobacterium bovis subsp bovis AF2122/97
cgccgcaauggaccgaacgac

SEQ ID NO: 1048798 - RNA, 19 nt, Mycobacterium bovis subsp bovis AF2122/97
cgccgcacacucucgguga

SEQ ID NO: 1048799 - RNA, 13 nt, Mycobacterium bovis subsp bovis AF2122/97
cgccgauuccacc

SEQ ID NO: 1048800 - RNA, 20 nt, Mycobacterium bovis subsp bovis AF2122/97
cgccgauuccaccgccgacg

SEQ ID NO: 1048801 - RNA, 21 nt, Mycobacterium bovis subsp bovis AF2122/97
cgccgauuccaccgccgacgc

SEQ ID NO: 1048802 - RNA, 23 nt, Mycobacterium bovis subsp bovis AF2122/97
cgccgauuccaccgccgacgccc

SEQ ID NO: 1048803 - RNA, 15 nt, Mycobacterium bovis subsp bovis AF2122/97
cgccgaugucgacga

SEQ ID NO: 1048804 - RNA, 15 nt, Mycobacterium bovis subsp bovis AF2122/97
cgccgauguggucgg

SEQ ID NO: 1048805 - RNA, 21 nt, Mycobacterium bovis subsp bovis AF2122/97
cgccgauguggucggcuguca

SEQ ID NO: 1048806 - RNA, 16 nt, Mycobacterium bovis subsp bovis AF2122/97
cgccgauucgccgucg

SEQ ID NO: 1048807 - RNA, 22 nt, Mycobacterium bovis subsp bovis AF2122/97
cgccgauuggcaggcaaugccc

SEQ ID NO: 1048808 - RNA, 19 nt, Mycobacterium bovis subsp bovis AF2122/97
cgccgauguuggcagggcc

SEQ ID NO: 1048809 - RNA, 14 nt, Mycobacterium bovis subsp bovis AF2122/97
cgccgcccagcauc

SEQ ID NO: 1048810 - RNA, 21 nt, Mycobacterium bovis subsp bovis AF2122/97
cgccgcccagcaucucggcgg

SEQ ID NO: 1048811 - RNA, 22 nt, Mycobacterium bovis subsp bovis AF2122/97
cgccgcccagcaucucggcggc

SEQ ID NO: 1048812 - RNA, 14 nt, Mycobacterium bovis subsp bovis AF2122/97
cgccgcccagcgga

SEQ ID NO: 1048813 - RNA, 12 nt, Mycobacterium bovis subsp bovis AF2122/97
cgccgcccagcg

SEQ ID NO: 1048814 - RNA, 22 nt, Mycobacterium bovis subsp bovis AF2122/97
cgccgccccauacuugcgccga

SEQ ID NO: 1048815 - RNA, 20 nt, Mycobacterium bovis subsp bovis AF2122/97
cgccgccaguccggacggca

SEQ ID NO: 1048816 - RNA, 22 nt, Mycobacterium bovis subsp bovis AF2122/97
cgccgccaguccggacggcagc

SEQ ID NO: 1048817 - RNA, 16 nt, Mycobacterium bovis subsp bovis AF2122/97
cgccgccagguccgcc

SEQ ID NO: 1048818 - RNA, 19 nt, Mycobacterium bovis subsp bovis AF2122/97
cgccgccagguccgccggu

SEQ ID NO: 1048819 - RNA, 21 nt, Mycobacterium bovis subsp bovis AF2122/97
cgccgccagguccgccggugc

SEQ ID NO: 1048820 - RNA, 14 nt, Mycobacterium bovis subsp bovis AF2122/97
cgccgccagcgccg

SEQ ID NO: 1048821 - RNA, 18 nt, Mycobacterium bovis subsp bovis AF2122/97
cgccgccagcgccgccgg

SEQ ID NO: 1048822 - RNA, 16 nt, Mycobacterium bovis subsp bovis AF2122/97
cgccgcagcuccccga

SEQ ID NO: 1048823 - RNA, 17 nt, Mycobacterium bovis subsp bovis AF2122/97
cgccgcagcuccccgac

SEQ ID NO: 1048824 - RNA, 22 nt, Mycobacterium bovis subsp bovis AF2122/97
cgccgcagcuccccgaccgaac

SEQ ID NO: 1048825 - RNA, 19 nt, Mycobacterium bovis subsp bovis AF2122/97
cgccgcagcuuguccggug

SEQ ID NO: 1048826 - RNA, 13 nt, Mycobacterium bovis subsp bovis AF2122/97
cgccgcagggccg

SEQ ID NO: 1048827 - RNA, 15 nt, Mycobacterium bovis subsp bovis AF2122/97
cgccgcagggccgcg

SEQ ID NO: 1048828 - RNA, 12 nt, Mycobacterium bovis subsp bovis AF2122/97
cgccgccagccu

SEQ ID NO: 1048829 - RNA, 13 nt, Mycobacterium bovis subsp bovis AF2122/97
cgccgccagcgcc

SEQ ID NO: 1048830 - RNA, 12 nt, Mycobacterium bovis subsp bovis AF2122/97
cgccgccagcgc

SEQ ID NO: 1048831 - RNA, 18 nt, Mycobacterium bovis subsp bovis AF2122/97
cgccgccagcgcgguguc

SEQ ID NO: 1048832 - RNA, 22 nt, Mycobacterium bovis subsp bovis AF2122/97
cgccgcacgccggcaugccagc

SEQ ID NO: 1048833 - RNA, 22 nt, Mycobacterium bovis subsp bovis AF2122/97
cgccgcagaucaccgccagcug

SEQ ID NO: 1048834 - RNA, 16 nt, Mycobacterium bovis subsp bovis AF2122/97
cgccgcagcgcucgcg

SEQ ID NO: 1048835 - RNA, 23 nt, Mycobacterium bovis subsp bovis AF2122/97
cgccgcagcaggugcaucgccac

SEQ ID NO: 1048836 - RNA, 18 nt, Mycobacterium bovis subsp bovis AF2122/97
cgccgcagaugggccucc

SEQ ID NO: 1048837 - RNA, 21 nt, Mycobacterium bovis subsp bovis AF2122/97
cgccgcagaugggccuccacc

SEQ ID NO: 1048838 - RNA, 13 nt, Mycobacterium bovis subsp bovis AF2122/97
cgccgccgaugcc

SEQ ID NO: 1048839 - RNA, 13 nt, Mycobacterium bovis subsp bovis AF2122/97
cgccgccgccacc

SEQ ID NO: 1048840 - RNA, 16 nt, Mycobacterium bovis subsp bovis AF2122/97
cgccgccgccaccggc

SEQ ID NO: 1048841 - RNA, 15 nt, Mycobacterium bovis subsp bovis AF2122/97
cgccgccgccacggc

SEQ ID NO: 1048842 - RNA, 16 nt, Mycobacterium bovis subsp bovis AF2122/97
cgccgccgccaccacc

SEQ ID NO: 1048843 - RNA, 14 nt, Mycobacterium bovis subsp bovis AF2122/97
cgccgccgccaccg

SEQ ID NO: 1048844 - RNA, 15 nt, Mycobacterium bovis subsp bovis AF2122/97
cgccgccgccaucgc

SEQ ID NO: 1048845 - RNA, 16 nt, Mycobacterium bovis subsp bovis AF2122/97
cgccgccgccaucgcc

SEQ ID NO: 1048846 - RNA, 17 nt, Mycobacterium bovis subsp bovis AF2122/97
cgccgccgccaucgccg

SEQ ID NO: 1048847 - RNA, 13 nt, Mycobacterium bovis subsp bovis AF2122/97
cgccgccgcccgg

SEQ ID NO: 1048848 - RNA, 13 nt, Mycobacterium bovis subsp bovis AF2122/97
cgccgccgcccgu

SEQ ID NO: 1048849 - RNA, 13 nt, Mycobacterium bovis subsp bovis AF2122/97
cgccgccgcgacg

SEQ ID NO: 1048850 - RNA, 15 nt, Mycobacterium bovis subsp bovis AF2122/97
cgccgccgcgacgca

SEQ ID NO: 1048851 - RNA, 12 nt, Mycobacterium bovis subsp bovis AF2122/97
cgccgccgcgac

SEQ ID NO: 1048852 - RNA, 16 nt, Mycobacterium bovis subsp bovis AF2122/97
cgccgccgccggcgcc

SEQ ID NO: 1048853 - RNA, 15 nt, Mycobacterium bovis subsp bovis AF2122/97
cgccgccgccggguc

SEQ ID NO: 1048854 - RNA, 12 nt, Mycobacterium bovis subsp bovis AF2122/97
cgccgccgcgcg

SEQ ID NO: 1048855 - RNA, 13 nt, Mycobacterium bovis subsp bovis AF2122/97
cgccgccgcguuc

SEQ ID NO: 1048856 - RNA, 14 nt, Mycobacterium bovis subsp bovis AF2122/97
cgccgccgcguuca

SEQ ID NO: 1048857 - RNA, 15 nt, Mycobacterium bovis subsp bovis AF2122/97
cgccgccgccgacgc

SEQ ID NO: 1048858 - RNA, 19 nt, Mycobacterium bovis subsp bovis AF2122/97
cgccgccggacccaccguc

SEQ ID NO: 1048859 - RNA, 17 nt, Mycobacterium bovis subsp bovis AF2122/97
cgccgccggaucgccgg

SEQ ID NO: 1048860 - RNA, 20 nt, Mycobacterium bovis subsp bovis AF2122/97
cgccgcccucucacggcggu

SEQ ID NO: 1048861 - RNA, 18 nt, Mycobacterium bovis subsp bovis AF2122/97
cgccgcccccgccggccg

SEQ ID NO: 1048862 - RNA, 20 nt, Mycobacterium bovis subsp bovis AF2122/97
cgccgcccccgccggccgcg

SEQ ID NO: 1048863 - RNA, 16 nt, Mycobacterium bovis subsp bovis AF2122/97
cgccgcccuggccgcc

SEQ ID NO: 1048864 - RNA, 18 nt, Mycobacterium bovis subsp bovis AF2122/97
cgccgcccuggccgccgg

SEQ ID NO: 1048865 - RNA, 19 nt, Mycobacterium bovis subsp bovis AF2122/97
cgccgcccuggccgccggc

SEQ ID NO: 1048866 - RNA, 23 nt, Mycobacterium bovis subsp bovis AF2122/97
cgccgcccuggccgccggccccg

SEQ ID NO: 1048867 - RNA, 21 nt, Mycobacterium bovis subsp bovis AF2122/97
cgccgcccuugccgccggccc

SEQ ID NO: 1048868 - RNA, 23 nt, Mycobacterium bovis subsp bovis AF2122/97
cgccgcccuugccgccggccccg

SEQ ID NO: 1048869 - RNA, 14 nt, Mycobacterium bovis subsp bovis AF2122/97
cgccgccgaaaacc

SEQ ID NO: 1048870 - RNA, 15 nt, Mycobacterium bovis subsp bovis AF2122/97
cgccgcccuccgacg

SEQ ID NO: 1048871 - RNA, 19 nt, Mycobacterium bovis subsp bovis AF2122/97
cgccgccgagauuggugca

SEQ ID NO: 1048872 - RNA, 16 nt, Mycobacterium bovis subsp bovis AF2122/97
cgccgccgaucaccag

SEQ ID NO: 1048873 - RNA, 21 nt, Mycobacterium bovis subsp bovis AF2122/97
cgccgccgacgccgccggcgc

SEQ ID NO: 1048874 - RNA, 14 nt, Mycobacterium bovis subsp bovis AF2122/97
cgccgccgacggau

SEQ ID NO: 1048875 - RNA, 16 nt, Mycobacterium bovis subsp bovis AF2122/97
cgccgccgacgaaggc

SEQ ID NO: 1048876 - RNA, 14 nt, Mycobacterium bovis subsp bovis AF2122/97
cgccgccgacguga

SEQ ID NO: 1048877 - RNA, 16 nt, Mycobacterium bovis subsp bovis AF2122/97
cgccgagcagacgcag

SEQ ID NO: 1048878 - RNA, 13 nt, Mycobacterium bovis subsp bovis AF2122/97
cgccgagaccgcc

SEQ ID NO: 1048879 - RNA, 14 nt, Mycobacterium bovis subsp bovis AF2122/97
cgccgagaccgccg

SEQ ID NO: 1048880 - RNA, 16 nt, Mycobacterium bovis subsp bovis AF2122/97
cgccgagaacgauguc

SEQ ID NO: 1048881 - RNA, 19 nt, Mycobacterium bovis subsp bovis AF2122/97
cgccgagaacgauguccgc

SEQ ID NO: 1048882 - RNA, 15 nt, Mycobacterium bovis subsp bovis AF2122/97
cgccgagaccgccgc

SEQ ID NO: 1048883 - RNA, 18 nt, Mycobacterium bovis subsp bovis AF2122/97
cgccgagaccgcgugguc

SEQ ID NO: 1048884 - RNA, 23 nt, Mycobacterium bovis subsp bovis AF2122/97
cgccgagaccgcguggucggcga

SEQ ID NO: 1048885 - RNA, 12 nt, Mycobacterium bovis subsp bovis AF2122/97
cgccgagaccgg

SEQ ID NO: 1048886 - RNA, 17 nt, Mycobacterium bovis subsp bovis AF2122/97
cgccgagaccggccagu

SEQ ID NO: 1048887 - RNA, 22 nt, Mycobacterium bovis subsp bovis AF2122/97
cgccgagccagcacccgcagcc

SEQ ID NO: 1048888 - RNA, 23 nt, Mycobacterium bovis subsp bovis AF2122/97
cgccgagcagcccgcggaucacg

SEQ ID NO: 1048889 - RNA, 17 nt, Mycobacterium bovis subsp bovis AF2122/97
cgccgagcaggucggca

SEQ ID NO: 1048890 - RNA, 14 nt, Mycobacterium bovis subsp bovis AF2122/97
cgccgagcccgccg

SEQ ID NO: 1048891 - RNA, 17 nt, Mycobacterium bovis subsp bovis AF2122/97
cgccgagcccgccgggu

SEQ ID NO: 1048892 - RNA, 17 nt, Mycobacterium bovis subsp bovis AF2122/97
cgccgaucaacaugccg

SEQ ID NO: 1048893 - RNA, 15 nt, Mycobacterium bovis subsp bovis AF2122/97
cgccgaggccgccgu

SEQ ID NO: 1048894 - RNA, 20 nt, Mycobacterium bovis subsp bovis AF2122/97
cgccgaggccgccguugccg

SEQ ID NO: 1048895 - RNA, 19 nt, Mycobacterium bovis subsp bovis AF2122/97
cgccgaggccuaccaggcg

SEQ ID NO: 1048896 - RNA, 20 nt, Mycobacterium bovis subsp bovis AF2122/97
cgccgaggccuaccaggcgc

SEQ ID NO: 1048897 - RNA, 22 nt, Mycobacterium bovis subsp bovis AF2122/97
cgccgaggccuaccaggcgcgg

SEQ ID NO: 1048898 - RNA, 17 nt, Mycobacterium bovis subsp bovis AF2122/97
cgccgaggccucggcca

SEQ ID NO: 1048899 - RNA, 20 nt, Mycobacterium bovis subsp bovis AF2122/97
cgccgaucacggugggcgcc

SEQ ID NO: 1048900 - RNA, 14 nt, Mycobacterium bovis subsp bovis AF2122/97
cgccgaucaccagg

SEQ ID NO: 1048901 - RNA, 16 nt, Mycobacterium bovis subsp bovis AF2122/97
cgccgaucaccaccgg

SEQ ID NO: 1048902 - RNA, 14 nt, Mycobacterium bovis subsp bovis AF2122/97
cgccgaggcaaccg

SEQ ID NO: 1048903 - RNA, 20 nt, Mycobacterium bovis subsp bovis AF2122/97
cgccgaggcagcgucgucga

SEQ ID NO: 1048904 - RNA, 17 nt, Mycobacterium bovis subsp bovis AF2122/97
cgccgaggcauugcugu

SEQ ID NO: 1048905 - RNA, 14 nt, Mycobacterium bovis subsp bovis AF2122/97
cgccgaggacgccg

SEQ ID NO: 1048906 - RNA, 19 nt, Mycobacterium bovis subsp bovis AF2122/97
cgccgaggacgccggcgcc

SEQ ID NO: 1048907 - RNA, 20 nt, Mycobacterium bovis subsp bovis AF2122/97
cgccgaggacgccggcgccg

SEQ ID NO: 1048908 - RNA, 13 nt, Mycobacterium bovis subsp bovis AF2122/97
cgccgagcgccag

SEQ ID NO: 1048909 - RNA, 16 nt, Mycobacterium bovis subsp bovis AF2122/97
cgccgacccgccgcgg

SEQ ID NO: 1048910 - RNA, 17 nt, Mycobacterium bovis subsp bovis AF2122/97
cgccgacccgccgcgga

SEQ ID NO: 1048911 - RNA, 17 nt, Mycobacterium bovis subsp bovis AF2122/97
cgccgacccgcgcgccg

SEQ ID NO: 1048912 - RNA, 13 nt, Mycobacterium bovis subsp bovis AF2122/97
cgccgacccguac

SEQ ID NO: 1048913 - RNA, 19 nt, Mycobacterium bovis subsp bovis AF2122/97
cgccgacaggugaaggugc

SEQ ID NO: 1048914 - RNA, 16 nt, Mycobacterium bovis subsp bovis AF2122/97
cgccgacagccgaucc

SEQ ID NO: 1048915 - RNA, 22 nt, Mycobacterium bovis subsp bovis AF2122/97
cgccgacagccgauccgaucgc

SEQ ID NO: 1048916 - RNA, 15 nt, Mycobacterium bovis subsp bovis AF2122/97
cgccgacaggccggc

SEQ ID NO: 1048917 - RNA, 15 nt, Mycobacterium bovis subsp bovis AF2122/97
cgccgacaccggcug

SEQ ID NO: 1048918 - RNA, 18 nt, Mycobacterium bovis subsp bovis AF2122/97
cgccgacaccggcugacc

SEQ ID NO: 1048919 - RNA, 13 nt, Mycobacterium bovis subsp bovis AF2122/97
cgccgaccgcgcc

SEQ ID NO: 1048920 - RNA, 21 nt, Mycobacterium bovis subsp bovis AF2122/97
cgccgaccgacaccaccaggu

SEQ ID NO: 1048921 - RNA, 15 nt, Mycobacterium bovis subsp bovis AF2122/97
cgccgaccggaccgg

SEQ ID NO: 1048922 - RNA, 14 nt, Mycobacterium bovis subsp bovis AF2122/97
cgccgaccgcgccg

SEQ ID NO: 1048923 - RNA, 16 nt, Mycobacterium bovis subsp bovis AF2122/97
cgccgaccggcccgca

SEQ ID NO: 1048924 - RNA, 18 nt, Mycobacterium bovis subsp bovis AF2122/97
cgccgacccgccacaucg

SEQ ID NO: 1048925 - RNA, 17 nt, Mycobacterium bovis subsp bovis AF2122/97
cgccgaccggccacgac

SEQ ID NO: 1048926 - RNA, 20 nt, Mycobacterium bovis subsp bovis AF2122/97
cgccgacucggcaccgcggc

SEQ ID NO: 1048927 - RNA, 22 nt, Mycobacterium bovis subsp bovis AF2122/97
cgccgacucggcaccgcggccg

SEQ ID NO: 1048928 - RNA, 21 nt, Mycobacterium bovis subsp bovis AF2122/97
cgccgacggccagcaggauga

SEQ ID NO: 1048929 - RNA, 18 nt, Mycobacterium bovis subsp bovis AF2122/97
cgccgacggccagcagga

SEQ ID NO: 1048930 - RNA, 20 nt, Mycobacterium bovis subsp bovis AF2122/97
cgccgacggccagcaggaug

SEQ ID NO: 1048931 - RNA, 14 nt, Mycobacterium bovis subsp bovis AF2122/97
cgccgacggcaccg

SEQ ID NO: 1048932 - RNA, 15 nt, Mycobacterium bovis subsp bovis AF2122/97
cgccgacggccagca

SEQ ID NO: 1048933 - RNA, 21 nt, Mycobacterium bovis subsp bovis AF2122/97
cgccgacuugauuucgaucgc

SEQ ID NO: 1048934 - RNA, 17 nt, Mycobacterium bovis subsp bovis AF2122/97
cgccgacuuugucgcgg

SEQ ID NO: 1048935 - RNA, 14 nt, Mycobacterium bovis subsp bovis AF2122/97
cgccgacgcccagg

SEQ ID NO: 1048936 - RNA, 20 nt, Mycobacterium bovis subsp bovis AF2122/97
cgccgacgauuaccagcggc

SEQ ID NO: 1048937 - RNA, 14 nt, Mycobacterium bovis subsp bovis AF2122/97
cgccgacgccgccg

SEQ ID NO: 1048938 - RNA, 15 nt, Mycobacterium bovis subsp bovis AF2122/97
cgccgacgccgccgg

SEQ ID NO: 1048939 - RNA, 20 nt, Mycobacterium bovis subsp bovis AF2122/97
cgccgacgccgccggcaccg

SEQ ID NO: 1048940 - RNA, 15 nt, Mycobacterium bovis subsp bovis AF2122/97
cgccgacgccguugc

SEQ ID NO: 1048941 - RNA, 13 nt, Mycobacterium bovis subsp bovis AF2122/97
cgccgacgccguu

SEQ ID NO: 1048942 - RNA, 17 nt, Mycobacterium bovis subsp bovis AF2122/97
cgccgaagcugcggguc

SEQ ID NO: 1048943 - RNA, 13 nt, Mycobacterium bovis subsp bovis AF2122/97
cgccgaagccgcg

SEQ ID NO: 1048944 - RNA, 15 nt, Mycobacterium bovis subsp bovis AF2122/97
cgccgaagccgcgca

SEQ ID NO: 1048945 - RNA, 15 nt, Mycobacterium bovis subsp bovis AF2122/97
cgccgaacaccgccg

SEQ ID NO: 1048946 - RNA, 15 nt, Mycobacterium bovis subsp bovis AF2122/97
cgccgacaccaccgg

SEQ ID NO: 1048947 - RNA, 16 nt, Mycobacterium bovis subsp bovis AF2122/97
cgccgacaccaccggc

SEQ ID NO: 1048948 - RNA, 14 nt, Mycobacterium bovis subsp bovis AF2122/97
cgccgacaccaccg

SEQ ID NO: 1048949 - RNA, 19 nt, Mycobacterium bovis subsp bovis AF2122/97
cgccgaaggccgccacaaa

SEQ ID NO: 1048950 - RNA, 20 nt, Mycobacterium bovis subsp bovis AF2122/97
cgccgaauucauccgggcuc

SEQ ID NO: 1048951 - RNA, 15 nt, Mycobacterium bovis subsp bovis AF2122/97
cgccgaagcgaugcc

SEQ ID NO: 1048952 - RNA, 16 nt, Mycobacterium bovis subsp bovis AF2122/97
cgccgaagcgggcccg

SEQ ID NO: 1048953 - RNA, 13 nt, Mycobacterium bovis subsp bovis AF2122/97
cgccgaagccgac

SEQ ID NO: 1048954 - RNA, 14 nt, Mycobacterium bovis subsp bovis AF2122/97
cgccgaagccgacg

SEQ ID NO: 1048955 - RNA, 15 nt, Mycobacterium bovis subsp bovis AF2122/97
cgccgaagccgacga

SEQ ID NO: 1048956 - RNA, 17 nt, Mycobacterium bovis subsp bovis AF2122/97
cgccgaagccgacgaac

SEQ ID NO: 1048957 - RNA, 20 nt, Mycobacterium bovis subsp bovis AF2122/97
cgccgaaaagggcgacagcg

SEQ ID NO: 1048958 - RNA, 18 nt, Mycobacterium bovis subsp bovis AF2122/97
cgccgaaaaggucgggga

SEQ ID NO: 1048959 - RNA, 16 nt, Mycobacterium bovis subsp bovis AF2122/97
cgccgaagaggagaac

SEQ ID NO: 1048960 - RNA, 17 nt, Mycobacterium bovis subsp bovis AF2122/97
cgccgaaagggucgacg

SEQ ID NO: 1048961 - RNA, 13 nt, Mycobacterium bovis subsp bovis AF2122/97
cgccgaacaccga

SEQ ID NO: 1048962 - RNA, 15 nt, Mycobacterium bovis subsp bovis AF2122/97
cgccgaaaucggcca

SEQ ID NO: 1048963 - RNA, 16 nt, Mycobacterium bovis subsp bovis AF2122/97
cgccgaacaccacacc

SEQ ID NO: 1048964 - RNA, 14 nt, Mycobacterium bovis subsp bovis AF2122/97
cgcccuugaucagc

SEQ ID NO: 1048965 - RNA, 14 nt, Mycobacterium bovis subsp bovis AF2122/97
cgccgaaacagcac

SEQ ID NO: 1048966 - RNA, 23 nt, Mycobacterium bovis subsp bovis AF2122/97
cgccgaaaccgggacaaucucgg

SEQ ID NO: 1048967 - RNA, 14 nt, Mycobacterium bovis subsp bovis AF2122/97
cgccgaaaucggcc

SEQ ID NO: 1048968 - RNA, 13 nt, Mycobacterium bovis subsp bovis AF2122/97
cgcccuggccgcc

SEQ ID NO: 1048969 - RNA, 22 nt, Mycobacterium bovis subsp bovis AF2122/97
cgcccuggccgcccagaccgcc

SEQ ID NO: 1048970 - RNA, 19 nt, Mycobacterium bovis subsp bovis AF2122/97
cgcccuugauguccgcgac

SEQ ID NO: 1048971 - RNA, 20 nt, Mycobacterium bovis subsp bovis AF2122/97
cgcccuugauguccgcgacg

SEQ ID NO: 1048972 - RNA, 15 nt, Mycobacterium bovis subsp bovis AF2122/97
cgcccuugccgccag

SEQ ID NO: 1048973 - RNA, 17 nt, Mycobacterium bovis subsp bovis AF2122/97
cgcccuugccgccagcc

SEQ ID NO: 1048974 - RNA, 18 nt, Mycobacterium bovis subsp bovis AF2122/97
cgcccuugccgccagccc

SEQ ID NO: 1048975 - RNA, 14 nt, Mycobacterium bovis subsp bovis AF2122/97
cgcccuugccgccg

SEQ ID NO: 1048976 - RNA, 17 nt, Mycobacterium bovis subsp bovis AF2122/97
cgcccuugccgccggcc

SEQ ID NO: 1048977 - RNA, 14 nt, Mycobacterium bovis subsp bovis AF2122/97
cgcccuugccgccu

SEQ ID NO: 1048978 - RNA, 15 nt, Mycobacterium bovis subsp bovis AF2122/97
cgcccuugccggcga

SEQ ID NO: 1048979 - RNA, 14 nt, Mycobacterium bovis subsp bovis AF2122/97
cgcccuugagccgc

SEQ ID NO: 1048980 - RNA, 17 nt, Mycobacterium bovis subsp bovis AF2122/97
cgcccuggaaugccgcc

SEQ ID NO: 1048981 - RNA, 18 nt, Mycobacterium bovis subsp bovis AF2122/97
cgcccuggaaugccgcca

SEQ ID NO: 1048982 - RNA, 18 nt, Mycobacterium bovis subsp bovis AF2122/97
cgcccuggacgucggcga

SEQ ID NO: 1048983 - RNA, 14 nt, Mycobacterium bovis subsp bovis AF2122/97
cgcccuggcaacga

SEQ ID NO: 1048984 - RNA, 22 nt, Mycobacterium bovis subsp bovis AF2122/97
cgcccuggcaacgacacgccgc

SEQ ID NO: 1048985 - RNA, 23 nt, Mycobacterium bovis subsp bovis AF2122/97
cgcccuggacgucggcgauaucg

SEQ ID NO: 1048986 - RNA, 13 nt, Mycobacterium bovis subsp bovis AF2122/97
cgcccggucgagc

SEQ ID NO: 1048987 - RNA, 14 nt, Mycobacterium bovis subsp bovis AF2122/97
cgcccggucgggcg

SEQ ID NO: 1048988 - RNA, 16 nt, Mycobacterium bovis subsp bovis AF2122/97
cgcccggucgggcgcg

SEQ ID NO: 1048989 - RNA, 15 nt, Mycobacterium bovis subsp bovis AF2122/97
cgcccggucucgacg

SEQ ID NO: 1048990 - RNA, 21 nt, Mycobacterium bovis subsp bovis AF2122/97
cgcccgguguguucggcccgc

SEQ ID NO: 1048991 - RNA, 15 nt, Mycobacterium bovis subsp bovis AF2122/97
cgcccggucacgcug

SEQ ID NO: 1048992 - RNA, 17 nt, Mycobacterium bovis subsp bovis AF2122/97
cgcccggucacgcugug

SEQ ID NO: 1048993 - RNA, 18 nt, Mycobacterium bovis subsp bovis AF2122/97
cgcccgggucccggcagc

SEQ ID NO: 1048994 - RNA, 14 nt, Mycobacterium bovis subsp bovis AF2122/97
cgccccgugggccu

SEQ ID NO: 1048995 - RNA, 14 nt, Mycobacterium bovis subsp bovis AF2122/97
cgccccggcggcgg

SEQ ID NO: 1048996 - RNA, 19 nt, Mycobacterium bovis subsp bovis AF2122/97
cgccccccacggcccguug

SEQ ID NO: 1048997 - RNA, 15 nt, Mycobacterium bovis subsp bovis AF2122/97
cgccccaugcaacac

SEQ ID NO: 1048998 - RNA, 18 nt, Mycobacterium bovis subsp bovis AF2122/97
cgccccaugcaacacacc

SEQ ID NO: 1048999 - RNA, 21 nt, Mycobacterium bovis subsp bovis AF2122/97
cgccccaugcaacacaccgcg

SEQ ID NO: 1049000 - RNA, 22 nt, Mycobacterium bovis subsp bovis AF2122/97
cgccccaugucaagcgaugucc

SEQ ID NO: 1049001 - RNA, 21 nt, Mycobacterium bovis subsp bovis AF2122/97
cgccccagggggcgugccgcc

SEQ ID NO: 1049002 - RNA, 22 nt, Mycobacterium bovis subsp bovis AF2122/97
cgccccagggggcgugccgccg

SEQ ID NO: 1049003 - RNA, 23 nt, Mycobacterium bovis subsp bovis AF2122/97
cgccccagggggcgugccgccgc

SEQ ID NO: 1049004 - RNA, 19 nt, Mycobacterium bovis subsp bovis AF2122/97
cgccccagguuccgcuguc

SEQ ID NO: 1049005 - RNA, 22 nt, Mycobacterium bovis subsp bovis AF2122/97
cgccccaguucgacggcgucaa

SEQ ID NO: 1049006 - RNA, 17 nt, Mycobacterium bovis subsp bovis AF2122/97
cgcccauucccagaggc

SEQ ID NO: 1049007 - RNA, 21 nt, Mycobacterium bovis subsp bovis AF2122/97
cgcccauugacguagaccguc

SEQ ID NO: 1049008 - RNA, 18 nt, Mycobacterium bovis subsp bovis AF2122/97
cgcccauggccaccaggg

SEQ ID NO: 1049009 - RNA, 20 nt, Mycobacterium bovis subsp bovis AF2122/97
cgccccagccaugcugcucg

SEQ ID NO: 1049010 - RNA, 18 nt, Mycobacterium bovis subsp bovis AF2122/97
cgccccagcugcggucgc

SEQ ID NO: 1049011 - RNA, 16 nt, Mycobacterium bovis subsp bovis AF2122/97
cgccccaccgcgccga

SEQ ID NO: 1049012 - RNA, 18 nt, Mycobacterium bovis subsp bovis AF2122/97
cgccccaccgcgccgagc

SEQ ID NO: 1049013 - RNA, 16 nt, Mycobacterium bovis subsp bovis AF2122/97
cgccccaccggcccgg

SEQ ID NO: 1049014 - RNA, 16 nt, Mycobacterium bovis subsp bovis AF2122/97
cgccccaccggccgaa

SEQ ID NO: 1049015 - RNA, 14 nt, Mycobacterium bovis subsp bovis AF2122/97
cgcccagggcgucg

SEQ ID NO: 1049016 - RNA, 14 nt, Mycobacterium bovis subsp bovis AF2122/97
cgcccaggugaucg

SEQ ID NO: 1049017 - RNA, 18 nt, Mycobacterium bovis subsp bovis AF2122/97
cgcccaggugaucgcgag

SEQ ID NO: 1049018 - RNA, 16 nt, Mycobacterium bovis subsp bovis AF2122/97
cgcccagucccaggug

SEQ ID NO: 1049019 - RNA, 13 nt, Mycobacterium bovis subsp bovis AF2122/97
cgcccagucgccg

SEQ ID NO: 1049020 - RNA, 19 nt, Mycobacterium bovis subsp bovis AF2122/97
cgcccagugcgcaacccag

SEQ ID NO: 1049021 - RNA, 22 nt, Mycobacterium bovis subsp bovis AF2122/97
cgcccagugcgcaacccagccg

SEQ ID NO: 1049022 - RNA, 16 nt, Mycobacterium bovis subsp bovis AF2122/97
cgcccagucgccgcgg

SEQ ID NO: 1049023 - RNA, 14 nt, Mycobacterium bovis subsp bovis AF2122/97
cgcccagucgccgc

SEQ ID NO: 1049024 - RNA, 16 nt, Mycobacterium bovis subsp bovis AF2122/97
cgcccagugccagaac

SEQ ID NO: 1049025 - RNA, 20 nt, Mycobacterium bovis subsp bovis AF2122/97
cgcccagugccagaacccgg

SEQ ID NO: 1049026 - RNA, 14 nt, Mycobacterium bovis subsp bovis AF2122/97
cgcccaucaccccg

SEQ ID NO: 1049027 - RNA, 22 nt, Mycobacterium bovis subsp bovis AF2122/97
cgcccauagcugccggcccacc

SEQ ID NO: 1049028 - RNA, 16 nt, Mycobacterium bovis subsp bovis AF2122/97
cgcccagugugcgccg

SEQ ID NO: 1049029 - RNA, 18 nt, Mycobacterium bovis subsp bovis AF2122/97
cgcccagugugcgccgug

SEQ ID NO: 1049030 - RNA, 19 nt, Mycobacterium bovis subsp bovis AF2122/97
cgcccaucgcgacggcccg

SEQ ID NO: 1049031 - RNA, 23 nt, Mycobacterium bovis subsp bovis AF2122/97
cgcccaugcugacacgacaugac

SEQ ID NO: 1049032 - RNA, 21 nt, Mycobacterium bovis subsp bovis AF2122/97
cgcccaugaccggccgccaac

SEQ ID NO: 1049033 - RNA, 14 nt, Mycobacterium bovis subsp bovis AF2122/97
cgcccggccagguc

SEQ ID NO: 1049034 - RNA, 17 nt, Mycobacterium bovis subsp bovis AF2122/97
cgcccggccccgcaagc

SEQ ID NO: 1049035 - RNA, 21 nt, Mycobacterium bovis subsp bovis AF2122/97
cgcccggccccgcaagcggau

SEQ ID NO: 1049036 - RNA, 20 nt, Mycobacterium bovis subsp bovis AF2122/97
cgcccggcaguucgcggcca

SEQ ID NO: 1049037 - RNA, 16 nt, Mycobacterium bovis subsp bovis AF2122/97
cgcccggccccgcggc

SEQ ID NO: 1049038 - RNA, 12 nt, Mycobacterium bovis subsp bovis AF2122/97
cgcccggcccgc

SEQ ID NO: 1049039 - RNA, 14 nt, Mycobacterium bovis subsp bovis AF2122/97
cgcccggcccggcu

SEQ ID NO: 1049040 - RNA, 13 nt, Mycobacterium bovis subsp bovis AF2122/97
cgcccggcccggc

SEQ ID NO: 1049041 - RNA, 21 nt, Mycobacterium bovis subsp bovis AF2122/97
cgcccggccugcuggucacca

SEQ ID NO: 1049042 - RNA, 13 nt, Mycobacterium bovis subsp bovis AF2122/97
cgcccggcggauc

SEQ ID NO: 1049043 - RNA, 17 nt, Mycobacterium bovis subsp bovis AF2122/97
cgcccggcggaucccga

SEQ ID NO: 1049044 - RNA, 21 nt, Mycobacterium bovis subsp bovis AF2122/97
cgcccggcguauugcaccgcc

SEQ ID NO: 1049045 - RNA, 14 nt, Mycobacterium bovis subsp bovis AF2122/97
cgcccgcucggccg

SEQ ID NO: 1049046 - RNA, 18 nt, Mycobacterium bovis subsp bovis AF2122/97
cgcccgcuccgccgucgc

SEQ ID NO: 1049047 - RNA, 13 nt, Mycobacterium bovis subsp bovis AF2122/97
cgcccgcugcaga

SEQ ID NO: 1049048 - RNA, 17 nt, Mycobacterium bovis subsp bovis AF2122/97
cgcccgcugccgucgga

SEQ ID NO: 1049049 - RNA, 19 nt, Mycobacterium bovis subsp bovis AF2122/97
cgcccgcugccgucggaga

SEQ ID NO: 1049050 - RNA, 16 nt, Mycobacterium bovis subsp bovis AF2122/97
cgcccgcgccaccggc

SEQ ID NO: 1049051 - RNA, 18 nt, Mycobacterium bovis subsp bovis AF2122/97
cgcccgcucggccgcagc

SEQ ID NO: 1049052 - RNA, 14 nt, Mycobacterium bovis subsp bovis AF2122/97
cgcccgcugcggcg

SEQ ID NO: 1049053 - RNA, 13 nt, Mycobacterium bovis subsp bovis AF2122/97
cgcccggcaguuc

SEQ ID NO: 1049054 - RNA, 18 nt, Mycobacterium bovis subsp bovis AF2122/97
cgcccgccaucagcccgg

SEQ ID NO: 1049055 - RNA, 22 nt, Mycobacterium bovis subsp bovis AF2122/97
cgcccgccaccggguucaccga

SEQ ID NO: 1049056 - RNA, 13 nt, Mycobacterium bovis subsp bovis AF2122/97
cgcccgccaccgg

SEQ ID NO: 1049057 - RNA, 14 nt, Mycobacterium bovis subsp bovis AF2122/97
cgcccgccaccggg

SEQ ID NO: 1049058 - RNA, 14 nt, Mycobacterium bovis subsp bovis AF2122/97
cgcccgcccgcacg

SEQ ID NO: 1049059 - RNA, 17 nt, Mycobacterium bovis subsp bovis AF2122/97
cgcccgcgccuccguug

SEQ ID NO: 1049060 - RNA, 15 nt, Mycobacterium bovis subsp bovis AF2122/97
cgcccgcgcccccgg

SEQ ID NO: 1049061 - RNA, 22 nt, Mycobacterium bovis subsp bovis AF2122/97
cgcccgcgccaccgauaccguc

SEQ ID NO: 1049062 - RNA, 15 nt, Mycobacterium bovis subsp bovis AF2122/97
cgcccgcgccaccgg

SEQ ID NO: 1049063 - RNA, 12 nt, Mycobacterium bovis subsp bovis AF2122/97
cgcccgcgccgc

SEQ ID NO: 1049064 - RNA, 17 nt, Mycobacterium bovis subsp bovis AF2122/97
cgcccgcgccgccgcca

SEQ ID NO: 1049065 - RNA, 17 nt, Mycobacterium bovis subsp bovis AF2122/97
cgcccgcgccgccgcua

SEQ ID NO: 1049066 - RNA, 15 nt, Mycobacterium bovis subsp bovis AF2122/97
cgcccgcgccgccgg

SEQ ID NO: 1049067 - RNA, 19 nt, Mycobacterium bovis subsp bovis AF2122/97
cgcccgcgccgccggaccc

SEQ ID NO: 1049068 - RNA, 14 nt, Mycobacterium bovis subsp bovis AF2122/97
cgcccgcgagcugu

SEQ ID NO: 1049069 - RNA, 14 nt, Mycobacterium bovis subsp bovis AF2122/97
cgcccgcgccaccg

SEQ ID NO: 1049070 - RNA, 15 nt, Mycobacterium bovis subsp bovis AF2122/97
cgcccgcgccaccga

SEQ ID NO: 1049071 - RNA, 13 nt, Mycobacterium bovis subsp bovis AF2122/97
cgcccgcgccacc

SEQ ID NO: 1049072 - RNA, 23 nt, Mycobacterium bovis subsp bovis AF2122/97
cgcccgcgccaccagcaccgccg

SEQ ID NO: 1049073 - RNA, 11 nt, Mycobacterium bovis subsp bovis AF2122/97
cgcccgccacc

SEQ ID NO: 1049074 - RNA, 15 nt, Mycobacterium bovis subsp bovis AF2122/97
cgcccgcaucgcggc

SEQ ID NO: 1049075 - RNA, 23 nt, Mycobacterium bovis subsp bovis AF2122/97
cgcccgcauugaucucgaccggc

SEQ ID NO: 1049076 - RNA, 23 nt, Mycobacterium bovis subsp bovis AF2122/97
cgcccgaaaaacgaccccucacc

SEQ ID NO: 1049077 - RNA, 17 nt, Mycobacterium bovis subsp bovis AF2122/97
cgcccgcacucggcggu

SEQ ID NO: 1049078 - RNA, 13 nt, Mycobacterium bovis subsp bovis AF2122/97
cgcccgcagggcc

SEQ ID NO: 1049079 - RNA, 14 nt, Mycobacterium bovis subsp bovis AF2122/97
cgcccgcagggccg

SEQ ID NO: 1049080 - RNA, 17 nt, Mycobacterium bovis subsp bovis AF2122/97
cgcccgcagggccgccg

SEQ ID NO: 1049081 - RNA, 20 nt, Mycobacterium bovis subsp bovis AF2122/97
cgcccgcaggacgcugccgg

SEQ ID NO: 1049082 - RNA, 20 nt, Mycobacterium bovis subsp bovis AF2122/97
cgcccgcacguucacgcgcg

SEQ ID NO: 1049083 - RNA, 16 nt, Mycobacterium bovis subsp bovis AF2122/97
cgccccuggcaccucg

SEQ ID NO: 1049084 - RNA, 20 nt, Mycobacterium bovis subsp bovis AF2122/97
cgccccugcgcggccaccuc

SEQ ID NO: 1049085 - RNA, 21 nt, Mycobacterium bovis subsp bovis AF2122/97
cgccccguuucggucgacaac

SEQ ID NO: 1049086 - RNA, 14 nt, Mycobacterium bovis subsp bovis AF2122/97
cgcccgaagccggg

SEQ ID NO: 1049087 - RNA, 18 nt, Mycobacterium bovis subsp bovis AF2122/97
cgcccgaaugcgacgucg

SEQ ID NO: 1049088 - RNA, 15 nt, Mycobacterium bovis subsp bovis AF2122/97
cgcccgaaugcggug

SEQ ID NO: 1049089 - RNA, 12 nt, Mycobacterium bovis subsp bovis AF2122/97
cgcccgacaccc

SEQ ID NO: 1049090 - RNA, 16 nt, Mycobacterium bovis subsp bovis AF2122/97
cgcccgacccaucacc

SEQ ID NO: 1049091 - RNA, 22 nt, Mycobacterium bovis subsp bovis AF2122/97
cgccaugugugcaaaggcgccg

SEQ ID NO: 1049092 - RNA, 19 nt, Mycobacterium bovis subsp bovis AF2122/97
cgccauguugaagcgaagc

SEQ ID NO: 1049093 - RNA, 21 nt, Mycobacterium bovis subsp bovis AF2122/97
cgccauuccaucgcgcaccgc

SEQ ID NO: 1049094 - RNA, 22 nt, Mycobacterium bovis subsp bovis AF2122/97
cgccauucaucggcaucgacug

SEQ ID NO: 1049095 - RNA, 15 nt, Mycobacterium bovis subsp bovis AF2122/97
cgccauuccaagacg

SEQ ID NO: 1049096 - RNA, 22 nt, Mycobacterium bovis subsp bovis AF2122/97
cgccauuccagccggugccgcc

SEQ ID NO: 1049097 - RNA, 13 nt, Mycobacterium bovis subsp bovis AF2122/97
cgccauugacgcc

SEQ ID NO: 1049098 - RNA, 23 nt, Mycobacterium bovis subsp bovis AF2122/97
cgccauugaggaagccguuggcg

SEQ ID NO: 1049099 - RNA, 13 nt, Mycobacterium bovis subsp bovis AF2122/97
cgccauugccgcc

SEQ ID NO: 1049100 - RNA, 13 nt, Mycobacterium bovis subsp bovis AF2122/97
cgccauuggcgcc

SEQ ID NO: 1049101 - RNA, 14 nt, Mycobacterium bovis subsp bovis AF2122/97
cgccauuggcgccg

SEQ ID NO: 1049102 - RNA, 17 nt, Mycobacterium bovis subsp bovis AF2122/97
cgccauuggcgccguca

SEQ ID NO: 1049103 - RNA, 14 nt, Mycobacterium bovis subsp bovis AF2122/97
cgccauugccgccg

SEQ ID NO: 1049104 - RNA, 18 nt, Mycobacterium bovis subsp bovis AF2122/97
cgccauugccgccggugc

SEQ ID NO: 1049105 - RNA, 19 nt, Mycobacterium bovis subsp bovis AF2122/97
cgccauugccgccggugcc

SEQ ID NO: 1049106 - RNA, 18 nt, Mycobacterium bovis subsp bovis AF2122/97
cgccauugccgccgucgc

SEQ ID NO: 1049107 - RNA, 15 nt, Mycobacterium bovis subsp bovis AF2122/97
cgcccacagcugacg

SEQ ID NO: 1049108 - RNA, 19 nt, Mycobacterium bovis subsp bovis AF2122/97
cgcccacagcugacgagcc

SEQ ID NO: 1049109 - RNA, 22 nt, Mycobacterium bovis subsp bovis AF2122/97
cgcccacaaugacucggccgca

SEQ ID NO: 1049110 - RNA, 23 nt, Mycobacterium bovis subsp bovis AF2122/97
cgcccacaaugacucggccgcac

SEQ ID NO: 1049111 - RNA, 19 nt, Mycobacterium bovis subsp bovis AF2122/97
cgcccaagguggcggccag

SEQ ID NO: 1049112 - RNA, 17 nt, Mycobacterium bovis subsp bovis AF2122/97
cgcccaauuucgucucg

SEQ ID NO: 1049113 - RNA, 21 nt, Mycobacterium bovis subsp bovis AF2122/97
cgcccaauuucgucucgaaau

SEQ ID NO: 1049114 - RNA, 18 nt, Mycobacterium bovis subsp bovis AF2122/97
cgcccaauuucgugccga

SEQ ID NO: 1049115 - RNA, 20 nt, Mycobacterium bovis subsp bovis AF2122/97
cgcccaauuucgugccgaau

SEQ ID NO: 1049116 - RNA, 20 nt, Mycobacterium bovis subsp bovis AF2122/97
cgcccaagccgccggcgcca

SEQ ID NO: 1049117 - RNA, 20 nt, Mycobacterium bovis subsp bovis AF2122/97
cgcccaacgucgccagguca

SEQ ID NO: 1049118 - RNA, 21 nt, Mycobacterium bovis subsp bovis AF2122/97
cgcccaaccugggaaugacgg

SEQ ID NO: 1049119 - RNA, 13 nt, Mycobacterium bovis subsp bovis AF2122/97
cgcccaacaccgc

SEQ ID NO: 1049120 - RNA, 18 nt, Mycobacterium bovis subsp bovis AF2122/97
cgcccaacaacgcuucgg

SEQ ID NO: 1049121 - RNA, 12 nt, Mycobacterium bovis subsp bovis AF2122/97
cgccaugcggcg

SEQ ID NO: 1049122 - RNA, 15 nt, Mycobacterium bovis subsp bovis AF2122/97
cgccaugcgccaacc

SEQ ID NO: 1049123 - RNA, 18 nt, Mycobacterium bovis subsp bovis AF2122/97
cgccaugcgccaacccgg

SEQ ID NO: 1049124 - RNA, 14 nt, Mycobacterium bovis subsp bovis AF2122/97
cgccaugcggcgcg

SEQ ID NO: 1049125 - RNA, 19 nt, Mycobacterium bovis subsp bovis AF2122/97
cgccaugcggcgcgucgcg

SEQ ID NO: 1049126 - RNA, 13 nt, Mycobacterium bovis subsp bovis AF2122/97
cgccaugcugucg

SEQ ID NO: 1049127 - RNA, 23 nt, Mycobacterium bovis subsp bovis AF2122/97
cgccauggaucccacgaguuggc

SEQ ID NO: 1049128 - RNA, 23 nt, Mycobacterium bovis subsp bovis AF2122/97
cgccaggaucugguugaaccggu

SEQ ID NO: 1049129 - RNA, 14 nt, Mycobacterium bovis subsp bovis AF2122/97
cgccaugcgcacca

SEQ ID NO: 1049130 - RNA, 20 nt, Mycobacterium bovis subsp bovis AF2122/97
cgccaggaaucccucggccg

SEQ ID NO: 1049131 - RNA, 18 nt, Mycobacterium bovis subsp bovis AF2122/97
cgccaggaacucggccca

SEQ ID NO: 1049132 - RNA, 14 nt, Mycobacterium bovis subsp bovis AF2122/97
cgccaggagcgcgg

SEQ ID NO: 1049133 - RNA, 18 nt, Mycobacterium bovis subsp bovis AF2122/97
cgccaggagcgcggcccg

SEQ ID NO: 1049134 - RNA, 23 nt, Mycobacterium bovis subsp bovis AF2122/97
cgccaggagcgcggcccgccucg

SEQ ID NO: 1049135 - RNA, 18 nt, Mycobacterium bovis subsp bovis AF2122/97
cgcccagcaaggcccgaa

SEQ ID NO: 1049136 - RNA, 20 nt, Mycobacterium bovis subsp bovis AF2122/97
cgcccagcaucucggcggcc

SEQ ID NO: 1049137 - RNA, 22 nt, Mycobacterium bovis subsp bovis AF2122/97
cgcccagcaucucggcggccaa

SEQ ID NO: 1049138 - RNA, 13 nt, Mycobacterium bovis subsp bovis AF2122/97
cgcccagcaggcc

SEQ ID NO: 1049139 - RNA, 13 nt, Mycobacterium bovis subsp bovis AF2122/97
cgcccagcagcac

SEQ ID NO: 1049140 - RNA, 14 nt, Mycobacterium bovis subsp bovis AF2122/97
cgcccagcccggcg

SEQ ID NO: 1049141 - RNA, 21 nt, Mycobacterium bovis subsp bovis AF2122/97
cgcccagcccggcguuguuga

SEQ ID NO: 1049142 - RNA, 14 nt, Mycobacterium bovis subsp bovis AF2122/97
cgcccagccgcagc

SEQ ID NO: 1049143 - RNA, 19 nt, Mycobacterium bovis subsp bovis AF2122/97
cgcccagccguucccggug

SEQ ID NO: 1049144 - RNA, 16 nt, Mycobacterium bovis subsp bovis AF2122/97
cgcccagcgacccggc

SEQ ID NO: 1049145 - RNA, 15 nt, Mycobacterium bovis subsp bovis AF2122/97
cgcccagcgagcgcc

SEQ ID NO: 1049146 - RNA, 17 nt, Mycobacterium bovis subsp bovis AF2122/97
cgcccagcgagcgccag

SEQ ID NO: 1049147 - RNA, 20 nt, Mycobacterium bovis subsp bovis AF2122/97
cgcccagcgagcgccagguc

SEQ ID NO: 1049148 - RNA, 21 nt, Mycobacterium bovis subsp bovis AF2122/97
cgcccagcgagcgccagguca

SEQ ID NO: 1049149 - RNA, 23 nt, Mycobacterium bovis subsp bovis AF2122/97
cgcccagccacugacggcuucca

SEQ ID NO: 1049150 - RNA, 16 nt, Mycobacterium bovis subsp bovis AF2122/97
cgcccagcgcuagccg

SEQ ID NO: 1049151 - RNA, 18 nt, Mycobacterium bovis subsp bovis AF2122/97
cgcccagcgcuagccggg

SEQ ID NO: 1049152 - RNA, 12 nt, Mycobacterium bovis subsp bovis AF2122/97
cgcccagcucga

SEQ ID NO: 1049153 - RNA, 16 nt, Mycobacterium bovis subsp bovis AF2122/97
cgcccaggaagccgag

SEQ ID NO: 1049154 - RNA, 20 nt, Mycobacterium bovis subsp bovis AF2122/97
cgcccagcguugucgggugg

SEQ ID NO: 1049155 - RNA, 17 nt, Mycobacterium bovis subsp bovis AF2122/97
cgcccaggccgaucagc

SEQ ID NO: 1049156 - RNA, 12 nt, Mycobacterium bovis subsp bovis AF2122/97
cgcccacccgcu

SEQ ID NO: 1049157 - RNA, 24 nt, Mycobacterium bovis subsp bovis AF2122/97
cgcccacccgcugcgagaucgcgg

SEQ ID NO: 1049158 - RNA, 16 nt, Mycobacterium bovis subsp bovis AF2122/97
cgcccaccccggccgc

SEQ ID NO: 1049159 - RNA, 13 nt, Mycobacterium bovis subsp bovis AF2122/97
cgcccaccccggc

SEQ ID NO: 1049160 - RNA, 14 nt, Mycobacterium bovis subsp bovis AF2122/97
cgcccaccgcaacg

SEQ ID NO: 1049161 - RNA, 20 nt, Mycobacterium bovis subsp bovis AF2122/97
cgcccacccggaaagaucuc

SEQ ID NO: 1049162 - RNA, 21 nt, Mycobacterium bovis subsp bovis AF2122/97
cgcccaccgaaaccggucagc

SEQ ID NO: 1049163 - RNA, 15 nt, Mycobacterium bovis subsp bovis AF2122/97
cgcccaccggucgcc

SEQ ID NO: 1049164 - RNA, 14 nt, Mycobacterium bovis subsp bovis AF2122/97
cgcccaccgggcgg

SEQ ID NO: 1049165 - RNA, 16 nt, Mycobacterium bovis subsp bovis AF2122/97
cgcccaccgggcggcg

SEQ ID NO: 1049166 - RNA, 19 nt, Mycobacterium bovis subsp bovis AF2122/97
cgcccaccgggcggcggcg

SEQ ID NO: 1049167 - RNA, 13 nt, Mycobacterium bovis subsp bovis AF2122/97
cgcccaccggucg

SEQ ID NO: 1049168 - RNA, 17 nt, Mycobacterium bovis subsp bovis AF2122/97
cgcccaccacacagccg

SEQ ID NO: 1049169 - RNA, 22 nt, Mycobacterium bovis subsp bovis AF2122/97
cgcccaccacgcgacgcggggc

SEQ ID NO: 1049170 - RNA, 22 nt, Mycobacterium bovis subsp bovis AF2122/97
cgcccaccaugaucacaccgag

SEQ ID NO: 1049171 - RNA, 16 nt, Mycobacterium bovis subsp bovis AF2122/97
cgcccacagcuugccc

SEQ ID NO: 1049172 - RNA, 20 nt, Mycobacterium bovis subsp bovis AF2122/97
cgcccacagcuugcccgagc

SEQ ID NO: 1049173 - RNA, 14 nt, Mycobacterium bovis subsp bovis AF2122/97
cgcccacagcccgg

SEQ ID NO: 1049174 - RNA, 18 nt, Mycobacterium bovis subsp bovis AF2122/97
cgcccacaugcgcucgcg

SEQ ID NO: 1049175 - RNA, 15 nt, Mycobacterium bovis subsp bovis AF2122/97
cgcccacaucgucgg

SEQ ID NO: 1049176 - RNA, 21 nt, Mycobacterium bovis subsp bovis AF2122/97
cgcccacaucgucggcgggcg

SEQ ID NO: 1049177 - RNA, 22 nt, Mycobacterium bovis subsp bovis AF2122/97
cgcccacaucgucggcgggcgg

SEQ ID NO: 1049178 - RNA, 13 nt, Mycobacterium bovis subsp bovis AF2122/97
cgcccacgcugcc

SEQ ID NO: 1049179 - RNA, 17 nt, Mycobacterium bovis subsp bovis AF2122/97
cgcccacuccagcagcu

SEQ ID NO: 1049180 - RNA, 16 nt, Mycobacterium bovis subsp bovis AF2122/97
cgcccaccucgaucgc

SEQ ID NO: 1049181 - RNA, 22 nt, Mycobacterium bovis subsp bovis AF2122/97
cgcccagauguuuagcguccga

SEQ ID NO: 1049182 - RNA, 15 nt, Mycobacterium bovis subsp bovis AF2122/97
cgcccagaccgccga

SEQ ID NO: 1049183 - RNA, 16 nt, Mycobacterium bovis subsp bovis AF2122/97
cgcccagaccgccgac

SEQ ID NO: 1049184 - RNA, 17 nt, Mycobacterium bovis subsp bovis AF2122/97
cgcccagaccgccgacg

SEQ ID NO: 1049185 - RNA, 14 nt, Mycobacterium bovis subsp bovis AF2122/97
cgcccagaucgccg

SEQ ID NO: 1049186 - RNA, 16 nt, Mycobacterium bovis subsp bovis AF2122/97
cgcccagagccgcugc

SEQ ID NO: 1049187 - RNA, 23 nt, Mycobacterium bovis subsp bovis AF2122/97
cgcccagagugaauccggcauac

SEQ ID NO: 1049188 - RNA, 14 nt, Mycobacterium bovis subsp bovis AF2122/97
cgggccggccgccg

SEQ ID NO: 1049189 - RNA, 15 nt, Mycobacterium bovis subsp bovis AF2122/97
cgggccggccgccgc

SEQ ID NO: 1049190 - RNA, 17 nt, Mycobacterium bovis subsp bovis AF2122/97
cgggccggccgccgcgg

SEQ ID NO: 1049191 - RNA, 17 nt, Mycobacterium bovis subsp bovis AF2122/97
cgggccggucggugagc

SEQ ID NO: 1049192 - RNA, 13 nt, Mycobacterium bovis subsp bovis AF2122/97
cgggccggucggu

SEQ ID NO: 1049193 - RNA, 19 nt, Mycobacterium bovis subsp bovis AF2122/97
cgggccggugcgcaccaga

SEQ ID NO: 1049194 - RNA, 16 nt, Mycobacterium bovis subsp bovis AF2122/97
cgggccguacggcgcg

SEQ ID NO: 1049195 - RNA, 17 nt, Mycobacterium bovis subsp bovis AF2122/97
cgggcgaaauuccgggc

SEQ ID NO: 1049196 - RNA, 20 nt, Mycobacterium bovis subsp bovis AF2122/97
cgggcgacccguucucggug

SEQ ID NO: 1049197 - RNA, 12 nt, Mycobacterium bovis subsp bovis AF2122/97
cgggcgacccgu

SEQ ID NO: 1049198 - RNA, 13 nt, Mycobacterium bovis subsp bovis AF2122/97
cgggcgacccguu

SEQ ID NO: 1049199 - RNA, 20 nt, Mycobacterium bovis subsp bovis AF2122/97
cgggcgaccaccaccgccgc

SEQ ID NO: 1049200 - RNA, 21 nt, Mycobacterium bovis subsp bovis AF2122/97
cgggcgaccaccaccgccgcc

SEQ ID NO: 1049201 - RNA, 22 nt, Mycobacterium bovis subsp bovis AF2122/97
cgggcgaccaccaccgccgccg

SEQ ID NO: 1049202 - RNA, 14 nt, Mycobacterium bovis subsp bovis AF2122/97
cgggcgaccaccgc

SEQ ID NO: 1049203 - RNA, 17 nt, Mycobacterium bovis subsp bovis AF2122/97
cgggcgaagcuagcgcc

SEQ ID NO: 1049204 - RNA, 16 nt, Mycobacterium bovis subsp bovis AF2122/97
cgggcgaccaccaccg

SEQ ID NO: 1049205 - RNA, 17 nt, Mycobacterium bovis subsp bovis AF2122/97
cgggcgaccaccaccgc

SEQ ID NO: 1049206 - RNA, 15 nt, Mycobacterium bovis subsp bovis AF2122/97
cgggcgagaacccac

SEQ ID NO: 1049207 - RNA, 21 nt, Mycobacterium bovis subsp bovis AF2122/97
cgggcgagaucuuuucaccac

SEQ ID NO: 1049208 - RNA, 14 nt, Mycobacterium bovis subsp bovis AF2122/97
cgggcgagcucguc

SEQ ID NO: 1049209 - RNA, 14 nt, Mycobacterium bovis subsp bovis AF2122/97
cgggcgagcgcggc

SEQ ID NO: 1049210 - RNA, 18 nt, Mycobacterium bovis subsp bovis AF2122/97
cgggccgaucucuccggc

SEQ ID NO: 1049211 - RNA, 13 nt, Mycobacterium bovis subsp bovis AF2122/97
cgggccgaucacc

SEQ ID NO: 1049212 - RNA, 17 nt, Mycobacterium bovis subsp bovis AF2122/97
cgggccgacgggcgcaa

SEQ ID NO: 1049213 - RNA, 23 nt, Mycobacterium bovis subsp bovis AF2122/97
cgggccgagaucacgccgggcga

SEQ ID NO: 1049214 - RNA, 21 nt, Mycobacterium bovis subsp bovis AF2122/97
cgggccgcgcgggccgccgca

SEQ ID NO: 1049215 - RNA, 13 nt, Mycobacterium bovis subsp bovis AF2122/97
cgggccgcggcgg

SEQ ID NO: 1049216 - RNA, 14 nt, Mycobacterium bovis subsp bovis AF2122/97
cgggccgcggcggc

SEQ ID NO: 1049217 - RNA, 18 nt, Mycobacterium bovis subsp bovis AF2122/97
cgggccgcggccacaucg

SEQ ID NO: 1049218 - RNA, 15 nt, Mycobacterium bovis subsp bovis AF2122/97
cgggccgcguccaga

SEQ ID NO: 1049219 - RNA, 19 nt, Mycobacterium bovis subsp bovis AF2122/97
cgggccgcgucgaacuggg

SEQ ID NO: 1049220 - RNA, 21 nt, Mycobacterium bovis subsp bovis AF2122/97
cgggccgcugugggucgaucc

SEQ ID NO: 1049221 - RNA, 17 nt, Mycobacterium bovis subsp bovis AF2122/97
cgggccggaccaucagc

SEQ ID NO: 1049222 - RNA, 24 nt, Mycobacterium bovis subsp bovis AF2122/97
cgggccggaccaucagcgucgacg

SEQ ID NO: 1049223 - RNA, 14 nt, Mycobacterium bovis subsp bovis AF2122/97
cgggccggagccgg

SEQ ID NO: 1049224 - RNA, 17 nt, Mycobacterium bovis subsp bovis AF2122/97
cgggccggagccggugc

SEQ ID NO: 1049225 - RNA, 17 nt, Mycobacterium bovis subsp bovis AF2122/97
cgggccggcaucgucgg

SEQ ID NO: 1049226 - RNA, 17 nt, Mycobacterium bovis subsp bovis AF2122/97
cgggcccgcaggucggc

SEQ ID NO: 1049227 - RNA, 18 nt, Mycobacterium bovis subsp bovis AF2122/97
cgggcccgaugucgucga

SEQ ID NO: 1049228 - RNA, 20 nt, Mycobacterium bovis subsp bovis AF2122/97
cgggcccgaugucgucgacg

SEQ ID NO: 1049229 - RNA, 15 nt, Mycobacterium bovis subsp bovis AF2122/97
cgggcccgacgacga

SEQ ID NO: 1049230 - RNA, 15 nt, Mycobacterium bovis subsp bovis AF2122/97
cgggcccgacgcgug

SEQ ID NO: 1049231 - RNA, 14 nt, Mycobacterium bovis subsp bovis AF2122/97
cgggcccgacguug

SEQ ID NO: 1049232 - RNA, 18 nt, Mycobacterium bovis subsp bovis AF2122/97
cgggccgaauaccacacc

SEQ ID NO: 1049233 - RNA, 23 nt, Mycobacterium bovis subsp bovis AF2122/97
cgggccgaccagagcuucgccgc

SEQ ID NO: 1049234 - RNA, 16 nt, Mycobacterium bovis subsp bovis AF2122/97
cgggccgacgcaggug

SEQ ID NO: 1049235 - RNA, 17 nt, Mycobacterium bovis subsp bovis AF2122/97
cgggccccacggcgggu

SEQ ID NO: 1049236 - RNA, 17 nt, Mycobacterium bovis subsp bovis AF2122/97
cgggcccccggcagcau

SEQ ID NO: 1049237 - RNA, 13 nt, Mycobacterium bovis subsp bovis AF2122/97
cgggcccaucgcc

SEQ ID NO: 1049238 - RNA, 17 nt, Mycobacterium bovis subsp bovis AF2122/97
cgggcccaucgcccggu

SEQ ID NO: 1049239 - RNA, 14 nt, Mycobacterium bovis subsp bovis AF2122/97
cgggccccacaucg

SEQ ID NO: 1049240 - RNA, 21 nt, Mycobacterium bovis subsp bovis AF2122/97
cgggcccaggacagcagccgc

SEQ ID NO: 1049241 - RNA, 20 nt, Mycobacterium bovis subsp bovis AF2122/97
cgggccaccacgcgccgcac

SEQ ID NO: 1049242 - RNA, 16 nt, Mycobacterium bovis subsp bovis AF2122/97
cgggccaccagcgucg

SEQ ID NO: 1049243 - RNA, 13 nt, Mycobacterium bovis subsp bovis AF2122/97
cgggcccagcagg

SEQ ID NO: 1049244 - RNA, 17 nt, Mycobacterium bovis subsp bovis AF2122/97
cgggcccagccggaccg

SEQ ID NO: 1049245 - RNA, 14 nt, Mycobacterium bovis subsp bovis AF2122/97
cgggcccagcagcg

SEQ ID NO: 1049246 - RNA, 16 nt, Mycobacterium bovis subsp bovis AF2122/97
cgggccaacucggcga

SEQ ID NO: 1049247 - RNA, 12 nt, Mycobacterium bovis subsp bovis AF2122/97
cgggcaccaccc

SEQ ID NO: 1049248 - RNA, 13 nt, Mycobacterium bovis subsp bovis AF2122/97
cgggcaccaaccu

SEQ ID NO: 1049249 - RNA, 12 nt, Mycobacterium bovis subsp bovis AF2122/97
cgggcaccacca

SEQ ID NO: 1049250 - RNA, 20 nt, Mycobacterium bovis subsp bovis AF2122/97
cgggcaccaccacaccggag

SEQ ID NO: 1049251 - RNA, 17 nt, Mycobacterium bovis subsp bovis AF2122/97
cgggcacgccgccgacg

SEQ ID NO: 1049252 - RNA, 23 nt, Mycobacterium bovis subsp bovis AF2122/97
cgggcacgcccucgucgaucgcc

SEQ ID NO: 1049253 - RNA, 17 nt, Mycobacterium bovis subsp bovis AF2122/97
cgggcacgcccucgucg

SEQ ID NO: 1049254 - RNA, 22 nt, Mycobacterium bovis subsp bovis AF2122/97
cgggcacgcccucgucgaucgc

SEQ ID NO: 1049255 - RNA, 15 nt, Mycobacterium bovis subsp bovis AF2122/97
cgggcacucagcagg

SEQ ID NO: 1049256 - RNA, 20 nt, Mycobacterium bovis subsp bovis AF2122/97
cgggcacucagcaggggauc

SEQ ID NO: 1049257 - RNA, 18 nt, Mycobacterium bovis subsp bovis AF2122/97
cgggcagcaaaaaccagc

SEQ ID NO: 1049258 - RNA, 19 nt, Mycobacterium bovis subsp bovis AF2122/97
cgggcagcaacaggcccac

SEQ ID NO: 1049259 - RNA, 22 nt, Mycobacterium bovis subsp bovis AF2122/97
cgggcagcaacaggcccacggc

SEQ ID NO: 1049260 - RNA, 22 nt, Mycobacterium bovis subsp bovis AF2122/97
cgggcacggugaugaggaucgc

SEQ ID NO: 1049261 - RNA, 23 nt, Mycobacterium bovis subsp bovis AF2122/97
cgggcacugugaggucauuggcg

SEQ ID NO: 1049262 - RNA, 13 nt, Mycobacterium bovis subsp bovis AF2122/97
cgggaagcgagca

SEQ ID NO: 1049263 - RNA, 18 nt, Mycobacterium bovis subsp bovis AF2122/97
cgggaaggcucaccacgg

SEQ ID NO: 1049264 - RNA, 16 nt, Mycobacterium bovis subsp bovis AF2122/97
cgggaagccgccgggc

SEQ ID NO: 1049265 - RNA, 20 nt, Mycobacterium bovis subsp bovis AF2122/97
cgggaagucgcugaagccgu

SEQ ID NO: 1049266 - RNA, 17 nt, Mycobacterium bovis subsp bovis AF2122/97
cgggaagucccgagugg

SEQ ID NO: 1049267 - RNA, 15 nt, Mycobacterium bovis subsp bovis AF2122/97
cgggaauccggugau

SEQ ID NO: 1049268 - RNA, 19 nt, Mycobacterium bovis subsp bovis AF2122/97
cgggaauccggugaugacc

SEQ ID NO: 1049269 - RNA, 14 nt, Mycobacterium bovis subsp bovis AF2122/97
cgggaagugcaccc

SEQ ID NO: 1049270 - RNA, 19 nt, Mycobacterium bovis subsp bovis AF2122/97
cgggaagucggggucgcgg

SEQ ID NO: 1049271 - RNA, 17 nt, Mycobacterium bovis subsp bovis AF2122/97
cgggaaguugcccaggu

SEQ ID NO: 1049272 - RNA, 20 nt, Mycobacterium bovis subsp bovis AF2122/97
cgggcacaccgacgccgcca

SEQ ID NO: 1049273 - RNA, 21 nt, Mycobacterium bovis subsp bovis AF2122/97
cgggcacaccgcaccugggcg

SEQ ID NO: 1049274 - RNA, 20 nt, Mycobacterium bovis subsp bovis AF2122/97
cgggcaaugucgacaccggc

SEQ ID NO: 1049275 - RNA, 14 nt, Mycobacterium bovis subsp bovis AF2122/97
cgggcagcaccagc

SEQ ID NO: 1049276 - RNA, 16 nt, Mycobacterium bovis subsp bovis AF2122/97
cgggcagcgcggccag

SEQ ID NO: 1049277 - RNA, 18 nt, Mycobacterium bovis subsp bovis AF2122/97
cgggcagcgcggccagug

SEQ ID NO: 1049278 - RNA, 16 nt, Mycobacterium bovis subsp bovis AF2122/97
cgggcagaggcuggcg

SEQ ID NO: 1049279 - RNA, 15 nt, Mycobacterium bovis subsp bovis AF2122/97
cgggcaggccccacu

SEQ ID NO: 1049280 - RNA, 20 nt, Mycobacterium bovis subsp bovis AF2122/97
cgggcagcuucaacaccggc

SEQ ID NO: 1049281 - RNA, 21 nt, Mycobacterium bovis subsp bovis AF2122/97
cgggcagcuucaaugucggug

SEQ ID NO: 1049282 - RNA, 21 nt, Mycobacterium bovis subsp bovis AF2122/97
cgggcaggagcagcacgucga

SEQ ID NO: 1049283 - RNA, 17 nt, Mycobacterium bovis subsp bovis AF2122/97
cgggcagcuggcgacgg

SEQ ID NO: 1049284 - RNA, 13 nt, Mycobacterium bovis subsp bovis AF2122/97
cgggcaucggcgg

SEQ ID NO: 1049285 - RNA, 16 nt, Mycobacterium bovis subsp bovis AF2122/97
cgggcaucggcgguuc

SEQ ID NO: 1049286 - RNA, 20 nt, Mycobacterium bovis subsp bovis AF2122/97
cgggcauccuucaccagcug

SEQ ID NO: 1049287 - RNA, 18 nt, Mycobacterium bovis subsp bovis AF2122/97
cgggcauccuucaccagc

SEQ ID NO: 1049288 - RNA, 14 nt, Mycobacterium bovis subsp bovis AF2122/97
cgggcaggccgucg

SEQ ID NO: 1049289 - RNA, 15 nt, Mycobacterium bovis subsp bovis AF2122/97
cgggcaggcggccag

SEQ ID NO: 1049290 - RNA, 12 nt, Mycobacterium bovis subsp bovis AF2122/97
cgggcaggccgu

SEQ ID NO: 1049291 - RNA, 13 nt, Mycobacterium bovis subsp bovis AF2122/97
cgggcaggccgcu

SEQ ID NO: 1049292 - RNA, 15 nt, Mycobacterium bovis subsp bovis AF2122/97
cgggcagggaccgca

SEQ ID NO: 1049293 - RNA, 14 nt, Mycobacterium bovis subsp bovis AF2122/97
cgggcaugccggcg

SEQ ID NO: 1049294 - RNA, 15 nt, Mycobacterium bovis subsp bovis AF2122/97
cgggcaugccggcga

SEQ ID NO: 1049295 - RNA, 17 nt, Mycobacterium bovis subsp bovis AF2122/97
cgggcaugcucuggcaa

SEQ ID NO: 1049296 - RNA, 16 nt, Mycobacterium bovis subsp bovis AF2122/97
cgggcaucgucgucgc

SEQ ID NO: 1049297 - RNA, 22 nt, Mycobacterium bovis subsp bovis AF2122/97
cgggcaucgucgucgcugccgc

SEQ ID NO: 1049298 - RNA, 19 nt, Mycobacterium bovis subsp bovis AF2122/97
cgggcaucggugccacggc

SEQ ID NO: 1049299 - RNA, 23 nt, Mycobacterium bovis subsp bovis AF2122/97
cgggcaugauguugaaacaccgc

SEQ ID NO: 1049300 - RNA, 16 nt, Mycobacterium bovis subsp bovis AF2122/97
cgggcauggucgccgg

SEQ ID NO: 1049301 - RNA, 14 nt, Mycobacterium bovis subsp bovis AF2122/97
cgggcauggcggcg

SEQ ID NO: 1049302 - RNA, 16 nt, Mycobacterium bovis subsp bovis AF2122/97
cgggcauggcggcgua

SEQ ID NO: 1049303 - RNA, 14 nt, Mycobacterium bovis subsp bovis AF2122/97
cgggccaaagccgu

SEQ ID NO: 1049304 - RNA, 23 nt, Mycobacterium bovis subsp bovis AF2122/97
cgggcauuucguggcacgggucg

SEQ ID NO: 1049305 - RNA, 22 nt, Mycobacterium bovis subsp bovis AF2122/97
cgggccaaagccgucagcucac

SEQ ID NO: 1049306 - RNA, 22 nt, Mycobacterium bovis subsp bovis AF2122/97
cgggcauuucguggcacggguc

SEQ ID NO: 1049307 - RNA, 15 nt, Mycobacterium bovis subsp bovis AF2122/97
cgggcggaucgccgg

SEQ ID NO: 1049308 - RNA, 22 nt, Mycobacterium bovis subsp bovis AF2122/97
cgggcggaucgccggggacgcc

SEQ ID NO: 1049309 - RNA, 14 nt, Mycobacterium bovis subsp bovis AF2122/97
cgggcggccaccgc

SEQ ID NO: 1049310 - RNA, 13 nt, Mycobacterium bovis subsp bovis AF2122/97
cgggcggccagcu

SEQ ID NO: 1049311 - RNA, 17 nt, Mycobacterium bovis subsp bovis AF2122/97
cgggcggccaggcgcga

SEQ ID NO: 1049312 - RNA, 22 nt, Mycobacterium bovis subsp bovis AF2122/97
cgggcggccucccgggccgccg

SEQ ID NO: 1049313 - RNA, 15 nt, Mycobacterium bovis subsp bovis AF2122/97
cgggcggcggccugg

SEQ ID NO: 1049314 - RNA, 14 nt, Mycobacterium bovis subsp bovis AF2122/97
cgggcggcgcuggc

SEQ ID NO: 1049315 - RNA, 11 nt, Mycobacterium bovis subsp bovis AF2122/97
cgggcggcguc

SEQ ID NO: 1049316 - RNA, 16 nt, Mycobacterium bovis subsp bovis AF2122/97
cgggcggcgucgguga

SEQ ID NO: 1049317 - RNA, 15 nt, Mycobacterium bovis subsp bovis AF2122/97
cgggcggcggcgacu

SEQ ID NO: 1049318 - RNA, 13 nt, Mycobacterium bovis subsp bovis AF2122/97
cgggcggcgucga

SEQ ID NO: 1049319 - RNA, 17 nt, Mycobacterium bovis subsp bovis AF2122/97
cgggcgggacucggcga

SEQ ID NO: 1049320 - RNA, 17 nt, Mycobacterium bovis subsp bovis AF2122/97
cgggcgggauccaccca

SEQ ID NO: 1049321 - RNA, 17 nt, Mycobacterium bovis subsp bovis AF2122/97
cgggcgguaaucgcgag

SEQ ID NO: 1049322 - RNA, 16 nt, Mycobacterium bovis subsp bovis AF2122/97
cgggcgggccugcgcg

SEQ ID NO: 1049323 - RNA, 16 nt, Mycobacterium bovis subsp bovis AF2122/97
cgggcggggacggcgg

SEQ ID NO: 1049324 - RNA, 16 nt, Mycobacterium bovis subsp bovis AF2122/97
cgggcggucgaagacc

SEQ ID NO: 1049325 - RNA, 21 nt, Mycobacterium bovis subsp bovis AF2122/97
cgggcgguaaucgcgagacca

SEQ ID NO: 1049326 - RNA, 22 nt, Mycobacterium bovis subsp bovis AF2122/97
cgggcgguccaaaacaccgcca

SEQ ID NO: 1049327 - RNA, 21 nt, Mycobacterium bovis subsp bovis AF2122/97
cgggcgucagcaguucggcga

SEQ ID NO: 1049328 - RNA, 13 nt, Mycobacterium bovis subsp bovis AF2122/97
cgggcguccacgc

SEQ ID NO: 1049329 - RNA, 14 nt, Mycobacterium bovis subsp bovis AF2122/97
cgggcgucccggcg

SEQ ID NO: 1049330 - RNA, 15 nt, Mycobacterium bovis subsp bovis AF2122/97
cgggcgucccggcgg

SEQ ID NO: 1049331 - RNA, 21 nt, Mycobacterium bovis subsp bovis AF2122/97
cgggcgucccggcggucagcg

SEQ ID NO: 1049332 - RNA, 23 nt, Mycobacterium bovis subsp bovis AF2122/97
cgggcgucacggugcguucgugc

SEQ ID NO: 1049333 - RNA, 13 nt, Mycobacterium bovis subsp bovis AF2122/97
cgggcggugcaca

SEQ ID NO: 1049334 - RNA, 21 nt, Mycobacterium bovis subsp bovis AF2122/97
cgggcguccacgcugaccaac

SEQ ID NO: 1049335 - RNA, 15 nt, Mycobacterium bovis subsp bovis AF2122/97
cgggcguccgccggc

SEQ ID NO: 1049336 - RNA, 17 nt, Mycobacterium bovis subsp bovis AF2122/97
cgggcguccgccggcga

SEQ ID NO: 1049337 - RNA, 13 nt, Mycobacterium bovis subsp bovis AF2122/97
cgggcgucgucgg

SEQ ID NO: 1049338 - RNA, 19 nt, Mycobacterium bovis subsp bovis AF2122/97
cgggcgugaguggcucgcu

SEQ ID NO: 1049339 - RNA, 19 nt, Mycobacterium bovis subsp bovis AF2122/97
cgggcgugaucccgcccaa

SEQ ID NO: 1049340 - RNA, 14 nt, Mycobacterium bovis subsp bovis AF2122/97
cgggcgugccgacc

SEQ ID NO: 1049341 - RNA, 15 nt, Mycobacterium bovis subsp bovis AF2122/97
cgggcgucgucggug

SEQ ID NO: 1049342 - RNA, 15 nt, Mycobacterium bovis subsp bovis AF2122/97
cgggcgugccgacca

SEQ ID NO: 1049343 - RNA, 18 nt, Mycobacterium bovis subsp bovis AF2122/97
cgggcgugccgaccagca

SEQ ID NO: 1049344 - RNA, 21 nt, Mycobacterium bovis subsp bovis AF2122/97
cgggcgugccgaccagcaucu

SEQ ID NO: 1049345 - RNA, 15 nt, Mycobacterium bovis subsp bovis AF2122/97
cgggcgugcggcggc

SEQ ID NO: 1049346 - RNA, 20 nt, Mycobacterium bovis subsp bovis AF2122/97
cgggcuaucgguucagcugc

SEQ ID NO: 1049347 - RNA, 22 nt, Mycobacterium bovis subsp bovis AF2122/97
cgggcucaaacggaauguagcc

SEQ ID NO: 1049348 - RNA, 14 nt, Mycobacterium bovis subsp bovis AF2122/97
cgggcucaacacca

SEQ ID NO: 1049349 - RNA, 19 nt, Mycobacterium bovis subsp bovis AF2122/97
cgggcucaacaccagccgg

SEQ ID NO: 1049350 - RNA, 22 nt, Mycobacterium bovis subsp bovis AF2122/97
cgggcucaacaccagccggucg

SEQ ID NO: 1049351 - RNA, 17 nt, Mycobacterium bovis subsp bovis AF2122/97
cgggcucacaugugcgc

SEQ ID NO: 1049352 - RNA, 16 nt, Mycobacterium bovis subsp bovis AF2122/97
cgggcuccccaagucg

SEQ ID NO: 1049353 - RNA, 17 nt, Mycobacterium bovis subsp bovis AF2122/97
cgggcuccccaagucga

SEQ ID NO: 1049354 - RNA, 19 nt, Mycobacterium bovis subsp bovis AF2122/97
cgggcucagcggcgaccgc

SEQ ID NO: 1049355 - RNA, 21 nt, Mycobacterium bovis subsp bovis AF2122/97
cgggcuccaauugcggccgcg

SEQ ID NO: 1049356 - RNA, 13 nt, Mycobacterium bovis subsp bovis AF2122/97
cgggcuccccggc

SEQ ID NO: 1049357 - RNA, 20 nt, Mycobacterium bovis subsp bovis AF2122/97
cgggcuccccggcaaccggg

SEQ ID NO: 1049358 - RNA, 21 nt, Mycobacterium bovis subsp bovis AF2122/97
cgggcuccccggcaaccggga

SEQ ID NO: 1049359 - RNA, 15 nt, Mycobacterium bovis subsp bovis AF2122/97
cgggcucagcggcga

SEQ ID NO: 1049360 - RNA, 14 nt, Mycobacterium bovis subsp bovis AF2122/97
cgggcucgcauucg

SEQ ID NO: 1049361 - RNA, 15 nt, Mycobacterium bovis subsp bovis AF2122/97
cgggcucgcccgcua

SEQ ID NO: 1049362 - RNA, 18 nt, Mycobacterium bovis subsp bovis AF2122/97
cgggcgccuuggucgccg

SEQ ID NO: 1049363 - RNA, 20 nt, Mycobacterium bovis subsp bovis AF2122/97
cgggcgccuuggucgccgcc

SEQ ID NO: 1049364 - RNA, 20 nt, Mycobacterium bovis subsp bovis AF2122/97
cgggcgccuuggucgccgcu

SEQ ID NO: 1049365 - RNA, 19 nt, Mycobacterium bovis subsp bovis AF2122/97
cgggcgccuuccaggcggg

SEQ ID NO: 1049366 - RNA, 22 nt, Mycobacterium bovis subsp bovis AF2122/97
cgggcgccuuccaggcgggcgg

SEQ ID NO: 1049367 - RNA, 23 nt, Mycobacterium bovis subsp bovis AF2122/97
cgggcgccuuccaggcgggcggc

SEQ ID NO: 1049368 - RNA, 13 nt, Mycobacterium bovis subsp bovis AF2122/97
cgggcgcgccggc

SEQ ID NO: 1049369 - RNA, 15 nt, Mycobacterium bovis subsp bovis AF2122/97
cgggcgcgcucgugg

SEQ ID NO: 1049370 - RNA, 12 nt, Mycobacterium bovis subsp bovis AF2122/97
cgggcgcgcugc

SEQ ID NO: 1049371 - RNA, 19 nt, Mycobacterium bovis subsp bovis AF2122/97
cgggcgcguccucgccgca

SEQ ID NO: 1049372 - RNA, 20 nt, Mycobacterium bovis subsp bovis AF2122/97
cgggcgcguccucgccgcac

SEQ ID NO: 1049373 - RNA, 14 nt, Mycobacterium bovis subsp bovis AF2122/97
cgggcgcggggcgg

SEQ ID NO: 1049374 - RNA, 19 nt, Mycobacterium bovis subsp bovis AF2122/97
cgggcgcgguaaccacgcg

SEQ ID NO: 1049375 - RNA, 20 nt, Mycobacterium bovis subsp bovis AF2122/97
cgggcgcgguaaccacgcgg

SEQ ID NO: 1049376 - RNA, 17 nt, Mycobacterium bovis subsp bovis AF2122/97
cgggcgcgucggcguug

SEQ ID NO: 1049377 - RNA, 14 nt, Mycobacterium bovis subsp bovis AF2122/97
cgggcgcuggacgg

SEQ ID NO: 1049378 - RNA, 18 nt, Mycobacterium bovis subsp bovis AF2122/97
cgggcgcuggacggcggg

SEQ ID NO: 1049379 - RNA, 19 nt, Mycobacterium bovis subsp bovis AF2122/97
cgggcgcuggacggcgggc

SEQ ID NO: 1049380 - RNA, 21 nt, Mycobacterium bovis subsp bovis AF2122/97
cgggcgcuggacggcgggccg

SEQ ID NO: 1049381 - RNA, 18 nt, Mycobacterium bovis subsp bovis AF2122/97
cgggcgcuugcaccaggg

SEQ ID NO: 1049382 - RNA, 20 nt, Mycobacterium bovis subsp bovis AF2122/97
cgggcgcuugcaccaggggc

SEQ ID NO: 1049383 - RNA, 19 nt, Mycobacterium bovis subsp bovis AF2122/97
cgggcgcuugccggggugu

SEQ ID NO: 1049384 - RNA, 18 nt, Mycobacterium bovis subsp bovis AF2122/97
cgggcggaaagcccgucg

SEQ ID NO: 1049385 - RNA, 15 nt, Mycobacterium bovis subsp bovis AF2122/97
cgggcggaacgccgg

SEQ ID NO: 1049386 - RNA, 15 nt, Mycobacterium bovis subsp bovis AF2122/97
cgggcggcagcggcu

SEQ ID NO: 1049387 - RNA, 20 nt, Mycobacterium bovis subsp bovis AF2122/97
cgggcgccaacgggcugccc

SEQ ID NO: 1049388 - RNA, 19 nt, Mycobacterium bovis subsp bovis AF2122/97
cgggcgcccaugcugacac

SEQ ID NO: 1049389 - RNA, 19 nt, Mycobacterium bovis subsp bovis AF2122/97
cgggcgccccaccggcccg

SEQ ID NO: 1049390 - RNA, 20 nt, Mycobacterium bovis subsp bovis AF2122/97
cgggcgcccuuaagccggcg

SEQ ID NO: 1049391 - RNA, 15 nt, Mycobacterium bovis subsp bovis AF2122/97
cgggcgccgaucacg

SEQ ID NO: 1049392 - RNA, 13 nt, Mycobacterium bovis subsp bovis AF2122/97
cgggcgccgcagc

SEQ ID NO: 1049393 - RNA, 16 nt, Mycobacterium bovis subsp bovis AF2122/97
cgggcgccgcagcgcu

SEQ ID NO: 1049394 - RNA, 23 nt, Mycobacterium bovis subsp bovis AF2122/97
cgggcgccgugccccgggcccag

SEQ ID NO: 1049395 - RNA, 13 nt, Mycobacterium bovis subsp bovis AF2122/97
cgggcgaucucga

SEQ ID NO: 1049396 - RNA, 15 nt, Mycobacterium bovis subsp bovis AF2122/97
cgggcgaugacccgg

SEQ ID NO: 1049397 - RNA, 17 nt, Mycobacterium bovis subsp bovis AF2122/97
cgggcgaugacccggaa

SEQ ID NO: 1049398 - RNA, 21 nt, Mycobacterium bovis subsp bovis AF2122/97
cgggcgaucaacccuagggcg

SEQ ID NO: 1049399 - RNA, 23 nt, Mycobacterium bovis subsp bovis AF2122/97
cgggcgaucaacccuagggcggu

SEQ ID NO: 1049400 - RNA, 21 nt, Mycobacterium bovis subsp bovis AF2122/97
cgggcgaguacaggcgcagcg

SEQ ID NO: 1049401 - RNA, 22 nt, Mycobacterium bovis subsp bovis AF2122/97
cgggcgaguacaggcgcagcgu

SEQ ID NO: 1049402 - RNA, 21 nt, Mycobacterium bovis subsp bovis AF2122/97
cgggcgaguagucgacgucga

SEQ ID NO: 1049403 - RNA, 19 nt, Mycobacterium bovis subsp bovis AF2122/97
cgggcgaguacaggcgcag

SEQ ID NO: 1049404 - RNA, 16 nt, Mycobacterium bovis subsp bovis AF2122/97
cgggcgaugcgggccg

SEQ ID NO: 1049405 - RNA, 17 nt, Mycobacterium bovis subsp bovis AF2122/97
cgggcgaugcgggccgc

SEQ ID NO: 1049406 - RNA, 20 nt, Mycobacterium bovis subsp bovis AF2122/97
cgggcgaugcgggccgccag

SEQ ID NO: 1049407 - RNA, 22 nt, Mycobacterium bovis subsp bovis AF2122/97
cgggcgauucgcaaucagcugg

SEQ ID NO: 1049408 - RNA, 17 nt, Mycobacterium bovis subsp bovis AF2122/97
cgggcgauuucggcgcc

SEQ ID NO: 1049409 - RNA, 21 nt, Mycobacterium bovis subsp bovis AF2122/97
cgggcgauuucggcgccggcg

SEQ ID NO: 1049410 - RNA, 15 nt, Mycobacterium bovis subsp bovis AF2122/97
cgggcgcacgcccgc

SEQ ID NO: 1049411 - RNA, 16 nt, Mycobacterium bovis subsp bovis AF2122/97
cgggcgcacgcccgca

SEQ ID NO: 1049412 - RNA, 14 nt, Mycobacterium bovis subsp bovis AF2122/97
cgggcgcaccaggg

SEQ ID NO: 1049413 - RNA, 22 nt, Mycobacterium bovis subsp bovis AF2122/97
cgggcgcacgguccacgguggc

SEQ ID NO: 1049414 - RNA, 13 nt, Mycobacterium bovis subsp bovis AF2122/97
cgggcgcaccagg

SEQ ID NO: 1049415 - RNA, 19 nt, Mycobacterium bovis subsp bovis AF2122/97
cgggucgugccccggcgcg

SEQ ID NO: 1049416 - RNA, 15 nt, Mycobacterium bovis subsp bovis AF2122/97
cgggucgugcgacaa

SEQ ID NO: 1049417 - RNA, 13 nt, Mycobacterium bovis subsp bovis AF2122/97
cgggucggccggg

SEQ ID NO: 1049418 - RNA, 12 nt, Mycobacterium bovis subsp bovis AF2122/97
cgggucggccgc

SEQ ID NO: 1049419 - RNA, 16 nt, Mycobacterium bovis subsp bovis AF2122/97
cgggucggccgcugga

SEQ ID NO: 1049420 - RNA, 18 nt, Mycobacterium bovis subsp bovis AF2122/97
cgggucguuggcggcggu

SEQ ID NO: 1049421 - RNA, 22 nt, Mycobacterium bovis subsp bovis AF2122/97
cgggucguuggcggcggucggc

SEQ ID NO: 1049422 - RNA, 14 nt, Mycobacterium bovis subsp bovis AF2122/97
cgggucgugcgugc

SEQ ID NO: 1049423 - RNA, 17 nt, Mycobacterium bovis subsp bovis AF2122/97
cgggucuacagcguugc

SEQ ID NO: 1049424 - RNA, 14 nt, Mycobacterium bovis subsp bovis AF2122/97
cgggucgcugccgg

SEQ ID NO: 1049425 - RNA, 17 nt, Mycobacterium bovis subsp bovis AF2122/97
cgggucgcugccggcug

SEQ ID NO: 1049426 - RNA, 23 nt, Mycobacterium bovis subsp bovis AF2122/97
cgggucgcgggguaggcccagca

SEQ ID NO: 1049427 - RNA, 16 nt, Mycobacterium bovis subsp bovis AF2122/97
cgggucgcgcuggcgc

SEQ ID NO: 1049428 - RNA, 12 nt, Mycobacterium bovis subsp bovis AF2122/97
cgggucggcacg

SEQ ID NO: 1049429 - RNA, 16 nt, Mycobacterium bovis subsp bovis AF2122/97
cgggucggcacgaccc

SEQ ID NO: 1049430 - RNA, 18 nt, Mycobacterium bovis subsp bovis AF2122/97
cgggucggcacgacccgg

SEQ ID NO: 1049431 - RNA, 20 nt, Mycobacterium bovis subsp bovis AF2122/97
cgggucggcacgacccggga

SEQ ID NO: 1049432 - RNA, 16 nt, Mycobacterium bovis subsp bovis AF2122/97
cggguccaggaacggc

SEQ ID NO: 1049433 - RNA, 15 nt, Mycobacterium bovis subsp bovis AF2122/97
cggguccaggcguug

SEQ ID NO: 1049434 - RNA, 15 nt, Mycobacterium bovis subsp bovis AF2122/97
cggguccagccaccg

SEQ ID NO: 1049435 - RNA, 21 nt, Mycobacterium bovis subsp bovis AF2122/97
cggguccagccaccgaccccg

SEQ ID NO: 1049436 - RNA, 22 nt, Mycobacterium bovis subsp bovis AF2122/97
cggguccagccaccgaccccgg

SEQ ID NO: 1049437 - RNA, 12 nt, Mycobacterium bovis subsp bovis AF2122/97
cggguccaccgc

SEQ ID NO: 1049438 - RNA, 22 nt, Mycobacterium bovis subsp bovis AF2122/97
cgggucccaaucgucggccagc

SEQ ID NO: 1049439 - RNA, 23 nt, Mycobacterium bovis subsp bovis AF2122/97
cgggucccaaucgucggccagca

SEQ ID NO: 1049440 - RNA, 17 nt, Mycobacterium bovis subsp bovis AF2122/97
cgggucccaaucgucgg

SEQ ID NO: 1049441 - RNA, 15 nt, Mycobacterium bovis subsp bovis AF2122/97
cgggucccgccacca

SEQ ID NO: 1049442 - RNA, 21 nt, Mycobacterium bovis subsp bovis AF2122/97
cgggucaaugcuggcagcggc

SEQ ID NO: 1049443 - RNA, 23 nt, Mycobacterium bovis subsp bovis AF2122/97
cggguccaagaaccacgacguug

SEQ ID NO: 1049444 - RNA, 19 nt, Mycobacterium bovis subsp bovis AF2122/97
cgggucaucuugccaccgc

SEQ ID NO: 1049445 - RNA, 14 nt, Mycobacterium bovis subsp bovis AF2122/97
cgggucacacuccc

SEQ ID NO: 1049446 - RNA, 13 nt, Mycobacterium bovis subsp bovis AF2122/97
cgggucaccagcg

SEQ ID NO: 1049447 - RNA, 17 nt, Mycobacterium bovis subsp bovis AF2122/97
cgggucaacgccaucac

SEQ ID NO: 1049448 - RNA, 21 nt, Mycobacterium bovis subsp bovis AF2122/97
cgggucaacgccaucaccccg

SEQ ID NO: 1049449 - RNA, 22 nt, Mycobacterium bovis subsp bovis AF2122/97
cgggucaacgccaucaccccgg

SEQ ID NO: 1049450 - RNA, 19 nt, Mycobacterium bovis subsp bovis AF2122/97
cggguauugaaguucgggc

SEQ ID NO: 1049451 - RNA, 19 nt, Mycobacterium bovis subsp bovis AF2122/97
cggguagaaccagcccggc

SEQ ID NO: 1049452 - RNA, 15 nt, Mycobacterium bovis subsp bovis AF2122/97
cggguagacaccgcg

SEQ ID NO: 1049453 - RNA, 18 nt, Mycobacterium bovis subsp bovis AF2122/97
cggguagacaugggugaa

SEQ ID NO: 1049454 - RNA, 22 nt, Mycobacterium bovis subsp bovis AF2122/97
cggguagacaugggugaaucga

SEQ ID NO: 1049455 - RNA, 17 nt, Mycobacterium bovis subsp bovis AF2122/97
cggguacccaucugcuc

SEQ ID NO: 1049456 - RNA, 18 nt, Mycobacterium bovis subsp bovis AF2122/97
cggguaccacgcuggcgc

SEQ ID NO: 1049457 - RNA, 21 nt, Mycobacterium bovis subsp bovis AF2122/97
cggguacggucucacggcgcg

SEQ ID NO: 1049458 - RNA, 20 nt, Mycobacterium bovis subsp bovis AF2122/97
cggguacuuacgggucgcgg

SEQ ID NO: 1049459 - RNA, 17 nt, Mycobacterium bovis subsp bovis AF2122/97
cggguaggugacgacgu

SEQ ID NO: 1049460 - RNA, 13 nt, Mycobacterium bovis subsp bovis AF2122/97
cggguacccggga

SEQ ID NO: 1049461 - RNA, 22 nt, Mycobacterium bovis subsp bovis AF2122/97
cggguagauguucacgccgccg

SEQ ID NO: 1049462 - RNA, 17 nt, Mycobacterium bovis subsp bovis AF2122/97
cggguagcggcgccgcc

SEQ ID NO: 1049463 - RNA, 19 nt, Mycobacterium bovis subsp bovis AF2122/97
cggguagcgguucaucacc

SEQ ID NO: 1049464 - RNA, 14 nt, Mycobacterium bovis subsp bovis AF2122/97
cggguagcugccgc

SEQ ID NO: 1049465 - RNA, 19 nt, Mycobacterium bovis subsp bovis AF2122/97
cggguagcugccgcggccg

SEQ ID NO: 1049466 - RNA, 21 nt, Mycobacterium bovis subsp bovis AF2122/97
cggguagcugccgcggccggc

SEQ ID NO: 1049467 - RNA, 15 nt, Mycobacterium bovis subsp bovis AF2122/97
cggguauggcggcga

SEQ ID NO: 1049468 - RNA, 21 nt, Mycobacterium bovis subsp bovis AF2122/97
cggguauggcggcgacggccg

SEQ ID NO: 1049469 - RNA, 23 nt, Mycobacterium bovis subsp bovis AF2122/97
cggguaugggagucccaccaucg

SEQ ID NO: 1049470 - RNA, 15 nt, Mycobacterium bovis subsp bovis AF2122/97
cggguaggccgccgu

SEQ ID NO: 1049471 - RNA, 17 nt, Mycobacterium bovis subsp bovis AF2122/97
cgggguuguccucggcg

SEQ ID NO: 1049472 - RNA, 21 nt, Mycobacterium bovis subsp bovis AF2122/97
cgggguuguccucggcgauca

SEQ ID NO: 1049473 - RNA, 16 nt, Mycobacterium bovis subsp bovis AF2122/97
cgggguuggccguggu

SEQ ID NO: 1049474 - RNA, 24 nt, Mycobacterium bovis subsp bovis AF2122/97
cggguaaaccagguggccaggccg

SEQ ID NO: 1049475 - RNA, 14 nt, Mycobacterium bovis subsp bovis AF2122/97
cgggguugaccgcc

SEQ ID NO: 1049476 - RNA, 16 nt, Mycobacterium bovis subsp bovis AF2122/97
cgggguugaccgccac

SEQ ID NO: 1049477 - RNA, 20 nt, Mycobacterium bovis subsp bovis AF2122/97
cgggguugaccgccaccccg

SEQ ID NO: 1049478 - RNA, 23 nt, Mycobacterium bovis subsp bovis AF2122/97
cgggguugaccguggucggaggu

SEQ ID NO: 1049479 - RNA, 14 nt, Mycobacterium bovis subsp bovis AF2122/97
cgggguugaucacc

SEQ ID NO: 1049480 - RNA, 16 nt, Mycobacterium bovis subsp bovis AF2122/97
cgggguugaucaccga

SEQ ID NO: 1049481 - RNA, 17 nt, Mycobacterium bovis subsp bovis AF2122/97
cgggguugaucaccgac

SEQ ID NO: 1049482 - RNA, 18 nt, Mycobacterium bovis subsp bovis AF2122/97
cgggguugaucaccgaca

SEQ ID NO: 1049483 - RNA, 21 nt, Mycobacterium bovis subsp bovis AF2122/97
cgggguugaucaccgacaccg

SEQ ID NO: 1049484 - RNA, 23 nt, Mycobacterium bovis subsp bovis AF2122/97
cgggguugaucaccgacaccgug

SEQ ID NO: 1049485 - RNA, 21 nt, Mycobacterium bovis subsp bovis AF2122/97
cggguaaauauugcgcccggc

SEQ ID NO: 1049486 - RNA, 19 nt, Mycobacterium bovis subsp bovis AF2122/97
cggguaacgauugucgaug

SEQ ID NO: 1049487 - RNA, 15 nt, Mycobacterium bovis subsp bovis AF2122/97
cggguaagacgucgg

SEQ ID NO: 1049488 - RNA, 20 nt, Mycobacterium bovis subsp bovis AF2122/97
cggguaagcgaccgacgcca

SEQ ID NO: 1049489 - RNA, 20 nt, Mycobacterium bovis subsp bovis AF2122/97
cggguaauucuugacgccga

SEQ ID NO: 1049490 - RNA, 16 nt, Mycobacterium bovis subsp bovis AF2122/97
cggguacaccacgguu

SEQ ID NO: 1049491 - RNA, 18 nt, Mycobacterium bovis subsp bovis AF2122/97
cggguacacccgcucgcc

SEQ ID NO: 1049492 - RNA, 23 nt, Mycobacterium bovis subsp bovis AF2122/97
cggggggauccagcaggccggga

SEQ ID NO: 1049493 - RNA, 20 nt, Mycobacterium bovis subsp bovis AF2122/97
cggggggcaggucgagcgcc

SEQ ID NO: 1049494 - RNA, 20 nt, Mycobacterium bovis subsp bovis AF2122/97
cgggggcuuuugcgucugcu

SEQ ID NO: 1049495 - RNA, 19 nt, Mycobacterium bovis subsp bovis AF2122/97
cggggguaauugccagccu

SEQ ID NO: 1049496 - RNA, 16 nt, Mycobacterium bovis subsp bovis AF2122/97
cggggguacgucaccg

SEQ ID NO: 1049497 - RNA, 19 nt, Mycobacterium bovis subsp bovis AF2122/97
cggggguacgucaccgggu

SEQ ID NO: 1049498 - RNA, 16 nt, Mycobacterium bovis subsp bovis AF2122/97
cggggcugaccgccac

SEQ ID NO: 1049499 - RNA, 14 nt, Mycobacterium bovis subsp bovis AF2122/97
cgggggcugcacgc

SEQ ID NO: 1049500 - RNA, 17 nt, Mycobacterium bovis subsp bovis AF2122/97
cgggggcgucgccgccg

SEQ ID NO: 1049501 - RNA, 18 nt, Mycobacterium bovis subsp bovis AF2122/97
cgggggcgucgccgccgg

SEQ ID NO: 1049502 - RNA, 20 nt, Mycobacterium bovis subsp bovis AF2122/97
cgggggcgucgccgccgggc

SEQ ID NO: 1049503 - RNA, 13 nt, Mycobacterium bovis subsp bovis AF2122/97
cggggucggccug

SEQ ID NO: 1049504 - RNA, 16 nt, Mycobacterium bovis subsp bovis AF2122/97
cggggucggcccgcca

SEQ ID NO: 1049505 - RNA, 22 nt, Mycobacterium bovis subsp bovis AF2122/97
cgggguacaggcugcugcgcga

SEQ ID NO: 1049506 - RNA, 21 nt, Mycobacterium bovis subsp bovis AF2122/97
cgggguagaccuucucgccgc

SEQ ID NO: 1049507 - RNA, 21 nt, Mycobacterium bovis subsp bovis AF2122/97
cgggggugcucggucgaugcu

SEQ ID NO: 1049508 - RNA, 18 nt, Mycobacterium bovis subsp bovis AF2122/97
cgggggucgggcgugucg

SEQ ID NO: 1049509 - RNA, 22 nt, Mycobacterium bovis subsp bovis AF2122/97
cggggcucaagucucccggccg

SEQ ID NO: 1049510 - RNA, 21 nt, Mycobacterium bovis subsp bovis AF2122/97
cggggucggccugcggcaccg

SEQ ID NO: 1049511 - RNA, 22 nt, Mycobacterium bovis subsp bovis AF2122/97
cggggucuugacggcgccaggc

SEQ ID NO: 1049512 - RNA, 19 nt, Mycobacterium bovis subsp bovis AF2122/97
cggggugaaaaucgccauc

SEQ ID NO: 1049513 - RNA, 23 nt, Mycobacterium bovis subsp bovis AF2122/97
cggggugaacgcggacaccgcgg

SEQ ID NO: 1049514 - RNA, 22 nt, Mycobacterium bovis subsp bovis AF2122/97
cggggucggggaagacgaccgu

SEQ ID NO: 1049515 - RNA, 18 nt, Mycobacterium bovis subsp bovis AF2122/97
cggggucguugaggccgg

SEQ ID NO: 1049516 - RNA, 19 nt, Mycobacterium bovis subsp bovis AF2122/97
cggggucguugaggccggu

SEQ ID NO: 1049517 - RNA, 21 nt, Mycobacterium bovis subsp bovis AF2122/97
cggggucguugaggccgguga

SEQ ID NO: 1049518 - RNA, 22 nt, Mycobacterium bovis subsp bovis AF2122/97
cggggucguugaggccggugaa

SEQ ID NO: 1049519 - RNA, 17 nt, Mycobacterium bovis subsp bovis AF2122/97
cggggugugcgggcggu

SEQ ID NO: 1049520 - RNA, 14 nt, Mycobacterium bovis subsp bovis AF2122/97
cggggugugcgggg

SEQ ID NO: 1049521 - RNA, 18 nt, Mycobacterium bovis subsp bovis AF2122/97
cgggguggucgcaccgcc

SEQ ID NO: 1049522 - RNA, 20 nt, Mycobacterium bovis subsp bovis AF2122/97
cgggguggucgcaccgccgg

SEQ ID NO: 1049523 - RNA, 14 nt, Mycobacterium bovis subsp bovis AF2122/97
cggggugcacaccg

SEQ ID NO: 1049524 - RNA, 18 nt, Mycobacterium bovis subsp bovis AF2122/97
cggggugcacaccgucgc

SEQ ID NO: 1049525 - RNA, 22 nt, Mycobacterium bovis subsp bovis AF2122/97
cgggguuacucgcagcgccguc

SEQ ID NO: 1049526 - RNA, 23 nt, Mycobacterium bovis subsp bovis AF2122/97
cggggugguggaagguguuggug

SEQ ID NO: 1049527 - RNA, 24 nt, Mycobacterium bovis subsp bovis AF2122/97
cggggugcacaccgucgcgcucgc

SEQ ID NO: 1049528 - RNA, 16 nt, Mycobacterium bovis subsp bovis AF2122/97
cggggcucucgagucc

SEQ ID NO: 1049529 - RNA, 14 nt, Mycobacterium bovis subsp bovis AF2122/97
cggggcugcccgcg

SEQ ID NO: 1049530 - RNA, 14 nt, Mycobacterium bovis subsp bovis AF2122/97
cggggcugccgccg

SEQ ID NO: 1049531 - RNA, 15 nt, Mycobacterium bovis subsp bovis AF2122/97
cggggcugccgccgu

SEQ ID NO: 1049532 - RNA, 13 nt, Mycobacterium bovis subsp bovis AF2122/97
cggggcuagucgg

SEQ ID NO: 1049533 - RNA, 20 nt, Mycobacterium bovis subsp bovis AF2122/97
cggggcgucguaaacgucgg

SEQ ID NO: 1049534 - RNA, 19 nt, Mycobacterium bovis subsp bovis AF2122/97
cggggcgucgcaacccggc

SEQ ID NO: 1049535 - RNA, 19 nt, Mycobacterium bovis subsp bovis AF2122/97
cggggcgaacggcaccgcg

SEQ ID NO: 1049536 - RNA, 21 nt, Mycobacterium bovis subsp bovis AF2122/97
cggggcgaagcuugacguugc

SEQ ID NO: 1049537 - RNA, 13 nt, Mycobacterium bovis subsp bovis AF2122/97
cggggcggucggc

SEQ ID NO: 1049538 - RNA, 16 nt, Mycobacterium bovis subsp bovis AF2122/97
cggggcggucggccgg

SEQ ID NO: 1049539 - RNA, 13 nt, Mycobacterium bovis subsp bovis AF2122/97
cggggcggugggc

SEQ ID NO: 1049540 - RNA, 20 nt, Mycobacterium bovis subsp bovis AF2122/97
cggggccuucggcccggugg

SEQ ID NO: 1049541 - RNA, 15 nt, Mycobacterium bovis subsp bovis AF2122/97
cggggcgauccccag

SEQ ID NO: 1049542 - RNA, 23 nt, Mycobacterium bovis subsp bovis AF2122/97
cggggcgaugagccugcaggccg

SEQ ID NO: 1049543 - RNA, 18 nt, Mycobacterium bovis subsp bovis AF2122/97
cgggcugcuugcgcccgg

SEQ ID NO: 1049544 - RNA, 15 nt, Mycobacterium bovis subsp bovis AF2122/97
cggggccggcggcuc

SEQ ID NO: 1049545 - RNA, 19 nt, Mycobacterium bovis subsp bovis AF2122/97
cggggccggcggcucgggu

SEQ ID NO: 1049546 - RNA, 16 nt, Mycobacterium bovis subsp bovis AF2122/97
cgggcuggccagcgcg

SEQ ID NO: 1049547 - RNA, 13 nt, Mycobacterium bovis subsp bovis AF2122/97
cggggccggcggc

SEQ ID NO: 1049548 - RNA, 20 nt, Mycobacterium bovis subsp bovis AF2122/97
cggggccgucucgccgugga

SEQ ID NO: 1049549 - RNA, 18 nt, Mycobacterium bovis subsp bovis AF2122/97
cgggcugcagugacucga

SEQ ID NO: 1049550 - RNA, 16 nt, Mycobacterium bovis subsp bovis AF2122/97
cgggcugcagccgaca

SEQ ID NO: 1049551 - RNA, 17 nt, Mycobacterium bovis subsp bovis AF2122/97
cgggcucgcccgcuacg

SEQ ID NO: 1049552 - RNA, 21 nt, Mycobacterium bovis subsp bovis AF2122/97
cgggcugaggcggcgacgacc

SEQ ID NO: 1049553 - RNA, 16 nt, Mycobacterium bovis subsp bovis AF2122/97
cgggcugccgcaugcg

SEQ ID NO: 1049554 - RNA, 16 nt, Mycobacterium bovis subsp bovis AF2122/97
cgggcugccgcccaug

SEQ ID NO: 1049555 - RNA, 19 nt, Mycobacterium bovis subsp bovis AF2122/97
cgggugaaucgacaccgcc

SEQ ID NO: 1049556 - RNA, 17 nt, Mycobacterium bovis subsp bovis AF2122/97
cggguggcuuccggggu

SEQ ID NO: 1049557 - RNA, 19 nt, Mycobacterium bovis subsp bovis AF2122/97
cgggugggacaccaucucc

SEQ ID NO: 1049558 - RNA, 21 nt, Mycobacterium bovis subsp bovis AF2122/97
cgggugggagcagccgaaccg

SEQ ID NO: 1049559 - RNA, 15 nt, Mycobacterium bovis subsp bovis AF2122/97
cgggugagauccgau

SEQ ID NO: 1049560 - RNA, 18 nt, Mycobacterium bovis subsp bovis AF2122/97
cgggugaaucgacaccgc

SEQ ID NO: 1049561 - RNA, 21 nt, Mycobacterium bovis subsp bovis AF2122/97
cgggucuggccaacgccgggu

SEQ ID NO: 1049562 - RNA, 17 nt, Mycobacterium bovis subsp bovis AF2122/97
cgggugaaguuggcgug

SEQ ID NO: 1049563 - RNA, 18 nt, Mycobacterium bovis subsp bovis AF2122/97
cgggugaaggaugcggcc

SEQ ID NO: 1049564 - RNA, 18 nt, Mycobacterium bovis subsp bovis AF2122/97
cgggucuuggcacacagg

SEQ ID NO: 1049565 - RNA, 18 nt, Mycobacterium bovis subsp bovis AF2122/97
cgggugaaacgauggcga

SEQ ID NO: 1049566 - RNA, 21 nt, Mycobacterium bovis subsp bovis AF2122/97
cgggugaaacgauggcgauga

SEQ ID NO: 1049567 - RNA, 20 nt, Mycobacterium bovis subsp bovis AF2122/97
cgggucuuccggugcgccga

SEQ ID NO: 1049568 - RNA, 16 nt, Mycobacterium bovis subsp bovis AF2122/97
cgggucugggugguga

SEQ ID NO: 1049569 - RNA, 15 nt, Mycobacterium bovis subsp bovis AF2122/97
cgggucucgccgacc

SEQ ID NO: 1049570 - RNA, 17 nt, Mycobacterium bovis subsp bovis AF2122/97
cgggucucgccgaccuu

SEQ ID NO: 1049571 - RNA, 16 nt, Mycobacterium bovis subsp bovis AF2122/97
cgggucucggugcggc

SEQ ID NO: 1049572 - RNA, 14 nt, Mycobacterium bovis subsp bovis AF2122/97
cggguuccagcggc

SEQ ID NO: 1049573 - RNA, 18 nt, Mycobacterium bovis subsp bovis AF2122/97
cggguuccagcggcaccg

SEQ ID NO: 1049574 - RNA, 15 nt, Mycobacterium bovis subsp bovis AF2122/97
cggguucgcgucuga

SEQ ID NO: 1049575 - RNA, 15 nt, Mycobacterium bovis subsp bovis AF2122/97
cggguggugcggccg

SEQ ID NO: 1049576 - RNA, 19 nt, Mycobacterium bovis subsp bovis AF2122/97
cggguucgccggauccgau

SEQ ID NO: 1049577 - RNA, 20 nt, Mycobacterium bovis subsp bovis AF2122/97
cgggugagacaaaggugccg

SEQ ID NO: 1049578 - RNA, 23 nt, Mycobacterium bovis subsp bovis AF2122/97
cgggugggcaagcugaccgccag

SEQ ID NO: 1049579 - RNA, 17 nt, Mycobacterium bovis subsp bovis AF2122/97
cgggugggcacaccggu

SEQ ID NO: 1049580 - RNA, 13 nt, Mycobacterium bovis subsp bovis AF2122/97
cgggugguccagc

SEQ ID NO: 1049581 - RNA, 23 nt, Mycobacterium bovis subsp bovis AF2122/97
cgggugguucaccucggcgacga

SEQ ID NO: 1049582 - RNA, 16 nt, Mycobacterium bovis subsp bovis AF2122/97
cgggugucgggcagca

SEQ ID NO: 1049583 - RNA, 19 nt, Mycobacterium bovis subsp bovis AF2122/97
cgggugucgggcgcgcugc

SEQ ID NO: 1049584 - RNA, 12 nt, Mycobacterium bovis subsp bovis AF2122/97
cggguugcgcgg

SEQ ID NO: 1049585 - RNA, 17 nt, Mycobacterium bovis subsp bovis AF2122/97
cggguugagccgccgcg

SEQ ID NO: 1049586 - RNA, 20 nt, Mycobacterium bovis subsp bovis AF2122/97
cggguucuucaacuccggga

SEQ ID NO: 1049587 - RNA, 17 nt, Mycobacterium bovis subsp bovis AF2122/97
cgguacccgcacccguu

SEQ ID NO: 1049588 - RNA, 22 nt, Mycobacterium bovis subsp bovis AF2122/97
cggguuggccggguuggccggc

SEQ ID NO: 1049589 - RNA, 13 nt, Mycobacterium bovis subsp bovis AF2122/97
cggguugggaccg

SEQ ID NO: 1049590 - RNA, 14 nt, Mycobacterium bovis subsp bovis AF2122/97
cggguuggcgucgc

SEQ ID NO: 1049591 - RNA, 14 nt, Mycobacterium bovis subsp bovis AF2122/97
cggguuggcgacga

SEQ ID NO: 1049592 - RNA, 17 nt, Mycobacterium bovis subsp bovis AF2122/97
cggguugcggucaccgg

SEQ ID NO: 1049593 - RNA, 14 nt, Mycobacterium bovis subsp bovis AF2122/97
cggguuggcgccgg

SEQ ID NO: 1049594 - RNA, 17 nt, Mycobacterium bovis subsp bovis AF2122/97
cggguuggcgccggcca

SEQ ID NO: 1049595 - RNA, 19 nt, Mycobacterium bovis subsp bovis AF2122/97
cggguuggcgccggccagu

SEQ ID NO: 1049596 - RNA, 14 nt, Mycobacterium bovis subsp bovis AF2122/97
cggguuggccggcg

SEQ ID NO: 1049597 - RNA, 15 nt, Mycobacterium bovis subsp bovis AF2122/97
cggguuggccggcgc

SEQ ID NO: 1049598 - RNA, 19 nt, Mycobacterium bovis subsp bovis AF2122/97
cggguuggccggcgcugcc

SEQ ID NO: 1049599 - RNA, 12 nt, Mycobacterium bovis subsp bovis AF2122/97
cgguaccgccgg

SEQ ID NO: 1049600 - RNA, 12 nt, Mycobacterium bovis subsp bovis AF2122/97
cgguaccggcga

SEQ ID NO: 1049601 - RNA, 18 nt, Mycobacterium bovis subsp bovis AF2122/97
cgguaccgccggcuccgc

SEQ ID NO: 1049602 - RNA, 17 nt, Mycobacterium bovis subsp bovis AF2122/97
cgguaccgcucgggcgc

SEQ ID NO: 1049603 - RNA, 18 nt, Mycobacterium bovis subsp bovis AF2122/97
cgguaccgcucgggcgcg

SEQ ID NO: 1049604 - RNA, 14 nt, Mycobacterium bovis subsp bovis AF2122/97
cgguaccgccgcgg

SEQ ID NO: 1049605 - RNA, 17 nt, Mycobacterium bovis subsp bovis AF2122/97
cgguacccguagcacca

SEQ ID NO: 1049606 - RNA, 14 nt, Mycobacterium bovis subsp bovis AF2122/97
cgguaccgacgggg

SEQ ID NO: 1049607 - RNA, 21 nt, Mycobacterium bovis subsp bovis AF2122/97
cgguacgggucgccggacugc

SEQ ID NO: 1049608 - RNA, 17 nt, Mycobacterium bovis subsp bovis AF2122/97
cgguaccuagccgcaga

SEQ ID NO: 1049609 - RNA, 16 nt, Mycobacterium bovis subsp bovis AF2122/97
cgguaccucaacacca

SEQ ID NO: 1049610 - RNA, 14 nt, Mycobacterium bovis subsp bovis AF2122/97
cgguacgccgccgc

SEQ ID NO: 1049611 - RNA, 15 nt, Mycobacterium bovis subsp bovis AF2122/97
cgguacgccgcgccg

SEQ ID NO: 1049612 - RNA, 12 nt, Mycobacterium bovis subsp bovis AF2122/97
cgguacgccggu

SEQ ID NO: 1049613 - RNA, 20 nt, Mycobacterium bovis subsp bovis AF2122/97
cgguacgccggucggugcgg

SEQ ID NO: 1049614 - RNA, 18 nt, Mycobacterium bovis subsp bovis AF2122/97
cgguagaucuucggccgc

SEQ ID NO: 1049615 - RNA, 15 nt, Mycobacterium bovis subsp bovis AF2122/97
cgguagacgccgccg

SEQ ID NO: 1049616 - RNA, 18 nt, Mycobacterium bovis subsp bovis AF2122/97
cgguagacaagucggcgc

SEQ ID NO: 1049617 - RNA, 22 nt, Mycobacterium bovis subsp bovis AF2122/97
cgguagacaagucggcgcuggc

SEQ ID NO: 1049618 - RNA, 19 nt, Mycobacterium bovis subsp bovis AF2122/97
cgguaccccagcgcugucg

SEQ ID NO: 1049619 - RNA, 22 nt, Mycobacterium bovis subsp bovis AF2122/97
cgguaucgagggcagccgccca

SEQ ID NO: 1049620 - RNA, 12 nt, Mycobacterium bovis subsp bovis AF2122/97
cgguaucgccaa

SEQ ID NO: 1049621 - RNA, 20 nt, Mycobacterium bovis subsp bovis AF2122/97
cgguaucgucccggcgaccg

SEQ ID NO: 1049622 - RNA, 18 nt, Mycobacterium bovis subsp bovis AF2122/97
cgguaucggucagccacg

SEQ ID NO: 1049623 - RNA, 13 nt, Mycobacterium bovis subsp bovis AF2122/97
cgguaugcucgcu

SEQ ID NO: 1049624 - RNA, 14 nt, Mycobacterium bovis subsp bovis AF2122/97
cgguagucgaugcu

SEQ ID NO: 1049625 - RNA, 15 nt, Mycobacterium bovis subsp bovis AF2122/97
cgguagugucguagg

SEQ ID NO: 1049626 - RNA, 17 nt, Mycobacterium bovis subsp bovis AF2122/97
cgguaguuaacccaggg

SEQ ID NO: 1049627 - RNA, 17 nt, Mycobacterium bovis subsp bovis AF2122/97
cgguaguugcgcggcau

SEQ ID NO: 1049628 - RNA, 18 nt, Mycobacterium bovis subsp bovis AF2122/97
cgguaguugcgcggcauc

SEQ ID NO: 1049629 - RNA, 20 nt, Mycobacterium bovis subsp bovis AF2122/97
cgguaguugucccgccgcgc

SEQ ID NO: 1049630 - RNA, 12 nt, Mycobacterium bovis subsp bovis AF2122/97
cgguagucgucg

SEQ ID NO: 1049631 - RNA, 19 nt, Mycobacterium bovis subsp bovis AF2122/97
cgguaguuaacccagggcc

SEQ ID NO: 1049632 - RNA, 16 nt, Mycobacterium bovis subsp bovis AF2122/97
cgguauacccggcccc

SEQ ID NO: 1049633 - RNA, 23 nt, Mycobacterium bovis subsp bovis AF2122/97
cgguauagccaagugagcgaucg

SEQ ID NO: 1049634 - RNA, 22 nt, Mycobacterium bovis subsp bovis AF2122/97
cgguaucccccagccgcggcgc

SEQ ID NO: 1049635 - RNA, 18 nt, Mycobacterium bovis subsp bovis AF2122/97
cgguaucgaaagccaacu

SEQ ID NO: 1049636 - RNA, 14 nt, Mycobacterium bovis subsp bovis AF2122/97
cgguaguccgcgcu

SEQ ID NO: 1049637 - RNA, 17 nt, Mycobacterium bovis subsp bovis AF2122/97
cgguaguccgcgcucag

SEQ ID NO: 1049638 - RNA, 12 nt, Mycobacterium bovis subsp bovis AF2122/97
cgguaguccgcu

SEQ ID NO: 1049639 - RNA, 13 nt, Mycobacterium bovis subsp bovis AF2122/97
cgguaguccggcu

SEQ ID NO: 1049640 - RNA, 18 nt, Mycobacterium bovis subsp bovis AF2122/97
cgguaguccggcuuaccg

SEQ ID NO: 1049641 - RNA, 18 nt, Mycobacterium bovis subsp bovis AF2122/97
cgguaggcggccagcgcg

SEQ ID NO: 1049642 - RNA, 23 nt, Mycobacterium bovis subsp bovis AF2122/97
cgguagcauccagcgcgcgcuga

SEQ ID NO: 1049643 - RNA, 17 nt, Mycobacterium bovis subsp bovis AF2122/97
cgguagccaagcgagcg

SEQ ID NO: 1049644 - RNA, 18 nt, Mycobacterium bovis subsp bovis AF2122/97
cgguagcacugucgaggu

SEQ ID NO: 1049645 - RNA, 16 nt, Mycobacterium bovis subsp bovis AF2122/97
cgguagcacagcagca

SEQ ID NO: 1049646 - RNA, 14 nt, Mycobacterium bovis subsp bovis AF2122/97
cgguaggccggcaa

SEQ ID NO: 1049647 - RNA, 14 nt, Mycobacterium bovis subsp bovis AF2122/97
cgguagccgagcuc

SEQ ID NO: 1049648 - RNA, 18 nt, Mycobacterium bovis subsp bovis AF2122/97
cgguagccccgucgaccu

SEQ ID NO: 1049649 - RNA, 18 nt, Mycobacterium bovis subsp bovis AF2122/97
cgguagccgaccagcgcu

SEQ ID NO: 1049650 - RNA, 14 nt, Mycobacterium bovis subsp bovis AF2122/97
cgguagccgaccga

SEQ ID NO: 1049651 - RNA, 16 nt, Mycobacterium bovis subsp bovis AF2122/97
cgguagccgaccgacc

SEQ ID NO: 1049652 - RNA, 18 nt, Mycobacterium bovis subsp bovis AF2122/97
cgguagccgacgacacgg

SEQ ID NO: 1049653 - RNA, 20 nt, Mycobacterium bovis subsp bovis AF2122/97
cgguagccgacgacacgggu

SEQ ID NO: 1049654 - RNA, 12 nt, Mycobacterium bovis subsp bovis AF2122/97
cggucacgacgu

SEQ ID NO: 1049655 - RNA, 16 nt, Mycobacterium bovis subsp bovis AF2122/97
cggucacgaucacgau

SEQ ID NO: 1049656 - RNA, 12 nt, Mycobacterium bovis subsp bovis AF2122/97
cggucaccggcg

SEQ ID NO: 1049657 - RNA, 19 nt, Mycobacterium bovis subsp bovis AF2122/97
cggucaccggcgcaccgga

SEQ ID NO: 1049658 - RNA, 15 nt, Mycobacterium bovis subsp bovis AF2122/97
cggucaccucgaugc

SEQ ID NO: 1049659 - RNA, 16 nt, Mycobacterium bovis subsp bovis AF2122/97
cggucaccccggcucg

SEQ ID NO: 1049660 - RNA, 17 nt, Mycobacterium bovis subsp bovis AF2122/97
cggucaccccggcucgg

SEQ ID NO: 1049661 - RNA, 20 nt, Mycobacterium bovis subsp bovis AF2122/97
cggucaaucccggccagggg

SEQ ID NO: 1049662 - RNA, 14 nt, Mycobacterium bovis subsp bovis AF2122/97
cggucaccaccgug

SEQ ID NO: 1049663 - RNA, 21 nt, Mycobacterium bovis subsp bovis AF2122/97
cggucaccaccguggcgcccg

SEQ ID NO: 1049664 - RNA, 16 nt, Mycobacterium bovis subsp bovis AF2122/97
cggucaccacgcggcg

SEQ ID NO: 1049665 - RNA, 17 nt, Mycobacterium bovis subsp bovis AF2122/97
cggucaccacgcggcgg

SEQ ID NO: 1049666 - RNA, 19 nt, Mycobacterium bovis subsp bovis AF2122/97
cggucaccggagagccggu

SEQ ID NO: 1049667 - RNA, 17 nt, Mycobacterium bovis subsp bovis AF2122/97
cggucaccucgccggcg

SEQ ID NO: 1049668 - RNA, 18 nt, Mycobacterium bovis subsp bovis AF2122/97
cggucaccucgccggcgg

SEQ ID NO: 1049669 - RNA, 15 nt, Mycobacterium bovis subsp bovis AF2122/97
cggucacguccgcgg

SEQ ID NO: 1049670 - RNA, 15 nt, Mycobacterium bovis subsp bovis AF2122/97
cggucacgucgauga

SEQ ID NO: 1049671 - RNA, 21 nt, Mycobacterium bovis subsp bovis AF2122/97
cggucacgugguccaagacag

SEQ ID NO: 1049672 - RNA, 19 nt, Mycobacterium bovis subsp bovis AF2122/97
cggucacuuuacguagucg

SEQ ID NO: 1049673 - RNA, 16 nt, Mycobacterium bovis subsp bovis AF2122/97
cggucagauucggcga

SEQ ID NO: 1049674 - RNA, 15 nt, Mycobacterium bovis subsp bovis AF2122/97
cggucacucuggcga

SEQ ID NO: 1049675 - RNA, 16 nt, Mycobacterium bovis subsp bovis AF2122/97
cggucaccauggcgcc

SEQ ID NO: 1049676 - RNA, 18 nt, Mycobacterium bovis subsp bovis AF2122/97
cggucaccauggcgccgc

SEQ ID NO: 1049677 - RNA, 21 nt, Mycobacterium bovis subsp bovis AF2122/97
cggucaccauggcgccgcgcc

SEQ ID NO: 1049678 - RNA, 22 nt, Mycobacterium bovis subsp bovis AF2122/97
cggucaccauggcgccgcgccg

SEQ ID NO: 1049679 - RNA, 19 nt, Mycobacterium bovis subsp bovis AF2122/97
cggucaauugugcggcccc

SEQ ID NO: 1049680 - RNA, 12 nt, Mycobacterium bovis subsp bovis AF2122/97
cggucacaccga

SEQ ID NO: 1049681 - RNA, 17 nt, Mycobacterium bovis subsp bovis AF2122/97
cggucaaggugcgccgc

SEQ ID NO: 1049682 - RNA, 13 nt, Mycobacterium bovis subsp bovis AF2122/97
cggucaacgacag

SEQ ID NO: 1049683 - RNA, 14 nt, Mycobacterium bovis subsp bovis AF2122/97
cggucaagccggcg

SEQ ID NO: 1049684 - RNA, 21 nt, Mycobacterium bovis subsp bovis AF2122/97
cggucaaacugccaucggaca

SEQ ID NO: 1049685 - RNA, 14 nt, Mycobacterium bovis subsp bovis AF2122/97
cgguauuaccgccg

SEQ ID NO: 1049686 - RNA, 13 nt, Mycobacterium bovis subsp bovis AF2122/97
cgguauugcccgg

SEQ ID NO: 1049687 - RNA, 16 nt, Mycobacterium bovis subsp bovis AF2122/97
cggcggacgacgucgg

SEQ ID NO: 1049688 - RNA, 20 nt, Mycobacterium bovis subsp bovis AF2122/97
cggcggacgcccggcgcacc

SEQ ID NO: 1049689 - RNA, 18 nt, Mycobacterium bovis subsp bovis AF2122/97
cggcggaccgcagcguga

SEQ ID NO: 1049690 - RNA, 13 nt, Mycobacterium bovis subsp bovis AF2122/97
cggcggacgacgu

SEQ ID NO: 1049691 - RNA, 22 nt, Mycobacterium bovis subsp bovis AF2122/97
cggcggacugagagauggucgg

SEQ ID NO: 1049692 - RNA, 16 nt, Mycobacterium bovis subsp bovis AF2122/97
cggcggagucgacggu

SEQ ID NO: 1049693 - RNA, 14 nt, Mycobacterium bovis subsp bovis AF2122/97
cggcggagucgacg

SEQ ID NO: 1049694 - RNA, 14 nt, Mycobacterium bovis subsp bovis AF2122/97
cggcggaggcuucg

SEQ ID NO: 1049695 - RNA, 18 nt, Mycobacterium bovis subsp bovis AF2122/97
cggcggagaaggcgacca

SEQ ID NO: 1049696 - RNA, 21 nt, Mycobacterium bovis subsp bovis AF2122/97
cggcggagucgcgcagggcga

SEQ ID NO: 1049697 - RNA, 17 nt, Mycobacterium bovis subsp bovis AF2122/97
cggcggaucggcggccg

SEQ ID NO: 1049698 - RNA, 18 nt, Mycobacterium bovis subsp bovis AF2122/97
cggcggaucggcggccgg

SEQ ID NO: 1049699 - RNA, 20 nt, Mycobacterium bovis subsp bovis AF2122/97
cggcggaucccgaggcgccc

SEQ ID NO: 1049700 - RNA, 21 nt, Mycobacterium bovis subsp bovis AF2122/97
cggcggaucccgaggcgccca

SEQ ID NO: 1049701 - RNA, 16 nt, Mycobacterium bovis subsp bovis AF2122/97
cggcggauagucgcgg

SEQ ID NO: 1049702 - RNA, 22 nt, Mycobacterium bovis subsp bovis AF2122/97
cggcggaucccgaggcgcccaa

SEQ ID NO: 1049703 - RNA, 16 nt, Mycobacterium bovis subsp bovis AF2122/97
cggcggauuccggcau

SEQ ID NO: 1049704 - RNA, 17 nt, Mycobacterium bovis subsp bovis AF2122/97
cggcggauucgcgcugg

SEQ ID NO: 1049705 - RNA, 19 nt, Mycobacterium bovis subsp bovis AF2122/97
cggcggauucgcgcugguc

SEQ ID NO: 1049706 - RNA, 21 nt, Mycobacterium bovis subsp bovis AF2122/97
cggcggauucggcgcugcggc

SEQ ID NO: 1049707 - RNA, 22 nt, Mycobacterium bovis subsp bovis AF2122/97
cggcggauucggcgcugcggcg

SEQ ID NO: 1049708 - RNA, 22 nt, Mycobacterium bovis subsp bovis AF2122/97
cggcggauucgguaucagggga

SEQ ID NO: 1049709 - RNA, 23 nt, Mycobacterium bovis subsp bovis AF2122/97
cggcggacccggugacccgcugg

SEQ ID NO: 1049710 - RNA, 12 nt, Mycobacterium bovis subsp bovis AF2122/97
cggcggaccgca

SEQ ID NO: 1049711 - RNA, 12 nt, Mycobacterium bovis subsp bovis AF2122/97
cggcggacccgg

SEQ ID NO: 1049712 - RNA, 14 nt, Mycobacterium bovis subsp bovis AF2122/97
cggcggaccgcagc

SEQ ID NO: 1049713 - RNA, 15 nt, Mycobacterium bovis subsp bovis AF2122/97
cggcggaccgcagcg

SEQ ID NO: 1049714 - RNA, 20 nt, Mycobacterium bovis subsp bovis AF2122/97
cggcggacaugcaccucgag

SEQ ID NO: 1049715 - RNA, 13 nt, Mycobacterium bovis subsp bovis AF2122/97
cggcggacccgcu

SEQ ID NO: 1049716 - RNA, 18 nt, Mycobacterium bovis subsp bovis AF2122/97
cggcggaaggcgucgaac

SEQ ID NO: 1049717 - RNA, 19 nt, Mycobacterium bovis subsp bovis AF2122/97
cggcggacaggcccggugg

SEQ ID NO: 1049718 - RNA, 18 nt, Mycobacterium bovis subsp bovis AF2122/97
cggcggacccgcucgcgg

SEQ ID NO: 1049719 - RNA, 16 nt, Mycobacterium bovis subsp bovis AF2122/97
cggcggaaggcgucga

SEQ ID NO: 1049720 - RNA, 22 nt, Mycobacterium bovis subsp bovis AF2122/97
cggcggaagaagugcacugcga

SEQ ID NO: 1049721 - RNA, 18 nt, Mycobacterium bovis subsp bovis AF2122/97
cggcggacaccucgggcg

SEQ ID NO: 1049722 - RNA, 22 nt, Mycobacterium bovis subsp bovis AF2122/97
cggcggacaccucgggcgcccg

SEQ ID NO: 1049723 - RNA, 14 nt, Mycobacterium bovis subsp bovis AF2122/97
cggcggaaacaacc

SEQ ID NO: 1049724 - RNA, 17 nt, Mycobacterium bovis subsp bovis AF2122/97
cggcggaaauggcgucg

SEQ ID NO: 1049725 - RNA, 21 nt, Mycobacterium bovis subsp bovis AF2122/97
cggcggaaauggcgucgccgg

SEQ ID NO: 1049726 - RNA, 23 nt, Mycobacterium bovis subsp bovis AF2122/97
cggcggaaauggcgucgccggca

SEQ ID NO: 1049727 - RNA, 19 nt, Mycobacterium bovis subsp bovis AF2122/97
cggcggaacaccgacgaca

SEQ ID NO: 1049728 - RNA, 13 nt, Mycobacterium bovis subsp bovis AF2122/97
cggcgcucgucga

SEQ ID NO: 1049729 - RNA, 15 nt, Mycobacterium bovis subsp bovis AF2122/97
cggcgcucgucgauc

SEQ ID NO: 1049730 - RNA, 19 nt, Mycobacterium bovis subsp bovis AF2122/97
cggcgcucgucgcggcccg

SEQ ID NO: 1049731 - RNA, 16 nt, Mycobacterium bovis subsp bovis AF2122/97
cggcgcucggcgagcu

SEQ ID NO: 1049732 - RNA, 17 nt, Mycobacterium bovis subsp bovis AF2122/97
cggcgcucgcggcggcg

SEQ ID NO: 1049733 - RNA, 13 nt, Mycobacterium bovis subsp bovis AF2122/97
cggcgcucggcga

SEQ ID NO: 1049734 - RNA, 17 nt, Mycobacterium bovis subsp bovis AF2122/97
cggcgcugacgaacgcu

SEQ ID NO: 1049735 - RNA, 17 nt, Mycobacterium bovis subsp bovis AF2122/97
cggcgcugaucgcgcgc

SEQ ID NO: 1049736 - RNA, 14 nt, Mycobacterium bovis subsp bovis AF2122/97
cggcgcugcccggg

SEQ ID NO: 1049737 - RNA, 14 nt, Mycobacterium bovis subsp bovis AF2122/97
cggcgcugccaggc

SEQ ID NO: 1049738 - RNA, 20 nt, Mycobacterium bovis subsp bovis AF2122/97
cggcgcugcccgggcugccg

SEQ ID NO: 1049739 - RNA, 22 nt, Mycobacterium bovis subsp bovis AF2122/97
cggcgcugcccgggcugccgcc

SEQ ID NO: 1049740 - RNA, 12 nt, Mycobacterium bovis subsp bovis AF2122/97
cggcgcugccgg

SEQ ID NO: 1049741 - RNA, 14 nt, Mycobacterium bovis subsp bovis AF2122/97
cggcgcuggcgggc

SEQ ID NO: 1049742 - RNA, 15 nt, Mycobacterium bovis subsp bovis AF2122/97
cggcgcuggcgggca

SEQ ID NO: 1049743 - RNA, 19 nt, Mycobacterium bovis subsp bovis AF2122/97
cggcgcuggcgggcgaucg

SEQ ID NO: 1049744 - RNA, 18 nt, Mycobacterium bovis subsp bovis AF2122/97
cggcgcuggugcgccacg

SEQ ID NO: 1049745 - RNA, 14 nt, Mycobacterium bovis subsp bovis AF2122/97
cggcgcugggacgg

SEQ ID NO: 1049746 - RNA, 19 nt, Mycobacterium bovis subsp bovis AF2122/97
cggcgcugaacuagggucg

SEQ ID NO: 1049747 - RNA, 13 nt, Mycobacterium bovis subsp bovis AF2122/97
cggcgcugcgcga

SEQ ID NO: 1049748 - RNA, 19 nt, Mycobacterium bovis subsp bovis AF2122/97
cggcgcugcgcgcgaucca

SEQ ID NO: 1049749 - RNA, 18 nt, Mycobacterium bovis subsp bovis AF2122/97
cggcgcugcggcgugccg

SEQ ID NO: 1049750 - RNA, 21 nt, Mycobacterium bovis subsp bovis AF2122/97
cggcgcugcugccauugccga

SEQ ID NO: 1049751 - RNA, 19 nt, Mycobacterium bovis subsp bovis AF2122/97
cggcgccaguauggccgcc

SEQ ID NO: 1049752 - RNA, 21 nt, Mycobacterium bovis subsp bovis AF2122/97
cggcgccaguauggccgccac

SEQ ID NO: 1049753 - RNA, 23 nt, Mycobacterium bovis subsp bovis AF2122/97
cggcgccauagccgcgacccgcg

SEQ ID NO: 1049754 - RNA, 20 nt, Mycobacterium bovis subsp bovis AF2122/97
cggcgccaggcaccacgacc

SEQ ID NO: 1049755 - RNA, 17 nt, Mycobacterium bovis subsp bovis AF2122/97
cggcgccaguauggccg

SEQ ID NO: 1049756 - RNA, 15 nt, Mycobacterium bovis subsp bovis AF2122/97
cggcgcgggccacca

SEQ ID NO: 1049757 - RNA, 23 nt, Mycobacterium bovis subsp bovis AF2122/97
cggcgcgggcacgcccucgucga

SEQ ID NO: 1049758 - RNA, 16 nt, Mycobacterium bovis subsp bovis AF2122/97
cggcgcgggucggcga

SEQ ID NO: 1049759 - RNA, 21 nt, Mycobacterium bovis subsp bovis AF2122/97
cggcgccacccgcgccgcccg

SEQ ID NO: 1049760 - RNA, 19 nt, Mycobacterium bovis subsp bovis AF2122/97
cggcgccacccccaccguc

SEQ ID NO: 1049761 - RNA, 14 nt, Mycobacterium bovis subsp bovis AF2122/97
cggcgccaccgccg

SEQ ID NO: 1049762 - RNA, 17 nt, Mycobacterium bovis subsp bovis AF2122/97
cggcgccaccgccgcug

SEQ ID NO: 1049763 - RNA, 15 nt, Mycobacterium bovis subsp bovis AF2122/97
cggcgccaggcacca

SEQ ID NO: 1049764 - RNA, 16 nt, Mycobacterium bovis subsp bovis AF2122/97
cggcgccaggcaccac

SEQ ID NO: 1049765 - RNA, 17 nt, Mycobacterium bovis subsp bovis AF2122/97
cggcgccagcgccgcca

SEQ ID NO: 1049766 - RNA, 17 nt, Mycobacterium bovis subsp bovis AF2122/97
cggcgcauuccggcgcc

SEQ ID NO: 1049767 - RNA, 20 nt, Mycobacterium bovis subsp bovis AF2122/97
cggcgccagcgccgccaccg

SEQ ID NO: 1049768 - RNA, 19 nt, Mycobacterium bovis subsp bovis AF2122/97
cggcgcauucccuugucgg

SEQ ID NO: 1049769 - RNA, 14 nt, Mycobacterium bovis subsp bovis AF2122/97
cggcgcuagcgccg

SEQ ID NO: 1049770 - RNA, 14 nt, Mycobacterium bovis subsp bovis AF2122/97
cggcgcuccaacgc

SEQ ID NO: 1049771 - RNA, 20 nt, Mycobacterium bovis subsp bovis AF2122/97
cggcgcucaaugcggucaac

SEQ ID NO: 1049772 - RNA, 21 nt, Mycobacterium bovis subsp bovis AF2122/97
cggcgcucaaugcggucaacg

SEQ ID NO: 1049773 - RNA, 22 nt, Mycobacterium bovis subsp bovis AF2122/97
cggcgcucacgggcgaucgugc

SEQ ID NO: 1049774 - RNA, 21 nt, Mycobacterium bovis subsp bovis AF2122/97
cggcgcgguggggcgcgccgg

SEQ ID NO: 1049775 - RNA, 16 nt, Mycobacterium bovis subsp bovis AF2122/97
cggcgcgucguugccg

SEQ ID NO: 1049776 - RNA, 22 nt, Mycobacterium bovis subsp bovis AF2122/97
cggcgcguaguaaugcucgacg

SEQ ID NO: 1049777 - RNA, 18 nt, Mycobacterium bovis subsp bovis AF2122/97
cggcggccggcgccggcg

SEQ ID NO: 1049778 - RNA, 20 nt, Mycobacterium bovis subsp bovis AF2122/97
cggcggccggcgccggcgcg

SEQ ID NO: 1049779 - RNA, 17 nt, Mycobacterium bovis subsp bovis AF2122/97
cggcggccgcgaccagc

SEQ ID NO: 1049780 - RNA, 21 nt, Mycobacterium bovis subsp bovis AF2122/97
cggcggccgcgaccagcgccg

SEQ ID NO: 1049781 - RNA, 15 nt, Mycobacterium bovis subsp bovis AF2122/97
cggcggccgcgaugg

SEQ ID NO: 1049782 - RNA, 21 nt, Mycobacterium bovis subsp bovis AF2122/97
cggcggccgcggugcccgucg

SEQ ID NO: 1049783 - RNA, 14 nt, Mycobacterium bovis subsp bovis AF2122/97
cggcggccgcccag

SEQ ID NO: 1049784 - RNA, 17 nt, Mycobacterium bovis subsp bovis AF2122/97
cggcggccgcccagaug

SEQ ID NO: 1049785 - RNA, 14 nt, Mycobacterium bovis subsp bovis AF2122/97
cggcggccgcgugc

SEQ ID NO: 1049786 - RNA, 19 nt, Mycobacterium bovis subsp bovis AF2122/97
cggcggccgcuucggcggu

SEQ ID NO: 1049787 - RNA, 14 nt, Mycobacterium bovis subsp bovis AF2122/97
cggcggcccacgcg

SEQ ID NO: 1049788 - RNA, 19 nt, Mycobacterium bovis subsp bovis AF2122/97
cggcggccggcacgggcgg

SEQ ID NO: 1049789 - RNA, 14 nt, Mycobacterium bovis subsp bovis AF2122/97
cggcggccgucacc

SEQ ID NO: 1049790 - RNA, 16 nt, Mycobacterium bovis subsp bovis AF2122/97
cggcggccuccaccac

SEQ ID NO: 1049791 - RNA, 20 nt, Mycobacterium bovis subsp bovis AF2122/97
cggcggccuccaccacgucg

SEQ ID NO: 1049792 - RNA, 21 nt, Mycobacterium bovis subsp bovis AF2122/97
cggcggccuccaccacgucgg

SEQ ID NO: 1049793 - RNA, 16 nt, Mycobacterium bovis subsp bovis AF2122/97
cggcggccucgcugcu

SEQ ID NO: 1049794 - RNA, 15 nt, Mycobacterium bovis subsp bovis AF2122/97
cggcggccucggucu

SEQ ID NO: 1049795 - RNA, 15 nt, Mycobacterium bovis subsp bovis AF2122/97
cggcggccgugucgg

SEQ ID NO: 1049796 - RNA, 12 nt, Mycobacterium bovis subsp bovis AF2122/97
cggcggcgacca

SEQ ID NO: 1049797 - RNA, 13 nt, Mycobacterium bovis subsp bovis AF2122/97
cggcggcgaccag

SEQ ID NO: 1049798 - RNA, 14 nt, Mycobacterium bovis subsp bovis AF2122/97
cggcggcgaccaga

SEQ ID NO: 1049799 - RNA, 21 nt, Mycobacterium bovis subsp bovis AF2122/97
cggcggcgaacucggcgauga

SEQ ID NO: 1049800 - RNA, 16 nt, Mycobacterium bovis subsp bovis AF2122/97
cggcggccuugcgggc

SEQ ID NO: 1049801 - RNA, 18 nt, Mycobacterium bovis subsp bovis AF2122/97
cggcggccuggcacccgg

SEQ ID NO: 1049802 - RNA, 19 nt, Mycobacterium bovis subsp bovis AF2122/97
cggcggccuggcacccggg

SEQ ID NO: 1049803 - RNA, 14 nt, Mycobacterium bovis subsp bovis AF2122/97
cggcggccugggcc

SEQ ID NO: 1049804 - RNA, 18 nt, Mycobacterium bovis subsp bovis AF2122/97
cggcggccugggccagcc

SEQ ID NO: 1049805 - RNA, 15 nt, Mycobacterium bovis subsp bovis AF2122/97
cggcggccugggcca

SEQ ID NO: 1049806 - RNA, 15 nt, Mycobacterium bovis subsp bovis AF2122/97
cggcggcgacguggc

SEQ ID NO: 1049807 - RNA, 12 nt, Mycobacterium bovis subsp bovis AF2122/97
cggcggcgacgg

SEQ ID NO: 1049808 - RNA, 19 nt, Mycobacterium bovis subsp bovis AF2122/97
cggcggccugggccagccg

SEQ ID NO: 1049809 - RNA, 18 nt, Mycobacterium bovis subsp bovis AF2122/97
cggcggccuucggccggc

SEQ ID NO: 1049810 - RNA, 18 nt, Mycobacterium bovis subsp bovis AF2122/97
cggcggccuucuccccga

SEQ ID NO: 1049811 - RNA, 15 nt, Mycobacterium bovis subsp bovis AF2122/97
cggcggcgaccgcca

SEQ ID NO: 1049812 - RNA, 17 nt, Mycobacterium bovis subsp bovis AF2122/97
cggcggcgacgagcgca

SEQ ID NO: 1049813 - RNA, 20 nt, Mycobacterium bovis subsp bovis AF2122/97
cggcggcgacgagcgcagcg

SEQ ID NO: 1049814 - RNA, 15 nt, Mycobacterium bovis subsp bovis AF2122/97
cggcggcgcgaucga

SEQ ID NO: 1049815 - RNA, 15 nt, Mycobacterium bovis subsp bovis AF2122/97
cggcggcgacggcgg

SEQ ID NO: 1049816 - RNA, 19 nt, Mycobacterium bovis subsp bovis AF2122/97
cggcggcgacggugccacc

SEQ ID NO: 1049817 - RNA, 20 nt, Mycobacterium bovis subsp bovis AF2122/97
cggcggcgacggugccaccg

SEQ ID NO: 1049818 - RNA, 21 nt, Mycobacterium bovis subsp bovis AF2122/97
cggcggcgacggugccaccgc

SEQ ID NO: 1049819 - RNA, 15 nt, Mycobacterium bovis subsp bovis AF2122/97
cggcggcgcucgucg

SEQ ID NO: 1049820 - RNA, 16 nt, Mycobacterium bovis subsp bovis AF2122/97
cggcggcgcucgucga

SEQ ID NO: 1049821 - RNA, 14 nt, Mycobacterium bovis subsp bovis AF2122/97
cggcggcggcacgc

SEQ ID NO: 1049822 - RNA, 16 nt, Mycobacterium bovis subsp bovis AF2122/97
cggcggcgucgacggc

SEQ ID NO: 1049823 - RNA, 14 nt, Mycobacterium bovis subsp bovis AF2122/97
cggcggcggaggcu

SEQ ID NO: 1049824 - RNA, 14 nt, Mycobacterium bovis subsp bovis AF2122/97
cggcggcggcaacg

SEQ ID NO: 1049825 - RNA, 15 nt, Mycobacterium bovis subsp bovis AF2122/97
cggcggcggcaacgg

SEQ ID NO: 1049826 - RNA, 17 nt, Mycobacterium bovis subsp bovis AF2122/97
cggcggcggcaacggcg

SEQ ID NO: 1049827 - RNA, 13 nt, Mycobacterium bovis subsp bovis AF2122/97
cggcggcugccgg

SEQ ID NO: 1049828 - RNA, 14 nt, Mycobacterium bovis subsp bovis AF2122/97
cggcggcugccggu

SEQ ID NO: 1049829 - RNA, 19 nt, Mycobacterium bovis subsp bovis AF2122/97
cggcggcuaggcaccagcg

SEQ ID NO: 1049830 - RNA, 18 nt, Mycobacterium bovis subsp bovis AF2122/97
cggcgggggcgucgccgc

SEQ ID NO: 1049831 - RNA, 16 nt, Mycobacterium bovis subsp bovis AF2122/97
cggcgggggcggcggc

SEQ ID NO: 1049832 - RNA, 17 nt, Mycobacterium bovis subsp bovis AF2122/97
cggcgggggcggcggcu

SEQ ID NO: 1049833 - RNA, 14 nt, Mycobacterium bovis subsp bovis AF2122/97
cggcggggcggcgg

SEQ ID NO: 1049834 - RNA, 18 nt, Mycobacterium bovis subsp bovis AF2122/97
cggcggggcggcgguggg

SEQ ID NO: 1049835 - RNA, 18 nt, Mycobacterium bovis subsp bovis AF2122/97
cggcggcugucggccggg

SEQ ID NO: 1049836 - RNA, 14 nt, Mycobacterium bovis subsp bovis AF2122/97
cggcggggccggcg

SEQ ID NO: 1049837 - RNA, 13 nt, Mycobacterium bovis subsp bovis AF2122/97
cggcgggcggugg

SEQ ID NO: 1049838 - RNA, 18 nt, Mycobacterium bovis subsp bovis AF2122/97
cggcgggcguaccuucga

SEQ ID NO: 1049839 - RNA, 19 nt, Mycobacterium bovis subsp bovis AF2122/97
cggcggggacucugccacc

SEQ ID NO: 1049840 - RNA, 15 nt, Mycobacterium bovis subsp bovis AF2122/97
cggcggggaucgcug

SEQ ID NO: 1049841 - RNA, 21 nt, Mycobacterium bovis subsp bovis AF2122/97
cggcgggcucuacucgcggcc

SEQ ID NO: 1049842 - RNA, 13 nt, Mycobacterium bovis subsp bovis AF2122/97
cggcgggcggccg

SEQ ID NO: 1049843 - RNA, 14 nt, Mycobacterium bovis subsp bovis AF2122/97
cggcgggcggccgc

SEQ ID NO: 1049844 - RNA, 14 nt, Mycobacterium bovis subsp bovis AF2122/97
cggcgggcgcgggc

SEQ ID NO: 1049845 - RNA, 16 nt, Mycobacterium bovis subsp bovis AF2122/97
cggcggcugucggccg

SEQ ID NO: 1049846 - RNA, 17 nt, Mycobacterium bovis subsp bovis AF2122/97
cggcggcucccgggggu

SEQ ID NO: 1049847 - RNA, 14 nt, Mycobacterium bovis subsp bovis AF2122/97
cggcggccgcagcg

SEQ ID NO: 1049848 - RNA, 21 nt, Mycobacterium bovis subsp bovis AF2122/97
cggcggccgcagcggccagcc

SEQ ID NO: 1049849 - RNA, 14 nt, Mycobacterium bovis subsp bovis AF2122/97
cggcggcccggccg

SEQ ID NO: 1049850 - RNA, 15 nt, Mycobacterium bovis subsp bovis AF2122/97
cggcggccgagcgca

SEQ ID NO: 1049851 - RNA, 20 nt, Mycobacterium bovis subsp bovis AF2122/97
cggcggcccuaaacaccgcg

SEQ ID NO: 1049852 - RNA, 12 nt, Mycobacterium bovis subsp bovis AF2122/97
cggcggcccgcu

SEQ ID NO: 1049853 - RNA, 17 nt, Mycobacterium bovis subsp bovis AF2122/97
cggcggcccgcagcccg

SEQ ID NO: 1049854 - RNA, 20 nt, Mycobacterium bovis subsp bovis AF2122/97
cggcggcccgcagcccgccg

SEQ ID NO: 1049855 - RNA, 21 nt, Mycobacterium bovis subsp bovis AF2122/97
cggcggcccgcagcccgccgg

SEQ ID NO: 1049856 - RNA, 20 nt, Mycobacterium bovis subsp bovis AF2122/97
cggcggcccgauagaucgcg

SEQ ID NO: 1049857 - RNA, 19 nt, Mycobacterium bovis subsp bovis AF2122/97
cggcggcccgauccagugg

SEQ ID NO: 1049858 - RNA, 24 nt, Mycobacterium bovis subsp bovis AF2122/97
cggcggcccgauccagugguaggc

SEQ ID NO: 1049859 - RNA, 13 nt, Mycobacterium bovis subsp bovis AF2122/97
cggcggcccgaua

SEQ ID NO: 1049860 - RNA, 12 nt, Mycobacterium bovis subsp bovis AF2122/97
cggcggccccgg

SEQ ID NO: 1049861 - RNA, 13 nt, Mycobacterium bovis subsp bovis AF2122/97
cggcggccccggc

SEQ ID NO: 1049862 - RNA, 24 nt, Mycobacterium bovis subsp bovis AF2122/97
cggcggccccggcauugcccgagc

SEQ ID NO: 1049863 - RNA, 13 nt, Mycobacterium bovis subsp bovis AF2122/97
cggcggccacggc

SEQ ID NO: 1049864 - RNA, 14 nt, Mycobacterium bovis subsp bovis AF2122/97
cggcggccacgucc

SEQ ID NO: 1049865 - RNA, 14 nt, Mycobacterium bovis subsp bovis AF2122/97
cggcggccagcgca

SEQ ID NO: 1049866 - RNA, 20 nt, Mycobacterium bovis subsp bovis AF2122/97
cggcggccauagugaggccg

SEQ ID NO: 1049867 - RNA, 13 nt, Mycobacterium bovis subsp bovis AF2122/97
cggcggccccagg

SEQ ID NO: 1049868 - RNA, 19 nt, Mycobacterium bovis subsp bovis AF2122/97
cggcggcagcggcgccgcc

SEQ ID NO: 1049869 - RNA, 16 nt, Mycobacterium bovis subsp bovis AF2122/97
cggcggcagcggcgua

SEQ ID NO: 1049870 - RNA, 14 nt, Mycobacterium bovis subsp bovis AF2122/97
cggcggcaggccgg

SEQ ID NO: 1049871 - RNA, 19 nt, Mycobacterium bovis subsp bovis AF2122/97
cggcggcaggccggccacc

SEQ ID NO: 1049872 - RNA, 20 nt, Mycobacterium bovis subsp bovis AF2122/97
cggcggcauagugcgacugc

SEQ ID NO: 1049873 - RNA, 18 nt, Mycobacterium bovis subsp bovis AF2122/97
cggcggcaucaccuggcg

SEQ ID NO: 1049874 - RNA, 24 nt, Mycobacterium bovis subsp bovis AF2122/97
cggcggcaucgaguucggcccgca

SEQ ID NO: 1049875 - RNA, 17 nt, Mycobacterium bovis subsp bovis AF2122/97
cggcggcaucggcggca

SEQ ID NO: 1049876 - RNA, 18 nt, Mycobacterium bovis subsp bovis AF2122/97
cggcggcaucggcggcaa

SEQ ID NO: 1049877 - RNA, 16 nt, Mycobacterium bovis subsp bovis AF2122/97
cggcggcaucgguggu

SEQ ID NO: 1049878 - RNA, 19 nt, Mycobacterium bovis subsp bovis AF2122/97
cggcggcaugaagcaguug

SEQ ID NO: 1049879 - RNA, 18 nt, Mycobacterium bovis subsp bovis AF2122/97
cggcggccaccugcuggc

SEQ ID NO: 1049880 - RNA, 15 nt, Mycobacterium bovis subsp bovis AF2122/97
cggcggccacgccgg

SEQ ID NO: 1049881 - RNA, 16 nt, Mycobacterium bovis subsp bovis AF2122/97
cggcggcaugggucgu

SEQ ID NO: 1049882 - RNA, 15 nt, Mycobacterium bovis subsp bovis AF2122/97
cggcggcaucgaguu

SEQ ID NO: 1049883 - RNA, 20 nt, Mycobacterium bovis subsp bovis AF2122/97
cggcggcauguucaucgcag

SEQ ID NO: 1049884 - RNA, 19 nt, Mycobacterium bovis subsp bovis AF2122/97
cggcggcaaccccgagcgg

SEQ ID NO: 1049885 - RNA, 23 nt, Mycobacterium bovis subsp bovis AF2122/97
cggcggcaaccccgagcggagcc

SEQ ID NO: 1049886 - RNA, 18 nt, Mycobacterium bovis subsp bovis AF2122/97
cggcggcaacccugcccg

SEQ ID NO: 1049887 - RNA, 20 nt, Mycobacterium bovis subsp bovis AF2122/97
cggcggcaacccugcccggc

SEQ ID NO: 1049888 - RNA, 23 nt, Mycobacterium bovis subsp bovis AF2122/97
cggcggcaacccugcccggcccg

SEQ ID NO: 1049889 - RNA, 17 nt, Mycobacterium bovis subsp bovis AF2122/97
cggcggcaaccgccgcc

SEQ ID NO: 1049890 - RNA, 18 nt, Mycobacterium bovis subsp bovis AF2122/97
cggcggcaaccgccgcca

SEQ ID NO: 1049891 - RNA, 20 nt, Mycobacterium bovis subsp bovis AF2122/97
cggcggcaaccgccgccacc

SEQ ID NO: 1049892 - RNA, 15 nt, Mycobacterium bovis subsp bovis AF2122/97
cggcggcaacggcgg

SEQ ID NO: 1049893 - RNA, 17 nt, Mycobacterium bovis subsp bovis AF2122/97
cggcggcaacggcggca

SEQ ID NO: 1049894 - RNA, 23 nt, Mycobacterium bovis subsp bovis AF2122/97
cggcggcaacggcggcaucggcg

SEQ ID NO: 1049895 - RNA, 18 nt, Mycobacterium bovis subsp bovis AF2122/97
cggcggcaacggcggcga

SEQ ID NO: 1049896 - RNA, 23 nt, Mycobacterium bovis subsp bovis AF2122/97
cggcggcaaagaacagccggcca

SEQ ID NO: 1049897 - RNA, 13 nt, Mycobacterium bovis subsp bovis AF2122/97
cggcggauggcgu

SEQ ID NO: 1049898 - RNA, 15 nt, Mycobacterium bovis subsp bovis AF2122/97
cggcggcaacggugg

SEQ ID NO: 1049899 - RNA, 14 nt, Mycobacterium bovis subsp bovis AF2122/97
cggcggcaagggcg

SEQ ID NO: 1049900 - RNA, 16 nt, Mycobacterium bovis subsp bovis AF2122/97
cggcggcaagggcggc

SEQ ID NO: 1049901 - RNA, 20 nt, Mycobacterium bovis subsp bovis AF2122/97
cggcggcaagggcggcaacg

SEQ ID NO: 1049902 - RNA, 21 nt, Mycobacterium bovis subsp bovis AF2122/97
cggcggcaagggcggcaacgg

SEQ ID NO: 1049903 - RNA, 17 nt, Mycobacterium bovis subsp bovis AF2122/97
cggcggcaaggguggug

SEQ ID NO: 1049904 - RNA, 15 nt, Mycobacterium bovis subsp bovis AF2122/97
cggcggcacccgggu

SEQ ID NO: 1049905 - RNA, 22 nt, Mycobacterium bovis subsp bovis AF2122/97
cggcggcagcauauccgccggc

SEQ ID NO: 1049906 - RNA, 16 nt, Mycobacterium bovis subsp bovis AF2122/97
cggcggcaacgguggc

SEQ ID NO: 1049907 - RNA, 18 nt, Mycobacterium bovis subsp bovis AF2122/97
cggcggcacccggguggc

SEQ ID NO: 1049908 - RNA, 14 nt, Mycobacterium bovis subsp bovis AF2122/97
cggcggcagcaccc

SEQ ID NO: 1049909 - RNA, 14 nt, Mycobacterium bovis subsp bovis AF2122/97
cggcggcacgggcg

SEQ ID NO: 1049910 - RNA, 16 nt, Mycobacterium bovis subsp bovis AF2122/97
cggcggcacgggcggc

SEQ ID NO: 1049911 - RNA, 15 nt, Mycobacterium bovis subsp bovis AF2122/97
cggcggguagcucgc

SEQ ID NO: 1049912 - RNA, 21 nt, Mycobacterium bovis subsp bovis AF2122/97
cggcggggggugaucgccacc

SEQ ID NO: 1049913 - RNA, 22 nt, Mycobacterium bovis subsp bovis AF2122/97
cggcggggggugaucgccaccg

SEQ ID NO: 1049914 - RNA, 18 nt, Mycobacterium bovis subsp bovis AF2122/97
cggcgggggaccccgcca

SEQ ID NO: 1049915 - RNA, 21 nt, Mycobacterium bovis subsp bovis AF2122/97
cggcgggucugggucaggcga

SEQ ID NO: 1049916 - RNA, 14 nt, Mycobacterium bovis subsp bovis AF2122/97
cggcgggugccgag

SEQ ID NO: 1049917 - RNA, 15 nt, Mycobacterium bovis subsp bovis AF2122/97
cggcgggugccgagc

SEQ ID NO: 1049918 - RNA, 16 nt, Mycobacterium bovis subsp bovis AF2122/97
cggcgggugccgagcu

SEQ ID NO: 1049919 - RNA, 14 nt, Mycobacterium bovis subsp bovis AF2122/97
cggcgggucccgcc

SEQ ID NO: 1049920 - RNA, 20 nt, Mycobacterium bovis subsp bovis AF2122/97
cggcgggggcgucgccgccg

SEQ ID NO: 1049921 - RNA, 15 nt, Mycobacterium bovis subsp bovis AF2122/97
cggcguccaccugcu

SEQ ID NO: 1049922 - RNA, 18 nt, Mycobacterium bovis subsp bovis AF2122/97
cggcgucaggcacaacgc

SEQ ID NO: 1049923 - RNA, 21 nt, Mycobacterium bovis subsp bovis AF2122/97
cggcgggugccgagcuggcga

SEQ ID NO: 1049924 - RNA, 21 nt, Mycobacterium bovis subsp bovis AF2122/97
cggcgucaggcacaacgcgac

SEQ ID NO: 1049925 - RNA, 14 nt, Mycobacterium bovis subsp bovis AF2122/97
cggcgucauccacc

SEQ ID NO: 1049926 - RNA, 15 nt, Mycobacterium bovis subsp bovis AF2122/97
cggcguccgcccagc

SEQ ID NO: 1049927 - RNA, 16 nt, Mycobacterium bovis subsp bovis AF2122/97
cggcguccgcccagca

SEQ ID NO: 1049928 - RNA, 21 nt, Mycobacterium bovis subsp bovis AF2122/97
cggcguccggguggcacacca

SEQ ID NO: 1049929 - RNA, 23 nt, Mycobacterium bovis subsp bovis AF2122/97
cggcguccaucaccagcaguggc

SEQ ID NO: 1049930 - RNA, 13 nt, Mycobacterium bovis subsp bovis AF2122/97
cggcguccaucgc

SEQ ID NO: 1049931 - RNA, 16 nt, Mycobacterium bovis subsp bovis AF2122/97
cggcgucauccaccgc

SEQ ID NO: 1049932 - RNA, 17 nt, Mycobacterium bovis subsp bovis AF2122/97
cggcguccaucgcgcgc

SEQ ID NO: 1049933 - RNA, 24 nt, Mycobacterium bovis subsp bovis AF2122/97
cggcguccaucgcgcgccgaccga

SEQ ID NO: 1049934 - RNA, 15 nt, Mycobacterium bovis subsp bovis AF2122/97
cggcguccgaccggu

SEQ ID NO: 1049935 - RNA, 13 nt, Mycobacterium bovis subsp bovis AF2122/97
cggcgucgaccag

SEQ ID NO: 1049936 - RNA, 15 nt, Mycobacterium bovis subsp bovis AF2122/97
cggcgucgaccaguu

SEQ ID NO: 1049937 - RNA, 18 nt, Mycobacterium bovis subsp bovis AF2122/97
cggcgucgaccaguucgg

SEQ ID NO: 1049938 - RNA, 14 nt, Mycobacterium bovis subsp bovis AF2122/97
cggcgucgacccag

SEQ ID NO: 1049939 - RNA, 13 nt, Mycobacterium bovis subsp bovis AF2122/97
cggcgucgacgau

SEQ ID NO: 1049940 - RNA, 18 nt, Mycobacterium bovis subsp bovis AF2122/97
cggcgucgaauaggccgc

SEQ ID NO: 1049941 - RNA, 15 nt, Mycobacterium bovis subsp bovis AF2122/97
cggcgucgaccucgc

SEQ ID NO: 1049942 - RNA, 22 nt, Mycobacterium bovis subsp bovis AF2122/97
cggcgucgagauagucggccgg

SEQ ID NO: 1049943 - RNA, 21 nt, Mycobacterium bovis subsp bovis AF2122/97
cggcgucgagggagcgccgca

SEQ ID NO: 1049944 - RNA, 23 nt, Mycobacterium bovis subsp bovis AF2122/97
cggcgucgagggagcgccgcagg

SEQ ID NO: 1049945 - RNA, 14 nt, Mycobacterium bovis subsp bovis AF2122/97
cggcgucgagccgg

SEQ ID NO: 1049946 - RNA, 13 nt, Mycobacterium bovis subsp bovis AF2122/97
cggcgucgagcuc

SEQ ID NO: 1049947 - RNA, 20 nt, Mycobacterium bovis subsp bovis AF2122/97
cggcgucgacugcgugccgc

SEQ ID NO: 1049948 - RNA, 18 nt, Mycobacterium bovis subsp bovis AF2122/97
cggcgucgacuggccguu

SEQ ID NO: 1049949 - RNA, 13 nt, Mycobacterium bovis subsp bovis AF2122/97
cggcgucgacggc

SEQ ID NO: 1049950 - RNA, 19 nt, Mycobacterium bovis subsp bovis AF2122/97
cggcgucgaguucgguugc

SEQ ID NO: 1049951 - RNA, 16 nt, Mycobacterium bovis subsp bovis AF2122/97
cggcgucgcucguugc

SEQ ID NO: 1049952 - RNA, 14 nt, Mycobacterium bovis subsp bovis AF2122/97
cggcgucgcgguug

SEQ ID NO: 1049953 - RNA, 12 nt, Mycobacterium bovis subsp bovis AF2122/97
cggcgucgccgc

SEQ ID NO: 1049954 - RNA, 19 nt, Mycobacterium bovis subsp bovis AF2122/97
cggcgucgauggccacccg

SEQ ID NO: 1049955 - RNA, 14 nt, Mycobacterium bovis subsp bovis AF2122/97
cggcgucgccgcca

SEQ ID NO: 1049956 - RNA, 13 nt, Mycobacterium bovis subsp bovis AF2122/97
cggcgucgcugcc

SEQ ID NO: 1049957 - RNA, 12 nt, Mycobacterium bovis subsp bovis AF2122/97
cggcgucggcca

SEQ ID NO: 1049958 - RNA, 20 nt, Mycobacterium bovis subsp bovis AF2122/97
cggcgucgcuggccaggccg

SEQ ID NO: 1049959 - RNA, 22 nt, Mycobacterium bovis subsp bovis AF2122/97
cggcgucgcuggccaggccggc

SEQ ID NO: 1049960 - RNA, 14 nt, Mycobacterium bovis subsp bovis AF2122/97
cggcgucggccacc

SEQ ID NO: 1049961 - RNA, 17 nt, Mycobacterium bovis subsp bovis AF2122/97
cggcgucggcgcccagc

SEQ ID NO: 1049962 - RNA, 13 nt, Mycobacterium bovis subsp bovis AF2122/97
cggcgucggcgcg

SEQ ID NO: 1049963 - RNA, 21 nt, Mycobacterium bovis subsp bovis AF2122/97
cggcgugaaaaacgcccgcgc

SEQ ID NO: 1049964 - RNA, 17 nt, Mycobacterium bovis subsp bovis AF2122/97
cggcgucggcgcggccg

SEQ ID NO: 1049965 - RNA, 15 nt, Mycobacterium bovis subsp bovis AF2122/97
cggcgugucacgucg

SEQ ID NO: 1049966 - RNA, 18 nt, Mycobacterium bovis subsp bovis AF2122/97
cggcgugguguccaccgc

SEQ ID NO: 1049967 - RNA, 14 nt, Mycobacterium bovis subsp bovis AF2122/97
cggcguguacgucg

SEQ ID NO: 1049968 - RNA, 15 nt, Mycobacterium bovis subsp bovis AF2122/97
cggcguguacgucga

SEQ ID NO: 1049969 - RNA, 23 nt, Mycobacterium bovis subsp bovis AF2122/97
cggcgugcaugagccgggugcga

SEQ ID NO: 1049970 - RNA, 16 nt, Mycobacterium bovis subsp bovis AF2122/97
cggcgugcaugagccg

SEQ ID NO: 1049971 - RNA, 12 nt, Mycobacterium bovis subsp bovis AF2122/97
cggcgucgggcc

SEQ ID NO: 1049972 - RNA, 15 nt, Mycobacterium bovis subsp bovis AF2122/97
cggcgugcagaaucc

SEQ ID NO: 1049973 - RNA, 22 nt, Mycobacterium bovis subsp bovis AF2122/97
cggcgugaugucuaccaacacc

SEQ ID NO: 1049974 - RNA, 23 nt, Mycobacterium bovis subsp bovis AF2122/97
cggcgugcagcagcuugacccac

SEQ ID NO: 1049975 - RNA, 15 nt, Mycobacterium bovis subsp bovis AF2122/97
cggcgugcagcaccc

SEQ ID NO: 1049976 - RNA, 15 nt, Mycobacterium bovis subsp bovis AF2122/97
cggcgugaucaccgg

SEQ ID NO: 1049977 - RNA, 16 nt, Mycobacterium bovis subsp bovis AF2122/97
cggcgugaucaccggc

SEQ ID NO: 1049978 - RNA, 17 nt, Mycobacterium bovis subsp bovis AF2122/97
cggcgugaucaccggca

SEQ ID NO: 1049979 - RNA, 14 nt, Mycobacterium bovis subsp bovis AF2122/97
cggcguugccgccg

SEQ ID NO: 1049980 - RNA, 16 nt, Mycobacterium bovis subsp bovis AF2122/97
cggcguugccgccggc

SEQ ID NO: 1049981 - RNA, 20 nt, Mycobacterium bovis subsp bovis AF2122/97
cggcguugauccgcacccca

SEQ ID NO: 1049982 - RNA, 15 nt, Mycobacterium bovis subsp bovis AF2122/97
cggcguugagcuggc

SEQ ID NO: 1049983 - RNA, 20 nt, Mycobacterium bovis subsp bovis AF2122/97
cggcguugaucgacaucacc

SEQ ID NO: 1049984 - RNA, 19 nt, Mycobacterium bovis subsp bovis AF2122/97
cggcguugccgccgucccc

SEQ ID NO: 1049985 - RNA, 16 nt, Mycobacterium bovis subsp bovis AF2122/97
cggcguugccgccguu

SEQ ID NO: 1049986 - RNA, 18 nt, Mycobacterium bovis subsp bovis AF2122/97
cggcguugccgccguugc

SEQ ID NO: 1049987 - RNA, 20 nt, Mycobacterium bovis subsp bovis AF2122/97
cggcguugccgccguugccg

SEQ ID NO: 1049988 - RNA, 20 nt, Mycobacterium bovis subsp bovis AF2122/97
cggcgugucguugccagggc

SEQ ID NO: 1049989 - RNA, 22 nt, Mycobacterium bovis subsp bovis AF2122/97
cggcgugucguugccagggcgg

SEQ ID NO: 1049990 - RNA, 15 nt, Mycobacterium bovis subsp bovis AF2122/97
cggcgugucucgucg

SEQ ID NO: 1049991 - RNA, 16 nt, Mycobacterium bovis subsp bovis AF2122/97
cggcguguacgucgau

SEQ ID NO: 1049992 - RNA, 17 nt, Mycobacterium bovis subsp bovis AF2122/97
cggcgugucugcccgag

SEQ ID NO: 1049993 - RNA, 17 nt, Mycobacterium bovis subsp bovis AF2122/97
cggcguguccgccgaac

SEQ ID NO: 1049994 - RNA, 14 nt, Mycobacterium bovis subsp bovis AF2122/97
cggcgugucgaggg

SEQ ID NO: 1049995 - RNA, 15 nt, Mycobacterium bovis subsp bovis AF2122/97
cggcgugucgccgcc

SEQ ID NO: 1049996 - RNA, 17 nt, Mycobacterium bovis subsp bovis AF2122/97
cggcgugucgccgccac

SEQ ID NO: 1049997 - RNA, 16 nt, Mycobacterium bovis subsp bovis AF2122/97
cggcgugucgcgucgc

SEQ ID NO: 1049998 - RNA, 20 nt, Mycobacterium bovis subsp bovis AF2122/97
cggcguguucugaucggugg

SEQ ID NO: 1049999 - RNA, 13 nt, Mycobacterium bovis subsp bovis AF2122/97
cggcuccagcacc

SEQ ID NO: 1050000 - RNA, 14 nt, Mycobacterium bovis subsp bovis AF2122/97
cggcuccagcaccg

SEQ ID NO: 1050001 - RNA, 16 nt, Mycobacterium bovis subsp bovis AF2122/97
cggcuccagcaugggc

SEQ ID NO: 1050002 - RNA, 14 nt, Mycobacterium bovis subsp bovis AF2122/97
cggcuccaacgaug

SEQ ID NO: 1050003 - RNA, 18 nt, Mycobacterium bovis subsp bovis AF2122/97
cggcuccaacgauggaac

SEQ ID NO: 1050004 - RNA, 19 nt, Mycobacterium bovis subsp bovis AF2122/97
cggcuccaccgggcccgcc

SEQ ID NO: 1050005 - RNA, 21 nt, Mycobacterium bovis subsp bovis AF2122/97
cggcucaaccucuggcggcgg

SEQ ID NO: 1050006 - RNA, 21 nt, Mycobacterium bovis subsp bovis AF2122/97
cggcuccacuuggggcgccag

SEQ ID NO: 1050007 - RNA, 18 nt, Mycobacterium bovis subsp bovis AF2122/97
cggcucaaccucuggcgg

SEQ ID NO: 1050008 - RNA, 19 nt, Mycobacterium bovis subsp bovis AF2122/97
cggcucaaccucuggcggc

SEQ ID NO: 1050009 - RNA, 12 nt, Mycobacterium bovis subsp bovis AF2122/97
cggcuaugcugg

SEQ ID NO: 1050010 - RNA, 16 nt, Mycobacterium bovis subsp bovis AF2122/97
cggcuaugcuggcgca

SEQ ID NO: 1050011 - RNA, 20 nt, Mycobacterium bovis subsp bovis AF2122/97
cggcuaugcuggcgcagcgc

SEQ ID NO: 1050012 - RNA, 22 nt, Mycobacterium bovis subsp bovis AF2122/97
cggcuaugcuggcgcagcgcca

SEQ ID NO: 1050013 - RNA, 14 nt, Mycobacterium bovis subsp bovis AF2122/97
cggcuauggcgccg

SEQ ID NO: 1050014 - RNA, 18 nt, Mycobacterium bovis subsp bovis AF2122/97
cggcuauggcgccgcggc

SEQ ID NO: 1050015 - RNA, 18 nt, Mycobacterium bovis subsp bovis AF2122/97
cggcguuuuccgggcugu

SEQ ID NO: 1050016 - RNA, 23 nt, Mycobacterium bovis subsp bovis AF2122/97
cggcguuuucaauuucacugcga

SEQ ID NO: 1050017 - RNA, 23 nt, Mycobacterium bovis subsp bovis AF2122/97
cggcuagugugaccgucagcccg

SEQ ID NO: 1050018 - RNA, 18 nt, Mycobacterium bovis subsp bovis AF2122/97
cggcuagggcagcagccc

SEQ ID NO: 1050019 - RNA, 19 nt, Mycobacterium bovis subsp bovis AF2122/97
cggcuagggcccuggcggc

SEQ ID NO: 1050020 - RNA, 18 nt, Mycobacterium bovis subsp bovis AF2122/97
cggcuaggccagcacggc

SEQ ID NO: 1050021 - RNA, 20 nt, Mycobacterium bovis subsp bovis AF2122/97
cggcuaggccagcacggcga

SEQ ID NO: 1050022 - RNA, 23 nt, Mycobacterium bovis subsp bovis AF2122/97
cggcuaggccagcacggcgacga

SEQ ID NO: 1050023 - RNA, 19 nt, Mycobacterium bovis subsp bovis AF2122/97
cggcuaggccggccggagu

SEQ ID NO: 1050024 - RNA, 17 nt, Mycobacterium bovis subsp bovis AF2122/97
cggcguuggugcagucg

SEQ ID NO: 1050025 - RNA, 17 nt, Mycobacterium bovis subsp bovis AF2122/97
cggcguuguugaccagc

SEQ ID NO: 1050026 - RNA, 23 nt, Mycobacterium bovis subsp bovis AF2122/97
cggcguuggcgccguuaccgccg

SEQ ID NO: 1050027 - RNA, 15 nt, Mycobacterium bovis subsp bovis AF2122/97
cggcguuggcgccgu

SEQ ID NO: 1050028 - RNA, 23 nt, Mycobacterium bovis subsp bovis AF2122/97
cggcguuuagggcgauuuccauc

SEQ ID NO: 1050029 - RNA, 19 nt, Mycobacterium bovis subsp bovis AF2122/97
cggcugcccguucugccca

SEQ ID NO: 1050030 - RNA, 19 nt, Mycobacterium bovis subsp bovis AF2122/97
cggcugcccaugguggcga

SEQ ID NO: 1050031 - RNA, 13 nt, Mycobacterium bovis subsp bovis AF2122/97
cggcugccgcacc

SEQ ID NO: 1050032 - RNA, 14 nt, Mycobacterium bovis subsp bovis AF2122/97
cggcugccgcacca

SEQ ID NO: 1050033 - RNA, 13 nt, Mycobacterium bovis subsp bovis AF2122/97
cggcugccgcgcg

SEQ ID NO: 1050034 - RNA, 19 nt, Mycobacterium bovis subsp bovis AF2122/97
cggcugccgcgcgcugccg

SEQ ID NO: 1050035 - RNA, 20 nt, Mycobacterium bovis subsp bovis AF2122/97
cggcugccgcgcgcugccgc

SEQ ID NO: 1050036 - RNA, 12 nt, Mycobacterium bovis subsp bovis AF2122/97
cggcugccgcgg

SEQ ID NO: 1050037 - RNA, 13 nt, Mycobacterium bovis subsp bovis AF2122/97
cggcugccgcggc

SEQ ID NO: 1050038 - RNA, 16 nt, Mycobacterium bovis subsp bovis AF2122/97
cggcugccgcggcugc

SEQ ID NO: 1050039 - RNA, 18 nt, Mycobacterium bovis subsp bovis AF2122/97
cggcugccgcggcugcca

SEQ ID NO: 1050040 - RNA, 22 nt, Mycobacterium bovis subsp bovis AF2122/97
cggcugccgcggcugccauccc

SEQ ID NO: 1050041 - RNA, 22 nt, Mycobacterium bovis subsp bovis AF2122/97
cggcugcgccgaacaccacacc

SEQ ID NO: 1050042 - RNA, 23 nt, Mycobacterium bovis subsp bovis AF2122/97
cggcugcgccgaacaccacaccg

SEQ ID NO: 1050043 - RNA, 19 nt, Mycobacterium bovis subsp bovis AF2122/97
cggcugcgaaagccacucg

SEQ ID NO: 1050044 - RNA, 14 nt, Mycobacterium bovis subsp bovis AF2122/97
cggcugccgucagc

SEQ ID NO: 1050045 - RNA, 21 nt, Mycobacterium bovis subsp bovis AF2122/97
cggcugccucccuuccgcgcu

SEQ ID NO: 1050046 - RNA, 20 nt, Mycobacterium bovis subsp bovis AF2122/97
cggcugcgacaggacgucgg

SEQ ID NO: 1050047 - RNA, 22 nt, Mycobacterium bovis subsp bovis AF2122/97
cggcugcgcuuugcacagcggc

SEQ ID NO: 1050048 - RNA, 17 nt, Mycobacterium bovis subsp bovis AF2122/97
cggcugcggaacggguc

SEQ ID NO: 1050049 - RNA, 16 nt, Mycobacterium bovis subsp bovis AF2122/97
cggcugcggaggcggg

SEQ ID NO: 1050050 - RNA, 15 nt, Mycobacterium bovis subsp bovis AF2122/97
cggcugcggcaacga

SEQ ID NO: 1050051 - RNA, 21 nt, Mycobacterium bovis subsp bovis AF2122/97
cggcugcugcgcggugccggc

SEQ ID NO: 1050052 - RNA, 18 nt, Mycobacterium bovis subsp bovis AF2122/97
cggcugcuccgucgccga

SEQ ID NO: 1050053 - RNA, 16 nt, Mycobacterium bovis subsp bovis AF2122/97
cggcugcugcgcggug

SEQ ID NO: 1050054 - RNA, 16 nt, Mycobacterium bovis subsp bovis AF2122/97
cggcugcguuggcugg

SEQ ID NO: 1050055 - RNA, 17 nt, Mycobacterium bovis subsp bovis AF2122/97
cggcugcagccgaccga

SEQ ID NO: 1050056 - RNA, 13 nt, Mycobacterium bovis subsp bovis AF2122/97
cggcugcagccga

SEQ ID NO: 1050057 - RNA, 15 nt, Mycobacterium bovis subsp bovis AF2122/97
cggcugcagccgacc

SEQ ID NO: 1050058 - RNA, 21 nt, Mycobacterium bovis subsp bovis AF2122/97
cggcugcauccuccucgucga

SEQ ID NO: 1050059 - RNA, 21 nt, Mycobacterium bovis subsp bovis AF2122/97
cggcugccacacaggcgucca

SEQ ID NO: 1050060 - RNA, 12 nt, Mycobacterium bovis subsp bovis AF2122/97
cggcugccacgc

SEQ ID NO: 1050061 - RNA, 15 nt, Mycobacterium bovis subsp bovis AF2122/97
cggcugccacgcguc

SEQ ID NO: 1050062 - RNA, 16 nt, Mycobacterium bovis subsp bovis AF2122/97
cggcugccagcgccgc

SEQ ID NO: 1050063 - RNA, 17 nt, Mycobacterium bovis subsp bovis AF2122/97
cggcugccagcgccgcc

SEQ ID NO: 1050064 - RNA, 22 nt, Mycobacterium bovis subsp bovis AF2122/97
cggcugccagcgccgccgccga

SEQ ID NO: 1050065 - RNA, 16 nt, Mycobacterium bovis subsp bovis AF2122/97
cggcugccagugccgc

SEQ ID NO: 1050066 - RNA, 14 nt, Mycobacterium bovis subsp bovis AF2122/97
cggcugccagcgcu

SEQ ID NO: 1050067 - RNA, 16 nt, Mycobacterium bovis subsp bovis AF2122/97
cggcugaacggcagcc

SEQ ID NO: 1050068 - RNA, 17 nt, Mycobacterium bovis subsp bovis AF2122/97
cggcugaaccgcuggga

SEQ ID NO: 1050069 - RNA, 19 nt, Mycobacterium bovis subsp bovis AF2122/97
cggcucuuuuucgaucgcu

SEQ ID NO: 1050070 - RNA, 16 nt, Mycobacterium bovis subsp bovis AF2122/97
cggcugaauucggcga

SEQ ID NO: 1050071 - RNA, 17 nt, Mycobacterium bovis subsp bovis AF2122/97
cggcugaauucggcgag

SEQ ID NO: 1050072 - RNA, 15 nt, Mycobacterium bovis subsp bovis AF2122/97
cggcucuccggugau

SEQ ID NO: 1050073 - RNA, 20 nt, Mycobacterium bovis subsp bovis AF2122/97
cggcucuagaucgccgagcg

SEQ ID NO: 1050074 - RNA, 17 nt, Mycobacterium bovis subsp bovis AF2122/97
cggcucuauccggcgca

SEQ ID NO: 1050075 - RNA, 13 nt, Mycobacterium bovis subsp bovis AF2122/97
cggcucgucgcuc

SEQ ID NO: 1050076 - RNA, 13 nt, Mycobacterium bovis subsp bovis AF2122/97
cggcucgucgggc

SEQ ID NO: 1050077 - RNA, 15 nt, Mycobacterium bovis subsp bovis AF2122/97
cggcucgucagguuc

SEQ ID NO: 1050078 - RNA, 18 nt, Mycobacterium bovis subsp bovis AF2122/97
cggcucgucgauccccgc

SEQ ID NO: 1050079 - RNA, 20 nt, Mycobacterium bovis subsp bovis AF2122/97
cggcucgucgaugucgacgu

SEQ ID NO: 1050080 - RNA, 17 nt, Mycobacterium bovis subsp bovis AF2122/97
cggcucgggugcgcccg

SEQ ID NO: 1050081 - RNA, 21 nt, Mycobacterium bovis subsp bovis AF2122/97
cggcucgggugcgcccggcca

SEQ ID NO: 1050082 - RNA, 18 nt, Mycobacterium bovis subsp bovis AF2122/97
cggcucguagcuggugcg

SEQ ID NO: 1050083 - RNA, 16 nt, Mycobacterium bovis subsp bovis AF2122/97
cggcucggugcgccag

SEQ ID NO: 1050084 - RNA, 22 nt, Mycobacterium bovis subsp bovis AF2122/97
cggcuccagguccacauccagg

SEQ ID NO: 1050085 - RNA, 17 nt, Mycobacterium bovis subsp bovis AF2122/97
cggcuccgaaggccgcc

SEQ ID NO: 1050086 - RNA, 23 nt, Mycobacterium bovis subsp bovis AF2122/97
cggcuggugggacgcggccgagg

SEQ ID NO: 1050087 - RNA, 22 nt, Mycobacterium bovis subsp bovis AF2122/97
cggcuggugggggagcggccgc

SEQ ID NO: 1050088 - RNA, 23 nt, Mycobacterium bovis subsp bovis AF2122/97
cggcuggugggggagcggccgcc

SEQ ID NO: 1050089 - RNA, 19 nt, Mycobacterium bovis subsp bovis AF2122/97
cggcugguguccagccagg

SEQ ID NO: 1050090 - RNA, 20 nt, Mycobacterium bovis subsp bovis AF2122/97
cggcugguguccagccaggc

SEQ ID NO: 1050091 - RNA, 13 nt, Mycobacterium bovis subsp bovis AF2122/97
cggcuggugucgg

SEQ ID NO: 1050092 - RNA, 22 nt, Mycobacterium bovis subsp bovis AF2122/97
cggcuggugccaacugcgccgu

SEQ ID NO: 1050093 - RNA, 19 nt, Mycobacterium bovis subsp bovis AF2122/97
cggcuuagaacgugcuggu

SEQ ID NO: 1050094 - RNA, 14 nt, Mycobacterium bovis subsp bovis AF2122/97
cggcuuaccggcgg

SEQ ID NO: 1050095 - RNA, 19 nt, Mycobacterium bovis subsp bovis AF2122/97
cggcuuaaggcccuggccg

SEQ ID NO: 1050096 - RNA, 18 nt, Mycobacterium bovis subsp bovis AF2122/97
cggcuucacugagaucca

SEQ ID NO: 1050097 - RNA, 20 nt, Mycobacterium bovis subsp bovis AF2122/97
cggcuguggucgcugcugcc

SEQ ID NO: 1050098 - RNA, 16 nt, Mycobacterium bovis subsp bovis AF2122/97
cggcugucggccgggu

SEQ ID NO: 1050099 - RNA, 16 nt, Mycobacterium bovis subsp bovis AF2122/97
cggcuguucucgccga

SEQ ID NO: 1050100 - RNA, 13 nt, Mycobacterium bovis subsp bovis AF2122/97
cggcugggcgaag

SEQ ID NO: 1050101 - RNA, 20 nt, Mycobacterium bovis subsp bovis AF2122/97
cggcuggggccccgcgccgg

SEQ ID NO: 1050102 - RNA, 20 nt, Mycobacterium bovis subsp bovis AF2122/97
cggcugguccuccuucggug

SEQ ID NO: 1050103 - RNA, 20 nt, Mycobacterium bovis subsp bovis AF2122/97
cggcuggcgugcugcuagcc

SEQ ID NO: 1050104 - RNA, 23 nt, Mycobacterium bovis subsp bovis AF2122/97
cggcuggcuagcagguacucgcc

SEQ ID NO: 1050105 - RNA, 15 nt, Mycobacterium bovis subsp bovis AF2122/97
cggcuggcgucgaug

SEQ ID NO: 1050106 - RNA, 18 nt, Mycobacterium bovis subsp bovis AF2122/97
cggcuggcccagcgacca

SEQ ID NO: 1050107 - RNA, 20 nt, Mycobacterium bovis subsp bovis AF2122/97
cggcugcuuuaaccgcguca

SEQ ID NO: 1050108 - RNA, 20 nt, Mycobacterium bovis subsp bovis AF2122/97
cggcuggcccgcaugccggc

SEQ ID NO: 1050109 - RNA, 14 nt, Mycobacterium bovis subsp bovis AF2122/97
cggcuggccgcgcc

SEQ ID NO: 1050110 - RNA, 13 nt, Mycobacterium bovis subsp bovis AF2122/97
cggcuggcggccu

SEQ ID NO: 1050111 - RNA, 17 nt, Mycobacterium bovis subsp bovis AF2122/97
cgggaaauaucucggug

SEQ ID NO: 1050112 - RNA, 21 nt, Mycobacterium bovis subsp bovis AF2122/97
cgggaacaacggcguaaucgg

SEQ ID NO: 1050113 - RNA, 16 nt, Mycobacterium bovis subsp bovis AF2122/97
cgggaaaguagcgugc

SEQ ID NO: 1050114 - RNA, 23 nt, Mycobacterium bovis subsp bovis AF2122/97
cgggaaacacguucucaccacca

SEQ ID NO: 1050115 - RNA, 22 nt, Mycobacterium bovis subsp bovis AF2122/97
cgggaaacguuccagcuugucg

SEQ ID NO: 1050116 - RNA, 16 nt, Mycobacterium bovis subsp bovis AF2122/97
cgggaaaccgaggaug

SEQ ID NO: 1050117 - RNA, 13 nt, Mycobacterium bovis subsp bovis AF2122/97
cgggaaacaccgg

SEQ ID NO: 1050118 - RNA, 12 nt, Mycobacterium bovis subsp bovis AF2122/97
cggcuuuucgac

SEQ ID NO: 1050119 - RNA, 23 nt, Mycobacterium bovis subsp bovis AF2122/97
cggcuuuucgacgcuguggcucg

SEQ ID NO: 1050120 - RNA, 19 nt, Mycobacterium bovis subsp bovis AF2122/97
cggcuuuugucacaggcga

SEQ ID NO: 1050121 - RNA, 22 nt, Mycobacterium bovis subsp bovis AF2122/97
cggcuuuugucacaggcgacac

SEQ ID NO: 1050122 - RNA, 14 nt, Mycobacterium bovis subsp bovis AF2122/97
cggcuuugcuugcc

SEQ ID NO: 1050123 - RNA, 15 nt, Mycobacterium bovis subsp bovis AF2122/97
cggcuuugcuugccg

SEQ ID NO: 1050124 - RNA, 16 nt, Mycobacterium bovis subsp bovis AF2122/97
cggcuuuggccgccgu

SEQ ID NO: 1050125 - RNA, 16 nt, Mycobacterium bovis subsp bovis AF2122/97
cggcuuugagccgcuc

SEQ ID NO: 1050126 - RNA, 16 nt, Mycobacterium bovis subsp bovis AF2122/97
cggcuuugcggcgcga

SEQ ID NO: 1050127 - RNA, 19 nt, Mycobacterium bovis subsp bovis AF2122/97
cggcuuugcggcgcgacca

SEQ ID NO: 1050128 - RNA, 16 nt, Mycobacterium bovis subsp bovis AF2122/97
cggcuucgccgcgcuu

SEQ ID NO: 1050129 - RNA, 17 nt, Mycobacterium bovis subsp bovis AF2122/97
cggcuucgaccaucacc

SEQ ID NO: 1050130 - RNA, 22 nt, Mycobacterium bovis subsp bovis AF2122/97
cggcuucgaccaucaccacggc

SEQ ID NO: 1050131 - RNA, 22 nt, Mycobacterium bovis subsp bovis AF2122/97
cggcuuccccgguagcguucgg

SEQ ID NO: 1050132 - RNA, 21 nt, Mycobacterium bovis subsp bovis AF2122/97
cggcuucaguccggcccccga

SEQ ID NO: 1050133 - RNA, 18 nt, Mycobacterium bovis subsp bovis AF2122/97
cggcuuccaacucggcgg

SEQ ID NO: 1050134 - RNA, 23 nt, Mycobacterium bovis subsp bovis AF2122/97
cggcuuccaacucggcggccagc

SEQ ID NO: 1050135 - RNA, 24 nt, Mycobacterium bovis subsp bovis AF2122/97
cggcuuccaacucggcggccagcg

SEQ ID NO: 1050136 - RNA, 22 nt, Mycobacterium bovis subsp bovis AF2122/97
cggcuugggcgguagccgacga

SEQ ID NO: 1050137 - RNA, 20 nt, Mycobacterium bovis subsp bovis AF2122/97
cggcuugggcuugcgccgga

SEQ ID NO: 1050138 - RNA, 21 nt, Mycobacterium bovis subsp bovis AF2122/97
cggcuugggccaggcccagcu

SEQ ID NO: 1050139 - RNA, 15 nt, Mycobacterium bovis subsp bovis AF2122/97
cggcuugucgaccac

SEQ ID NO: 1050140 - RNA, 18 nt, Mycobacterium bovis subsp bovis AF2122/97
cggcuugucgaccacgac

SEQ ID NO: 1050141 - RNA, 19 nt, Mycobacterium bovis subsp bovis AF2122/97
cggcuuggugaaccgcgcg

SEQ ID NO: 1050142 - RNA, 14 nt, Mycobacterium bovis subsp bovis AF2122/97
cggccgcggcagcg

SEQ ID NO: 1050143 - RNA, 16 nt, Mycobacterium bovis subsp bovis AF2122/97
cggccgcggaccgcga

SEQ ID NO: 1050144 - RNA, 13 nt, Mycobacterium bovis subsp bovis AF2122/97
cggccgcggccuc

SEQ ID NO: 1050145 - RNA, 14 nt, Mycobacterium bovis subsp bovis AF2122/97
cggccgcggccucc

SEQ ID NO: 1050146 - RNA, 15 nt, Mycobacterium bovis subsp bovis AF2122/97
cggccgcggcgucgu

SEQ ID NO: 1050147 - RNA, 18 nt, Mycobacterium bovis subsp bovis AF2122/97
cggccgcggcggccccgc

SEQ ID NO: 1050148 - RNA, 20 nt, Mycobacterium bovis subsp bovis AF2122/97
cggccgcgggcgcgcaggua

SEQ ID NO: 1050149 - RNA, 16 nt, Mycobacterium bovis subsp bovis AF2122/97
cggccgcgugcucgcc

SEQ ID NO: 1050150 - RNA, 19 nt, Mycobacterium bovis subsp bovis AF2122/97
cggccgcuauggcccgggc

SEQ ID NO: 1050151 - RNA, 21 nt, Mycobacterium bovis subsp bovis AF2122/97
cggccgcuauggcccgggccg

SEQ ID NO: 1050152 - RNA, 23 nt, Mycobacterium bovis subsp bovis AF2122/97
cggccgcuauggcccgggccgaa

SEQ ID NO: 1050153 - RNA, 15 nt, Mycobacterium bovis subsp bovis AF2122/97
cggccgcucaccccg

SEQ ID NO: 1050154 - RNA, 17 nt, Mycobacterium bovis subsp bovis AF2122/97
cggccgcuggaggcggc

SEQ ID NO: 1050155 - RNA, 22 nt, Mycobacterium bovis subsp bovis AF2122/97
cggccgcucguuacgccgagca

SEQ ID NO: 1050156 - RNA, 18 nt, Mycobacterium bovis subsp bovis AF2122/97
cggccgcugccacuagca

SEQ ID NO: 1050157 - RNA, 15 nt, Mycobacterium bovis subsp bovis AF2122/97
cggccgcugggccca

SEQ ID NO: 1050158 - RNA, 13 nt, Mycobacterium bovis subsp bovis AF2122/97
cggccggacgggu

SEQ ID NO: 1050159 - RNA, 14 nt, Mycobacterium bovis subsp bovis AF2122/97
cggccgcggcuuca

SEQ ID NO: 1050160 - RNA, 16 nt, Mycobacterium bovis subsp bovis AF2122/97
cggccgcuucggcggu

SEQ ID NO: 1050161 - RNA, 14 nt, Mycobacterium bovis subsp bovis AF2122/97
cggccggcccgggu

SEQ ID NO: 1050162 - RNA, 17 nt, Mycobacterium bovis subsp bovis AF2122/97
cggccggcacgggcggg

SEQ ID NO: 1050163 - RNA, 14 nt, Mycobacterium bovis subsp bovis AF2122/97
cggccggccaggug

SEQ ID NO: 1050164 - RNA, 23 nt, Mycobacterium bovis subsp bovis AF2122/97
cggccggccagguguugacgauc

SEQ ID NO: 1050165 - RNA, 17 nt, Mycobacterium bovis subsp bovis AF2122/97
cggccgagucgauugcc

SEQ ID NO: 1050166 - RNA, 21 nt, Mycobacterium bovis subsp bovis AF2122/97
cggccgaguaccagcccaccg

SEQ ID NO: 1050167 - RNA, 21 nt, Mycobacterium bovis subsp bovis AF2122/97
cggccgagucgauugccaccg

SEQ ID NO: 1050168 - RNA, 22 nt, Mycobacterium bovis subsp bovis AF2122/97
cggccgagucgauugccaccga

SEQ ID NO: 1050169 - RNA, 18 nt, Mycobacterium bovis subsp bovis AF2122/97
cggccgauacagaucugg

SEQ ID NO: 1050170 - RNA, 16 nt, Mycobacterium bovis subsp bovis AF2122/97
cggccgauacgaagcc

SEQ ID NO: 1050171 - RNA, 14 nt, Mycobacterium bovis subsp bovis AF2122/97
cggccgccagcgca

SEQ ID NO: 1050172 - RNA, 16 nt, Mycobacterium bovis subsp bovis AF2122/97
cggccgaucagcagcu

SEQ ID NO: 1050173 - RNA, 14 nt, Mycobacterium bovis subsp bovis AF2122/97
cggccgccagcgcg

SEQ ID NO: 1050174 - RNA, 17 nt, Mycobacterium bovis subsp bovis AF2122/97
cggccgccagcgcgccg

SEQ ID NO: 1050175 - RNA, 15 nt, Mycobacterium bovis subsp bovis AF2122/97
cggccgcccgcucga

SEQ ID NO: 1050176 - RNA, 21 nt, Mycobacterium bovis subsp bovis AF2122/97
cggccgcgcgcucgagcaggc

SEQ ID NO: 1050177 - RNA, 13 nt, Mycobacterium bovis subsp bovis AF2122/97
cggccgcgcgggg

SEQ ID NO: 1050178 - RNA, 24 nt, Mycobacterium bovis subsp bovis AF2122/97
cggccgccucguacggaccgucgc

SEQ ID NO: 1050179 - RNA, 13 nt, Mycobacterium bovis subsp bovis AF2122/97
cggccgccucgua

SEQ ID NO: 1050180 - RNA, 16 nt, Mycobacterium bovis subsp bovis AF2122/97
cggccgccucguacgg

SEQ ID NO: 1050181 - RNA, 18 nt, Mycobacterium bovis subsp bovis AF2122/97
cggccgagcgcacugggg

SEQ ID NO: 1050182 - RNA, 19 nt, Mycobacterium bovis subsp bovis AF2122/97
cggccgccucguacggacc

SEQ ID NO: 1050183 - RNA, 13 nt, Mycobacterium bovis subsp bovis AF2122/97
cggccgccuaccc

SEQ ID NO: 1050184 - RNA, 21 nt, Mycobacterium bovis subsp bovis AF2122/97
cggccgccuacccguucuucg

SEQ ID NO: 1050185 - RNA, 23 nt, Mycobacterium bovis subsp bovis AF2122/97
cggccgccgggaaauaucucggu

SEQ ID NO: 1050186 - RNA, 21 nt, Mycobacterium bovis subsp bovis AF2122/97
cggccgccgaaacucaccagc

SEQ ID NO: 1050187 - RNA, 19 nt, Mycobacterium bovis subsp bovis AF2122/97
cggccgaacgccucgccgg

SEQ ID NO: 1050188 - RNA, 12 nt, Mycobacterium bovis subsp bovis AF2122/97
cggccgacaccg

SEQ ID NO: 1050189 - RNA, 21 nt, Mycobacterium bovis subsp bovis AF2122/97
cggccgaauuccucaaggucg

SEQ ID NO: 1050190 - RNA, 14 nt, Mycobacterium bovis subsp bovis AF2122/97
cggccgacaacccg

SEQ ID NO: 1050191 - RNA, 20 nt, Mycobacterium bovis subsp bovis AF2122/97
cggccgacaccgccaccacg

SEQ ID NO: 1050192 - RNA, 17 nt, Mycobacterium bovis subsp bovis AF2122/97
cggccgaaucuccgccg

SEQ ID NO: 1050193 - RNA, 20 nt, Mycobacterium bovis subsp bovis AF2122/97
cggccgaaucuccgccguga

SEQ ID NO: 1050194 - RNA, 13 nt, Mycobacterium bovis subsp bovis AF2122/97
cggccgaccgcga

SEQ ID NO: 1050195 - RNA, 14 nt, Mycobacterium bovis subsp bovis AF2122/97
cggccgaccgcgac

SEQ ID NO: 1050196 - RNA, 16 nt, Mycobacterium bovis subsp bovis AF2122/97
cggccgaccgcgaccc

SEQ ID NO: 1050197 - RNA, 21 nt, Mycobacterium bovis subsp bovis AF2122/97
cggccgacaacccggccgggc

SEQ ID NO: 1050198 - RNA, 13 nt, Mycobacterium bovis subsp bovis AF2122/97
cggccgacacgcc

SEQ ID NO: 1050199 - RNA, 14 nt, Mycobacterium bovis subsp bovis AF2122/97
cggccgacgcuggc

SEQ ID NO: 1050200 - RNA, 17 nt, Mycobacterium bovis subsp bovis AF2122/97
cggccgacgcuggcggu

SEQ ID NO: 1050201 - RNA, 15 nt, Mycobacterium bovis subsp bovis AF2122/97
cggccgaccucggca

SEQ ID NO: 1050202 - RNA, 13 nt, Mycobacterium bovis subsp bovis AF2122/97
cggccgacccgga

SEQ ID NO: 1050203 - RNA, 21 nt, Mycobacterium bovis subsp bovis AF2122/97
cggccgacuuggugaccccgu

SEQ ID NO: 1050204 - RNA, 17 nt, Mycobacterium bovis subsp bovis AF2122/97
cggccgagcugguuggc

SEQ ID NO: 1050205 - RNA, 17 nt, Mycobacterium bovis subsp bovis AF2122/97
cggccgaggucacccgg

SEQ ID NO: 1050206 - RNA, 18 nt, Mycobacterium bovis subsp bovis AF2122/97
cggccgaggucacccggu

SEQ ID NO: 1050207 - RNA, 15 nt, Mycobacterium bovis subsp bovis AF2122/97
cggccgaggucgcgg

SEQ ID NO: 1050208 - RNA, 17 nt, Mycobacterium bovis subsp bovis AF2122/97
cggccgaggucgcgguc

SEQ ID NO: 1050209 - RNA, 18 nt, Mycobacterium bovis subsp bovis AF2122/97
cggccgaggucgcggucu

SEQ ID NO: 1050210 - RNA, 23 nt, Mycobacterium bovis subsp bovis AF2122/97
cggccgagcguggccaauccggc

SEQ ID NO: 1050211 - RNA, 16 nt, Mycobacterium bovis subsp bovis AF2122/97
cggccgaggaccagag

SEQ ID NO: 1050212 - RNA, 19 nt, Mycobacterium bovis subsp bovis AF2122/97
cggccgaggaccagaggcg

SEQ ID NO: 1050213 - RNA, 16 nt, Mycobacterium bovis subsp bovis AF2122/97
cggcccuccaccggug

SEQ ID NO: 1050214 - RNA, 18 nt, Mycobacterium bovis subsp bovis AF2122/97
cggcccuacgcagcgcgg

SEQ ID NO: 1050215 - RNA, 17 nt, Mycobacterium bovis subsp bovis AF2122/97
cggcccuaucguuaucg

SEQ ID NO: 1050216 - RNA, 20 nt, Mycobacterium bovis subsp bovis AF2122/97
cggcccuaucguuaucgaca

SEQ ID NO: 1050217 - RNA, 22 nt, Mycobacterium bovis subsp bovis AF2122/97
cggcccuaucguuaucgacacc

SEQ ID NO: 1050218 - RNA, 14 nt, Mycobacterium bovis subsp bovis AF2122/97
cggcccuaaacacc

SEQ ID NO: 1050219 - RNA, 16 nt, Mycobacterium bovis subsp bovis AF2122/97
cggcccuaaacaccgc

SEQ ID NO: 1050220 - RNA, 15 nt, Mycobacterium bovis subsp bovis AF2122/97
cggcccugccgccgg

SEQ ID NO: 1050221 - RNA, 18 nt, Mycobacterium bovis subsp bovis AF2122/97
cggcccugccgccggccc

SEQ ID NO: 1050222 - RNA, 13 nt, Mycobacterium bovis subsp bovis AF2122/97
cggcccuccgggc

SEQ ID NO: 1050223 - RNA, 15 nt, Mycobacterium bovis subsp bovis AF2122/97
cggcccucgaauucg

SEQ ID NO: 1050224 - RNA, 21 nt, Mycobacterium bovis subsp bovis AF2122/97
cggcccucgaauucggccggc

SEQ ID NO: 1050225 - RNA, 22 nt, Mycobacterium bovis subsp bovis AF2122/97
cggcccugaacgguucggccgg

SEQ ID NO: 1050226 - RNA, 23 nt, Mycobacterium bovis subsp bovis AF2122/97
cggcccugaacgguucggccggg

SEQ ID NO: 1050227 - RNA, 21 nt, Mycobacterium bovis subsp bovis AF2122/97
cggcccugaccucauguccgc

SEQ ID NO: 1050228 - RNA, 22 nt, Mycobacterium bovis subsp bovis AF2122/97
cggcccguguggucccggcacg

SEQ ID NO: 1050229 - RNA, 20 nt, Mycobacterium bovis subsp bovis AF2122/97
cggcccugcucgccgucucg

SEQ ID NO: 1050230 - RNA, 14 nt, Mycobacterium bovis subsp bovis AF2122/97
cggcccggcucggu

SEQ ID NO: 1050231 - RNA, 18 nt, Mycobacterium bovis subsp bovis AF2122/97
cggcccggguaucgccag

SEQ ID NO: 1050232 - RNA, 18 nt, Mycobacterium bovis subsp bovis AF2122/97
cggcccggguuggccgaa

SEQ ID NO: 1050233 - RNA, 22 nt, Mycobacterium bovis subsp bovis AF2122/97
cggcccgugccacagcucgccg

SEQ ID NO: 1050234 - RNA, 14 nt, Mycobacterium bovis subsp bovis AF2122/97
cggcccgucaccgc

SEQ ID NO: 1050235 - RNA, 18 nt, Mycobacterium bovis subsp bovis AF2122/97
cggcccgucgcgucgacc

SEQ ID NO: 1050236 - RNA, 13 nt, Mycobacterium bovis subsp bovis AF2122/97
cggcccggugagc

SEQ ID NO: 1050237 - RNA, 14 nt, Mycobacterium bovis subsp bovis AF2122/97
cggcccgguggaca

SEQ ID NO: 1050238 - RNA, 20 nt, Mycobacterium bovis subsp bovis AF2122/97
cggcccgguuggaccacgug

SEQ ID NO: 1050239 - RNA, 21 nt, Mycobacterium bovis subsp bovis AF2122/97
cggcccggguggcccggaaca

SEQ ID NO: 1050240 - RNA, 16 nt, Mycobacterium bovis subsp bovis AF2122/97
cggcccgggucagcga

SEQ ID NO: 1050241 - RNA, 19 nt, Mycobacterium bovis subsp bovis AF2122/97
cggcccggguuggccgaac

SEQ ID NO: 1050242 - RNA, 15 nt, Mycobacterium bovis subsp bovis AF2122/97
cggcccggucuacgc

SEQ ID NO: 1050243 - RNA, 12 nt, Mycobacterium bovis subsp bovis AF2122/97
cggcccacacca

SEQ ID NO: 1050244 - RNA, 15 nt, Mycobacterium bovis subsp bovis AF2122/97
cggcccacaccagcg

SEQ ID NO: 1050245 - RNA, 16 nt, Mycobacterium bovis subsp bovis AF2122/97
cggcccacaccagcgc

SEQ ID NO: 1050246 - RNA, 15 nt, Mycobacterium bovis subsp bovis AF2122/97
cggcccacacggucg

SEQ ID NO: 1050247 - RNA, 19 nt, Mycobacterium bovis subsp bovis AF2122/97
cggcccacacggucgucgc

SEQ ID NO: 1050248 - RNA, 21 nt, Mycobacterium bovis subsp bovis AF2122/97
cggcccacacggucgucgcga

SEQ ID NO: 1050249 - RNA, 12 nt, Mycobacterium bovis subsp bovis AF2122/97
cggcccaccagg

SEQ ID NO: 1050250 - RNA, 13 nt, Mycobacterium bovis subsp bovis AF2122/97
cggcccaccgacg

SEQ ID NO: 1050251 - RNA, 19 nt, Mycobacterium bovis subsp bovis AF2122/97
cggccaugaucacaccgcu

SEQ ID NO: 1050252 - RNA, 15 nt, Mycobacterium bovis subsp bovis AF2122/97
cggccaugccuucgg

SEQ ID NO: 1050253 - RNA, 19 nt, Mycobacterium bovis subsp bovis AF2122/97
cggcccaaggaacggcguc

SEQ ID NO: 1050254 - RNA, 15 nt, Mycobacterium bovis subsp bovis AF2122/97
cggccauggcagcgc

SEQ ID NO: 1050255 - RNA, 15 nt, Mycobacterium bovis subsp bovis AF2122/97
cggcccaaccggucg

SEQ ID NO: 1050256 - RNA, 17 nt, Mycobacterium bovis subsp bovis AF2122/97
cggccaguugcacaucg

SEQ ID NO: 1050257 - RNA, 16 nt, Mycobacterium bovis subsp bovis AF2122/97
cggccaguucggccuu

SEQ ID NO: 1050258 - RNA, 17 nt, Mycobacterium bovis subsp bovis AF2122/97
cggccaguucggcggcc

SEQ ID NO: 1050259 - RNA, 13 nt, Mycobacterium bovis subsp bovis AF2122/97
cggccaguucggc

SEQ ID NO: 1050260 - RNA, 20 nt, Mycobacterium bovis subsp bovis AF2122/97
cggccaguugcacaucggug

SEQ ID NO: 1050261 - RNA, 19 nt, Mycobacterium bovis subsp bovis AF2122/97
cggccaguugguagccgcc

SEQ ID NO: 1050262 - RNA, 18 nt, Mycobacterium bovis subsp bovis AF2122/97
cggccauagcgccgcgcc

SEQ ID NO: 1050263 - RNA, 21 nt, Mycobacterium bovis subsp bovis AF2122/97
cggccauagcgccgcgcccac

SEQ ID NO: 1050264 - RNA, 19 nt, Mycobacterium bovis subsp bovis AF2122/97
cggccauagugaggccgac

SEQ ID NO: 1050265 - RNA, 21 nt, Mycobacterium bovis subsp bovis AF2122/97
cggccauagugaggccgacca

SEQ ID NO: 1050266 - RNA, 23 nt, Mycobacterium bovis subsp bovis AF2122/97
cggccauagugaggccgaccagc

SEQ ID NO: 1050267 - RNA, 14 nt, Mycobacterium bovis subsp bovis AF2122/97
cggccaucgugcgg

SEQ ID NO: 1050268 - RNA, 22 nt, Mycobacterium bovis subsp bovis AF2122/97
cggccaugaaaaucggcaagac

SEQ ID NO: 1050269 - RNA, 17 nt, Mycobacterium bovis subsp bovis AF2122/97
cggccaucugcucgugg

SEQ ID NO: 1050270 - RNA, 17 nt, Mycobacterium bovis subsp bovis AF2122/97
cggccaucgccgacacc

SEQ ID NO: 1050271 - RNA, 17 nt, Mycobacterium bovis subsp bovis AF2122/97
cggccaccugcucgucg

SEQ ID NO: 1050272 - RNA, 15 nt, Mycobacterium bovis subsp bovis AF2122/97
cggccaccuggucgg

SEQ ID NO: 1050273 - RNA, 15 nt, Mycobacterium bovis subsp bovis AF2122/97
cggccacgccggcgu

SEQ ID NO: 1050274 - RNA, 21 nt, Mycobacterium bovis subsp bovis AF2122/97
cggccagguaauugccgaccg

SEQ ID NO: 1050275 - RNA, 23 nt, Mycobacterium bovis subsp bovis AF2122/97
cggccagguaauugccgaccgcc

SEQ ID NO: 1050276 - RNA, 22 nt, Mycobacterium bovis subsp bovis AF2122/97
cggccagguauguccgccauug

SEQ ID NO: 1050277 - RNA, 18 nt, Mycobacterium bovis subsp bovis AF2122/97
cggccaccaucgccccga

SEQ ID NO: 1050278 - RNA, 17 nt, Mycobacterium bovis subsp bovis AF2122/97
cggccaggggcgcagcg

SEQ ID NO: 1050279 - RNA, 20 nt, Mycobacterium bovis subsp bovis AF2122/97
cggccaggggcgcagcgcgg

SEQ ID NO: 1050280 - RNA, 21 nt, Mycobacterium bovis subsp bovis AF2122/97
cggccaggggcgcagcgcggc

SEQ ID NO: 1050281 - RNA, 20 nt, Mycobacterium bovis subsp bovis AF2122/97
cggccaggucgagcaccggc

SEQ ID NO: 1050282 - RNA, 18 nt, Mycobacterium bovis subsp bovis AF2122/97
cggccaggucgacaccgc

SEQ ID NO: 1050283 - RNA, 14 nt, Mycobacterium bovis subsp bovis AF2122/97
cggccaggucgcga

SEQ ID NO: 1050284 - RNA, 23 nt, Mycobacterium bovis subsp bovis AF2122/97
cggccagggugcccucggccgcc

SEQ ID NO: 1050285 - RNA, 15 nt, Mycobacterium bovis subsp bovis AF2122/97
cggccagugcgcgcg

SEQ ID NO: 1050286 - RNA, 21 nt, Mycobacterium bovis subsp bovis AF2122/97
cggccagugucagcacgacga

SEQ ID NO: 1050287 - RNA, 15 nt, Mycobacterium bovis subsp bovis AF2122/97
cggccagugucagca

SEQ ID NO: 1050288 - RNA, 19 nt, Mycobacterium bovis subsp bovis AF2122/97
cggccagugucagcacgac

SEQ ID NO: 1050289 - RNA, 20 nt, Mycobacterium bovis subsp bovis AF2122/97
cggccagugucagcacgacg

SEQ ID NO: 1050290 - RNA, 16 nt, Mycobacterium bovis subsp bovis AF2122/97
cggccagugacaacgc

SEQ ID NO: 1050291 - RNA, 17 nt, Mycobacterium bovis subsp bovis AF2122/97
cggccaguccgcgcgca

SEQ ID NO: 1050292 - RNA, 19 nt, Mycobacterium bovis subsp bovis AF2122/97
cggcccggacgucggcggc

SEQ ID NO: 1050293 - RNA, 14 nt, Mycobacterium bovis subsp bovis AF2122/97
cggcccgcgggcgg

SEQ ID NO: 1050294 - RNA, 13 nt, Mycobacterium bovis subsp bovis AF2122/97
cggcccgcggucg

SEQ ID NO: 1050295 - RNA, 14 nt, Mycobacterium bovis subsp bovis AF2122/97
cggcccgcucaacg

SEQ ID NO: 1050296 - RNA, 12 nt, Mycobacterium bovis subsp bovis AF2122/97
cggcccgcucga

SEQ ID NO: 1050297 - RNA, 15 nt, Mycobacterium bovis subsp bovis AF2122/97
cggcccgcugaccau

SEQ ID NO: 1050298 - RNA, 16 nt, Mycobacterium bovis subsp bovis AF2122/97
cggcccgcucgaucgg

SEQ ID NO: 1050299 - RNA, 14 nt, Mycobacterium bovis subsp bovis AF2122/97
cggcccggcacccg

SEQ ID NO: 1050300 - RNA, 12 nt, Mycobacterium bovis subsp bovis AF2122/97
cggcccggcccg

SEQ ID NO: 1050301 - RNA, 15 nt, Mycobacterium bovis subsp bovis AF2122/97
cggcccgcagcagca

SEQ ID NO: 1050302 - RNA, 13 nt, Mycobacterium bovis subsp bovis AF2122/97
cggcccgaucggc

SEQ ID NO: 1050303 - RNA, 16 nt, Mycobacterium bovis subsp bovis AF2122/97
cggcccgaucggcaac

SEQ ID NO: 1050304 - RNA, 13 nt, Mycobacterium bovis subsp bovis AF2122/97
cggcccgccaccc

SEQ ID NO: 1050305 - RNA, 21 nt, Mycobacterium bovis subsp bovis AF2122/97
cggcccgcaaacagucggaga

SEQ ID NO: 1050306 - RNA, 19 nt, Mycobacterium bovis subsp bovis AF2122/97
cggcccgcaacgcgucggu

SEQ ID NO: 1050307 - RNA, 13 nt, Mycobacterium bovis subsp bovis AF2122/97
cggcccgccgagu

SEQ ID NO: 1050308 - RNA, 16 nt, Mycobacterium bovis subsp bovis AF2122/97
cggcccgccucggcgg

SEQ ID NO: 1050309 - RNA, 18 nt, Mycobacterium bovis subsp bovis AF2122/97
cggcccgccucggcggcg

SEQ ID NO: 1050310 - RNA, 15 nt, Mycobacterium bovis subsp bovis AF2122/97
cggcccgccguccgg

SEQ ID NO: 1050311 - RNA, 16 nt, Mycobacterium bovis subsp bovis AF2122/97
cggcccgcgaucgggc

SEQ ID NO: 1050312 - RNA, 12 nt, Mycobacterium bovis subsp bovis AF2122/97
cggcccgaugac

SEQ ID NO: 1050313 - RNA, 14 nt, Mycobacterium bovis subsp bovis AF2122/97
cggcccgauccagu

SEQ ID NO: 1050314 - RNA, 13 nt, Mycobacterium bovis subsp bovis AF2122/97
cggcccgaucacc

SEQ ID NO: 1050315 - RNA, 23 nt, Mycobacterium bovis subsp bovis AF2122/97
cggcccgaucaccauccagccca

SEQ ID NO: 1050316 - RNA, 19 nt, Mycobacterium bovis subsp bovis AF2122/97
cggcccgauagaucgcgug

SEQ ID NO: 1050317 - RNA, 15 nt, Mycobacterium bovis subsp bovis AF2122/97
cggcccgacccggcc

SEQ ID NO: 1050318 - RNA, 16 nt, Mycobacterium bovis subsp bovis AF2122/97
cggcccgacccggccg

SEQ ID NO: 1050319 - RNA, 14 nt, Mycobacterium bovis subsp bovis AF2122/97
cggcccgaggugcc

SEQ ID NO: 1050320 - RNA, 17 nt, Mycobacterium bovis subsp bovis AF2122/97
cggcccgaggugccggg

SEQ ID NO: 1050321 - RNA, 21 nt, Mycobacterium bovis subsp bovis AF2122/97
cggcccgaggugccggggccc

SEQ ID NO: 1050322 - RNA, 22 nt, Mycobacterium bovis subsp bovis AF2122/97
cggcccgaggugccggggcccc

SEQ ID NO: 1050323 - RNA, 14 nt, Mycobacterium bovis subsp bovis AF2122/97
cggcccgaggcggg

SEQ ID NO: 1050324 - RNA, 17 nt, Mycobacterium bovis subsp bovis AF2122/97
cggcccgaggcucgggc

SEQ ID NO: 1050325 - RNA, 20 nt, Mycobacterium bovis subsp bovis AF2122/97
cggcccgaggcucgggccgc

SEQ ID NO: 1050326 - RNA, 14 nt, Mycobacterium bovis subsp bovis AF2122/97
cggccccugccacg

SEQ ID NO: 1050327 - RNA, 18 nt, Mycobacterium bovis subsp bovis AF2122/97
cggcccgaauuugggcga

SEQ ID NO: 1050328 - RNA, 22 nt, Mycobacterium bovis subsp bovis AF2122/97
cggcccauucaucuugcggcag

SEQ ID NO: 1050329 - RNA, 15 nt, Mycobacterium bovis subsp bovis AF2122/97
cggccccgucgccga

SEQ ID NO: 1050330 - RNA, 16 nt, Mycobacterium bovis subsp bovis AF2122/97
cggccccgucgucuag

SEQ ID NO: 1050331 - RNA, 21 nt, Mycobacterium bovis subsp bovis AF2122/97
cggcccauaacagcuggcggc

SEQ ID NO: 1050332 - RNA, 17 nt, Mycobacterium bovis subsp bovis AF2122/97
cggcccauugucgauca

SEQ ID NO: 1050333 - RNA, 11 nt, Mycobacterium bovis subsp bovis AF2122/97
cggcccaccgg

SEQ ID NO: 1050334 - RNA, 23 nt, Mycobacterium bovis subsp bovis AF2122/97
cggcccagguccgcgugcugccg

SEQ ID NO: 1050335 - RNA, 13 nt, Mycobacterium bovis subsp bovis AF2122/97
cggcccagguugc

SEQ ID NO: 1050336 - RNA, 16 nt, Mycobacterium bovis subsp bovis AF2122/97
cggcccaucgggcgcc

SEQ ID NO: 1050337 - RNA, 19 nt, Mycobacterium bovis subsp bovis AF2122/97
cggcccaucgggcgcccau

SEQ ID NO: 1050338 - RNA, 19 nt, Mycobacterium bovis subsp bovis AF2122/97
cggcccaugaucucggcga

SEQ ID NO: 1050339 - RNA, 18 nt, Mycobacterium bovis subsp bovis AF2122/97
cggcccaugcagcggcga

SEQ ID NO: 1050340 - RNA, 19 nt, Mycobacterium bovis subsp bovis AF2122/97
cggcccaugcagcggcgaa

SEQ ID NO: 1050341 - RNA, 15 nt, Mycobacterium bovis subsp bovis AF2122/97
cggccugcucggcga

SEQ ID NO: 1050342 - RNA, 13 nt, Mycobacterium bovis subsp bovis AF2122/97
cggccugcugguc

SEQ ID NO: 1050343 - RNA, 22 nt, Mycobacterium bovis subsp bovis AF2122/97
cggccugcuggucaccaucacc

SEQ ID NO: 1050344 - RNA, 20 nt, Mycobacterium bovis subsp bovis AF2122/97
cggccugcucgggggccgac

SEQ ID NO: 1050345 - RNA, 20 nt, Mycobacterium bovis subsp bovis AF2122/97
cggccuggaucgugccgaac

SEQ ID NO: 1050346 - RNA, 16 nt, Mycobacterium bovis subsp bovis AF2122/97
cggccuggcacccggg

SEQ ID NO: 1050347 - RNA, 16 nt, Mycobacterium bovis subsp bovis AF2122/97
cggccuggccgccaga

SEQ ID NO: 1050348 - RNA, 19 nt, Mycobacterium bovis subsp bovis AF2122/97
cggccuggcaggguggggc

SEQ ID NO: 1050349 - RNA, 20 nt, Mycobacterium bovis subsp bovis AF2122/97
cggccuggcaggguggggcg

SEQ ID NO: 1050350 - RNA, 21 nt, Mycobacterium bovis subsp bovis AF2122/97
cggccugcgacacaacgggug

SEQ ID NO: 1050351 - RNA, 16 nt, Mycobacterium bovis subsp bovis AF2122/97
cggccuuggcggcggc

SEQ ID NO: 1050352 - RNA, 17 nt, Mycobacterium bovis subsp bovis AF2122/97
cggccuuggcggcggca

SEQ ID NO: 1050353 - RNA, 13 nt, Mycobacterium bovis subsp bovis AF2122/97
cggccuuggcggc

SEQ ID NO: 1050354 - RNA, 17 nt, Mycobacterium bovis subsp bovis AF2122/97
cggccuuggcggccgcg

SEQ ID NO: 1050355 - RNA, 18 nt, Mycobacterium bovis subsp bovis AF2122/97
cggccuuggcggccgcga

SEQ ID NO: 1050356 - RNA, 15 nt, Mycobacterium bovis subsp bovis AF2122/97
cggcgaacccaccgc

SEQ ID NO: 1050357 - RNA, 16 nt, Mycobacterium bovis subsp bovis AF2122/97
cggcgaaccccagcgc

SEQ ID NO: 1050358 - RNA, 15 nt, Mycobacterium bovis subsp bovis AF2122/97
cggcgaaacucgucg

SEQ ID NO: 1050359 - RNA, 19 nt, Mycobacterium bovis subsp bovis AF2122/97
cggcgaaccgucucgcccc

SEQ ID NO: 1050360 - RNA, 20 nt, Mycobacterium bovis subsp bovis AF2122/97
cggcgaacccuccgcagcua

SEQ ID NO: 1050361 - RNA, 22 nt, Mycobacterium bovis subsp bovis AF2122/97
cggccuuuuccgggucgugcga

SEQ ID NO: 1050362 - RNA, 14 nt, Mycobacterium bovis subsp bovis AF2122/97
cggccuuugucgcc

SEQ ID NO: 1050363 - RNA, 16 nt, Mycobacterium bovis subsp bovis AF2122/97
cggccuuuacccgggc

SEQ ID NO: 1050364 - RNA, 21 nt, Mycobacterium bovis subsp bovis AF2122/97
cggccuuuacccgggcggcgg

SEQ ID NO: 1050365 - RNA, 19 nt, Mycobacterium bovis subsp bovis AF2122/97
cggccuuuccagcaccccg

SEQ ID NO: 1050366 - RNA, 13 nt, Mycobacterium bovis subsp bovis AF2122/97
cggcgaccgccag

SEQ ID NO: 1050367 - RNA, 15 nt, Mycobacterium bovis subsp bovis AF2122/97
cggcgaccgacgccg

SEQ ID NO: 1050368 - RNA, 16 nt, Mycobacterium bovis subsp bovis AF2122/97
cggcgaccgacgccgg

SEQ ID NO: 1050369 - RNA, 22 nt, Mycobacterium bovis subsp bovis AF2122/97
cggcgaccgacgccggugucgg

SEQ ID NO: 1050370 - RNA, 21 nt, Mycobacterium bovis subsp bovis AF2122/97
cggcgacccggguagacaccg

SEQ ID NO: 1050371 - RNA, 16 nt, Mycobacterium bovis subsp bovis AF2122/97
cggcgacccggucacu

SEQ ID NO: 1050372 - RNA, 17 nt, Mycobacterium bovis subsp bovis AF2122/97
cggcgacccggucgcgg

SEQ ID NO: 1050373 - RNA, 21 nt, Mycobacterium bovis subsp bovis AF2122/97
cggcgacccgucccccgcacg

SEQ ID NO: 1050374 - RNA, 18 nt, Mycobacterium bovis subsp bovis AF2122/97
cggcgacagcuuggccgg

SEQ ID NO: 1050375 - RNA, 23 nt, Mycobacterium bovis subsp bovis AF2122/97
cggcgacacgccagccgugccgg

SEQ ID NO: 1050376 - RNA, 21 nt, Mycobacterium bovis subsp bovis AF2122/97
cggcgacacgccaggugaugc

SEQ ID NO: 1050377 - RNA, 17 nt, Mycobacterium bovis subsp bovis AF2122/97
cggcgacagcgcggcgg

SEQ ID NO: 1050378 - RNA, 20 nt, Mycobacterium bovis subsp bovis AF2122/97
cggcgacagcgcggcggucg

SEQ ID NO: 1050379 - RNA, 23 nt, Mycobacterium bovis subsp bovis AF2122/97
cggcgacaagccgagcccgucga

SEQ ID NO: 1050380 - RNA, 13 nt, Mycobacterium bovis subsp bovis AF2122/97
cggcgaaucggug

SEQ ID NO: 1050381 - RNA, 18 nt, Mycobacterium bovis subsp bovis AF2122/97
cggcgaaugccagugaca

SEQ ID NO: 1050382 - RNA, 22 nt, Mycobacterium bovis subsp bovis AF2122/97
cggcgaaugcgguccucgaucg

SEQ ID NO: 1050383 - RNA, 14 nt, Mycobacterium bovis subsp bovis AF2122/97
cggcgacacccugg

SEQ ID NO: 1050384 - RNA, 22 nt, Mycobacterium bovis subsp bovis AF2122/97
cggcgacacccugggugccggc

SEQ ID NO: 1050385 - RNA, 14 nt, Mycobacterium bovis subsp bovis AF2122/97
cggcgacaccgcag

SEQ ID NO: 1050386 - RNA, 17 nt, Mycobacterium bovis subsp bovis AF2122/97
cggcgacacgccagccg

SEQ ID NO: 1050387 - RNA, 21 nt, Mycobacterium bovis subsp bovis AF2122/97
cggcgacacgccagccgugcc

SEQ ID NO: 1050388 - RNA, 20 nt, Mycobacterium bovis subsp bovis AF2122/97
cggcgaagaagccggcaagc

SEQ ID NO: 1050389 - RNA, 21 nt, Mycobacterium bovis subsp bovis AF2122/97
cggcgaagaagccggcaagcg

SEQ ID NO: 1050390 - RNA, 13 nt, Mycobacterium bovis subsp bovis AF2122/97
cggcgaacggauu

SEQ ID NO: 1050391 - RNA, 19 nt, Mycobacterium bovis subsp bovis AF2122/97
cggcgaacggauucccgcc

SEQ ID NO: 1050392 - RNA, 23 nt, Mycobacterium bovis subsp bovis AF2122/97
cggcgaacggauucccgcccagc

SEQ ID NO: 1050393 - RNA, 15 nt, Mycobacterium bovis subsp bovis AF2122/97
cggcgaacgcgucca

SEQ ID NO: 1050394 - RNA, 21 nt, Mycobacterium bovis subsp bovis AF2122/97
cggcgaacgcguccagcgcgg

SEQ ID NO: 1050395 - RNA, 23 nt, Mycobacterium bovis subsp bovis AF2122/97
cggcgaacgcguccagcgcggcc

SEQ ID NO: 1050396 - RNA, 13 nt, Mycobacterium bovis subsp bovis AF2122/97
cggcgaagccggg

SEQ ID NO: 1050397 - RNA, 15 nt, Mycobacterium bovis subsp bovis AF2122/97
cggcgaagcacaccg

SEQ ID NO: 1050398 - RNA, 16 nt, Mycobacterium bovis subsp bovis AF2122/97
cggcgaagcacaccgu

SEQ ID NO: 1050399 - RNA, 23 nt, Mycobacterium bovis subsp bovis AF2122/97
cggcgaagcacaccguccgucgg

SEQ ID NO: 1050400 - RNA, 16 nt, Mycobacterium bovis subsp bovis AF2122/97
cggcgaagccggccgg

SEQ ID NO: 1050401 - RNA, 14 nt, Mycobacterium bovis subsp bovis AF2122/97
cggcgaaucgggca

SEQ ID NO: 1050402 - RNA, 15 nt, Mycobacterium bovis subsp bovis AF2122/97
cggcgaaucgggcaa

SEQ ID NO: 1050403 - RNA, 20 nt, Mycobacterium bovis subsp bovis AF2122/97
cggcgaaucgggcaaagucg

SEQ ID NO: 1050404 - RNA, 15 nt, Mycobacterium bovis subsp bovis AF2122/97
cggcgaaccggccca

SEQ ID NO: 1050405 - RNA, 18 nt, Mycobacterium bovis subsp bovis AF2122/97
cggcgaacucgcgccgag

SEQ ID NO: 1050406 - RNA, 20 nt, Mycobacterium bovis subsp bovis AF2122/97
cggcgaacucgcgccgagcc

SEQ ID NO: 1050407 - RNA, 21 nt, Mycobacterium bovis subsp bovis AF2122/97
cggcgaacugggugcggucuc

SEQ ID NO: 1050408 - RNA, 19 nt, Mycobacterium bovis subsp bovis AF2122/97
cggcgaagauaucggcacg

SEQ ID NO: 1050409 - RNA, 17 nt, Mycobacterium bovis subsp bovis AF2122/97
cggccuccaucgcgaca

SEQ ID NO: 1050410 - RNA, 14 nt, Mycobacterium bovis subsp bovis AF2122/97
cggccuccggaccg

SEQ ID NO: 1050411 - RNA, 17 nt, Mycobacterium bovis subsp bovis AF2122/97
cggccucccgggccgcc

SEQ ID NO: 1050412 - RNA, 18 nt, Mycobacterium bovis subsp bovis AF2122/97
cggccucccgggccgccg

SEQ ID NO: 1050413 - RNA, 14 nt, Mycobacterium bovis subsp bovis AF2122/97
cggccucgaugucg

SEQ ID NO: 1050414 - RNA, 12 nt, Mycobacterium bovis subsp bovis AF2122/97
cggccuccgggc

SEQ ID NO: 1050415 - RNA, 17 nt, Mycobacterium bovis subsp bovis AF2122/97
cggccucguuguagccg

SEQ ID NO: 1050416 - RNA, 18 nt, Mycobacterium bovis subsp bovis AF2122/97
cggccucuagcuugacaa

SEQ ID NO: 1050417 - RNA, 16 nt, Mycobacterium bovis subsp bovis AF2122/97
cggccucguugaccgg

SEQ ID NO: 1050418 - RNA, 20 nt, Mycobacterium bovis subsp bovis AF2122/97
cggccucgaugucgcggucg

SEQ ID NO: 1050419 - RNA, 16 nt, Mycobacterium bovis subsp bovis AF2122/97
cggccucgccggcgcg

SEQ ID NO: 1050420 - RNA, 20 nt, Mycobacterium bovis subsp bovis AF2122/97
cggccucgccggcgcgcagc

SEQ ID NO: 1050421 - RNA, 17 nt, Mycobacterium bovis subsp bovis AF2122/97
cggccucguugaccggg

SEQ ID NO: 1050422 - RNA, 20 nt, Mycobacterium bovis subsp bovis AF2122/97
cggccucuggaucacgucga

SEQ ID NO: 1050423 - RNA, 12 nt, Mycobacterium bovis subsp bovis AF2122/97
cggccugaccgg

SEQ ID NO: 1050424 - RNA, 17 nt, Mycobacterium bovis subsp bovis AF2122/97
cggccugaccggucacc

SEQ ID NO: 1050425 - RNA, 21 nt, Mycobacterium bovis subsp bovis AF2122/97
cggccugaccggucacccgug

SEQ ID NO: 1050426 - RNA, 13 nt, Mycobacterium bovis subsp bovis AF2122/97
cggccugcacggc

SEQ ID NO: 1050427 - RNA, 20 nt, Mycobacterium bovis subsp bovis AF2122/97
cggccugcacggcgcugacg

SEQ ID NO: 1050428 - RNA, 18 nt, Mycobacterium bovis subsp bovis AF2122/97
cggccugccgcucgccgg

SEQ ID NO: 1050429 - RNA, 13 nt, Mycobacterium bovis subsp bovis AF2122/97
cggccggcgcggc

SEQ ID NO: 1050430 - RNA, 12 nt, Mycobacterium bovis subsp bovis AF2122/97
cggccggcggcc

SEQ ID NO: 1050431 - RNA, 15 nt, Mycobacterium bovis subsp bovis AF2122/97
cggccggcggccgcc

SEQ ID NO: 1050432 - RNA, 17 nt, Mycobacterium bovis subsp bovis AF2122/97
cggccggcgcucgcggc

SEQ ID NO: 1050433 - RNA, 19 nt, Mycobacterium bovis subsp bovis AF2122/97
cggccggcgcucgcggcgg

SEQ ID NO: 1050434 - RNA, 20 nt, Mycobacterium bovis subsp bovis AF2122/97
cggccggcguguucugaucg

SEQ ID NO: 1050435 - RNA, 22 nt, Mycobacterium bovis subsp bovis AF2122/97
cggccguggcauguugcggacc

SEQ ID NO: 1050436 - RNA, 14 nt, Mycobacterium bovis subsp bovis AF2122/97
cggccgugccgccg

SEQ ID NO: 1050437 - RNA, 15 nt, Mycobacterium bovis subsp bovis AF2122/97
cggccgugccgccga

SEQ ID NO: 1050438 - RNA, 15 nt, Mycobacterium bovis subsp bovis AF2122/97
cggccgggacggcga

SEQ ID NO: 1050439 - RNA, 16 nt, Mycobacterium bovis subsp bovis AF2122/97
cggccguggcguggcu

SEQ ID NO: 1050440 - RNA, 22 nt, Mycobacterium bovis subsp bovis AF2122/97
cggccgugguggucucgagggu

SEQ ID NO: 1050441 - RNA, 19 nt, Mycobacterium bovis subsp bovis AF2122/97
cggccucaacacccggccg

SEQ ID NO: 1050442 - RNA, 20 nt, Mycobacterium bovis subsp bovis AF2122/97
cggccucaacacccggccga

SEQ ID NO: 1050443 - RNA, 21 nt, Mycobacterium bovis subsp bovis AF2122/97
cggccucaacacccggccgac

SEQ ID NO: 1050444 - RNA, 15 nt, Mycobacterium bovis subsp bovis AF2122/97
cggccuccccgaccu

SEQ ID NO: 1050445 - RNA, 15 nt, Mycobacterium bovis subsp bovis AF2122/97
cggccuccagcaccc

SEQ ID NO: 1050446 - RNA, 14 nt, Mycobacterium bovis subsp bovis AF2122/97
cggccgugucgggc

SEQ ID NO: 1050447 - RNA, 20 nt, Mycobacterium bovis subsp bovis AF2122/97
cggccguugggaaacaucgu

SEQ ID NO: 1050448 - RNA, 12 nt, Mycobacterium bovis subsp bovis AF2122/97
cggccguugggc

SEQ ID NO: 1050449 - RNA, 17 nt, Mycobacterium bovis subsp bovis AF2122/97
cggccuaacucgccugc

SEQ ID NO: 1050450 - RNA, 16 nt, Mycobacterium bovis subsp bovis AF2122/97
cggccguugggccacc

SEQ ID NO: 1050451 - RNA, 18 nt, Mycobacterium bovis subsp bovis AF2122/97
cggccguugggccaccgg

SEQ ID NO: 1050452 - RNA, 16 nt, Mycobacterium bovis subsp bovis AF2122/97
cggccuaggacgccgc

SEQ ID NO: 1050453 - RNA, 21 nt, Mycobacterium bovis subsp bovis AF2122/97
cggccuagggcggcggcgcga

SEQ ID NO: 1050454 - RNA, 19 nt, Mycobacterium bovis subsp bovis AF2122/97
cggccuaccgagcuacgac

SEQ ID NO: 1050455 - RNA, 18 nt, Mycobacterium bovis subsp bovis AF2122/97
cggcgauuaccggcacgc

SEQ ID NO: 1050456 - RNA, 14 nt, Mycobacterium bovis subsp bovis AF2122/97
cggcgauggucccg

SEQ ID NO: 1050457 - RNA, 16 nt, Mycobacterium bovis subsp bovis AF2122/97
cggcgauuggcuguga

SEQ ID NO: 1050458 - RNA, 15 nt, Mycobacterium bovis subsp bovis AF2122/97
cggcgauugcccgug

SEQ ID NO: 1050459 - RNA, 20 nt, Mycobacterium bovis subsp bovis AF2122/97
cggcgauugcccgugcgaug

SEQ ID NO: 1050460 - RNA, 14 nt, Mycobacterium bovis subsp bovis AF2122/97
cggcgcaccugggc

SEQ ID NO: 1050461 - RNA, 15 nt, Mycobacterium bovis subsp bovis AF2122/97
cggcgcaccugggcu

SEQ ID NO: 1050462 - RNA, 21 nt, Mycobacterium bovis subsp bovis AF2122/97
cggcgcaccugggcugccggc

SEQ ID NO: 1050463 - RNA, 14 nt, Mycobacterium bovis subsp bovis AF2122/97
cggcgcaccgucgc

SEQ ID NO: 1050464 - RNA, 20 nt, Mycobacterium bovis subsp bovis AF2122/97
cggcgcacgaaaccgcagcg

SEQ ID NO: 1050465 - RNA, 23 nt, Mycobacterium bovis subsp bovis AF2122/97
cggcgcacgaaaccgcagcgcga

SEQ ID NO: 1050466 - RNA, 20 nt, Mycobacterium bovis subsp bovis AF2122/97
cggcgcaggucgcgcaguug

SEQ ID NO: 1050467 - RNA, 15 nt, Mycobacterium bovis subsp bovis AF2122/97
cggcgcagguucucg

SEQ ID NO: 1050468 - RNA, 20 nt, Mycobacterium bovis subsp bovis AF2122/97
cggcgcaguuggcaccagcc

SEQ ID NO: 1050469 - RNA, 23 nt, Mycobacterium bovis subsp bovis AF2122/97
cggcgcaguuggcaccagccggu

SEQ ID NO: 1050470 - RNA, 15 nt, Mycobacterium bovis subsp bovis AF2122/97
cggcgcauaggcggc

SEQ ID NO: 1050471 - RNA, 20 nt, Mycobacterium bovis subsp bovis AF2122/97
cggcgcauaggcggccaucg

SEQ ID NO: 1050472 - RNA, 22 nt, Mycobacterium bovis subsp bovis AF2122/97
cggcgcaucaccacccgaccgc

SEQ ID NO: 1050473 - RNA, 18 nt, Mycobacterium bovis subsp bovis AF2122/97
cggcgcagguucucggug

SEQ ID NO: 1050474 - RNA, 13 nt, Mycobacterium bovis subsp bovis AF2122/97
cggcgcagugcga

SEQ ID NO: 1050475 - RNA, 17 nt, Mycobacterium bovis subsp bovis AF2122/97
cggcgcagugcgacucu

SEQ ID NO: 1050476 - RNA, 23 nt, Mycobacterium bovis subsp bovis AF2122/97
cggcgcagugcgacucugcgucu

SEQ ID NO: 1050477 - RNA, 17 nt, Mycobacterium bovis subsp bovis AF2122/97
cggcgcaguggugucgg

SEQ ID NO: 1050478 - RNA, 12 nt, Mycobacterium bovis subsp bovis AF2122/97
cggcgcagcugc

SEQ ID NO: 1050479 - RNA, 21 nt, Mycobacterium bovis subsp bovis AF2122/97
cggcgcagcuaacccgccacg

SEQ ID NO: 1050480 - RNA, 16 nt, Mycobacterium bovis subsp bovis AF2122/97
cggcgcagcacauccu

SEQ ID NO: 1050481 - RNA, 15 nt, Mycobacterium bovis subsp bovis AF2122/97
cggcgcagcguguug

SEQ ID NO: 1050482 - RNA, 16 nt, Mycobacterium bovis subsp bovis AF2122/97
cggcgaucaacucggg

SEQ ID NO: 1050483 - RNA, 18 nt, Mycobacterium bovis subsp bovis AF2122/97
cggcgaucaacucgggca

SEQ ID NO: 1050484 - RNA, 19 nt, Mycobacterium bovis subsp bovis AF2122/97
cggcgauauaggacgccgc

SEQ ID NO: 1050485 - RNA, 21 nt, Mycobacterium bovis subsp bovis AF2122/97
cggcgaucaacucgggcagcg

SEQ ID NO: 1050486 - RNA, 13 nt, Mycobacterium bovis subsp bovis AF2122/97
cggcgaucaagcc

SEQ ID NO: 1050487 - RNA, 20 nt, Mycobacterium bovis subsp bovis AF2122/97
cggcgaucaauugcccggca

SEQ ID NO: 1050488 - RNA, 19 nt, Mycobacterium bovis subsp bovis AF2122/97
cggcgaucggaggcccgcc

SEQ ID NO: 1050489 - RNA, 20 nt, Mycobacterium bovis subsp bovis AF2122/97
cggcgaucggaggcccgcca

SEQ ID NO: 1050490 - RNA, 15 nt, Mycobacterium bovis subsp bovis AF2122/97
cggcgaucgucaagc

SEQ ID NO: 1050491 - RNA, 19 nt, Mycobacterium bovis subsp bovis AF2122/97
cggcgaucgucaagccggg

SEQ ID NO: 1050492 - RNA, 24 nt, Mycobacterium bovis subsp bovis AF2122/97
cggcgaucgucaagccgggcacgg

SEQ ID NO: 1050493 - RNA, 19 nt, Mycobacterium bovis subsp bovis AF2122/97
cggcgaucgggcgggugaa

SEQ ID NO: 1050494 - RNA, 19 nt, Mycobacterium bovis subsp bovis AF2122/97
cggcgaucguguccaccgg

SEQ ID NO: 1050495 - RNA, 22 nt, Mycobacterium bovis subsp bovis AF2122/97
cggcgaucaccgagauggcgau

SEQ ID NO: 1050496 - RNA, 21 nt, Mycobacterium bovis subsp bovis AF2122/97
cggcgaugaugacggcggccc

SEQ ID NO: 1050497 - RNA, 18 nt, Mycobacterium bovis subsp bovis AF2122/97
cggcgaugauggcgcgau

SEQ ID NO: 1050498 - RNA, 23 nt, Mycobacterium bovis subsp bovis AF2122/97
cggcgaugucgaagccccucacc

SEQ ID NO: 1050499 - RNA, 14 nt, Mycobacterium bovis subsp bovis AF2122/97
cggcgagccgcgcc

SEQ ID NO: 1050500 - RNA, 19 nt, Mycobacterium bovis subsp bovis AF2122/97
cggcgagcgcaucggccaa

SEQ ID NO: 1050501 - RNA, 16 nt, Mycobacterium bovis subsp bovis AF2122/97
cggcgagcagacgccg

SEQ ID NO: 1050502 - RNA, 13 nt, Mycobacterium bovis subsp bovis AF2122/97
cggcgagcagggc

SEQ ID NO: 1050503 - RNA, 23 nt, Mycobacterium bovis subsp bovis AF2122/97
cggcgagccaaacuacccgccca

SEQ ID NO: 1050504 - RNA, 16 nt, Mycobacterium bovis subsp bovis AF2122/97
cggcgagcccgcaucg

SEQ ID NO: 1050505 - RNA, 14 nt, Mycobacterium bovis subsp bovis AF2122/97
cggcgagcggugau

SEQ ID NO: 1050506 - RNA, 13 nt, Mycobacterium bovis subsp bovis AF2122/97
cggcgagcgucgg

SEQ ID NO: 1050507 - RNA, 17 nt, Mycobacterium bovis subsp bovis AF2122/97
cggcgagcuccgaugcc

SEQ ID NO: 1050508 - RNA, 20 nt, Mycobacterium bovis subsp bovis AF2122/97
cggcgagcggccuccagcac

SEQ ID NO: 1050509 - RNA, 17 nt, Mycobacterium bovis subsp bovis AF2122/97
cggcgagcugcuuggcg

SEQ ID NO: 1050510 - RNA, 15 nt, Mycobacterium bovis subsp bovis AF2122/97
cggcgaggccgaacu

SEQ ID NO: 1050511 - RNA, 18 nt, Mycobacterium bovis subsp bovis AF2122/97
cggcgaggaacuggaccg

SEQ ID NO: 1050512 - RNA, 17 nt, Mycobacterium bovis subsp bovis AF2122/97
cggcgaggacgcgcccg

SEQ ID NO: 1050513 - RNA, 20 nt, Mycobacterium bovis subsp bovis AF2122/97
cggcgaggccucggcggccg

SEQ ID NO: 1050514 - RNA, 22 nt, Mycobacterium bovis subsp bovis AF2122/97
cggcgaggcgagucaccggguc

SEQ ID NO: 1050515 - RNA, 18 nt, Mycobacterium bovis subsp bovis AF2122/97
cggcgaggcggucgccga

SEQ ID NO: 1050516 - RNA, 21 nt, Mycobacterium bovis subsp bovis AF2122/97
cggcgaggucccggccgagcg

SEQ ID NO: 1050517 - RNA, 14 nt, Mycobacterium bovis subsp bovis AF2122/97
cggcgagggcgguc

SEQ ID NO: 1050518 - RNA, 14 nt, Mycobacterium bovis subsp bovis AF2122/97
cggcgagugcuguc

SEQ ID NO: 1050519 - RNA, 19 nt, Mycobacterium bovis subsp bovis AF2122/97
cggcgagucgguugucggg

SEQ ID NO: 1050520 - RNA, 22 nt, Mycobacterium bovis subsp bovis AF2122/97
cggcgaggucccggccgagcgu

SEQ ID NO: 1050521 - RNA, 20 nt, Mycobacterium bovis subsp bovis AF2122/97
cggcgaguccacaaguaccg

SEQ ID NO: 1050522 - RNA, 18 nt, Mycobacterium bovis subsp bovis AF2122/97
cggcgauaacuccgcggc

SEQ ID NO: 1050523 - RNA, 20 nt, Mycobacterium bovis subsp bovis AF2122/97
cggcgauaacuccgcggcga

SEQ ID NO: 1050524 - RNA, 12 nt, Mycobacterium bovis subsp bovis AF2122/97
cggcgauaccga

SEQ ID NO: 1050525 - RNA, 14 nt, Mycobacterium bovis subsp bovis AF2122/97
cggcgauaccgguu

SEQ ID NO: 1050526 - RNA, 17 nt, Mycobacterium bovis subsp bovis AF2122/97
cggcgaguucggcagcg

SEQ ID NO: 1050527 - RNA, 22 nt, Mycobacterium bovis subsp bovis AF2122/97
cggcgauaacuccgcggcgaac

SEQ ID NO: 1050528 - RNA, 15 nt, Mycobacterium bovis subsp bovis AF2122/97
cggcgaccugcucgc

SEQ ID NO: 1050529 - RNA, 16 nt, Mycobacterium bovis subsp bovis AF2122/97
cggcgaccucggcggc

SEQ ID NO: 1050530 - RNA, 17 nt, Mycobacterium bovis subsp bovis AF2122/97
cggcgaccucggcggcg

SEQ ID NO: 1050531 - RNA, 20 nt, Mycobacterium bovis subsp bovis AF2122/97
cggcgaccucggcggcggca

SEQ ID NO: 1050532 - RNA, 21 nt, Mycobacterium bovis subsp bovis AF2122/97
cggcgaccuccgggaugucga

SEQ ID NO: 1050533 - RNA, 17 nt, Mycobacterium bovis subsp bovis AF2122/97
cggcgaccggccggccg

SEQ ID NO: 1050534 - RNA, 13 nt, Mycobacterium bovis subsp bovis AF2122/97
cggcgaccgucga

SEQ ID NO: 1050535 - RNA, 15 nt, Mycobacterium bovis subsp bovis AF2122/97
cggcgaccgggcccc

SEQ ID NO: 1050536 - RNA, 13 nt, Mycobacterium bovis subsp bovis AF2122/97
cggcgaccggugc

SEQ ID NO: 1050537 - RNA, 20 nt, Mycobacterium bovis subsp bovis AF2122/97
cggcgaccgcgcucaccggg

SEQ ID NO: 1050538 - RNA, 17 nt, Mycobacterium bovis subsp bovis AF2122/97
cggcgaccgcgucgucc

SEQ ID NO: 1050539 - RNA, 18 nt, Mycobacterium bovis subsp bovis AF2122/97
cggcgaccuguccgguau

SEQ ID NO: 1050540 - RNA, 14 nt, Mycobacterium bovis subsp bovis AF2122/97
cggcgacgacccgg

SEQ ID NO: 1050541 - RNA, 22 nt, Mycobacterium bovis subsp bovis AF2122/97
cggcgagcaccaccccagcggc

SEQ ID NO: 1050542 - RNA, 23 nt, Mycobacterium bovis subsp bovis AF2122/97
cggcgagcaccaccccagcggcc

SEQ ID NO: 1050543 - RNA, 17 nt, Mycobacterium bovis subsp bovis AF2122/97
cggcgagcacccgcugg

SEQ ID NO: 1050544 - RNA, 21 nt, Mycobacterium bovis subsp bovis AF2122/97
cggcgagcacccgcuggucga

SEQ ID NO: 1050545 - RNA, 12 nt, Mycobacterium bovis subsp bovis AF2122/97
cggcgagcaccg

SEQ ID NO: 1050546 - RNA, 16 nt, Mycobacterium bovis subsp bovis AF2122/97
cggcgagcaccgugcc

SEQ ID NO: 1050547 - RNA, 23 nt, Mycobacterium bovis subsp bovis AF2122/97
cggcgacucgaggaccugcucgg

SEQ ID NO: 1050548 - RNA, 23 nt, Mycobacterium bovis subsp bovis AF2122/97
cggcgacuacggccucgcugggc

SEQ ID NO: 1050549 - RNA, 21 nt, Mycobacterium bovis subsp bovis AF2122/97
cggcgagagcgucaaccacgg

SEQ ID NO: 1050550 - RNA, 18 nt, Mycobacterium bovis subsp bovis AF2122/97
cggcgagaagucgcagcg

SEQ ID NO: 1050551 - RNA, 19 nt, Mycobacterium bovis subsp bovis AF2122/97
cggcgagaagucgcagcga

SEQ ID NO: 1050552 - RNA, 23 nt, Mycobacterium bovis subsp bovis AF2122/97
cggcauagaucgggucguuggcg

SEQ ID NO: 1050553 - RNA, 20 nt, Mycobacterium bovis subsp bovis AF2122/97
cggcauacucuuugugccca

SEQ ID NO: 1050554 - RNA, 17 nt, Mycobacterium bovis subsp bovis AF2122/97
cggcauacauccaggcu

SEQ ID NO: 1050555 - RNA, 23 nt, Mycobacterium bovis subsp bovis AF2122/97
cggcauacauccaggcuguggcc

SEQ ID NO: 1050556 - RNA, 21 nt, Mycobacterium bovis subsp bovis AF2122/97
cggcauacaucgccuugccca

SEQ ID NO: 1050557 - RNA, 16 nt, Mycobacterium bovis subsp bovis AF2122/97
cggcauacccaucaac

SEQ ID NO: 1050558 - RNA, 20 nt, Mycobacterium bovis subsp bovis AF2122/97
cggcauaccgaacagcaccu

SEQ ID NO: 1050559 - RNA, 14 nt, Mycobacterium bovis subsp bovis AF2122/97
cggcauagcggccc

SEQ ID NO: 1050560 - RNA, 19 nt, Mycobacterium bovis subsp bovis AF2122/97
cggcauagcggcccaucgg

SEQ ID NO: 1050561 - RNA, 19 nt, Mycobacterium bovis subsp bovis AF2122/97
cggcaucaacgcgggcgcu

SEQ ID NO: 1050562 - RNA, 22 nt, Mycobacterium bovis subsp bovis AF2122/97
cggcauagcucagaccggcgcc

SEQ ID NO: 1050563 - RNA, 20 nt, Mycobacterium bovis subsp bovis AF2122/97
cggcagugggggugguaccg

SEQ ID NO: 1050564 - RNA, 19 nt, Mycobacterium bovis subsp bovis AF2122/97
cggcauaacccuggccggu

SEQ ID NO: 1050565 - RNA, 22 nt, Mycobacterium bovis subsp bovis AF2122/97
cggcauaacccuggccggugcg

SEQ ID NO: 1050566 - RNA, 18 nt, Mycobacterium bovis subsp bovis AF2122/97
cggcaguuccugacgcca

SEQ ID NO: 1050567 - RNA, 19 nt, Mycobacterium bovis subsp bovis AF2122/97
cggcaguugaacucgacca

SEQ ID NO: 1050568 - RNA, 16 nt, Mycobacterium bovis subsp bovis AF2122/97
cggcagugccaugggc

SEQ ID NO: 1050569 - RNA, 16 nt, Mycobacterium bovis subsp bovis AF2122/97
cggcagucgcgguacc

SEQ ID NO: 1050570 - RNA, 16 nt, Mycobacterium bovis subsp bovis AF2122/97
cggcaggugcggucaa

SEQ ID NO: 1050571 - RNA, 19 nt, Mycobacterium bovis subsp bovis AF2122/97
cggcagguguuggugcggg

SEQ ID NO: 1050572 - RNA, 19 nt, Mycobacterium bovis subsp bovis AF2122/97
cggcagucccagcgccgca

SEQ ID NO: 1050573 - RNA, 23 nt, Mycobacterium bovis subsp bovis AF2122/97
cggcagucccagcgccgcacaga

SEQ ID NO: 1050574 - RNA, 20 nt, Mycobacterium bovis subsp bovis AF2122/97
cggcagucauuauucgcgca

SEQ ID NO: 1050575 - RNA, 21 nt, Mycobacterium bovis subsp bovis AF2122/97
cggcaguaccccucgcacaau

SEQ ID NO: 1050576 - RNA, 15 nt, Mycobacterium bovis subsp bovis AF2122/97
cggcagcggugcugg

SEQ ID NO: 1050577 - RNA, 16 nt, Mycobacterium bovis subsp bovis AF2122/97
cggcagcggugcuggu

SEQ ID NO: 1050578 - RNA, 22 nt, Mycobacterium bovis subsp bovis AF2122/97
cggcagcggguuugccgggcgc

SEQ ID NO: 1050579 - RNA, 20 nt, Mycobacterium bovis subsp bovis AF2122/97
cggcagcggcgcgcugcacg

SEQ ID NO: 1050580 - RNA, 14 nt, Mycobacterium bovis subsp bovis AF2122/97
cggcagcggcgguc

SEQ ID NO: 1050581 - RNA, 21 nt, Mycobacterium bovis subsp bovis AF2122/97
cggcagcggcgucgucgucga

SEQ ID NO: 1050582 - RNA, 17 nt, Mycobacterium bovis subsp bovis AF2122/97
cggcagcucggggcaca

SEQ ID NO: 1050583 - RNA, 20 nt, Mycobacterium bovis subsp bovis AF2122/97
cggcagcucccgccacgucg

SEQ ID NO: 1050584 - RNA, 19 nt, Mycobacterium bovis subsp bovis AF2122/97
cggcagcuacuaugccaac

SEQ ID NO: 1050585 - RNA, 15 nt, Mycobacterium bovis subsp bovis AF2122/97
cggcaggucgaugcu

SEQ ID NO: 1050586 - RNA, 18 nt, Mycobacterium bovis subsp bovis AF2122/97
cggcaggucuucgcuguc

SEQ ID NO: 1050587 - RNA, 14 nt, Mycobacterium bovis subsp bovis AF2122/97
cggcaggugcggcg

SEQ ID NO: 1050588 - RNA, 19 nt, Mycobacterium bovis subsp bovis AF2122/97
cggcaggugcggcggcauc

SEQ ID NO: 1050589 - RNA, 15 nt, Mycobacterium bovis subsp bovis AF2122/97
cggcaggugcgguca

SEQ ID NO: 1050590 - RNA, 22 nt, Mycobacterium bovis subsp bovis AF2122/97
cggcagguccaucuggcgcgcc

SEQ ID NO: 1050591 - RNA, 23 nt, Mycobacterium bovis subsp bovis AF2122/97
cggcagguaccaccgcggugugg

SEQ ID NO: 1050592 - RNA, 13 nt, Mycobacterium bovis subsp bovis AF2122/97
cggcagcuugcag

SEQ ID NO: 1050593 - RNA, 21 nt, Mycobacterium bovis subsp bovis AF2122/97
cggcagcuugcagugccgccg

SEQ ID NO: 1050594 - RNA, 20 nt, Mycobacterium bovis subsp bovis AF2122/97
cggcagcuggcgcagccugc

SEQ ID NO: 1050595 - RNA, 22 nt, Mycobacterium bovis subsp bovis AF2122/97
cggcagcuggcgcagccugccg

SEQ ID NO: 1050596 - RNA, 16 nt, Mycobacterium bovis subsp bovis AF2122/97
cggcagcuggucggug

SEQ ID NO: 1050597 - RNA, 16 nt, Mycobacterium bovis subsp bovis AF2122/97
cggcagcugcucgguc

SEQ ID NO: 1050598 - RNA, 17 nt, Mycobacterium bovis subsp bovis AF2122/97
cggcagcuucucgccga

SEQ ID NO: 1050599 - RNA, 20 nt, Mycobacterium bovis subsp bovis AF2122/97
cggccaaagacccggcaccc

SEQ ID NO: 1050600 - RNA, 23 nt, Mycobacterium bovis subsp bovis AF2122/97
cggccaaaauuuugucggccgcc

SEQ ID NO: 1050601 - RNA, 22 nt, Mycobacterium bovis subsp bovis AF2122/97
cggccaaaugccuuugggcugu

SEQ ID NO: 1050602 - RNA, 23 nt, Mycobacterium bovis subsp bovis AF2122/97
cggcauuuucgagguacagcggg

SEQ ID NO: 1050603 - RNA, 21 nt, Mycobacterium bovis subsp bovis AF2122/97
cggccaaaacauaucggugcc

SEQ ID NO: 1050604 - RNA, 21 nt, Mycobacterium bovis subsp bovis AF2122/97
cggccaaaauggcgcgaacgu

SEQ ID NO: 1050605 - RNA, 14 nt, Mycobacterium bovis subsp bovis AF2122/97
cggccaacccgggc

SEQ ID NO: 1050606 - RNA, 16 nt, Mycobacterium bovis subsp bovis AF2122/97
cggccaacccgggccg

SEQ ID NO: 1050607 - RNA, 19 nt, Mycobacterium bovis subsp bovis AF2122/97
cggccaacccgggccgcca

SEQ ID NO: 1050608 - RNA, 23 nt, Mycobacterium bovis subsp bovis AF2122/97
cggccaacccgggccgccagggc

SEQ ID NO: 1050609 - RNA, 17 nt, Mycobacterium bovis subsp bovis AF2122/97
cggccaacauccggugg

SEQ ID NO: 1050610 - RNA, 18 nt, Mycobacterium bovis subsp bovis AF2122/97
cggccaaccaugcugucg

SEQ ID NO: 1050611 - RNA, 22 nt, Mycobacterium bovis subsp bovis AF2122/97
cggccaaccaugcugucggugc

SEQ ID NO: 1050612 - RNA, 23 nt, Mycobacterium bovis subsp bovis AF2122/97
cggccaacccauuucgucagcga

SEQ ID NO: 1050613 - RNA, 18 nt, Mycobacterium bovis subsp bovis AF2122/97
cggccaacccguagcuga

SEQ ID NO: 1050614 - RNA, 20 nt, Mycobacterium bovis subsp bovis AF2122/97
cggccaacgacgacccguug

SEQ ID NO: 1050615 - RNA, 14 nt, Mycobacterium bovis subsp bovis AF2122/97
cggccaacgccgcc

SEQ ID NO: 1050616 - RNA, 17 nt, Mycobacterium bovis subsp bovis AF2122/97
cggccaacgccgccgca

SEQ ID NO: 1050617 - RNA, 14 nt, Mycobacterium bovis subsp bovis AF2122/97
cggccaacugggcc

SEQ ID NO: 1050618 - RNA, 20 nt, Mycobacterium bovis subsp bovis AF2122/97
cggccaacuucugcacgaac

SEQ ID NO: 1050619 - RNA, 22 nt, Mycobacterium bovis subsp bovis AF2122/97
cggccacccacauggcggcccg

SEQ ID NO: 1050620 - RNA, 19 nt, Mycobacterium bovis subsp bovis AF2122/97
cggccaccgaggcguucag

SEQ ID NO: 1050621 - RNA, 20 nt, Mycobacterium bovis subsp bovis AF2122/97
cggccacccgcaggucgcac

SEQ ID NO: 1050622 - RNA, 13 nt, Mycobacterium bovis subsp bovis AF2122/97
cggccacccgcga

SEQ ID NO: 1050623 - RNA, 15 nt, Mycobacterium bovis subsp bovis AF2122/97
cggccacccgcgcga

SEQ ID NO: 1050624 - RNA, 12 nt, Mycobacterium bovis subsp bovis AF2122/97
cggccaccugcu

SEQ ID NO: 1050625 - RNA, 16 nt, Mycobacterium bovis subsp bovis AF2122/97
cggccaccucuucucg

SEQ ID NO: 1050626 - RNA, 15 nt, Mycobacterium bovis subsp bovis AF2122/97
cggccaccagcgccu

SEQ ID NO: 1050627 - RNA, 15 nt, Mycobacterium bovis subsp bovis AF2122/97
cggccaacgacggcc

SEQ ID NO: 1050628 - RNA, 15 nt, Mycobacterium bovis subsp bovis AF2122/97
cggccaagccggcga

SEQ ID NO: 1050629 - RNA, 15 nt, Mycobacterium bovis subsp bovis AF2122/97
cggccaccagcgccc

SEQ ID NO: 1050630 - RNA, 16 nt, Mycobacterium bovis subsp bovis AF2122/97
cggccaccagcgcccg

SEQ ID NO: 1050631 - RNA, 17 nt, Mycobacterium bovis subsp bovis AF2122/97
cggccaccagggccacc

SEQ ID NO: 1050632 - RNA, 23 nt, Mycobacterium bovis subsp bovis AF2122/97
cggcaugccggucuucgcgggac

SEQ ID NO: 1050633 - RNA, 15 nt, Mycobacterium bovis subsp bovis AF2122/97
cggcaugccgccaug

SEQ ID NO: 1050634 - RNA, 23 nt, Mycobacterium bovis subsp bovis AF2122/97
cggcaugccgccaugcgcaccag

SEQ ID NO: 1050635 - RNA, 21 nt, Mycobacterium bovis subsp bovis AF2122/97
cggcaucgacugccagcgccg

SEQ ID NO: 1050636 - RNA, 16 nt, Mycobacterium bovis subsp bovis AF2122/97
cggcaugcgugccggc

SEQ ID NO: 1050637 - RNA, 20 nt, Mycobacterium bovis subsp bovis AF2122/97
cggcauugccgccguugccg

SEQ ID NO: 1050638 - RNA, 13 nt, Mycobacterium bovis subsp bovis AF2122/97
cggcauggcaggc

SEQ ID NO: 1050639 - RNA, 19 nt, Mycobacterium bovis subsp bovis AF2122/97
cggcauuucagcgcgccgc

SEQ ID NO: 1050640 - RNA, 22 nt, Mycobacterium bovis subsp bovis AF2122/97
cggcauuggcggugccgguagc

SEQ ID NO: 1050641 - RNA, 17 nt, Mycobacterium bovis subsp bovis AF2122/97
cggcauugguaccggcu

SEQ ID NO: 1050642 - RNA, 15 nt, Mycobacterium bovis subsp bovis AF2122/97
cggcaucgacugcca

SEQ ID NO: 1050643 - RNA, 17 nt, Mycobacterium bovis subsp bovis AF2122/97
cggcaucgacugccagc

SEQ ID NO: 1050644 - RNA, 20 nt, Mycobacterium bovis subsp bovis AF2122/97
cggcaucccggaacgccgcc

SEQ ID NO: 1050645 - RNA, 21 nt, Mycobacterium bovis subsp bovis AF2122/97
cggcaucgaagugcggcccgg

SEQ ID NO: 1050646 - RNA, 19 nt, Mycobacterium bovis subsp bovis AF2122/97
cggcauccucugaaccagc

SEQ ID NO: 1050647 - RNA, 23 nt, Mycobacterium bovis subsp bovis AF2122/97
cggcaucgagacgcacggccacc

SEQ ID NO: 1050648 - RNA, 17 nt, Mycobacterium bovis subsp bovis AF2122/97
cggcaugcaaugcuggc

SEQ ID NO: 1050649 - RNA, 21 nt, Mycobacterium bovis subsp bovis AF2122/97
cggcaugcaaugcuggcggcg

SEQ ID NO: 1050650 - RNA, 17 nt, Mycobacterium bovis subsp bovis AF2122/97
cggcaugccagccacga

SEQ ID NO: 1050651 - RNA, 21 nt, Mycobacterium bovis subsp bovis AF2122/97
cggcaugcccgcggugaccac

SEQ ID NO: 1050652 - RNA, 18 nt, Mycobacterium bovis subsp bovis AF2122/97
cggcaucccgccacacca

SEQ ID NO: 1050653 - RNA, 21 nt, Mycobacterium bovis subsp bovis AF2122/97
cggcaucccgccacaccaacg

SEQ ID NO: 1050654 - RNA, 14 nt, Mycobacterium bovis subsp bovis AF2122/97
cggcauccgcgggg

SEQ ID NO: 1050655 - RNA, 14 nt, Mycobacterium bovis subsp bovis AF2122/97
cggcaagggcggca

SEQ ID NO: 1050656 - RNA, 15 nt, Mycobacterium bovis subsp bovis AF2122/97
cggcaagggcuucgg

SEQ ID NO: 1050657 - RNA, 16 nt, Mycobacterium bovis subsp bovis AF2122/97
cggcaagucgacgccg

SEQ ID NO: 1050658 - RNA, 17 nt, Mycobacterium bovis subsp bovis AF2122/97
cggcaagucgacgccgc

SEQ ID NO: 1050659 - RNA, 18 nt, Mycobacterium bovis subsp bovis AF2122/97
cggcaagucgacgccgca

SEQ ID NO: 1050660 - RNA, 17 nt, Mycobacterium bovis subsp bovis AF2122/97
cggcaaggguggggccg

SEQ ID NO: 1050661 - RNA, 18 nt, Mycobacterium bovis subsp bovis AF2122/97
cggcaaggguggggccgg

SEQ ID NO: 1050662 - RNA, 19 nt, Mycobacterium bovis subsp bovis AF2122/97
cggcaaggguggggccggc

SEQ ID NO: 1050663 - RNA, 22 nt, Mycobacterium bovis subsp bovis AF2122/97
cggcaagccacgccggucgcgg

SEQ ID NO: 1050664 - RNA, 17 nt, Mycobacterium bovis subsp bovis AF2122/97
cggcaagcacaccgcca

SEQ ID NO: 1050665 - RNA, 18 nt, Mycobacterium bovis subsp bovis AF2122/97
cggcaagcacaccgccag

SEQ ID NO: 1050666 - RNA, 13 nt, Mycobacterium bovis subsp bovis AF2122/97
cggcaagcacggu

SEQ ID NO: 1050667 - RNA, 24 nt, Mycobacterium bovis subsp bovis AF2122/97
cggcaagcggaauuccgccuagga

SEQ ID NO: 1050668 - RNA, 15 nt, Mycobacterium bovis subsp bovis AF2122/97
cggcaagcgcacgcu

SEQ ID NO: 1050669 - RNA, 18 nt, Mycobacterium bovis subsp bovis AF2122/97
cggcaagcgcagacacga

SEQ ID NO: 1050670 - RNA, 20 nt, Mycobacterium bovis subsp bovis AF2122/97
cggcaagcucguccggugcg

SEQ ID NO: 1050671 - RNA, 21 nt, Mycobacterium bovis subsp bovis AF2122/97
cggcaagaguugccggaucga

SEQ ID NO: 1050672 - RNA, 15 nt, Mycobacterium bovis subsp bovis AF2122/97
cggcaagacgcgguc

SEQ ID NO: 1050673 - RNA, 19 nt, Mycobacterium bovis subsp bovis AF2122/97
cggaugcgcuuccaucgcc

SEQ ID NO: 1050674 - RNA, 21 nt, Mycobacterium bovis subsp bovis AF2122/97
cggaugcgcaaccgcggcccc

SEQ ID NO: 1050675 - RNA, 17 nt, Mycobacterium bovis subsp bovis AF2122/97
cggaugccggucggcgu

SEQ ID NO: 1050676 - RNA, 21 nt, Mycobacterium bovis subsp bovis AF2122/97
cggcaaucgacucagcccggc

SEQ ID NO: 1050677 - RNA, 20 nt, Mycobacterium bovis subsp bovis AF2122/97
cggcaaucaggucgucggug

SEQ ID NO: 1050678 - RNA, 23 nt, Mycobacterium bovis subsp bovis AF2122/97
cggcaaucaggucgucggugucu

SEQ ID NO: 1050679 - RNA, 17 nt, Mycobacterium bovis subsp bovis AF2122/97
cggcaauacccgccgcg

SEQ ID NO: 1050680 - RNA, 13 nt, Mycobacterium bovis subsp bovis AF2122/97
cggcaauaccgcc

SEQ ID NO: 1050681 - RNA, 23 nt, Mycobacterium bovis subsp bovis AF2122/97
cggcaauaccgccagcgccaccg

SEQ ID NO: 1050682 - RNA, 23 nt, Mycobacterium bovis subsp bovis AF2122/97
cggcaaucucccgaaucgugcgg

SEQ ID NO: 1050683 - RNA, 18 nt, Mycobacterium bovis subsp bovis AF2122/97
cggcaaucucgaucuugg

SEQ ID NO: 1050684 - RNA, 20 nt, Mycobacterium bovis subsp bovis AF2122/97
cggcaaugacguacgggguc

SEQ ID NO: 1050685 - RNA, 12 nt, Mycobacterium bovis subsp bovis AF2122/97
cggcaaucggcg

SEQ ID NO: 1050686 - RNA, 16 nt, Mycobacterium bovis subsp bovis AF2122/97
cggcaauggccagcac

SEQ ID NO: 1050687 - RNA, 18 nt, Mycobacterium bovis subsp bovis AF2122/97
cggcaauggccagcacca

SEQ ID NO: 1050688 - RNA, 17 nt, Mycobacterium bovis subsp bovis AF2122/97
cggcaccagaucuucga

SEQ ID NO: 1050689 - RNA, 16 nt, Mycobacterium bovis subsp bovis AF2122/97
cggcaaugccgcggcc

SEQ ID NO: 1050690 - RNA, 19 nt, Mycobacterium bovis subsp bovis AF2122/97
cggcaaugcggggcaaucc

SEQ ID NO: 1050691 - RNA, 15 nt, Mycobacterium bovis subsp bovis AF2122/97
cggcaccagcggguc

SEQ ID NO: 1050692 - RNA, 17 nt, Mycobacterium bovis subsp bovis AF2122/97
cggcaccagcgggucgg

SEQ ID NO: 1050693 - RNA, 20 nt, Mycobacterium bovis subsp bovis AF2122/97
cggcaccagcgggucggcgg

SEQ ID NO: 1050694 - RNA, 18 nt, Mycobacterium bovis subsp bovis AF2122/97
cggcaccagcggcaccgc

SEQ ID NO: 1050695 - RNA, 14 nt, Mycobacterium bovis subsp bovis AF2122/97
cggcaccagcgcgc

SEQ ID NO: 1050696 - RNA, 15 nt, Mycobacterium bovis subsp bovis AF2122/97
cggcaccagguugcc

SEQ ID NO: 1050697 - RNA, 23 nt, Mycobacterium bovis subsp bovis AF2122/97
cggcacccaaccaggccgcgaca

SEQ ID NO: 1050698 - RNA, 18 nt, Mycobacterium bovis subsp bovis AF2122/97
cggcacccacccguucgg

SEQ ID NO: 1050699 - RNA, 19 nt, Mycobacterium bovis subsp bovis AF2122/97
cggcacccacccguucggc

SEQ ID NO: 1050700 - RNA, 23 nt, Mycobacterium bovis subsp bovis AF2122/97
cggcaccgcguaauucgacuucg

SEQ ID NO: 1050701 - RNA, 15 nt, Mycobacterium bovis subsp bovis AF2122/97
cggcaccgccggugg

SEQ ID NO: 1050702 - RNA, 19 nt, Mycobacterium bovis subsp bovis AF2122/97
cggcaccgccugcgccgcc

SEQ ID NO: 1050703 - RNA, 22 nt, Mycobacterium bovis subsp bovis AF2122/97
cggcaccgccugcgccgcccgc

SEQ ID NO: 1050704 - RNA, 19 nt, Mycobacterium bovis subsp bovis AF2122/97
cggcaccgccggcaccgcc

SEQ ID NO: 1050705 - RNA, 15 nt, Mycobacterium bovis subsp bovis AF2122/97
cggcaccgccggcgc

SEQ ID NO: 1050706 - RNA, 21 nt, Mycobacterium bovis subsp bovis AF2122/97
cggcaccgccggcgccaccgu

SEQ ID NO: 1050707 - RNA, 19 nt, Mycobacterium bovis subsp bovis AF2122/97
cggcaccgccggcgcccag

SEQ ID NO: 1050708 - RNA, 14 nt, Mycobacterium bovis subsp bovis AF2122/97
cggcacccagucgg

SEQ ID NO: 1050709 - RNA, 17 nt, Mycobacterium bovis subsp bovis AF2122/97
cggcacccagucggcgc

SEQ ID NO: 1050710 - RNA, 22 nt, Mycobacterium bovis subsp bovis AF2122/97
cggcacccagucggcgccgccg

SEQ ID NO: 1050711 - RNA, 19 nt, Mycobacterium bovis subsp bovis AF2122/97
cggcaccccacgccugccg

SEQ ID NO: 1050712 - RNA, 20 nt, Mycobacterium bovis subsp bovis AF2122/97
cggcaccccacgccugccga

SEQ ID NO: 1050713 - RNA, 14 nt, Mycobacterium bovis subsp bovis AF2122/97
cggcacccccgacg

SEQ ID NO: 1050714 - RNA, 12 nt, Mycobacterium bovis subsp bovis AF2122/97
cggcaccgccgg

SEQ ID NO: 1050715 - RNA, 18 nt, Mycobacterium bovis subsp bovis AF2122/97
cggcaccgccgcccccgc

SEQ ID NO: 1050716 - RNA, 19 nt, Mycobacterium bovis subsp bovis AF2122/97
cggcacgggaaucgcucgc

SEQ ID NO: 1050717 - RNA, 16 nt, Mycobacterium bovis subsp bovis AF2122/97
cggcacggucgcccga

SEQ ID NO: 1050718 - RNA, 12 nt, Mycobacterium bovis subsp bovis AF2122/97
cggcacggugaa

SEQ ID NO: 1050719 - RNA, 12 nt, Mycobacterium bovis subsp bovis AF2122/97
cggcacgguguc

SEQ ID NO: 1050720 - RNA, 17 nt, Mycobacterium bovis subsp bovis AF2122/97
cggcacgucgcccccgg

SEQ ID NO: 1050721 - RNA, 18 nt, Mycobacterium bovis subsp bovis AF2122/97
cggcacgucgucguccca

SEQ ID NO: 1050722 - RNA, 24 nt, Mycobacterium bovis subsp bovis AF2122/97
cggcacuacgcagccguagcuggg

SEQ ID NO: 1050723 - RNA, 17 nt, Mycobacterium bovis subsp bovis AF2122/97
cggcacuagcgagccgg

SEQ ID NO: 1050724 - RNA, 21 nt, Mycobacterium bovis subsp bovis AF2122/97
cggcacuagcgagccggcgcc

SEQ ID NO: 1050725 - RNA, 13 nt, Mycobacterium bovis subsp bovis AF2122/97
cggcacgcccaca

SEQ ID NO: 1050726 - RNA, 13 nt, Mycobacterium bovis subsp bovis AF2122/97
cggcacgcacgcg

SEQ ID NO: 1050727 - RNA, 16 nt, Mycobacterium bovis subsp bovis AF2122/97
cggcacgcacgcgguu

SEQ ID NO: 1050728 - RNA, 14 nt, Mycobacterium bovis subsp bovis AF2122/97
cggcacgccauacc

SEQ ID NO: 1050729 - RNA, 15 nt, Mycobacterium bovis subsp bovis AF2122/97
cggcacgaucgccaa

SEQ ID NO: 1050730 - RNA, 13 nt, Mycobacterium bovis subsp bovis AF2122/97
cggcaccgccgcc

SEQ ID NO: 1050731 - RNA, 18 nt, Mycobacterium bovis subsp bovis AF2122/97
cggcaccgcugccgcugc

SEQ ID NO: 1050732 - RNA, 21 nt, Mycobacterium bovis subsp bovis AF2122/97
cggcaccgcugccgcugccga

SEQ ID NO: 1050733 - RNA, 14 nt, Mycobacterium bovis subsp bovis AF2122/97
cggcaccgcugccg

SEQ ID NO: 1050734 - RNA, 15 nt, Mycobacterium bovis subsp bovis AF2122/97
cggcaccgcugccgc

SEQ ID NO: 1050735 - RNA, 20 nt, Mycobacterium bovis subsp bovis AF2122/97
cggcaccgcgcccaccagcg

SEQ ID NO: 1050736 - RNA, 15 nt, Mycobacterium bovis subsp bovis AF2122/97
cggcaccgcggccag

SEQ ID NO: 1050737 - RNA, 16 nt, Mycobacterium bovis subsp bovis AF2122/97
cggcaccgcggccagc

SEQ ID NO: 1050738 - RNA, 18 nt, Mycobacterium bovis subsp bovis AF2122/97
cggcacgaaauugggcga

SEQ ID NO: 1050739 - RNA, 17 nt, Mycobacterium bovis subsp bovis AF2122/97
cggcacgaaucccccgg

SEQ ID NO: 1050740 - RNA, 13 nt, Mycobacterium bovis subsp bovis AF2122/97
cggcaccggcaac

SEQ ID NO: 1050741 - RNA, 20 nt, Mycobacterium bovis subsp bovis AF2122/97
cggcacgaaauugggcgauu

SEQ ID NO: 1050742 - RNA, 23 nt, Mycobacterium bovis subsp bovis AF2122/97
cggcacugcgaaucuccgcgcgg

SEQ ID NO: 1050743 - RNA, 15 nt, Mycobacterium bovis subsp bovis AF2122/97
cggcacugcggccag

SEQ ID NO: 1050744 - RNA, 15 nt, Mycobacterium bovis subsp bovis AF2122/97
cggcagcagaguucc

SEQ ID NO: 1050745 - RNA, 15 nt, Mycobacterium bovis subsp bovis AF2122/97
cggcagcagccggcg

SEQ ID NO: 1050746 - RNA, 15 nt, Mycobacterium bovis subsp bovis AF2122/97
cggcagcagcgggcg

SEQ ID NO: 1050747 - RNA, 15 nt, Mycobacterium bovis subsp bovis AF2122/97
cggcagcagcggugc

SEQ ID NO: 1050748 - RNA, 23 nt, Mycobacterium bovis subsp bovis AF2122/97
cggcagcagcggugcagcccgcc

SEQ ID NO: 1050749 - RNA, 15 nt, Mycobacterium bovis subsp bovis AF2122/97
cggcagcaggacacc

SEQ ID NO: 1050750 - RNA, 19 nt, Mycobacterium bovis subsp bovis AF2122/97
cggcagcaggacaccuacc

SEQ ID NO: 1050751 - RNA, 20 nt, Mycobacterium bovis subsp bovis AF2122/97
cggcagcaggacaccuaccg

SEQ ID NO: 1050752 - RNA, 16 nt, Mycobacterium bovis subsp bovis AF2122/97
cggcacggugucgcgc

SEQ ID NO: 1050753 - RNA, 15 nt, Mycobacterium bovis subsp bovis AF2122/97
cggcacgucguuggg

SEQ ID NO: 1050754 - RNA, 14 nt, Mycobacterium bovis subsp bovis AF2122/97
cggcacugaccgcg

SEQ ID NO: 1050755 - RNA, 16 nt, Mycobacterium bovis subsp bovis AF2122/97
cggcacugaccgcgau

SEQ ID NO: 1050756 - RNA, 20 nt, Mycobacterium bovis subsp bovis AF2122/97
cggcacugaccgcgaugauc

SEQ ID NO: 1050757 - RNA, 19 nt, Mycobacterium bovis subsp bovis AF2122/97
cggcacugcccagcagacc

SEQ ID NO: 1050758 - RNA, 20 nt, Mycobacterium bovis subsp bovis AF2122/97
cggcacugcccagcagacca

SEQ ID NO: 1050759 - RNA, 12 nt, Mycobacterium bovis subsp bovis AF2122/97
cggcagcggcga

SEQ ID NO: 1050760 - RNA, 15 nt, Mycobacterium bovis subsp bovis AF2122/97
cggcagcggcgaguu

SEQ ID NO: 1050761 - RNA, 13 nt, Mycobacterium bovis subsp bovis AF2122/97
cggcagcggcgau

SEQ ID NO: 1050762 - RNA, 14 nt, Mycobacterium bovis subsp bovis AF2122/97
cggcagcggcgauc

SEQ ID NO: 1050763 - RNA, 13 nt, Mycobacterium bovis subsp bovis AF2122/97
cggcagcgagacu

SEQ ID NO: 1050764 - RNA, 20 nt, Mycobacterium bovis subsp bovis AF2122/97
cggcagcgagacuucgacgc

SEQ ID NO: 1050765 - RNA, 14 nt, Mycobacterium bovis subsp bovis AF2122/97
cggcagcgcggcca

SEQ ID NO: 1050766 - RNA, 15 nt, Mycobacterium bovis subsp bovis AF2122/97
cggcagcgacgccgg

SEQ ID NO: 1050767 - RNA, 22 nt, Mycobacterium bovis subsp bovis AF2122/97
cggcagccuugaucucguccca

SEQ ID NO: 1050768 - RNA, 15 nt, Mycobacterium bovis subsp bovis AF2122/97
cggcagccgcauagg

SEQ ID NO: 1050769 - RNA, 16 nt, Mycobacterium bovis subsp bovis AF2122/97
cggcagcauauccgcc

SEQ ID NO: 1050770 - RNA, 14 nt, Mycobacterium bovis subsp bovis AF2122/97
cggcagcccggcgg

SEQ ID NO: 1050771 - RNA, 18 nt, Mycobacterium bovis subsp bovis AF2122/97
cggcagcccggcggccgc

SEQ ID NO: 1050772 - RNA, 14 nt, Mycobacterium bovis subsp bovis AF2122/97
cggcagcccgggcg

SEQ ID NO: 1050773 - RNA, 19 nt, Mycobacterium bovis subsp bovis AF2122/97
cggcagcccgggcgugggc

SEQ ID NO: 1050774 - RNA, 13 nt, Mycobacterium bovis subsp bovis AF2122/97
cggcagcccggug

SEQ ID NO: 1050775 - RNA, 16 nt, Mycobacterium bovis subsp bovis AF2122/97
cggcagcccggugugc

SEQ ID NO: 1050776 - RNA, 20 nt, Mycobacterium bovis subsp bovis AF2122/97
cggcagccggcuugggcggu

SEQ ID NO: 1050777 - RNA, 23 nt, Mycobacterium bovis subsp bovis AF2122/97
cggcagccggcuugggcgguagc

SEQ ID NO: 1050778 - RNA, 15 nt, Mycobacterium bovis subsp bovis AF2122/97
cggcagccgggcggc

SEQ ID NO: 1050779 - RNA, 18 nt, Mycobacterium bovis subsp bovis AF2122/97
cggcagccgggcggcagc

SEQ ID NO: 1050780 - RNA, 22 nt, Mycobacterium bovis subsp bovis AF2122/97
cggcagccgggcggcagcggcu

SEQ ID NO: 1050781 - RNA, 13 nt, Mycobacterium bovis subsp bovis AF2122/97
cggcagccuggcc

SEQ ID NO: 1050782 - RNA, 14 nt, Mycobacterium bovis subsp bovis AF2122/97
cggcagccuggccu

SEQ ID NO: 1050783 - RNA, 17 nt, Mycobacterium bovis subsp bovis AF2122/97
cggcagccuugaucucg

SEQ ID NO: 1050784 - RNA, 14 nt, Mycobacterium bovis subsp bovis AF2122/97
cggaccgcccgugc

SEQ ID NO: 1050785 - RNA, 12 nt, Mycobacterium bovis subsp bovis AF2122/97
cggaccgccgca

SEQ ID NO: 1050786 - RNA, 21 nt, Mycobacterium bovis subsp bovis AF2122/97
cggaccgauugucggcaacga

SEQ ID NO: 1050787 - RNA, 23 nt, Mycobacterium bovis subsp bovis AF2122/97
cggaccgauugucggcaacgacc

SEQ ID NO: 1050788 - RNA, 21 nt, Mycobacterium bovis subsp bovis AF2122/97
cggaccgauuucuuuaccagc

SEQ ID NO: 1050789 - RNA, 23 nt, Mycobacterium bovis subsp bovis AF2122/97
cggaccgauuucuuuaccagcac

SEQ ID NO: 1050790 - RNA, 14 nt, Mycobacterium bovis subsp bovis AF2122/97
cggaccgaugacga

SEQ ID NO: 1050791 - RNA, 19 nt, Mycobacterium bovis subsp bovis AF2122/97
cggacccggugacccgcug

SEQ ID NO: 1050792 - RNA, 21 nt, Mycobacterium bovis subsp bovis AF2122/97
cggacccggugacccgcuggg

SEQ ID NO: 1050793 - RNA, 20 nt, Mycobacterium bovis subsp bovis AF2122/97
cggaccgaagaccuccucgg

SEQ ID NO: 1050794 - RNA, 22 nt, Mycobacterium bovis subsp bovis AF2122/97
cggacccuuccgccgccgccgg

SEQ ID NO: 1050795 - RNA, 19 nt, Mycobacterium bovis subsp bovis AF2122/97
cggacccgacagccgcugc

SEQ ID NO: 1050796 - RNA, 18 nt, Mycobacterium bovis subsp bovis AF2122/97
cggacccgcucgcggcga

SEQ ID NO: 1050797 - RNA, 17 nt, Mycobacterium bovis subsp bovis AF2122/97
cggaccccacgaguagc

SEQ ID NO: 1050798 - RNA, 15 nt, Mycobacterium bovis subsp bovis AF2122/97
cggacccgcagcugc

SEQ ID NO: 1050799 - RNA, 20 nt, Mycobacterium bovis subsp bovis AF2122/97
cggacccgcccuugccgccg

SEQ ID NO: 1050800 - RNA, 15 nt, Mycobacterium bovis subsp bovis AF2122/97
cggacccgccggguc

SEQ ID NO: 1050801 - RNA, 21 nt, Mycobacterium bovis subsp bovis AF2122/97
cggacccgccggguccgccgg

SEQ ID NO: 1050802 - RNA, 13 nt, Mycobacterium bovis subsp bovis AF2122/97
cggacccgccgug

SEQ ID NO: 1050803 - RNA, 14 nt, Mycobacterium bovis subsp bovis AF2122/97
cggacccgcucgcg

SEQ ID NO: 1050804 - RNA, 13 nt, Mycobacterium bovis subsp bovis AF2122/97
cggacccgcccuu

SEQ ID NO: 1050805 - RNA, 13 nt, Mycobacterium bovis subsp bovis AF2122/97
cggacccgcgcgu

SEQ ID NO: 1050806 - RNA, 17 nt, Mycobacterium bovis subsp bovis AF2122/97
cggaccguggcagcugc

SEQ ID NO: 1050807 - RNA, 18 nt, Mycobacterium bovis subsp bovis AF2122/97
cggaccggcuuccccagc

SEQ ID NO: 1050808 - RNA, 16 nt, Mycobacterium bovis subsp bovis AF2122/97
cggaccgucgccggug

SEQ ID NO: 1050809 - RNA, 14 nt, Mycobacterium bovis subsp bovis AF2122/97
cggaccggcgcgcu

SEQ ID NO: 1050810 - RNA, 13 nt, Mycobacterium bovis subsp bovis AF2122/97
cggaccgcggauu

SEQ ID NO: 1050811 - RNA, 16 nt, Mycobacterium bovis subsp bovis AF2122/97
cggaccgcgucgcggg

SEQ ID NO: 1050812 - RNA, 21 nt, Mycobacterium bovis subsp bovis AF2122/97
cggaccgcuucgacgucguug

SEQ ID NO: 1050813 - RNA, 17 nt, Mycobacterium bovis subsp bovis AF2122/97
cggaccuccucgcccau

SEQ ID NO: 1050814 - RNA, 16 nt, Mycobacterium bovis subsp bovis AF2122/97
cggaccugaccggugg

SEQ ID NO: 1050815 - RNA, 17 nt, Mycobacterium bovis subsp bovis AF2122/97
cggaccugcgagaucgg

SEQ ID NO: 1050816 - RNA, 16 nt, Mycobacterium bovis subsp bovis AF2122/97
cggaccugcgccggug

SEQ ID NO: 1050817 - RNA, 16 nt, Mycobacterium bovis subsp bovis AF2122/97
cggaccuggcggcggu

SEQ ID NO: 1050818 - RNA, 22 nt, Mycobacterium bovis subsp bovis AF2122/97
cggaccugggcgacuaccggcu

SEQ ID NO: 1050819 - RNA, 14 nt, Mycobacterium bovis subsp bovis AF2122/97
cggacgaacccguu

SEQ ID NO: 1050820 - RNA, 15 nt, Mycobacterium bovis subsp bovis AF2122/97
cggaccuucggcggu

SEQ ID NO: 1050821 - RNA, 17 nt, Mycobacterium bovis subsp bovis AF2122/97
cggaccuucggcggugc

SEQ ID NO: 1050822 - RNA, 20 nt, Mycobacterium bovis subsp bovis AF2122/97
cggaccgcgacggcgccggc

SEQ ID NO: 1050823 - RNA, 17 nt, Mycobacterium bovis subsp bovis AF2122/97
cggacgaucaggguguc

SEQ ID NO: 1050824 - RNA, 19 nt, Mycobacterium bovis subsp bovis AF2122/97
cggacgcaacacccgggcg

SEQ ID NO: 1050825 - RNA, 24 nt, Mycobacterium bovis subsp bovis AF2122/97
cggacgccaugcccgcacgcucgg

SEQ ID NO: 1050826 - RNA, 15 nt, Mycobacterium bovis subsp bovis AF2122/97
cggacgcccggcgca

SEQ ID NO: 1050827 - RNA, 18 nt, Mycobacterium bovis subsp bovis AF2122/97
cggacgcccggcgcacca

SEQ ID NO: 1050828 - RNA, 22 nt, Mycobacterium bovis subsp bovis AF2122/97
cggacgccgacaaccuuggcga

SEQ ID NO: 1050829 - RNA, 15 nt, Mycobacterium bovis subsp bovis AF2122/97
cggacgacgucgggu

SEQ ID NO: 1050830 - RNA, 19 nt, Mycobacterium bovis subsp bovis AF2122/97
cggacgaaacgaucgcgcc

SEQ ID NO: 1050831 - RNA, 20 nt, Mycobacterium bovis subsp bovis AF2122/97
cggacgaaacgaucgcgcca

SEQ ID NO: 1050832 - RNA, 14 nt, Mycobacterium bovis subsp bovis AF2122/97
cggacgaucagggu

SEQ ID NO: 1050833 - RNA, 16 nt, Mycobacterium bovis subsp bovis AF2122/97
cggacggcagccgggc

SEQ ID NO: 1050834 - RNA, 18 nt, Mycobacterium bovis subsp bovis AF2122/97
cggacggcaggcuggcga

SEQ ID NO: 1050835 - RNA, 16 nt, Mycobacterium bovis subsp bovis AF2122/97
cggacgcgccggcgug

SEQ ID NO: 1050836 - RNA, 12 nt, Mycobacterium bovis subsp bovis AF2122/97
cggacgcugggc

SEQ ID NO: 1050837 - RNA, 15 nt, Mycobacterium bovis subsp bovis AF2122/97
cggacgcgcggaugg

SEQ ID NO: 1050838 - RNA, 18 nt, Mycobacterium bovis subsp bovis AF2122/97
cggacggccaucgccagc

SEQ ID NO: 1050839 - RNA, 14 nt, Mycobacterium bovis subsp bovis AF2122/97
cggacggcgucgag

SEQ ID NO: 1050840 - RNA, 15 nt, Mycobacterium bovis subsp bovis AF2122/97
cggacggcgucgagu

SEQ ID NO: 1050841 - RNA, 18 nt, Mycobacterium bovis subsp bovis AF2122/97
cggacgggaucgcccagg

SEQ ID NO: 1050842 - RNA, 12 nt, Mycobacterium bovis subsp bovis AF2122/97
cggacccaccaa

SEQ ID NO: 1050843 - RNA, 19 nt, Mycobacterium bovis subsp bovis AF2122/97
cggacccacccgcaccgcc

SEQ ID NO: 1050844 - RNA, 14 nt, Mycobacterium bovis subsp bovis AF2122/97
cggacccagcaccc

SEQ ID NO: 1050845 - RNA, 18 nt, Mycobacterium bovis subsp bovis AF2122/97
cggaccaggccgcgcgca

SEQ ID NO: 1050846 - RNA, 23 nt, Mycobacterium bovis subsp bovis AF2122/97
cggaccacuguuggugccgccac

SEQ ID NO: 1050847 - RNA, 18 nt, Mycobacterium bovis subsp bovis AF2122/97
cggaccagagugguggcg

SEQ ID NO: 1050848 - RNA, 22 nt, Mycobacterium bovis subsp bovis AF2122/97
cggaccacaccgucaccgagcc

SEQ ID NO: 1050849 - RNA, 17 nt, Mycobacterium bovis subsp bovis AF2122/97
cggaccacaucugguca

SEQ ID NO: 1050850 - RNA, 14 nt, Mycobacterium bovis subsp bovis AF2122/97
cggaccacccggcg

SEQ ID NO: 1050851 - RNA, 17 nt, Mycobacterium bovis subsp bovis AF2122/97
cggaccacccggcgcga

SEQ ID NO: 1050852 - RNA, 13 nt, Mycobacterium bovis subsp bovis AF2122/97
cggaccaccgccg

SEQ ID NO: 1050853 - RNA, 15 nt, Mycobacterium bovis subsp bovis AF2122/97
cggacagggcggcga

SEQ ID NO: 1050854 - RNA, 14 nt, Mycobacterium bovis subsp bovis AF2122/97
cggacagggcggcg

SEQ ID NO: 1050855 - RNA, 18 nt, Mycobacterium bovis subsp bovis AF2122/97
cggacagcgccuggccgg

SEQ ID NO: 1050856 - RNA, 16 nt, Mycobacterium bovis subsp bovis AF2122/97
cggacagggcggcaac

SEQ ID NO: 1050857 - RNA, 19 nt, Mycobacterium bovis subsp bovis AF2122/97
cggacagggcggcaacggc

SEQ ID NO: 1050858 - RNA, 16 nt, Mycobacterium bovis subsp bovis AF2122/97
cggacagggcggcgag

SEQ ID NO: 1050859 - RNA, 18 nt, Mycobacterium bovis subsp bovis AF2122/97
cggacagguaacgcgguu

SEQ ID NO: 1050860 - RNA, 18 nt, Mycobacterium bovis subsp bovis AF2122/97
cggacagguagucgccgg

SEQ ID NO: 1050861 - RNA, 16 nt, Mycobacterium bovis subsp bovis AF2122/97
cggacauagccgcgcu

SEQ ID NO: 1050862 - RNA, 19 nt, Mycobacterium bovis subsp bovis AF2122/97
cggacaugcgggcagcacu

SEQ ID NO: 1050863 - RNA, 15 nt, Mycobacterium bovis subsp bovis AF2122/97
cggacaccccgcacg

SEQ ID NO: 1050864 - RNA, 18 nt, Mycobacterium bovis subsp bovis AF2122/97
cggacacgaucgcgucgg

SEQ ID NO: 1050865 - RNA, 13 nt, Mycobacterium bovis subsp bovis AF2122/97
cggacacgaucgc

SEQ ID NO: 1050866 - RNA, 13 nt, Mycobacterium bovis subsp bovis AF2122/97
cggacaccucggg

SEQ ID NO: 1050867 - RNA, 12 nt, Mycobacterium bovis subsp bovis AF2122/97
cggacaccgcgg

SEQ ID NO: 1050868 - RNA, 14 nt, Mycobacterium bovis subsp bovis AF2122/97
cggacaccgcggcg

SEQ ID NO: 1050869 - RNA, 14 nt, Mycobacterium bovis subsp bovis AF2122/97
cggacaagucggca

SEQ ID NO: 1050870 - RNA, 16 nt, Mycobacterium bovis subsp bovis AF2122/97
cggacaggcccggugg

SEQ ID NO: 1050871 - RNA, 19 nt, Mycobacterium bovis subsp bovis AF2122/97
cggacaggcccgguggcgg

SEQ ID NO: 1050872 - RNA, 21 nt, Mycobacterium bovis subsp bovis AF2122/97
cggacaggcuugacugcacac

SEQ ID NO: 1050873 - RNA, 12 nt, Mycobacterium bovis subsp bovis AF2122/97
cggacagcucgc

SEQ ID NO: 1050874 - RNA, 14 nt, Mycobacterium bovis subsp bovis AF2122/97
cggacagcagccgg

SEQ ID NO: 1050875 - RNA, 22 nt, Mycobacterium bovis subsp bovis AF2122/97
cggacaaccuggggccaccaga

SEQ ID NO: 1050876 - RNA, 13 nt, Mycobacterium bovis subsp bovis AF2122/97
cgcuguaaccggu

SEQ ID NO: 1050877 - RNA, 14 nt, Mycobacterium bovis subsp bovis AF2122/97
cgcuguaaccggua

SEQ ID NO: 1050878 - RNA, 18 nt, Mycobacterium bovis subsp bovis AF2122/97
cgcugguggucagcaccc

SEQ ID NO: 1050879 - RNA, 18 nt, Mycobacterium bovis subsp bovis AF2122/97
cgcugguuggccugccgu

SEQ ID NO: 1050880 - RNA, 22 nt, Mycobacterium bovis subsp bovis AF2122/97
cgcuggugcgccacgccaccgc

SEQ ID NO: 1050881 - RNA, 19 nt, Mycobacterium bovis subsp bovis AF2122/97
cgcuggugguucccgacau

SEQ ID NO: 1050882 - RNA, 22 nt, Mycobacterium bovis subsp bovis AF2122/97
cgcugguggcggucaccacgcg

SEQ ID NO: 1050883 - RNA, 14 nt, Mycobacterium bovis subsp bovis AF2122/97
cgcuggugcacggc

SEQ ID NO: 1050884 - RNA, 17 nt, Mycobacterium bovis subsp bovis AF2122/97
cggaauggcgccggccg

SEQ ID NO: 1050885 - RNA, 22 nt, Mycobacterium bovis subsp bovis AF2122/97
cggaauggcgccggccggcgcg

SEQ ID NO: 1050886 - RNA, 19 nt, Mycobacterium bovis subsp bovis AF2122/97
cggaaucuuguugucgugc

SEQ ID NO: 1050887 - RNA, 17 nt, Mycobacterium bovis subsp bovis AF2122/97
cggaaugcccgggcccg

SEQ ID NO: 1050888 - RNA, 17 nt, Mycobacterium bovis subsp bovis AF2122/97
cggaaugaaggcaccga

SEQ ID NO: 1050889 - RNA, 17 nt, Mycobacterium bovis subsp bovis AF2122/97
cggaaucgucgcggccg

SEQ ID NO: 1050890 - RNA, 18 nt, Mycobacterium bovis subsp bovis AF2122/97
cggaaucgucgcggccgu

SEQ ID NO: 1050891 - RNA, 14 nt, Mycobacterium bovis subsp bovis AF2122/97
cgcuguagucgcgc

SEQ ID NO: 1050892 - RNA, 14 nt, Mycobacterium bovis subsp bovis AF2122/97
cggaaucggcggcg

SEQ ID NO: 1050893 - RNA, 12 nt, Mycobacterium bovis subsp bovis AF2122/97
cggaaucgucgc

SEQ ID NO: 1050894 - RNA, 20 nt, Mycobacterium bovis subsp bovis AF2122/97
cgcuguaggccagcccggcg

SEQ ID NO: 1050895 - RNA, 14 nt, Mycobacterium bovis subsp bovis AF2122/97
cgcuguaggcagcc

SEQ ID NO: 1050896 - RNA, 20 nt, Mycobacterium bovis subsp bovis AF2122/97
cggacaaagccgucgcgacg

SEQ ID NO: 1050897 - RNA, 19 nt, Mycobacterium bovis subsp bovis AF2122/97
cggacaaagcugcucgucg

SEQ ID NO: 1050898 - RNA, 17 nt, Mycobacterium bovis subsp bovis AF2122/97
cggaauggaggccgccg

SEQ ID NO: 1050899 - RNA, 20 nt, Mycobacterium bovis subsp bovis AF2122/97
cggaauguaguccagcucgc

SEQ ID NO: 1050900 - RNA, 13 nt, Mycobacterium bovis subsp bovis AF2122/97
cggaaugggcgcc

SEQ ID NO: 1050901 - RNA, 22 nt, Mycobacterium bovis subsp bovis AF2122/97
cggaaugggcgccacagccgua

SEQ ID NO: 1050902 - RNA, 15 nt, Mycobacterium bovis subsp bovis AF2122/97
cggaauucgguuggc

SEQ ID NO: 1050903 - RNA, 19 nt, Mycobacterium bovis subsp bovis AF2122/97
cggagaugaucauguggug

SEQ ID NO: 1050904 - RNA, 14 nt, Mycobacterium bovis subsp bovis AF2122/97
cggagaucgucgcg

SEQ ID NO: 1050905 - RNA, 18 nt, Mycobacterium bovis subsp bovis AF2122/97
cggagaguaggaccucgg

SEQ ID NO: 1050906 - RNA, 12 nt, Mycobacterium bovis subsp bovis AF2122/97
cggagccgagcc

SEQ ID NO: 1050907 - RNA, 17 nt, Mycobacterium bovis subsp bovis AF2122/97
cggagccaggacgacgc

SEQ ID NO: 1050908 - RNA, 18 nt, Mycobacterium bovis subsp bovis AF2122/97
cggagccaaugucuacgc

SEQ ID NO: 1050909 - RNA, 23 nt, Mycobacterium bovis subsp bovis AF2122/97
cggagccacucggcccggcagga

SEQ ID NO: 1050910 - RNA, 23 nt, Mycobacterium bovis subsp bovis AF2122/97
cggagaugccauuucgucgucgc

SEQ ID NO: 1050911 - RNA, 17 nt, Mycobacterium bovis subsp bovis AF2122/97
cggagcagcucacuggu

SEQ ID NO: 1050912 - RNA, 14 nt, Mycobacterium bovis subsp bovis AF2122/97
cggagcacccgggg

SEQ ID NO: 1050913 - RNA, 16 nt, Mycobacterium bovis subsp bovis AF2122/97
cggagcgggugcgggc

SEQ ID NO: 1050914 - RNA, 18 nt, Mycobacterium bovis subsp bovis AF2122/97
cggagcgggugcgggcgu

SEQ ID NO: 1050915 - RNA, 15 nt, Mycobacterium bovis subsp bovis AF2122/97
cggagcggugccgac

SEQ ID NO: 1050916 - RNA, 19 nt, Mycobacterium bovis subsp bovis AF2122/97
cggagcgccgagcucggcg

SEQ ID NO: 1050917 - RNA, 21 nt, Mycobacterium bovis subsp bovis AF2122/97
cggagcgccgagcucggcgcc

SEQ ID NO: 1050918 - RNA, 14 nt, Mycobacterium bovis subsp bovis AF2122/97
cggagcgccgagcu

SEQ ID NO: 1050919 - RNA, 13 nt, Mycobacterium bovis subsp bovis AF2122/97
cggagcgauccgg

SEQ ID NO: 1050920 - RNA, 15 nt, Mycobacterium bovis subsp bovis AF2122/97
cggagcgauccggca

SEQ ID NO: 1050921 - RNA, 23 nt, Mycobacterium bovis subsp bovis AF2122/97
cggagccgucgagcagccgagcu

SEQ ID NO: 1050922 - RNA, 23 nt, Mycobacterium bovis subsp bovis AF2122/97
cggagcgcauuuguugcugcugc

SEQ ID NO: 1050923 - RNA, 21 nt, Mycobacterium bovis subsp bovis AF2122/97
cggagccccugucaacgccgc

SEQ ID NO: 1050924 - RNA, 19 nt, Mycobacterium bovis subsp bovis AF2122/97
cggagccgaugaucgaaca

SEQ ID NO: 1050925 - RNA, 22 nt, Mycobacterium bovis subsp bovis AF2122/97
cggagccgccaggugcucgucg

SEQ ID NO: 1050926 - RNA, 23 nt, Mycobacterium bovis subsp bovis AF2122/97
cggagccgccaggugcucgucga

SEQ ID NO: 1050927 - RNA, 22 nt, Mycobacterium bovis subsp bovis AF2122/97
cggagccgcccaagccgccggc

SEQ ID NO: 1050928 - RNA, 12 nt, Mycobacterium bovis subsp bovis AF2122/97
cggagccgccga

SEQ ID NO: 1050929 - RNA, 12 nt, Mycobacterium bovis subsp bovis AF2122/97
cggagccgccgc

SEQ ID NO: 1050930 - RNA, 14 nt, Mycobacterium bovis subsp bovis AF2122/97
cggagccgccgcug

SEQ ID NO: 1050931 - RNA, 16 nt, Mycobacterium bovis subsp bovis AF2122/97
cggagccgccgcuggu

SEQ ID NO: 1050932 - RNA, 18 nt, Mycobacterium bovis subsp bovis AF2122/97
cggagccgccgcuggucu

SEQ ID NO: 1050933 - RNA, 18 nt, Mycobacterium bovis subsp bovis AF2122/97
cggagccucgaacaucgg

SEQ ID NO: 1050934 - RNA, 13 nt, Mycobacterium bovis subsp bovis AF2122/97
cggagccgcccaa

SEQ ID NO: 1050935 - RNA, 20 nt, Mycobacterium bovis subsp bovis AF2122/97
cggagccgcccaagccgccg

SEQ ID NO: 1050936 - RNA, 16 nt, Mycobacterium bovis subsp bovis AF2122/97
cggagccggugccgac

SEQ ID NO: 1050937 - RNA, 13 nt, Mycobacterium bovis subsp bovis AF2122/97
cggagccggcgca

SEQ ID NO: 1050938 - RNA, 14 nt, Mycobacterium bovis subsp bovis AF2122/97
cggagccgggcagu

SEQ ID NO: 1050939 - RNA, 12 nt, Mycobacterium bovis subsp bovis AF2122/97
cggagccgggug

SEQ ID NO: 1050940 - RNA, 16 nt, Mycobacterium bovis subsp bovis AF2122/97
cggacggguuacucgc

SEQ ID NO: 1050941 - RNA, 23 nt, Mycobacterium bovis subsp bovis AF2122/97
cggacgggaucgcccaggcgcga

SEQ ID NO: 1050942 - RNA, 14 nt, Mycobacterium bovis subsp bovis AF2122/97
cggacgucggcggc

SEQ ID NO: 1050943 - RNA, 16 nt, Mycobacterium bovis subsp bovis AF2122/97
cggacgucggcggccg

SEQ ID NO: 1050944 - RNA, 17 nt, Mycobacterium bovis subsp bovis AF2122/97
cggacgucggcggccgu

SEQ ID NO: 1050945 - RNA, 13 nt, Mycobacterium bovis subsp bovis AF2122/97
cggacgugccggg

SEQ ID NO: 1050946 - RNA, 20 nt, Mycobacterium bovis subsp bovis AF2122/97
cggacgugccgggucaccga

SEQ ID NO: 1050947 - RNA, 20 nt, Mycobacterium bovis subsp bovis AF2122/97
cggacucccucgaucacggc

SEQ ID NO: 1050948 - RNA, 14 nt, Mycobacterium bovis subsp bovis AF2122/97
cggacuccggccgg

SEQ ID NO: 1050949 - RNA, 18 nt, Mycobacterium bovis subsp bovis AF2122/97
cggacucacgaggcacaa

SEQ ID NO: 1050950 - RNA, 19 nt, Mycobacterium bovis subsp bovis AF2122/97
cggacguggucggagcggg

SEQ ID NO: 1050951 - RNA, 13 nt, Mycobacterium bovis subsp bovis AF2122/97
cggacuaccgccg

SEQ ID NO: 1050952 - RNA, 15 nt, Mycobacterium bovis subsp bovis AF2122/97
cggacuaccgccggc

SEQ ID NO: 1050953 - RNA, 16 nt, Mycobacterium bovis subsp bovis AF2122/97
cggacuaccgccggcg

SEQ ID NO: 1050954 - RNA, 17 nt, Mycobacterium bovis subsp bovis AF2122/97
cggacuaccgccggcgg

SEQ ID NO: 1050955 - RNA, 23 nt, Mycobacterium bovis subsp bovis AF2122/97
cggacugcgaaaauccgugccga

SEQ ID NO: 1050956 - RNA, 19 nt, Mycobacterium bovis subsp bovis AF2122/97
cggacugcggaacaccagc

SEQ ID NO: 1050957 - RNA, 19 nt, Mycobacterium bovis subsp bovis AF2122/97
cggacugcagcgcggccgg

SEQ ID NO: 1050958 - RNA, 20 nt, Mycobacterium bovis subsp bovis AF2122/97
cggacugcagcgcggccgga

SEQ ID NO: 1050959 - RNA, 18 nt, Mycobacterium bovis subsp bovis AF2122/97
cggacucggaauucggcg

SEQ ID NO: 1050960 - RNA, 22 nt, Mycobacterium bovis subsp bovis AF2122/97
cggacucggaauucggcgucgu

SEQ ID NO: 1050961 - RNA, 15 nt, Mycobacterium bovis subsp bovis AF2122/97
cggacugcagcgcgg

SEQ ID NO: 1050962 - RNA, 23 nt, Mycobacterium bovis subsp bovis AF2122/97
cggacugcggcccgacccggccg

SEQ ID NO: 1050963 - RNA, 16 nt, Mycobacterium bovis subsp bovis AF2122/97
cggagacgucgccgca

SEQ ID NO: 1050964 - RNA, 16 nt, Mycobacterium bovis subsp bovis AF2122/97
cggagacgaucgccag

SEQ ID NO: 1050965 - RNA, 20 nt, Mycobacterium bovis subsp bovis AF2122/97
cggagacgaucgccaggccg

SEQ ID NO: 1050966 - RNA, 19 nt, Mycobacterium bovis subsp bovis AF2122/97
cggagacuccagcaaggcc

SEQ ID NO: 1050967 - RNA, 16 nt, Mycobacterium bovis subsp bovis AF2122/97
cggagacccgggugcu

SEQ ID NO: 1050968 - RNA, 15 nt, Mycobacterium bovis subsp bovis AF2122/97
cggagacccguccgg

SEQ ID NO: 1050969 - RNA, 16 nt, Mycobacterium bovis subsp bovis AF2122/97
cggagaccccgcgcgc

SEQ ID NO: 1050970 - RNA, 17 nt, Mycobacterium bovis subsp bovis AF2122/97
cggagacacccgccagg

SEQ ID NO: 1050971 - RNA, 14 nt, Mycobacterium bovis subsp bovis AF2122/97
cggagaccagcucg

SEQ ID NO: 1050972 - RNA, 21 nt, Mycobacterium bovis subsp bovis AF2122/97
cggagaaggcgcgggcgacgu

SEQ ID NO: 1050973 - RNA, 23 nt, Mycobacterium bovis subsp bovis AF2122/97
cggagaauagaucagggcucgcu

SEQ ID NO: 1050974 - RNA, 22 nt, Mycobacterium bovis subsp bovis AF2122/97
cggagaaguucgugagcgaacg

SEQ ID NO: 1050975 - RNA, 21 nt, Mycobacterium bovis subsp bovis AF2122/97
cggacuuuaaaccgaacccac

SEQ ID NO: 1050976 - RNA, 14 nt, Mycobacterium bovis subsp bovis AF2122/97
cggacuugcgagcc

SEQ ID NO: 1050977 - RNA, 15 nt, Mycobacterium bovis subsp bovis AF2122/97
cggacuugcgagccg

SEQ ID NO: 1050978 - RNA, 15 nt, Mycobacterium bovis subsp bovis AF2122/97
cggacuucccgcgcg

SEQ ID NO: 1050979 - RNA, 16 nt, Mycobacterium bovis subsp bovis AF2122/97
cggacuucccgcgcga

SEQ ID NO: 1050980 - RNA, 16 nt, Mycobacterium bovis subsp bovis AF2122/97
cggacuucgaugucga

SEQ ID NO: 1050981 - RNA, 16 nt, Mycobacterium bovis subsp bovis AF2122/97
cggacuucgccgcccg

SEQ ID NO: 1050982 - RNA, 19 nt, Mycobacterium bovis subsp bovis AF2122/97
cggacuucguuccgugccg

SEQ ID NO: 1050983 - RNA, 19 nt, Mycobacterium bovis subsp bovis AF2122/97
cggagcuagacccgucacc

SEQ ID NO: 1050984 - RNA, 20 nt, Mycobacterium bovis subsp bovis AF2122/97
cggagcuagacccgucaccg

SEQ ID NO: 1050985 - RNA, 22 nt, Mycobacterium bovis subsp bovis AF2122/97
cggagcuagacccgucaccgcc

SEQ ID NO: 1050986 - RNA, 20 nt, Mycobacterium bovis subsp bovis AF2122/97
cggagcucaaccaccucgcc

SEQ ID NO: 1050987 - RNA, 20 nt, Mycobacterium bovis subsp bovis AF2122/97
cggagcgggccagcacccgc

SEQ ID NO: 1050988 - RNA, 17 nt, Mycobacterium bovis subsp bovis AF2122/97
cggagcuuguugcagcg

SEQ ID NO: 1050989 - RNA, 15 nt, Mycobacterium bovis subsp bovis AF2122/97
cggaggauagggcuu

SEQ ID NO: 1050990 - RNA, 23 nt, Mycobacterium bovis subsp bovis AF2122/97
cggaggauagggcuuugucaccg

SEQ ID NO: 1050991 - RNA, 15 nt, Mycobacterium bovis subsp bovis AF2122/97
cggaggcaauccgau

SEQ ID NO: 1050992 - RNA, 17 nt, Mycobacterium bovis subsp bovis AF2122/97
cggaggcgaccacgucg

SEQ ID NO: 1050993 - RNA, 20 nt, Mycobacterium bovis subsp bovis AF2122/97
cggaggcgaccacgucggcg

SEQ ID NO: 1050994 - RNA, 21 nt, Mycobacterium bovis subsp bovis AF2122/97
cggaggcgaccccggccccga

SEQ ID NO: 1050995 - RNA, 14 nt, Mycobacterium bovis subsp bovis AF2122/97
cggaggcccgccac

SEQ ID NO: 1050996 - RNA, 12 nt, Mycobacterium bovis subsp bovis AF2122/97
cggaggccgccg

SEQ ID NO: 1050997 - RNA, 18 nt, Mycobacterium bovis subsp bovis AF2122/97
cggaggccgccgcgccgg

SEQ ID NO: 1050998 - RNA, 19 nt, Mycobacterium bovis subsp bovis AF2122/97
cggaggccgccgcgccggu

SEQ ID NO: 1050999 - RNA, 14 nt, Mycobacterium bovis subsp bovis AF2122/97
cggaggcggccagc

SEQ ID NO: 1051000 - RNA, 22 nt, Mycobacterium bovis subsp bovis AF2122/97
cggaggcggccagccuaccggc

SEQ ID NO: 1051001 - RNA, 16 nt, Mycobacterium bovis subsp bovis AF2122/97
cggaggguucggacgg

SEQ ID NO: 1051002 - RNA, 16 nt, Mycobacterium bovis subsp bovis AF2122/97
cggaggugccggcgcc

SEQ ID NO: 1051003 - RNA, 13 nt, Mycobacterium bovis subsp bovis AF2122/97
cggaggugccggc

SEQ ID NO: 1051004 - RNA, 21 nt, Mycobacterium bovis subsp bovis AF2122/97
cggaggugaaccccgccggca

SEQ ID NO: 1051005 - RNA, 16 nt, Mycobacterium bovis subsp bovis AF2122/97
cggagcggggaaguug

SEQ ID NO: 1051006 - RNA, 16 nt, Mycobacterium bovis subsp bovis AF2122/97
cggaggguugccgccg

SEQ ID NO: 1051007 - RNA, 18 nt, Mycobacterium bovis subsp bovis AF2122/97
cggauaacccagcggcgc

SEQ ID NO: 1051008 - RNA, 14 nt, Mycobacterium bovis subsp bovis AF2122/97
cggauaacccgugg

SEQ ID NO: 1051009 - RNA, 14 nt, Mycobacterium bovis subsp bovis AF2122/97
cggaucggucggca

SEQ ID NO: 1051010 - RNA, 17 nt, Mycobacterium bovis subsp bovis AF2122/97
cggaucggucggcacca

SEQ ID NO: 1051011 - RNA, 20 nt, Mycobacterium bovis subsp bovis AF2122/97
cggaucgucgaacagcaccg

SEQ ID NO: 1051012 - RNA, 21 nt, Mycobacterium bovis subsp bovis AF2122/97
cggaucgucgaacagcaccgc

SEQ ID NO: 1051013 - RNA, 20 nt, Mycobacterium bovis subsp bovis AF2122/97
cggaucgccggggacgccgc

SEQ ID NO: 1051014 - RNA, 22 nt, Mycobacterium bovis subsp bovis AF2122/97
cggaucgccggggacgccgcgg

SEQ ID NO: 1051015 - RNA, 23 nt, Mycobacterium bovis subsp bovis AF2122/97
cggaucgccggugaacagggacu

SEQ ID NO: 1051016 - RNA, 15 nt, Mycobacterium bovis subsp bovis AF2122/97
cggaucgccgucgcg

SEQ ID NO: 1051017 - RNA, 20 nt, Mycobacterium bovis subsp bovis AF2122/97
cggaucgccgucgcgaccga

SEQ ID NO: 1051018 - RNA, 14 nt, Mycobacterium bovis subsp bovis AF2122/97
cggaucgccgucgg

SEQ ID NO: 1051019 - RNA, 17 nt, Mycobacterium bovis subsp bovis AF2122/97
cggaucgccgucggcgg

SEQ ID NO: 1051020 - RNA, 23 nt, Mycobacterium bovis subsp bovis AF2122/97
cggaucugagcuagccguucggc

SEQ ID NO: 1051021 - RNA, 15 nt, Mycobacterium bovis subsp bovis AF2122/97
cggaucucaccaccc

SEQ ID NO: 1051022 - RNA, 20 nt, Mycobacterium bovis subsp bovis AF2122/97
cggaucuggugggugcggcc

SEQ ID NO: 1051023 - RNA, 13 nt, Mycobacterium bovis subsp bovis AF2122/97
cggaucucgaccu

SEQ ID NO: 1051024 - RNA, 22 nt, Mycobacterium bovis subsp bovis AF2122/97
cggaucucgaccucgucggccg

SEQ ID NO: 1051025 - RNA, 17 nt, Mycobacterium bovis subsp bovis AF2122/97
cggaucguggcgcccgu

SEQ ID NO: 1051026 - RNA, 23 nt, Mycobacterium bovis subsp bovis AF2122/97
cggaucgucgucguguggggcgg

SEQ ID NO: 1051027 - RNA, 17 nt, Mycobacterium bovis subsp bovis AF2122/97
cggaucgucgugcacgg

SEQ ID NO: 1051028 - RNA, 15 nt, Mycobacterium bovis subsp bovis AF2122/97
cggaucaggcccggg

SEQ ID NO: 1051029 - RNA, 18 nt, Mycobacterium bovis subsp bovis AF2122/97
cggaucaggcccgggcgg

SEQ ID NO: 1051030 - RNA, 17 nt, Mycobacterium bovis subsp bovis AF2122/97
cggaucgaagaccagca

SEQ ID NO: 1051031 - RNA, 20 nt, Mycobacterium bovis subsp bovis AF2122/97
cggaucgaagaccagcaacg

SEQ ID NO: 1051032 - RNA, 23 nt, Mycobacterium bovis subsp bovis AF2122/97
cggaucgacauaguuggcgcccg

SEQ ID NO: 1051033 - RNA, 15 nt, Mycobacterium bovis subsp bovis AF2122/97
cggaucgauuccgcc

SEQ ID NO: 1051034 - RNA, 17 nt, Mycobacterium bovis subsp bovis AF2122/97
cggaucgccaggccguc

SEQ ID NO: 1051035 - RNA, 21 nt, Mycobacterium bovis subsp bovis AF2122/97
cggaucacgaaaucgcccuga

SEQ ID NO: 1051036 - RNA, 22 nt, Mycobacterium bovis subsp bovis AF2122/97
cggaucagaggacccgugcacg

SEQ ID NO: 1051037 - RNA, 21 nt, Mycobacterium bovis subsp bovis AF2122/97
cggaucaaccccacacccggg

SEQ ID NO: 1051038 - RNA, 15 nt, Mycobacterium bovis subsp bovis AF2122/97
cggaucaagcgcaca

SEQ ID NO: 1051039 - RNA, 13 nt, Mycobacterium bovis subsp bovis AF2122/97
cggaucaccaucg

SEQ ID NO: 1051040 - RNA, 19 nt, Mycobacterium bovis subsp bovis AF2122/97
cggaucaccaucgccgccg

SEQ ID NO: 1051041 - RNA, 21 nt, Mycobacterium bovis subsp bovis AF2122/97
cggaucaccaucgccgccgcg

SEQ ID NO: 1051042 - RNA, 13 nt, Mycobacterium bovis subsp bovis AF2122/97
cggaucaccgcgc

SEQ ID NO: 1051043 - RNA, 19 nt, Mycobacterium bovis subsp bovis AF2122/97
cggaucaccgcgcccgccg

SEQ ID NO: 1051044 - RNA, 14 nt, Mycobacterium bovis subsp bovis AF2122/97
ccguucacgcucgu

SEQ ID NO: 1051045 - RNA, 21 nt, Mycobacterium bovis subsp bovis AF2122/97
ccguucaacaugaguggcaau

SEQ ID NO: 1051046 - RNA, 13 nt, Mycobacterium bovis subsp bovis AF2122/97
ccguucacccagc

SEQ ID NO: 1051047 - RNA, 19 nt, Mycobacterium bovis subsp bovis AF2122/97
ccguuagcuuagcugccgu

SEQ ID NO: 1051048 - RNA, 18 nt, Mycobacterium bovis subsp bovis AF2122/97
ccguuaccgccguugccg

SEQ ID NO: 1051049 - RNA, 17 nt, Mycobacterium bovis subsp bovis AF2122/97
ccguuaccgacgccggu

SEQ ID NO: 1051050 - RNA, 12 nt, Mycobacterium bovis subsp bovis AF2122/97
ccguuaccgccg

SEQ ID NO: 1051051 - RNA, 14 nt, Mycobacterium bovis subsp bovis AF2122/97
ccguuaccgccggc

SEQ ID NO: 1051052 - RNA, 20 nt, Mycobacterium bovis subsp bovis AF2122/97
ccguuaccgccggcgccggu

SEQ ID NO: 1051053 - RNA, 21 nt, Mycobacterium bovis subsp bovis AF2122/97
ccguuaccgccguuaccgacg

SEQ ID NO: 1051054 - RNA, 19 nt, Mycobacterium bovis subsp bovis AF2122/97
ccguggcggacggcgucga

SEQ ID NO: 1051055 - RNA, 15 nt, Mycobacterium bovis subsp bovis AF2122/97
ccguguucgccacac

SEQ ID NO: 1051056 - RNA, 16 nt, Mycobacterium bovis subsp bovis AF2122/97
ccguguucagcaccca

SEQ ID NO: 1051057 - RNA, 15 nt, Mycobacterium bovis subsp bovis AF2122/97
ccgugugugcgaucc

SEQ ID NO: 1051058 - RNA, 16 nt, Mycobacterium bovis subsp bovis AF2122/97
ccgugugugcgaucca

SEQ ID NO: 1051059 - RNA, 19 nt, Mycobacterium bovis subsp bovis AF2122/97
ccguguugagggugcccga

SEQ ID NO: 1051060 - RNA, 19 nt, Mycobacterium bovis subsp bovis AF2122/97
ccguggaucggcagcccgg

SEQ ID NO: 1051061 - RNA, 13 nt, Mycobacterium bovis subsp bovis AF2122/97
ccguggcacccgc

SEQ ID NO: 1051062 - RNA, 23 nt, Mycobacterium bovis subsp bovis AF2122/97
ccguggcacccgcaguggucggc

SEQ ID NO: 1051063 - RNA, 12 nt, Mycobacterium bovis subsp bovis AF2122/97
ccguggcccgcu

SEQ ID NO: 1051064 - RNA, 18 nt, Mycobacterium bovis subsp bovis AF2122/97
ccguggccggacccauug

SEQ ID NO: 1051065 - RNA, 13 nt, Mycobacterium bovis subsp bovis AF2122/97
ccguggccucgaa

SEQ ID NO: 1051066 - RNA, 20 nt, Mycobacterium bovis subsp bovis AF2122/97
ccguggcggcgggccucggc

SEQ ID NO: 1051067 - RNA, 23 nt, Mycobacterium bovis subsp bovis AF2122/97
ccguggcggcgggccucggcgac

SEQ ID NO: 1051068 - RNA, 13 nt, Mycobacterium bovis subsp bovis AF2122/97
ccgugucgccggc

SEQ ID NO: 1051069 - RNA, 14 nt, Mycobacterium bovis subsp bovis AF2122/97
ccgugucgccggcg

SEQ ID NO: 1051070 - RNA, 17 nt, Mycobacterium bovis subsp bovis AF2122/97
ccgugucgccggcgaag

SEQ ID NO: 1051071 - RNA, 22 nt, Mycobacterium bovis subsp bovis AF2122/97
ccguggcggccuccuccccgac

SEQ ID NO: 1051072 - RNA, 16 nt, Mycobacterium bovis subsp bovis AF2122/97
ccguggcgccggucgc

SEQ ID NO: 1051073 - RNA, 14 nt, Mycobacterium bovis subsp bovis AF2122/97
ccgugugcacgcga

SEQ ID NO: 1051074 - RNA, 14 nt, Mycobacterium bovis subsp bovis AF2122/97
ccgugugccacggg

SEQ ID NO: 1051075 - RNA, 19 nt, Mycobacterium bovis subsp bovis AF2122/97
ccguguggccguuggccgg

SEQ ID NO: 1051076 - RNA, 17 nt, Mycobacterium bovis subsp bovis AF2122/97
ccgugugggccccgccg

SEQ ID NO: 1051077 - RNA, 14 nt, Mycobacterium bovis subsp bovis AF2122/97
ccgugccggugugu

SEQ ID NO: 1051078 - RNA, 16 nt, Mycobacterium bovis subsp bovis AF2122/97
ccgugccgggcgacgg

SEQ ID NO: 1051079 - RNA, 16 nt, Mycobacterium bovis subsp bovis AF2122/97
ccgugcgucgauggcg

SEQ ID NO: 1051080 - RNA, 12 nt, Mycobacterium bovis subsp bovis AF2122/97
ccgugcucacgg

SEQ ID NO: 1051081 - RNA, 19 nt, Mycobacterium bovis subsp bovis AF2122/97
ccgugcggguucacugccg

SEQ ID NO: 1051082 - RNA, 22 nt, Mycobacterium bovis subsp bovis AF2122/97
ccgugcggguucacugccggcc

SEQ ID NO: 1051083 - RNA, 19 nt, Mycobacterium bovis subsp bovis AF2122/97
ccgugcugaacuccgccgc

SEQ ID NO: 1051084 - RNA, 15 nt, Mycobacterium bovis subsp bovis AF2122/97
ccgugcgggucgucc

SEQ ID NO: 1051085 - RNA, 18 nt, Mycobacterium bovis subsp bovis AF2122/97
ccgugcugcccaucccgg

SEQ ID NO: 1051086 - RNA, 22 nt, Mycobacterium bovis subsp bovis AF2122/97
ccguggaagauguugccgccgg

SEQ ID NO: 1051087 - RNA, 17 nt, Mycobacterium bovis subsp bovis AF2122/97
ccguggaaagccggcgu

SEQ ID NO: 1051088 - RNA, 19 nt, Mycobacterium bovis subsp bovis AF2122/97
ccguggaagacgucgaggu

SEQ ID NO: 1051089 - RNA, 18 nt, Mycobacterium bovis subsp bovis AF2122/97
ccgugcugggcgccgcgc

SEQ ID NO: 1051090 - RNA, 12 nt, Mycobacterium bovis subsp bovis AF2122/97
ccgugcuggcgc

SEQ ID NO: 1051091 - RNA, 13 nt, Mycobacterium bovis subsp bovis AF2122/97
ccgugcuggcgcc

SEQ ID NO: 1051092 - RNA, 15 nt, Mycobacterium bovis subsp bovis AF2122/97
ccgugcuggcgccga

SEQ ID NO: 1051093 - RNA, 22 nt, Mycobacterium bovis subsp bovis AF2122/97
ccgugcugggcaucaccgacgc

SEQ ID NO: 1051094 - RNA, 15 nt, Mycobacterium bovis subsp bovis AF2122/97
ccgugaacggcucgg

SEQ ID NO: 1051095 - RNA, 23 nt, Mycobacterium bovis subsp bovis AF2122/97
ccgucuuuggugccgagcagcuu

SEQ ID NO: 1051096 - RNA, 20 nt, Mycobacterium bovis subsp bovis AF2122/97
ccgucuuugucacgcaccgc

SEQ ID NO: 1051097 - RNA, 22 nt, Mycobacterium bovis subsp bovis AF2122/97
ccgucuuugucacgcaccgcgg

SEQ ID NO: 1051098 - RNA, 21 nt, Mycobacterium bovis subsp bovis AF2122/97
ccgugacccucagcaccgcug

SEQ ID NO: 1051099 - RNA, 18 nt, Mycobacterium bovis subsp bovis AF2122/97
ccgugaccgagaagccca

SEQ ID NO: 1051100 - RNA, 13 nt, Mycobacterium bovis subsp bovis AF2122/97
ccgugaccgccgc

SEQ ID NO: 1051101 - RNA, 15 nt, Mycobacterium bovis subsp bovis AF2122/97
ccgugaccgccgcgc

SEQ ID NO: 1051102 - RNA, 16 nt, Mycobacterium bovis subsp bovis AF2122/97
ccgugaccgccgcgcc

SEQ ID NO: 1051103 - RNA, 17 nt, Mycobacterium bovis subsp bovis AF2122/97
ccgugaccgccgcgccg

SEQ ID NO: 1051104 - RNA, 22 nt, Mycobacterium bovis subsp bovis AF2122/97
ccgugaauggcagcacgaccug

SEQ ID NO: 1051105 - RNA, 13 nt, Mycobacterium bovis subsp bovis AF2122/97
ccgugacaccggg

SEQ ID NO: 1051106 - RNA, 23 nt, Mycobacterium bovis subsp bovis AF2122/97
ccgugacaccggggacgucgacu

SEQ ID NO: 1051107 - RNA, 21 nt, Mycobacterium bovis subsp bovis AF2122/97
ccgugccgaaaaucgcagcca

SEQ ID NO: 1051108 - RNA, 12 nt, Mycobacterium bovis subsp bovis AF2122/97
ccgugccgagcg

SEQ ID NO: 1051109 - RNA, 20 nt, Mycobacterium bovis subsp bovis AF2122/97
ccgugccgagcuucagcgcg

SEQ ID NO: 1051110 - RNA, 19 nt, Mycobacterium bovis subsp bovis AF2122/97
ccgugccgcccucaccgcc

SEQ ID NO: 1051111 - RNA, 14 nt, Mycobacterium bovis subsp bovis AF2122/97
ccgugccgccgaca

SEQ ID NO: 1051112 - RNA, 22 nt, Mycobacterium bovis subsp bovis AF2122/97
ccgugccgccgacaccaccggc

SEQ ID NO: 1051113 - RNA, 17 nt, Mycobacterium bovis subsp bovis AF2122/97
ccgugccgcaucacccg

SEQ ID NO: 1051114 - RNA, 19 nt, Mycobacterium bovis subsp bovis AF2122/97
ccgugccgcaucacccggg

SEQ ID NO: 1051115 - RNA, 16 nt, Mycobacterium bovis subsp bovis AF2122/97
ccgugccagcugccga

SEQ ID NO: 1051116 - RNA, 18 nt, Mycobacterium bovis subsp bovis AF2122/97
ccgugcccaggccaccgg

SEQ ID NO: 1051117 - RNA, 19 nt, Mycobacterium bovis subsp bovis AF2122/97
ccgugcccaggccaccggc

SEQ ID NO: 1051118 - RNA, 14 nt, Mycobacterium bovis subsp bovis AF2122/97
ccgugccagcaggg

SEQ ID NO: 1051119 - RNA, 13 nt, Mycobacterium bovis subsp bovis AF2122/97
ccgucgaccacga

SEQ ID NO: 1051120 - RNA, 19 nt, Mycobacterium bovis subsp bovis AF2122/97
ccgucgacaacaaacccgg

SEQ ID NO: 1051121 - RNA, 14 nt, Mycobacterium bovis subsp bovis AF2122/97
ccgucgacaccgcg

SEQ ID NO: 1051122 - RNA, 21 nt, Mycobacterium bovis subsp bovis AF2122/97
ccguccgauuucccagcgcag

SEQ ID NO: 1051123 - RNA, 21 nt, Mycobacterium bovis subsp bovis AF2122/97
ccgucgaagaugaccugaucg

SEQ ID NO: 1051124 - RNA, 22 nt, Mycobacterium bovis subsp bovis AF2122/97
ccgucgaagaugaccugaucga

SEQ ID NO: 1051125 - RNA, 15 nt, Mycobacterium bovis subsp bovis AF2122/97
ccgucgaacgcgcgc

SEQ ID NO: 1051126 - RNA, 17 nt, Mycobacterium bovis subsp bovis AF2122/97
ccgucgaaccaguccuc

SEQ ID NO: 1051127 - RNA, 17 nt, Mycobacterium bovis subsp bovis AF2122/97
ccgucgaaccuaccgug

SEQ ID NO: 1051128 - RNA, 21 nt, Mycobacterium bovis subsp bovis AF2122/97
ccgucccggcucgagcucggc

SEQ ID NO: 1051129 - RNA, 20 nt, Mycobacterium bovis subsp bovis AF2122/97
ccgucccgcgagcagcccgg

SEQ ID NO: 1051130 - RNA, 21 nt, Mycobacterium bovis subsp bovis AF2122/97
ccguccgaccgauaacacccg

SEQ ID NO: 1051131 - RNA, 21 nt, Mycobacterium bovis subsp bovis AF2122/97
ccgucgaaagagaaggcggcg

SEQ ID NO: 1051132 - RNA, 17 nt, Mycobacterium bovis subsp bovis AF2122/97
ccgucgacgucgauggu

SEQ ID NO: 1051133 - RNA, 16 nt, Mycobacterium bovis subsp bovis AF2122/97
ccgucgacgucgaugg

SEQ ID NO: 1051134 - RNA, 12 nt, Mycobacterium bovis subsp bovis AF2122/97
ccgucgacgcgg

SEQ ID NO: 1051135 - RNA, 14 nt, Mycobacterium bovis subsp bovis AF2122/97
ccgucgacgcggcc

SEQ ID NO: 1051136 - RNA, 16 nt, Mycobacterium bovis subsp bovis AF2122/97
ccgucgaccggcggga

SEQ ID NO: 1051137 - RNA, 23 nt, Mycobacterium bovis subsp bovis AF2122/97
ccgucgaccggcgggaugcgcgc

SEQ ID NO: 1051138 - RNA, 13 nt, Mycobacterium bovis subsp bovis AF2122/97
ccgucgaccggcg

SEQ ID NO: 1051139 - RNA, 15 nt, Mycobacterium bovis subsp bovis AF2122/97
ccgucgagccgugcc

SEQ ID NO: 1051140 - RNA, 21 nt, Mycobacterium bovis subsp bovis AF2122/97
ccgucgagcaacgugacccgg

SEQ ID NO: 1051141 - RNA, 16 nt, Mycobacterium bovis subsp bovis AF2122/97
ccgucggccgagucga

SEQ ID NO: 1051142 - RNA, 14 nt, Mycobacterium bovis subsp bovis AF2122/97
ccgucggccggcaa

SEQ ID NO: 1051143 - RNA, 21 nt, Mycobacterium bovis subsp bovis AF2122/97
ccgucgucgaccacgacguuc

SEQ ID NO: 1051144 - RNA, 15 nt, Mycobacterium bovis subsp bovis AF2122/97
ccgucgucggucacc

SEQ ID NO: 1051145 - RNA, 14 nt, Mycobacterium bovis subsp bovis AF2122/97
ccgucgucggucuc

SEQ ID NO: 1051146 - RNA, 13 nt, Mycobacterium bovis subsp bovis AF2122/97
ccgucgucgaucg

SEQ ID NO: 1051147 - RNA, 21 nt, Mycobacterium bovis subsp bovis AF2122/97
ccgucgucgagcaccacccgg

SEQ ID NO: 1051148 - RNA, 22 nt, Mycobacterium bovis subsp bovis AF2122/97
ccgucgucgagcaccacccggg

SEQ ID NO: 1051149 - RNA, 17 nt, Mycobacterium bovis subsp bovis AF2122/97
ccgucgucaccgcgacg

SEQ ID NO: 1051150 - RNA, 16 nt, Mycobacterium bovis subsp bovis AF2122/97
ccgucguagguggccg

SEQ ID NO: 1051151 - RNA, 19 nt, Mycobacterium bovis subsp bovis AF2122/97
ccgucguaguuggugaaca

SEQ ID NO: 1051152 - RNA, 12 nt, Mycobacterium bovis subsp bovis AF2122/97
ccgucggcgccg

SEQ ID NO: 1051153 - RNA, 16 nt, Mycobacterium bovis subsp bovis AF2122/97
ccgucggcgcucgucg

SEQ ID NO: 1051154 - RNA, 21 nt, Mycobacterium bovis subsp bovis AF2122/97
ccgucggcgcgcaccucggcg

SEQ ID NO: 1051155 - RNA, 20 nt, Mycobacterium bovis subsp bovis AF2122/97
ccgucggcgccucggaccag

SEQ ID NO: 1051156 - RNA, 16 nt, Mycobacterium bovis subsp bovis AF2122/97
ccgucggcgaugaagu

SEQ ID NO: 1051157 - RNA, 19 nt, Mycobacterium bovis subsp bovis AF2122/97
ccgucgagcacggugagcc

SEQ ID NO: 1051158 - RNA, 21 nt, Mycobacterium bovis subsp bovis AF2122/97
ccgucggcgagcagacgccgc

SEQ ID NO: 1051159 - RNA, 20 nt, Mycobacterium bovis subsp bovis AF2122/97
ccgucuucgccgccaccggc

SEQ ID NO: 1051160 - RNA, 24 nt, Mycobacterium bovis subsp bovis AF2122/97
ccgucuuguaggacaagugccggc

SEQ ID NO: 1051161 - RNA, 16 nt, Mycobacterium bovis subsp bovis AF2122/97
ccgucuuaucggcguc

SEQ ID NO: 1051162 - RNA, 22 nt, Mycobacterium bovis subsp bovis AF2122/97
ccgucuggcaugaccgcugccg

SEQ ID NO: 1051163 - RNA, 15 nt, Mycobacterium bovis subsp bovis AF2122/97
ccgucuggccguugc

SEQ ID NO: 1051164 - RNA, 14 nt, Mycobacterium bovis subsp bovis AF2122/97
ccgucucugccacg

SEQ ID NO: 1051165 - RNA, 21 nt, Mycobacterium bovis subsp bovis AF2122/97
ccgucgucgugcacgacgaca

SEQ ID NO: 1051166 - RNA, 14 nt, Mycobacterium bovis subsp bovis AF2122/97
ccgucucgaucgcg

SEQ ID NO: 1051167 - RNA, 15 nt, Mycobacterium bovis subsp bovis AF2122/97
ccgucucgaucgcgg

SEQ ID NO: 1051168 - RNA, 17 nt, Mycobacterium bovis subsp bovis AF2122/97
ccgucugacccaccgcc

SEQ ID NO: 1051169 - RNA, 18 nt, Mycobacterium bovis subsp bovis AF2122/97
ccgucugacccaccgccc

SEQ ID NO: 1051170 - RNA, 20 nt, Mycobacterium bovis subsp bovis AF2122/97
ccgucugacccaccgccccg

SEQ ID NO: 1051171 - RNA, 22 nt, Mycobacterium bovis subsp bovis AF2122/97
ccgucugacccaccgccccggc

SEQ ID NO: 1051172 - RNA, 14 nt, Mycobacterium bovis subsp bovis AF2122/97
ccgucugcaccggc

SEQ ID NO: 1051173 - RNA, 18 nt, Mycobacterium bovis subsp bovis AF2122/97
ccgucugcgacccgggcc

SEQ ID NO: 1051174 - RNA, 23 nt, Mycobacterium bovis subsp bovis AF2122/97
ccgucugcgacccgggccgcggc

SEQ ID NO: 1051175 - RNA, 15 nt, Mycobacterium bovis subsp bovis AF2122/97
ccgucucggcgaccg

SEQ ID NO: 1051176 - RNA, 20 nt, Mycobacterium bovis subsp bovis AF2122/97
ccgucucggcgaccgacgcc

SEQ ID NO: 1051177 - RNA, 15 nt, Mycobacterium bovis subsp bovis AF2122/97
ccgguucgccgccgu

SEQ ID NO: 1051178 - RNA, 22 nt, Mycobacterium bovis subsp bovis AF2122/97
ccgguucugcgcccacccgcgc

SEQ ID NO: 1051179 - RNA, 18 nt, Mycobacterium bovis subsp bovis AF2122/97
ccgguucugggccugcgg

SEQ ID NO: 1051180 - RNA, 17 nt, Mycobacterium bovis subsp bovis AF2122/97
ccggugugcccgccugg

SEQ ID NO: 1051181 - RNA, 12 nt, Mycobacterium bovis subsp bovis AF2122/97
ccggugucggug

SEQ ID NO: 1051182 - RNA, 19 nt, Mycobacterium bovis subsp bovis AF2122/97
ccggugucggugcgcggca

SEQ ID NO: 1051183 - RNA, 18 nt, Mycobacterium bovis subsp bovis AF2122/97
ccggugugcugcacggcc

SEQ ID NO: 1051184 - RNA, 20 nt, Mycobacterium bovis subsp bovis AF2122/97
ccggugugcuguuuggcccc

SEQ ID NO: 1051185 - RNA, 23 nt, Mycobacterium bovis subsp bovis AF2122/97
ccggugugcuguuuggccccguu

SEQ ID NO: 1051186 - RNA, 14 nt, Mycobacterium bovis subsp bovis AF2122/97
ccggugugcgcacc

SEQ ID NO: 1051187 - RNA, 16 nt, Mycobacterium bovis subsp bovis AF2122/97
ccgguguguccagcgg

SEQ ID NO: 1051188 - RNA, 12 nt, Mycobacterium bovis subsp bovis AF2122/97
ccgguuggcccc

SEQ ID NO: 1051189 - RNA, 18 nt, Mycobacterium bovis subsp bovis AF2122/97
ccgguugacacccgggcc

SEQ ID NO: 1051190 - RNA, 16 nt, Mycobacterium bovis subsp bovis AF2122/97
ccgguugacacccggg

SEQ ID NO: 1051191 - RNA, 17 nt, Mycobacterium bovis subsp bovis AF2122/97
ccgguugacgggcucgg

SEQ ID NO: 1051192 - RNA, 15 nt, Mycobacterium bovis subsp bovis AF2122/97
ccgguggcggcggcg

SEQ ID NO: 1051193 - RNA, 18 nt, Mycobacterium bovis subsp bovis AF2122/97
ccgguggcggcggcggca

SEQ ID NO: 1051194 - RNA, 20 nt, Mycobacterium bovis subsp bovis AF2122/97
ccgguggcggcucacgaccg

SEQ ID NO: 1051195 - RNA, 12 nt, Mycobacterium bovis subsp bovis AF2122/97
ccgguggccggu

SEQ ID NO: 1051196 - RNA, 15 nt, Mycobacterium bovis subsp bovis AF2122/97
ccgguggcagccugc

SEQ ID NO: 1051197 - RNA, 13 nt, Mycobacterium bovis subsp bovis AF2122/97
ccgguggcauucg

SEQ ID NO: 1051198 - RNA, 13 nt, Mycobacterium bovis subsp bovis AF2122/97
ccgguggccaaca

SEQ ID NO: 1051199 - RNA, 14 nt, Mycobacterium bovis subsp bovis AF2122/97
ccgguggccaacac

SEQ ID NO: 1051200 - RNA, 12 nt, Mycobacterium bovis subsp bovis AF2122/97
ccgguggcagcc

SEQ ID NO: 1051201 - RNA, 17 nt, Mycobacterium bovis subsp bovis AF2122/97
ccgguggcagagccgcc

SEQ ID NO: 1051202 - RNA, 23 nt, Mycobacterium bovis subsp bovis AF2122/97
ccgguggcagagccgccguugcc

SEQ ID NO: 1051203 - RNA, 17 nt, Mycobacterium bovis subsp bovis AF2122/97
ccggugucggcuggucg

SEQ ID NO: 1051204 - RNA, 17 nt, Mycobacterium bovis subsp bovis AF2122/97
ccggugucaguccgaca

SEQ ID NO: 1051205 - RNA, 13 nt, Mycobacterium bovis subsp bovis AF2122/97
ccggugucgaugc

SEQ ID NO: 1051206 - RNA, 12 nt, Mycobacterium bovis subsp bovis AF2122/97
ccggugucggcc

SEQ ID NO: 1051207 - RNA, 14 nt, Mycobacterium bovis subsp bovis AF2122/97
ccggugucggccag

SEQ ID NO: 1051208 - RNA, 15 nt, Mycobacterium bovis subsp bovis AF2122/97
ccgguguccagccac

SEQ ID NO: 1051209 - RNA, 18 nt, Mycobacterium bovis subsp bovis AF2122/97
ccgguguccagccacgcu

SEQ ID NO: 1051210 - RNA, 14 nt, Mycobacterium bovis subsp bovis AF2122/97
ccgguggcccgccg

SEQ ID NO: 1051211 - RNA, 15 nt, Mycobacterium bovis subsp bovis AF2122/97
ccgguggcgccgggg

SEQ ID NO: 1051212 - RNA, 19 nt, Mycobacterium bovis subsp bovis AF2122/97
ccgguguacauaucgaagc

SEQ ID NO: 1051213 - RNA, 19 nt, Mycobacterium bovis subsp bovis AF2122/97
ccgguguagcagcgccagc

SEQ ID NO: 1051214 - RNA, 19 nt, Mycobacterium bovis subsp bovis AF2122/97
ccgguguaggccucggcag

SEQ ID NO: 1051215 - RNA, 23 nt, Mycobacterium bovis subsp bovis AF2122/97
ccggugagcuuagcgcaugggcc

SEQ ID NO: 1051216 - RNA, 18 nt, Mycobacterium bovis subsp bovis AF2122/97
ccggugaggaucagcgug

SEQ ID NO: 1051217 - RNA, 18 nt, Mycobacterium bovis subsp bovis AF2122/97
ccggugagcgagcgcgcg

SEQ ID NO: 1051218 - RNA, 14 nt, Mycobacterium bovis subsp bovis AF2122/97
ccggugagcgcagc

SEQ ID NO: 1051219 - RNA, 15 nt, Mycobacterium bovis subsp bovis AF2122/97
ccggugagcgcagcu

SEQ ID NO: 1051220 - RNA, 12 nt, Mycobacterium bovis subsp bovis AF2122/97
ccggugagccgg

SEQ ID NO: 1051221 - RNA, 14 nt, Mycobacterium bovis subsp bovis AF2122/97
ccggugagccggau

SEQ ID NO: 1051222 - RNA, 12 nt, Mycobacterium bovis subsp bovis AF2122/97
ccggugagaaga

SEQ ID NO: 1051223 - RNA, 13 nt, Mycobacterium bovis subsp bovis AF2122/97
ccgggugcgcacc

SEQ ID NO: 1051224 - RNA, 17 nt, Mycobacterium bovis subsp bovis AF2122/97
ccgggugcgcacccggg

SEQ ID NO: 1051225 - RNA, 23 nt, Mycobacterium bovis subsp bovis AF2122/97
ccgggugcgcacccgggugcgcu

SEQ ID NO: 1051226 - RNA, 18 nt, Mycobacterium bovis subsp bovis AF2122/97
ccggugacgaugaccgcg

SEQ ID NO: 1051227 - RNA, 16 nt, Mycobacterium bovis subsp bovis AF2122/97
ccggugacgcacagca

SEQ ID NO: 1051228 - RNA, 20 nt, Mycobacterium bovis subsp bovis AF2122/97
ccggugacgcacagcagcac

SEQ ID NO: 1051229 - RNA, 22 nt, Mycobacterium bovis subsp bovis AF2122/97
ccggugacgcacagcagcaccg

SEQ ID NO: 1051230 - RNA, 23 nt, Mycobacterium bovis subsp bovis AF2122/97
ccggugacgcacagcagcaccgc

SEQ ID NO: 1051231 - RNA, 16 nt, Mycobacterium bovis subsp bovis AF2122/97
ccggugacgccgucga

SEQ ID NO: 1051232 - RNA, 14 nt, Mycobacterium bovis subsp bovis AF2122/97
ccgggugcgacgcg

SEQ ID NO: 1051233 - RNA, 19 nt, Mycobacterium bovis subsp bovis AF2122/97
ccgggugcgacgcgaccgc

SEQ ID NO: 1051234 - RNA, 21 nt, Mycobacterium bovis subsp bovis AF2122/97
ccgggugcgacgcgaccgcga

SEQ ID NO: 1051235 - RNA, 17 nt, Mycobacterium bovis subsp bovis AF2122/97
ccgggugaguucggcgu

SEQ ID NO: 1051236 - RNA, 15 nt, Mycobacterium bovis subsp bovis AF2122/97
ccggugccacugccg

SEQ ID NO: 1051237 - RNA, 17 nt, Mycobacterium bovis subsp bovis AF2122/97
ccggugccacugccguu

SEQ ID NO: 1051238 - RNA, 15 nt, Mycobacterium bovis subsp bovis AF2122/97
ccgguggcaccggcg

SEQ ID NO: 1051239 - RNA, 13 nt, Mycobacterium bovis subsp bovis AF2122/97
ccgguggcacggc

SEQ ID NO: 1051240 - RNA, 21 nt, Mycobacterium bovis subsp bovis AF2122/97
ccgguggacgaucuggcagcc

SEQ ID NO: 1051241 - RNA, 23 nt, Mycobacterium bovis subsp bovis AF2122/97
ccgguggacgcagagucaacaga

SEQ ID NO: 1051242 - RNA, 14 nt, Mycobacterium bovis subsp bovis AF2122/97
ccgguggacccggc

SEQ ID NO: 1051243 - RNA, 19 nt, Mycobacterium bovis subsp bovis AF2122/97
ccgguggacccggcggugc

SEQ ID NO: 1051244 - RNA, 16 nt, Mycobacterium bovis subsp bovis AF2122/97
ccggugcccaccaccg

SEQ ID NO: 1051245 - RNA, 15 nt, Mycobacterium bovis subsp bovis AF2122/97
ccggugccaccgacg

SEQ ID NO: 1051246 - RNA, 21 nt, Mycobacterium bovis subsp bovis AF2122/97
ccggugccaccggcuggugcc

SEQ ID NO: 1051247 - RNA, 15 nt, Mycobacterium bovis subsp bovis AF2122/97
ccggugccagcagug

SEQ ID NO: 1051248 - RNA, 18 nt, Mycobacterium bovis subsp bovis AF2122/97
ccggugaucgcgguggcg

SEQ ID NO: 1051249 - RNA, 16 nt, Mycobacterium bovis subsp bovis AF2122/97
ccggugaucggcggca

SEQ ID NO: 1051250 - RNA, 14 nt, Mycobacterium bovis subsp bovis AF2122/97
ccggugauccgguc

SEQ ID NO: 1051251 - RNA, 14 nt, Mycobacterium bovis subsp bovis AF2122/97
ccgggugccggugc

SEQ ID NO: 1051252 - RNA, 21 nt, Mycobacterium bovis subsp bovis AF2122/97
ccgggucgacgacgucgcgca

SEQ ID NO: 1051253 - RNA, 23 nt, Mycobacterium bovis subsp bovis AF2122/97
ccggugauggugaccagcaggcc

SEQ ID NO: 1051254 - RNA, 17 nt, Mycobacterium bovis subsp bovis AF2122/97
ccggugauggccgacca

SEQ ID NO: 1051255 - RNA, 16 nt, Mycobacterium bovis subsp bovis AF2122/97
ccggugauggugacca

SEQ ID NO: 1051256 - RNA, 16 nt, Mycobacterium bovis subsp bovis AF2122/97
ccggugauccggucgu

SEQ ID NO: 1051257 - RNA, 23 nt, Mycobacterium bovis subsp bovis AF2122/97
ccggugcaaccccaaguccagca

SEQ ID NO: 1051258 - RNA, 23 nt, Mycobacterium bovis subsp bovis AF2122/97
ccggugauguagagcucaccguc

SEQ ID NO: 1051259 - RNA, 20 nt, Mycobacterium bovis subsp bovis AF2122/97
ccggugauguccgcacaacg

SEQ ID NO: 1051260 - RNA, 16 nt, Mycobacterium bovis subsp bovis AF2122/97
ccguaacagccggccg

SEQ ID NO: 1051261 - RNA, 21 nt, Mycobacterium bovis subsp bovis AF2122/97
ccgguuuggagcucaucgacg

SEQ ID NO: 1051262 - RNA, 13 nt, Mycobacterium bovis subsp bovis AF2122/97
ccguaaaagccga

SEQ ID NO: 1051263 - RNA, 13 nt, Mycobacterium bovis subsp bovis AF2122/97
ccgguuugacguc

SEQ ID NO: 1051264 - RNA, 17 nt, Mycobacterium bovis subsp bovis AF2122/97
ccgguuuggucgccgcg

SEQ ID NO: 1051265 - RNA, 15 nt, Mycobacterium bovis subsp bovis AF2122/97
ccgguuucuucggcc

SEQ ID NO: 1051266 - RNA, 20 nt, Mycobacterium bovis subsp bovis AF2122/97
ccgguuucgaggcgaagcgg

SEQ ID NO: 1051267 - RNA, 16 nt, Mycobacterium bovis subsp bovis AF2122/97
ccgguugugcgcgcgc

SEQ ID NO: 1051268 - RNA, 17 nt, Mycobacterium bovis subsp bovis AF2122/97
ccgguugugcgcgcgcc

SEQ ID NO: 1051269 - RNA, 19 nt, Mycobacterium bovis subsp bovis AF2122/97
ccgguuguggaaccacggc

SEQ ID NO: 1051270 - RNA, 20 nt, Mycobacterium bovis subsp bovis AF2122/97
ccgguuggcugccggcaaca

SEQ ID NO: 1051271 - RNA, 20 nt, Mycobacterium bovis subsp bovis AF2122/97
ccgguugcggcugcguuggc

SEQ ID NO: 1051272 - RNA, 15 nt, Mycobacterium bovis subsp bovis AF2122/97
ccgguuggccagcca

SEQ ID NO: 1051273 - RNA, 16 nt, Mycobacterium bovis subsp bovis AF2122/97
ccguacaucagcgcga

SEQ ID NO: 1051274 - RNA, 13 nt, Mycobacterium bovis subsp bovis AF2122/97
ccguacagcggcg

SEQ ID NO: 1051275 - RNA, 18 nt, Mycobacterium bovis subsp bovis AF2122/97
ccguacagcggcggcguc

SEQ ID NO: 1051276 - RNA, 13 nt, Mycobacterium bovis subsp bovis AF2122/97
ccguaccggugau

SEQ ID NO: 1051277 - RNA, 13 nt, Mycobacterium bovis subsp bovis AF2122/97
ccguacgccggcg

SEQ ID NO: 1051278 - RNA, 14 nt, Mycobacterium bovis subsp bovis AF2122/97
ccguacgccggcgg

SEQ ID NO: 1051279 - RNA, 23 nt, Mycobacterium bovis subsp bovis AF2122/97
ccgucacccccgauagcgaccgc

SEQ ID NO: 1051280 - RNA, 15 nt, Mycobacterium bovis subsp bovis AF2122/97
ccgucacaggccgcc

SEQ ID NO: 1051281 - RNA, 15 nt, Mycobacterium bovis subsp bovis AF2122/97
ccgucaccaccgccg

SEQ ID NO: 1051282 - RNA, 22 nt, Mycobacterium bovis subsp bovis AF2122/97
ccgucaaccagggugccggcgg

SEQ ID NO: 1051283 - RNA, 12 nt, Mycobacterium bovis subsp bovis AF2122/97
ccgucaacgaug

SEQ ID NO: 1051284 - RNA, 23 nt, Mycobacterium bovis subsp bovis AF2122/97
ccgucagcuuggacccugcgccg

SEQ ID NO: 1051285 - RNA, 18 nt, Mycobacterium bovis subsp bovis AF2122/97
ccgucaguagccacgccc

SEQ ID NO: 1051286 - RNA, 14 nt, Mycobacterium bovis subsp bovis AF2122/97
ccgucaggcgugcc

SEQ ID NO: 1051287 - RNA, 15 nt, Mycobacterium bovis subsp bovis AF2122/97
ccgucaggcgugccg

SEQ ID NO: 1051288 - RNA, 17 nt, Mycobacterium bovis subsp bovis AF2122/97
ccgucagggucagcugg

SEQ ID NO: 1051289 - RNA, 19 nt, Mycobacterium bovis subsp bovis AF2122/97
ccgucagcgucggcgcauc

SEQ ID NO: 1051290 - RNA, 20 nt, Mycobacterium bovis subsp bovis AF2122/97
ccgucagcgucugagcgccg

SEQ ID NO: 1051291 - RNA, 17 nt, Mycobacterium bovis subsp bovis AF2122/97
ccgucagcggcggccac

SEQ ID NO: 1051292 - RNA, 14 nt, Mycobacterium bovis subsp bovis AF2122/97
ccgucagccaggug

SEQ ID NO: 1051293 - RNA, 14 nt, Mycobacterium bovis subsp bovis AF2122/97
ccgucagcgcgccg

SEQ ID NO: 1051294 - RNA, 15 nt, Mycobacterium bovis subsp bovis AF2122/97
ccgucagcgcgccgu

SEQ ID NO: 1051295 - RNA, 16 nt, Mycobacterium bovis subsp bovis AF2122/97
ccgucagcgcgccguc

SEQ ID NO: 1051296 - RNA, 12 nt, Mycobacterium bovis subsp bovis AF2122/97
ccgucagcggca

SEQ ID NO: 1051297 - RNA, 17 nt, Mycobacterium bovis subsp bovis AF2122/97
ccgucauggcgaaccgu

SEQ ID NO: 1051298 - RNA, 19 nt, Mycobacterium bovis subsp bovis AF2122/97
ccgucauggcgggugcggc

SEQ ID NO: 1051299 - RNA, 16 nt, Mycobacterium bovis subsp bovis AF2122/97
ccgucaucgugcccgc

SEQ ID NO: 1051300 - RNA, 15 nt, Mycobacterium bovis subsp bovis AF2122/97
ccgucaucgccgggu

SEQ ID NO: 1051301 - RNA, 14 nt, Mycobacterium bovis subsp bovis AF2122/97
ccgucauagcaggc

SEQ ID NO: 1051302 - RNA, 16 nt, Mycobacterium bovis subsp bovis AF2122/97
ccgucauacucgacac

SEQ ID NO: 1051303 - RNA, 16 nt, Mycobacterium bovis subsp bovis AF2122/97
ccguccccggcguccg

SEQ ID NO: 1051304 - RNA, 17 nt, Mycobacterium bovis subsp bovis AF2122/97
ccguccccggcguccga

SEQ ID NO: 1051305 - RNA, 18 nt, Mycobacterium bovis subsp bovis AF2122/97
ccgucccgaaacgccggg

SEQ ID NO: 1051306 - RNA, 21 nt, Mycobacterium bovis subsp bovis AF2122/97
ccgucccgauacggccggccg

SEQ ID NO: 1051307 - RNA, 12 nt, Mycobacterium bovis subsp bovis AF2122/97
ccgucccgcgag

SEQ ID NO: 1051308 - RNA, 14 nt, Mycobacterium bovis subsp bovis AF2122/97
ccgucccgcgagca

SEQ ID NO: 1051309 - RNA, 17 nt, Mycobacterium bovis subsp bovis AF2122/97
ccgucccccgcacgcgg

SEQ ID NO: 1051310 - RNA, 18 nt, Mycobacterium bovis subsp bovis AF2122/97
ccguccccgcagcgccua

SEQ ID NO: 1051311 - RNA, 22 nt, Mycobacterium bovis subsp bovis AF2122/97
ccguccaauuggcgucgucggc

SEQ ID NO: 1051312 - RNA, 21 nt, Mycobacterium bovis subsp bovis AF2122/97
ccguccaacuacgccagccgc

SEQ ID NO: 1051313 - RNA, 15 nt, Mycobacterium bovis subsp bovis AF2122/97
ccguccaagccggcu

SEQ ID NO: 1051314 - RNA, 20 nt, Mycobacterium bovis subsp bovis AF2122/97
ccgucaugcccaccgccugg

SEQ ID NO: 1051315 - RNA, 15 nt, Mycobacterium bovis subsp bovis AF2122/97
ccgucaugccgacga

SEQ ID NO: 1051316 - RNA, 15 nt, Mycobacterium bovis subsp bovis AF2122/97
ccgucauugccacca

SEQ ID NO: 1051317 - RNA, 12 nt, Mycobacterium bovis subsp bovis AF2122/97
ccugcccggccc

SEQ ID NO: 1051318 - RNA, 19 nt, Mycobacterium bovis subsp bovis AF2122/97
ccugcccccggcgcggcgg

SEQ ID NO: 1051319 - RNA, 16 nt, Mycobacterium bovis subsp bovis AF2122/97
ccugccccacccgcgg

SEQ ID NO: 1051320 - RNA, 12 nt, Mycobacterium bovis subsp bovis AF2122/97
ccugcccaccau

SEQ ID NO: 1051321 - RNA, 14 nt, Mycobacterium bovis subsp bovis AF2122/97
ccugcccacgcgga

SEQ ID NO: 1051322 - RNA, 23 nt, Mycobacterium bovis subsp bovis AF2122/97
ccugcccaacccauaucgauaac

SEQ ID NO: 1051323 - RNA, 18 nt, Mycobacterium bovis subsp bovis AF2122/97
ccugccaguccugaugac

SEQ ID NO: 1051324 - RNA, 13 nt, Mycobacterium bovis subsp bovis AF2122/97
ccugcagcgcgac

SEQ ID NO: 1051325 - RNA, 19 nt, Mycobacterium bovis subsp bovis AF2122/97
ccugcagcgaugacgacca

SEQ ID NO: 1051326 - RNA, 20 nt, Mycobacterium bovis subsp bovis AF2122/97
ccugcagcgaugacgaccaa

SEQ ID NO: 1051327 - RNA, 13 nt, Mycobacterium bovis subsp bovis AF2122/97
ccugcaugcccag

SEQ ID NO: 1051328 - RNA, 20 nt, Mycobacterium bovis subsp bovis AF2122/97
ccugauuucaacggucaauc

SEQ ID NO: 1051329 - RNA, 14 nt, Mycobacterium bovis subsp bovis AF2122/97
ccugacacgcccgc

SEQ ID NO: 1051330 - RNA, 17 nt, Mycobacterium bovis subsp bovis AF2122/97
ccugacacgcccgcgag

SEQ ID NO: 1051331 - RNA, 15 nt, Mycobacterium bovis subsp bovis AF2122/97
ccugacacaacaccg

SEQ ID NO: 1051332 - RNA, 18 nt, Mycobacterium bovis subsp bovis AF2122/97
ccugaaucaccggagcgc

SEQ ID NO: 1051333 - RNA, 18 nt, Mycobacterium bovis subsp bovis AF2122/97
ccugaaucgguucggcca

SEQ ID NO: 1051334 - RNA, 15 nt, Mycobacterium bovis subsp bovis AF2122/97
ccugacccggagccg

SEQ ID NO: 1051335 - RNA, 16 nt, Mycobacterium bovis subsp bovis AF2122/97
ccugacccggagccgc

SEQ ID NO: 1051336 - RNA, 21 nt, Mycobacterium bovis subsp bovis AF2122/97
ccugacacccaucgaccgccc

SEQ ID NO: 1051337 - RNA, 15 nt, Mycobacterium bovis subsp bovis AF2122/97
ccugauccggccggu

SEQ ID NO: 1051338 - RNA, 14 nt, Mycobacterium bovis subsp bovis AF2122/97
ccugaucggucaac

SEQ ID NO: 1051339 - RNA, 19 nt, Mycobacterium bovis subsp bovis AF2122/97
ccugauggcgcugcaccgu

SEQ ID NO: 1051340 - RNA, 22 nt, Mycobacterium bovis subsp bovis AF2122/97
ccugaugaugugggcgauggca

SEQ ID NO: 1051341 - RNA, 12 nt, Mycobacterium bovis subsp bovis AF2122/97
ccucggcggccg

SEQ ID NO: 1051342 - RNA, 16 nt, Mycobacterium bovis subsp bovis AF2122/97
ccucggcggcguugug

SEQ ID NO: 1051343 - RNA, 14 nt, Mycobacterium bovis subsp bovis AF2122/97
ccucggcgggaucc

SEQ ID NO: 1051344 - RNA, 20 nt, Mycobacterium bovis subsp bovis AF2122/97
ccucggguguggucaccagg

SEQ ID NO: 1051345 - RNA, 17 nt, Mycobacterium bovis subsp bovis AF2122/97
ccucggucagcucgucg

SEQ ID NO: 1051346 - RNA, 21 nt, Mycobacterium bovis subsp bovis AF2122/97
ccucgguagcauccagcgcgc

SEQ ID NO: 1051347 - RNA, 15 nt, Mycobacterium bovis subsp bovis AF2122/97
ccucggucaccgagg

SEQ ID NO: 1051348 - RNA, 16 nt, Mycobacterium bovis subsp bovis AF2122/97
ccucggucaccgaggg

SEQ ID NO: 1051349 - RNA, 17 nt, Mycobacterium bovis subsp bovis AF2122/97
ccucggugaccaggccg

SEQ ID NO: 1051350 - RNA, 15 nt, Mycobacterium bovis subsp bovis AF2122/97
ccucggcgcugcgca

SEQ ID NO: 1051351 - RNA, 22 nt, Mycobacterium bovis subsp bovis AF2122/97
ccucggcgaucaauugcccggc

SEQ ID NO: 1051352 - RNA, 14 nt, Mycobacterium bovis subsp bovis AF2122/97
ccucggcgacgucg

SEQ ID NO: 1051353 - RNA, 17 nt, Mycobacterium bovis subsp bovis AF2122/97
ccucggcgacgucggcg

SEQ ID NO: 1051354 - RNA, 19 nt, Mycobacterium bovis subsp bovis AF2122/97
ccucgcuaauugcggccgc

SEQ ID NO: 1051355 - RNA, 16 nt, Mycobacterium bovis subsp bovis AF2122/97
ccucgcggugcgccac

SEQ ID NO: 1051356 - RNA, 17 nt, Mycobacterium bovis subsp bovis AF2122/97
ccucgcgggcgaucggc

SEQ ID NO: 1051357 - RNA, 13 nt, Mycobacterium bovis subsp bovis AF2122/97
ccucgcgggcggc

SEQ ID NO: 1051358 - RNA, 16 nt, Mycobacterium bovis subsp bovis AF2122/97
ccucgccggacgggug

SEQ ID NO: 1051359 - RNA, 14 nt, Mycobacterium bovis subsp bovis AF2122/97
ccucgcgcucgccg

SEQ ID NO: 1051360 - RNA, 16 nt, Mycobacterium bovis subsp bovis AF2122/97
ccucuagcgccucgcc

SEQ ID NO: 1051361 - RNA, 20 nt, Mycobacterium bovis subsp bovis AF2122/97
ccucguaggcguacaccagg

SEQ ID NO: 1051362 - RNA, 22 nt, Mycobacterium bovis subsp bovis AF2122/97
ccucgguggucuuggcccggcg

SEQ ID NO: 1051363 - RNA, 17 nt, Mycobacterium bovis subsp bovis AF2122/97
ccucggugugcucgccg

SEQ ID NO: 1051364 - RNA, 18 nt, Mycobacterium bovis subsp bovis AF2122/97
ccucggugugcucgccga

SEQ ID NO: 1051365 - RNA, 16 nt, Mycobacterium bovis subsp bovis AF2122/97
ccucgguguccucgac

SEQ ID NO: 1051366 - RNA, 22 nt, Mycobacterium bovis subsp bovis AF2122/97
ccucggugcggaacaccgcccg

SEQ ID NO: 1051367 - RNA, 17 nt, Mycobacterium bovis subsp bovis AF2122/97
ccucggugccacugccg

SEQ ID NO: 1051368 - RNA, 14 nt, Mycobacterium bovis subsp bovis AF2122/97
ccucggugccggcc

SEQ ID NO: 1051369 - RNA, 15 nt, Mycobacterium bovis subsp bovis AF2122/97
ccucggugccggccg

SEQ ID NO: 1051370 - RNA, 21 nt, Mycobacterium bovis subsp bovis AF2122/97
ccucugcugagcugcucgccg

SEQ ID NO: 1051371 - RNA, 14 nt, Mycobacterium bovis subsp bovis AF2122/97
ccucugguggcgcu

SEQ ID NO: 1051372 - RNA, 14 nt, Mycobacterium bovis subsp bovis AF2122/97
ccugaaaacaccgc

SEQ ID NO: 1051373 - RNA, 15 nt, Mycobacterium bovis subsp bovis AF2122/97
ccugaaccggccgcg

SEQ ID NO: 1051374 - RNA, 19 nt, Mycobacterium bovis subsp bovis AF2122/97
ccugaaagcuaccgaucgc

SEQ ID NO: 1051375 - RNA, 15 nt, Mycobacterium bovis subsp bovis AF2122/97
ccugaagccgcgcug

SEQ ID NO: 1051376 - RNA, 14 nt, Mycobacterium bovis subsp bovis AF2122/97
ccugaaggccagcc

SEQ ID NO: 1051377 - RNA, 18 nt, Mycobacterium bovis subsp bovis AF2122/97
ccugaaggccagccaacg

SEQ ID NO: 1051378 - RNA, 14 nt, Mycobacterium bovis subsp bovis AF2122/97
ccucgagcaccgcg

SEQ ID NO: 1051379 - RNA, 16 nt, Mycobacterium bovis subsp bovis AF2122/97
ccucgagcugcuggcg

SEQ ID NO: 1051380 - RNA, 20 nt, Mycobacterium bovis subsp bovis AF2122/97
ccucgagcugcuggcgcgcc

SEQ ID NO: 1051381 - RNA, 21 nt, Mycobacterium bovis subsp bovis AF2122/97
ccucgagcgcuguggcccaca

SEQ ID NO: 1051382 - RNA, 18 nt, Mycobacterium bovis subsp bovis AF2122/97
ccucgagcggcagaugaa

SEQ ID NO: 1051383 - RNA, 17 nt, Mycobacterium bovis subsp bovis AF2122/97
ccucgagguccucgucg

SEQ ID NO: 1051384 - RNA, 20 nt, Mycobacterium bovis subsp bovis AF2122/97
ccucgagguccucgucggcg

SEQ ID NO: 1051385 - RNA, 14 nt, Mycobacterium bovis subsp bovis AF2122/97
ccucgagugccgcc

SEQ ID NO: 1051386 - RNA, 15 nt, Mycobacterium bovis subsp bovis AF2122/97
ccucgagugccgccg

SEQ ID NO: 1051387 - RNA, 18 nt, Mycobacterium bovis subsp bovis AF2122/97
ccuccucuuggguccaca

SEQ ID NO: 1051388 - RNA, 18 nt, Mycobacterium bovis subsp bovis AF2122/97
ccucgacguccaucccgg

SEQ ID NO: 1051389 - RNA, 14 nt, Mycobacterium bovis subsp bovis AF2122/97
ccuccugcgagugc

SEQ ID NO: 1051390 - RNA, 14 nt, Mycobacterium bovis subsp bovis AF2122/97
ccuccgcugccgcc

SEQ ID NO: 1051391 - RNA, 20 nt, Mycobacterium bovis subsp bovis AF2122/97
ccuccgcugccgcccgcgcc

SEQ ID NO: 1051392 - RNA, 14 nt, Mycobacterium bovis subsp bovis AF2122/97
ccuccggacccacc

SEQ ID NO: 1051393 - RNA, 20 nt, Mycobacterium bovis subsp bovis AF2122/97
ccuccggauaacccagcggc

SEQ ID NO: 1051394 - RNA, 23 nt, Mycobacterium bovis subsp bovis AF2122/97
ccuccggauaacccagcggcgcc

SEQ ID NO: 1051395 - RNA, 16 nt, Mycobacterium bovis subsp bovis AF2122/97
ccuccacggcgggaac

SEQ ID NO: 1051396 - RNA, 23 nt, Mycobacterium bovis subsp bovis AF2122/97
ccuccguaacgccaagcucggcc

SEQ ID NO: 1051397 - RNA, 22 nt, Mycobacterium bovis subsp bovis AF2122/97
ccuccggcgcagcgaccgguaa

SEQ ID NO: 1051398 - RNA, 14 nt, Mycobacterium bovis subsp bovis AF2122/97
ccuccgucagcgcc

SEQ ID NO: 1051399 - RNA, 16 nt, Mycobacterium bovis subsp bovis AF2122/97
ccuccgguaucggcga

SEQ ID NO: 1051400 - RNA, 18 nt, Mycobacterium bovis subsp bovis AF2122/97
ccuccgugggcagcgcgc

SEQ ID NO: 1051401 - RNA, 20 nt, Mycobacterium bovis subsp bovis AF2122/97
ccuccgugggcagcgcgccc

SEQ ID NO: 1051402 - RNA, 23 nt, Mycobacterium bovis subsp bovis AF2122/97
ccuccucgcccauuggccaggug

SEQ ID NO: 1051403 - RNA, 20 nt, Mycobacterium bovis subsp bovis AF2122/97
ccuccucgaccagagccgcg

SEQ ID NO: 1051404 - RNA, 23 nt, Mycobacterium bovis subsp bovis AF2122/97
ccuccucgaccguggcggccucc

SEQ ID NO: 1051405 - RNA, 15 nt, Mycobacterium bovis subsp bovis AF2122/97
ccuccucgacgucgg

SEQ ID NO: 1051406 - RNA, 16 nt, Mycobacterium bovis subsp bovis AF2122/97
ccucgaguuuggccag

SEQ ID NO: 1051407 - RNA, 17 nt, Mycobacterium bovis subsp bovis AF2122/97
ccucgaucacggcggcc

SEQ ID NO: 1051408 - RNA, 21 nt, Mycobacterium bovis subsp bovis AF2122/97
ccucgaucagacgcucgaccu

SEQ ID NO: 1051409 - RNA, 16 nt, Mycobacterium bovis subsp bovis AF2122/97
ccucgaucgucgacgc

SEQ ID NO: 1051410 - RNA, 16 nt, Mycobacterium bovis subsp bovis AF2122/97
ccucgaugacaucggu

SEQ ID NO: 1051411 - RNA, 20 nt, Mycobacterium bovis subsp bovis AF2122/97
ccucgaugacaucggucagc

SEQ ID NO: 1051412 - RNA, 19 nt, Mycobacterium bovis subsp bovis AF2122/97
ccucgagguauucgcgcag

SEQ ID NO: 1051413 - RNA, 15 nt, Mycobacterium bovis subsp bovis AF2122/97
ccucgaugcgggcgc

SEQ ID NO: 1051414 - RNA, 18 nt, Mycobacterium bovis subsp bovis AF2122/97
ccucgaugucgcggucgc

SEQ ID NO: 1051415 - RNA, 19 nt, Mycobacterium bovis subsp bovis AF2122/97
ccucgaugucgcggucgcc

SEQ ID NO: 1051416 - RNA, 13 nt, Mycobacterium bovis subsp bovis AF2122/97
ccucgcacgacac

SEQ ID NO: 1051417 - RNA, 12 nt, Mycobacterium bovis subsp bovis AF2122/97
ccucgcaaccgg

SEQ ID NO: 1051418 - RNA, 20 nt, Mycobacterium bovis subsp bovis AF2122/97
ccucgcacaauggcggcgcc

SEQ ID NO: 1051419 - RNA, 14 nt, Mycobacterium bovis subsp bovis AF2122/97
ccucgccggcggga

SEQ ID NO: 1051420 - RNA, 14 nt, Mycobacterium bovis subsp bovis AF2122/97
ccucgccggugacg

SEQ ID NO: 1051421 - RNA, 19 nt, Mycobacterium bovis subsp bovis AF2122/97
ccucgccggcgcgcagccg

SEQ ID NO: 1051422 - RNA, 15 nt, Mycobacterium bovis subsp bovis AF2122/97
ccucgccgcacgccg

SEQ ID NO: 1051423 - RNA, 19 nt, Mycobacterium bovis subsp bovis AF2122/97
ccucgcccugcagacgggu

SEQ ID NO: 1051424 - RNA, 15 nt, Mycobacterium bovis subsp bovis AF2122/97
ccucgcccugcagac

SEQ ID NO: 1051425 - RNA, 13 nt, Mycobacterium bovis subsp bovis AF2122/97
ccucgcccgcacc

SEQ ID NO: 1051426 - RNA, 13 nt, Mycobacterium bovis subsp bovis AF2122/97
ccguucgcgccgu

SEQ ID NO: 1051427 - RNA, 18 nt, Mycobacterium bovis subsp bovis AF2122/97
ccguucgcccgcccgucu

SEQ ID NO: 1051428 - RNA, 13 nt, Mycobacterium bovis subsp bovis AF2122/97
ccguucgccgucg

SEQ ID NO: 1051429 - RNA, 16 nt, Mycobacterium bovis subsp bovis AF2122/97
ccguucgcccgcccgu

SEQ ID NO: 1051430 - RNA, 17 nt, Mycobacterium bovis subsp bovis AF2122/97
ccguucgcccgcccguc

SEQ ID NO: 1051431 - RNA, 19 nt, Mycobacterium bovis subsp bovis AF2122/97
ccguucggcgacagcgcgg

SEQ ID NO: 1051432 - RNA, 12 nt, Mycobacterium bovis subsp bovis AF2122/97
ccguucggcgcc

SEQ ID NO: 1051433 - RNA, 22 nt, Mycobacterium bovis subsp bovis AF2122/97
ccguucgaaguucucggugcgc

SEQ ID NO: 1051434 - RNA, 19 nt, Mycobacterium bovis subsp bovis AF2122/97
ccguucgccuggucaccga

SEQ ID NO: 1051435 - RNA, 18 nt, Mycobacterium bovis subsp bovis AF2122/97
ccguucgcgucgccgaug

SEQ ID NO: 1051436 - RNA, 17 nt, Mycobacterium bovis subsp bovis AF2122/97
ccguucaugcggcggcg

SEQ ID NO: 1051437 - RNA, 18 nt, Mycobacterium bovis subsp bovis AF2122/97
ccguuccacgccggcauc

SEQ ID NO: 1051438 - RNA, 15 nt, Mycobacterium bovis subsp bovis AF2122/97
ccguucccaccacca

SEQ ID NO: 1051439 - RNA, 20 nt, Mycobacterium bovis subsp bovis AF2122/97
ccguucccacccacgccgac

SEQ ID NO: 1051440 - RNA, 15 nt, Mycobacterium bovis subsp bovis AF2122/97
ccguuccguaucggg

SEQ ID NO: 1051441 - RNA, 21 nt, Mycobacterium bovis subsp bovis AF2122/97
ccguucccacccacgccgacu

SEQ ID NO: 1051442 - RNA, 14 nt, Mycobacterium bovis subsp bovis AF2122/97
ccuacgccgccagc

SEQ ID NO: 1051443 - RNA, 19 nt, Mycobacterium bovis subsp bovis AF2122/97
ccuaccgaugaaccaggcg

SEQ ID NO: 1051444 - RNA, 14 nt, Mycobacterium bovis subsp bovis AF2122/97
ccuacugcggucgc

SEQ ID NO: 1051445 - RNA, 18 nt, Mycobacterium bovis subsp bovis AF2122/97
ccuagccgaagcgcccgg

SEQ ID NO: 1051446 - RNA, 14 nt, Mycobacterium bovis subsp bovis AF2122/97
ccuagccgcuccgc

SEQ ID NO: 1051447 - RNA, 17 nt, Mycobacterium bovis subsp bovis AF2122/97
ccuagcagggugccggc

SEQ ID NO: 1051448 - RNA, 20 nt, Mycobacterium bovis subsp bovis AF2122/97
ccuagcagggugccggcgcc

SEQ ID NO: 1051449 - RNA, 19 nt, Mycobacterium bovis subsp bovis AF2122/97
ccuagccccugaaggccag

SEQ ID NO: 1051450 - RNA, 13 nt, Mycobacterium bovis subsp bovis AF2122/97
ccuagggcggcgg

SEQ ID NO: 1051451 - RNA, 22 nt, Mycobacterium bovis subsp bovis AF2122/97
ccuagcccgauucugauaucgu

SEQ ID NO: 1051452 - RNA, 14 nt, Mycobacterium bovis subsp bovis AF2122/97
ccuagcuggugcgc

SEQ ID NO: 1051453 - RNA, 18 nt, Mycobacterium bovis subsp bovis AF2122/97
ccuaggucgacgccgacc

SEQ ID NO: 1051454 - RNA, 22 nt, Mycobacterium bovis subsp bovis AF2122/97
ccuaggugaguaagcccggucg

SEQ ID NO: 1051455 - RNA, 18 nt, Mycobacterium bovis subsp bovis AF2122/97
ccuaggugugcgacgacg

SEQ ID NO: 1051456 - RNA, 20 nt, Mycobacterium bovis subsp bovis AF2122/97
ccuaggugugcgacgacggc

SEQ ID NO: 1051457 - RNA, 20 nt, Mycobacterium bovis subsp bovis AF2122/97
ccuagucaccuugaccgggu

SEQ ID NO: 1051458 - RNA, 20 nt, Mycobacterium bovis subsp bovis AF2122/97
ccuagcgagcgcacaccggc

SEQ ID NO: 1051459 - RNA, 14 nt, Mycobacterium bovis subsp bovis AF2122/97
ccuagcgcggcgac

SEQ ID NO: 1051460 - RNA, 13 nt, Mycobacterium bovis subsp bovis AF2122/97
ccuaggguggcga

SEQ ID NO: 1051461 - RNA, 17 nt, Mycobacterium bovis subsp bovis AF2122/97
ccuaggucgacgccgac

SEQ ID NO: 1051462 - RNA, 13 nt, Mycobacterium bovis subsp bovis AF2122/97
ccucagccaccgg

SEQ ID NO: 1051463 - RNA, 18 nt, Mycobacterium bovis subsp bovis AF2122/97
ccuaucacgagccaggga

SEQ ID NO: 1051464 - RNA, 18 nt, Mycobacterium bovis subsp bovis AF2122/97
ccuagugccaggaucgcg

SEQ ID NO: 1051465 - RNA, 14 nt, Mycobacterium bovis subsp bovis AF2122/97
ccuauacgcaacag

SEQ ID NO: 1051466 - RNA, 15 nt, Mycobacterium bovis subsp bovis AF2122/97
ccucagccggugcgc

SEQ ID NO: 1051467 - RNA, 14 nt, Mycobacterium bovis subsp bovis AF2122/97
ccucagccgcgccg

SEQ ID NO: 1051468 - RNA, 13 nt, Mycobacterium bovis subsp bovis AF2122/97
ccucagccgcggc

SEQ ID NO: 1051469 - RNA, 17 nt, Mycobacterium bovis subsp bovis AF2122/97
ccucagcgaugcucacu

SEQ ID NO: 1051470 - RNA, 13 nt, Mycobacterium bovis subsp bovis AF2122/97
ccucagugcgcac

SEQ ID NO: 1051471 - RNA, 14 nt, Mycobacterium bovis subsp bovis AF2122/97
ccucagugcgcacg

SEQ ID NO: 1051472 - RNA, 19 nt, Mycobacterium bovis subsp bovis AF2122/97
ccucaguguacaccgcgcc

SEQ ID NO: 1051473 - RNA, 17 nt, Mycobacterium bovis subsp bovis AF2122/97
ccucaucggacagcgcc

SEQ ID NO: 1051474 - RNA, 23 nt, Mycobacterium bovis subsp bovis AF2122/97
ccucauccaccgauggcgcgcuc

SEQ ID NO: 1051475 - RNA, 19 nt, Mycobacterium bovis subsp bovis AF2122/97
ccucaugcuaggccaccgg

SEQ ID NO: 1051476 - RNA, 18 nt, Mycobacterium bovis subsp bovis AF2122/97
ccuccacgcgccacucgu

SEQ ID NO: 1051477 - RNA, 19 nt, Mycobacterium bovis subsp bovis AF2122/97
ccuccaccagugccccgcc

SEQ ID NO: 1051478 - RNA, 13 nt, Mycobacterium bovis subsp bovis AF2122/97
ccuccaccgcgcc

SEQ ID NO: 1051479 - RNA, 18 nt, Mycobacterium bovis subsp bovis AF2122/97
ccuccaccgcgccggcgg

SEQ ID NO: 1051480 - RNA, 14 nt, Mycobacterium bovis subsp bovis AF2122/97
ccuccaagcccgcc

SEQ ID NO: 1051481 - RNA, 21 nt, Mycobacterium bovis subsp bovis AF2122/97
ccucauugccguucucgucga

SEQ ID NO: 1051482 - RNA, 16 nt, Mycobacterium bovis subsp bovis AF2122/97
ccuccacagcggccau

SEQ ID NO: 1051483 - RNA, 20 nt, Mycobacterium bovis subsp bovis AF2122/97
ccggccccgccgucaccccc

SEQ ID NO: 1051484 - RNA, 19 nt, Mycobacterium bovis subsp bovis AF2122/97
ccggccccgcggccagcac

SEQ ID NO: 1051485 - RNA, 16 nt, Mycobacterium bovis subsp bovis AF2122/97
ccggccccgccgucac

SEQ ID NO: 1051486 - RNA, 14 nt, Mycobacterium bovis subsp bovis AF2122/97
ccggccccaccgac

SEQ ID NO: 1051487 - RNA, 16 nt, Mycobacterium bovis subsp bovis AF2122/97
ccggccccgccgaugg

SEQ ID NO: 1051488 - RNA, 13 nt, Mycobacterium bovis subsp bovis AF2122/97
ccggccccgccgc

SEQ ID NO: 1051489 - RNA, 17 nt, Mycobacterium bovis subsp bovis AF2122/97
ccggccccgccggcccc

SEQ ID NO: 1051490 - RNA, 21 nt, Mycobacterium bovis subsp bovis AF2122/97
ccggccccgccggcgccgccc

SEQ ID NO: 1051491 - RNA, 14 nt, Mycobacterium bovis subsp bovis AF2122/97
ccggccccgccguc

SEQ ID NO: 1051492 - RNA, 15 nt, Mycobacterium bovis subsp bovis AF2122/97
ccggccccgccguca

SEQ ID NO: 1051493 - RNA, 22 nt, Mycobacterium bovis subsp bovis AF2122/97
ccggccccgccagcgccgccgg

SEQ ID NO: 1051494 - RNA, 14 nt, Mycobacterium bovis subsp bovis AF2122/97
ccggccccgcccgc

SEQ ID NO: 1051495 - RNA, 18 nt, Mycobacterium bovis subsp bovis AF2122/97
ccggccccgcccgcgcgg

SEQ ID NO: 1051496 - RNA, 13 nt, Mycobacterium bovis subsp bovis AF2122/97
ccggccccgacgg

SEQ ID NO: 1051497 - RNA, 20 nt, Mycobacterium bovis subsp bovis AF2122/97
ccggcccaaggaacggcguc

SEQ ID NO: 1051498 - RNA, 24 nt, Mycobacterium bovis subsp bovis AF2122/97
ccggcccacucacacaaccgacgg

SEQ ID NO: 1051499 - RNA, 15 nt, Mycobacterium bovis subsp bovis AF2122/97
ccggcccagcgcccc

SEQ ID NO: 1051500 - RNA, 21 nt, Mycobacterium bovis subsp bovis AF2122/97
ccggcccaucuucggacgcca

SEQ ID NO: 1051501 - RNA, 14 nt, Mycobacterium bovis subsp bovis AF2122/97
ccggccccaccggc

SEQ ID NO: 1051502 - RNA, 22 nt, Mycobacterium bovis subsp bovis AF2122/97
ccggccccaccgguaccgccac

SEQ ID NO: 1051503 - RNA, 16 nt, Mycobacterium bovis subsp bovis AF2122/97
ccggccccaccggugc

SEQ ID NO: 1051504 - RNA, 18 nt, Mycobacterium bovis subsp bovis AF2122/97
ccggcccccgacuccggc

SEQ ID NO: 1051505 - RNA, 13 nt, Mycobacterium bovis subsp bovis AF2122/97
ccggcccgccacc

SEQ ID NO: 1051506 - RNA, 14 nt, Mycobacterium bovis subsp bovis AF2122/97
ccggcccgaucggc

SEQ ID NO: 1051507 - RNA, 17 nt, Mycobacterium bovis subsp bovis AF2122/97
ccggcccgaucggcaac

SEQ ID NO: 1051508 - RNA, 14 nt, Mycobacterium bovis subsp bovis AF2122/97
ccggcccgaggcgg

SEQ ID NO: 1051509 - RNA, 13 nt, Mycobacterium bovis subsp bovis AF2122/97
ccggcccgcccgu

SEQ ID NO: 1051510 - RNA, 19 nt, Mycobacterium bovis subsp bovis AF2122/97
ccggcccggggacgcccuc

SEQ ID NO: 1051511 - RNA, 16 nt, Mycobacterium bovis subsp bovis AF2122/97
ccggcccggugaugaa

SEQ ID NO: 1051512 - RNA, 22 nt, Mycobacterium bovis subsp bovis AF2122/97
ccggcccggguaucgccagugg

SEQ ID NO: 1051513 - RNA, 13 nt, Mycobacterium bovis subsp bovis AF2122/97
ccggcccggugau

SEQ ID NO: 1051514 - RNA, 13 nt, Mycobacterium bovis subsp bovis AF2122/97
ccggcccugccgc

SEQ ID NO: 1051515 - RNA, 14 nt, Mycobacterium bovis subsp bovis AF2122/97
ccggcccugccgcc

SEQ ID NO: 1051516 - RNA, 18 nt, Mycobacterium bovis subsp bovis AF2122/97
ccggcccugagcugccga

SEQ ID NO: 1051517 - RNA, 22 nt, Mycobacterium bovis subsp bovis AF2122/97
ccggcccugagcugccgagcgg

SEQ ID NO: 1051518 - RNA, 14 nt, Mycobacterium bovis subsp bovis AF2122/97
ccggcccuccgggc

SEQ ID NO: 1051519 - RNA, 23 nt, Mycobacterium bovis subsp bovis AF2122/97
ccggcccucgccagagucggaga

SEQ ID NO: 1051520 - RNA, 14 nt, Mycobacterium bovis subsp bovis AF2122/97
ccggccgccgaaac

SEQ ID NO: 1051521 - RNA, 13 nt, Mycobacterium bovis subsp bovis AF2122/97
ccggccgcgaucc

SEQ ID NO: 1051522 - RNA, 16 nt, Mycobacterium bovis subsp bovis AF2122/97
ccggccgcgacgacac

SEQ ID NO: 1051523 - RNA, 13 nt, Mycobacterium bovis subsp bovis AF2122/97
ccggccgcgccgg

SEQ ID NO: 1051524 - RNA, 13 nt, Mycobacterium bovis subsp bovis AF2122/97
ccggccgcgcacc

SEQ ID NO: 1051525 - RNA, 19 nt, Mycobacterium bovis subsp bovis AF2122/97
ccggccgcggcggccccgc

SEQ ID NO: 1051526 - RNA, 12 nt, Mycobacterium bovis subsp bovis AF2122/97
ccggccgcgccc

SEQ ID NO: 1051527 - RNA, 14 nt, Mycobacterium bovis subsp bovis AF2122/97
ccggccgcgucacg

SEQ ID NO: 1051528 - RNA, 12 nt, Mycobacterium bovis subsp bovis AF2122/97
ccggccgcgcgg

SEQ ID NO: 1051529 - RNA, 17 nt, Mycobacterium bovis subsp bovis AF2122/97
ccggccgcuuggccgcu

SEQ ID NO: 1051530 - RNA, 15 nt, Mycobacterium bovis subsp bovis AF2122/97
ccggccgacgcuggc

SEQ ID NO: 1051531 - RNA, 16 nt, Mycobacterium bovis subsp bovis AF2122/97
ccggccgacgcuggcg

SEQ ID NO: 1051532 - RNA, 17 nt, Mycobacterium bovis subsp bovis AF2122/97
ccggccgaugcgacccg

SEQ ID NO: 1051533 - RNA, 13 nt, Mycobacterium bovis subsp bovis AF2122/97
ccggccgccaacu

SEQ ID NO: 1051534 - RNA, 19 nt, Mycobacterium bovis subsp bovis AF2122/97
ccggccgaugcgacccgca

SEQ ID NO: 1051535 - RNA, 14 nt, Mycobacterium bovis subsp bovis AF2122/97
ccggccgcacgccg

SEQ ID NO: 1051536 - RNA, 21 nt, Mycobacterium bovis subsp bovis AF2122/97
ccggccgcacgccggccagcg

SEQ ID NO: 1051537 - RNA, 14 nt, Mycobacterium bovis subsp bovis AF2122/97
ccggccgccagcgc

SEQ ID NO: 1051538 - RNA, 13 nt, Mycobacterium bovis subsp bovis AF2122/97
ccggccgcccgcu

SEQ ID NO: 1051539 - RNA, 14 nt, Mycobacterium bovis subsp bovis AF2122/97
ccggccgcccgcuc

SEQ ID NO: 1051540 - RNA, 14 nt, Mycobacterium bovis subsp bovis AF2122/97
ccggccgaacgccu

SEQ ID NO: 1051541 - RNA, 15 nt, Mycobacterium bovis subsp bovis AF2122/97
ccggccgaacgccuc

SEQ ID NO: 1051542 - RNA, 22 nt, Mycobacterium bovis subsp bovis AF2122/97
ccggccgaacgccucgccggcc

SEQ ID NO: 1051543 - RNA, 14 nt, Mycobacterium bovis subsp bovis AF2122/97
ccggccgacacgcc

SEQ ID NO: 1051544 - RNA, 16 nt, Mycobacterium bovis subsp bovis AF2122/97
ccggccgacacgccga

SEQ ID NO: 1051545 - RNA, 17 nt, Mycobacterium bovis subsp bovis AF2122/97
ccggcccugccgccggc

SEQ ID NO: 1051546 - RNA, 19 nt, Mycobacterium bovis subsp bovis AF2122/97
ccggcccugccgccggccc

SEQ ID NO: 1051547 - RNA, 21 nt, Mycobacterium bovis subsp bovis AF2122/97
ccggccgaguaccagcccacc

SEQ ID NO: 1051548 - RNA, 15 nt, Mycobacterium bovis subsp bovis AF2122/97
ccggccgacccggau

SEQ ID NO: 1051549 - RNA, 18 nt, Mycobacterium bovis subsp bovis AF2122/97
ccgcuggcucaucgaagc

SEQ ID NO: 1051550 - RNA, 12 nt, Mycobacterium bovis subsp bovis AF2122/97
ccgcugggccgg

SEQ ID NO: 1051551 - RNA, 18 nt, Mycobacterium bovis subsp bovis AF2122/97
ccgcugggauucugggcg

SEQ ID NO: 1051552 - RNA, 16 nt, Mycobacterium bovis subsp bovis AF2122/97
ccggaagcggcguucg

SEQ ID NO: 1051553 - RNA, 14 nt, Mycobacterium bovis subsp bovis AF2122/97
ccggaagcgccggc

SEQ ID NO: 1051554 - RNA, 21 nt, Mycobacterium bovis subsp bovis AF2122/97
ccggaaguugaucuugccgcc

SEQ ID NO: 1051555 - RNA, 21 nt, Mycobacterium bovis subsp bovis AF2122/97
ccggaauagcaacgcugcggc

SEQ ID NO: 1051556 - RNA, 15 nt, Mycobacterium bovis subsp bovis AF2122/97
ccggcauagcggccc

SEQ ID NO: 1051557 - RNA, 17 nt, Mycobacterium bovis subsp bovis AF2122/97
ccggcauagcggcccau

SEQ ID NO: 1051558 - RNA, 20 nt, Mycobacterium bovis subsp bovis AF2122/97
ccggcauaaaccgcguccgc

SEQ ID NO: 1051559 - RNA, 21 nt, Mycobacterium bovis subsp bovis AF2122/97
ccggcauacaacuggugggcc

SEQ ID NO: 1051560 - RNA, 15 nt, Mycobacterium bovis subsp bovis AF2122/97
ccggcauacaccgug

SEQ ID NO: 1051561 - RNA, 14 nt, Mycobacterium bovis subsp bovis AF2122/97
ccggcauacagccg

SEQ ID NO: 1051562 - RNA, 15 nt, Mycobacterium bovis subsp bovis AF2122/97
ccggcauacagccgg

SEQ ID NO: 1051563 - RNA, 16 nt, Mycobacterium bovis subsp bovis AF2122/97
ccggcauacagccggc

SEQ ID NO: 1051564 - RNA, 20 nt, Mycobacterium bovis subsp bovis AF2122/97
ccggcauacaucgccuugcc

SEQ ID NO: 1051565 - RNA, 19 nt, Mycobacterium bovis subsp bovis AF2122/97
ccggaaucggcggcggauu

SEQ ID NO: 1051566 - RNA, 14 nt, Mycobacterium bovis subsp bovis AF2122/97
ccggaaucgaugau

SEQ ID NO: 1051567 - RNA, 24 nt, Mycobacterium bovis subsp bovis AF2122/97
ccggaaucgucgcggccgucgcgg

SEQ ID NO: 1051568 - RNA, 16 nt, Mycobacterium bovis subsp bovis AF2122/97
ccggaauacccgcugg

SEQ ID NO: 1051569 - RNA, 17 nt, Mycobacterium bovis subsp bovis AF2122/97
ccggaauccuggccgcc

SEQ ID NO: 1051570 - RNA, 21 nt, Mycobacterium bovis subsp bovis AF2122/97
ccggcauccgguucgccgccg

SEQ ID NO: 1051571 - RNA, 23 nt, Mycobacterium bovis subsp bovis AF2122/97
ccggcaucgagacgcacggccac

SEQ ID NO: 1051572 - RNA, 15 nt, Mycobacterium bovis subsp bovis AF2122/97
ccggcaucgaucaac

SEQ ID NO: 1051573 - RNA, 18 nt, Mycobacterium bovis subsp bovis AF2122/97
ccggcauuaggccggggu

SEQ ID NO: 1051574 - RNA, 19 nt, Mycobacterium bovis subsp bovis AF2122/97
ccggccaucgaccguccgg

SEQ ID NO: 1051575 - RNA, 14 nt, Mycobacterium bovis subsp bovis AF2122/97
ccggcccaccaggc

SEQ ID NO: 1051576 - RNA, 13 nt, Mycobacterium bovis subsp bovis AF2122/97
ccggcccaccgac

SEQ ID NO: 1051577 - RNA, 14 nt, Mycobacterium bovis subsp bovis AF2122/97
ccggcccaccgacg

SEQ ID NO: 1051578 - RNA, 16 nt, Mycobacterium bovis subsp bovis AF2122/97
ccggccaugugcacgg

SEQ ID NO: 1051579 - RNA, 17 nt, Mycobacterium bovis subsp bovis AF2122/97
ccggccaugugcacggc

SEQ ID NO: 1051580 - RNA, 13 nt, Mycobacterium bovis subsp bovis AF2122/97
ccggccaggccgg

SEQ ID NO: 1051581 - RNA, 17 nt, Mycobacterium bovis subsp bovis AF2122/97
ccggccagguauguccg

SEQ ID NO: 1051582 - RNA, 18 nt, Mycobacterium bovis subsp bovis AF2122/97
ccggccagguauguccgc

SEQ ID NO: 1051583 - RNA, 16 nt, Mycobacterium bovis subsp bovis AF2122/97
ccggccaggugacguu

SEQ ID NO: 1051584 - RNA, 16 nt, Mycobacterium bovis subsp bovis AF2122/97
ccggccaguccgcgcg

SEQ ID NO: 1051585 - RNA, 17 nt, Mycobacterium bovis subsp bovis AF2122/97
ccggccaguccgcgcgc

SEQ ID NO: 1051586 - RNA, 16 nt, Mycobacterium bovis subsp bovis AF2122/97
ccggccaggccggcgg

SEQ ID NO: 1051587 - RNA, 13 nt, Mycobacterium bovis subsp bovis AF2122/97
ccggccaggccga

SEQ ID NO: 1051588 - RNA, 20 nt, Mycobacterium bovis subsp bovis AF2122/97
ccggccacacucgccagggc

SEQ ID NO: 1051589 - RNA, 18 nt, Mycobacterium bovis subsp bovis AF2122/97
ccggccaggggcgcagcg

SEQ ID NO: 1051590 - RNA, 21 nt, Mycobacterium bovis subsp bovis AF2122/97
ccggccaggggcgcagcgcgg

SEQ ID NO: 1051591 - RNA, 16 nt, Mycobacterium bovis subsp bovis AF2122/97
ccggccaaccaccaac

SEQ ID NO: 1051592 - RNA, 16 nt, Mycobacterium bovis subsp bovis AF2122/97
ccggccaauggccugc

SEQ ID NO: 1051593 - RNA, 17 nt, Mycobacterium bovis subsp bovis AF2122/97
ccggccaauggccugca

SEQ ID NO: 1051594 - RNA, 22 nt, Mycobacterium bovis subsp bovis AF2122/97
ccggccaagggugcuugucgcc

SEQ ID NO: 1051595 - RNA, 15 nt, Mycobacterium bovis subsp bovis AF2122/97
ccggccaauggccug

SEQ ID NO: 1051596 - RNA, 15 nt, Mycobacterium bovis subsp bovis AF2122/97
ccggccaacgccgcc

SEQ ID NO: 1051597 - RNA, 17 nt, Mycobacterium bovis subsp bovis AF2122/97
ccggccaacgccgccgc

SEQ ID NO: 1051598 - RNA, 17 nt, Mycobacterium bovis subsp bovis AF2122/97
ccggccaacggcacccu

SEQ ID NO: 1051599 - RNA, 13 nt, Mycobacterium bovis subsp bovis AF2122/97
ccggccaacuggg

SEQ ID NO: 1051600 - RNA, 23 nt, Mycobacterium bovis subsp bovis AF2122/97
ccggccaacugggccgagcgcgc

SEQ ID NO: 1051601 - RNA, 14 nt, Mycobacterium bovis subsp bovis AF2122/97
ccggccaagccggc

SEQ ID NO: 1051602 - RNA, 16 nt, Mycobacterium bovis subsp bovis AF2122/97
ccggccaagccggcga

SEQ ID NO: 1051603 - RNA, 20 nt, Mycobacterium bovis subsp bovis AF2122/97
ccggcauuccguaggccaca

SEQ ID NO: 1051604 - RNA, 18 nt, Mycobacterium bovis subsp bovis AF2122/97
ccggcauugcccgagccc

SEQ ID NO: 1051605 - RNA, 14 nt, Mycobacterium bovis subsp bovis AF2122/97
ccggcauugccgcc

SEQ ID NO: 1051606 - RNA, 14 nt, Mycobacterium bovis subsp bovis AF2122/97
ccggccaaaauggc

SEQ ID NO: 1051607 - RNA, 19 nt, Mycobacterium bovis subsp bovis AF2122/97
ccggccaaaauuuugucgg

SEQ ID NO: 1051608 - RNA, 21 nt, Mycobacterium bovis subsp bovis AF2122/97
ccggccaaaauuuugucggcc

SEQ ID NO: 1051609 - RNA, 15 nt, Mycobacterium bovis subsp bovis AF2122/97
ccggccucuggauca

SEQ ID NO: 1051610 - RNA, 16 nt, Mycobacterium bovis subsp bovis AF2122/97
ccggccucggcgagca

SEQ ID NO: 1051611 - RNA, 17 nt, Mycobacterium bovis subsp bovis AF2122/97
ccggccugcgacgagcc

SEQ ID NO: 1051612 - RNA, 15 nt, Mycobacterium bovis subsp bovis AF2122/97
ccggccugcgcgacc

SEQ ID NO: 1051613 - RNA, 18 nt, Mycobacterium bovis subsp bovis AF2122/97
ccggccugcgcgaccgac

SEQ ID NO: 1051614 - RNA, 23 nt, Mycobacterium bovis subsp bovis AF2122/97
ccggccuucuccaucgucggcaa

SEQ ID NO: 1051615 - RNA, 12 nt, Mycobacterium bovis subsp bovis AF2122/97
ccggccuucucg

SEQ ID NO: 1051616 - RNA, 16 nt, Mycobacterium bovis subsp bovis AF2122/97
ccggccuucucgccgu

SEQ ID NO: 1051617 - RNA, 21 nt, Mycobacterium bovis subsp bovis AF2122/97
ccggccuucucgccguguucg

SEQ ID NO: 1051618 - RNA, 16 nt, Mycobacterium bovis subsp bovis AF2122/97
ccggccugucccgcac

SEQ ID NO: 1051619 - RNA, 21 nt, Mycobacterium bovis subsp bovis AF2122/97
ccggccugucccgcacccggc

SEQ ID NO: 1051620 - RNA, 14 nt, Mycobacterium bovis subsp bovis AF2122/97
ccggccuggccgcc

SEQ ID NO: 1051621 - RNA, 22 nt, Mycobacterium bovis subsp bovis AF2122/97
ccggccucggugagcagcucgg

SEQ ID NO: 1051622 - RNA, 15 nt, Mycobacterium bovis subsp bovis AF2122/97
ccggccugcucggcg

SEQ ID NO: 1051623 - RNA, 15 nt, Mycobacterium bovis subsp bovis AF2122/97
ccggcgaacugcgau

SEQ ID NO: 1051624 - RNA, 16 nt, Mycobacterium bovis subsp bovis AF2122/97
ccggcgaagaccgccg

SEQ ID NO: 1051625 - RNA, 19 nt, Mycobacterium bovis subsp bovis AF2122/97
ccggcgaagaccgccggga

SEQ ID NO: 1051626 - RNA, 21 nt, Mycobacterium bovis subsp bovis AF2122/97
ccggcgaaaagacugcgccgc

SEQ ID NO: 1051627 - RNA, 22 nt, Mycobacterium bovis subsp bovis AF2122/97
ccggcgaacucgcgccgagcca

SEQ ID NO: 1051628 - RNA, 16 nt, Mycobacterium bovis subsp bovis AF2122/97
ccggcgaagccggccg

SEQ ID NO: 1051629 - RNA, 22 nt, Mycobacterium bovis subsp bovis AF2122/97
ccggcgaauccgcacagguccg

SEQ ID NO: 1051630 - RNA, 18 nt, Mycobacterium bovis subsp bovis AF2122/97
ccggcgaaugcgguccuc

SEQ ID NO: 1051631 - RNA, 15 nt, Mycobacterium bovis subsp bovis AF2122/97
ccggcgaauacgacc

SEQ ID NO: 1051632 - RNA, 18 nt, Mycobacterium bovis subsp bovis AF2122/97
ccggcgaauacgaccguc

SEQ ID NO: 1051633 - RNA, 22 nt, Mycobacterium bovis subsp bovis AF2122/97
ccggcgaauacgaccgucgcgc

SEQ ID NO: 1051634 - RNA, 23 nt, Mycobacterium bovis subsp bovis AF2122/97
ccggcgaauacgaccgucgcgcu

SEQ ID NO: 1051635 - RNA, 19 nt, Mycobacterium bovis subsp bovis AF2122/97
ccggcgaccaaggccgacc

SEQ ID NO: 1051636 - RNA, 15 nt, Mycobacterium bovis subsp bovis AF2122/97
ccggccuuggcggcg

SEQ ID NO: 1051637 - RNA, 16 nt, Mycobacterium bovis subsp bovis AF2122/97
ccggccuuuacccggg

SEQ ID NO: 1051638 - RNA, 19 nt, Mycobacterium bovis subsp bovis AF2122/97
ccggccuuuacccgggcgg

SEQ ID NO: 1051639 - RNA, 20 nt, Mycobacterium bovis subsp bovis AF2122/97
ccggccuuuccagcaccccg

SEQ ID NO: 1051640 - RNA, 19 nt, Mycobacterium bovis subsp bovis AF2122/97
ccggcgaacaggcgaccgg

SEQ ID NO: 1051641 - RNA, 20 nt, Mycobacterium bovis subsp bovis AF2122/97
ccggcgaacaggcgaccggg

SEQ ID NO: 1051642 - RNA, 21 nt, Mycobacterium bovis subsp bovis AF2122/97
ccggcgaacccagcggagcca

SEQ ID NO: 1051643 - RNA, 20 nt, Mycobacterium bovis subsp bovis AF2122/97
ccggcgaaccccagcgcauc

SEQ ID NO: 1051644 - RNA, 18 nt, Mycobacterium bovis subsp bovis AF2122/97
ccggccuuauucacccgg

SEQ ID NO: 1051645 - RNA, 16 nt, Mycobacterium bovis subsp bovis AF2122/97
ccggccuugccaccgg

SEQ ID NO: 1051646 - RNA, 23 nt, Mycobacterium bovis subsp bovis AF2122/97
ccggccuugcccucaacggcggc

SEQ ID NO: 1051647 - RNA, 14 nt, Mycobacterium bovis subsp bovis AF2122/97
ccggccuugccgcc

SEQ ID NO: 1051648 - RNA, 17 nt, Mycobacterium bovis subsp bovis AF2122/97
ccggccuugccgccggc

SEQ ID NO: 1051649 - RNA, 19 nt, Mycobacterium bovis subsp bovis AF2122/97
ccggccuugccgccggcgc

SEQ ID NO: 1051650 - RNA, 20 nt, Mycobacterium bovis subsp bovis AF2122/97
ccggccuugccgccggcgcc

SEQ ID NO: 1051651 - RNA, 13 nt, Mycobacterium bovis subsp bovis AF2122/97
ccggccggcagga

SEQ ID NO: 1051652 - RNA, 14 nt, Mycobacterium bovis subsp bovis AF2122/97
ccggccggccagca

SEQ ID NO: 1051653 - RNA, 14 nt, Mycobacterium bovis subsp bovis AF2122/97
ccggccggcgggcc

SEQ ID NO: 1051654 - RNA, 17 nt, Mycobacterium bovis subsp bovis AF2122/97
ccggccggcgggccugc

SEQ ID NO: 1051655 - RNA, 13 nt, Mycobacterium bovis subsp bovis AF2122/97
ccggccgggcccu

SEQ ID NO: 1051656 - RNA, 12 nt, Mycobacterium bovis subsp bovis AF2122/97
ccggccgggccu

SEQ ID NO: 1051657 - RNA, 23 nt, Mycobacterium bovis subsp bovis AF2122/97
ccggccggugccaguccaaaacc

SEQ ID NO: 1051658 - RNA, 19 nt, Mycobacterium bovis subsp bovis AF2122/97
ccggccgguaguagcugac

SEQ ID NO: 1051659 - RNA, 13 nt, Mycobacterium bovis subsp bovis AF2122/97
ccggccgguggcc

SEQ ID NO: 1051660 - RNA, 22 nt, Mycobacterium bovis subsp bovis AF2122/97
ccggccgguggccagcacgugc

SEQ ID NO: 1051661 - RNA, 20 nt, Mycobacterium bovis subsp bovis AF2122/97
ccggccgguuggccagccac

SEQ ID NO: 1051662 - RNA, 17 nt, Mycobacterium bovis subsp bovis AF2122/97
ccggccguugggccacc

SEQ ID NO: 1051663 - RNA, 15 nt, Mycobacterium bovis subsp bovis AF2122/97
ccggccgugccgccg

SEQ ID NO: 1051664 - RNA, 15 nt, Mycobacterium bovis subsp bovis AF2122/97
ccggccgucgggcag

SEQ ID NO: 1051665 - RNA, 18 nt, Mycobacterium bovis subsp bovis AF2122/97
ccggccggaguccgucgg

SEQ ID NO: 1051666 - RNA, 13 nt, Mycobacterium bovis subsp bovis AF2122/97
ccggccgucggcc

SEQ ID NO: 1051667 - RNA, 14 nt, Mycobacterium bovis subsp bovis AF2122/97
ccggccgucccgcg

SEQ ID NO: 1051668 - RNA, 21 nt, Mycobacterium bovis subsp bovis AF2122/97
ccggccgucccgcgagcagcc

SEQ ID NO: 1051669 - RNA, 14 nt, Mycobacterium bovis subsp bovis AF2122/97
ccggccgucgaucu

SEQ ID NO: 1051670 - RNA, 15 nt, Mycobacterium bovis subsp bovis AF2122/97
ccggccgucaucugg

SEQ ID NO: 1051671 - RNA, 16 nt, Mycobacterium bovis subsp bovis AF2122/97
ccggccucgccggggc

SEQ ID NO: 1051672 - RNA, 23 nt, Mycobacterium bovis subsp bovis AF2122/97
ccggccucgaugucgcggucgcc

SEQ ID NO: 1051673 - RNA, 20 nt, Mycobacterium bovis subsp bovis AF2122/97
ccggccuaccgagcuacgac

SEQ ID NO: 1051674 - RNA, 23 nt, Mycobacterium bovis subsp bovis AF2122/97
ccggcgacgccggccuuggcgau

SEQ ID NO: 1051675 - RNA, 15 nt, Mycobacterium bovis subsp bovis AF2122/97
ccggcgacgacccgg

SEQ ID NO: 1051676 - RNA, 19 nt, Mycobacterium bovis subsp bovis AF2122/97
ccggcgacgacccgggucg

SEQ ID NO: 1051677 - RNA, 15 nt, Mycobacterium bovis subsp bovis AF2122/97
ccggcgacaccgcag

SEQ ID NO: 1051678 - RNA, 14 nt, Mycobacterium bovis subsp bovis AF2122/97
ccggcgacccgggu

SEQ ID NO: 1051679 - RNA, 13 nt, Mycobacterium bovis subsp bovis AF2122/97
ccggcgaccagga

SEQ ID NO: 1051680 - RNA, 12 nt, Mycobacterium bovis subsp bovis AF2122/97
ccggcgaccggg

SEQ ID NO: 1051681 - RNA, 14 nt, Mycobacterium bovis subsp bovis AF2122/97
ccggcgaccgggau

SEQ ID NO: 1051682 - RNA, 13 nt, Mycobacterium bovis subsp bovis AF2122/97
ccggcgaccgggc

SEQ ID NO: 1051683 - RNA, 22 nt, Mycobacterium bovis subsp bovis AF2122/97
ccggcgacgggucgggcaaccu

SEQ ID NO: 1051684 - RNA, 18 nt, Mycobacterium bovis subsp bovis AF2122/97
ccggcgacgcuaccgccg

SEQ ID NO: 1051685 - RNA, 21 nt, Mycobacterium bovis subsp bovis AF2122/97
ccggcgacucugugacgggca

SEQ ID NO: 1051686 - RNA, 15 nt, Mycobacterium bovis subsp bovis AF2122/97
ccggcgagcagggcg

SEQ ID NO: 1051687 - RNA, 23 nt, Mycobacterium bovis subsp bovis AF2122/97
ccggcgagcagggcgucgaccgc

SEQ ID NO: 1051688 - RNA, 14 nt, Mycobacterium bovis subsp bovis AF2122/97
ccggcgagcccgca

SEQ ID NO: 1051689 - RNA, 15 nt, Mycobacterium bovis subsp bovis AF2122/97
ccggcgagcccgcau

SEQ ID NO: 1051690 - RNA, 19 nt, Mycobacterium bovis subsp bovis AF2122/97
ccggcgaucaacgcgcacc

SEQ ID NO: 1051691 - RNA, 14 nt, Mycobacterium bovis subsp bovis AF2122/97
ccggcgaucaccgu

SEQ ID NO: 1051692 - RNA, 23 nt, Mycobacterium bovis subsp bovis AF2122/97
ccggcgagggugagcauggcuag

SEQ ID NO: 1051693 - RNA, 20 nt, Mycobacterium bovis subsp bovis AF2122/97
ccggcgagggcgcggauacg

SEQ ID NO: 1051694 - RNA, 18 nt, Mycobacterium bovis subsp bovis AF2122/97
ccggcgagcagacgcaua

SEQ ID NO: 1051695 - RNA, 14 nt, Mycobacterium bovis subsp bovis AF2122/97
ccggcgaucguguc

SEQ ID NO: 1051696 - RNA, 17 nt, Mycobacterium bovis subsp bovis AF2122/97
ccggcgaucucgaccgu

SEQ ID NO: 1051697 - RNA, 21 nt, Mycobacterium bovis subsp bovis AF2122/97
ccggcgaucgggcgggugaac

SEQ ID NO: 1051698 - RNA, 14 nt, Mycobacterium bovis subsp bovis AF2122/97
ccggcgaugcagcc

SEQ ID NO: 1051699 - RNA, 13 nt, Mycobacterium bovis subsp bovis AF2122/97
ccggcgaugagca

SEQ ID NO: 1051700 - RNA, 21 nt, Mycobacterium bovis subsp bovis AF2122/97
ccggcgcaccaucgcggccgc

SEQ ID NO: 1051701 - RNA, 22 nt, Mycobacterium bovis subsp bovis AF2122/97
ccggcgaugagcaugcccagcg

SEQ ID NO: 1051702 - RNA, 17 nt, Mycobacterium bovis subsp bovis AF2122/97
ccggcgauuaccggcac

SEQ ID NO: 1051703 - RNA, 20 nt, Mycobacterium bovis subsp bovis AF2122/97
ccggcgauuaccggcacgcc

SEQ ID NO: 1051704 - RNA, 14 nt, Mycobacterium bovis subsp bovis AF2122/97
ccggcgcaacaacc

SEQ ID NO: 1051705 - RNA, 14 nt, Mycobacterium bovis subsp bovis AF2122/97
ccggcgcaagcgcc

SEQ ID NO: 1051706 - RNA, 18 nt, Mycobacterium bovis subsp bovis AF2122/97
ccggcgcaagcgccgcgc

SEQ ID NO: 1051707 - RNA, 19 nt, Mycobacterium bovis subsp bovis AF2122/97
ccggcgcaagcgccgcgcu

SEQ ID NO: 1051708 - RNA, 22 nt, Mycobacterium bovis subsp bovis AF2122/97
ccggcgcacaaacauacgccac

SEQ ID NO: 1051709 - RNA, 22 nt, Mycobacterium bovis subsp bovis AF2122/97
ccggcgcaccggagucgcccgg

SEQ ID NO: 1051710 - RNA, 14 nt, Mycobacterium bovis subsp bovis AF2122/97
ccggcgcaccuggg

SEQ ID NO: 1051711 - RNA, 19 nt, Mycobacterium bovis subsp bovis AF2122/97
ccggcgccaccguugccga

SEQ ID NO: 1051712 - RNA, 12 nt, Mycobacterium bovis subsp bovis AF2122/97
ccggcgcccggg

SEQ ID NO: 1051713 - RNA, 14 nt, Mycobacterium bovis subsp bovis AF2122/97
ccggcgccaccgcc

SEQ ID NO: 1051714 - RNA, 15 nt, Mycobacterium bovis subsp bovis AF2122/97
ccggcgccaccgccg

SEQ ID NO: 1051715 - RNA, 17 nt, Mycobacterium bovis subsp bovis AF2122/97
ccggcgccaccgccgcu

SEQ ID NO: 1051716 - RNA, 20 nt, Mycobacterium bovis subsp bovis AF2122/97
ccggcgccaccgccgcugcc

SEQ ID NO: 1051717 - RNA, 18 nt, Mycobacterium bovis subsp bovis AF2122/97
ccggcgccaccggcgccg

SEQ ID NO: 1051718 - RNA, 13 nt, Mycobacterium bovis subsp bovis AF2122/97
ccggcgccaccgu

SEQ ID NO: 1051719 - RNA, 16 nt, Mycobacterium bovis subsp bovis AF2122/97
ccggcgccaccguugc

SEQ ID NO: 1051720 - RNA, 21 nt, Mycobacterium bovis subsp bovis AF2122/97
ccggcgccacccccaccgucg

SEQ ID NO: 1051721 - RNA, 24 nt, Mycobacterium bovis subsp bovis AF2122/97
ccggcgccacccccaccgucgcgg

SEQ ID NO: 1051722 - RNA, 14 nt, Mycobacterium bovis subsp bovis AF2122/97
ccggcgccacccgc

SEQ ID NO: 1051723 - RNA, 19 nt, Mycobacterium bovis subsp bovis AF2122/97
ccggcgccacccgcgccgc

SEQ ID NO: 1051724 - RNA, 20 nt, Mycobacterium bovis subsp bovis AF2122/97
ccggcgccaccgucaccgcc

SEQ ID NO: 1051725 - RNA, 21 nt, Mycobacterium bovis subsp bovis AF2122/97
ccggcgccaccgucaccgccg

SEQ ID NO: 1051726 - RNA, 15 nt, Mycobacterium bovis subsp bovis AF2122/97
ccggcgccaccgucg

SEQ ID NO: 1051727 - RNA, 16 nt, Mycobacterium bovis subsp bovis AF2122/97
ccggcgccaccgucgc

SEQ ID NO: 1051728 - RNA, 17 nt, Mycobacterium bovis subsp bovis AF2122/97
ccggcgccaccgucgcc

SEQ ID NO: 1051729 - RNA, 18 nt, Mycobacterium bovis subsp bovis AF2122/97
ccggcgccaccgucgccg

SEQ ID NO: 1051730 - RNA, 22 nt, Mycobacterium bovis subsp bovis AF2122/97
ccggcgccaccgugguggacga

SEQ ID NO: 1051731 - RNA, 11 nt, Mycobacterium bovis subsp bovis AF2122/97
ccggcgcagcu

SEQ ID NO: 1051732 - RNA, 19 nt, Mycobacterium bovis subsp bovis AF2122/97
ccggcgcaguagccgacca

SEQ ID NO: 1051733 - RNA, 21 nt, Mycobacterium bovis subsp bovis AF2122/97
ccggcgcaguagccgaccagg

SEQ ID NO: 1051734 - RNA, 23 nt, Mycobacterium bovis subsp bovis AF2122/97
ccggcgcaguagccgaccaggac

SEQ ID NO: 1051735 - RNA, 18 nt, Mycobacterium bovis subsp bovis AF2122/97
ccggcgcaguagccgacc

SEQ ID NO: 1051736 - RNA, 15 nt, Mycobacterium bovis subsp bovis AF2122/97
ccggcgcagcgaccg

SEQ ID NO: 1051737 - RNA, 19 nt, Mycobacterium bovis subsp bovis AF2122/97
ccggcgccgcaaucagacg

SEQ ID NO: 1051738 - RNA, 20 nt, Mycobacterium bovis subsp bovis AF2122/97
ccggcgccgcaaucagacgg

SEQ ID NO: 1051739 - RNA, 13 nt, Mycobacterium bovis subsp bovis AF2122/97
ccggcgccgcacc

SEQ ID NO: 1051740 - RNA, 18 nt, Mycobacterium bovis subsp bovis AF2122/97
ccggcgccgccacugccg

SEQ ID NO: 1051741 - RNA, 16 nt, Mycobacterium bovis subsp bovis AF2122/97
ccggcgccgccagcac

SEQ ID NO: 1051742 - RNA, 23 nt, Mycobacterium bovis subsp bovis AF2122/97
ccggcgccgccagcaccaccggc

SEQ ID NO: 1051743 - RNA, 17 nt, Mycobacterium bovis subsp bovis AF2122/97
ccggcgccgccauugcc

SEQ ID NO: 1051744 - RNA, 12 nt, Mycobacterium bovis subsp bovis AF2122/97
ccggcgccgcca

SEQ ID NO: 1051745 - RNA, 13 nt, Mycobacterium bovis subsp bovis AF2122/97
ccggcgccgccca

SEQ ID NO: 1051746 - RNA, 19 nt, Mycobacterium bovis subsp bovis AF2122/97
ccggcgccgcccuugccgc

SEQ ID NO: 1051747 - RNA, 16 nt, Mycobacterium bovis subsp bovis AF2122/97
ccggcgccgcccgcgc

SEQ ID NO: 1051748 - RNA, 21 nt, Mycobacterium bovis subsp bovis AF2122/97
ccggcgccgcccgcgccacca

SEQ ID NO: 1051749 - RNA, 19 nt, Mycobacterium bovis subsp bovis AF2122/97
ccggcgccgcccgcgccgc

SEQ ID NO: 1051750 - RNA, 17 nt, Mycobacterium bovis subsp bovis AF2122/97
ccggcgccgcccuugcc

SEQ ID NO: 1051751 - RNA, 15 nt, Mycobacterium bovis subsp bovis AF2122/97
ccggcggccacgccg

SEQ ID NO: 1051752 - RNA, 17 nt, Mycobacterium bovis subsp bovis AF2122/97
ccggcggccacgccggc

SEQ ID NO: 1051753 - RNA, 13 nt, Mycobacterium bovis subsp bovis AF2122/97
ccggcgccgccgg

SEQ ID NO: 1051754 - RNA, 14 nt, Mycobacterium bovis subsp bovis AF2122/97
ccggcgccgccggc

SEQ ID NO: 1051755 - RNA, 15 nt, Mycobacterium bovis subsp bovis AF2122/97
ccggcgccgccggca

SEQ ID NO: 1051756 - RNA, 16 nt, Mycobacterium bovis subsp bovis AF2122/97
ccggcgccgccggcac

SEQ ID NO: 1051757 - RNA, 15 nt, Mycobacterium bovis subsp bovis AF2122/97
ccggcggccccaggg

SEQ ID NO: 1051758 - RNA, 13 nt, Mycobacterium bovis subsp bovis AF2122/97
ccggcggccaucc

SEQ ID NO: 1051759 - RNA, 17 nt, Mycobacterium bovis subsp bovis AF2122/97
ccggcggccaucccgcg

SEQ ID NO: 1051760 - RNA, 20 nt, Mycobacterium bovis subsp bovis AF2122/97
ccggcggccaucccgcguuc

SEQ ID NO: 1051761 - RNA, 13 nt, Mycobacterium bovis subsp bovis AF2122/97
ccggcggccgcca

SEQ ID NO: 1051762 - RNA, 20 nt, Mycobacterium bovis subsp bovis AF2122/97
ccggcggcccgcucgaaagc

SEQ ID NO: 1051763 - RNA, 20 nt, Mycobacterium bovis subsp bovis AF2122/97
ccggcggccgccaucagccg

SEQ ID NO: 1051764 - RNA, 22 nt, Mycobacterium bovis subsp bovis AF2122/97
ccggcggccgcuucggcgguca

SEQ ID NO: 1051765 - RNA, 13 nt, Mycobacterium bovis subsp bovis AF2122/97
ccggcggcggcca

SEQ ID NO: 1051766 - RNA, 19 nt, Mycobacterium bovis subsp bovis AF2122/97
ccggcggcggaggcuucga

SEQ ID NO: 1051767 - RNA, 15 nt, Mycobacterium bovis subsp bovis AF2122/97
ccggcggcggccagg

SEQ ID NO: 1051768 - RNA, 14 nt, Mycobacterium bovis subsp bovis AF2122/97
ccggcggcggccgc

SEQ ID NO: 1051769 - RNA, 22 nt, Mycobacterium bovis subsp bovis AF2122/97
ccggcggcggccgcagcggcca

SEQ ID NO: 1051770 - RNA, 14 nt, Mycobacterium bovis subsp bovis AF2122/97
ccggcggcggugcg

SEQ ID NO: 1051771 - RNA, 23 nt, Mycobacterium bovis subsp bovis AF2122/97
ccggcggcguccaucgcgcgccg

SEQ ID NO: 1051772 - RNA, 12 nt, Mycobacterium bovis subsp bovis AF2122/97
ccggcggcggcc

SEQ ID NO: 1051773 - RNA, 18 nt, Mycobacterium bovis subsp bovis AF2122/97
ccggcgggaugcgcgccc

SEQ ID NO: 1051774 - RNA, 19 nt, Mycobacterium bovis subsp bovis AF2122/97
ccggcgggaugcgcgcccg

SEQ ID NO: 1051775 - RNA, 22 nt, Mycobacterium bovis subsp bovis AF2122/97
ccggcgggaugcgcgcccgacg

SEQ ID NO: 1051776 - RNA, 17 nt, Mycobacterium bovis subsp bovis AF2122/97
ccggcgguagucggcca

SEQ ID NO: 1051777 - RNA, 15 nt, Mycobacterium bovis subsp bovis AF2122/97
ccggcgguagucggc

SEQ ID NO: 1051778 - RNA, 17 nt, Mycobacterium bovis subsp bovis AF2122/97
ccggcggucagcagcgc

SEQ ID NO: 1051779 - RNA, 21 nt, Mycobacterium bovis subsp bovis AF2122/97
ccggcggucagcagcgccguc

SEQ ID NO: 1051780 - RNA, 17 nt, Mycobacterium bovis subsp bovis AF2122/97
ccggcggucagcggcuc

SEQ ID NO: 1051781 - RNA, 19 nt, Mycobacterium bovis subsp bovis AF2122/97
ccggcgguagucggccagc

SEQ ID NO: 1051782 - RNA, 17 nt, Mycobacterium bovis subsp bovis AF2122/97
ccggcggugccgucagc

SEQ ID NO: 1051783 - RNA, 17 nt, Mycobacterium bovis subsp bovis AF2122/97
ccggcggugccgucgcc

SEQ ID NO: 1051784 - RNA, 21 nt, Mycobacterium bovis subsp bovis AF2122/97
ccggcggugccgucgccgccc

SEQ ID NO: 1051785 - RNA, 21 nt, Mycobacterium bovis subsp bovis AF2122/97
ccggcguccaguccgaucacc

SEQ ID NO: 1051786 - RNA, 23 nt, Mycobacterium bovis subsp bovis AF2122/97
ccggcggugacggcggcaacggc

SEQ ID NO: 1051787 - RNA, 21 nt, Mycobacterium bovis subsp bovis AF2122/97
ccggcgugucgcgucgugcga

SEQ ID NO: 1051788 - RNA, 22 nt, Mycobacterium bovis subsp bovis AF2122/97
ccggcguggugagccucggcga

SEQ ID NO: 1051789 - RNA, 17 nt, Mycobacterium bovis subsp bovis AF2122/97
ccggcguguucugaucg

SEQ ID NO: 1051790 - RNA, 17 nt, Mycobacterium bovis subsp bovis AF2122/97
ccggcgugguagacggc

SEQ ID NO: 1051791 - RNA, 23 nt, Mycobacterium bovis subsp bovis AF2122/97
ccggcguggcuucacccaacccc

SEQ ID NO: 1051792 - RNA, 23 nt, Mycobacterium bovis subsp bovis AF2122/97
ccggcgugcugugcucacgagca

SEQ ID NO: 1051793 - RNA, 13 nt, Mycobacterium bovis subsp bovis AF2122/97
ccggcguggaucc

SEQ ID NO: 1051794 - RNA, 22 nt, Mycobacterium bovis subsp bovis AF2122/97
ccggcguggauccguagaaggc

SEQ ID NO: 1051795 - RNA, 16 nt, Mycobacterium bovis subsp bovis AF2122/97
ccggcgucgaugacga

SEQ ID NO: 1051796 - RNA, 17 nt, Mycobacterium bovis subsp bovis AF2122/97
ccggcgucgacgucggc

SEQ ID NO: 1051797 - RNA, 13 nt, Mycobacterium bovis subsp bovis AF2122/97
ccggcgucgagcc

SEQ ID NO: 1051798 - RNA, 13 nt, Mycobacterium bovis subsp bovis AF2122/97
ccggcguccgacc

SEQ ID NO: 1051799 - RNA, 18 nt, Mycobacterium bovis subsp bovis AF2122/97
ccggcgucgaaggugacc

SEQ ID NO: 1051800 - RNA, 21 nt, Mycobacterium bovis subsp bovis AF2122/97
ccggcgucgacgauucccgcg

SEQ ID NO: 1051801 - RNA, 14 nt, Mycobacterium bovis subsp bovis AF2122/97
ccggcgucgacguc

SEQ ID NO: 1051802 - RNA, 18 nt, Mycobacterium bovis subsp bovis AF2122/97
ccggcgucgaugacgacg

SEQ ID NO: 1051803 - RNA, 23 nt, Mycobacterium bovis subsp bovis AF2122/97
ccggcgucgaugacgacgccguc

SEQ ID NO: 1051804 - RNA, 15 nt, Mycobacterium bovis subsp bovis AF2122/97
ccggcgucgcuggcc

SEQ ID NO: 1051805 - RNA, 17 nt, Mycobacterium bovis subsp bovis AF2122/97
ccggcgucgcuggccag

SEQ ID NO: 1051806 - RNA, 16 nt, Mycobacterium bovis subsp bovis AF2122/97
ccggcgugcagaaucc

SEQ ID NO: 1051807 - RNA, 14 nt, Mycobacterium bovis subsp bovis AF2122/97
ccggcgugcacucc

SEQ ID NO: 1051808 - RNA, 16 nt, Mycobacterium bovis subsp bovis AF2122/97
ccggcguugccgaaac

SEQ ID NO: 1051809 - RNA, 15 nt, Mycobacterium bovis subsp bovis AF2122/97
ccggcguugccgccg

SEQ ID NO: 1051810 - RNA, 12 nt, Mycobacterium bovis subsp bovis AF2122/97
ccggcguuggcc

SEQ ID NO: 1051811 - RNA, 20 nt, Mycobacterium bovis subsp bovis AF2122/97
ccggcguucccgccauugcc

SEQ ID NO: 1051812 - RNA, 19 nt, Mycobacterium bovis subsp bovis AF2122/97
ccggcguuguugaccagca

SEQ ID NO: 1051813 - RNA, 20 nt, Mycobacterium bovis subsp bovis AF2122/97
ccggcguuguugaccagcac

SEQ ID NO: 1051814 - RNA, 14 nt, Mycobacterium bovis subsp bovis AF2122/97
ccggcuaccggcgu

SEQ ID NO: 1051815 - RNA, 16 nt, Mycobacterium bovis subsp bovis AF2122/97
ccggcuccgccguuga

SEQ ID NO: 1051816 - RNA, 17 nt, Mycobacterium bovis subsp bovis AF2122/97
ccggcuccgccguugac

SEQ ID NO: 1051817 - RNA, 17 nt, Mycobacterium bovis subsp bovis AF2122/97
ccggcuacgacggcgcc

SEQ ID NO: 1051818 - RNA, 19 nt, Mycobacterium bovis subsp bovis AF2122/97
ccggcuacgacggcgccau

SEQ ID NO: 1051819 - RNA, 14 nt, Mycobacterium bovis subsp bovis AF2122/97
ccggcuagcucggc

SEQ ID NO: 1051820 - RNA, 18 nt, Mycobacterium bovis subsp bovis AF2122/97
ccggcuagcucggcggcu

SEQ ID NO: 1051821 - RNA, 19 nt, Mycobacterium bovis subsp bovis AF2122/97
ccggcuaggagaucagcac

SEQ ID NO: 1051822 - RNA, 21 nt, Mycobacterium bovis subsp bovis AF2122/97
ccggcucgacgcgucgccggc

SEQ ID NO: 1051823 - RNA, 23 nt, Mycobacterium bovis subsp bovis AF2122/97
ccggcucgacgcgucgccggccg

SEQ ID NO: 1051824 - RNA, 20 nt, Mycobacterium bovis subsp bovis AF2122/97
ccggcuaccgccuugucggc

SEQ ID NO: 1051825 - RNA, 20 nt, Mycobacterium bovis subsp bovis AF2122/97
ccggcuccuccccggcccgc

SEQ ID NO: 1051826 - RNA, 17 nt, Mycobacterium bovis subsp bovis AF2122/97
ccggcuccggcggugcc

SEQ ID NO: 1051827 - RNA, 20 nt, Mycobacterium bovis subsp bovis AF2122/97
ccggcuccggcggugccguc

SEQ ID NO: 1051828 - RNA, 17 nt, Mycobacterium bovis subsp bovis AF2122/97
ccggcuauaucccgccc

SEQ ID NO: 1051829 - RNA, 22 nt, Mycobacterium bovis subsp bovis AF2122/97
ccggcuccgccguugacgccgu

SEQ ID NO: 1051830 - RNA, 20 nt, Mycobacterium bovis subsp bovis AF2122/97
ccggcuccgccguugccgcc

SEQ ID NO: 1051831 - RNA, 13 nt, Mycobacterium bovis subsp bovis AF2122/97
ccggcucgccggc

SEQ ID NO: 1051832 - RNA, 19 nt, Mycobacterium bovis subsp bovis AF2122/97
ccggcucgccggcgaccgg

SEQ ID NO: 1051833 - RNA, 20 nt, Mycobacterium bovis subsp bovis AF2122/97
ccggcucgccggcgaccggg

SEQ ID NO: 1051834 - RNA, 16 nt, Mycobacterium bovis subsp bovis AF2122/97
ccggcucggaaaccgc

SEQ ID NO: 1051835 - RNA, 21 nt, Mycobacterium bovis subsp bovis AF2122/97
ccggcucggaaaccgccccgu

SEQ ID NO: 1051836 - RNA, 13 nt, Mycobacterium bovis subsp bovis AF2122/97
ccggcucggccag

SEQ ID NO: 1051837 - RNA, 14 nt, Mycobacterium bovis subsp bovis AF2122/97
ccggcucgagcucg

SEQ ID NO: 1051838 - RNA, 22 nt, Mycobacterium bovis subsp bovis AF2122/97
ccggcucgccgacccgccgcgg

SEQ ID NO: 1051839 - RNA, 18 nt, Mycobacterium bovis subsp bovis AF2122/97
ccggcugcaggugcuggu

SEQ ID NO: 1051840 - RNA, 12 nt, Mycobacterium bovis subsp bovis AF2122/97
ccggcugcaucc

SEQ ID NO: 1051841 - RNA, 21 nt, Mycobacterium bovis subsp bovis AF2122/97
ccggcugcauccuccucgucg

SEQ ID NO: 1051842 - RNA, 19 nt, Mycobacterium bovis subsp bovis AF2122/97
ccggcugauucgagccaca

SEQ ID NO: 1051843 - RNA, 13 nt, Mycobacterium bovis subsp bovis AF2122/97
ccggcugccacac

SEQ ID NO: 1051844 - RNA, 16 nt, Mycobacterium bovis subsp bovis AF2122/97
ccggcugccagcgccg

SEQ ID NO: 1051845 - RNA, 18 nt, Mycobacterium bovis subsp bovis AF2122/97
ccggcugccagcgccgcc

SEQ ID NO: 1051846 - RNA, 19 nt, Mycobacterium bovis subsp bovis AF2122/97
ccggcugccagcgccgccg

SEQ ID NO: 1051847 - RNA, 19 nt, Mycobacterium bovis subsp bovis AF2122/97
ccggcugcggaucacagug

SEQ ID NO: 1051848 - RNA, 15 nt, Mycobacterium bovis subsp bovis AF2122/97
ccggcugccgucagc

SEQ ID NO: 1051849 - RNA, 23 nt, Mycobacterium bovis subsp bovis AF2122/97
ccggcugcgguaaucgccaccgc

SEQ ID NO: 1051850 - RNA, 14 nt, Mycobacterium bovis subsp bovis AF2122/97
ccgggaaacaccgg

SEQ ID NO: 1051851 - RNA, 15 nt, Mycobacterium bovis subsp bovis AF2122/97
ccgggaaacaccggc

SEQ ID NO: 1051852 - RNA, 19 nt, Mycobacterium bovis subsp bovis AF2122/97
ccgggaccaggccaacggc

SEQ ID NO: 1051853 - RNA, 17 nt, Mycobacterium bovis subsp bovis AF2122/97
ccgggaaauaucucggu

SEQ ID NO: 1051854 - RNA, 18 nt, Mycobacterium bovis subsp bovis AF2122/97
ccgggacggugaaaccgg

SEQ ID NO: 1051855 - RNA, 16 nt, Mycobacterium bovis subsp bovis AF2122/97
ccgggaccgccccggc

SEQ ID NO: 1051856 - RNA, 23 nt, Mycobacterium bovis subsp bovis AF2122/97
ccgggaccgccccggccaggaca

SEQ ID NO: 1051857 - RNA, 11 nt, Mycobacterium bovis subsp bovis AF2122/97
ccgggaccgga

SEQ ID NO: 1051858 - RNA, 18 nt, Mycobacterium bovis subsp bovis AF2122/97
ccgggacgaaucccgcgc

SEQ ID NO: 1051859 - RNA, 20 nt, Mycobacterium bovis subsp bovis AF2122/97
ccgggacgaaucccgcgccc

SEQ ID NO: 1051860 - RNA, 23 nt, Mycobacterium bovis subsp bovis AF2122/97
ccgggacgaaucccgcgcccggc

SEQ ID NO: 1051861 - RNA, 14 nt, Mycobacterium bovis subsp bovis AF2122/97
ccggcuuggugaac

SEQ ID NO: 1051862 - RNA, 19 nt, Mycobacterium bovis subsp bovis AF2122/97
ccggcuuggugaaccgcgc

SEQ ID NO: 1051863 - RNA, 23 nt, Mycobacterium bovis subsp bovis AF2122/97
ccggcuuuuccggcauugccgcc

SEQ ID NO: 1051864 - RNA, 19 nt, Mycobacterium bovis subsp bovis AF2122/97
ccggcuuuugcgcccagca

SEQ ID NO: 1051865 - RNA, 15 nt, Mycobacterium bovis subsp bovis AF2122/97
ccggcuuggccuuug

SEQ ID NO: 1051866 - RNA, 21 nt, Mycobacterium bovis subsp bovis AF2122/97
ccggcuucgucggccagcagc

SEQ ID NO: 1051867 - RNA, 22 nt, Mycobacterium bovis subsp bovis AF2122/97
ccggcuucggguguucgcgcgc

SEQ ID NO: 1051868 - RNA, 13 nt, Mycobacterium bovis subsp bovis AF2122/97
ccggcuucggcga

SEQ ID NO: 1051869 - RNA, 16 nt, Mycobacterium bovis subsp bovis AF2122/97
ccggcuucgucggcca

SEQ ID NO: 1051870 - RNA, 17 nt, Mycobacterium bovis subsp bovis AF2122/97
ccggcuucgucggccag

SEQ ID NO: 1051871 - RNA, 18 nt, Mycobacterium bovis subsp bovis AF2122/97
ccggcuucguccaccgcg

SEQ ID NO: 1051872 - RNA, 19 nt, Mycobacterium bovis subsp bovis AF2122/97
ccggcuucguccaccgcga

SEQ ID NO: 1051873 - RNA, 19 nt, Mycobacterium bovis subsp bovis AF2122/97
ccggcuucgcccagagccg

SEQ ID NO: 1051874 - RNA, 12 nt, Mycobacterium bovis subsp bovis AF2122/97
ccggcuucgccg

SEQ ID NO: 1051875 - RNA, 15 nt, Mycobacterium bovis subsp bovis AF2122/97
ccggcuuccccagca

SEQ ID NO: 1051876 - RNA, 21 nt, Mycobacterium bovis subsp bovis AF2122/97
ccgggcuuguagacgccaugc

SEQ ID NO: 1051877 - RNA, 20 nt, Mycobacterium bovis subsp bovis AF2122/97
ccggggaaagccgcagccgc

SEQ ID NO: 1051878 - RNA, 18 nt, Mycobacterium bovis subsp bovis AF2122/97
ccgggcuuggccgcgccg

SEQ ID NO: 1051879 - RNA, 20 nt, Mycobacterium bovis subsp bovis AF2122/97
ccgggcuuggccgcgccggu

SEQ ID NO: 1051880 - RNA, 23 nt, Mycobacterium bovis subsp bovis AF2122/97
ccgggcuuggccgcgccggucgu

SEQ ID NO: 1051881 - RNA, 23 nt, Mycobacterium bovis subsp bovis AF2122/97
ccggggaagcuaaccgcuuggug

SEQ ID NO: 1051882 - RNA, 20 nt, Mycobacterium bovis subsp bovis AF2122/97
ccggggacaacucgcguggc

SEQ ID NO: 1051883 - RNA, 20 nt, Mycobacterium bovis subsp bovis AF2122/97
ccggggacagcccggcagau

SEQ ID NO: 1051884 - RNA, 16 nt, Mycobacterium bovis subsp bovis AF2122/97
ccggggacgucgacuu

SEQ ID NO: 1051885 - RNA, 18 nt, Mycobacterium bovis subsp bovis AF2122/97
ccggggacgggucggcag

SEQ ID NO: 1051886 - RNA, 15 nt, Mycobacterium bovis subsp bovis AF2122/97
ccggggacgccgcgg

SEQ ID NO: 1051887 - RNA, 16 nt, Mycobacterium bovis subsp bovis AF2122/97
ccggggacgccgcggc

SEQ ID NO: 1051888 - RNA, 13 nt, Mycobacterium bovis subsp bovis AF2122/97
ccggggacggguc

SEQ ID NO: 1051889 - RNA, 16 nt, Mycobacterium bovis subsp bovis AF2122/97
ccggggauaccgguca

SEQ ID NO: 1051890 - RNA, 13 nt, Mycobacterium bovis subsp bovis AF2122/97
ccggggccacccg

SEQ ID NO: 1051891 - RNA, 15 nt, Mycobacterium bovis subsp bovis AF2122/97
ccggggccacccgca

SEQ ID NO: 1051892 - RNA, 16 nt, Mycobacterium bovis subsp bovis AF2122/97
ccggggccccaugccg

SEQ ID NO: 1051893 - RNA, 19 nt, Mycobacterium bovis subsp bovis AF2122/97
ccggggccccaugccgacc

SEQ ID NO: 1051894 - RNA, 12 nt, Mycobacterium bovis subsp bovis AF2122/97
ccggggaucggg

SEQ ID NO: 1051895 - RNA, 13 nt, Mycobacterium bovis subsp bovis AF2122/97
ccggggccgccga

SEQ ID NO: 1051896 - RNA, 21 nt, Mycobacterium bovis subsp bovis AF2122/97
ccggggccccaugccgaccgg

SEQ ID NO: 1051897 - RNA, 13 nt, Mycobacterium bovis subsp bovis AF2122/97
ccggggcccggac

SEQ ID NO: 1051898 - RNA, 21 nt, Mycobacterium bovis subsp bovis AF2122/97
ccggggcgaacggcaccgcgc

SEQ ID NO: 1051899 - RNA, 23 nt, Mycobacterium bovis subsp bovis AF2122/97
ccggggaaccuugaccgaccagc

SEQ ID NO: 1051900 - RNA, 10 nt, Mycobacterium bovis subsp bovis AF2122/97
ccggggcgca

SEQ ID NO: 1051901 - RNA, 16 nt, Mycobacterium bovis subsp bovis AF2122/97
ccggggcggaaccugu

SEQ ID NO: 1051902 - RNA, 13 nt, Mycobacterium bovis subsp bovis AF2122/97
ccggggcggccga

SEQ ID NO: 1051903 - RNA, 18 nt, Mycobacterium bovis subsp bovis AF2122/97
ccggggcgcucgcgcgcu

SEQ ID NO: 1051904 - RNA, 18 nt, Mycobacterium bovis subsp bovis AF2122/97
ccggggcgcucgugaugu

SEQ ID NO: 1051905 - RNA, 17 nt, Mycobacterium bovis subsp bovis AF2122/97
ccggggcggugggcgcu

SEQ ID NO: 1051906 - RNA, 22 nt, Mycobacterium bovis subsp bovis AF2122/97
ccgggggaagcgccaaacccgg

SEQ ID NO: 1051907 - RNA, 15 nt, Mycobacterium bovis subsp bovis AF2122/97
ccggggcgcccggcc

SEQ ID NO: 1051908 - RNA, 22 nt, Mycobacterium bovis subsp bovis AF2122/97
ccggggggcugcugcucggccu

SEQ ID NO: 1051909 - RNA, 19 nt, Mycobacterium bovis subsp bovis AF2122/97
ccgggguccaucggggccg

SEQ ID NO: 1051910 - RNA, 20 nt, Mycobacterium bovis subsp bovis AF2122/97
ccggggucaccuuggccggg

SEQ ID NO: 1051911 - RNA, 17 nt, Mycobacterium bovis subsp bovis AF2122/97
ccgggggaagcgcgucc

SEQ ID NO: 1051912 - RNA, 23 nt, Mycobacterium bovis subsp bovis AF2122/97
ccggggguguuggaagucccgcc

SEQ ID NO: 1051913 - RNA, 12 nt, Mycobacterium bovis subsp bovis AF2122/97
ccggggucaccu

SEQ ID NO: 1051914 - RNA, 23 nt, Mycobacterium bovis subsp bovis AF2122/97
ccggguccaagaaccacgacguu

SEQ ID NO: 1051915 - RNA, 22 nt, Mycobacterium bovis subsp bovis AF2122/97
ccgggucgaacaggccggccgc

SEQ ID NO: 1051916 - RNA, 23 nt, Mycobacterium bovis subsp bovis AF2122/97
ccgggucgaacaggccggccgcg

SEQ ID NO: 1051917 - RNA, 20 nt, Mycobacterium bovis subsp bovis AF2122/97
ccgggucgaaucgugucgcc

SEQ ID NO: 1051918 - RNA, 17 nt, Mycobacterium bovis subsp bovis AF2122/97
ccggguccgccguugcc

SEQ ID NO: 1051919 - RNA, 19 nt, Mycobacterium bovis subsp bovis AF2122/97
ccgggucacuccggcggcu

SEQ ID NO: 1051920 - RNA, 15 nt, Mycobacterium bovis subsp bovis AF2122/97
ccggguccggcguac

SEQ ID NO: 1051921 - RNA, 16 nt, Mycobacterium bovis subsp bovis AF2122/97
ccgggucgccgaugac

SEQ ID NO: 1051922 - RNA, 19 nt, Mycobacterium bovis subsp bovis AF2122/97
ccgggucgccgaugacggu

SEQ ID NO: 1051923 - RNA, 19 nt, Mycobacterium bovis subsp bovis AF2122/97
ccgggugaggcggugacga

SEQ ID NO: 1051924 - RNA, 12 nt, Mycobacterium bovis subsp bovis AF2122/97
ccgggucgauca

SEQ ID NO: 1051925 - RNA, 14 nt, Mycobacterium bovis subsp bovis AF2122/97
ccgggucgaucacc

SEQ ID NO: 1051926 - RNA, 21 nt, Mycobacterium bovis subsp bovis AF2122/97
ccgggucgaugucggggccgu

SEQ ID NO: 1051927 - RNA, 18 nt, Mycobacterium bovis subsp bovis AF2122/97
ccgggucgcaaccgccgc

SEQ ID NO: 1051928 - RNA, 20 nt, Mycobacterium bovis subsp bovis AF2122/97
ccgggucgcaaccgccgcca

SEQ ID NO: 1051929 - RNA, 19 nt, Mycobacterium bovis subsp bovis AF2122/97
ccggggugcccccggugcc

SEQ ID NO: 1051930 - RNA, 20 nt, Mycobacterium bovis subsp bovis AF2122/97
ccgggguggugaguaccaau

SEQ ID NO: 1051931 - RNA, 18 nt, Mycobacterium bovis subsp bovis AF2122/97
ccggggugccggcgaugu

SEQ ID NO: 1051932 - RNA, 17 nt, Mycobacterium bovis subsp bovis AF2122/97
ccggggugcccggccgc

SEQ ID NO: 1051933 - RNA, 16 nt, Mycobacterium bovis subsp bovis AF2122/97
ccgggguggcgcgcca

SEQ ID NO: 1051934 - RNA, 21 nt, Mycobacterium bovis subsp bovis AF2122/97
ccgggguuacucgcagcgccg

SEQ ID NO: 1051935 - RNA, 17 nt, Mycobacterium bovis subsp bovis AF2122/97
ccgggguucaccgucga

SEQ ID NO: 1051936 - RNA, 15 nt, Mycobacterium bovis subsp bovis AF2122/97
ccgggucaccagcgc

SEQ ID NO: 1051937 - RNA, 13 nt, Mycobacterium bovis subsp bovis AF2122/97
ccgggucaccgau

SEQ ID NO: 1051938 - RNA, 22 nt, Mycobacterium bovis subsp bovis AF2122/97
ccgggucaacgccaucaccccg

SEQ ID NO: 1051939 - RNA, 23 nt, Mycobacterium bovis subsp bovis AF2122/97
ccggguaucgccaguggugcacc

SEQ ID NO: 1051940 - RNA, 14 nt, Mycobacterium bovis subsp bovis AF2122/97
ccggguauuaccgc

SEQ ID NO: 1051941 - RNA, 14 nt, Mycobacterium bovis subsp bovis AF2122/97
ccggguacgccggg

SEQ ID NO: 1051942 - RNA, 14 nt, Mycobacterium bovis subsp bovis AF2122/97
ccggguacggcgua

SEQ ID NO: 1051943 - RNA, 16 nt, Mycobacterium bovis subsp bovis AF2122/97
ccggguagccggcgug

SEQ ID NO: 1051944 - RNA, 18 nt, Mycobacterium bovis subsp bovis AF2122/97
ccggguagcggcgccgcc

SEQ ID NO: 1051945 - RNA, 15 nt, Mycobacterium bovis subsp bovis AF2122/97
ccggguagcucccug

SEQ ID NO: 1051946 - RNA, 18 nt, Mycobacterium bovis subsp bovis AF2122/97
ccgggcgcaagcagcccg

SEQ ID NO: 1051947 - RNA, 14 nt, Mycobacterium bovis subsp bovis AF2122/97
ccgggcgaucgccu

SEQ ID NO: 1051948 - RNA, 14 nt, Mycobacterium bovis subsp bovis AF2122/97
ccgggcggcggcgg

SEQ ID NO: 1051949 - RNA, 18 nt, Mycobacterium bovis subsp bovis AF2122/97
ccgggcggcggccugggc

SEQ ID NO: 1051950 - RNA, 14 nt, Mycobacterium bovis subsp bovis AF2122/97
ccgggcggcggcga

SEQ ID NO: 1051951 - RNA, 15 nt, Mycobacterium bovis subsp bovis AF2122/97
ccgggcggcggcgac

SEQ ID NO: 1051952 - RNA, 12 nt, Mycobacterium bovis subsp bovis AF2122/97
ccgggcggcguu

SEQ ID NO: 1051953 - RNA, 15 nt, Mycobacterium bovis subsp bovis AF2122/97
ccgggcggucgagau

SEQ ID NO: 1051954 - RNA, 20 nt, Mycobacterium bovis subsp bovis AF2122/97
ccgggcgggcuggugucagc

SEQ ID NO: 1051955 - RNA, 19 nt, Mycobacterium bovis subsp bovis AF2122/97
ccgggcgggauccacccag

SEQ ID NO: 1051956 - RNA, 21 nt, Mycobacterium bovis subsp bovis AF2122/97
ccgggcgggauccacccagug

SEQ ID NO: 1051957 - RNA, 15 nt, Mycobacterium bovis subsp bovis AF2122/97
ccgggcugccaaggc

SEQ ID NO: 1051958 - RNA, 13 nt, Mycobacterium bovis subsp bovis AF2122/97
ccgggcugccgcc

SEQ ID NO: 1051959 - RNA, 15 nt, Mycobacterium bovis subsp bovis AF2122/97
ccgggcugccgccca

SEQ ID NO: 1051960 - RNA, 15 nt, Mycobacterium bovis subsp bovis AF2122/97
ccgggcucggugacc

SEQ ID NO: 1051961 - RNA, 19 nt, Mycobacterium bovis subsp bovis AF2122/97
ccgggcucuggccaguccg

SEQ ID NO: 1051962 - RNA, 17 nt, Mycobacterium bovis subsp bovis AF2122/97
ccgggcugcuugcgccc

SEQ ID NO: 1051963 - RNA, 20 nt, Mycobacterium bovis subsp bovis AF2122/97
ccgggcugcuugcgcccggc

SEQ ID NO: 1051964 - RNA, 16 nt, Mycobacterium bovis subsp bovis AF2122/97
ccgggcuggccagcgc

SEQ ID NO: 1051965 - RNA, 19 nt, Mycobacterium bovis subsp bovis AF2122/97
ccgggcuggccagcgcgcu

SEQ ID NO: 1051966 - RNA, 20 nt, Mycobacterium bovis subsp bovis AF2122/97
ccgggcuggccagcgcgcuc

SEQ ID NO: 1051967 - RNA, 18 nt, Mycobacterium bovis subsp bovis AF2122/97
ccgggcuucagcacgcgg

SEQ ID NO: 1051968 - RNA, 17 nt, Mycobacterium bovis subsp bovis AF2122/97
ccgggcuggccgacucg

SEQ ID NO: 1051969 - RNA, 22 nt, Mycobacterium bovis subsp bovis AF2122/97
ccgggcuguagcgaaugaucuu

SEQ ID NO: 1051970 - RNA, 12 nt, Mycobacterium bovis subsp bovis AF2122/97
ccgggccgccga

SEQ ID NO: 1051971 - RNA, 23 nt, Mycobacterium bovis subsp bovis AF2122/97
ccgggccgaucaccccgguggac

SEQ ID NO: 1051972 - RNA, 15 nt, Mycobacterium bovis subsp bovis AF2122/97
ccgggccgccagggc

SEQ ID NO: 1051973 - RNA, 17 nt, Mycobacterium bovis subsp bovis AF2122/97
ccgggcccgucggacau

SEQ ID NO: 1051974 - RNA, 15 nt, Mycobacterium bovis subsp bovis AF2122/97
ccgggccgaagcgcg

SEQ ID NO: 1051975 - RNA, 17 nt, Mycobacterium bovis subsp bovis AF2122/97
ccgggccgaagcgcgcg

SEQ ID NO: 1051976 - RNA, 16 nt, Mycobacterium bovis subsp bovis AF2122/97
ccgggccgagcgcacc

SEQ ID NO: 1051977 - RNA, 15 nt, Mycobacterium bovis subsp bovis AF2122/97
ccgggcgaccaacac

SEQ ID NO: 1051978 - RNA, 15 nt, Mycobacterium bovis subsp bovis AF2122/97
ccgggcgaccaccac

SEQ ID NO: 1051979 - RNA, 17 nt, Mycobacterium bovis subsp bovis AF2122/97
ccgggcgaccaccaccg

SEQ ID NO: 1051980 - RNA, 19 nt, Mycobacterium bovis subsp bovis AF2122/97
ccgggcgaccaccaccgcc

SEQ ID NO: 1051981 - RNA, 20 nt, Mycobacterium bovis subsp bovis AF2122/97
ccgggcgaccaccaccgccg

SEQ ID NO: 1051982 - RNA, 24 nt, Mycobacterium bovis subsp bovis AF2122/97
ccgggcgaccaccaccgccgccga

SEQ ID NO: 1051983 - RNA, 12 nt, Mycobacterium bovis subsp bovis AF2122/97
ccgggccgccgc

SEQ ID NO: 1051984 - RNA, 21 nt, Mycobacterium bovis subsp bovis AF2122/97
ccgggccgagcgcaccacggc

SEQ ID NO: 1051985 - RNA, 19 nt, Mycobacterium bovis subsp bovis AF2122/97
ccgggcgaauccggcgggu

SEQ ID NO: 1051986 - RNA, 12 nt, Mycobacterium bovis subsp bovis AF2122/97
ccgggcgacggu

SEQ ID NO: 1051987 - RNA, 19 nt, Mycobacterium bovis subsp bovis AF2122/97
ccgggcgaguacaggcgca

SEQ ID NO: 1051988 - RNA, 18 nt, Mycobacterium bovis subsp bovis AF2122/97
ccgggcgagucccggcgg

SEQ ID NO: 1051989 - RNA, 20 nt, Mycobacterium bovis subsp bovis AF2122/97
ccgggcaaggccaccgucgc

SEQ ID NO: 1051990 - RNA, 19 nt, Mycobacterium bovis subsp bovis AF2122/97
ccgggcaacgcgaaccggc

SEQ ID NO: 1051991 - RNA, 22 nt, Mycobacterium bovis subsp bovis AF2122/97
ccgggcaacgcgaaccggccau

SEQ ID NO: 1051992 - RNA, 15 nt, Mycobacterium bovis subsp bovis AF2122/97
ccgggagugcgccgg

SEQ ID NO: 1051993 - RNA, 22 nt, Mycobacterium bovis subsp bovis AF2122/97
ccgggaugugcggcugcaccgg

SEQ ID NO: 1051994 - RNA, 14 nt, Mycobacterium bovis subsp bovis AF2122/97
ccgggcaacggcgg

SEQ ID NO: 1051995 - RNA, 20 nt, Mycobacterium bovis subsp bovis AF2122/97
ccgggcaaccagcagcaggu

SEQ ID NO: 1051996 - RNA, 22 nt, Mycobacterium bovis subsp bovis AF2122/97
ccgggcaaccagcagcagguug

SEQ ID NO: 1051997 - RNA, 20 nt, Mycobacterium bovis subsp bovis AF2122/97
ccgggcaaaucaagcacagc

SEQ ID NO: 1051998 - RNA, 22 nt, Mycobacterium bovis subsp bovis AF2122/97
ccgggcaaaucaagcacagccc

SEQ ID NO: 1051999 - RNA, 20 nt, Mycobacterium bovis subsp bovis AF2122/97
ccgggacguuguccaccgcc

SEQ ID NO: 1052000 - RNA, 21 nt, Mycobacterium bovis subsp bovis AF2122/97
ccgggacguuguccaccgcca

SEQ ID NO: 1052001 - RNA, 16 nt, Mycobacterium bovis subsp bovis AF2122/97
ccgggacuaccacccg

SEQ ID NO: 1052002 - RNA, 18 nt, Mycobacterium bovis subsp bovis AF2122/97
ccgggacgauucucgagu

SEQ ID NO: 1052003 - RNA, 21 nt, Mycobacterium bovis subsp bovis AF2122/97
ccgggauggcucacccaggcg

SEQ ID NO: 1052004 - RNA, 21 nt, Mycobacterium bovis subsp bovis AF2122/97
ccgggaugcgacagcgcuggg

SEQ ID NO: 1052005 - RNA, 15 nt, Mycobacterium bovis subsp bovis AF2122/97
ccgggaggcggcgcc

SEQ ID NO: 1052006 - RNA, 17 nt, Mycobacterium bovis subsp bovis AF2122/97
ccgggaggcggcgccgc

SEQ ID NO: 1052007 - RNA, 16 nt, Mycobacterium bovis subsp bovis AF2122/97
ccgcgccaccggcacc

SEQ ID NO: 1052008 - RNA, 11 nt, Mycobacterium bovis subsp bovis AF2122/97
ccgcgccaccu

SEQ ID NO: 1052009 - RNA, 21 nt, Mycobacterium bovis subsp bovis AF2122/97
ccgcgccaccucccacgccgc

SEQ ID NO: 1052010 - RNA, 23 nt, Mycobacterium bovis subsp bovis AF2122/97
ccgcgccaccucccacgccgccg

SEQ ID NO: 1052011 - RNA, 22 nt, Mycobacterium bovis subsp bovis AF2122/97
ccgcgccaccuccgacgggcga

SEQ ID NO: 1052012 - RNA, 17 nt, Mycobacterium bovis subsp bovis AF2122/97
ccgcgcaucugucgcgc

SEQ ID NO: 1052013 - RNA, 14 nt, Mycobacterium bovis subsp bovis AF2122/97
ccgcgcaggggcgg

SEQ ID NO: 1052014 - RNA, 15 nt, Mycobacterium bovis subsp bovis AF2122/97
ccgcgcaggcuucca

SEQ ID NO: 1052015 - RNA, 19 nt, Mycobacterium bovis subsp bovis AF2122/97
ccgcgcaacuaucgcaccu

SEQ ID NO: 1052016 - RNA, 19 nt, Mycobacterium bovis subsp bovis AF2122/97
ccgcgauucgcggcagccg

SEQ ID NO: 1052017 - RNA, 21 nt, Mycobacterium bovis subsp bovis AF2122/97
ccgcgauucgcggcagccggc

SEQ ID NO: 1052018 - RNA, 14 nt, Mycobacterium bovis subsp bovis AF2122/97
ccgcgcaacaccuc

SEQ ID NO: 1052019 - RNA, 14 nt, Mycobacterium bovis subsp bovis AF2122/97
ccgcgcagcgucaa

SEQ ID NO: 1052020 - RNA, 18 nt, Mycobacterium bovis subsp bovis AF2122/97
ccgcgcagccggcccguc

SEQ ID NO: 1052021 - RNA, 20 nt, Mycobacterium bovis subsp bovis AF2122/97
ccgcgauggugcgcccgccg

SEQ ID NO: 1052022 - RNA, 16 nt, Mycobacterium bovis subsp bovis AF2122/97
ccgcgcagcagugccg

SEQ ID NO: 1052023 - RNA, 16 nt, Mycobacterium bovis subsp bovis AF2122/97
ccgcgcagcgcggcgg

SEQ ID NO: 1052024 - RNA, 20 nt, Mycobacterium bovis subsp bovis AF2122/97
ccgcgcagcgcggcggcauc

SEQ ID NO: 1052025 - RNA, 14 nt, Mycobacterium bovis subsp bovis AF2122/97
ccgcgaugcgcacc

SEQ ID NO: 1052026 - RNA, 12 nt, Mycobacterium bovis subsp bovis AF2122/97
ccgcgauucgcg

SEQ ID NO: 1052027 - RNA, 21 nt, Mycobacterium bovis subsp bovis AF2122/97
ccgcgauuagcaaaccgaccg

SEQ ID NO: 1052028 - RNA, 12 nt, Mycobacterium bovis subsp bovis AF2122/97
ccgcgacggcgg

SEQ ID NO: 1052029 - RNA, 14 nt, Mycobacterium bovis subsp bovis AF2122/97
ccgcgacggaacca

SEQ ID NO: 1052030 - RNA, 14 nt, Mycobacterium bovis subsp bovis AF2122/97
ccgcgaccagcugg

SEQ ID NO: 1052031 - RNA, 23 nt, Mycobacterium bovis subsp bovis AF2122/97
ccgcgaccaucgcgacggcaagc

SEQ ID NO: 1052032 - RNA, 17 nt, Mycobacterium bovis subsp bovis AF2122/97
ccgcgaccagaggcgug

SEQ ID NO: 1052033 - RNA, 15 nt, Mycobacterium bovis subsp bovis AF2122/97
ccgcgaccagcgccg

SEQ ID NO: 1052034 - RNA, 16 nt, Mycobacterium bovis subsp bovis AF2122/97
ccgcgaccagcgccgc

SEQ ID NO: 1052035 - RNA, 18 nt, Mycobacterium bovis subsp bovis AF2122/97
ccgcgaccagcgccgcac

SEQ ID NO: 1052036 - RNA, 13 nt, Mycobacterium bovis subsp bovis AF2122/97
ccgcgacaccccg

SEQ ID NO: 1052037 - RNA, 20 nt, Mycobacterium bovis subsp bovis AF2122/97
ccgcgacaacaacucuucgg

SEQ ID NO: 1052038 - RNA, 22 nt, Mycobacterium bovis subsp bovis AF2122/97
ccgcgacaacaacucuucggcg

SEQ ID NO: 1052039 - RNA, 11 nt, Mycobacterium bovis subsp bovis AF2122/97
ccgcgaucacc

SEQ ID NO: 1052040 - RNA, 21 nt, Mycobacterium bovis subsp bovis AF2122/97
ccgcgacugcaccuggccgcc

SEQ ID NO: 1052041 - RNA, 19 nt, Mycobacterium bovis subsp bovis AF2122/97
ccgcgaggugaaucgcguc

SEQ ID NO: 1052042 - RNA, 17 nt, Mycobacterium bovis subsp bovis AF2122/97
ccgcgagguugaccacc

SEQ ID NO: 1052043 - RNA, 16 nt, Mycobacterium bovis subsp bovis AF2122/97
ccgccggugugcccgc

SEQ ID NO: 1052044 - RNA, 20 nt, Mycobacterium bovis subsp bovis AF2122/97
ccgccgguguugccguuacc

SEQ ID NO: 1052045 - RNA, 19 nt, Mycobacterium bovis subsp bovis AF2122/97
ccgccgguuccgccggccc

SEQ ID NO: 1052046 - RNA, 20 nt, Mycobacterium bovis subsp bovis AF2122/97
ccgccgguuccgccggcccc

SEQ ID NO: 1052047 - RNA, 12 nt, Mycobacterium bovis subsp bovis AF2122/97
ccgccgguggug

SEQ ID NO: 1052048 - RNA, 21 nt, Mycobacterium bovis subsp bovis AF2122/97
ccgccgguggugccggcgccg

SEQ ID NO: 1052049 - RNA, 22 nt, Mycobacterium bovis subsp bovis AF2122/97
ccgccgguggugccggcgccgc

SEQ ID NO: 1052050 - RNA, 18 nt, Mycobacterium bovis subsp bovis AF2122/97
ccgccgguggcgccgggg

SEQ ID NO: 1052051 - RNA, 19 nt, Mycobacterium bovis subsp bovis AF2122/97
ccgccgguggcgccggggc

SEQ ID NO: 1052052 - RNA, 22 nt, Mycobacterium bovis subsp bovis AF2122/97
ccgccgguggcgccggggccgc

SEQ ID NO: 1052053 - RNA, 14 nt, Mycobacterium bovis subsp bovis AF2122/97
ccgccgguggccgc

SEQ ID NO: 1052054 - RNA, 13 nt, Mycobacterium bovis subsp bovis AF2122/97
ccgccgguggccg

SEQ ID NO: 1052055 - RNA, 12 nt, Mycobacterium bovis subsp bovis AF2122/97
ccgccggugcgg

SEQ ID NO: 1052056 - RNA, 15 nt, Mycobacterium bovis subsp bovis AF2122/97
ccgccggugcggcca

SEQ ID NO: 1052057 - RNA, 15 nt, Mycobacterium bovis subsp bovis AF2122/97
ccgccggugccgcca

SEQ ID NO: 1052058 - RNA, 16 nt, Mycobacterium bovis subsp bovis AF2122/97
ccgccggugccgcccg

SEQ ID NO: 1052059 - RNA, 16 nt, Mycobacterium bovis subsp bovis AF2122/97
ccgccggugccgccgg

SEQ ID NO: 1052060 - RNA, 22 nt, Mycobacterium bovis subsp bovis AF2122/97
ccgccggugccgccggugccgc

SEQ ID NO: 1052061 - RNA, 20 nt, Mycobacterium bovis subsp bovis AF2122/97
ccgccggugccgccgucgcc

SEQ ID NO: 1052062 - RNA, 22 nt, Mycobacterium bovis subsp bovis AF2122/97
ccgccggugccgccgucgccgc

SEQ ID NO: 1052063 - RNA, 21 nt, Mycobacterium bovis subsp bovis AF2122/97
ccgccggugccgccugcgccg

SEQ ID NO: 1052064 - RNA, 17 nt, Mycobacterium bovis subsp bovis AF2122/97
ccgccgguggccgcgcu

SEQ ID NO: 1052065 - RNA, 23 nt, Mycobacterium bovis subsp bovis AF2122/97
ccgccguaacggucgcugucggc

SEQ ID NO: 1052066 - RNA, 19 nt, Mycobacterium bovis subsp bovis AF2122/97
ccgccguaugccgccaacc

SEQ ID NO: 1052067 - RNA, 21 nt, Mycobacterium bovis subsp bovis AF2122/97
ccgccguaugccgccaaccgc

SEQ ID NO: 1052068 - RNA, 16 nt, Mycobacterium bovis subsp bovis AF2122/97
ccgccguagaccagcc

SEQ ID NO: 1052069 - RNA, 19 nt, Mycobacterium bovis subsp bovis AF2122/97
ccgccguagaccagccguc

SEQ ID NO: 1052070 - RNA, 15 nt, Mycobacterium bovis subsp bovis AF2122/97
ccgccgucaccgccc

SEQ ID NO: 1052071 - RNA, 20 nt, Mycobacterium bovis subsp bovis AF2122/97
ccgccgucaccgcccuugcc

SEQ ID NO: 1052072 - RNA, 22 nt, Mycobacterium bovis subsp bovis AF2122/97
ccgccguugccgccgucaccgc

SEQ ID NO: 1052073 - RNA, 20 nt, Mycobacterium bovis subsp bovis AF2122/97
ccgccguugccgccguuacc

SEQ ID NO: 1052074 - RNA, 20 nt, Mycobacterium bovis subsp bovis AF2122/97
ccgccgucacccccgauagc

SEQ ID NO: 1052075 - RNA, 13 nt, Mycobacterium bovis subsp bovis AF2122/97
ccgccgucaccgc

SEQ ID NO: 1052076 - RNA, 21 nt, Mycobacterium bovis subsp bovis AF2122/97
ccgccguugccgccguugccg

SEQ ID NO: 1052077 - RNA, 16 nt, Mycobacterium bovis subsp bovis AF2122/97
ccgccguugccguaca

SEQ ID NO: 1052078 - RNA, 22 nt, Mycobacterium bovis subsp bovis AF2122/97
ccgccguugccguacagcccgg

SEQ ID NO: 1052079 - RNA, 23 nt, Mycobacterium bovis subsp bovis AF2122/97
ccgccguugccguacagcccggc

SEQ ID NO: 1052080 - RNA, 16 nt, Mycobacterium bovis subsp bovis AF2122/97
ccgccucaaugaccac

SEQ ID NO: 1052081 - RNA, 22 nt, Mycobacterium bovis subsp bovis AF2122/97
ccgccuaggaguuccucgaucg

SEQ ID NO: 1052082 - RNA, 19 nt, Mycobacterium bovis subsp bovis AF2122/97
ccgccguuuccgccgccgc

SEQ ID NO: 1052083 - RNA, 20 nt, Mycobacterium bovis subsp bovis AF2122/97
ccgccguuugcgccguugcc

SEQ ID NO: 1052084 - RNA, 22 nt, Mycobacterium bovis subsp bovis AF2122/97
ccgccguuggcucgagccgccc

SEQ ID NO: 1052085 - RNA, 15 nt, Mycobacterium bovis subsp bovis AF2122/97
ccgccguugggccgc

SEQ ID NO: 1052086 - RNA, 13 nt, Mycobacterium bovis subsp bovis AF2122/97
ccgccuacgacgc

SEQ ID NO: 1052087 - RNA, 15 nt, Mycobacterium bovis subsp bovis AF2122/97
ccgccuacgacgcag

SEQ ID NO: 1052088 - RNA, 19 nt, Mycobacterium bovis subsp bovis AF2122/97
ccgccuaaagcgugucgcc

SEQ ID NO: 1052089 - RNA, 21 nt, Mycobacterium bovis subsp bovis AF2122/97
ccgccuaagcauucagcgcgc

SEQ ID NO: 1052090 - RNA, 18 nt, Mycobacterium bovis subsp bovis AF2122/97
ccgccuaaucggccugcc

SEQ ID NO: 1052091 - RNA, 20 nt, Mycobacterium bovis subsp bovis AF2122/97
ccgccucguacggaccgucg

SEQ ID NO: 1052092 - RNA, 15 nt, Mycobacterium bovis subsp bovis AF2122/97
ccgccuccaccgccg

SEQ ID NO: 1052093 - RNA, 16 nt, Mycobacterium bovis subsp bovis AF2122/97
ccgccuccaccgccgc

SEQ ID NO: 1052094 - RNA, 20 nt, Mycobacterium bovis subsp bovis AF2122/97
ccgccuccaccgccgcgcgg

SEQ ID NO: 1052095 - RNA, 14 nt, Mycobacterium bovis subsp bovis AF2122/97
ccgccucgggccgg

SEQ ID NO: 1052096 - RNA, 16 nt, Mycobacterium bovis subsp bovis AF2122/97
ccgccugaccgccacc

SEQ ID NO: 1052097 - RNA, 18 nt, Mycobacterium bovis subsp bovis AF2122/97
ccgccugaccgccaccgu

SEQ ID NO: 1052098 - RNA, 22 nt, Mycobacterium bovis subsp bovis AF2122/97
ccgccucugucuucagcugcgg

SEQ ID NO: 1052099 - RNA, 12 nt, Mycobacterium bovis subsp bovis AF2122/97
ccgccugaccgc

SEQ ID NO: 1052100 - RNA, 14 nt, Mycobacterium bovis subsp bovis AF2122/97
ccgccugcaccgcc

SEQ ID NO: 1052101 - RNA, 17 nt, Mycobacterium bovis subsp bovis AF2122/97
ccgccugcaccgccgcc

SEQ ID NO: 1052102 - RNA, 18 nt, Mycobacterium bovis subsp bovis AF2122/97
ccgcgaacgcgacagcca

SEQ ID NO: 1052103 - RNA, 19 nt, Mycobacterium bovis subsp bovis AF2122/97
ccgcgaacgcgacagccac

SEQ ID NO: 1052104 - RNA, 19 nt, Mycobacterium bovis subsp bovis AF2122/97
ccgcgaagcgcucggcagc

SEQ ID NO: 1052105 - RNA, 20 nt, Mycobacterium bovis subsp bovis AF2122/97
ccgcgaacgauuucggccca

SEQ ID NO: 1052106 - RNA, 15 nt, Mycobacterium bovis subsp bovis AF2122/97
ccgcgaauucggcau

SEQ ID NO: 1052107 - RNA, 20 nt, Mycobacterium bovis subsp bovis AF2122/97
ccgcgaaugcugugccgaga

SEQ ID NO: 1052108 - RNA, 18 nt, Mycobacterium bovis subsp bovis AF2122/97
ccgcgaaucaacaggacc

SEQ ID NO: 1052109 - RNA, 21 nt, Mycobacterium bovis subsp bovis AF2122/97
ccgcgaaucaacaggaccggg

SEQ ID NO: 1052110 - RNA, 21 nt, Mycobacterium bovis subsp bovis AF2122/97
ccgcgaagcgcucggcagccg

SEQ ID NO: 1052111 - RNA, 15 nt, Mycobacterium bovis subsp bovis AF2122/97
ccgcgaagcgggaag

SEQ ID NO: 1052112 - RNA, 13 nt, Mycobacterium bovis subsp bovis AF2122/97
ccgcgaagcugcg

SEQ ID NO: 1052113 - RNA, 16 nt, Mycobacterium bovis subsp bovis AF2122/97
ccgcgaagcugcgggu

SEQ ID NO: 1052114 - RNA, 16 nt, Mycobacterium bovis subsp bovis AF2122/97
ccgccuuggucaccuu

SEQ ID NO: 1052115 - RNA, 18 nt, Mycobacterium bovis subsp bovis AF2122/97
ccgccugcgcggcugccg

SEQ ID NO: 1052116 - RNA, 23 nt, Mycobacterium bovis subsp bovis AF2122/97
ccgccugcgcggcugccgucucc

SEQ ID NO: 1052117 - RNA, 15 nt, Mycobacterium bovis subsp bovis AF2122/97
ccgccugcgccgcca

SEQ ID NO: 1052118 - RNA, 19 nt, Mycobacterium bovis subsp bovis AF2122/97
ccgccugcgccgcccgcgc

SEQ ID NO: 1052119 - RNA, 16 nt, Mycobacterium bovis subsp bovis AF2122/97
ccgccugccccacccg

SEQ ID NO: 1052120 - RNA, 13 nt, Mycobacterium bovis subsp bovis AF2122/97
ccgccugcccggc

SEQ ID NO: 1052121 - RNA, 19 nt, Mycobacterium bovis subsp bovis AF2122/97
ccgccugcccggcccgcuc

SEQ ID NO: 1052122 - RNA, 14 nt, Mycobacterium bovis subsp bovis AF2122/97
ccgccugccucgcc

SEQ ID NO: 1052123 - RNA, 17 nt, Mycobacterium bovis subsp bovis AF2122/97
ccgcgaacaaccugccg

SEQ ID NO: 1052124 - RNA, 18 nt, Mycobacterium bovis subsp bovis AF2122/97
ccgcgaacaaccugccgg

SEQ ID NO: 1052125 - RNA, 13 nt, Mycobacterium bovis subsp bovis AF2122/97
ccgcgaacauggu

SEQ ID NO: 1052126 - RNA, 18 nt, Mycobacterium bovis subsp bovis AF2122/97
ccgcgaacgaucccgccg

SEQ ID NO: 1052127 - RNA, 15 nt, Mycobacterium bovis subsp bovis AF2122/97
ccgcgaaccgcggau

SEQ ID NO: 1052128 - RNA, 20 nt, Mycobacterium bovis subsp bovis AF2122/97
ccgccuuugcccgccgcguc

SEQ ID NO: 1052129 - RNA, 15 nt, Mycobacterium bovis subsp bovis AF2122/97
ccgccuuugccgccg

SEQ ID NO: 1052130 - RNA, 16 nt, Mycobacterium bovis subsp bovis AF2122/97
ccgccuuugccgccgg

SEQ ID NO: 1052131 - RNA, 18 nt, Mycobacterium bovis subsp bovis AF2122/97
ccgccuuugccgccggca

SEQ ID NO: 1052132 - RNA, 19 nt, Mycobacterium bovis subsp bovis AF2122/97
ccgccggccaguccgcgcg

SEQ ID NO: 1052133 - RNA, 15 nt, Mycobacterium bovis subsp bovis AF2122/97
ccgccggcgccaccg

SEQ ID NO: 1052134 - RNA, 17 nt, Mycobacterium bovis subsp bovis AF2122/97
ccgccggcgccaccguc

SEQ ID NO: 1052135 - RNA, 22 nt, Mycobacterium bovis subsp bovis AF2122/97
ccgccggcgccaccgucaccgc

SEQ ID NO: 1052136 - RNA, 19 nt, Mycobacterium bovis subsp bovis AF2122/97
ccgccggcgccagcgccgc

SEQ ID NO: 1052137 - RNA, 18 nt, Mycobacterium bovis subsp bovis AF2122/97
ccgccggcgcccaggccg

SEQ ID NO: 1052138 - RNA, 22 nt, Mycobacterium bovis subsp bovis AF2122/97
ccgccggcgcccaggccgauca

SEQ ID NO: 1052139 - RNA, 17 nt, Mycobacterium bovis subsp bovis AF2122/97
ccgccggcgccgcccgc

SEQ ID NO: 1052140 - RNA, 20 nt, Mycobacterium bovis subsp bovis AF2122/97
ccgccggcgccgcccgcgcc

SEQ ID NO: 1052141 - RNA, 21 nt, Mycobacterium bovis subsp bovis AF2122/97
ccgccggcgccgcccgcgccg

SEQ ID NO: 1052142 - RNA, 20 nt, Mycobacterium bovis subsp bovis AF2122/97
ccgccggcgccgccgaugcc

SEQ ID NO: 1052143 - RNA, 22 nt, Mycobacterium bovis subsp bovis AF2122/97
ccgccggcgccgccggcgccgc

SEQ ID NO: 1052144 - RNA, 22 nt, Mycobacterium bovis subsp bovis AF2122/97
ccgccggcgccgccauugccau

SEQ ID NO: 1052145 - RNA, 13 nt, Mycobacterium bovis subsp bovis AF2122/97
ccgccggcgccgg

SEQ ID NO: 1052146 - RNA, 15 nt, Mycobacterium bovis subsp bovis AF2122/97
ccgccggcgcuggcg

SEQ ID NO: 1052147 - RNA, 19 nt, Mycobacterium bovis subsp bovis AF2122/97
ccgccggcgcuggcgggcg

SEQ ID NO: 1052148 - RNA, 12 nt, Mycobacterium bovis subsp bovis AF2122/97
ccgccggcggcg

SEQ ID NO: 1052149 - RNA, 18 nt, Mycobacterium bovis subsp bovis AF2122/97
ccgccggcggucgcguac

SEQ ID NO: 1052150 - RNA, 13 nt, Mycobacterium bovis subsp bovis AF2122/97
ccgccggcggcgg

SEQ ID NO: 1052151 - RNA, 14 nt, Mycobacterium bovis subsp bovis AF2122/97
ccgccggcggcggc

SEQ ID NO: 1052152 - RNA, 18 nt, Mycobacterium bovis subsp bovis AF2122/97
ccgccggcggcggccgca

SEQ ID NO: 1052153 - RNA, 13 nt, Mycobacterium bovis subsp bovis AF2122/97
ccgccgggcgccg

SEQ ID NO: 1052154 - RNA, 22 nt, Mycobacterium bovis subsp bovis AF2122/97
ccgccggugaucggcggcaacc

SEQ ID NO: 1052155 - RNA, 14 nt, Mycobacterium bovis subsp bovis AF2122/97
ccgccggucccgcg

SEQ ID NO: 1052156 - RNA, 16 nt, Mycobacterium bovis subsp bovis AF2122/97
ccgccggucccggacg

SEQ ID NO: 1052157 - RNA, 18 nt, Mycobacterium bovis subsp bovis AF2122/97
ccgccggguuggcgccgg

SEQ ID NO: 1052158 - RNA, 13 nt, Mycobacterium bovis subsp bovis AF2122/97
ccgccggugccga

SEQ ID NO: 1052159 - RNA, 14 nt, Mycobacterium bovis subsp bovis AF2122/97
ccgccggugccgau

SEQ ID NO: 1052160 - RNA, 16 nt, Mycobacterium bovis subsp bovis AF2122/97
ccgccggugccgauca

SEQ ID NO: 1052161 - RNA, 19 nt, Mycobacterium bovis subsp bovis AF2122/97
ccgccggugccgaucagca

SEQ ID NO: 1052162 - RNA, 12 nt, Mycobacterium bovis subsp bovis AF2122/97
ccgccggugcca

SEQ ID NO: 1052163 - RNA, 14 nt, Mycobacterium bovis subsp bovis AF2122/97
ccgccggugccacc

SEQ ID NO: 1052164 - RNA, 12 nt, Mycobacterium bovis subsp bovis AF2122/97
ccgccggggccc

SEQ ID NO: 1052165 - RNA, 19 nt, Mycobacterium bovis subsp bovis AF2122/97
ccgccgggcuucagcacgc

SEQ ID NO: 1052166 - RNA, 22 nt, Mycobacterium bovis subsp bovis AF2122/97
ccgccgggugcgccguugccgc

SEQ ID NO: 1052167 - RNA, 14 nt, Mycobacterium bovis subsp bovis AF2122/97
ccgccgggugucgg

SEQ ID NO: 1052168 - RNA, 18 nt, Mycobacterium bovis subsp bovis AF2122/97
ccgccggguccgccgggc

SEQ ID NO: 1052169 - RNA, 23 nt, Mycobacterium bovis subsp bovis AF2122/97
ccgccggguauugauugacugcu

SEQ ID NO: 1052170 - RNA, 14 nt, Mycobacterium bovis subsp bovis AF2122/97
ccgccgcgagcaga

SEQ ID NO: 1052171 - RNA, 17 nt, Mycobacterium bovis subsp bovis AF2122/97
ccgccgcgaccacgcac

SEQ ID NO: 1052172 - RNA, 19 nt, Mycobacterium bovis subsp bovis AF2122/97
ccgccgccugugcgcggug

SEQ ID NO: 1052173 - RNA, 20 nt, Mycobacterium bovis subsp bovis AF2122/97
ccgccgccugugcgcgguga

SEQ ID NO: 1052174 - RNA, 22 nt, Mycobacterium bovis subsp bovis AF2122/97
ccgccgccugugcgcggugacg

SEQ ID NO: 1052175 - RNA, 20 nt, Mycobacterium bovis subsp bovis AF2122/97
ccgccgccuuuuuucgccgc

SEQ ID NO: 1052176 - RNA, 17 nt, Mycobacterium bovis subsp bovis AF2122/97
ccgccgcgagcgccggc

SEQ ID NO: 1052177 - RNA, 23 nt, Mycobacterium bovis subsp bovis AF2122/97
ccgccgcgaugacggugccgacc

SEQ ID NO: 1052178 - RNA, 23 nt, Mycobacterium bovis subsp bovis AF2122/97
ccgccgcgaugccacccaacagc

SEQ ID NO: 1052179 - RNA, 18 nt, Mycobacterium bovis subsp bovis AF2122/97
ccgccgcgauggccccug

SEQ ID NO: 1052180 - RNA, 15 nt, Mycobacterium bovis subsp bovis AF2122/97
ccgccgcgcagccgc

SEQ ID NO: 1052181 - RNA, 21 nt, Mycobacterium bovis subsp bovis AF2122/97
ccgccgcguaccaauucccgc

SEQ ID NO: 1052182 - RNA, 13 nt, Mycobacterium bovis subsp bovis AF2122/97
ccgccgcgcccgg

SEQ ID NO: 1052183 - RNA, 20 nt, Mycobacterium bovis subsp bovis AF2122/97
ccgccgcgcagccgcucgac

SEQ ID NO: 1052184 - RNA, 23 nt, Mycobacterium bovis subsp bovis AF2122/97
ccgccgcguuucggucguuggug

SEQ ID NO: 1052185 - RNA, 18 nt, Mycobacterium bovis subsp bovis AF2122/97
ccgccgcuaccccagccg

SEQ ID NO: 1052186 - RNA, 15 nt, Mycobacterium bovis subsp bovis AF2122/97
ccgccgcuaccgccc

SEQ ID NO: 1052187 - RNA, 16 nt, Mycobacterium bovis subsp bovis AF2122/97
ccgccgcuaccgcccg

SEQ ID NO: 1052188 - RNA, 15 nt, Mycobacterium bovis subsp bovis AF2122/97
ccgccgcuaccgccg

SEQ ID NO: 1052189 - RNA, 16 nt, Mycobacterium bovis subsp bovis AF2122/97
ccgccggcagcaucgg

SEQ ID NO: 1052190 - RNA, 13 nt, Mycobacterium bovis subsp bovis AF2122/97
ccgccggcaccgu

SEQ ID NO: 1052191 - RNA, 16 nt, Mycobacterium bovis subsp bovis AF2122/97
ccgccggccaguccgc

SEQ ID NO: 1052192 - RNA, 17 nt, Mycobacterium bovis subsp bovis AF2122/97
ccgccggccagcgucgc

SEQ ID NO: 1052193 - RNA, 12 nt, Mycobacterium bovis subsp bovis AF2122/97
ccgccggccagc

SEQ ID NO: 1052194 - RNA, 13 nt, Mycobacterium bovis subsp bovis AF2122/97
ccgccggcaacgc

SEQ ID NO: 1052195 - RNA, 15 nt, Mycobacterium bovis subsp bovis AF2122/97
ccgccggcaccgccg

SEQ ID NO: 1052196 - RNA, 18 nt, Mycobacterium bovis subsp bovis AF2122/97
ccgccggcaccgccgccc

SEQ ID NO: 1052197 - RNA, 14 nt, Mycobacterium bovis subsp bovis AF2122/97
ccgccggcaccggg

SEQ ID NO: 1052198 - RNA, 14 nt, Mycobacterium bovis subsp bovis AF2122/97
ccgccggcacccgc

SEQ ID NO: 1052199 - RNA, 19 nt, Mycobacterium bovis subsp bovis AF2122/97
ccgccggcacccgccgugc

SEQ ID NO: 1052200 - RNA, 21 nt, Mycobacterium bovis subsp bovis AF2122/97
ccgccggcaauaccgccagcg

SEQ ID NO: 1052201 - RNA, 17 nt, Mycobacterium bovis subsp bovis AF2122/97
ccgccgcuccaggucga

SEQ ID NO: 1052202 - RNA, 18 nt, Mycobacterium bovis subsp bovis AF2122/97
ccgccgcuccaggucgac

SEQ ID NO: 1052203 - RNA, 16 nt, Mycobacterium bovis subsp bovis AF2122/97
ccgccgccgccggcgc

SEQ ID NO: 1052204 - RNA, 15 nt, Mycobacterium bovis subsp bovis AF2122/97
ccgccgccgccaucg

SEQ ID NO: 1052205 - RNA, 14 nt, Mycobacterium bovis subsp bovis AF2122/97
ccgccgccgcccgu

SEQ ID NO: 1052206 - RNA, 15 nt, Mycobacterium bovis subsp bovis AF2122/97
ccgccgccgccgacg

SEQ ID NO: 1052207 - RNA, 22 nt, Mycobacterium bovis subsp bovis AF2122/97
ccgccgcccguaucggcuucgu

SEQ ID NO: 1052208 - RNA, 14 nt, Mycobacterium bovis subsp bovis AF2122/97
ccgccgccgcguac

SEQ ID NO: 1052209 - RNA, 12 nt, Mycobacterium bovis subsp bovis AF2122/97
ccgccgccggca

SEQ ID NO: 1052210 - RNA, 15 nt, Mycobacterium bovis subsp bovis AF2122/97
ccgccgccugcccgg

SEQ ID NO: 1052211 - RNA, 16 nt, Mycobacterium bovis subsp bovis AF2122/97
ccgccgccugcccggc

SEQ ID NO: 1052212 - RNA, 13 nt, Mycobacterium bovis subsp bovis AF2122/97
ccgccgccgucgg

SEQ ID NO: 1052213 - RNA, 15 nt, Mycobacterium bovis subsp bovis AF2122/97
ccgccgccggugcgg

SEQ ID NO: 1052214 - RNA, 15 nt, Mycobacterium bovis subsp bovis AF2122/97
ccgccgccuccgccg

SEQ ID NO: 1052215 - RNA, 15 nt, Mycobacterium bovis subsp bovis AF2122/97
ccgccgcagacgccg

SEQ ID NO: 1052216 - RNA, 17 nt, Mycobacterium bovis subsp bovis AF2122/97
ccgccgcaaccgcgaag

SEQ ID NO: 1052217 - RNA, 14 nt, Mycobacterium bovis subsp bovis AF2122/97
ccgccgcaccgccg

SEQ ID NO: 1052218 - RNA, 15 nt, Mycobacterium bovis subsp bovis AF2122/97
ccgccgcaccgccgc

SEQ ID NO: 1052219 - RNA, 22 nt, Mycobacterium bovis subsp bovis AF2122/97
ccgccgagcggaccaccgcucg

SEQ ID NO: 1052220 - RNA, 16 nt, Mycobacterium bovis subsp bovis AF2122/97
ccgccgagggcgccgg

SEQ ID NO: 1052221 - RNA, 21 nt, Mycobacterium bovis subsp bovis AF2122/97
ccgccgaggucgguucggccg

SEQ ID NO: 1052222 - RNA, 21 nt, Mycobacterium bovis subsp bovis AF2122/97
ccgccgagcuggcgcgcgggg

SEQ ID NO: 1052223 - RNA, 12 nt, Mycobacterium bovis subsp bovis AF2122/97
ccgccgagcaga

SEQ ID NO: 1052224 - RNA, 15 nt, Mycobacterium bovis subsp bovis AF2122/97
ccgcccucggugaga

SEQ ID NO: 1052225 - RNA, 15 nt, Mycobacterium bovis subsp bovis AF2122/97
ccgccgacgccgccg

SEQ ID NO: 1052226 - RNA, 14 nt, Mycobacterium bovis subsp bovis AF2122/97
ccgccgacggaucg

SEQ ID NO: 1052227 - RNA, 15 nt, Mycobacterium bovis subsp bovis AF2122/97
ccgccgacgggaacc

SEQ ID NO: 1052228 - RNA, 20 nt, Mycobacterium bovis subsp bovis AF2122/97
ccgccgagaugaugcugccg

SEQ ID NO: 1052229 - RNA, 21 nt, Mycobacterium bovis subsp bovis AF2122/97
ccgccgagaugaugcugccgg

SEQ ID NO: 1052230 - RNA, 22 nt, Mycobacterium bovis subsp bovis AF2122/97
ccgccgagaugaugcugccggc

SEQ ID NO: 1052231 - RNA, 17 nt, Mycobacterium bovis subsp bovis AF2122/97
ccgccgacuccccgccg

SEQ ID NO: 1052232 - RNA, 12 nt, Mycobacterium bovis subsp bovis AF2122/97
ccgccgacguga

SEQ ID NO: 1052233 - RNA, 15 nt, Mycobacterium bovis subsp bovis AF2122/97
ccgccgacguugggg

SEQ ID NO: 1052234 - RNA, 23 nt, Mycobacterium bovis subsp bovis AF2122/97
ccgccgagauagcaacgaagccg

SEQ ID NO: 1052235 - RNA, 19 nt, Mycobacterium bovis subsp bovis AF2122/97
ccgcccucccuggggccgu

SEQ ID NO: 1052236 - RNA, 23 nt, Mycobacterium bovis subsp bovis AF2122/97
ccgccgacuugauuucgaucgcg

SEQ ID NO: 1052237 - RNA, 21 nt, Mycobacterium bovis subsp bovis AF2122/97
ccgcccguagacccacagucg

SEQ ID NO: 1052238 - RNA, 23 nt, Mycobacterium bovis subsp bovis AF2122/97
ccgcccggucgggcgcggggcgg

SEQ ID NO: 1052239 - RNA, 19 nt, Mycobacterium bovis subsp bovis AF2122/97
ccgcccggugcuaaccgac

SEQ ID NO: 1052240 - RNA, 13 nt, Mycobacterium bovis subsp bovis AF2122/97
ccgcccgugauca

SEQ ID NO: 1052241 - RNA, 18 nt, Mycobacterium bovis subsp bovis AF2122/97
ccgcccgugaucaccacg

SEQ ID NO: 1052242 - RNA, 12 nt, Mycobacterium bovis subsp bovis AF2122/97
ccgcccgugccg

SEQ ID NO: 1052243 - RNA, 13 nt, Mycobacterium bovis subsp bovis AF2122/97
ccgcccgugccgc

SEQ ID NO: 1052244 - RNA, 15 nt, Mycobacterium bovis subsp bovis AF2122/97
ccgcccgugccgccc

SEQ ID NO: 1052245 - RNA, 13 nt, Mycobacterium bovis subsp bovis AF2122/97
ccgcccgugccgu

SEQ ID NO: 1052246 - RNA, 13 nt, Mycobacterium bovis subsp bovis AF2122/97
ccgcccucaccgc

SEQ ID NO: 1052247 - RNA, 14 nt, Mycobacterium bovis subsp bovis AF2122/97
ccgccauccgaugg

SEQ ID NO: 1052248 - RNA, 16 nt, Mycobacterium bovis subsp bovis AF2122/97
ccgccaucgccaacac

SEQ ID NO: 1052249 - RNA, 18 nt, Mycobacterium bovis subsp bovis AF2122/97
ccgccaucauggcggccc

SEQ ID NO: 1052250 - RNA, 19 nt, Mycobacterium bovis subsp bovis AF2122/97
ccgccaucauggcggcccg

SEQ ID NO: 1052251 - RNA, 14 nt, Mycobacterium bovis subsp bovis AF2122/97
ccgccaucagccgc

SEQ ID NO: 1052252 - RNA, 20 nt, Mycobacterium bovis subsp bovis AF2122/97
ccgcugcuagugcgggccgu

SEQ ID NO: 1052253 - RNA, 15 nt, Mycobacterium bovis subsp bovis AF2122/97
ccgcugcugcugccc

SEQ ID NO: 1052254 - RNA, 19 nt, Mycobacterium bovis subsp bovis AF2122/97
ccgcugcuccucgcgguag

SEQ ID NO: 1052255 - RNA, 14 nt, Mycobacterium bovis subsp bovis AF2122/97
ccgcugcggugccg

SEQ ID NO: 1052256 - RNA, 17 nt, Mycobacterium bovis subsp bovis AF2122/97
ccgcugcggugccggcc

SEQ ID NO: 1052257 - RNA, 22 nt, Mycobacterium bovis subsp bovis AF2122/97
ccgcugcggugccggcccugcu

SEQ ID NO: 1052258 - RNA, 17 nt, Mycobacterium bovis subsp bovis AF2122/97
ccgcugcggcaccgagc

SEQ ID NO: 1052259 - RNA, 21 nt, Mycobacterium bovis subsp bovis AF2122/97
ccgcugacuccugcggcaccg

SEQ ID NO: 1052260 - RNA, 20 nt, Mycobacterium bovis subsp bovis AF2122/97
ccgcugcuugucgaggcgca

SEQ ID NO: 1052261 - RNA, 18 nt, Mycobacterium bovis subsp bovis AF2122/97
ccgcuggagaucacgccg

SEQ ID NO: 1052262 - RNA, 21 nt, Mycobacterium bovis subsp bovis AF2122/97
ccgcuggagaucacgccgacg

SEQ ID NO: 1052263 - RNA, 16 nt, Mycobacterium bovis subsp bovis AF2122/97
ccgcuggcaaucccgc

SEQ ID NO: 1052264 - RNA, 15 nt, Mycobacterium bovis subsp bovis AF2122/97
ccgcucgucguccgg

SEQ ID NO: 1052265 - RNA, 20 nt, Mycobacterium bovis subsp bovis AF2122/97
ccgcucgucguccggccacg

SEQ ID NO: 1052266 - RNA, 22 nt, Mycobacterium bovis subsp bovis AF2122/97
ccgcucgucguccggccacggu

SEQ ID NO: 1052267 - RNA, 22 nt, Mycobacterium bovis subsp bovis AF2122/97
ccgcucguuacgccgagcacac

SEQ ID NO: 1052268 - RNA, 21 nt, Mycobacterium bovis subsp bovis AF2122/97
ccgcucguuacgccgagcaca

SEQ ID NO: 1052269 - RNA, 17 nt, Mycobacterium bovis subsp bovis AF2122/97
ccgcucuccaccccguc

SEQ ID NO: 1052270 - RNA, 13 nt, Mycobacterium bovis subsp bovis AF2122/97
ccgcucucggcga

SEQ ID NO: 1052271 - RNA, 17 nt, Mycobacterium bovis subsp bovis AF2122/97
ccgcucugcggccacgc

SEQ ID NO: 1052272 - RNA, 14 nt, Mycobacterium bovis subsp bovis AF2122/97
ccgcugcggcaccg

SEQ ID NO: 1052273 - RNA, 15 nt, Mycobacterium bovis subsp bovis AF2122/97
ccgcugacgguucgg

SEQ ID NO: 1052274 - RNA, 23 nt, Mycobacterium bovis subsp bovis AF2122/97
ccgcugaagccaaaugcgcuguc

SEQ ID NO: 1052275 - RNA, 21 nt, Mycobacterium bovis subsp bovis AF2122/97
ccgcugacgaagcacaguucg

SEQ ID NO: 1052276 - RNA, 13 nt, Mycobacterium bovis subsp bovis AF2122/97
ccgcugaccauca

SEQ ID NO: 1052277 - RNA, 17 nt, Mycobacterium bovis subsp bovis AF2122/97
ccgcugaauuggcgccg

SEQ ID NO: 1052278 - RNA, 16 nt, Mycobacterium bovis subsp bovis AF2122/97
ccgcugaacaccgugg

SEQ ID NO: 1052279 - RNA, 19 nt, Mycobacterium bovis subsp bovis AF2122/97
ccgcucgggcgcgaggacg

SEQ ID NO: 1052280 - RNA, 20 nt, Mycobacterium bovis subsp bovis AF2122/97
ccgcucgagcagcgcgccgu

SEQ ID NO: 1052281 - RNA, 15 nt, Mycobacterium bovis subsp bovis AF2122/97
ccgcucgcaggccgg

SEQ ID NO: 1052282 - RNA, 18 nt, Mycobacterium bovis subsp bovis AF2122/97
ccgcucgggguggucggc

SEQ ID NO: 1052283 - RNA, 23 nt, Mycobacterium bovis subsp bovis AF2122/97
ccgcucgggguugcucgcgaucg

SEQ ID NO: 1052284 - RNA, 17 nt, Mycobacterium bovis subsp bovis AF2122/97
ccgcucgguaccggucg

SEQ ID NO: 1052285 - RNA, 11 nt, Mycobacterium bovis subsp bovis AF2122/97
ccgcucgucgc

SEQ ID NO: 1052286 - RNA, 22 nt, Mycobacterium bovis subsp bovis AF2122/97
ccgcucgucgccgguggcaccc

SEQ ID NO: 1052287 - RNA, 18 nt, Mycobacterium bovis subsp bovis AF2122/97
ccgcucgaccagacgcug

SEQ ID NO: 1052288 - RNA, 16 nt, Mycobacterium bovis subsp bovis AF2122/97
ccgcucgacggcccgc

SEQ ID NO: 1052289 - RNA, 17 nt, Mycobacterium bovis subsp bovis AF2122/97
ccgcucgacggcccgcc

SEQ ID NO: 1052290 - RNA, 15 nt, Mycobacterium bovis subsp bovis AF2122/97
ccgcucgaucggcag

SEQ ID NO: 1052291 - RNA, 16 nt, Mycobacterium bovis subsp bovis AF2122/97
ccgcucgaucggcagc

SEQ ID NO: 1052292 - RNA, 21 nt, Mycobacterium bovis subsp bovis AF2122/97
ccgcucgaucggcagccaggg

SEQ ID NO: 1052293 - RNA, 20 nt, Mycobacterium bovis subsp bovis AF2122/97
ccgcucgaaagcgucgauca

SEQ ID NO: 1052294 - RNA, 21 nt, Mycobacterium bovis subsp bovis AF2122/97
ccgcuaggacggcgcgagccg

SEQ ID NO: 1052295 - RNA, 19 nt, Mycobacterium bovis subsp bovis AF2122/97
ccgcuaccgcccgcgccac

SEQ ID NO: 1052296 - RNA, 13 nt, Mycobacterium bovis subsp bovis AF2122/97
ccgcuaacgcacc

SEQ ID NO: 1052297 - RNA, 14 nt, Mycobacterium bovis subsp bovis AF2122/97
ccgcuaccgucagu

SEQ ID NO: 1052298 - RNA, 21 nt, Mycobacterium bovis subsp bovis AF2122/97
ccgcuaccguuguugaggaug

SEQ ID NO: 1052299 - RNA, 16 nt, Mycobacterium bovis subsp bovis AF2122/97
ccgcuacggcagcccg

SEQ ID NO: 1052300 - RNA, 13 nt, Mycobacterium bovis subsp bovis AF2122/97
ccgcuacgcgcgc

SEQ ID NO: 1052301 - RNA, 14 nt, Mycobacterium bovis subsp bovis AF2122/97
ccgcuacgcgcgcu

SEQ ID NO: 1052302 - RNA, 18 nt, Mycobacterium bovis subsp bovis AF2122/97
ccgcuacgcgcgcucgcu

SEQ ID NO: 1052303 - RNA, 20 nt, Mycobacterium bovis subsp bovis AF2122/97
ccgcuacgcgcgcucgcuca

SEQ ID NO: 1052304 - RNA, 14 nt, Mycobacterium bovis subsp bovis AF2122/97
ccgcuagcccacca

SEQ ID NO: 1052305 - RNA, 20 nt, Mycobacterium bovis subsp bovis AF2122/97
ccgcuagcgcuugcgacccc

SEQ ID NO: 1052306 - RNA, 19 nt, Mycobacterium bovis subsp bovis AF2122/97
ccgcguuuauaccucgccg

SEQ ID NO: 1052307 - RNA, 22 nt, Mycobacterium bovis subsp bovis AF2122/97
ccgcguuuauaccucgccgccc

SEQ ID NO: 1052308 - RNA, 23 nt, Mycobacterium bovis subsp bovis AF2122/97
ccgcguuuauaccucgccgcccu

SEQ ID NO: 1052309 - RNA, 21 nt, Mycobacterium bovis subsp bovis AF2122/97
ccgcguuggacaauucgacga

SEQ ID NO: 1052310 - RNA, 13 nt, Mycobacterium bovis subsp bovis AF2122/97
ccgcguuggccac

SEQ ID NO: 1052311 - RNA, 16 nt, Mycobacterium bovis subsp bovis AF2122/97
ccgcguuucggucguu

SEQ ID NO: 1052312 - RNA, 22 nt, Mycobacterium bovis subsp bovis AF2122/97
ccgcggugcccgucggauggaa

SEQ ID NO: 1052313 - RNA, 22 nt, Mycobacterium bovis subsp bovis AF2122/97
ccgcggugaguucgccggaggc

SEQ ID NO: 1052314 - RNA, 14 nt, Mycobacterium bovis subsp bovis AF2122/97
ccgcggugacgcaa

SEQ ID NO: 1052315 - RNA, 23 nt, Mycobacterium bovis subsp bovis AF2122/97
ccgcggcuuggccuagccgcggc

SEQ ID NO: 1052316 - RNA, 19 nt, Mycobacterium bovis subsp bovis AF2122/97
ccgcgggaucgguggcggc

SEQ ID NO: 1052317 - RNA, 23 nt, Mycobacterium bovis subsp bovis AF2122/97
ccgcgggaucgguggcggcacgc

SEQ ID NO: 1052318 - RNA, 15 nt, Mycobacterium bovis subsp bovis AF2122/97
ccgcggcugucacgc

SEQ ID NO: 1052319 - RNA, 21 nt, Mycobacterium bovis subsp bovis AF2122/97
ccgcgggaccuucgagccgca

SEQ ID NO: 1052320 - RNA, 20 nt, Mycobacterium bovis subsp bovis AF2122/97
ccgcgggacaccaccgcccg

SEQ ID NO: 1052321 - RNA, 21 nt, Mycobacterium bovis subsp bovis AF2122/97
ccgcgggacaccaccgcccgc

SEQ ID NO: 1052322 - RNA, 20 nt, Mycobacterium bovis subsp bovis AF2122/97
ccgcggcugcuccgucgccg

SEQ ID NO: 1052323 - RNA, 19 nt, Mycobacterium bovis subsp bovis AF2122/97
ccgcggcuaggccaagccg

SEQ ID NO: 1052324 - RNA, 23 nt, Mycobacterium bovis subsp bovis AF2122/97
ccgcggcuaggccaagccgcggc

SEQ ID NO: 1052325 - RNA, 18 nt, Mycobacterium bovis subsp bovis AF2122/97
ccgcggcuaggccagcac

SEQ ID NO: 1052326 - RNA, 23 nt, Mycobacterium bovis subsp bovis AF2122/97
ccgcggcuaggccagcacggcga

SEQ ID NO: 1052327 - RNA, 16 nt, Mycobacterium bovis subsp bovis AF2122/97
ccgcgguggcggcgag

SEQ ID NO: 1052328 - RNA, 18 nt, Mycobacterium bovis subsp bovis AF2122/97
ccgcgguggcggcgagca

SEQ ID NO: 1052329 - RNA, 17 nt, Mycobacterium bovis subsp bovis AF2122/97
ccgcggugacgccagcc

SEQ ID NO: 1052330 - RNA, 21 nt, Mycobacterium bovis subsp bovis AF2122/97
ccgcgguguauccgacgucgg

SEQ ID NO: 1052331 - RNA, 20 nt, Mycobacterium bovis subsp bovis AF2122/97
ccgcguagaccagugaccgc

SEQ ID NO: 1052332 - RNA, 18 nt, Mycobacterium bovis subsp bovis AF2122/97
ccgcguagguggccagcg

SEQ ID NO: 1052333 - RNA, 21 nt, Mycobacterium bovis subsp bovis AF2122/97
ccgcguagguggccagcgcgg

SEQ ID NO: 1052334 - RNA, 14 nt, Mycobacterium bovis subsp bovis AF2122/97
ccgcguagacccca

SEQ ID NO: 1052335 - RNA, 16 nt, Mycobacterium bovis subsp bovis AF2122/97
ccgcguagugguggaa

SEQ ID NO: 1052336 - RNA, 22 nt, Mycobacterium bovis subsp bovis AF2122/97
ccgcgucacccguagguaguug

SEQ ID NO: 1052337 - RNA, 22 nt, Mycobacterium bovis subsp bovis AF2122/97
ccgcgucaccggaggccgccgc

SEQ ID NO: 1052338 - RNA, 22 nt, Mycobacterium bovis subsp bovis AF2122/97
ccgcgucaguccucaucgagcg

SEQ ID NO: 1052339 - RNA, 16 nt, Mycobacterium bovis subsp bovis AF2122/97
ccgcgucaucaccggu

SEQ ID NO: 1052340 - RNA, 23 nt, Mycobacterium bovis subsp bovis AF2122/97
ccgcgucaucaccgguacugcga

SEQ ID NO: 1052341 - RNA, 14 nt, Mycobacterium bovis subsp bovis AF2122/97
ccgcgucgucgaga

SEQ ID NO: 1052342 - RNA, 22 nt, Mycobacterium bovis subsp bovis AF2122/97
ccgcgucgucgagaaucggcau

SEQ ID NO: 1052343 - RNA, 14 nt, Mycobacterium bovis subsp bovis AF2122/97
ccgcgucgggccgc

SEQ ID NO: 1052344 - RNA, 14 nt, Mycobacterium bovis subsp bovis AF2122/97
ccgcgucguagcca

SEQ ID NO: 1052345 - RNA, 13 nt, Mycobacterium bovis subsp bovis AF2122/97
ccgcgugaccgac

SEQ ID NO: 1052346 - RNA, 23 nt, Mycobacterium bovis subsp bovis AF2122/97
ccgcgugacgcuuggccaauaga

SEQ ID NO: 1052347 - RNA, 16 nt, Mycobacterium bovis subsp bovis AF2122/97
ccgcguccaaggcgcg

SEQ ID NO: 1052348 - RNA, 18 nt, Mycobacterium bovis subsp bovis AF2122/97
ccgcguccaaggcgcgcu

SEQ ID NO: 1052349 - RNA, 23 nt, Mycobacterium bovis subsp bovis AF2122/97
ccgcguccaaggcgcgcugggcg

SEQ ID NO: 1052350 - RNA, 17 nt, Mycobacterium bovis subsp bovis AF2122/97
ccgcgucggcggccagu

SEQ ID NO: 1052351 - RNA, 14 nt, Mycobacterium bovis subsp bovis AF2122/97
ccgcgucggcggcg

SEQ ID NO: 1052352 - RNA, 15 nt, Mycobacterium bovis subsp bovis AF2122/97
ccgcgucggcggcga

SEQ ID NO: 1052353 - RNA, 16 nt, Mycobacterium bovis subsp bovis AF2122/97
ccgcgucggcggcgac

SEQ ID NO: 1052354 - RNA, 19 nt, Mycobacterium bovis subsp bovis AF2122/97
ccgcguggugcugaccgcg

SEQ ID NO: 1052355 - RNA, 22 nt, Mycobacterium bovis subsp bovis AF2122/97
ccgcguggugcugaccgcgccg

SEQ ID NO: 1052356 - RNA, 23 nt, Mycobacterium bovis subsp bovis AF2122/97
ccgcguggugcugaccgcgccgg

SEQ ID NO: 1052357 - RNA, 23 nt, Mycobacterium bovis subsp bovis AF2122/97
ccgcgugguuccggcgugcagca

SEQ ID NO: 1052358 - RNA, 14 nt, Mycobacterium bovis subsp bovis AF2122/97
ccgcguucagggca

SEQ ID NO: 1052359 - RNA, 15 nt, Mycobacterium bovis subsp bovis AF2122/97
ccgcguguaccgcga

SEQ ID NO: 1052360 - RNA, 23 nt, Mycobacterium bovis subsp bovis AF2122/97
ccgcguucugguuguugccgacg

SEQ ID NO: 1052361 - RNA, 16 nt, Mycobacterium bovis subsp bovis AF2122/97
ccgcguuaugccaggc

SEQ ID NO: 1052362 - RNA, 13 nt, Mycobacterium bovis subsp bovis AF2122/97
ccgcguugaaggc

SEQ ID NO: 1052363 - RNA, 21 nt, Mycobacterium bovis subsp bovis AF2122/97
ccgcguugccaaagcccacac

SEQ ID NO: 1052364 - RNA, 19 nt, Mycobacterium bovis subsp bovis AF2122/97
ccgcgugggcaugcggauu

SEQ ID NO: 1052365 - RNA, 15 nt, Mycobacterium bovis subsp bovis AF2122/97
ccgcguggcuggcgg

SEQ ID NO: 1052366 - RNA, 14 nt, Mycobacterium bovis subsp bovis AF2122/97
ccgcgugcggggga

SEQ ID NO: 1052367 - RNA, 18 nt, Mycobacterium bovis subsp bovis AF2122/97
ccgcguggcuggcggcga

SEQ ID NO: 1052368 - RNA, 19 nt, Mycobacterium bovis subsp bovis AF2122/97
ccgcgugacguaccacggc

SEQ ID NO: 1052369 - RNA, 20 nt, Mycobacterium bovis subsp bovis AF2122/97
ccgcgugacguaccacggcg

SEQ ID NO: 1052370 - RNA, 23 nt, Mycobacterium bovis subsp bovis AF2122/97
ccgcgcgccaucgccuccagccg

SEQ ID NO: 1052371 - RNA, 15 nt, Mycobacterium bovis subsp bovis AF2122/97
ccgcgcgccagcucg

SEQ ID NO: 1052372 - RNA, 17 nt, Mycobacterium bovis subsp bovis AF2122/97
ccgcgcgccagcucggc

SEQ ID NO: 1052373 - RNA, 12 nt, Mycobacterium bovis subsp bovis AF2122/97
ccgcgcgcacca

SEQ ID NO: 1052374 - RNA, 13 nt, Mycobacterium bovis subsp bovis AF2122/97
ccgcgcgaaccgc

SEQ ID NO: 1052375 - RNA, 13 nt, Mycobacterium bovis subsp bovis AF2122/97
ccgcgcgcaccgg

SEQ ID NO: 1052376 - RNA, 19 nt, Mycobacterium bovis subsp bovis AF2122/97
ccgcgcgcagaugagcgcg

SEQ ID NO: 1052377 - RNA, 14 nt, Mycobacterium bovis subsp bovis AF2122/97
ccgcgcgcagggcg

SEQ ID NO: 1052378 - RNA, 15 nt, Mycobacterium bovis subsp bovis AF2122/97
ccgcgcgccggcgac

SEQ ID NO: 1052379 - RNA, 15 nt, Mycobacterium bovis subsp bovis AF2122/97
ccgcgcgcaucgcgc

SEQ ID NO: 1052380 - RNA, 22 nt, Mycobacterium bovis subsp bovis AF2122/97
ccgcgcgcgccgcauccagccg

SEQ ID NO: 1052381 - RNA, 22 nt, Mycobacterium bovis subsp bovis AF2122/97
ccgcgccuggagcgaucuccgu

SEQ ID NO: 1052382 - RNA, 20 nt, Mycobacterium bovis subsp bovis AF2122/97
ccgcgccugccucaccgccg

SEQ ID NO: 1052383 - RNA, 21 nt, Mycobacterium bovis subsp bovis AF2122/97
ccgcgccugccucaccgccgc

SEQ ID NO: 1052384 - RNA, 15 nt, Mycobacterium bovis subsp bovis AF2122/97
ccgcgccuccguugc

SEQ ID NO: 1052385 - RNA, 12 nt, Mycobacterium bovis subsp bovis AF2122/97
ccgcgcgagccg

SEQ ID NO: 1052386 - RNA, 13 nt, Mycobacterium bovis subsp bovis AF2122/97
ccgcgcgagccgc

SEQ ID NO: 1052387 - RNA, 15 nt, Mycobacterium bovis subsp bovis AF2122/97
ccgcgcgagccgcuc

SEQ ID NO: 1052388 - RNA, 22 nt, Mycobacterium bovis subsp bovis AF2122/97
ccgcgcgagccucgcgcgugug

SEQ ID NO: 1052389 - RNA, 16 nt, Mycobacterium bovis subsp bovis AF2122/97
ccgcgcgacaacccgg

SEQ ID NO: 1052390 - RNA, 13 nt, Mycobacterium bovis subsp bovis AF2122/97
ccgcgccgacggc

SEQ ID NO: 1052391 - RNA, 11 nt, Mycobacterium bovis subsp bovis AF2122/97
ccgcgccgacg

SEQ ID NO: 1052392 - RNA, 20 nt, Mycobacterium bovis subsp bovis AF2122/97
ccgcgccgauuccaccgccg

SEQ ID NO: 1052393 - RNA, 12 nt, Mycobacterium bovis subsp bovis AF2122/97
ccgcgccgagcc

SEQ ID NO: 1052394 - RNA, 14 nt, Mycobacterium bovis subsp bovis AF2122/97
ccgcgccgagcccg

SEQ ID NO: 1052395 - RNA, 15 nt, Mycobacterium bovis subsp bovis AF2122/97
ccgcgccgagcccgg

SEQ ID NO: 1052396 - RNA, 15 nt, Mycobacterium bovis subsp bovis AF2122/97
ccgcgccgccgccac

SEQ ID NO: 1052397 - RNA, 13 nt, Mycobacterium bovis subsp bovis AF2122/97
ccgcgccgcgccg

SEQ ID NO: 1052398 - RNA, 19 nt, Mycobacterium bovis subsp bovis AF2122/97
ccgcgccgcgccgccucgg

SEQ ID NO: 1052399 - RNA, 20 nt, Mycobacterium bovis subsp bovis AF2122/97
ccgcgccgccggacccaccg

SEQ ID NO: 1052400 - RNA, 16 nt, Mycobacterium bovis subsp bovis AF2122/97
ccgcgccgcggcccgc

SEQ ID NO: 1052401 - RNA, 22 nt, Mycobacterium bovis subsp bovis AF2122/97
ccgcgccggugugcgcaccccg

SEQ ID NO: 1052402 - RNA, 15 nt, Mycobacterium bovis subsp bovis AF2122/97
ccgcgccguggacga

SEQ ID NO: 1052403 - RNA, 12 nt, Mycobacterium bovis subsp bovis AF2122/97
ccgcgccuaccc

SEQ ID NO: 1052404 - RNA, 22 nt, Mycobacterium bovis subsp bovis AF2122/97
ccgcgccuacccuucgguaggc

SEQ ID NO: 1052405 - RNA, 15 nt, Mycobacterium bovis subsp bovis AF2122/97
ccgcgccgcgcaucg

SEQ ID NO: 1052406 - RNA, 13 nt, Mycobacterium bovis subsp bovis AF2122/97
ccgcgccggcggc

SEQ ID NO: 1052407 - RNA, 14 nt, Mycobacterium bovis subsp bovis AF2122/97
ccgcgccggcggcc

SEQ ID NO: 1052408 - RNA, 16 nt, Mycobacterium bovis subsp bovis AF2122/97
ccgcgccggcggccac

SEQ ID NO: 1052409 - RNA, 16 nt, Mycobacterium bovis subsp bovis AF2122/97
ccgcgccggcgggcga

SEQ ID NO: 1052410 - RNA, 13 nt, Mycobacterium bovis subsp bovis AF2122/97
ccgcgccggcccc

SEQ ID NO: 1052411 - RNA, 14 nt, Mycobacterium bovis subsp bovis AF2122/97
ccgcgccggccgcu

SEQ ID NO: 1052412 - RNA, 18 nt, Mycobacterium bovis subsp bovis AF2122/97
ccgcgccggcacgggcgu

SEQ ID NO: 1052413 - RNA, 19 nt, Mycobacterium bovis subsp bovis AF2122/97
ccgcgccggacagcgcauc

SEQ ID NO: 1052414 - RNA, 13 nt, Mycobacterium bovis subsp bovis AF2122/97
ccgcgcgcugccg

SEQ ID NO: 1052415 - RNA, 13 nt, Mycobacterium bovis subsp bovis AF2122/97
ccgcgcggcgcau

SEQ ID NO: 1052416 - RNA, 13 nt, Mycobacterium bovis subsp bovis AF2122/97
ccgcgcggcgcag

SEQ ID NO: 1052417 - RNA, 14 nt, Mycobacterium bovis subsp bovis AF2122/97
ccgcgcggcgcagc

SEQ ID NO: 1052418 - RNA, 18 nt, Mycobacterium bovis subsp bovis AF2122/97
ccgcgcggcgagagccuc

SEQ ID NO: 1052419 - RNA, 11 nt, Mycobacterium bovis subsp bovis AF2122/97
ccgcgcggcga

SEQ ID NO: 1052420 - RNA, 12 nt, Mycobacterium bovis subsp bovis AF2122/97
ccgcgcggcgac

SEQ ID NO: 1052421 - RNA, 15 nt, Mycobacterium bovis subsp bovis AF2122/97
ccgcgcggcgacagc

SEQ ID NO: 1052422 - RNA, 17 nt, Mycobacterium bovis subsp bovis AF2122/97
ccgcgcucaucugcgcg

SEQ ID NO: 1052423 - RNA, 18 nt, Mycobacterium bovis subsp bovis AF2122/97
ccgcgcucaucugcgcgc

SEQ ID NO: 1052424 - RNA, 23 nt, Mycobacterium bovis subsp bovis AF2122/97
ccgcgcuccaacaaugccagcug

SEQ ID NO: 1052425 - RNA, 17 nt, Mycobacterium bovis subsp bovis AF2122/97
ccgcgcucgacgagcac

SEQ ID NO: 1052426 - RNA, 13 nt, Mycobacterium bovis subsp bovis AF2122/97
ccgcgcucgccga

SEQ ID NO: 1052427 - RNA, 13 nt, Mycobacterium bovis subsp bovis AF2122/97
ccgcgcggcaggu

SEQ ID NO: 1052428 - RNA, 17 nt, Mycobacterium bovis subsp bovis AF2122/97
ccgcgcgggaaacguuc

SEQ ID NO: 1052429 - RNA, 13 nt, Mycobacterium bovis subsp bovis AF2122/97
ccgcgcgggcgga

SEQ ID NO: 1052430 - RNA, 14 nt, Mycobacterium bovis subsp bovis AF2122/97
ccgcgcgggccgcc

SEQ ID NO: 1052431 - RNA, 15 nt, Mycobacterium bovis subsp bovis AF2122/97
ccgcgcgggccgccg

SEQ ID NO: 1052432 - RNA, 12 nt, Mycobacterium bovis subsp bovis AF2122/97
ccgcgcggcacu

SEQ ID NO: 1052433 - RNA, 19 nt, Mycobacterium bovis subsp bovis AF2122/97
ccgcgcggcgcauuccggc

SEQ ID NO: 1052434 - RNA, 15 nt, Mycobacterium bovis subsp bovis AF2122/97
ccgcgcggcggcgcc

SEQ ID NO: 1052435 - RNA, 16 nt, Mycobacterium bovis subsp bovis AF2122/97
ccgcgcggcggcgccg

SEQ ID NO: 1052436 - RNA, 20 nt, Mycobacterium bovis subsp bovis AF2122/97
ccgcgcggcggcgccggcgc

SEQ ID NO: 1052437 - RNA, 16 nt, Mycobacterium bovis subsp bovis AF2122/97
ccgcggcaacgcgguc

SEQ ID NO: 1052438 - RNA, 24 nt, Mycobacterium bovis subsp bovis AF2122/97
ccgcggcccgcuccacggucaggc

SEQ ID NO: 1052439 - RNA, 20 nt, Mycobacterium bovis subsp bovis AF2122/97
ccgcggcccgcucgaucggc

SEQ ID NO: 1052440 - RNA, 18 nt, Mycobacterium bovis subsp bovis AF2122/97
ccgcggcccggacgucgg

SEQ ID NO: 1052441 - RNA, 22 nt, Mycobacterium bovis subsp bovis AF2122/97
ccgcggcccgcuccacggucag

SEQ ID NO: 1052442 - RNA, 24 nt, Mycobacterium bovis subsp bovis AF2122/97
ccgcggcccacucucgccacgccg

SEQ ID NO: 1052443 - RNA, 13 nt, Mycobacterium bovis subsp bovis AF2122/97
ccgcggccccgac

SEQ ID NO: 1052444 - RNA, 19 nt, Mycobacterium bovis subsp bovis AF2122/97
ccgcggccccgacugccgc

SEQ ID NO: 1052445 - RNA, 12 nt, Mycobacterium bovis subsp bovis AF2122/97
ccgcggccccgc

SEQ ID NO: 1052446 - RNA, 14 nt, Mycobacterium bovis subsp bovis AF2122/97
ccgcggccccgccg

SEQ ID NO: 1052447 - RNA, 21 nt, Mycobacterium bovis subsp bovis AF2122/97
ccgcggccgccguccccgccg

SEQ ID NO: 1052448 - RNA, 12 nt, Mycobacterium bovis subsp bovis AF2122/97
ccgcggccgccg

SEQ ID NO: 1052449 - RNA, 13 nt, Mycobacterium bovis subsp bovis AF2122/97
ccgcggccgcgga

SEQ ID NO: 1052450 - RNA, 13 nt, Mycobacterium bovis subsp bovis AF2122/97
ccgcggcggcgcg

SEQ ID NO: 1052451 - RNA, 14 nt, Mycobacterium bovis subsp bovis AF2122/97
ccgcggcggcgcgu

SEQ ID NO: 1052452 - RNA, 18 nt, Mycobacterium bovis subsp bovis AF2122/97
ccgcggcggcgcguggug

SEQ ID NO: 1052453 - RNA, 15 nt, Mycobacterium bovis subsp bovis AF2122/97
ccgcggcggcggcca

SEQ ID NO: 1052454 - RNA, 15 nt, Mycobacterium bovis subsp bovis AF2122/97
ccgcggcggccagcg

SEQ ID NO: 1052455 - RNA, 20 nt, Mycobacterium bovis subsp bovis AF2122/97
ccgcggcggccccgcgccac

SEQ ID NO: 1052456 - RNA, 12 nt, Mycobacterium bovis subsp bovis AF2122/97
ccgcggcggcca

SEQ ID NO: 1052457 - RNA, 22 nt, Mycobacterium bovis subsp bovis AF2122/97
ccgcggcggucagucccgugac

SEQ ID NO: 1052458 - RNA, 18 nt, Mycobacterium bovis subsp bovis AF2122/97
ccgcggacuugcgagccg

SEQ ID NO: 1052459 - RNA, 20 nt, Mycobacterium bovis subsp bovis AF2122/97
ccgcggacuugcgagccgua

SEQ ID NO: 1052460 - RNA, 20 nt, Mycobacterium bovis subsp bovis AF2122/97
ccgcgcucgcacccgcucgg

SEQ ID NO: 1052461 - RNA, 12 nt, Mycobacterium bovis subsp bovis AF2122/97
ccgcgcucgucg

SEQ ID NO: 1052462 - RNA, 19 nt, Mycobacterium bovis subsp bovis AF2122/97
ccgcggaggcggccagccu

SEQ ID NO: 1052463 - RNA, 23 nt, Mycobacterium bovis subsp bovis AF2122/97
ccgcggagcucaaccaccucgcc

SEQ ID NO: 1052464 - RNA, 19 nt, Mycobacterium bovis subsp bovis AF2122/97
ccgcggacuuggcggucgg

SEQ ID NO: 1052465 - RNA, 12 nt, Mycobacterium bovis subsp bovis AF2122/97
ccgcggccagcg

SEQ ID NO: 1052466 - RNA, 17 nt, Mycobacterium bovis subsp bovis AF2122/97
ccgcggcaacaccaccu

SEQ ID NO: 1052467 - RNA, 21 nt, Mycobacterium bovis subsp bovis AF2122/97
ccgcggccaguacgucgauca

SEQ ID NO: 1052468 - RNA, 20 nt, Mycobacterium bovis subsp bovis AF2122/97
ccgcggaucgaccgccagcg

SEQ ID NO: 1052469 - RNA, 21 nt, Mycobacterium bovis subsp bovis AF2122/97
ccgcggaucgaccgccagcgc

SEQ ID NO: 1052470 - RNA, 23 nt, Mycobacterium bovis subsp bovis AF2122/97
ccgcggaucgaccgccagcgccg

SEQ ID NO: 1052471 - RNA, 16 nt, Mycobacterium bovis subsp bovis AF2122/97
ccgcggaucgacuucg

SEQ ID NO: 1052472 - RNA, 22 nt, Mycobacterium bovis subsp bovis AF2122/97
ccgcggauaggccgcgcggcgg

SEQ ID NO: 1052473 - RNA, 22 nt, Mycobacterium bovis subsp bovis AF2122/97
ccgcggaucaccaucgccgccg

SEQ ID NO: 1052474 - RNA, 23 nt, Mycobacterium bovis subsp bovis AF2122/97
ccgcggaucaccaucgccgccgc

SEQ ID NO: 1052475 - RNA, 20 nt, Mycobacterium bovis subsp bovis AF2122/97
ccgauagugacuuggccaug

SEQ ID NO: 1052476 - RNA, 16 nt, Mycobacterium bovis subsp bovis AF2122/97
ccgauaucgcugcgga

SEQ ID NO: 1052477 - RNA, 18 nt, Mycobacterium bovis subsp bovis AF2122/97
ccgauaguucuggcccgc

SEQ ID NO: 1052478 - RNA, 22 nt, Mycobacterium bovis subsp bovis AF2122/97
ccgauauaccagggcaucagca

SEQ ID NO: 1052479 - RNA, 14 nt, Mycobacterium bovis subsp bovis AF2122/97
ccgauacgccaccg

SEQ ID NO: 1052480 - RNA, 20 nt, Mycobacterium bovis subsp bovis AF2122/97
ccgauacaggccacgcaccg

SEQ ID NO: 1052481 - RNA, 16 nt, Mycobacterium bovis subsp bovis AF2122/97
ccgauacggccggccg

SEQ ID NO: 1052482 - RNA, 20 nt, Mycobacterium bovis subsp bovis AF2122/97
ccgauacuucaucggcacag

SEQ ID NO: 1052483 - RNA, 19 nt, Mycobacterium bovis subsp bovis AF2122/97
ccgauagccugcggcggcg

SEQ ID NO: 1052484 - RNA, 17 nt, Mycobacterium bovis subsp bovis AF2122/97
ccgauagcgaccgcggc

SEQ ID NO: 1052485 - RNA, 23 nt, Mycobacterium bovis subsp bovis AF2122/97
ccgauacccggugaugguggcgg

SEQ ID NO: 1052486 - RNA, 17 nt, Mycobacterium bovis subsp bovis AF2122/97
ccgauaccggcggcgag

SEQ ID NO: 1052487 - RNA, 19 nt, Mycobacterium bovis subsp bovis AF2122/97
ccgauaccgucagcgccgc

SEQ ID NO: 1052488 - RNA, 14 nt, Mycobacterium bovis subsp bovis AF2122/97
ccgauacccgguga

SEQ ID NO: 1052489 - RNA, 14 nt, Mycobacterium bovis subsp bovis AF2122/97
ccgauacaccgacg

SEQ ID NO: 1052490 - RNA, 18 nt, Mycobacterium bovis subsp bovis AF2122/97
ccgaucaacagggccaga

SEQ ID NO: 1052491 - RNA, 14 nt, Mycobacterium bovis subsp bovis AF2122/97
ccgaucaauccgcc

SEQ ID NO: 1052492 - RNA, 23 nt, Mycobacterium bovis subsp bovis AF2122/97
ccgaucaauccgcccuugccgcc

SEQ ID NO: 1052493 - RNA, 21 nt, Mycobacterium bovis subsp bovis AF2122/97
ccgaucaacaugccggucauc

SEQ ID NO: 1052494 - RNA, 12 nt, Mycobacterium bovis subsp bovis AF2122/97
ccgaucaccccg

SEQ ID NO: 1052495 - RNA, 12 nt, Mycobacterium bovis subsp bovis AF2122/97
ccgaucaccacg

SEQ ID NO: 1052496 - RNA, 12 nt, Mycobacterium bovis subsp bovis AF2122/97
ccgaucaccgcc

SEQ ID NO: 1052497 - RNA, 20 nt, Mycobacterium bovis subsp bovis AF2122/97
ccgaucaccgcaucggugcc

SEQ ID NO: 1052498 - RNA, 15 nt, Mycobacterium bovis subsp bovis AF2122/97
ccgaucaccaccggc

SEQ ID NO: 1052499 - RNA, 14 nt, Mycobacterium bovis subsp bovis AF2122/97
ccgaucaccccggu

SEQ ID NO: 1052500 - RNA, 19 nt, Mycobacterium bovis subsp bovis AF2122/97
ccgaucaccccggucggcc

SEQ ID NO: 1052501 - RNA, 13 nt, Mycobacterium bovis subsp bovis AF2122/97
ccgaucaccgccg

SEQ ID NO: 1052502 - RNA, 19 nt, Mycobacterium bovis subsp bovis AF2122/97
ccgaucaccuucggccgac

SEQ ID NO: 1052503 - RNA, 21 nt, Mycobacterium bovis subsp bovis AF2122/97
ccgaucagcaccgacggcgca

SEQ ID NO: 1052504 - RNA, 14 nt, Mycobacterium bovis subsp bovis AF2122/97
ccgaucagcagggc

SEQ ID NO: 1052505 - RNA, 16 nt, Mycobacterium bovis subsp bovis AF2122/97
ccgaucagcaccgacg

SEQ ID NO: 1052506 - RNA, 17 nt, Mycobacterium bovis subsp bovis AF2122/97
ccgaucagcaccgacgg

SEQ ID NO: 1052507 - RNA, 16 nt, Mycobacterium bovis subsp bovis AF2122/97
ccgaucacgacguugc

SEQ ID NO: 1052508 - RNA, 15 nt, Mycobacterium bovis subsp bovis AF2122/97
ccgaucagcguggcg

SEQ ID NO: 1052509 - RNA, 17 nt, Mycobacterium bovis subsp bovis AF2122/97
ccgaucagcguggcgcc

SEQ ID NO: 1052510 - RNA, 12 nt, Mycobacterium bovis subsp bovis AF2122/97
ccgaucagcugc

SEQ ID NO: 1052511 - RNA, 16 nt, Mycobacterium bovis subsp bovis AF2122/97
ccgaucaggccgacgu

SEQ ID NO: 1052512 - RNA, 13 nt, Mycobacterium bovis subsp bovis AF2122/97
ccgaucaggccga

SEQ ID NO: 1052513 - RNA, 21 nt, Mycobacterium bovis subsp bovis AF2122/97
ccgaucagguacgccaggugc

SEQ ID NO: 1052514 - RNA, 13 nt, Mycobacterium bovis subsp bovis AF2122/97
ccgaucaucaccg

SEQ ID NO: 1052515 - RNA, 14 nt, Mycobacterium bovis subsp bovis AF2122/97
ccgaucaucaccgg

SEQ ID NO: 1052516 - RNA, 18 nt, Mycobacterium bovis subsp bovis AF2122/97
ccgaucaucauauccgcc

SEQ ID NO: 1052517 - RNA, 21 nt, Mycobacterium bovis subsp bovis AF2122/97
ccgaucaucauauccgcccca

SEQ ID NO: 1052518 - RNA, 14 nt, Mycobacterium bovis subsp bovis AF2122/97
ccgaucaucgacga

SEQ ID NO: 1052519 - RNA, 14 nt, Mycobacterium bovis subsp bovis AF2122/97
ccgauccagcaggc

SEQ ID NO: 1052520 - RNA, 20 nt, Mycobacterium bovis subsp bovis AF2122/97
ccgaucaugucggccggggc

SEQ ID NO: 1052521 - RNA, 16 nt, Mycobacterium bovis subsp bovis AF2122/97
ccgaucaugucggccg

SEQ ID NO: 1052522 - RNA, 16 nt, Mycobacterium bovis subsp bovis AF2122/97
ccgaucaguccggcgu

SEQ ID NO: 1052523 - RNA, 18 nt, Mycobacterium bovis subsp bovis AF2122/97
ccgauccacaacagcccg

SEQ ID NO: 1052524 - RNA, 23 nt, Mycobacterium bovis subsp bovis AF2122/97
ccgauccacauggugaccauggc

SEQ ID NO: 1052525 - RNA, 21 nt, Mycobacterium bovis subsp bovis AF2122/97
ccgaucccggcgagcacccgc

SEQ ID NO: 1052526 - RNA, 16 nt, Mycobacterium bovis subsp bovis AF2122/97
ccgaucccggccagcu

SEQ ID NO: 1052527 - RNA, 12 nt, Mycobacterium bovis subsp bovis AF2122/97
ccgaucccaccg

SEQ ID NO: 1052528 - RNA, 15 nt, Mycobacterium bovis subsp bovis AF2122/97
ccgaucgccgcgaag

SEQ ID NO: 1052529 - RNA, 17 nt, Mycobacterium bovis subsp bovis AF2122/97
ccgaucgaugccacguc

SEQ ID NO: 1052530 - RNA, 18 nt, Mycobacterium bovis subsp bovis AF2122/97
ccgaucgacugcagcccg

SEQ ID NO: 1052531 - RNA, 15 nt, Mycobacterium bovis subsp bovis AF2122/97
ccgaucggcaggccg

SEQ ID NO: 1052532 - RNA, 12 nt, Mycobacterium bovis subsp bovis AF2122/97
ccgaucggccac

SEQ ID NO: 1052533 - RNA, 14 nt, Mycobacterium bovis subsp bovis AF2122/97
ccgaucggcaaccc

SEQ ID NO: 1052534 - RNA, 19 nt, Mycobacterium bovis subsp bovis AF2122/97
ccgaucggcaaaccgucgg

SEQ ID NO: 1052535 - RNA, 17 nt, Mycobacterium bovis subsp bovis AF2122/97
ccgaucgcuccggcccu

SEQ ID NO: 1052536 - RNA, 23 nt, Mycobacterium bovis subsp bovis AF2122/97
ccgaucgcuccggcccugccgcc

SEQ ID NO: 1052537 - RNA, 13 nt, Mycobacterium bovis subsp bovis AF2122/97
ccgauccgguggc

SEQ ID NO: 1052538 - RNA, 19 nt, Mycobacterium bovis subsp bovis AF2122/97
ccgauccgguggcuggccg

SEQ ID NO: 1052539 - RNA, 21 nt, Mycobacterium bovis subsp bovis AF2122/97
ccgaucccgucgggcacaccg

SEQ ID NO: 1052540 - RNA, 21 nt, Mycobacterium bovis subsp bovis AF2122/97
ccgauccgcucacccgcccgg

SEQ ID NO: 1052541 - RNA, 22 nt, Mycobacterium bovis subsp bovis AF2122/97
ccgauccggaucccaccaccgc

SEQ ID NO: 1052542 - RNA, 13 nt, Mycobacterium bovis subsp bovis AF2122/97
ccgauccggccgc

SEQ ID NO: 1052543 - RNA, 16 nt, Mycobacterium bovis subsp bovis AF2122/97
ccgauccgcucacccg

SEQ ID NO: 1052544 - RNA, 17 nt, Mycobacterium bovis subsp bovis AF2122/97
ccgauccgcucacccgc

SEQ ID NO: 1052545 - RNA, 21 nt, Mycobacterium bovis subsp bovis AF2122/97
ccgaucgacacccgcucggcc

SEQ ID NO: 1052546 - RNA, 22 nt, Mycobacterium bovis subsp bovis AF2122/97
ccgaucgaucagcaacucggcc

SEQ ID NO: 1052547 - RNA, 15 nt, Mycobacterium bovis subsp bovis AF2122/97
ccgaucgaccgcugg

SEQ ID NO: 1052548 - RNA, 21 nt, Mycobacterium bovis subsp bovis AF2122/97
ccgaucgaccgcuggaucgcg

SEQ ID NO: 1052549 - RNA, 13 nt, Mycobacterium bovis subsp bovis AF2122/97
ccgaucggugacg

SEQ ID NO: 1052550 - RNA, 14 nt, Mycobacterium bovis subsp bovis AF2122/97
ccgaucggucgauc

SEQ ID NO: 1052551 - RNA, 13 nt, Mycobacterium bovis subsp bovis AF2122/97
ccgaucggucguc

SEQ ID NO: 1052552 - RNA, 18 nt, Mycobacterium bovis subsp bovis AF2122/97
ccgaucggucguccggau

SEQ ID NO: 1052553 - RNA, 20 nt, Mycobacterium bovis subsp bovis AF2122/97
ccgaucggucguccggaucg

SEQ ID NO: 1052554 - RNA, 16 nt, Mycobacterium bovis subsp bovis AF2122/97
ccgaucgggcccaccg

SEQ ID NO: 1052555 - RNA, 16 nt, Mycobacterium bovis subsp bovis AF2122/97
ccgaucgggcucacuc

SEQ ID NO: 1052556 - RNA, 15 nt, Mycobacterium bovis subsp bovis AF2122/97
ccgaucgggcuucgg

SEQ ID NO: 1052557 - RNA, 17 nt, Mycobacterium bovis subsp bovis AF2122/97
ccgaucgggcuucggcc

SEQ ID NO: 1052558 - RNA, 13 nt, Mycobacterium bovis subsp bovis AF2122/97
ccgaucggcgcgc

SEQ ID NO: 1052559 - RNA, 16 nt, Mycobacterium bovis subsp bovis AF2122/97
ccgaucggcgcgccga

SEQ ID NO: 1052560 - RNA, 14 nt, Mycobacterium bovis subsp bovis AF2122/97
ccgaucggcggauc

SEQ ID NO: 1052561 - RNA, 18 nt, Mycobacterium bovis subsp bovis AF2122/97
ccgaucgucucggccacg

SEQ ID NO: 1052562 - RNA, 20 nt, Mycobacterium bovis subsp bovis AF2122/97
ccgaucguaggacucggcgg

SEQ ID NO: 1052563 - RNA, 18 nt, Mycobacterium bovis subsp bovis AF2122/97
ccgaucggugacgcgccg

SEQ ID NO: 1052564 - RNA, 19 nt, Mycobacterium bovis subsp bovis AF2122/97
ccgaucggugacgcgccgu

SEQ ID NO: 1052565 - RNA, 20 nt, Mycobacterium bovis subsp bovis AF2122/97
ccgaucggugacgcgccgua

SEQ ID NO: 1052566 - RNA, 15 nt, Mycobacterium bovis subsp bovis AF2122/97
ccgaucggugccggc

SEQ ID NO: 1052567 - RNA, 16 nt, Mycobacterium bovis subsp bovis AF2122/97
ccgaucggugucgggc

SEQ ID NO: 1052568 - RNA, 22 nt, Mycobacterium bovis subsp bovis AF2122/97
ccgaucgugacguuguaggaga

SEQ ID NO: 1052569 - RNA, 21 nt, Mycobacterium bovis subsp bovis AF2122/97
ccgaucugguaagucagcucg

SEQ ID NO: 1052570 - RNA, 13 nt, Mycobacterium bovis subsp bovis AF2122/97
ccgaucuuggcca

SEQ ID NO: 1052571 - RNA, 14 nt, Mycobacterium bovis subsp bovis AF2122/97
ccgaucugcucgcc

SEQ ID NO: 1052572 - RNA, 14 nt, Mycobacterium bovis subsp bovis AF2122/97
ccgaugaaccaggc

SEQ ID NO: 1052573 - RNA, 15 nt, Mycobacterium bovis subsp bovis AF2122/97
ccgaucucuccggcg

SEQ ID NO: 1052574 - RNA, 23 nt, Mycobacterium bovis subsp bovis AF2122/97
ccgaugaaccaggcggccgcguc

SEQ ID NO: 1052575 - RNA, 21 nt, Mycobacterium bovis subsp bovis AF2122/97
ccgaugacgaucggcggcgcg

SEQ ID NO: 1052576 - RNA, 18 nt, Mycobacterium bovis subsp bovis AF2122/97
ccgaugacgaugccgccg

SEQ ID NO: 1052577 - RNA, 19 nt, Mycobacterium bovis subsp bovis AF2122/97
ccgaugacgauggccgccg

SEQ ID NO: 1052578 - RNA, 15 nt, Mycobacterium bovis subsp bovis AF2122/97
ccgauuccaccgccg

SEQ ID NO: 1052579 - RNA, 18 nt, Mycobacterium bovis subsp bovis AF2122/97
ccgauuccaccgccgacg

SEQ ID NO: 1052580 - RNA, 18 nt, Mycobacterium bovis subsp bovis AF2122/97
ccgauguuguugacgccc

SEQ ID NO: 1052581 - RNA, 19 nt, Mycobacterium bovis subsp bovis AF2122/97
ccgauuacggugaucgccg

SEQ ID NO: 1052582 - RNA, 14 nt, Mycobacterium bovis subsp bovis AF2122/97
ccgauguggccggc

SEQ ID NO: 1052583 - RNA, 19 nt, Mycobacterium bovis subsp bovis AF2122/97
ccgauguggccggcgaugg

SEQ ID NO: 1052584 - RNA, 21 nt, Mycobacterium bovis subsp bovis AF2122/97
ccgaugugccgauuggccugc

SEQ ID NO: 1052585 - RNA, 20 nt, Mycobacterium bovis subsp bovis AF2122/97
ccgaugugucgaugaggauc

SEQ ID NO: 1052586 - RNA, 23 nt, Mycobacterium bovis subsp bovis AF2122/97
ccgauguggcgcuguuguugucg

SEQ ID NO: 1052587 - RNA, 22 nt, Mycobacterium bovis subsp bovis AF2122/97
ccgauguguggaacauccgcac

SEQ ID NO: 1052588 - RNA, 22 nt, Mycobacterium bovis subsp bovis AF2122/97
ccgaugaggacauccggcgccg

SEQ ID NO: 1052589 - RNA, 16 nt, Mycobacterium bovis subsp bovis AF2122/97
ccgaugaugcggcgca

SEQ ID NO: 1052590 - RNA, 22 nt, Mycobacterium bovis subsp bovis AF2122/97
ccgaugaugcggcgcagcgacg

SEQ ID NO: 1052591 - RNA, 20 nt, Mycobacterium bovis subsp bovis AF2122/97
ccgaugauggacaccagcca

SEQ ID NO: 1052592 - RNA, 21 nt, Mycobacterium bovis subsp bovis AF2122/97
ccgaugucgaugccgcgcagc

SEQ ID NO: 1052593 - RNA, 12 nt, Mycobacterium bovis subsp bovis AF2122/97
ccgcaccaccgg

SEQ ID NO: 1052594 - RNA, 17 nt, Mycobacterium bovis subsp bovis AF2122/97
ccgcaccacgcccgacg

SEQ ID NO: 1052595 - RNA, 22 nt, Mycobacterium bovis subsp bovis AF2122/97
ccgcacaucgcucaucgucacc

SEQ ID NO: 1052596 - RNA, 23 nt, Mycobacterium bovis subsp bovis AF2122/97
ccgcaccagcauucucgccgacg

SEQ ID NO: 1052597 - RNA, 11 nt, Mycobacterium bovis subsp bovis AF2122/97
ccgcaccaccg

SEQ ID NO: 1052598 - RNA, 21 nt, Mycobacterium bovis subsp bovis AF2122/97
ccgcacaugagcuggaaucga

SEQ ID NO: 1052599 - RNA, 18 nt, Mycobacterium bovis subsp bovis AF2122/97
ccgcaauucccaucggcc

SEQ ID NO: 1052600 - RNA, 16 nt, Mycobacterium bovis subsp bovis AF2122/97
ccgcacagguccgggu

SEQ ID NO: 1052601 - RNA, 16 nt, Mycobacterium bovis subsp bovis AF2122/97
ccgcacaccugcgcgg

SEQ ID NO: 1052602 - RNA, 15 nt, Mycobacterium bovis subsp bovis AF2122/97
ccgcaauggcggccu

SEQ ID NO: 1052603 - RNA, 20 nt, Mycobacterium bovis subsp bovis AF2122/97
ccgcaaugaccuggccgccc

SEQ ID NO: 1052604 - RNA, 19 nt, Mycobacterium bovis subsp bovis AF2122/97
ccgcaaugcgagcgcgccg

SEQ ID NO: 1052605 - RNA, 20 nt, Mycobacterium bovis subsp bovis AF2122/97
ccgcaaugcgagcgcgccgg

SEQ ID NO: 1052606 - RNA, 14 nt, Mycobacterium bovis subsp bovis AF2122/97
ccgcaauggaccga

SEQ ID NO: 1052607 - RNA, 17 nt, Mycobacterium bovis subsp bovis AF2122/97
ccgcacagcgacgagau

SEQ ID NO: 1052608 - RNA, 20 nt, Mycobacterium bovis subsp bovis AF2122/97
ccgcacaacgauaguucggc

SEQ ID NO: 1052609 - RNA, 23 nt, Mycobacterium bovis subsp bovis AF2122/97
ccgcaauuggcguagcaacccag

SEQ ID NO: 1052610 - RNA, 18 nt, Mycobacterium bovis subsp bovis AF2122/97
ccgcacacgcgugcacca

SEQ ID NO: 1052611 - RNA, 19 nt, Mycobacterium bovis subsp bovis AF2122/97
ccgcacagaaaacgauggu

SEQ ID NO: 1052612 - RNA, 16 nt, Mycobacterium bovis subsp bovis AF2122/97
ccgcaacagcucggcc

SEQ ID NO: 1052613 - RNA, 20 nt, Mycobacterium bovis subsp bovis AF2122/97
ccgcaacagcucggccaggc

SEQ ID NO: 1052614 - RNA, 22 nt, Mycobacterium bovis subsp bovis AF2122/97
ccgcaacaucgggucgcugccg

SEQ ID NO: 1052615 - RNA, 19 nt, Mycobacterium bovis subsp bovis AF2122/97
ccgauucgugucggugcgc

SEQ ID NO: 1052616 - RNA, 19 nt, Mycobacterium bovis subsp bovis AF2122/97
ccgcaacaacgccgcgacg

SEQ ID NO: 1052617 - RNA, 21 nt, Mycobacterium bovis subsp bovis AF2122/97
ccgauucggccagcgcccgca

SEQ ID NO: 1052618 - RNA, 13 nt, Mycobacterium bovis subsp bovis AF2122/97
ccgauucggcgac

SEQ ID NO: 1052619 - RNA, 12 nt, Mycobacterium bovis subsp bovis AF2122/97
ccgcaaccgccg

SEQ ID NO: 1052620 - RNA, 13 nt, Mycobacterium bovis subsp bovis AF2122/97
ccgcaaccgagcu

SEQ ID NO: 1052621 - RNA, 20 nt, Mycobacterium bovis subsp bovis AF2122/97
ccgcaacgcgucggucgcgg

SEQ ID NO: 1052622 - RNA, 13 nt, Mycobacterium bovis subsp bovis AF2122/97
ccgcaacgacggc

SEQ ID NO: 1052623 - RNA, 24 nt, Mycobacterium bovis subsp bovis AF2122/97
ccgcaacgccaacacgcguuggug

SEQ ID NO: 1052624 - RNA, 21 nt, Mycobacterium bovis subsp bovis AF2122/97
ccgcaacgcuucggcagcucc

SEQ ID NO: 1052625 - RNA, 14 nt, Mycobacterium bovis subsp bovis AF2122/97
ccgcaaucgcgacg

SEQ ID NO: 1052626 - RNA, 19 nt, Mycobacterium bovis subsp bovis AF2122/97
ccgcaaucggaugauuucg

SEQ ID NO: 1052627 - RNA, 14 nt, Mycobacterium bovis subsp bovis AF2122/97
ccgcaaugaccgcg

SEQ ID NO: 1052628 - RNA, 15 nt, Mycobacterium bovis subsp bovis AF2122/97
ccgcaaucagacggc

SEQ ID NO: 1052629 - RNA, 14 nt, Mycobacterium bovis subsp bovis AF2122/97
ccgccacccggcgg

SEQ ID NO: 1052630 - RNA, 17 nt, Mycobacterium bovis subsp bovis AF2122/97
ccgccacccggcgggcg

SEQ ID NO: 1052631 - RNA, 21 nt, Mycobacterium bovis subsp bovis AF2122/97
ccgccaccgaagccgccgggu

SEQ ID NO: 1052632 - RNA, 12 nt, Mycobacterium bovis subsp bovis AF2122/97
ccgccaccgcac

SEQ ID NO: 1052633 - RNA, 16 nt, Mycobacterium bovis subsp bovis AF2122/97
ccgccaccccgcgcgc

SEQ ID NO: 1052634 - RNA, 12 nt, Mycobacterium bovis subsp bovis AF2122/97
ccgccaccccgg

SEQ ID NO: 1052635 - RNA, 16 nt, Mycobacterium bovis subsp bovis AF2122/97
ccgccaccccggucgg

SEQ ID NO: 1052636 - RNA, 12 nt, Mycobacterium bovis subsp bovis AF2122/97
ccgcaucgccga

SEQ ID NO: 1052637 - RNA, 18 nt, Mycobacterium bovis subsp bovis AF2122/97
ccgcauggugggugccgg

SEQ ID NO: 1052638 - RNA, 16 nt, Mycobacterium bovis subsp bovis AF2122/97
ccgcauucgcgacaac

SEQ ID NO: 1052639 - RNA, 13 nt, Mycobacterium bovis subsp bovis AF2122/97
ccgcauugacgaa

SEQ ID NO: 1052640 - RNA, 17 nt, Mycobacterium bovis subsp bovis AF2122/97
ccgcauugagcuggcgc

SEQ ID NO: 1052641 - RNA, 20 nt, Mycobacterium bovis subsp bovis AF2122/97
ccgcauugagcuggcgcccg

SEQ ID NO: 1052642 - RNA, 22 nt, Mycobacterium bovis subsp bovis AF2122/97
ccgcauugcagaaccgccaaca

SEQ ID NO: 1052643 - RNA, 15 nt, Mycobacterium bovis subsp bovis AF2122/97
ccgccaccggcgccg

SEQ ID NO: 1052644 - RNA, 18 nt, Mycobacterium bovis subsp bovis AF2122/97
ccgccaccggcgccgccg

SEQ ID NO: 1052645 - RNA, 19 nt, Mycobacterium bovis subsp bovis AF2122/97
ccgccaccggcgcgaccgc

SEQ ID NO: 1052646 - RNA, 15 nt, Mycobacterium bovis subsp bovis AF2122/97
ccgccaaacgcugcg

SEQ ID NO: 1052647 - RNA, 13 nt, Mycobacterium bovis subsp bovis AF2122/97
ccgccaccggaca

SEQ ID NO: 1052648 - RNA, 13 nt, Mycobacterium bovis subsp bovis AF2122/97
ccgccaccggcgu

SEQ ID NO: 1052649 - RNA, 14 nt, Mycobacterium bovis subsp bovis AF2122/97
ccgccaccggcuga

SEQ ID NO: 1052650 - RNA, 23 nt, Mycobacterium bovis subsp bovis AF2122/97
ccgccaccgcgacgagcggccgu

SEQ ID NO: 1052651 - RNA, 12 nt, Mycobacterium bovis subsp bovis AF2122/97
ccgccaccgcug

SEQ ID NO: 1052652 - RNA, 23 nt, Mycobacterium bovis subsp bovis AF2122/97
ccgccacguguggugugucaccg

SEQ ID NO: 1052653 - RNA, 18 nt, Mycobacterium bovis subsp bovis AF2122/97
ccgccaccguacgacagu

SEQ ID NO: 1052654 - RNA, 13 nt, Mycobacterium bovis subsp bovis AF2122/97
ccgccaccgucac

SEQ ID NO: 1052655 - RNA, 17 nt, Mycobacterium bovis subsp bovis AF2122/97
ccgccaccgucaccgcc

SEQ ID NO: 1052656 - RNA, 14 nt, Mycobacterium bovis subsp bovis AF2122/97
ccgccaccuuggcg

SEQ ID NO: 1052657 - RNA, 21 nt, Mycobacterium bovis subsp bovis AF2122/97
ccgccagaccgcggcggccga

SEQ ID NO: 1052658 - RNA, 18 nt, Mycobacterium bovis subsp bovis AF2122/97
ccgccacuucccccgggu

SEQ ID NO: 1052659 - RNA, 16 nt, Mycobacterium bovis subsp bovis AF2122/97
ccgccacucgcccgcu

SEQ ID NO: 1052660 - RNA, 20 nt, Mycobacterium bovis subsp bovis AF2122/97
ccgccacucgcccgcugccg

SEQ ID NO: 1052661 - RNA, 14 nt, Mycobacterium bovis subsp bovis AF2122/97
ccgccacugccggc

SEQ ID NO: 1052662 - RNA, 13 nt, Mycobacterium bovis subsp bovis AF2122/97
ccgccacuggcgc

SEQ ID NO: 1052663 - RNA, 15 nt, Mycobacterium bovis subsp bovis AF2122/97
ccgccacuggcgccg

SEQ ID NO: 1052664 - RNA, 21 nt, Mycobacterium bovis subsp bovis AF2122/97
ccgccacuggcgccggugccg

SEQ ID NO: 1052665 - RNA, 23 nt, Mycobacterium bovis subsp bovis AF2122/97
ccgccacuggcgcugaucgccuc

SEQ ID NO: 1052666 - RNA, 18 nt, Mycobacterium bovis subsp bovis AF2122/97
ccgccagaauugccggcg

SEQ ID NO: 1052667 - RNA, 15 nt, Mycobacterium bovis subsp bovis AF2122/97
ccgccagcggccgcu

SEQ ID NO: 1052668 - RNA, 14 nt, Mycobacterium bovis subsp bovis AF2122/97
ccgccagcggcaau

SEQ ID NO: 1052669 - RNA, 21 nt, Mycobacterium bovis subsp bovis AF2122/97
ccgccagcggcaauggccagc

SEQ ID NO: 1052670 - RNA, 16 nt, Mycobacterium bovis subsp bovis AF2122/97
ccgccagcgucgacac

SEQ ID NO: 1052671 - RNA, 12 nt, Mycobacterium bovis subsp bovis AF2122/97
ccgccagcucac

SEQ ID NO: 1052672 - RNA, 22 nt, Mycobacterium bovis subsp bovis AF2122/97
ccgccagcugggcagccagauc

SEQ ID NO: 1052673 - RNA, 18 nt, Mycobacterium bovis subsp bovis AF2122/97
ccgccagcugggcagcca

SEQ ID NO: 1052674 - RNA, 15 nt, Mycobacterium bovis subsp bovis AF2122/97
ccgccaggccgcgcg

SEQ ID NO: 1052675 - RNA, 22 nt, Mycobacterium bovis subsp bovis AF2122/97
ccgccaucaacaaggggcagca

SEQ ID NO: 1052676 - RNA, 18 nt, Mycobacterium bovis subsp bovis AF2122/97
ccgccagggcacguggcg

SEQ ID NO: 1052677 - RNA, 16 nt, Mycobacterium bovis subsp bovis AF2122/97
ccgccaucagcccggc

SEQ ID NO: 1052678 - RNA, 14 nt, Mycobacterium bovis subsp bovis AF2122/97
ccgccaggcggccg

SEQ ID NO: 1052679 - RNA, 15 nt, Mycobacterium bovis subsp bovis AF2122/97
ccgccagcccagcac

SEQ ID NO: 1052680 - RNA, 17 nt, Mycobacterium bovis subsp bovis AF2122/97
ccgccagcccagcacgc

SEQ ID NO: 1052681 - RNA, 18 nt, Mycobacterium bovis subsp bovis AF2122/97
ccgccagcccagcacgcu

SEQ ID NO: 1052682 - RNA, 21 nt, Mycobacterium bovis subsp bovis AF2122/97
ccgccagccccacccgcaugc

SEQ ID NO: 1052683 - RNA, 20 nt, Mycobacterium bovis subsp bovis AF2122/97
ccgccagauugccugacaac

SEQ ID NO: 1052684 - RNA, 21 nt, Mycobacterium bovis subsp bovis AF2122/97
ccgccagcccgucaucgcgua

SEQ ID NO: 1052685 - RNA, 13 nt, Mycobacterium bovis subsp bovis AF2122/97
ccgccagccccag

SEQ ID NO: 1052686 - RNA, 22 nt, Mycobacterium bovis subsp bovis AF2122/97
ccgccagccccagcguucccgc

SEQ ID NO: 1052687 - RNA, 18 nt, Mycobacterium bovis subsp bovis AF2122/97
ccgccagccccgcgccca

SEQ ID NO: 1052688 - RNA, 22 nt, Mycobacterium bovis subsp bovis AF2122/97
ccgccagccccgcgcccacccc

SEQ ID NO: 1052689 - RNA, 15 nt, Mycobacterium bovis subsp bovis AF2122/97
ccgccagccggcgca

SEQ ID NO: 1052690 - RNA, 16 nt, Mycobacterium bovis subsp bovis AF2122/97
ccgccagcgccgguca

SEQ ID NO: 1052691 - RNA, 14 nt, Mycobacterium bovis subsp bovis AF2122/97
ccgccagcgcgccg

SEQ ID NO: 1052692 - RNA, 13 nt, Mycobacterium bovis subsp bovis AF2122/97
ccgccagcgccgc

SEQ ID NO: 1052693 - RNA, 12 nt, Mycobacterium bovis subsp bovis AF2122/97
ccgccagcgcga

SEQ ID NO: 1052694 - RNA, 13 nt, Mycobacterium bovis subsp bovis AF2122/97
ccgccagcgcgaa

SEQ ID NO: 1052695 - RNA, 16 nt, Mycobacterium bovis subsp bovis AF2122/97
ccgccagcgccgccga

SEQ ID NO: 1052696 - RNA, 16 nt, Mycobacterium bovis subsp bovis AF2122/97
ccgccagcgccgccgg

SEQ ID NO: 1052697 - RNA, 13 nt, Mycobacterium bovis subsp bovis AF2122/97
ccgcacgccuacg

SEQ ID NO: 1052698 - RNA, 19 nt, Mycobacterium bovis subsp bovis AF2122/97
ccgcacgcuagccgacagc

SEQ ID NO: 1052699 - RNA, 13 nt, Mycobacterium bovis subsp bovis AF2122/97
ccgcacgcucggc

SEQ ID NO: 1052700 - RNA, 13 nt, Mycobacterium bovis subsp bovis AF2122/97
ccgcacggccggg

SEQ ID NO: 1052701 - RNA, 14 nt, Mycobacterium bovis subsp bovis AF2122/97
ccgcacgcuggcgg

SEQ ID NO: 1052702 - RNA, 16 nt, Mycobacterium bovis subsp bovis AF2122/97
ccgcacgcuggcgggc

SEQ ID NO: 1052703 - RNA, 19 nt, Mycobacterium bovis subsp bovis AF2122/97
ccgcacgcuggcgggcacu

SEQ ID NO: 1052704 - RNA, 13 nt, Mycobacterium bovis subsp bovis AF2122/97
ccgcagcucagca

SEQ ID NO: 1052705 - RNA, 16 nt, Mycobacterium bovis subsp bovis AF2122/97
ccgcacggcgacgcca

SEQ ID NO: 1052706 - RNA, 19 nt, Mycobacterium bovis subsp bovis AF2122/97
ccgcacggugaccacgccg

SEQ ID NO: 1052707 - RNA, 20 nt, Mycobacterium bovis subsp bovis AF2122/97
ccgcaccagcugucgggcag

SEQ ID NO: 1052708 - RNA, 17 nt, Mycobacterium bovis subsp bovis AF2122/97
ccgcaccaguggcgccc

SEQ ID NO: 1052709 - RNA, 18 nt, Mycobacterium bovis subsp bovis AF2122/97
ccgcaccaucggcgaggc

SEQ ID NO: 1052710 - RNA, 19 nt, Mycobacterium bovis subsp bovis AF2122/97
ccgcaccaucggcgaggcc

SEQ ID NO: 1052711 - RNA, 14 nt, Mycobacterium bovis subsp bovis AF2122/97
ccgcacgccgaccg

SEQ ID NO: 1052712 - RNA, 20 nt, Mycobacterium bovis subsp bovis AF2122/97
ccgcacgccgaccggcccgc

SEQ ID NO: 1052713 - RNA, 14 nt, Mycobacterium bovis subsp bovis AF2122/97
ccgcacgccggcau

SEQ ID NO: 1052714 - RNA, 15 nt, Mycobacterium bovis subsp bovis AF2122/97
ccgcacgcacgccac

SEQ ID NO: 1052715 - RNA, 20 nt, Mycobacterium bovis subsp bovis AF2122/97
ccgcacccaugaucccgcug

SEQ ID NO: 1052716 - RNA, 17 nt, Mycobacterium bovis subsp bovis AF2122/97
ccgcaggcgaacaccag

SEQ ID NO: 1052717 - RNA, 16 nt, Mycobacterium bovis subsp bovis AF2122/97
ccgcaggacgcugccg

SEQ ID NO: 1052718 - RNA, 22 nt, Mycobacterium bovis subsp bovis AF2122/97
ccgcaggcgauugcagcuucgg

SEQ ID NO: 1052719 - RNA, 15 nt, Mycobacterium bovis subsp bovis AF2122/97
ccgcaggguccacac

SEQ ID NO: 1052720 - RNA, 21 nt, Mycobacterium bovis subsp bovis AF2122/97
ccgcaggccgaagacgugccg

SEQ ID NO: 1052721 - RNA, 18 nt, Mycobacterium bovis subsp bovis AF2122/97
ccgcaggcuugccgaugg

SEQ ID NO: 1052722 - RNA, 15 nt, Mycobacterium bovis subsp bovis AF2122/97
ccgcagggccgccgc

SEQ ID NO: 1052723 - RNA, 17 nt, Mycobacterium bovis subsp bovis AF2122/97
ccgcagggccgcgcgca

SEQ ID NO: 1052724 - RNA, 17 nt, Mycobacterium bovis subsp bovis AF2122/97
ccgcaggcucaccgagc

SEQ ID NO: 1052725 - RNA, 19 nt, Mycobacterium bovis subsp bovis AF2122/97
ccgcaggcucaccgagccg

SEQ ID NO: 1052726 - RNA, 22 nt, Mycobacterium bovis subsp bovis AF2122/97
ccgcaggcucucuuugagcagg

SEQ ID NO: 1052727 - RNA, 16 nt, Mycobacterium bovis subsp bovis AF2122/97
ccgcagcuuggccuca

SEQ ID NO: 1052728 - RNA, 14 nt, Mycobacterium bovis subsp bovis AF2122/97
ccgcagcuuguccg

SEQ ID NO: 1052729 - RNA, 16 nt, Mycobacterium bovis subsp bovis AF2122/97
ccgcagcuuguccggu

SEQ ID NO: 1052730 - RNA, 22 nt, Mycobacterium bovis subsp bovis AF2122/97
ccgcacguagaaguaggcggcg

SEQ ID NO: 1052731 - RNA, 15 nt, Mycobacterium bovis subsp bovis AF2122/97
ccgcaggacgcugcc

SEQ ID NO: 1052732 - RNA, 14 nt, Mycobacterium bovis subsp bovis AF2122/97
ccgcagcugcggau

SEQ ID NO: 1052733 - RNA, 23 nt, Mycobacterium bovis subsp bovis AF2122/97
ccgcagcugcggauccaccacgc

SEQ ID NO: 1052734 - RNA, 19 nt, Mycobacterium bovis subsp bovis AF2122/97
ccgcaucgccucaccacgu

SEQ ID NO: 1052735 - RNA, 16 nt, Mycobacterium bovis subsp bovis AF2122/97
ccgcauauugcggcgc

SEQ ID NO: 1052736 - RNA, 17 nt, Mycobacterium bovis subsp bovis AF2122/97
ccgcauauugcggcgcc

SEQ ID NO: 1052737 - RNA, 19 nt, Mycobacterium bovis subsp bovis AF2122/97
ccgcauauugcggcgccgu

SEQ ID NO: 1052738 - RNA, 23 nt, Mycobacterium bovis subsp bovis AF2122/97
ccgcauaccuuccagaucgcggu

SEQ ID NO: 1052739 - RNA, 17 nt, Mycobacterium bovis subsp bovis AF2122/97
ccgcaggucgcuggccg

SEQ ID NO: 1052740 - RNA, 19 nt, Mycobacterium bovis subsp bovis AF2122/97
ccgcaggugggcguuggcg

SEQ ID NO: 1052741 - RNA, 22 nt, Mycobacterium bovis subsp bovis AF2122/97
ccgcaggugggcguuggcgacg

SEQ ID NO: 1052742 - RNA, 15 nt, Mycobacterium bovis subsp bovis AF2122/97
ccgcaguccggggcg

SEQ ID NO: 1052743 - RNA, 21 nt, Mycobacterium bovis subsp bovis AF2122/97
ccgcaguccggggcgcagguc

SEQ ID NO: 1052744 - RNA, 21 nt, Mycobacterium bovis subsp bovis AF2122/97
ccgcagugagcaaugccaacg

SEQ ID NO: 1052745 - RNA, 19 nt, Mycobacterium bovis subsp bovis AF2122/97
ccgcagucgcuggguggcg

SEQ ID NO: 1052746 - RNA, 21 nt, Mycobacterium bovis subsp bovis AF2122/97
ccgcagucgcuggguggcggg

SEQ ID NO: 1052747 - RNA, 24 nt, Mycobacterium bovis subsp bovis AF2122/97
ccgcagucgcuggguggcgggccg

SEQ ID NO: 1052748 - RNA, 14 nt, Mycobacterium bovis subsp bovis AF2122/97
ccgcauaacgccag

SEQ ID NO: 1052749 - RNA, 19 nt, Mycobacterium bovis subsp bovis AF2122/97
ccgcauaccuuccagaucg

SEQ ID NO: 1052750 - RNA, 15 nt, Mycobacterium bovis subsp bovis AF2122/97
ccgacggaguucgac

SEQ ID NO: 1052751 - RNA, 17 nt, Mycobacterium bovis subsp bovis AF2122/97
ccgacggacuccggccg

SEQ ID NO: 1052752 - RNA, 18 nt, Mycobacterium bovis subsp bovis AF2122/97
ccgacggacuccggccgg

SEQ ID NO: 1052753 - RNA, 19 nt, Mycobacterium bovis subsp bovis AF2122/97
ccgacggacuccggccggc

SEQ ID NO: 1052754 - RNA, 17 nt, Mycobacterium bovis subsp bovis AF2122/97
ccgacggacuucccgcg

SEQ ID NO: 1052755 - RNA, 19 nt, Mycobacterium bovis subsp bovis AF2122/97
ccgacggacuucccgcgcg

SEQ ID NO: 1052756 - RNA, 24 nt, Mycobacterium bovis subsp bovis AF2122/97
ccgacgcuaaguccccgcuuggcg

SEQ ID NO: 1052757 - RNA, 17 nt, Mycobacterium bovis subsp bovis AF2122/97
ccgacggaaugucagcc

SEQ ID NO: 1052758 - RNA, 18 nt, Mycobacterium bovis subsp bovis AF2122/97
ccgacggaaugucagccg

SEQ ID NO: 1052759 - RNA, 19 nt, Mycobacterium bovis subsp bovis AF2122/97
ccgacggaaugucagccgg

SEQ ID NO: 1052760 - RNA, 15 nt, Mycobacterium bovis subsp bovis AF2122/97
ccgacgcuggucggc

SEQ ID NO: 1052761 - RNA, 23 nt, Mycobacterium bovis subsp bovis AF2122/97
ccgacgcuggucggcggcuucgu

SEQ ID NO: 1052762 - RNA, 19 nt, Mycobacterium bovis subsp bovis AF2122/97
ccgacgcggucggcggccg

SEQ ID NO: 1052763 - RNA, 14 nt, Mycobacterium bovis subsp bovis AF2122/97
ccgacggccgcggc

SEQ ID NO: 1052764 - RNA, 17 nt, Mycobacterium bovis subsp bovis AF2122/97
ccgacggcccggugagc

SEQ ID NO: 1052765 - RNA, 18 nt, Mycobacterium bovis subsp bovis AF2122/97
ccgacggcagugcugcag

SEQ ID NO: 1052766 - RNA, 17 nt, Mycobacterium bovis subsp bovis AF2122/97
ccgacggccagcaggau

SEQ ID NO: 1052767 - RNA, 21 nt, Mycobacterium bovis subsp bovis AF2122/97
ccgacggcaaaccaguuggcg

SEQ ID NO: 1052768 - RNA, 19 nt, Mycobacterium bovis subsp bovis AF2122/97
ccgacggcaaugcggggca

SEQ ID NO: 1052769 - RNA, 19 nt, Mycobacterium bovis subsp bovis AF2122/97
ccgacggcgaccaccgcgg

SEQ ID NO: 1052770 - RNA, 15 nt, Mycobacterium bovis subsp bovis AF2122/97
ccgacggcccgguga

SEQ ID NO: 1052771 - RNA, 15 nt, Mycobacterium bovis subsp bovis AF2122/97
ccgacggcgcccagc

SEQ ID NO: 1052772 - RNA, 23 nt, Mycobacterium bovis subsp bovis AF2122/97
ccgacggcgcccagcgcuagccg

SEQ ID NO: 1052773 - RNA, 15 nt, Mycobacterium bovis subsp bovis AF2122/97
ccgacggcgccgaac

SEQ ID NO: 1052774 - RNA, 13 nt, Mycobacterium bovis subsp bovis AF2122/97
ccgacgggugcgc

SEQ ID NO: 1052775 - RNA, 19 nt, Mycobacterium bovis subsp bovis AF2122/97
ccgacgggggucgggcgug

SEQ ID NO: 1052776 - RNA, 19 nt, Mycobacterium bovis subsp bovis AF2122/97
ccgacggguaucccguccc

SEQ ID NO: 1052777 - RNA, 12 nt, Mycobacterium bovis subsp bovis AF2122/97
ccgacgggccgu

SEQ ID NO: 1052778 - RNA, 16 nt, Mycobacterium bovis subsp bovis AF2122/97
ccgacgggccgucgcc

SEQ ID NO: 1052779 - RNA, 17 nt, Mycobacterium bovis subsp bovis AF2122/97
ccgacgggccgucgccg

SEQ ID NO: 1052780 - RNA, 18 nt, Mycobacterium bovis subsp bovis AF2122/97
ccgacgggccgucgccgu

SEQ ID NO: 1052781 - RNA, 12 nt, Mycobacterium bovis subsp bovis AF2122/97
ccgacgggcgca

SEQ ID NO: 1052782 - RNA, 15 nt, Mycobacterium bovis subsp bovis AF2122/97
ccgacgggcgcaacg

SEQ ID NO: 1052783 - RNA, 17 nt, Mycobacterium bovis subsp bovis AF2122/97
ccgacgggauagacgac

SEQ ID NO: 1052784 - RNA, 16 nt, Mycobacterium bovis subsp bovis AF2122/97
ccgacgguguagccgc

SEQ ID NO: 1052785 - RNA, 19 nt, Mycobacterium bovis subsp bovis AF2122/97
ccgacgguguagccgccgg

SEQ ID NO: 1052786 - RNA, 22 nt, Mycobacterium bovis subsp bovis AF2122/97
ccgacgguguagccgccggcag

SEQ ID NO: 1052787 - RNA, 18 nt, Mycobacterium bovis subsp bovis AF2122/97
ccgacgguuacccagccg

SEQ ID NO: 1052788 - RNA, 16 nt, Mycobacterium bovis subsp bovis AF2122/97
ccgacguacaggacgg

SEQ ID NO: 1052789 - RNA, 12 nt, Mycobacterium bovis subsp bovis AF2122/97
ccgacggugaug

SEQ ID NO: 1052790 - RNA, 14 nt, Mycobacterium bovis subsp bovis AF2122/97
ccgacggucaacga

SEQ ID NO: 1052791 - RNA, 13 nt, Mycobacterium bovis subsp bovis AF2122/97
ccgacgucaggca

SEQ ID NO: 1052792 - RNA, 13 nt, Mycobacterium bovis subsp bovis AF2122/97
ccgacgcccgacg

SEQ ID NO: 1052793 - RNA, 14 nt, Mycobacterium bovis subsp bovis AF2122/97
ccgacgcccgacug

SEQ ID NO: 1052794 - RNA, 20 nt, Mycobacterium bovis subsp bovis AF2122/97
ccgacgcagcuugcccgacg

SEQ ID NO: 1052795 - RNA, 18 nt, Mycobacterium bovis subsp bovis AF2122/97
ccgacgccgccagguccg

SEQ ID NO: 1052796 - RNA, 19 nt, Mycobacterium bovis subsp bovis AF2122/97
ccgacgccgccagguccgc

SEQ ID NO: 1052797 - RNA, 23 nt, Mycobacterium bovis subsp bovis AF2122/97
ccgacgccgccagguccgccggu

SEQ ID NO: 1052798 - RNA, 13 nt, Mycobacterium bovis subsp bovis AF2122/97
ccgacgccgccgg

SEQ ID NO: 1052799 - RNA, 17 nt, Mycobacterium bovis subsp bovis AF2122/97
ccgacgccgccggcccc

SEQ ID NO: 1052800 - RNA, 16 nt, Mycobacterium bovis subsp bovis AF2122/97
ccgacgccgccggcgc

SEQ ID NO: 1052801 - RNA, 18 nt, Mycobacterium bovis subsp bovis AF2122/97
ccgacgccgccggcgcca

SEQ ID NO: 1052802 - RNA, 21 nt, Mycobacterium bovis subsp bovis AF2122/97
ccgacgccgccggcgccaccg

SEQ ID NO: 1052803 - RNA, 22 nt, Mycobacterium bovis subsp bovis AF2122/97
ccgacgccgccggcgccaccgu

SEQ ID NO: 1052804 - RNA, 14 nt, Mycobacterium bovis subsp bovis AF2122/97
ccgacgccggucac

SEQ ID NO: 1052805 - RNA, 14 nt, Mycobacterium bovis subsp bovis AF2122/97
ccgacgccggugcc

SEQ ID NO: 1052806 - RNA, 16 nt, Mycobacterium bovis subsp bovis AF2122/97
ccgacgccggugccgg

SEQ ID NO: 1052807 - RNA, 17 nt, Mycobacterium bovis subsp bovis AF2122/97
ccgacgccggugccggc

SEQ ID NO: 1052808 - RNA, 21 nt, Mycobacterium bovis subsp bovis AF2122/97
ccgacgccggugccggccaga

SEQ ID NO: 1052809 - RNA, 14 nt, Mycobacterium bovis subsp bovis AF2122/97
ccgacgccgguggc

SEQ ID NO: 1052810 - RNA, 16 nt, Mycobacterium bovis subsp bovis AF2122/97
ccgacgccggugucgg

SEQ ID NO: 1052811 - RNA, 18 nt, Mycobacterium bovis subsp bovis AF2122/97
ccgacgcgaucuguccgc

SEQ ID NO: 1052812 - RNA, 19 nt, Mycobacterium bovis subsp bovis AF2122/97
ccgacgcgaacgcggccac

SEQ ID NO: 1052813 - RNA, 22 nt, Mycobacterium bovis subsp bovis AF2122/97
ccgacgccugggcacggccguc

SEQ ID NO: 1052814 - RNA, 14 nt, Mycobacterium bovis subsp bovis AF2122/97
ccgacgcgaaccca

SEQ ID NO: 1052815 - RNA, 21 nt, Mycobacterium bovis subsp bovis AF2122/97
ccgacgccugggcacggccgu

SEQ ID NO: 1052816 - RNA, 14 nt, Mycobacterium bovis subsp bovis AF2122/97
ccgacgccguugcc

SEQ ID NO: 1052817 - RNA, 16 nt, Mycobacterium bovis subsp bovis AF2122/97
ccgacgcgcggccagc

SEQ ID NO: 1052818 - RNA, 23 nt, Mycobacterium bovis subsp bovis AF2122/97
ccgacgcgaucuguccgcgaacg

SEQ ID NO: 1052819 - RNA, 14 nt, Mycobacterium bovis subsp bovis AF2122/97
ccgacgcgcggcca

SEQ ID NO: 1052820 - RNA, 14 nt, Mycobacterium bovis subsp bovis AF2122/97
ccgacgcggcgggu

SEQ ID NO: 1052821 - RNA, 14 nt, Mycobacterium bovis subsp bovis AF2122/97
ccgaauggccgauc

SEQ ID NO: 1052822 - RNA, 15 nt, Mycobacterium bovis subsp bovis AF2122/97
ccgaauggccgccgc

SEQ ID NO: 1052823 - RNA, 17 nt, Mycobacterium bovis subsp bovis AF2122/97
ccgaauggccgccgcag

SEQ ID NO: 1052824 - RNA, 15 nt, Mycobacterium bovis subsp bovis AF2122/97
ccgaauuggcggaac

SEQ ID NO: 1052825 - RNA, 14 nt, Mycobacterium bovis subsp bovis AF2122/97
ccgaauuugucggc

SEQ ID NO: 1052826 - RNA, 24 nt, Mycobacterium bovis subsp bovis AF2122/97
ccgacaacgacgucgccgacccgg

SEQ ID NO: 1052827 - RNA, 15 nt, Mycobacterium bovis subsp bovis AF2122/97
ccgacaaccuuggcg

SEQ ID NO: 1052828 - RNA, 18 nt, Mycobacterium bovis subsp bovis AF2122/97
ccgacaaccuuggcgacu

SEQ ID NO: 1052829 - RNA, 20 nt, Mycobacterium bovis subsp bovis AF2122/97
ccgacaacuguccugccaga

SEQ ID NO: 1052830 - RNA, 17 nt, Mycobacterium bovis subsp bovis AF2122/97
ccgacaagaauggccgc

SEQ ID NO: 1052831 - RNA, 18 nt, Mycobacterium bovis subsp bovis AF2122/97
ccgacaacccggccgggc

SEQ ID NO: 1052832 - RNA, 19 nt, Mycobacterium bovis subsp bovis AF2122/97
ccgacaacccggccgggcc

SEQ ID NO: 1052833 - RNA, 22 nt, Mycobacterium bovis subsp bovis AF2122/97
ccgacaacccggccgggccugc

SEQ ID NO: 1052834 - RNA, 15 nt, Mycobacterium bovis subsp bovis AF2122/97
ccgacgaugcgcacu

SEQ ID NO: 1052835 - RNA, 16 nt, Mycobacterium bovis subsp bovis AF2122/97
ccgacaaucaccaacg

SEQ ID NO: 1052836 - RNA, 18 nt, Mycobacterium bovis subsp bovis AF2122/97
ccgacgccaccgccacca

SEQ ID NO: 1052837 - RNA, 21 nt, Mycobacterium bovis subsp bovis AF2122/97
ccgacgccagaacguggccau

SEQ ID NO: 1052838 - RNA, 19 nt, Mycobacterium bovis subsp bovis AF2122/97
ccgacgcacaggcgacggc

SEQ ID NO: 1052839 - RNA, 19 nt, Mycobacterium bovis subsp bovis AF2122/97
ccgacgcaccaacgcgauc

SEQ ID NO: 1052840 - RNA, 17 nt, Mycobacterium bovis subsp bovis AF2122/97
ccgacgcaccucggugg

SEQ ID NO: 1052841 - RNA, 18 nt, Mycobacterium bovis subsp bovis AF2122/97
ccgacacagcggcggguc

SEQ ID NO: 1052842 - RNA, 19 nt, Mycobacterium bovis subsp bovis AF2122/97
ccgacaaugucggcgaugc

SEQ ID NO: 1052843 - RNA, 21 nt, Mycobacterium bovis subsp bovis AF2122/97
ccgacgaugugcacggugugc

SEQ ID NO: 1052844 - RNA, 19 nt, Mycobacterium bovis subsp bovis AF2122/97
ccgagcaccugaccguuga

SEQ ID NO: 1052845 - RNA, 17 nt, Mycobacterium bovis subsp bovis AF2122/97
ccgagcaacggcggcag

SEQ ID NO: 1052846 - RNA, 22 nt, Mycobacterium bovis subsp bovis AF2122/97
ccgagcaacggcggcaggccgg

SEQ ID NO: 1052847 - RNA, 20 nt, Mycobacterium bovis subsp bovis AF2122/97
ccgagauccguccgcuggug

SEQ ID NO: 1052848 - RNA, 14 nt, Mycobacterium bovis subsp bovis AF2122/97
ccgagaucaccggu

SEQ ID NO: 1052849 - RNA, 15 nt, Mycobacterium bovis subsp bovis AF2122/97
ccgagauccacgcca

SEQ ID NO: 1052850 - RNA, 20 nt, Mycobacterium bovis subsp bovis AF2122/97
ccgagauccacgccagagcg

SEQ ID NO: 1052851 - RNA, 23 nt, Mycobacterium bovis subsp bovis AF2122/97
ccgagaugaugcugccggcacca

SEQ ID NO: 1052852 - RNA, 14 nt, Mycobacterium bovis subsp bovis AF2122/97
ccgagaugccggcg

SEQ ID NO: 1052853 - RNA, 20 nt, Mycobacterium bovis subsp bovis AF2122/97
ccgagaugcugcacccggag

SEQ ID NO: 1052854 - RNA, 17 nt, Mycobacterium bovis subsp bovis AF2122/97
ccgagcaaacacgccuc

SEQ ID NO: 1052855 - RNA, 21 nt, Mycobacterium bovis subsp bovis AF2122/97
ccgagcaacaccgucggcagc

SEQ ID NO: 1052856 - RNA, 16 nt, Mycobacterium bovis subsp bovis AF2122/97
ccgagaacggcgggcg

SEQ ID NO: 1052857 - RNA, 15 nt, Mycobacterium bovis subsp bovis AF2122/97
ccgagaacaccacgc

SEQ ID NO: 1052858 - RNA, 14 nt, Mycobacterium bovis subsp bovis AF2122/97
ccgagaaccagcga

SEQ ID NO: 1052859 - RNA, 21 nt, Mycobacterium bovis subsp bovis AF2122/97
ccgagaacgauguccgcgcga

SEQ ID NO: 1052860 - RNA, 14 nt, Mycobacterium bovis subsp bovis AF2122/97
ccgagaacgcccga

SEQ ID NO: 1052861 - RNA, 17 nt, Mycobacterium bovis subsp bovis AF2122/97
ccgagaccacgcgcguc

SEQ ID NO: 1052862 - RNA, 23 nt, Mycobacterium bovis subsp bovis AF2122/97
ccgagaccacgcgcgucggugug

SEQ ID NO: 1052863 - RNA, 17 nt, Mycobacterium bovis subsp bovis AF2122/97
ccgagaccaugccgacg

SEQ ID NO: 1052864 - RNA, 18 nt, Mycobacterium bovis subsp bovis AF2122/97
ccgagaccaugccgacga

SEQ ID NO: 1052865 - RNA, 13 nt, Mycobacterium bovis subsp bovis AF2122/97
ccgagaccgccgc

SEQ ID NO: 1052866 - RNA, 20 nt, Mycobacterium bovis subsp bovis AF2122/97
ccgagaccgcguggucggcg

SEQ ID NO: 1052867 - RNA, 16 nt, Mycobacterium bovis subsp bovis AF2122/97
ccgagacgucggcgua

SEQ ID NO: 1052868 - RNA, 17 nt, Mycobacterium bovis subsp bovis AF2122/97
ccgagacgucggcguag

SEQ ID NO: 1052869 - RNA, 15 nt, Mycobacterium bovis subsp bovis AF2122/97
ccgagaccggccagu

SEQ ID NO: 1052870 - RNA, 19 nt, Mycobacterium bovis subsp bovis AF2122/97
ccgagaccggccaguccgg

SEQ ID NO: 1052871 - RNA, 22 nt, Mycobacterium bovis subsp bovis AF2122/97
ccgagacuugcuggcccgcacg

SEQ ID NO: 1052872 - RNA, 15 nt, Mycobacterium bovis subsp bovis AF2122/97
ccgagagcagccagc

SEQ ID NO: 1052873 - RNA, 15 nt, Mycobacterium bovis subsp bovis AF2122/97
ccgagauagcaacga

SEQ ID NO: 1052874 - RNA, 20 nt, Mycobacterium bovis subsp bovis AF2122/97
ccgagaccaugccgacgacg

SEQ ID NO: 1052875 - RNA, 15 nt, Mycobacterium bovis subsp bovis AF2122/97
ccgagaucaccgcca

SEQ ID NO: 1052876 - RNA, 19 nt, Mycobacterium bovis subsp bovis AF2122/97
ccgacuuaagcgaacccga

SEQ ID NO: 1052877 - RNA, 16 nt, Mycobacterium bovis subsp bovis AF2122/97
ccgacugccgcgggca

SEQ ID NO: 1052878 - RNA, 18 nt, Mycobacterium bovis subsp bovis AF2122/97
ccgacugggcgcgacccc

SEQ ID NO: 1052879 - RNA, 14 nt, Mycobacterium bovis subsp bovis AF2122/97
ccgacuggccccgc

SEQ ID NO: 1052880 - RNA, 19 nt, Mycobacterium bovis subsp bovis AF2122/97
ccgacugcggguucgccga

SEQ ID NO: 1052881 - RNA, 21 nt, Mycobacterium bovis subsp bovis AF2122/97
ccgacuucggaaaggucggcc

SEQ ID NO: 1052882 - RNA, 22 nt, Mycobacterium bovis subsp bovis AF2122/97
ccgacuuguacgcaucgccguc

SEQ ID NO: 1052883 - RNA, 21 nt, Mycobacterium bovis subsp bovis AF2122/97
ccgacuugauuucgaucgcgg

SEQ ID NO: 1052884 - RNA, 23 nt, Mycobacterium bovis subsp bovis AF2122/97
ccgacucccccucuaccuccgcc

SEQ ID NO: 1052885 - RNA, 22 nt, Mycobacterium bovis subsp bovis AF2122/97
ccgacucaggucggugcgguca

SEQ ID NO: 1052886 - RNA, 14 nt, Mycobacterium bovis subsp bovis AF2122/97
ccgacucaggucgg

SEQ ID NO: 1052887 - RNA, 15 nt, Mycobacterium bovis subsp bovis AF2122/97
ccgacuccccgccgg

SEQ ID NO: 1052888 - RNA, 17 nt, Mycobacterium bovis subsp bovis AF2122/97
ccgacuccccgccgggc

SEQ ID NO: 1052889 - RNA, 21 nt, Mycobacterium bovis subsp bovis AF2122/97
ccgacucggcaccgcggccgc

SEQ ID NO: 1052890 - RNA, 13 nt, Mycobacterium bovis subsp bovis AF2122/97
ccgacugccgcgg

SEQ ID NO: 1052891 - RNA, 22 nt, Mycobacterium bovis subsp bovis AF2122/97
ccgacugcgcccauagcugccg

SEQ ID NO: 1052892 - RNA, 13 nt, Mycobacterium bovis subsp bovis AF2122/97
ccgacucggccgu

SEQ ID NO: 1052893 - RNA, 17 nt, Mycobacterium bovis subsp bovis AF2122/97
ccgacucggccgugacc

SEQ ID NO: 1052894 - RNA, 18 nt, Mycobacterium bovis subsp bovis AF2122/97
ccgacugaacgucaccgu

SEQ ID NO: 1052895 - RNA, 20 nt, Mycobacterium bovis subsp bovis AF2122/97
ccgacgucugguuggcuggc

SEQ ID NO: 1052896 - RNA, 19 nt, Mycobacterium bovis subsp bovis AF2122/97
ccgacgugaccagcuucgg

SEQ ID NO: 1052897 - RNA, 21 nt, Mycobacterium bovis subsp bovis AF2122/97
ccgacgugagggucaugucga

SEQ ID NO: 1052898 - RNA, 14 nt, Mycobacterium bovis subsp bovis AF2122/97
ccgacgucgccaag

SEQ ID NO: 1052899 - RNA, 17 nt, Mycobacterium bovis subsp bovis AF2122/97
ccgacgucgccaagacc

SEQ ID NO: 1052900 - RNA, 17 nt, Mycobacterium bovis subsp bovis AF2122/97
ccgacgucgacgccggc

SEQ ID NO: 1052901 - RNA, 19 nt, Mycobacterium bovis subsp bovis AF2122/97
ccgacgucgacgccggcca

SEQ ID NO: 1052902 - RNA, 19 nt, Mycobacterium bovis subsp bovis AF2122/97
ccgacgucaggcagcuccg

SEQ ID NO: 1052903 - RNA, 15 nt, Mycobacterium bovis subsp bovis AF2122/97
ccgacgucgacgaga

SEQ ID NO: 1052904 - RNA, 15 nt, Mycobacterium bovis subsp bovis AF2122/97
ccgacgucgacgccg

SEQ ID NO: 1052905 - RNA, 13 nt, Mycobacterium bovis subsp bovis AF2122/97
ccgacgucgacga

SEQ ID NO: 1052906 - RNA, 13 nt, Mycobacterium bovis subsp bovis AF2122/97
ccgacgugccccc

SEQ ID NO: 1052907 - RNA, 16 nt, Mycobacterium bovis subsp bovis AF2122/97
ccgacgucgccggacg

SEQ ID NO: 1052908 - RNA, 14 nt, Mycobacterium bovis subsp bovis AF2122/97
ccgacgugcggcgg

SEQ ID NO: 1052909 - RNA, 17 nt, Mycobacterium bovis subsp bovis AF2122/97
ccgacgugcggcggccu

SEQ ID NO: 1052910 - RNA, 17 nt, Mycobacterium bovis subsp bovis AF2122/97
ccgacguggaacugcag

SEQ ID NO: 1052911 - RNA, 14 nt, Mycobacterium bovis subsp bovis AF2122/97
ccgacguggccagc

SEQ ID NO: 1052912 - RNA, 23 nt, Mycobacterium bovis subsp bovis AF2122/97
ccgacuaguccgagggcgucgcc

SEQ ID NO: 1052913 - RNA, 19 nt, Mycobacterium bovis subsp bovis AF2122/97
ccgacguugaagccgccgg

SEQ ID NO: 1052914 - RNA, 17 nt, Mycobacterium bovis subsp bovis AF2122/97
ccgacuaucggccgccg

SEQ ID NO: 1052915 - RNA, 21 nt, Mycobacterium bovis subsp bovis AF2122/97
ccgacguuccccuucagcacg

SEQ ID NO: 1052916 - RNA, 16 nt, Mycobacterium bovis subsp bovis AF2122/97
ccgagcagcagaaacg

SEQ ID NO: 1052917 - RNA, 14 nt, Mycobacterium bovis subsp bovis AF2122/97
ccgagcagacgcag

SEQ ID NO: 1052918 - RNA, 19 nt, Mycobacterium bovis subsp bovis AF2122/97
ccgagcagacgcggaaucg

SEQ ID NO: 1052919 - RNA, 19 nt, Mycobacterium bovis subsp bovis AF2122/97
ccgagcagauacuccgcgg

SEQ ID NO: 1052920 - RNA, 22 nt, Mycobacterium bovis subsp bovis AF2122/97
ccgagcagauacuccgcgguug

SEQ ID NO: 1052921 - RNA, 17 nt, Mycobacterium bovis subsp bovis AF2122/97
ccgagcacucggccacg

SEQ ID NO: 1052922 - RNA, 17 nt, Mycobacterium bovis subsp bovis AF2122/97
ccgagcagacacagaau

SEQ ID NO: 1052923 - RNA, 17 nt, Mycobacterium bovis subsp bovis AF2122/97
ccgagcagacgcaaaau

SEQ ID NO: 1052924 - RNA, 19 nt, Mycobacterium bovis subsp bovis AF2122/97
ccgagcagacgcaaaaucg

SEQ ID NO: 1052925 - RNA, 16 nt, Mycobacterium bovis subsp bovis AF2122/97
ccgagcagggccggca

SEQ ID NO: 1052926 - RNA, 15 nt, Mycobacterium bovis subsp bovis AF2122/97
ccgagcagcccgcgg

SEQ ID NO: 1052927 - RNA, 18 nt, Mycobacterium bovis subsp bovis AF2122/97
ccgagcagcccgcggauc

SEQ ID NO: 1052928 - RNA, 22 nt, Mycobacterium bovis subsp bovis AF2122/97
ccgagcagggccggcaccgcag

SEQ ID NO: 1052929 - RNA, 23 nt, Mycobacterium bovis subsp bovis AF2122/97
ccgagcagggccggcaccgcagc

SEQ ID NO: 1052930 - RNA, 17 nt, Mycobacterium bovis subsp bovis AF2122/97
ccgagcagggccggcac

SEQ ID NO: 1052931 - RNA, 19 nt, Mycobacterium bovis subsp bovis AF2122/97
ccgagcagggccggcaccg

SEQ ID NO: 1052932 - RNA, 24 nt, Mycobacterium bovis subsp bovis AF2122/97
ccgagcaucagauucgcgcuggcc

SEQ ID NO: 1052933 - RNA, 16 nt, Mycobacterium bovis subsp bovis AF2122/97
ccgagcaucucgucgu

SEQ ID NO: 1052934 - RNA, 14 nt, Mycobacterium bovis subsp bovis AF2122/97
ccgagccguugcgc

SEQ ID NO: 1052935 - RNA, 17 nt, Mycobacterium bovis subsp bovis AF2122/97
ccgagccuugagcgcgg

SEQ ID NO: 1052936 - RNA, 18 nt, Mycobacterium bovis subsp bovis AF2122/97
ccgagccuugagcgcggc

SEQ ID NO: 1052937 - RNA, 14 nt, Mycobacterium bovis subsp bovis AF2122/97
ccgagccgguaacc

SEQ ID NO: 1052938 - RNA, 20 nt, Mycobacterium bovis subsp bovis AF2122/97
ccgagccgguaaccgcgucg

SEQ ID NO: 1052939 - RNA, 13 nt, Mycobacterium bovis subsp bovis AF2122/97
ccgagccgcagcu

SEQ ID NO: 1052940 - RNA, 16 nt, Mycobacterium bovis subsp bovis AF2122/97
ccgagccgcagcucgc

SEQ ID NO: 1052941 - RNA, 17 nt, Mycobacterium bovis subsp bovis AF2122/97
ccgagccgcggucaccc

SEQ ID NO: 1052942 - RNA, 20 nt, Mycobacterium bovis subsp bovis AF2122/97
ccgagccgcggucaccccgg

SEQ ID NO: 1052943 - RNA, 15 nt, Mycobacterium bovis subsp bovis AF2122/97
ccgagccgcugcgac

SEQ ID NO: 1052944 - RNA, 16 nt, Mycobacterium bovis subsp bovis AF2122/97
ccgagccggcacgcgc

SEQ ID NO: 1052945 - RNA, 16 nt, Mycobacterium bovis subsp bovis AF2122/97
ccgagcccgucgauca

SEQ ID NO: 1052946 - RNA, 16 nt, Mycobacterium bovis subsp bovis AF2122/97
ccgagcccuccagggc

SEQ ID NO: 1052947 - RNA, 20 nt, Mycobacterium bovis subsp bovis AF2122/97
ccgagccgauauaccagggc

SEQ ID NO: 1052948 - RNA, 12 nt, Mycobacterium bovis subsp bovis AF2122/97
ccgagccgccgu

SEQ ID NO: 1052949 - RNA, 13 nt, Mycobacterium bovis subsp bovis AF2122/97
ccgagcccgccgg

SEQ ID NO: 1052950 - RNA, 15 nt, Mycobacterium bovis subsp bovis AF2122/97
ccgagcccgccgggu

SEQ ID NO: 1052951 - RNA, 19 nt, Mycobacterium bovis subsp bovis AF2122/97
ccgagcccgggccguacgg

SEQ ID NO: 1052952 - RNA, 14 nt, Mycobacterium bovis subsp bovis AF2122/97
ccgagcccgggccu

SEQ ID NO: 1052953 - RNA, 13 nt, Mycobacterium bovis subsp bovis AF2122/97
ccgagcccggugc

SEQ ID NO: 1052954 - RNA, 14 nt, Mycobacterium bovis subsp bovis AF2122/97
ccgagccagcuccg

SEQ ID NO: 1052955 - RNA, 17 nt, Mycobacterium bovis subsp bovis AF2122/97
ccgagcccaauccgcaa

SEQ ID NO: 1052956 - RNA, 16 nt, Mycobacterium bovis subsp bovis AF2122/97
ccgagcccagcgccuc

SEQ ID NO: 1052957 - RNA, 22 nt, Mycobacterium bovis subsp bovis AF2122/97
ccgagcgugaagucacggcggc

SEQ ID NO: 1052958 - RNA, 23 nt, Mycobacterium bovis subsp bovis AF2122/97
ccgagcuagaucacggagcucuu

SEQ ID NO: 1052959 - RNA, 19 nt, Mycobacterium bovis subsp bovis AF2122/97
ccgagcgugaagucacggc

SEQ ID NO: 1052960 - RNA, 20 nt, Mycobacterium bovis subsp bovis AF2122/97
ccgagcgugaagucacggcg

SEQ ID NO: 1052961 - RNA, 21 nt, Mycobacterium bovis subsp bovis AF2122/97
ccgagcgugcgcugguggcgg

SEQ ID NO: 1052962 - RNA, 22 nt, Mycobacterium bovis subsp bovis AF2122/97
ccgagcgugcgcugguggcggc

SEQ ID NO: 1052963 - RNA, 20 nt, Mycobacterium bovis subsp bovis AF2122/97
ccgagcguggccaauccggc

SEQ ID NO: 1052964 - RNA, 12 nt, Mycobacterium bovis subsp bovis AF2122/97
ccgagcguggcg

SEQ ID NO: 1052965 - RNA, 15 nt, Mycobacterium bovis subsp bovis AF2122/97
ccgagcggcggcacu

SEQ ID NO: 1052966 - RNA, 20 nt, Mycobacterium bovis subsp bovis AF2122/97
ccgagcggcugagccgcauc

SEQ ID NO: 1052967 - RNA, 18 nt, Mycobacterium bovis subsp bovis AF2122/97
ccgagcgggaacgagcca

SEQ ID NO: 1052968 - RNA, 15 nt, Mycobacterium bovis subsp bovis AF2122/97
ccgagcggugccggc

SEQ ID NO: 1052969 - RNA, 17 nt, Mycobacterium bovis subsp bovis AF2122/97
ccgagcguaaugcugcu

SEQ ID NO: 1052970 - RNA, 18 nt, Mycobacterium bovis subsp bovis AF2122/97
ccgagcucggucaccacg

SEQ ID NO: 1052971 - RNA, 23 nt, Mycobacterium bovis subsp bovis AF2122/97
ccgagcucggucaccacggcggc

SEQ ID NO: 1052972 - RNA, 21 nt, Mycobacterium bovis subsp bovis AF2122/97
ccgagcucguugaccaggaau

SEQ ID NO: 1052973 - RNA, 19 nt, Mycobacterium bovis subsp bovis AF2122/97
ccgagcucguugcuggcgg

SEQ ID NO: 1052974 - RNA, 18 nt, Mycobacterium bovis subsp bovis AF2122/97
ccgagcucuaucgggaag

SEQ ID NO: 1052975 - RNA, 21 nt, Mycobacterium bovis subsp bovis AF2122/97
ccgagcucacuucacgccgcc

SEQ ID NO: 1052976 - RNA, 17 nt, Mycobacterium bovis subsp bovis AF2122/97
ccgagcuccgcggcgag

SEQ ID NO: 1052977 - RNA, 15 nt, Mycobacterium bovis subsp bovis AF2122/97
ccgagcucgccgcag

SEQ ID NO: 1052978 - RNA, 16 nt, Mycobacterium bovis subsp bovis AF2122/97
ccgagcucgccgcagc

SEQ ID NO: 1052979 - RNA, 17 nt, Mycobacterium bovis subsp bovis AF2122/97
ccgagcucgccgcagcg

SEQ ID NO: 1052980 - RNA, 21 nt, Mycobacterium bovis subsp bovis AF2122/97
ccgagcugauccggguggcgu

SEQ ID NO: 1052981 - RNA, 14 nt, Mycobacterium bovis subsp bovis AF2122/97
ccgagcugucggcu

SEQ ID NO: 1052982 - RNA, 21 nt, Mycobacterium bovis subsp bovis AF2122/97
ccgagcugugcgcagacaucg

SEQ ID NO: 1052983 - RNA, 20 nt, Mycobacterium bovis subsp bovis AF2122/97
ccgagcugccgucgcugccc

SEQ ID NO: 1052984 - RNA, 22 nt, Mycobacterium bovis subsp bovis AF2122/97
ccgagcuggcaacgccgcgccg

SEQ ID NO: 1052985 - RNA, 17 nt, Mycobacterium bovis subsp bovis AF2122/97
ccgagcuggccgucagc

SEQ ID NO: 1052986 - RNA, 18 nt, Mycobacterium bovis subsp bovis AF2122/97
ccgagcuggccgucagcg

SEQ ID NO: 1052987 - RNA, 22 nt, Mycobacterium bovis subsp bovis AF2122/97
ccgagcuggccgucagcgucgg

SEQ ID NO: 1052988 - RNA, 20 nt, Mycobacterium bovis subsp bovis AF2122/97
ccgagcuggcgcgcggggug

SEQ ID NO: 1052989 - RNA, 20 nt, Mycobacterium bovis subsp bovis AF2122/97
ccgagcugacgccgagcugg

SEQ ID NO: 1052990 - RNA, 19 nt, Mycobacterium bovis subsp bovis AF2122/97
ccgagcggaccaccgcucg

SEQ ID NO: 1052991 - RNA, 21 nt, Mycobacterium bovis subsp bovis AF2122/97
ccgagcggagccgccgacucg

SEQ ID NO: 1052992 - RNA, 14 nt, Mycobacterium bovis subsp bovis AF2122/97
ccgagcgcggcggc

SEQ ID NO: 1052993 - RNA, 15 nt, Mycobacterium bovis subsp bovis AF2122/97
ccgagcgcggcggcg

SEQ ID NO: 1052994 - RNA, 16 nt, Mycobacterium bovis subsp bovis AF2122/97
ccgagcgcggcggcgg

SEQ ID NO: 1052995 - RNA, 17 nt, Mycobacterium bovis subsp bovis AF2122/97
ccgagcgcggcggcgga

SEQ ID NO: 1052996 - RNA, 14 nt, Mycobacterium bovis subsp bovis AF2122/97
ccgagcgcgccggc

SEQ ID NO: 1052997 - RNA, 13 nt, Mycobacterium bovis subsp bovis AF2122/97
ccgagcgcgccgu

SEQ ID NO: 1052998 - RNA, 23 nt, Mycobacterium bovis subsp bovis AF2122/97
ccgagcggcaucggucaccgcgg

SEQ ID NO: 1052999 - RNA, 22 nt, Mycobacterium bovis subsp bovis AF2122/97
ccgagcggcccuucaccagcca

SEQ ID NO: 1053000 - RNA, 12 nt, Mycobacterium bovis subsp bovis AF2122/97
ccgagcgggaac

SEQ ID NO: 1053001 - RNA, 14 nt, Mycobacterium bovis subsp bovis AF2122/97
ccgagcgcccgcaa

SEQ ID NO: 1053002 - RNA, 13 nt, Mycobacterium bovis subsp bovis AF2122/97
ccgagcgcgauga

SEQ ID NO: 1053003 - RNA, 15 nt, Mycobacterium bovis subsp bovis AF2122/97
ccgagcgcaccgcug

SEQ ID NO: 1053004 - RNA, 15 nt, Mycobacterium bovis subsp bovis AF2122/97
ccgagcgaccguccc

SEQ ID NO: 1053005 - RNA, 22 nt, Mycobacterium bovis subsp bovis AF2122/97
ccgagcgaccgucccagcgccg

SEQ ID NO: 1053006 - RNA, 22 nt, Mycobacterium bovis subsp bovis AF2122/97
ccgagcgcaacucccagcacgg

SEQ ID NO: 1053007 - RNA, 23 nt, Mycobacterium bovis subsp bovis AF2122/97
ccgagcgcaacucccagcacggu

SEQ ID NO: 1053008 - RNA, 23 nt, Mycobacterium bovis subsp bovis AF2122/97
ccgagcgcaagagccguccgacc

SEQ ID NO: 1053009 - RNA, 22 nt, Mycobacterium bovis subsp bovis AF2122/97
ccgaggaugccgaaccgcgcgu

SEQ ID NO: 1053010 - RNA, 20 nt, Mycobacterium bovis subsp bovis AF2122/97
ccgaggcggguacaccacgg

SEQ ID NO: 1053011 - RNA, 21 nt, Mycobacterium bovis subsp bovis AF2122/97
ccgaggcuggcaucccgggca

SEQ ID NO: 1053012 - RNA, 23 nt, Mycobacterium bovis subsp bovis AF2122/97
ccgaggcuggcaucccgggcagu

SEQ ID NO: 1053013 - RNA, 13 nt, Mycobacterium bovis subsp bovis AF2122/97
ccgaggcucgggc

SEQ ID NO: 1053014 - RNA, 24 nt, Mycobacterium bovis subsp bovis AF2122/97
ccgaggcggucuuguccaggaacu

SEQ ID NO: 1053015 - RNA, 14 nt, Mycobacterium bovis subsp bovis AF2122/97
ccgagggauggccg

SEQ ID NO: 1053016 - RNA, 23 nt, Mycobacterium bovis subsp bovis AF2122/97
ccgagggauugccgugcucgucg

SEQ ID NO: 1053017 - RNA, 14 nt, Mycobacterium bovis subsp bovis AF2122/97
ccgagggcugcgug

SEQ ID NO: 1053018 - RNA, 14 nt, Mycobacterium bovis subsp bovis AF2122/97
ccgagggcggcagc

SEQ ID NO: 1053019 - RNA, 15 nt, Mycobacterium bovis subsp bovis AF2122/97
ccgagggcggcagcu

SEQ ID NO: 1053020 - RNA, 16 nt, Mycobacterium bovis subsp bovis AF2122/97
ccgagggcgucgccgc

SEQ ID NO: 1053021 - RNA, 17 nt, Mycobacterium bovis subsp bovis AF2122/97
ccgaggucgaaccgccg

SEQ ID NO: 1053022 - RNA, 16 nt, Mycobacterium bovis subsp bovis AF2122/97
ccgagguaacgcagcg

SEQ ID NO: 1053023 - RNA, 22 nt, Mycobacterium bovis subsp bovis AF2122/97
ccgaggguagacggggcgagca

SEQ ID NO: 1053024 - RNA, 14 nt, Mycobacterium bovis subsp bovis AF2122/97
ccgaggaugccgaa

SEQ ID NO: 1053025 - RNA, 20 nt, Mycobacterium bovis subsp bovis AF2122/97
ccgaggccgaccucguucgu

SEQ ID NO: 1053026 - RNA, 17 nt, Mycobacterium bovis subsp bovis AF2122/97
ccgaggccgccaucgcc

SEQ ID NO: 1053027 - RNA, 18 nt, Mycobacterium bovis subsp bovis AF2122/97
ccgaggccgccaucgccg

SEQ ID NO: 1053028 - RNA, 14 nt, Mycobacterium bovis subsp bovis AF2122/97
ccgaggccgccguu

SEQ ID NO: 1053029 - RNA, 17 nt, Mycobacterium bovis subsp bovis AF2122/97
ccgaggccuaccaggcg

SEQ ID NO: 1053030 - RNA, 16 nt, Mycobacterium bovis subsp bovis AF2122/97
ccgaggccucggccag

SEQ ID NO: 1053031 - RNA, 20 nt, Mycobacterium bovis subsp bovis AF2122/97
ccgagcuguggucacccgug

SEQ ID NO: 1053032 - RNA, 19 nt, Mycobacterium bovis subsp bovis AF2122/97
ccgagcguggcguuggcgg

SEQ ID NO: 1053033 - RNA, 20 nt, Mycobacterium bovis subsp bovis AF2122/97
ccgaggaauacucucgcgac

SEQ ID NO: 1053034 - RNA, 14 nt, Mycobacterium bovis subsp bovis AF2122/97
ccgagcuuggccgc

SEQ ID NO: 1053035 - RNA, 15 nt, Mycobacterium bovis subsp bovis AF2122/97
ccgagcuuggccgcc

SEQ ID NO: 1053036 - RNA, 19 nt, Mycobacterium bovis subsp bovis AF2122/97
ccgagcuucagcgcgcugc

SEQ ID NO: 1053037 - RNA, 12 nt, Mycobacterium bovis subsp bovis AF2122/97
ccgaggaucgcg

SEQ ID NO: 1053038 - RNA, 14 nt, Mycobacterium bovis subsp bovis AF2122/97
ccgaggaccagagg

SEQ ID NO: 1053039 - RNA, 18 nt, Mycobacterium bovis subsp bovis AF2122/97
ccgaggaccucgucaccg

SEQ ID NO: 1053040 - RNA, 21 nt, Mycobacterium bovis subsp bovis AF2122/97
ccgaggacuggaaagcagcag

SEQ ID NO: 1053041 - RNA, 23 nt, Mycobacterium bovis subsp bovis AF2122/97
ccgaggacuggaaagcagcagcg

SEQ ID NO: 1053042 - RNA, 21 nt, Mycobacterium bovis subsp bovis AF2122/97
ccgaggugcuuggggucaccc

SEQ ID NO: 1053043 - RNA, 17 nt, Mycobacterium bovis subsp bovis AF2122/97
ccgaggucgguucggcc

SEQ ID NO: 1053044 - RNA, 17 nt, Mycobacterium bovis subsp bovis AF2122/97
ccgaggugccgcgcagc

SEQ ID NO: 1053045 - RNA, 19 nt, Mycobacterium bovis subsp bovis AF2122/97
ccgaggugccgcgcagcug

SEQ ID NO: 1053046 - RNA, 22 nt, Mycobacterium bovis subsp bovis AF2122/97
ccgaggugccgcgcagcugccg

SEQ ID NO: 1053047 - RNA, 17 nt, Mycobacterium bovis subsp bovis AF2122/97
ccgaggucggccagcag

SEQ ID NO: 1053048 - RNA, 12 nt, Mycobacterium bovis subsp bovis AF2122/97
ccgagucgauca

SEQ ID NO: 1053049 - RNA, 14 nt, Mycobacterium bovis subsp bovis AF2122/97
ccgagucgaucacg

SEQ ID NO: 1053050 - RNA, 19 nt, Mycobacterium bovis subsp bovis AF2122/97
ccgagucgaucacguggug

SEQ ID NO: 1053051 - RNA, 16 nt, Mycobacterium bovis subsp bovis AF2122/97
ccgagucgacggccag

SEQ ID NO: 1053052 - RNA, 18 nt, Mycobacterium bovis subsp bovis AF2122/97
ccgagucgaaaccgcccg

SEQ ID NO: 1053053 - RNA, 21 nt, Mycobacterium bovis subsp bovis AF2122/97
ccgaguaccgauagccugcgg

SEQ ID NO: 1053054 - RNA, 21 nt, Mycobacterium bovis subsp bovis AF2122/97
ccgaguaccggccagccgcgg

SEQ ID NO: 1053055 - RNA, 20 nt, Mycobacterium bovis subsp bovis AF2122/97
ccgagguucaaagcagcgca

SEQ ID NO: 1053056 - RNA, 22 nt, Mycobacterium bovis subsp bovis AF2122/97
ccgagguuguuggagaugucga

SEQ ID NO: 1053057 - RNA, 22 nt, Mycobacterium bovis subsp bovis AF2122/97
ccgagugcccagcgaugcgcuc

SEQ ID NO: 1053058 - RNA, 15 nt, Mycobacterium bovis subsp bovis AF2122/97
ccgagucugcgagca

SEQ ID NO: 1053059 - RNA, 16 nt, Mycobacterium bovis subsp bovis AF2122/97
ccgagucugcgagcag

SEQ ID NO: 1053060 - RNA, 14 nt, Mycobacterium bovis subsp bovis AF2122/97
ccgagucggcaaac

SEQ ID NO: 1053061 - RNA, 17 nt, Mycobacterium bovis subsp bovis AF2122/97
ccgagugugaaucgcac

SEQ ID NO: 1053062 - RNA, 19 nt, Mycobacterium bovis subsp bovis AF2122/97
ccgagugugaaucgcacga

SEQ ID NO: 1053063 - RNA, 22 nt, Mycobacterium bovis subsp bovis AF2122/97
ccgaguggccggugggccgccc

SEQ ID NO: 1053064 - RNA, 22 nt, Mycobacterium bovis subsp bovis AF2122/97
ccgaguuaaacgcagcggugag

SEQ ID NO: 1053065 - RNA, 16 nt, Mycobacterium bovis subsp bovis AF2122/97
ccgaguuaccggugac

SEQ ID NO: 1053066 - RNA, 18 nt, Mycobacterium bovis subsp bovis AF2122/97
ccgaguuauagaagccga

SEQ ID NO: 1053067 - RNA, 22 nt, Mycobacterium bovis subsp bovis AF2122/97
ccgaguugaacaauccgguguu

SEQ ID NO: 1053068 - RNA, 23 nt, Mycobacterium bovis subsp bovis AF2122/97
ccgaguuugguguagacgugcgu

SEQ ID NO: 1053069 - RNA, 13 nt, Mycobacterium bovis subsp bovis AF2122/97
ccgaguugucgcc

SEQ ID NO: 1053070 - RNA, 17 nt, Mycobacterium bovis subsp bovis AF2122/97
ccgaguuguugcugccc

SEQ ID NO: 1053071 - RNA, 17 nt, Mycobacterium bovis subsp bovis AF2122/97
ccgaguuugcgauaccc

SEQ ID NO: 1053072 - RNA, 20 nt, Mycobacterium bovis subsp bovis AF2122/97
ccgaguugcccgggucggcc

SEQ ID NO: 1053073 - RNA, 20 nt, Mycobacterium bovis subsp bovis AF2122/97
ccgaguugaccgccgugggu

SEQ ID NO: 1053074 - RNA, 18 nt, Mycobacterium bovis subsp bovis AF2122/97
ccgauaaaggucacuccu

SEQ ID NO: 1053075 - RNA, 20 nt, Mycobacterium bovis subsp bovis AF2122/97
ccgauaaaugccgcgugggc

SEQ ID NO: 1053076 - RNA, 14 nt, Mycobacterium bovis subsp bovis AF2122/97
ccgauaaauggccg

SEQ ID NO: 1053077 - RNA, 18 nt, Mycobacterium bovis subsp bovis AF2122/97
ccgauaacaaggccgccg

SEQ ID NO: 1053078 - RNA, 20 nt, Mycobacterium bovis subsp bovis AF2122/97
cgcacucguugccgaccaug

SEQ ID NO: 1053079 - RNA, 20 nt, Mycobacterium bovis subsp bovis AF2122/97
cgcacucgcgucccgaaccg

SEQ ID NO: 1053080 - RNA, 22 nt, Mycobacterium bovis subsp bovis AF2122/97
cgcacucuagccggguguuggg

SEQ ID NO: 1053081 - RNA, 23 nt, Mycobacterium bovis subsp bovis AF2122/97
cgcacucccgagccacaaaggcg

SEQ ID NO: 1053082 - RNA, 22 nt, Mycobacterium bovis subsp bovis AF2122/97
cgcacuacucgaacaaccccgg

SEQ ID NO: 1053083 - RNA, 22 nt, Mycobacterium bovis subsp bovis AF2122/97
cgcacugguugggcgagaccgc

SEQ ID NO: 1053084 - RNA, 13 nt, Mycobacterium bovis subsp bovis AF2122/97
cgcacugccccgc

SEQ ID NO: 1053085 - RNA, 13 nt, Mycobacterium bovis subsp bovis AF2122/97
cgcacugcccggg

SEQ ID NO: 1053086 - RNA, 12 nt, Mycobacterium bovis subsp bovis AF2122/97
cgcacugccgcc

SEQ ID NO: 1053087 - RNA, 13 nt, Mycobacterium bovis subsp bovis AF2122/97
cgcacugccgggu

SEQ ID NO: 1053088 - RNA, 15 nt, Mycobacterium bovis subsp bovis AF2122/97
cgcacuggggaggcc

SEQ ID NO: 1053089 - RNA, 20 nt, Mycobacterium bovis subsp bovis AF2122/97
cgcacuggggaggccaaccc

SEQ ID NO: 1053090 - RNA, 18 nt, Mycobacterium bovis subsp bovis AF2122/97
cgcacugcgccggccggc

SEQ ID NO: 1053091 - RNA, 21 nt, Mycobacterium bovis subsp bovis AF2122/97
cgcacugcgccggccggcgca

SEQ ID NO: 1053092 - RNA, 14 nt, Mycobacterium bovis subsp bovis AF2122/97
cgcacguuggcggc

SEQ ID NO: 1053093 - RNA, 20 nt, Mycobacterium bovis subsp bovis AF2122/97
cgcacguuggcggccagcgc

SEQ ID NO: 1053094 - RNA, 14 nt, Mycobacterium bovis subsp bovis AF2122/97
cgcacguucggcga

SEQ ID NO: 1053095 - RNA, 19 nt, Mycobacterium bovis subsp bovis AF2122/97
cgcacguucggcgaugauc

SEQ ID NO: 1053096 - RNA, 15 nt, Mycobacterium bovis subsp bovis AF2122/97
cgcacgucgggcccg

SEQ ID NO: 1053097 - RNA, 18 nt, Mycobacterium bovis subsp bovis AF2122/97
cgcacgucgggcccgaug

SEQ ID NO: 1053098 - RNA, 23 nt, Mycobacterium bovis subsp bovis AF2122/97
cgcacguaucgugggugccggcu

SEQ ID NO: 1053099 - RNA, 18 nt, Mycobacterium bovis subsp bovis AF2122/97
cgcacguauccacggucg

SEQ ID NO: 1053100 - RNA, 22 nt, Mycobacterium bovis subsp bovis AF2122/97
cgcacggugaccacgccguggc

SEQ ID NO: 1053101 - RNA, 23 nt, Mycobacterium bovis subsp bovis AF2122/97
cgcacguauccacggucgaccag

SEQ ID NO: 1053102 - RNA, 14 nt, Mycobacterium bovis subsp bovis AF2122/97
cgcacggugccgcc

SEQ ID NO: 1053103 - RNA, 15 nt, Mycobacterium bovis subsp bovis AF2122/97
cgcacggugccgccg

SEQ ID NO: 1053104 - RNA, 16 nt, Mycobacterium bovis subsp bovis AF2122/97
cgcacggugccgccgu

SEQ ID NO: 1053105 - RNA, 18 nt, Mycobacterium bovis subsp bovis AF2122/97
cgcacggugccgccgucg

SEQ ID NO: 1053106 - RNA, 19 nt, Mycobacterium bovis subsp bovis AF2122/97
cgcacggugccgccgucga

SEQ ID NO: 1053107 - RNA, 22 nt, Mycobacterium bovis subsp bovis AF2122/97
cgcacguagaaguaggcggcga

SEQ ID NO: 1053108 - RNA, 12 nt, Mycobacterium bovis subsp bovis AF2122/97
cgcacgguggcu

SEQ ID NO: 1053109 - RNA, 22 nt, Mycobacterium bovis subsp bovis AF2122/97
cgcacgguucuuggcgucuugg

SEQ ID NO: 1053110 - RNA, 16 nt, Mycobacterium bovis subsp bovis AF2122/97
cgcacgggccaccagc

SEQ ID NO: 1053111 - RNA, 23 nt, Mycobacterium bovis subsp bovis AF2122/97
cgcacgguccacgguggcgccga

SEQ ID NO: 1053112 - RNA, 15 nt, Mycobacterium bovis subsp bovis AF2122/97
cgcacggugcugauc

SEQ ID NO: 1053113 - RNA, 21 nt, Mycobacterium bovis subsp bovis AF2122/97
cgcacggugaccacgccgugg

SEQ ID NO: 1053114 - RNA, 17 nt, Mycobacterium bovis subsp bovis AF2122/97
cgcacgccgcgugccgc

SEQ ID NO: 1053115 - RNA, 18 nt, Mycobacterium bovis subsp bovis AF2122/97
cgcacgccggcaugccag

SEQ ID NO: 1053116 - RNA, 19 nt, Mycobacterium bovis subsp bovis AF2122/97
cgcacgccgaccggcccgc

SEQ ID NO: 1053117 - RNA, 16 nt, Mycobacterium bovis subsp bovis AF2122/97
cgcacgccggccagcg

SEQ ID NO: 1053118 - RNA, 18 nt, Mycobacterium bovis subsp bovis AF2122/97
cgcacgcgcgcaggccgc

SEQ ID NO: 1053119 - RNA, 19 nt, Mycobacterium bovis subsp bovis AF2122/97
cgcacgcgcgcaggccgcc

SEQ ID NO: 1053120 - RNA, 20 nt, Mycobacterium bovis subsp bovis AF2122/97
cgcacgcgcgcaggccgccg

SEQ ID NO: 1053121 - RNA, 14 nt, Mycobacterium bovis subsp bovis AF2122/97
cgcacgcgggaggu

SEQ ID NO: 1053122 - RNA, 22 nt, Mycobacterium bovis subsp bovis AF2122/97
cgcacgcgguucaccacgucgu

SEQ ID NO: 1053123 - RNA, 21 nt, Mycobacterium bovis subsp bovis AF2122/97
cgcacgcggaaaggcuuccgc

SEQ ID NO: 1053124 - RNA, 13 nt, Mycobacterium bovis subsp bovis AF2122/97
cgcacgccaccgg

SEQ ID NO: 1053125 - RNA, 20 nt, Mycobacterium bovis subsp bovis AF2122/97
cgcacgcccugaagggccgc

SEQ ID NO: 1053126 - RNA, 15 nt, Mycobacterium bovis subsp bovis AF2122/97
cgcacgccgaccagc

SEQ ID NO: 1053127 - RNA, 14 nt, Mycobacterium bovis subsp bovis AF2122/97
cgcacgccgaccgg

SEQ ID NO: 1053128 - RNA, 14 nt, Mycobacterium bovis subsp bovis AF2122/97
cgcacgcaguucgg

SEQ ID NO: 1053129 - RNA, 17 nt, Mycobacterium bovis subsp bovis AF2122/97
cgcacgauggccgucga

SEQ ID NO: 1053130 - RNA, 18 nt, Mycobacterium bovis subsp bovis AF2122/97
cgcacgcaaugcgggccc

SEQ ID NO: 1053131 - RNA, 15 nt, Mycobacterium bovis subsp bovis AF2122/97
cgcacggcgacgcca

SEQ ID NO: 1053132 - RNA, 12 nt, Mycobacterium bovis subsp bovis AF2122/97
cgcacggcgccg

SEQ ID NO: 1053133 - RNA, 15 nt, Mycobacterium bovis subsp bovis AF2122/97
cgcacggcgccgacc

SEQ ID NO: 1053134 - RNA, 16 nt, Mycobacterium bovis subsp bovis AF2122/97
cgcacggcgccgaccc

SEQ ID NO: 1053135 - RNA, 17 nt, Mycobacterium bovis subsp bovis AF2122/97
cgcacggcgccgacccg

SEQ ID NO: 1053136 - RNA, 13 nt, Mycobacterium bovis subsp bovis AF2122/97
cgcacggcgucgg

SEQ ID NO: 1053137 - RNA, 14 nt, Mycobacterium bovis subsp bovis AF2122/97
cgcacggcgucggc

SEQ ID NO: 1053138 - RNA, 19 nt, Mycobacterium bovis subsp bovis AF2122/97
cgcacggcgucggccaccg

SEQ ID NO: 1053139 - RNA, 21 nt, Mycobacterium bovis subsp bovis AF2122/97
cgcacggcgucggccaccgcc

SEQ ID NO: 1053140 - RNA, 14 nt, Mycobacterium bovis subsp bovis AF2122/97
cgcacggcuggcgu

SEQ ID NO: 1053141 - RNA, 15 nt, Mycobacterium bovis subsp bovis AF2122/97
cgcacgcuggcgggc

SEQ ID NO: 1053142 - RNA, 19 nt, Mycobacterium bovis subsp bovis AF2122/97
cgcacggaggcggaccagg

SEQ ID NO: 1053143 - RNA, 18 nt, Mycobacterium bovis subsp bovis AF2122/97
cgcacggcagacacgcug

SEQ ID NO: 1053144 - RNA, 21 nt, Mycobacterium bovis subsp bovis AF2122/97
cgcacggcagacacgcugcag

SEQ ID NO: 1053145 - RNA, 20 nt, Mycobacterium bovis subsp bovis AF2122/97
cgcacggaugaugccggugu

SEQ ID NO: 1053146 - RNA, 22 nt, Mycobacterium bovis subsp bovis AF2122/97
cgcacggauucaucacgggacg

SEQ ID NO: 1053147 - RNA, 21 nt, Mycobacterium bovis subsp bovis AF2122/97
cgcacggaaggcccggcgcgg

SEQ ID NO: 1053148 - RNA, 23 nt, Mycobacterium bovis subsp bovis AF2122/97
cgcacggaaggcccggcgcggcc

SEQ ID NO: 1053149 - RNA, 14 nt, Mycobacterium bovis subsp bovis AF2122/97
cgcacggaccaucg

SEQ ID NO: 1053150 - RNA, 19 nt, Mycobacterium bovis subsp bovis AF2122/97
cgcacgcucggcgugucgg

SEQ ID NO: 1053151 - RNA, 14 nt, Mycobacterium bovis subsp bovis AF2122/97
cgcacgcucaguuu

SEQ ID NO: 1053152 - RNA, 21 nt, Mycobacterium bovis subsp bovis AF2122/97
cgcacgcucaguuuggccugg

SEQ ID NO: 1053153 - RNA, 14 nt, Mycobacterium bovis subsp bovis AF2122/97
cgcacgcucggcac

SEQ ID NO: 1053154 - RNA, 14 nt, Mycobacterium bovis subsp bovis AF2122/97
cgcacgcucggcgu

SEQ ID NO: 1053155 - RNA, 14 nt, Mycobacterium bovis subsp bovis AF2122/97
cgcaagcagcgcga

SEQ ID NO: 1053156 - RNA, 15 nt, Mycobacterium bovis subsp bovis AF2122/97
cgcaagagccguccg

SEQ ID NO: 1053157 - RNA, 15 nt, Mycobacterium bovis subsp bovis AF2122/97
cgcaacggccagcgc

SEQ ID NO: 1053158 - RNA, 17 nt, Mycobacterium bovis subsp bovis AF2122/97
cgcaagccgcgagucgc

SEQ ID NO: 1053159 - RNA, 17 nt, Mycobacterium bovis subsp bovis AF2122/97
cgcaagccucgugguga

SEQ ID NO: 1053160 - RNA, 22 nt, Mycobacterium bovis subsp bovis AF2122/97
cgcaagccucguggugagauca

SEQ ID NO: 1053161 - RNA, 16 nt, Mycobacterium bovis subsp bovis AF2122/97
cgcaacgggacgucac

SEQ ID NO: 1053162 - RNA, 24 nt, Mycobacterium bovis subsp bovis AF2122/97
cgcaagcgcggcgaagccgggugc

SEQ ID NO: 1053163 - RNA, 21 nt, Mycobacterium bovis subsp bovis AF2122/97
cgcaagcggacccgaccgucg

SEQ ID NO: 1053164 - RNA, 14 nt, Mycobacterium bovis subsp bovis AF2122/97
cgcaaggaugucgg

SEQ ID NO: 1053165 - RNA, 15 nt, Mycobacterium bovis subsp bovis AF2122/97
cgcaccgcgccgugg

SEQ ID NO: 1053166 - RNA, 20 nt, Mycobacterium bovis subsp bovis AF2122/97
cgcaaggaccugugcggccg

SEQ ID NO: 1053167 - RNA, 18 nt, Mycobacterium bovis subsp bovis AF2122/97
cgcaccggagucgcccgg

SEQ ID NO: 1053168 - RNA, 21 nt, Mycobacterium bovis subsp bovis AF2122/97
cgcaccggagucggcgucgaa

SEQ ID NO: 1053169 - RNA, 18 nt, Mycobacterium bovis subsp bovis AF2122/97
cgcaccggcgucggcgcg

SEQ ID NO: 1053170 - RNA, 19 nt, Mycobacterium bovis subsp bovis AF2122/97
cgcaccggcgucggcgcgg

SEQ ID NO: 1053171 - RNA, 15 nt, Mycobacterium bovis subsp bovis AF2122/97
cgcaccggcgucggc

SEQ ID NO: 1053172 - RNA, 17 nt, Mycobacterium bovis subsp bovis AF2122/97
cgcaccggcgucggcgc

SEQ ID NO: 1053173 - RNA, 19 nt, Mycobacterium bovis subsp bovis AF2122/97
cgcaccggggugugcgggc

SEQ ID NO: 1053174 - RNA, 19 nt, Mycobacterium bovis subsp bovis AF2122/97
cgcaccggguugagccgcc

SEQ ID NO: 1053175 - RNA, 21 nt, Mycobacterium bovis subsp bovis AF2122/97
cgcaccgguauguucggcaau

SEQ ID NO: 1053176 - RNA, 17 nt, Mycobacterium bovis subsp bovis AF2122/97
cgcaccggugcucgucg

SEQ ID NO: 1053177 - RNA, 18 nt, Mycobacterium bovis subsp bovis AF2122/97
cgcaccgcgguacgccgg

SEQ ID NO: 1053178 - RNA, 13 nt, Mycobacterium bovis subsp bovis AF2122/97
cgcaccgcggugg

SEQ ID NO: 1053179 - RNA, 21 nt, Mycobacterium bovis subsp bovis AF2122/97
cgcaccgcgguggggucgacg

SEQ ID NO: 1053180 - RNA, 19 nt, Mycobacterium bovis subsp bovis AF2122/97
cgcaccgcgggaucggugg

SEQ ID NO: 1053181 - RNA, 20 nt, Mycobacterium bovis subsp bovis AF2122/97
cgcaccgcugaccccggcag

SEQ ID NO: 1053182 - RNA, 20 nt, Mycobacterium bovis subsp bovis AF2122/97
cgcaccgcugaccgcaacgc

SEQ ID NO: 1053183 - RNA, 21 nt, Mycobacterium bovis subsp bovis AF2122/97
cgcaccgcguugaugaccgcc

SEQ ID NO: 1053184 - RNA, 14 nt, Mycobacterium bovis subsp bovis AF2122/97
cgcaccgcguucug

SEQ ID NO: 1053185 - RNA, 15 nt, Mycobacterium bovis subsp bovis AF2122/97
cgcacgaagccggcu

SEQ ID NO: 1053186 - RNA, 19 nt, Mycobacterium bovis subsp bovis AF2122/97
cgcacgaagccggcuucgg

SEQ ID NO: 1053187 - RNA, 14 nt, Mycobacterium bovis subsp bovis AF2122/97
cgcacgaccagcug

SEQ ID NO: 1053188 - RNA, 20 nt, Mycobacterium bovis subsp bovis AF2122/97
cgcacgacugugcgccgcag

SEQ ID NO: 1053189 - RNA, 22 nt, Mycobacterium bovis subsp bovis AF2122/97
cgcacgacugugcgccgcagcc

SEQ ID NO: 1053190 - RNA, 19 nt, Mycobacterium bovis subsp bovis AF2122/97
cgcacgacugugcgccgca

SEQ ID NO: 1053191 - RNA, 18 nt, Mycobacterium bovis subsp bovis AF2122/97
cgcacgauccgcacccgg

SEQ ID NO: 1053192 - RNA, 19 nt, Mycobacterium bovis subsp bovis AF2122/97
cgcacgauagccaccgacg

SEQ ID NO: 1053193 - RNA, 17 nt, Mycobacterium bovis subsp bovis AF2122/97
cgcacgaucgcccguga

SEQ ID NO: 1053194 - RNA, 15 nt, Mycobacterium bovis subsp bovis AF2122/97
cgcacgaaccggucg

SEQ ID NO: 1053195 - RNA, 20 nt, Mycobacterium bovis subsp bovis AF2122/97
cgcacgaaaccgcagcgcga

SEQ ID NO: 1053196 - RNA, 13 nt, Mycobacterium bovis subsp bovis AF2122/97
cgcaccugggcgg

SEQ ID NO: 1053197 - RNA, 22 nt, Mycobacterium bovis subsp bovis AF2122/97
cgcaccugggcugccggccaga

SEQ ID NO: 1053198 - RNA, 17 nt, Mycobacterium bovis subsp bovis AF2122/97
cgcaccugggucgacga

SEQ ID NO: 1053199 - RNA, 21 nt, Mycobacterium bovis subsp bovis AF2122/97
cgcaccucggcgaagucacgc

SEQ ID NO: 1053200 - RNA, 18 nt, Mycobacterium bovis subsp bovis AF2122/97
cgcaccugaaggcggcga

SEQ ID NO: 1053201 - RNA, 16 nt, Mycobacterium bovis subsp bovis AF2122/97
cgcaccugaucgguca

SEQ ID NO: 1053202 - RNA, 13 nt, Mycobacterium bovis subsp bovis AF2122/97
cgcaccucggugg

SEQ ID NO: 1053203 - RNA, 13 nt, Mycobacterium bovis subsp bovis AF2122/97
cgcaccuggcgcg

SEQ ID NO: 1053204 - RNA, 14 nt, Mycobacterium bovis subsp bovis AF2122/97
cgcaccugcgcgcg

SEQ ID NO: 1053205 - RNA, 16 nt, Mycobacterium bovis subsp bovis AF2122/97
cgcaccugcgaugaug

SEQ ID NO: 1053206 - RNA, 13 nt, Mycobacterium bovis subsp bovis AF2122/97
cgcaccggccgcu

SEQ ID NO: 1053207 - RNA, 18 nt, Mycobacterium bovis subsp bovis AF2122/97
cgcaccgugccgacgccc

SEQ ID NO: 1053208 - RNA, 13 nt, Mycobacterium bovis subsp bovis AF2122/97
cgcaccuaugguc

SEQ ID NO: 1053209 - RNA, 22 nt, Mycobacterium bovis subsp bovis AF2122/97
cgcaccuccugcgagugcggca

SEQ ID NO: 1053210 - RNA, 18 nt, Mycobacterium bovis subsp bovis AF2122/97
cgcaccgugucuacgccg

SEQ ID NO: 1053211 - RNA, 13 nt, Mycobacterium bovis subsp bovis AF2122/97
cgcaccguguggg

SEQ ID NO: 1053212 - RNA, 20 nt, Mycobacterium bovis subsp bovis AF2122/97
cgcaccgugugggccccgcc

SEQ ID NO: 1053213 - RNA, 22 nt, Mycobacterium bovis subsp bovis AF2122/97
cgcaccgugugggccccgccga

SEQ ID NO: 1053214 - RNA, 13 nt, Mycobacterium bovis subsp bovis AF2122/97
cgcaccgucgcgg

SEQ ID NO: 1053215 - RNA, 20 nt, Mycobacterium bovis subsp bovis AF2122/97
cgcagccgggccaaccgguc

SEQ ID NO: 1053216 - RNA, 13 nt, Mycobacterium bovis subsp bovis AF2122/97
cgcagccggucag

SEQ ID NO: 1053217 - RNA, 15 nt, Mycobacterium bovis subsp bovis AF2122/97
cgcagccggucaggu

SEQ ID NO: 1053218 - RNA, 21 nt, Mycobacterium bovis subsp bovis AF2122/97
cgcagccugcagcgaaacacc

SEQ ID NO: 1053219 - RNA, 17 nt, Mycobacterium bovis subsp bovis AF2122/97
cgcagccugccgaugac

SEQ ID NO: 1053220 - RNA, 18 nt, Mycobacterium bovis subsp bovis AF2122/97
cgcagccugccgaugacg

SEQ ID NO: 1053221 - RNA, 18 nt, Mycobacterium bovis subsp bovis AF2122/97
cgcagcgacgcgauuucg

SEQ ID NO: 1053222 - RNA, 14 nt, Mycobacterium bovis subsp bovis AF2122/97
cgcagcgaccaccg

SEQ ID NO: 1053223 - RNA, 21 nt, Mycobacterium bovis subsp bovis AF2122/97
cgcagccuggucgcgcagcuc

SEQ ID NO: 1053224 - RNA, 22 nt, Mycobacterium bovis subsp bovis AF2122/97
cgcagcgaaaacccggucggcg

SEQ ID NO: 1053225 - RNA, 17 nt, Mycobacterium bovis subsp bovis AF2122/97
cgcagcgauucgccuag

SEQ ID NO: 1053226 - RNA, 23 nt, Mycobacterium bovis subsp bovis AF2122/97
cgcagcgcaaacaucuugucgau

SEQ ID NO: 1053227 - RNA, 22 nt, Mycobacterium bovis subsp bovis AF2122/97
cgcagcgacgggaaagccaccu

SEQ ID NO: 1053228 - RNA, 18 nt, Mycobacterium bovis subsp bovis AF2122/97
cgcagcauguggccgccg

SEQ ID NO: 1053229 - RNA, 22 nt, Mycobacterium bovis subsp bovis AF2122/97
cgcagccaggugucgucgaucg

SEQ ID NO: 1053230 - RNA, 23 nt, Mycobacterium bovis subsp bovis AF2122/97
cgcagccaggugucgucgaucgc

SEQ ID NO: 1053231 - RNA, 14 nt, Mycobacterium bovis subsp bovis AF2122/97
cgcagccagcggua

SEQ ID NO: 1053232 - RNA, 14 nt, Mycobacterium bovis subsp bovis AF2122/97
cgcagccagcaagu

SEQ ID NO: 1053233 - RNA, 13 nt, Mycobacterium bovis subsp bovis AF2122/97
cgcagccacgucu

SEQ ID NO: 1053234 - RNA, 15 nt, Mycobacterium bovis subsp bovis AF2122/97
cgcagccacgucucg

SEQ ID NO: 1053235 - RNA, 21 nt, Mycobacterium bovis subsp bovis AF2122/97
cgcagccacguuacgcucgcg

SEQ ID NO: 1053236 - RNA, 22 nt, Mycobacterium bovis subsp bovis AF2122/97
cgcagccacguuacgcucgcgg

SEQ ID NO: 1053237 - RNA, 13 nt, Mycobacterium bovis subsp bovis AF2122/97
cgcagccagcgcc

SEQ ID NO: 1053238 - RNA, 16 nt, Mycobacterium bovis subsp bovis AF2122/97
cgcagcacucgcccaa

SEQ ID NO: 1053239 - RNA, 18 nt, Mycobacterium bovis subsp bovis AF2122/97
cgcagcagacuccguugc

SEQ ID NO: 1053240 - RNA, 16 nt, Mycobacterium bovis subsp bovis AF2122/97
cgcagcacggcggcca

SEQ ID NO: 1053241 - RNA, 17 nt, Mycobacterium bovis subsp bovis AF2122/97
cgcagcacggcggccac

SEQ ID NO: 1053242 - RNA, 13 nt, Mycobacterium bovis subsp bovis AF2122/97
cgcagcacugcgg

SEQ ID NO: 1053243 - RNA, 21 nt, Mycobacterium bovis subsp bovis AF2122/97
cgcagcagcaucggcacgucg

SEQ ID NO: 1053244 - RNA, 19 nt, Mycobacterium bovis subsp bovis AF2122/97
cgcagcaccucgucgaucg

SEQ ID NO: 1053245 - RNA, 21 nt, Mycobacterium bovis subsp bovis AF2122/97
cgcagcaccucgucgaucgcc

SEQ ID NO: 1053246 - RNA, 15 nt, Mycobacterium bovis subsp bovis AF2122/97
cgcagcaccucgucg

SEQ ID NO: 1053247 - RNA, 16 nt, Mycobacterium bovis subsp bovis AF2122/97
cgcagcaccucgucga

SEQ ID NO: 1053248 - RNA, 19 nt, Mycobacterium bovis subsp bovis AF2122/97
cgcagcaccgucgggccca

SEQ ID NO: 1053249 - RNA, 18 nt, Mycobacterium bovis subsp bovis AF2122/97
cgcagcaccguucgcagc

SEQ ID NO: 1053250 - RNA, 17 nt, Mycobacterium bovis subsp bovis AF2122/97
cgcagcacccugcgggc

SEQ ID NO: 1053251 - RNA, 21 nt, Mycobacterium bovis subsp bovis AF2122/97
cgcagcaccacauccaucucc

SEQ ID NO: 1053252 - RNA, 18 nt, Mycobacterium bovis subsp bovis AF2122/97
cgcagaacaccaccgcca

SEQ ID NO: 1053253 - RNA, 19 nt, Mycobacterium bovis subsp bovis AF2122/97
cgcagaacaccaccgccag

SEQ ID NO: 1053254 - RNA, 17 nt, Mycobacterium bovis subsp bovis AF2122/97
cgcagaacggaccucgg

SEQ ID NO: 1053255 - RNA, 19 nt, Mycobacterium bovis subsp bovis AF2122/97
cgcagcaccaggguggccc

SEQ ID NO: 1053256 - RNA, 13 nt, Mycobacterium bovis subsp bovis AF2122/97
cgcagaagccccc

SEQ ID NO: 1053257 - RNA, 19 nt, Mycobacterium bovis subsp bovis AF2122/97
cgcagcacauccugcagcu

SEQ ID NO: 1053258 - RNA, 22 nt, Mycobacterium bovis subsp bovis AF2122/97
cgcacuugaucgacggccaucg

SEQ ID NO: 1053259 - RNA, 23 nt, Mycobacterium bovis subsp bovis AF2122/97
cgcagaaauguauugcggugagu

SEQ ID NO: 1053260 - RNA, 14 nt, Mycobacterium bovis subsp bovis AF2122/97
cgcagaacaccacc

SEQ ID NO: 1053261 - RNA, 15 nt, Mycobacterium bovis subsp bovis AF2122/97
cgcagaacaccaccg

SEQ ID NO: 1053262 - RNA, 17 nt, Mycobacterium bovis subsp bovis AF2122/97
cgcagaacaccaccgcc

SEQ ID NO: 1053263 - RNA, 16 nt, Mycobacterium bovis subsp bovis AF2122/97
cgcagaaacgccgagc

SEQ ID NO: 1053264 - RNA, 21 nt, Mycobacterium bovis subsp bovis AF2122/97
cgcaggccccggugccgaccg

SEQ ID NO: 1053265 - RNA, 13 nt, Mycobacterium bovis subsp bovis AF2122/97
cgcaggccagggu

SEQ ID NO: 1053266 - RNA, 15 nt, Mycobacterium bovis subsp bovis AF2122/97
cgcaggccgccgcca

SEQ ID NO: 1053267 - RNA, 15 nt, Mycobacterium bovis subsp bovis AF2122/97
cgcaggccggcggcg

SEQ ID NO: 1053268 - RNA, 20 nt, Mycobacterium bovis subsp bovis AF2122/97
cgcaggcgugcuugaccgcc

SEQ ID NO: 1053269 - RNA, 16 nt, Mycobacterium bovis subsp bovis AF2122/97
cgcaggugcugggcga

SEQ ID NO: 1053270 - RNA, 16 nt, Mycobacterium bovis subsp bovis AF2122/97
cgcaggucgcuggccg

SEQ ID NO: 1053271 - RNA, 13 nt, Mycobacterium bovis subsp bovis AF2122/97
cgcaggucgcgca

SEQ ID NO: 1053272 - RNA, 16 nt, Mycobacterium bovis subsp bovis AF2122/97
cgcagggccgccgcga

SEQ ID NO: 1053273 - RNA, 18 nt, Mycobacterium bovis subsp bovis AF2122/97
cgcagggccgcgcgcacu

SEQ ID NO: 1053274 - RNA, 22 nt, Mycobacterium bovis subsp bovis AF2122/97
cgcaggcuugccgauggcggug

SEQ ID NO: 1053275 - RNA, 20 nt, Mycobacterium bovis subsp bovis AF2122/97
cgcagggaucgcagggauca

SEQ ID NO: 1053276 - RNA, 24 nt, Mycobacterium bovis subsp bovis AF2122/97
cgcagggcaucggucucgcaccag

SEQ ID NO: 1053277 - RNA, 22 nt, Mycobacterium bovis subsp bovis AF2122/97
cgcagcgcgaaggucagcgacu

SEQ ID NO: 1053278 - RNA, 18 nt, Mycobacterium bovis subsp bovis AF2122/97
cgcagcgccugcggcagc

SEQ ID NO: 1053279 - RNA, 22 nt, Mycobacterium bovis subsp bovis AF2122/97
cgcagcgccuccucgaucuccg

SEQ ID NO: 1053280 - RNA, 15 nt, Mycobacterium bovis subsp bovis AF2122/97
cgcagcgccgccacc

SEQ ID NO: 1053281 - RNA, 22 nt, Mycobacterium bovis subsp bovis AF2122/97
cgcagcgccgccaccccgcgcg

SEQ ID NO: 1053282 - RNA, 15 nt, Mycobacterium bovis subsp bovis AF2122/97
cgcagcgccacccga

SEQ ID NO: 1053283 - RNA, 13 nt, Mycobacterium bovis subsp bovis AF2122/97
cgcagcgccaucg

SEQ ID NO: 1053284 - RNA, 20 nt, Mycobacterium bovis subsp bovis AF2122/97
cgcagcgccauuccaagacg

SEQ ID NO: 1053285 - RNA, 15 nt, Mycobacterium bovis subsp bovis AF2122/97
cgcagcgccagcggg

SEQ ID NO: 1053286 - RNA, 22 nt, Mycobacterium bovis subsp bovis AF2122/97
cgcaggaccugcgucaucgcgg

SEQ ID NO: 1053287 - RNA, 14 nt, Mycobacterium bovis subsp bovis AF2122/97
cgccaccgauggcg

SEQ ID NO: 1053288 - RNA, 15 nt, Mycobacterium bovis subsp bovis AF2122/97
cgccaccgcacgcac

SEQ ID NO: 1053289 - RNA, 15 nt, Mycobacterium bovis subsp bovis AF2122/97
cgccaccgccgcugc

SEQ ID NO: 1053290 - RNA, 21 nt, Mycobacterium bovis subsp bovis AF2122/97
cgccaccgccgcugccggugu

SEQ ID NO: 1053291 - RNA, 14 nt, Mycobacterium bovis subsp bovis AF2122/97
cgccaccgccggca

SEQ ID NO: 1053292 - RNA, 15 nt, Mycobacterium bovis subsp bovis AF2122/97
cgccaccgccggcag

SEQ ID NO: 1053293 - RNA, 16 nt, Mycobacterium bovis subsp bovis AF2122/97
cgccaccgccggcagc

SEQ ID NO: 1053294 - RNA, 19 nt, Mycobacterium bovis subsp bovis AF2122/97
cgccaccgcgacaccccgg

SEQ ID NO: 1053295 - RNA, 13 nt, Mycobacterium bovis subsp bovis AF2122/97
cgccaccgcgacg

SEQ ID NO: 1053296 - RNA, 21 nt, Mycobacterium bovis subsp bovis AF2122/97
cgccaccggaggugcgccgcg

SEQ ID NO: 1053297 - RNA, 22 nt, Mycobacterium bovis subsp bovis AF2122/97
cgccaccggaggugcgccgcgg

SEQ ID NO: 1053298 - RNA, 13 nt, Mycobacterium bovis subsp bovis AF2122/97
cgccaccggcaau

SEQ ID NO: 1053299 - RNA, 18 nt, Mycobacterium bovis subsp bovis AF2122/97
cgccaccgagaucggaca

SEQ ID NO: 1053300 - RNA, 20 nt, Mycobacterium bovis subsp bovis AF2122/97
cgccacccuuggcccggugc

SEQ ID NO: 1053301 - RNA, 21 nt, Mycobacterium bovis subsp bovis AF2122/97
cgccacccuuggcccggugca

SEQ ID NO: 1053302 - RNA, 16 nt, Mycobacterium bovis subsp bovis AF2122/97
cgccaccgaagccgcc

SEQ ID NO: 1053303 - RNA, 16 nt, Mycobacterium bovis subsp bovis AF2122/97
cgccacagccguauug

SEQ ID NO: 1053304 - RNA, 18 nt, Mycobacterium bovis subsp bovis AF2122/97
cgccaccgaagccgccgg

SEQ ID NO: 1053305 - RNA, 12 nt, Mycobacterium bovis subsp bovis AF2122/97
cgccacccggcg

SEQ ID NO: 1053306 - RNA, 20 nt, Mycobacterium bovis subsp bovis AF2122/97
cgccacccggcgggcggugg

SEQ ID NO: 1053307 - RNA, 16 nt, Mycobacterium bovis subsp bovis AF2122/97
cgccacccgccaacgc

SEQ ID NO: 1053308 - RNA, 14 nt, Mycobacterium bovis subsp bovis AF2122/97
cgccacccgcguca

SEQ ID NO: 1053309 - RNA, 23 nt, Mycobacterium bovis subsp bovis AF2122/97
cgccaccccgcguaugccaggac

SEQ ID NO: 1053310 - RNA, 15 nt, Mycobacterium bovis subsp bovis AF2122/97
cgccacccgcaacua

SEQ ID NO: 1053311 - RNA, 13 nt, Mycobacterium bovis subsp bovis AF2122/97
cgccaccggcgac

SEQ ID NO: 1053312 - RNA, 13 nt, Mycobacterium bovis subsp bovis AF2122/97
cgccaccgcguca

SEQ ID NO: 1053313 - RNA, 14 nt, Mycobacterium bovis subsp bovis AF2122/97
cgccaccggcaccg

SEQ ID NO: 1053314 - RNA, 12 nt, Mycobacterium bovis subsp bovis AF2122/97
cgccaccggcgc

SEQ ID NO: 1053315 - RNA, 19 nt, Mycobacterium bovis subsp bovis AF2122/97
cgccaccggcgccaccggc

SEQ ID NO: 1053316 - RNA, 16 nt, Mycobacterium bovis subsp bovis AF2122/97
cgccaccggcgccgcc

SEQ ID NO: 1053317 - RNA, 18 nt, Mycobacterium bovis subsp bovis AF2122/97
cgccaccggcgccgcccg

SEQ ID NO: 1053318 - RNA, 20 nt, Mycobacterium bovis subsp bovis AF2122/97
cgccaccggcgccgcccgcg

SEQ ID NO: 1053319 - RNA, 18 nt, Mycobacterium bovis subsp bovis AF2122/97
cgccaccggcgccgccgu

SEQ ID NO: 1053320 - RNA, 13 nt, Mycobacterium bovis subsp bovis AF2122/97
cgccaccggcgcg

SEQ ID NO: 1053321 - RNA, 21 nt, Mycobacterium bovis subsp bovis AF2122/97
cgccaccggcgcgaccgcggc

SEQ ID NO: 1053322 - RNA, 22 nt, Mycobacterium bovis subsp bovis AF2122/97
cgccaccguacgacagucgcag

SEQ ID NO: 1053323 - RNA, 19 nt, Mycobacterium bovis subsp bovis AF2122/97
cgccaccguaggucgugga

SEQ ID NO: 1053324 - RNA, 16 nt, Mycobacterium bovis subsp bovis AF2122/97
cgccaccgucaccgcc

SEQ ID NO: 1053325 - RNA, 13 nt, Mycobacterium bovis subsp bovis AF2122/97
cgccaccgggacg

SEQ ID NO: 1053326 - RNA, 20 nt, Mycobacterium bovis subsp bovis AF2122/97
cgccaccgucauggcgggug

SEQ ID NO: 1053327 - RNA, 20 nt, Mycobacterium bovis subsp bovis AF2122/97
cgccaccgcugucgauggac

SEQ ID NO: 1053328 - RNA, 13 nt, Mycobacterium bovis subsp bovis AF2122/97
cgccaccggccgc

SEQ ID NO: 1053329 - RNA, 15 nt, Mycobacterium bovis subsp bovis AF2122/97
cgccacgaugaccgg

SEQ ID NO: 1053330 - RNA, 18 nt, Mycobacterium bovis subsp bovis AF2122/97
cgccacgcccgacgccag

SEQ ID NO: 1053331 - RNA, 23 nt, Mycobacterium bovis subsp bovis AF2122/97
cgccacgcccagcgcccgcgcgg

SEQ ID NO: 1053332 - RNA, 19 nt, Mycobacterium bovis subsp bovis AF2122/97
cgccacgcccgacgccagc

SEQ ID NO: 1053333 - RNA, 13 nt, Mycobacterium bovis subsp bovis AF2122/97
cgccacgccgagg

SEQ ID NO: 1053334 - RNA, 14 nt, Mycobacterium bovis subsp bovis AF2122/97
cgccacggcgggcg

SEQ ID NO: 1053335 - RNA, 14 nt, Mycobacterium bovis subsp bovis AF2122/97
cgccacgggcggcc

SEQ ID NO: 1053336 - RNA, 15 nt, Mycobacterium bovis subsp bovis AF2122/97
cgccacgggcggcca

SEQ ID NO: 1053337 - RNA, 22 nt, Mycobacterium bovis subsp bovis AF2122/97
cgccacggugguggugggaguu

SEQ ID NO: 1053338 - RNA, 20 nt, Mycobacterium bovis subsp bovis AF2122/97
cgccacggugucgcgaugcu

SEQ ID NO: 1053339 - RNA, 22 nt, Mycobacterium bovis subsp bovis AF2122/97
cgccacgguucgggcagcaccc

SEQ ID NO: 1053340 - RNA, 23 nt, Mycobacterium bovis subsp bovis AF2122/97
cgccacguacuuggacgacccgg

SEQ ID NO: 1053341 - RNA, 14 nt, Mycobacterium bovis subsp bovis AF2122/97
cgccacuggcgccg

SEQ ID NO: 1053342 - RNA, 22 nt, Mycobacterium bovis subsp bovis AF2122/97
cgccacuggcgccggugccgcc

SEQ ID NO: 1053343 - RNA, 19 nt, Mycobacterium bovis subsp bovis AF2122/97
cgccacuggaagccaagcu

SEQ ID NO: 1053344 - RNA, 15 nt, Mycobacterium bovis subsp bovis AF2122/97
cgccacuucccccgg

SEQ ID NO: 1053345 - RNA, 16 nt, Mycobacterium bovis subsp bovis AF2122/97
cgccacuguugaagaa

SEQ ID NO: 1053346 - RNA, 21 nt, Mycobacterium bovis subsp bovis AF2122/97
cgccacuguugaagaagcccg

SEQ ID NO: 1053347 - RNA, 14 nt, Mycobacterium bovis subsp bovis AF2122/97
cgccagaaagccca

SEQ ID NO: 1053348 - RNA, 14 nt, Mycobacterium bovis subsp bovis AF2122/97
cgccagaucaccgu

SEQ ID NO: 1053349 - RNA, 15 nt, Mycobacterium bovis subsp bovis AF2122/97
cgccacuugaugccg

SEQ ID NO: 1053350 - RNA, 16 nt, Mycobacterium bovis subsp bovis AF2122/97
cgccacuugaugccgc

SEQ ID NO: 1053351 - RNA, 20 nt, Mycobacterium bovis subsp bovis AF2122/97
cgccagagucggagacccgu

SEQ ID NO: 1053352 - RNA, 16 nt, Mycobacterium bovis subsp bovis AF2122/97
cgccagcugcgcagcg

SEQ ID NO: 1053353 - RNA, 20 nt, Mycobacterium bovis subsp bovis AF2122/97
cgccagcgggcuguaggcga

SEQ ID NO: 1053354 - RNA, 20 nt, Mycobacterium bovis subsp bovis AF2122/97
cgccagcggggcuagucggg

SEQ ID NO: 1053355 - RNA, 16 nt, Mycobacterium bovis subsp bovis AF2122/97
cgccagcucggcggca

SEQ ID NO: 1053356 - RNA, 21 nt, Mycobacterium bovis subsp bovis AF2122/97
cgccagcucggcggcagcggc

SEQ ID NO: 1053357 - RNA, 14 nt, Mycobacterium bovis subsp bovis AF2122/97
cgccagcgucgaca

SEQ ID NO: 1053358 - RNA, 17 nt, Mycobacterium bovis subsp bovis AF2122/97
cgccagcgguggaccac

SEQ ID NO: 1053359 - RNA, 14 nt, Mycobacterium bovis subsp bovis AF2122/97
cgccagcggccgcu

SEQ ID NO: 1053360 - RNA, 13 nt, Mycobacterium bovis subsp bovis AF2122/97
cgccagcggcgag

SEQ ID NO: 1053361 - RNA, 18 nt, Mycobacterium bovis subsp bovis AF2122/97
cgccagcgccgccggcgc

SEQ ID NO: 1053362 - RNA, 19 nt, Mycobacterium bovis subsp bovis AF2122/97
cgccagcggccgcuccacc

SEQ ID NO: 1053363 - RNA, 14 nt, Mycobacterium bovis subsp bovis AF2122/97
cgccagcggcagcg

SEQ ID NO: 1053364 - RNA, 22 nt, Mycobacterium bovis subsp bovis AF2122/97
cgccagcggcaauggccagcac

SEQ ID NO: 1053365 - RNA, 14 nt, Mycobacterium bovis subsp bovis AF2122/97
cgccagcgccgcca

SEQ ID NO: 1053366 - RNA, 14 nt, Mycobacterium bovis subsp bovis AF2122/97
cgccagcgccgccg

SEQ ID NO: 1053367 - RNA, 16 nt, Mycobacterium bovis subsp bovis AF2122/97
cgccagcgccgccgag

SEQ ID NO: 1053368 - RNA, 18 nt, Mycobacterium bovis subsp bovis AF2122/97
cgccagcgccgccggagc

SEQ ID NO: 1053369 - RNA, 19 nt, Mycobacterium bovis subsp bovis AF2122/97
cgccagcgccagugccucg

SEQ ID NO: 1053370 - RNA, 14 nt, Mycobacterium bovis subsp bovis AF2122/97
cgccagcgccacug

SEQ ID NO: 1053371 - RNA, 18 nt, Mycobacterium bovis subsp bovis AF2122/97
cgccagcgauaucggcgg

SEQ ID NO: 1053372 - RNA, 23 nt, Mycobacterium bovis subsp bovis AF2122/97
cgccagcgauccaccaagcucgc

SEQ ID NO: 1053373 - RNA, 15 nt, Mycobacterium bovis subsp bovis AF2122/97
cgccagcgccaccgu

SEQ ID NO: 1053374 - RNA, 17 nt, Mycobacterium bovis subsp bovis AF2122/97
cgccagcccggugaugg

SEQ ID NO: 1053375 - RNA, 15 nt, Mycobacterium bovis subsp bovis AF2122/97
cgccagcccguccgg

SEQ ID NO: 1053376 - RNA, 20 nt, Mycobacterium bovis subsp bovis AF2122/97
cgccagcccagcacgcuggc

SEQ ID NO: 1053377 - RNA, 23 nt, Mycobacterium bovis subsp bovis AF2122/97
cgccagccccauugccgucgcgg

SEQ ID NO: 1053378 - RNA, 17 nt, Mycobacterium bovis subsp bovis AF2122/97
cgccagccccgcgccca

SEQ ID NO: 1053379 - RNA, 21 nt, Mycobacterium bovis subsp bovis AF2122/97
cgccagccccgcgcccacccc

SEQ ID NO: 1053380 - RNA, 18 nt, Mycobacterium bovis subsp bovis AF2122/97
cgccagcagggccagacc

SEQ ID NO: 1053381 - RNA, 22 nt, Mycobacterium bovis subsp bovis AF2122/97
cgccagaucucgcgcgcggcga

SEQ ID NO: 1053382 - RNA, 13 nt, Mycobacterium bovis subsp bovis AF2122/97
cgccagaucucgc

SEQ ID NO: 1053383 - RNA, 16 nt, Mycobacterium bovis subsp bovis AF2122/97
cgccagaucgacgcca

SEQ ID NO: 1053384 - RNA, 21 nt, Mycobacterium bovis subsp bovis AF2122/97
cgcaucgagcccggacgagug

SEQ ID NO: 1053385 - RNA, 15 nt, Mycobacterium bovis subsp bovis AF2122/97
cgcaucgcacgggcc

SEQ ID NO: 1053386 - RNA, 22 nt, Mycobacterium bovis subsp bovis AF2122/97
cgcaucgcacgggccaccagcg

SEQ ID NO: 1053387 - RNA, 23 nt, Mycobacterium bovis subsp bovis AF2122/97
cgcaucgcccaacaacgcuucgg

SEQ ID NO: 1053388 - RNA, 16 nt, Mycobacterium bovis subsp bovis AF2122/97
cgcaucgacgugcgcg

SEQ ID NO: 1053389 - RNA, 17 nt, Mycobacterium bovis subsp bovis AF2122/97
cgcaucgacgugcgcgg

SEQ ID NO: 1053390 - RNA, 11 nt, Mycobacterium bovis subsp bovis AF2122/97
cgcaucgccaa

SEQ ID NO: 1053391 - RNA, 17 nt, Mycobacterium bovis subsp bovis AF2122/97
cgcaucgccucaccacg

SEQ ID NO: 1053392 - RNA, 13 nt, Mycobacterium bovis subsp bovis AF2122/97
cgcaucgcggccg

SEQ ID NO: 1053393 - RNA, 22 nt, Mycobacterium bovis subsp bovis AF2122/97
cgcaucgccuccucgacgucgg

SEQ ID NO: 1053394 - RNA, 16 nt, Mycobacterium bovis subsp bovis AF2122/97
cgcaucgccucgaggu

SEQ ID NO: 1053395 - RNA, 16 nt, Mycobacterium bovis subsp bovis AF2122/97
cgcaucggcgaacaac

SEQ ID NO: 1053396 - RNA, 14 nt, Mycobacterium bovis subsp bovis AF2122/97
cgcaucggccagca

SEQ ID NO: 1053397 - RNA, 20 nt, Mycobacterium bovis subsp bovis AF2122/97
cgcaucggccagcagcgacu

SEQ ID NO: 1053398 - RNA, 13 nt, Mycobacterium bovis subsp bovis AF2122/97
cgcaucggccccc

SEQ ID NO: 1053399 - RNA, 20 nt, Mycobacterium bovis subsp bovis AF2122/97
cgcaucggcccccaacgcgg

SEQ ID NO: 1053400 - RNA, 16 nt, Mycobacterium bovis subsp bovis AF2122/97
cgcaguaacgucgucg

SEQ ID NO: 1053401 - RNA, 19 nt, Mycobacterium bovis subsp bovis AF2122/97
cgcaggugggcguuggcga

SEQ ID NO: 1053402 - RNA, 14 nt, Mycobacterium bovis subsp bovis AF2122/97
cgcagguggucgau

SEQ ID NO: 1053403 - RNA, 14 nt, Mycobacterium bovis subsp bovis AF2122/97
cgcagguggugaca

SEQ ID NO: 1053404 - RNA, 16 nt, Mycobacterium bovis subsp bovis AF2122/97
cgcagguuggcaagca

SEQ ID NO: 1053405 - RNA, 17 nt, Mycobacterium bovis subsp bovis AF2122/97
cgcagguuggcaagcac

SEQ ID NO: 1053406 - RNA, 23 nt, Mycobacterium bovis subsp bovis AF2122/97
cgcaucgggcauuucguggcacg

SEQ ID NO: 1053407 - RNA, 19 nt, Mycobacterium bovis subsp bovis AF2122/97
cgcaucggucccacugccg

SEQ ID NO: 1053408 - RNA, 15 nt, Mycobacterium bovis subsp bovis AF2122/97
cgcaucgguggcacg

SEQ ID NO: 1053409 - RNA, 19 nt, Mycobacterium bovis subsp bovis AF2122/97
cgcaucggcgccagaucga

SEQ ID NO: 1053410 - RNA, 17 nt, Mycobacterium bovis subsp bovis AF2122/97
cgcaucggauggccccc

SEQ ID NO: 1053411 - RNA, 14 nt, Mycobacterium bovis subsp bovis AF2122/97
cgcaugacgccggc

SEQ ID NO: 1053412 - RNA, 16 nt, Mycobacterium bovis subsp bovis AF2122/97
cgcaucugucgcgcgg

SEQ ID NO: 1053413 - RNA, 22 nt, Mycobacterium bovis subsp bovis AF2122/97
cgcaucugcucggcaucgagca

SEQ ID NO: 1053414 - RNA, 16 nt, Mycobacterium bovis subsp bovis AF2122/97
cgcaucuggccggcgg

SEQ ID NO: 1053415 - RNA, 13 nt, Mycobacterium bovis subsp bovis AF2122/97
cgcauggcggcug

SEQ ID NO: 1053416 - RNA, 14 nt, Mycobacterium bovis subsp bovis AF2122/97
cgcauugagcuggc

SEQ ID NO: 1053417 - RNA, 19 nt, Mycobacterium bovis subsp bovis AF2122/97
cgcauugccgacgcgcggc

SEQ ID NO: 1053418 - RNA, 19 nt, Mycobacterium bovis subsp bovis AF2122/97
cgcauugccaacgcccacg

SEQ ID NO: 1053419 - RNA, 16 nt, Mycobacterium bovis subsp bovis AF2122/97
cgcauugcagaaccgc

SEQ ID NO: 1053420 - RNA, 20 nt, Mycobacterium bovis subsp bovis AF2122/97
cgcauugcagcguccccaug

SEQ ID NO: 1053421 - RNA, 12 nt, Mycobacterium bovis subsp bovis AF2122/97
cgcauggucgac

SEQ ID NO: 1053422 - RNA, 22 nt, Mycobacterium bovis subsp bovis AF2122/97
cgcaugggucauggcgcuggga

SEQ ID NO: 1053423 - RNA, 20 nt, Mycobacterium bovis subsp bovis AF2122/97
cgcaugggccaggucagccg

SEQ ID NO: 1053424 - RNA, 13 nt, Mycobacterium bovis subsp bovis AF2122/97
cgccaccaucguu

SEQ ID NO: 1053425 - RNA, 21 nt, Mycobacterium bovis subsp bovis AF2122/97
cgccaccaucguugccggugc

SEQ ID NO: 1053426 - RNA, 19 nt, Mycobacterium bovis subsp bovis AF2122/97
cgccaccauccccggcaac

SEQ ID NO: 1053427 - RNA, 18 nt, Mycobacterium bovis subsp bovis AF2122/97
cgccaccagcaccgccgc

SEQ ID NO: 1053428 - RNA, 16 nt, Mycobacterium bovis subsp bovis AF2122/97
cgccaccagggcggcc

SEQ ID NO: 1053429 - RNA, 23 nt, Mycobacterium bovis subsp bovis AF2122/97
cgccaccacggucaagccggcgc

SEQ ID NO: 1053430 - RNA, 11 nt, Mycobacterium bovis subsp bovis AF2122/97
cgccaccaccg

SEQ ID NO: 1053431 - RNA, 15 nt, Mycobacterium bovis subsp bovis AF2122/97
cgccaccacccggcg

SEQ ID NO: 1053432 - RNA, 13 nt, Mycobacterium bovis subsp bovis AF2122/97
cgccaccaccccg

SEQ ID NO: 1053433 - RNA, 16 nt, Mycobacterium bovis subsp bovis AF2122/97
cgccaccaccccgucg

SEQ ID NO: 1053434 - RNA, 21 nt, Mycobacterium bovis subsp bovis AF2122/97
cgccaccaccgcugccggcgc

SEQ ID NO: 1053435 - RNA, 14 nt, Mycobacterium bovis subsp bovis AF2122/97
cgccaccaccggcg

SEQ ID NO: 1053436 - RNA, 19 nt, Mycobacterium bovis subsp bovis AF2122/97
cgccaccaccuccgcgucg

SEQ ID NO: 1053437 - RNA, 21 nt, Mycobacterium bovis subsp bovis AF2122/97
cgccaccaccuccgcgucgga

SEQ ID NO: 1053438 - RNA, 14 nt, Mycobacterium bovis subsp bovis AF2122/97
cgccaccaccaggg

SEQ ID NO: 1053439 - RNA, 19 nt, Mycobacterium bovis subsp bovis AF2122/97
cgccacaccggggcggccg

SEQ ID NO: 1053440 - RNA, 13 nt, Mycobacterium bovis subsp bovis AF2122/97
cgccacagcaccc

SEQ ID NO: 1053441 - RNA, 23 nt, Mycobacterium bovis subsp bovis AF2122/97
cgccacagcacccacgccggugg

SEQ ID NO: 1053442 - RNA, 19 nt, Mycobacterium bovis subsp bovis AF2122/97
cgccacagcagcguugacg

SEQ ID NO: 1053443 - RNA, 23 nt, Mycobacterium bovis subsp bovis AF2122/97
cgccacauguugucgacggucgg

SEQ ID NO: 1053444 - RNA, 21 nt, Mycobacterium bovis subsp bovis AF2122/97
cgccaccaaauccgcaaggac

SEQ ID NO: 1053445 - RNA, 16 nt, Mycobacterium bovis subsp bovis AF2122/97
cgccacaaacccgaug

SEQ ID NO: 1053446 - RNA, 18 nt, Mycobacterium bovis subsp bovis AF2122/97
cgccacaacggcggcgca

SEQ ID NO: 1053447 - RNA, 14 nt, Mycobacterium bovis subsp bovis AF2122/97
cgccacaccaacgu

SEQ ID NO: 1053448 - RNA, 20 nt, Mycobacterium bovis subsp bovis AF2122/97
cgccacaccaugauugccag

SEQ ID NO: 1053449 - RNA, 18 nt, Mycobacterium bovis subsp bovis AF2122/97
cgccacacggggccgcca

SEQ ID NO: 1053450 - RNA, 20 nt, Mycobacterium bovis subsp bovis AF2122/97
cgccacacggggccgccagc

SEQ ID NO: 1053451 - RNA, 18 nt, Mycobacterium bovis subsp bovis AF2122/97
cgccacacucccgcgccc

SEQ ID NO: 1053452 - RNA, 13 nt, Mycobacterium bovis subsp bovis AF2122/97
cgccacacccgug

SEQ ID NO: 1053453 - RNA, 13 nt, Mycobacterium bovis subsp bovis AF2122/97
cgccaagcucggc

SEQ ID NO: 1053454 - RNA, 14 nt, Mycobacterium bovis subsp bovis AF2122/97
cgccaagcucggcc

SEQ ID NO: 1053455 - RNA, 23 nt, Mycobacterium bovis subsp bovis AF2122/97
cgccaagcucggccaccagcgcc

SEQ ID NO: 1053456 - RNA, 16 nt, Mycobacterium bovis subsp bovis AF2122/97
cgccaaugcccaggug

SEQ ID NO: 1053457 - RNA, 17 nt, Mycobacterium bovis subsp bovis AF2122/97
cgccaaugccgcggagg

SEQ ID NO: 1053458 - RNA, 23 nt, Mycobacterium bovis subsp bovis AF2122/97
cgccaaugccgcggaggcggcca

SEQ ID NO: 1053459 - RNA, 19 nt, Mycobacterium bovis subsp bovis AF2122/97
cgccaacucgagaguggcc

SEQ ID NO: 1053460 - RNA, 21 nt, Mycobacterium bovis subsp bovis AF2122/97
cgccaagcccaggcgaucgcc

SEQ ID NO: 1053461 - RNA, 13 nt, Mycobacterium bovis subsp bovis AF2122/97
cgccaacugcggc

SEQ ID NO: 1053462 - RNA, 20 nt, Mycobacterium bovis subsp bovis AF2122/97
cgcauuuuccacauccuggc

SEQ ID NO: 1053463 - RNA, 22 nt, Mycobacterium bovis subsp bovis AF2122/97
cgccaacguugcgccagcggug

SEQ ID NO: 1053464 - RNA, 15 nt, Mycobacterium bovis subsp bovis AF2122/97
cgccaacuucaccac

SEQ ID NO: 1053465 - RNA, 15 nt, Mycobacterium bovis subsp bovis AF2122/97
cgccaagaucgggug

SEQ ID NO: 1053466 - RNA, 20 nt, Mycobacterium bovis subsp bovis AF2122/97
cgccaagaucggguggcggg

SEQ ID NO: 1053467 - RNA, 22 nt, Mycobacterium bovis subsp bovis AF2122/97
cgccaagaucggguggcggguc

SEQ ID NO: 1053468 - RNA, 22 nt, Mycobacterium bovis subsp bovis AF2122/97
cgccaacuugcgagguaagcga

SEQ ID NO: 1053469 - RNA, 17 nt, Mycobacterium bovis subsp bovis AF2122/97
cgccaagacgucggcgu

SEQ ID NO: 1053470 - RNA, 18 nt, Mycobacterium bovis subsp bovis AF2122/97
cgccaagacgucggcgug

SEQ ID NO: 1053471 - RNA, 19 nt, Mycobacterium bovis subsp bovis AF2122/97
cgccaagacgucggcgugg

SEQ ID NO: 1053472 - RNA, 17 nt, Mycobacterium bovis subsp bovis AF2122/97
cgcauuucguggcgcgc

SEQ ID NO: 1053473 - RNA, 19 nt, Mycobacterium bovis subsp bovis AF2122/97
cgcauuucguggcgcgccg

SEQ ID NO: 1053474 - RNA, 18 nt, Mycobacterium bovis subsp bovis AF2122/97
cgcauuucgacgagacga

SEQ ID NO: 1053475 - RNA, 17 nt, Mycobacterium bovis subsp bovis AF2122/97
cgcauuucggaucucga

SEQ ID NO: 1053476 - RNA, 13 nt, Mycobacterium bovis subsp bovis AF2122/97
cgaucaggccguc

SEQ ID NO: 1053477 - RNA, 20 nt, Mycobacterium bovis subsp bovis AF2122/97
cgaucagcuugggcagcagc

SEQ ID NO: 1053478 - RNA, 21 nt, Mycobacterium bovis subsp bovis AF2122/97
cgaucagcuugugggcgacgg

SEQ ID NO: 1053479 - RNA, 14 nt, Mycobacterium bovis subsp bovis AF2122/97
cgaucagggcgaug

SEQ ID NO: 1053480 - RNA, 18 nt, Mycobacterium bovis subsp bovis AF2122/97
cgaucaggcugccgcugc

SEQ ID NO: 1053481 - RNA, 14 nt, Mycobacterium bovis subsp bovis AF2122/97
cgaucaggcggacg

SEQ ID NO: 1053482 - RNA, 18 nt, Mycobacterium bovis subsp bovis AF2122/97
cgaucagcggcagcaccg

SEQ ID NO: 1053483 - RNA, 21 nt, Mycobacterium bovis subsp bovis AF2122/97
cgaucagcggcagcaccgcac

SEQ ID NO: 1053484 - RNA, 16 nt, Mycobacterium bovis subsp bovis AF2122/97
cgaucagcaccgacgg

SEQ ID NO: 1053485 - RNA, 22 nt, Mycobacterium bovis subsp bovis AF2122/97
cgaucagaugcggcccgggcuc

SEQ ID NO: 1053486 - RNA, 15 nt, Mycobacterium bovis subsp bovis AF2122/97
cgaucagcgcgacgg

SEQ ID NO: 1053487 - RNA, 15 nt, Mycobacterium bovis subsp bovis AF2122/97
cgaucagcaacucgg

SEQ ID NO: 1053488 - RNA, 21 nt, Mycobacterium bovis subsp bovis AF2122/97
cgaucagcgccggauccacac

SEQ ID NO: 1053489 - RNA, 17 nt, Mycobacterium bovis subsp bovis AF2122/97
cgaucagcgcgacgguc

SEQ ID NO: 1053490 - RNA, 13 nt, Mycobacterium bovis subsp bovis AF2122/97
cgaucagcgcgca

SEQ ID NO: 1053491 - RNA, 12 nt, Mycobacterium bovis subsp bovis AF2122/97
cgaucacgucgu

SEQ ID NO: 1053492 - RNA, 19 nt, Mycobacterium bovis subsp bovis AF2122/97
cgaucacgucgucagccac

SEQ ID NO: 1053493 - RNA, 19 nt, Mycobacterium bovis subsp bovis AF2122/97
cgaucacggugggcgccga

SEQ ID NO: 1053494 - RNA, 17 nt, Mycobacterium bovis subsp bovis AF2122/97
cgaucacguacgccgcc

SEQ ID NO: 1053495 - RNA, 18 nt, Mycobacterium bovis subsp bovis AF2122/97
cgaucacguacgccgccg

SEQ ID NO: 1053496 - RNA, 16 nt, Mycobacterium bovis subsp bovis AF2122/97
cgaucacuagcgcccc

SEQ ID NO: 1053497 - RNA, 23 nt, Mycobacterium bovis subsp bovis AF2122/97
cgaucacuagucguagacggcga

SEQ ID NO: 1053498 - RNA, 20 nt, Mycobacterium bovis subsp bovis AF2122/97
cgaucacgugguccaaccgg

SEQ ID NO: 1053499 - RNA, 22 nt, Mycobacterium bovis subsp bovis AF2122/97
cgaucacgucgucagccaccgc

SEQ ID NO: 1053500 - RNA, 20 nt, Mycobacterium bovis subsp bovis AF2122/97
cgaucagauaguccggcuug

SEQ ID NO: 1053501 - RNA, 15 nt, Mycobacterium bovis subsp bovis AF2122/97
cgaucagacgcucga

SEQ ID NO: 1053502 - RNA, 17 nt, Mycobacterium bovis subsp bovis AF2122/97
cgaucagacgcucgacc

SEQ ID NO: 1053503 - RNA, 22 nt, Mycobacterium bovis subsp bovis AF2122/97
cgauccgccacgaaucgcccau

SEQ ID NO: 1053504 - RNA, 13 nt, Mycobacterium bovis subsp bovis AF2122/97
cgauccgcacagc

SEQ ID NO: 1053505 - RNA, 13 nt, Mycobacterium bovis subsp bovis AF2122/97
cgauccgacgacc

SEQ ID NO: 1053506 - RNA, 14 nt, Mycobacterium bovis subsp bovis AF2122/97
cgauccgagaccgc

SEQ ID NO: 1053507 - RNA, 18 nt, Mycobacterium bovis subsp bovis AF2122/97
cgauccgauaaauggccg

SEQ ID NO: 1053508 - RNA, 21 nt, Mycobacterium bovis subsp bovis AF2122/97
cgauccgauacagugcgcgga

SEQ ID NO: 1053509 - RNA, 14 nt, Mycobacterium bovis subsp bovis AF2122/97
cgauccgauccgcu

SEQ ID NO: 1053510 - RNA, 22 nt, Mycobacterium bovis subsp bovis AF2122/97
cgauccgcgcgcauauccgcag

SEQ ID NO: 1053511 - RNA, 19 nt, Mycobacterium bovis subsp bovis AF2122/97
cgaucccgugguggcgcca

SEQ ID NO: 1053512 - RNA, 18 nt, Mycobacterium bovis subsp bovis AF2122/97
cgaucccguccgcgccca

SEQ ID NO: 1053513 - RNA, 15 nt, Mycobacterium bovis subsp bovis AF2122/97
cgaucccggcgagca

SEQ ID NO: 1053514 - RNA, 13 nt, Mycobacterium bovis subsp bovis AF2122/97
cgaucccggcgag

SEQ ID NO: 1053515 - RNA, 14 nt, Mycobacterium bovis subsp bovis AF2122/97
cgaucccggccagc

SEQ ID NO: 1053516 - RNA, 17 nt, Mycobacterium bovis subsp bovis AF2122/97
cgaucccggccagcucc

SEQ ID NO: 1053517 - RNA, 13 nt, Mycobacterium bovis subsp bovis AF2122/97
cgauccagacggu

SEQ ID NO: 1053518 - RNA, 16 nt, Mycobacterium bovis subsp bovis AF2122/97
cgaucccgccggggcc

SEQ ID NO: 1053519 - RNA, 14 nt, Mycobacterium bovis subsp bovis AF2122/97
cgaucccgcggccg

SEQ ID NO: 1053520 - RNA, 16 nt, Mycobacterium bovis subsp bovis AF2122/97
cgaucccgcggccggg

SEQ ID NO: 1053521 - RNA, 19 nt, Mycobacterium bovis subsp bovis AF2122/97
cgauccacucggcgaucuc

SEQ ID NO: 1053522 - RNA, 18 nt, Mycobacterium bovis subsp bovis AF2122/97
cgauccacugccgcgcgc

SEQ ID NO: 1053523 - RNA, 19 nt, Mycobacterium bovis subsp bovis AF2122/97
cgauccacugccgcgcgcc

SEQ ID NO: 1053524 - RNA, 23 nt, Mycobacterium bovis subsp bovis AF2122/97
cgauccacugccgcgcgcccgcc

SEQ ID NO: 1053525 - RNA, 22 nt, Mycobacterium bovis subsp bovis AF2122/97
cgauccacuguagggccgguga

SEQ ID NO: 1053526 - RNA, 13 nt, Mycobacterium bovis subsp bovis AF2122/97
cgauccacccggc

SEQ ID NO: 1053527 - RNA, 14 nt, Mycobacterium bovis subsp bovis AF2122/97
cgauccacccggca

SEQ ID NO: 1053528 - RNA, 18 nt, Mycobacterium bovis subsp bovis AF2122/97
cgauccacccggcauuga

SEQ ID NO: 1053529 - RNA, 14 nt, Mycobacterium bovis subsp bovis AF2122/97
cgauccacuccggc

SEQ ID NO: 1053530 - RNA, 16 nt, Mycobacterium bovis subsp bovis AF2122/97
cgauccacggcgaugc

SEQ ID NO: 1053531 - RNA, 15 nt, Mycobacterium bovis subsp bovis AF2122/97
cgaucauggcggcag

SEQ ID NO: 1053532 - RNA, 23 nt, Mycobacterium bovis subsp bovis AF2122/97
cgaucaggggcccacccgaauca

SEQ ID NO: 1053533 - RNA, 18 nt, Mycobacterium bovis subsp bovis AF2122/97
cgaucagcgcggcgcccu

SEQ ID NO: 1053534 - RNA, 22 nt, Mycobacterium bovis subsp bovis AF2122/97
cgaucagggccccaccgagcgg

SEQ ID NO: 1053535 - RNA, 22 nt, Mycobacterium bovis subsp bovis AF2122/97
cgaucagggugucgaagagcag

SEQ ID NO: 1053536 - RNA, 19 nt, Mycobacterium bovis subsp bovis AF2122/97
cgaucagguacgccaggug

SEQ ID NO: 1053537 - RNA, 21 nt, Mycobacterium bovis subsp bovis AF2122/97
cgaucagguacuccccguugc

SEQ ID NO: 1053538 - RNA, 14 nt, Mycobacterium bovis subsp bovis AF2122/97
cgauacgcgcgucg

SEQ ID NO: 1053539 - RNA, 15 nt, Mycobacterium bovis subsp bovis AF2122/97
cgauacgcgcgucgg

SEQ ID NO: 1053540 - RNA, 14 nt, Mycobacterium bovis subsp bovis AF2122/97
cgauacgccaccgg

SEQ ID NO: 1053541 - RNA, 16 nt, Mycobacterium bovis subsp bovis AF2122/97
cgauacgccaccggca

SEQ ID NO: 1053542 - RNA, 16 nt, Mycobacterium bovis subsp bovis AF2122/97
cgauaccgucgugcgu

SEQ ID NO: 1053543 - RNA, 19 nt, Mycobacterium bovis subsp bovis AF2122/97
cgauaccgguugcggucau

SEQ ID NO: 1053544 - RNA, 16 nt, Mycobacterium bovis subsp bovis AF2122/97
cgauacgaagccgccg

SEQ ID NO: 1053545 - RNA, 22 nt, Mycobacterium bovis subsp bovis AF2122/97
cgauacgaagccgccgcgacca

SEQ ID NO: 1053546 - RNA, 15 nt, Mycobacterium bovis subsp bovis AF2122/97
cgauaccgccggccc

SEQ ID NO: 1053547 - RNA, 23 nt, Mycobacterium bovis subsp bovis AF2122/97
cgauaccgccggccccaccggug

SEQ ID NO: 1053548 - RNA, 16 nt, Mycobacterium bovis subsp bovis AF2122/97
cgauaccggcggcgag

SEQ ID NO: 1053549 - RNA, 13 nt, Mycobacterium bovis subsp bovis AF2122/97
cgauaccggcgug

SEQ ID NO: 1053550 - RNA, 14 nt, Mycobacterium bovis subsp bovis AF2122/97
cgauaccggcgugc

SEQ ID NO: 1053551 - RNA, 15 nt, Mycobacterium bovis subsp bovis AF2122/97
cgauaccggcgugca

SEQ ID NO: 1053552 - RNA, 20 nt, Mycobacterium bovis subsp bovis AF2122/97
cgauacacggcggcgauguc

SEQ ID NO: 1053553 - RNA, 14 nt, Mycobacterium bovis subsp bovis AF2122/97
cgauacaccgacgg

SEQ ID NO: 1053554 - RNA, 13 nt, Mycobacterium bovis subsp bovis AF2122/97
cgauacccaccgu

SEQ ID NO: 1053555 - RNA, 21 nt, Mycobacterium bovis subsp bovis AF2122/97
cgauacccagaauuccggcgg

SEQ ID NO: 1053556 - RNA, 13 nt, Mycobacterium bovis subsp bovis AF2122/97
cgauacccgguga

SEQ ID NO: 1053557 - RNA, 14 nt, Mycobacterium bovis subsp bovis AF2122/97
cgauaccgaccgaa

SEQ ID NO: 1053558 - RNA, 14 nt, Mycobacterium bovis subsp bovis AF2122/97
cgauaccgcaccaa

SEQ ID NO: 1053559 - RNA, 14 nt, Mycobacterium bovis subsp bovis AF2122/97
cgaguuuggccagu

SEQ ID NO: 1053560 - RNA, 19 nt, Mycobacterium bovis subsp bovis AF2122/97
cgaguuucugcucgaccgu

SEQ ID NO: 1053561 - RNA, 16 nt, Mycobacterium bovis subsp bovis AF2122/97
cgaguuucugcucgac

SEQ ID NO: 1053562 - RNA, 14 nt, Mycobacterium bovis subsp bovis AF2122/97
cgaguucggccgcg

SEQ ID NO: 1053563 - RNA, 16 nt, Mycobacterium bovis subsp bovis AF2122/97
cgaguucggccgcggu

SEQ ID NO: 1053564 - RNA, 19 nt, Mycobacterium bovis subsp bovis AF2122/97
cgaguucggccgcggugua

SEQ ID NO: 1053565 - RNA, 15 nt, Mycobacterium bovis subsp bovis AF2122/97
cgaguucgcgcacgu

SEQ ID NO: 1053566 - RNA, 16 nt, Mycobacterium bovis subsp bovis AF2122/97
cgaguucgcgcacguc

SEQ ID NO: 1053567 - RNA, 18 nt, Mycobacterium bovis subsp bovis AF2122/97
cgaguucgucagcggcca

SEQ ID NO: 1053568 - RNA, 17 nt, Mycobacterium bovis subsp bovis AF2122/97
cgaguugagaaccggcu

SEQ ID NO: 1053569 - RNA, 12 nt, Mycobacterium bovis subsp bovis AF2122/97
cgaguugagcau

SEQ ID NO: 1053570 - RNA, 20 nt, Mycobacterium bovis subsp bovis AF2122/97
cgaguugaugcaagcgggca

SEQ ID NO: 1053571 - RNA, 15 nt, Mycobacterium bovis subsp bovis AF2122/97
cgaguugcucggccg

SEQ ID NO: 1053572 - RNA, 22 nt, Mycobacterium bovis subsp bovis AF2122/97
cgaucaccccggucggcccgcg

SEQ ID NO: 1053573 - RNA, 23 nt, Mycobacterium bovis subsp bovis AF2122/97
cgaucacccgcacuccacgaucg

SEQ ID NO: 1053574 - RNA, 16 nt, Mycobacterium bovis subsp bovis AF2122/97
cgaucaccgacaccgu

SEQ ID NO: 1053575 - RNA, 19 nt, Mycobacterium bovis subsp bovis AF2122/97
cgaucaacaacagccgcag

SEQ ID NO: 1053576 - RNA, 14 nt, Mycobacterium bovis subsp bovis AF2122/97
cgaucaccccgcca

SEQ ID NO: 1053577 - RNA, 17 nt, Mycobacterium bovis subsp bovis AF2122/97
cgaucaccgagucgacg

SEQ ID NO: 1053578 - RNA, 12 nt, Mycobacterium bovis subsp bovis AF2122/97
cgaucacggugg

SEQ ID NO: 1053579 - RNA, 13 nt, Mycobacterium bovis subsp bovis AF2122/97
cgaucaccgcgcc

SEQ ID NO: 1053580 - RNA, 15 nt, Mycobacterium bovis subsp bovis AF2122/97
cgaucaccgcgccgg

SEQ ID NO: 1053581 - RNA, 15 nt, Mycobacterium bovis subsp bovis AF2122/97
cgaucacccccugga

SEQ ID NO: 1053582 - RNA, 21 nt, Mycobacterium bovis subsp bovis AF2122/97
cgaucaaccgggucagcccag

SEQ ID NO: 1053583 - RNA, 23 nt, Mycobacterium bovis subsp bovis AF2122/97
cgaucaaccccccgggcccgccg

SEQ ID NO: 1053584 - RNA, 18 nt, Mycobacterium bovis subsp bovis AF2122/97
cgaucaaccgcugucacc

SEQ ID NO: 1053585 - RNA, 15 nt, Mycobacterium bovis subsp bovis AF2122/97
cgauauuggcaucgu

SEQ ID NO: 1053586 - RNA, 14 nt, Mycobacterium bovis subsp bovis AF2122/97
cgauauggccgggu

SEQ ID NO: 1053587 - RNA, 21 nt, Mycobacterium bovis subsp bovis AF2122/97
cgauauggccuugcugcgcga

SEQ ID NO: 1053588 - RNA, 20 nt, Mycobacterium bovis subsp bovis AF2122/97
cgauauggguugccagcgac

SEQ ID NO: 1053589 - RNA, 17 nt, Mycobacterium bovis subsp bovis AF2122/97
cgauaugcagcucgcug

SEQ ID NO: 1053590 - RNA, 19 nt, Mycobacterium bovis subsp bovis AF2122/97
cgauagauacccgcggcag

SEQ ID NO: 1053591 - RNA, 18 nt, Mycobacterium bovis subsp bovis AF2122/97
cgauauuggacgcgcaug

SEQ ID NO: 1053592 - RNA, 15 nt, Mycobacterium bovis subsp bovis AF2122/97
cgauacggccggccg

SEQ ID NO: 1053593 - RNA, 18 nt, Mycobacterium bovis subsp bovis AF2122/97
cgauacggccggccguug

SEQ ID NO: 1053594 - RNA, 15 nt, Mycobacterium bovis subsp bovis AF2122/97
cgauacggguguggc

SEQ ID NO: 1053595 - RNA, 20 nt, Mycobacterium bovis subsp bovis AF2122/97
cgauagaacguagcgcccac

SEQ ID NO: 1053596 - RNA, 22 nt, Mycobacterium bovis subsp bovis AF2122/97
cgagggccugccgcacugggcg

SEQ ID NO: 1053597 - RNA, 21 nt, Mycobacterium bovis subsp bovis AF2122/97
cgagggcaaggacaagccgcu

SEQ ID NO: 1053598 - RNA, 18 nt, Mycobacterium bovis subsp bovis AF2122/97
cgagggccacggcugcgg

SEQ ID NO: 1053599 - RNA, 14 nt, Mycobacterium bovis subsp bovis AF2122/97
cgagggccgucaca

SEQ ID NO: 1053600 - RNA, 15 nt, Mycobacterium bovis subsp bovis AF2122/97
cgagggccgucacag

SEQ ID NO: 1053601 - RNA, 13 nt, Mycobacterium bovis subsp bovis AF2122/97
cgagggcgcgccg

SEQ ID NO: 1053602 - RNA, 14 nt, Mycobacterium bovis subsp bovis AF2122/97
cgagggcgccgggg

SEQ ID NO: 1053603 - RNA, 23 nt, Mycobacterium bovis subsp bovis AF2122/97
cgagggcgccgggggcgccgccg

SEQ ID NO: 1053604 - RNA, 16 nt, Mycobacterium bovis subsp bovis AF2122/97
cgagggcuaccggcgc

SEQ ID NO: 1053605 - RNA, 21 nt, Mycobacterium bovis subsp bovis AF2122/97
cgagggcuaccggcgccgcgc

SEQ ID NO: 1053606 - RNA, 22 nt, Mycobacterium bovis subsp bovis AF2122/97
cgagggcuaccggcgccgcgcg

SEQ ID NO: 1053607 - RNA, 13 nt, Mycobacterium bovis subsp bovis AF2122/97
cgagggcgucgcc

SEQ ID NO: 1053608 - RNA, 20 nt, Mycobacterium bovis subsp bovis AF2122/97
cgagggcgucgccgccguug

SEQ ID NO: 1053609 - RNA, 12 nt, Mycobacterium bovis subsp bovis AF2122/97
cgagggcgcgug

SEQ ID NO: 1053610 - RNA, 20 nt, Mycobacterium bovis subsp bovis AF2122/97
cgaggguaccaggcgccgug

SEQ ID NO: 1053611 - RNA, 16 nt, Mycobacterium bovis subsp bovis AF2122/97
cgagcggucgacgugu

SEQ ID NO: 1053612 - RNA, 14 nt, Mycobacterium bovis subsp bovis AF2122/97
cgagcgguugccau

SEQ ID NO: 1053613 - RNA, 14 nt, Mycobacterium bovis subsp bovis AF2122/97
cgagcggucgacgu

SEQ ID NO: 1053614 - RNA, 16 nt, Mycobacterium bovis subsp bovis AF2122/97
cgagcggucgaucuga

SEQ ID NO: 1053615 - RNA, 16 nt, Mycobacterium bovis subsp bovis AF2122/97
cgagcggucgcgguag

SEQ ID NO: 1053616 - RNA, 17 nt, Mycobacterium bovis subsp bovis AF2122/97
cgagcguaacgguaacc

SEQ ID NO: 1053617 - RNA, 23 nt, Mycobacterium bovis subsp bovis AF2122/97
cgagcggugauugcaagcgggca

SEQ ID NO: 1053618 - RNA, 17 nt, Mycobacterium bovis subsp bovis AF2122/97
cgagcgguugccauccg

SEQ ID NO: 1053619 - RNA, 20 nt, Mycobacterium bovis subsp bovis AF2122/97
cgagcguaacguggcugcga

SEQ ID NO: 1053620 - RNA, 18 nt, Mycobacterium bovis subsp bovis AF2122/97
cgaggcucgcguggccgc

SEQ ID NO: 1053621 - RNA, 12 nt, Mycobacterium bovis subsp bovis AF2122/97
cgaggcucgggc

SEQ ID NO: 1053622 - RNA, 22 nt, Mycobacterium bovis subsp bovis AF2122/97
cgaggcugaccguggcgccggu

SEQ ID NO: 1053623 - RNA, 12 nt, Mycobacterium bovis subsp bovis AF2122/97
cgagggcaacga

SEQ ID NO: 1053624 - RNA, 13 nt, Mycobacterium bovis subsp bovis AF2122/97
cgagggcacgcgc

SEQ ID NO: 1053625 - RNA, 14 nt, Mycobacterium bovis subsp bovis AF2122/97
cgagggcacgcgca

SEQ ID NO: 1053626 - RNA, 15 nt, Mycobacterium bovis subsp bovis AF2122/97
cgaggcuugcggcac

SEQ ID NO: 1053627 - RNA, 20 nt, Mycobacterium bovis subsp bovis AF2122/97
cgaggucguuucccuggccg

SEQ ID NO: 1053628 - RNA, 22 nt, Mycobacterium bovis subsp bovis AF2122/97
cgaggucguuucccuggccgcc

SEQ ID NO: 1053629 - RNA, 19 nt, Mycobacterium bovis subsp bovis AF2122/97
cgaggucugcggccgauac

SEQ ID NO: 1053630 - RNA, 22 nt, Mycobacterium bovis subsp bovis AF2122/97
cgaggucggugaggucgaugcc

SEQ ID NO: 1053631 - RNA, 17 nt, Mycobacterium bovis subsp bovis AF2122/97
cgaggucggcgaucugc

SEQ ID NO: 1053632 - RNA, 12 nt, Mycobacterium bovis subsp bovis AF2122/97
cgaggucggcga

SEQ ID NO: 1053633 - RNA, 15 nt, Mycobacterium bovis subsp bovis AF2122/97
cgaggucggccagca

SEQ ID NO: 1053634 - RNA, 18 nt, Mycobacterium bovis subsp bovis AF2122/97
cgagguccucgucggcgu

SEQ ID NO: 1053635 - RNA, 21 nt, Mycobacterium bovis subsp bovis AF2122/97
cgagguccucgucggcgucga

SEQ ID NO: 1053636 - RNA, 13 nt, Mycobacterium bovis subsp bovis AF2122/97
cgaggucggccag

SEQ ID NO: 1053637 - RNA, 18 nt, Mycobacterium bovis subsp bovis AF2122/97
cgaggugauguuggccgc

SEQ ID NO: 1053638 - RNA, 20 nt, Mycobacterium bovis subsp bovis AF2122/97
cgaggugauguuggccgcca

SEQ ID NO: 1053639 - RNA, 23 nt, Mycobacterium bovis subsp bovis AF2122/97
cgaggugagguugacccccgggu

SEQ ID NO: 1053640 - RNA, 14 nt, Mycobacterium bovis subsp bovis AF2122/97
cgaggugcucggau

SEQ ID NO: 1053641 - RNA, 20 nt, Mycobacterium bovis subsp bovis AF2122/97
cgaggugcccaaggccagga

SEQ ID NO: 1053642 - RNA, 13 nt, Mycobacterium bovis subsp bovis AF2122/97
cgaggugccgcgc

SEQ ID NO: 1053643 - RNA, 16 nt, Mycobacterium bovis subsp bovis AF2122/97
cgaggugccgcgcagc

SEQ ID NO: 1053644 - RNA, 19 nt, Mycobacterium bovis subsp bovis AF2122/97
cgaggugccgcgcagcugc

SEQ ID NO: 1053645 - RNA, 14 nt, Mycobacterium bovis subsp bovis AF2122/97
cgagguggcgcaca

SEQ ID NO: 1053646 - RNA, 18 nt, Mycobacterium bovis subsp bovis AF2122/97
cgaggucgagcgacccca

SEQ ID NO: 1053647 - RNA, 15 nt, Mycobacterium bovis subsp bovis AF2122/97
cgaggucgagcgccg

SEQ ID NO: 1053648 - RNA, 16 nt, Mycobacterium bovis subsp bovis AF2122/97
cgaggucgagcgccgc

SEQ ID NO: 1053649 - RNA, 15 nt, Mycobacterium bovis subsp bovis AF2122/97
cgagguccucagcga

SEQ ID NO: 1053650 - RNA, 22 nt, Mycobacterium bovis subsp bovis AF2122/97
cgagguccucgagguccucguc

SEQ ID NO: 1053651 - RNA, 15 nt, Mycobacterium bovis subsp bovis AF2122/97
cgagguccucgucgg

SEQ ID NO: 1053652 - RNA, 17 nt, Mycobacterium bovis subsp bovis AF2122/97
cgaggucacgcgaggcg

SEQ ID NO: 1053653 - RNA, 14 nt, Mycobacterium bovis subsp bovis AF2122/97
cgaggucacccggu

SEQ ID NO: 1053654 - RNA, 14 nt, Mycobacterium bovis subsp bovis AF2122/97
cgaggucagcgguu

SEQ ID NO: 1053655 - RNA, 12 nt, Mycobacterium bovis subsp bovis AF2122/97
cgagguccacca

SEQ ID NO: 1053656 - RNA, 15 nt, Mycobacterium bovis subsp bovis AF2122/97
cgagguccaccaccc

SEQ ID NO: 1053657 - RNA, 12 nt, Mycobacterium bovis subsp bovis AF2122/97
cgaggucccggc

SEQ ID NO: 1053658 - RNA, 14 nt, Mycobacterium bovis subsp bovis AF2122/97
cgagguagcgcgca

SEQ ID NO: 1053659 - RNA, 20 nt, Mycobacterium bovis subsp bovis AF2122/97
cgagguauaaacgcggcgcg

SEQ ID NO: 1053660 - RNA, 21 nt, Mycobacterium bovis subsp bovis AF2122/97
cgagguauaaacgcggcgcgc

SEQ ID NO: 1053661 - RNA, 17 nt, Mycobacterium bovis subsp bovis AF2122/97
cgagguauucgcgcagc

SEQ ID NO: 1053662 - RNA, 22 nt, Mycobacterium bovis subsp bovis AF2122/97
cgaggguuuucgcauagugcgg

SEQ ID NO: 1053663 - RNA, 17 nt, Mycobacterium bovis subsp bovis AF2122/97
cgagguaagcgagucga

SEQ ID NO: 1053664 - RNA, 18 nt, Mycobacterium bovis subsp bovis AF2122/97
cgagggugaagacaccgg

SEQ ID NO: 1053665 - RNA, 19 nt, Mycobacterium bovis subsp bovis AF2122/97
cgagggugaagacaccggc

SEQ ID NO: 1053666 - RNA, 21 nt, Mycobacterium bovis subsp bovis AF2122/97
cgagggugaaguggcgcagca

SEQ ID NO: 1053667 - RNA, 17 nt, Mycobacterium bovis subsp bovis AF2122/97
cgagggugacccccaau

SEQ ID NO: 1053668 - RNA, 23 nt, Mycobacterium bovis subsp bovis AF2122/97
cgagggugagcauggcuagggcg

SEQ ID NO: 1053669 - RNA, 16 nt, Mycobacterium bovis subsp bovis AF2122/97
cgagguucucccgcgc

SEQ ID NO: 1053670 - RNA, 16 nt, Mycobacterium bovis subsp bovis AF2122/97
cgagguugaccaccag

SEQ ID NO: 1053671 - RNA, 18 nt, Mycobacterium bovis subsp bovis AF2122/97
cgagguugaccaccagcg

SEQ ID NO: 1053672 - RNA, 21 nt, Mycobacterium bovis subsp bovis AF2122/97
cgagguugaccaccagcgugc

SEQ ID NO: 1053673 - RNA, 18 nt, Mycobacterium bovis subsp bovis AF2122/97
cgagguugccgcaccagu

SEQ ID NO: 1053674 - RNA, 18 nt, Mycobacterium bovis subsp bovis AF2122/97
cgagguugcgccgaccgg

SEQ ID NO: 1053675 - RNA, 19 nt, Mycobacterium bovis subsp bovis AF2122/97
cgagguugcggacggugua

SEQ ID NO: 1053676 - RNA, 17 nt, Mycobacterium bovis subsp bovis AF2122/97
cgaguacaggcgcagcg

SEQ ID NO: 1053677 - RNA, 18 nt, Mycobacterium bovis subsp bovis AF2122/97
cgaguaccagcccaccgg

SEQ ID NO: 1053678 - RNA, 21 nt, Mycobacterium bovis subsp bovis AF2122/97
cgaguaccagcccaccggcgc

SEQ ID NO: 1053679 - RNA, 15 nt, Mycobacterium bovis subsp bovis AF2122/97
cgaguaccaggacga

SEQ ID NO: 1053680 - RNA, 15 nt, Mycobacterium bovis subsp bovis AF2122/97
cgaggugccggggcc

SEQ ID NO: 1053681 - RNA, 20 nt, Mycobacterium bovis subsp bovis AF2122/97
cgaggugcuuggggucaccc

SEQ ID NO: 1053682 - RNA, 15 nt, Mycobacterium bovis subsp bovis AF2122/97
cgaggugggcgucau

SEQ ID NO: 1053683 - RNA, 19 nt, Mycobacterium bovis subsp bovis AF2122/97
cgaggugggcgucaucgac

SEQ ID NO: 1053684 - RNA, 15 nt, Mycobacterium bovis subsp bovis AF2122/97
cgagguggucgaccc

SEQ ID NO: 1053685 - RNA, 17 nt, Mycobacterium bovis subsp bovis AF2122/97
cgagguggucgacccgg

SEQ ID NO: 1053686 - RNA, 14 nt, Mycobacterium bovis subsp bovis AF2122/97
cgagguggcugcgc

SEQ ID NO: 1053687 - RNA, 17 nt, Mycobacterium bovis subsp bovis AF2122/97
cgagguguagcccuccg

SEQ ID NO: 1053688 - RNA, 15 nt, Mycobacterium bovis subsp bovis AF2122/97
cgagguucugccgcg

SEQ ID NO: 1053689 - RNA, 21 nt, Mycobacterium bovis subsp bovis AF2122/97
cgagguuccaguacccacgca

SEQ ID NO: 1053690 - RNA, 19 nt, Mycobacterium bovis subsp bovis AF2122/97
cgagguucaaagcagcgca

SEQ ID NO: 1053691 - RNA, 14 nt, Mycobacterium bovis subsp bovis AF2122/97
cgagguucagccug

SEQ ID NO: 1053692 - RNA, 15 nt, Mycobacterium bovis subsp bovis AF2122/97
cgaguauuuuucgac

SEQ ID NO: 1053693 - RNA, 17 nt, Mycobacterium bovis subsp bovis AF2122/97
cgaguccaacucggcca

SEQ ID NO: 1053694 - RNA, 24 nt, Mycobacterium bovis subsp bovis AF2122/97
cgaguccaagauguccgguccgcc

SEQ ID NO: 1053695 - RNA, 23 nt, Mycobacterium bovis subsp bovis AF2122/97
cgaguccacaaguaccgcaucga

SEQ ID NO: 1053696 - RNA, 14 nt, Mycobacterium bovis subsp bovis AF2122/97
cgaguagugcaggu

SEQ ID NO: 1053697 - RNA, 21 nt, Mycobacterium bovis subsp bovis AF2122/97
cgaguaguucgucgacgucgg

SEQ ID NO: 1053698 - RNA, 22 nt, Mycobacterium bovis subsp bovis AF2122/97
cgaguagaagauggcaccgccc

SEQ ID NO: 1053699 - RNA, 19 nt, Mycobacterium bovis subsp bovis AF2122/97
cgaguauuuuucgaccagc

SEQ ID NO: 1053700 - RNA, 15 nt, Mycobacterium bovis subsp bovis AF2122/97
cgaguaccgauagcc

SEQ ID NO: 1053701 - RNA, 15 nt, Mycobacterium bovis subsp bovis AF2122/97
cgaguacccaaccgg

SEQ ID NO: 1053702 - RNA, 17 nt, Mycobacterium bovis subsp bovis AF2122/97
cgaguacccaaccggua

SEQ ID NO: 1053703 - RNA, 16 nt, Mycobacterium bovis subsp bovis AF2122/97
cgaguaccggccagcc

SEQ ID NO: 1053704 - RNA, 17 nt, Mycobacterium bovis subsp bovis AF2122/97
cgaguaccggccagccg

SEQ ID NO: 1053705 - RNA, 20 nt, Mycobacterium bovis subsp bovis AF2122/97
cgaguagaagauggcaccgc

SEQ ID NO: 1053706 - RNA, 14 nt, Mycobacterium bovis subsp bovis AF2122/97
cgaguacggccugc

SEQ ID NO: 1053707 - RNA, 16 nt, Mycobacterium bovis subsp bovis AF2122/97
cgaguacggccugccg

SEQ ID NO: 1053708 - RNA, 16 nt, Mycobacterium bovis subsp bovis AF2122/97
cgaguagcugacccgc

SEQ ID NO: 1053709 - RNA, 22 nt, Mycobacterium bovis subsp bovis AF2122/97
cgaguagcugacccgcgguagc

SEQ ID NO: 1053710 - RNA, 17 nt, Mycobacterium bovis subsp bovis AF2122/97
cgaguaggcggcuccga

SEQ ID NO: 1053711 - RNA, 16 nt, Mycobacterium bovis subsp bovis AF2122/97
cgaguagauggucgac

SEQ ID NO: 1053712 - RNA, 19 nt, Mycobacterium bovis subsp bovis AF2122/97
cgaguagauggucgacggg

SEQ ID NO: 1053713 - RNA, 14 nt, Mycobacterium bovis subsp bovis AF2122/97
cgaguagccggucg

SEQ ID NO: 1053714 - RNA, 15 nt, Mycobacterium bovis subsp bovis AF2122/97
cgaguagccggucgg

SEQ ID NO: 1053715 - RNA, 19 nt, Mycobacterium bovis subsp bovis AF2122/97
cgaguagccguagccgccg

SEQ ID NO: 1053716 - RNA, 20 nt, Mycobacterium bovis subsp bovis AF2122/97
cgaguagccguagccgccgu

SEQ ID NO: 1053717 - RNA, 23 nt, Mycobacterium bovis subsp bovis AF2122/97
cgaguagccguagccgccgugga

SEQ ID NO: 1053718 - RNA, 15 nt, Mycobacterium bovis subsp bovis AF2122/97
cgagucgccagaccg

SEQ ID NO: 1053719 - RNA, 18 nt, Mycobacterium bovis subsp bovis AF2122/97
cgagucgccagaccgcac

SEQ ID NO: 1053720 - RNA, 17 nt, Mycobacterium bovis subsp bovis AF2122/97
cgagucgaucucggcag

SEQ ID NO: 1053721 - RNA, 13 nt, Mycobacterium bovis subsp bovis AF2122/97
cgagucgaugacc

SEQ ID NO: 1053722 - RNA, 18 nt, Mycobacterium bovis subsp bovis AF2122/97
cgagucgaugaccccggu

SEQ ID NO: 1053723 - RNA, 16 nt, Mycobacterium bovis subsp bovis AF2122/97
cgagucgaaaccgccc

SEQ ID NO: 1053724 - RNA, 15 nt, Mycobacterium bovis subsp bovis AF2122/97
cgagucggcgggcga

SEQ ID NO: 1053725 - RNA, 14 nt, Mycobacterium bovis subsp bovis AF2122/97
cgagucggcggggc

SEQ ID NO: 1053726 - RNA, 15 nt, Mycobacterium bovis subsp bovis AF2122/97
cgagucggcggggcg

SEQ ID NO: 1053727 - RNA, 17 nt, Mycobacterium bovis subsp bovis AF2122/97
cgagucgggggccgcgu

SEQ ID NO: 1053728 - RNA, 21 nt, Mycobacterium bovis subsp bovis AF2122/97
cgagucgggggccgcgucucg

SEQ ID NO: 1053729 - RNA, 13 nt, Mycobacterium bovis subsp bovis AF2122/97
cgagucgugcguu

SEQ ID NO: 1053730 - RNA, 18 nt, Mycobacterium bovis subsp bovis AF2122/97
cgagugaaguuguuggcc

SEQ ID NO: 1053731 - RNA, 24 nt, Mycobacterium bovis subsp bovis AF2122/97
cgagugaaguuguuggccagaccg

SEQ ID NO: 1053732 - RNA, 14 nt, Mycobacterium bovis subsp bovis AF2122/97
cgagucgaucacgu

SEQ ID NO: 1053733 - RNA, 20 nt, Mycobacterium bovis subsp bovis AF2122/97
cgaguccucgagugccgccg

SEQ ID NO: 1053734 - RNA, 23 nt, Mycobacterium bovis subsp bovis AF2122/97
cgaguccucgagugccgccgucg

SEQ ID NO: 1053735 - RNA, 19 nt, Mycobacterium bovis subsp bovis AF2122/97
cgaguccgacaguccgcgc

SEQ ID NO: 1053736 - RNA, 16 nt, Mycobacterium bovis subsp bovis AF2122/97
cgagucccggcgguug

SEQ ID NO: 1053737 - RNA, 19 nt, Mycobacterium bovis subsp bovis AF2122/97
cgaguccucgagugccgcc

SEQ ID NO: 1053738 - RNA, 15 nt, Mycobacterium bovis subsp bovis AF2122/97
cgagugcgacggcga

SEQ ID NO: 1053739 - RNA, 17 nt, Mycobacterium bovis subsp bovis AF2122/97
cgagugccucgaccugg

SEQ ID NO: 1053740 - RNA, 19 nt, Mycobacterium bovis subsp bovis AF2122/97
cgagugcacagccgggcuc

SEQ ID NO: 1053741 - RNA, 14 nt, Mycobacterium bovis subsp bovis AF2122/97
cgagugcccagcga

SEQ ID NO: 1053742 - RNA, 12 nt, Mycobacterium bovis subsp bovis AF2122/97
cgagugccgccg

SEQ ID NO: 1053743 - RNA, 22 nt, Mycobacterium bovis subsp bovis AF2122/97
cgagugcggugugugcaagccg

SEQ ID NO: 1053744 - RNA, 21 nt, Mycobacterium bovis subsp bovis AF2122/97
cgagugcggacuucgccgccc

SEQ ID NO: 1053745 - RNA, 14 nt, Mycobacterium bovis subsp bovis AF2122/97
cgagugcggcacga

SEQ ID NO: 1053746 - RNA, 18 nt, Mycobacterium bovis subsp bovis AF2122/97
cgagugcggcacgaucgc

SEQ ID NO: 1053747 - RNA, 21 nt, Mycobacterium bovis subsp bovis AF2122/97
cgagugcggcacgaucgccaa

SEQ ID NO: 1053748 - RNA, 15 nt, Mycobacterium bovis subsp bovis AF2122/97
cgagugcggcgacca

SEQ ID NO: 1053749 - RNA, 14 nt, Mycobacterium bovis subsp bovis AF2122/97
cgagugguccagcc

SEQ ID NO: 1053750 - RNA, 15 nt, Mycobacterium bovis subsp bovis AF2122/97
cgagugguccggcgg

SEQ ID NO: 1053751 - RNA, 22 nt, Mycobacterium bovis subsp bovis AF2122/97
cgagugggauucugacgaccgg

SEQ ID NO: 1053752 - RNA, 21 nt, Mycobacterium bovis subsp bovis AF2122/97
cgagugggugaggccaaccac

SEQ ID NO: 1053753 - RNA, 20 nt, Mycobacterium bovis subsp bovis AF2122/97
cgaguggaucauguucggcc

SEQ ID NO: 1053754 - RNA, 21 nt, Mycobacterium bovis subsp bovis AF2122/97
cgaguggaucauguucggcca

SEQ ID NO: 1053755 - RNA, 14 nt, Mycobacterium bovis subsp bovis AF2122/97
cgaguuaccggugg

SEQ ID NO: 1053756 - RNA, 13 nt, Mycobacterium bovis subsp bovis AF2122/97
cgaguuccggccg

SEQ ID NO: 1053757 - RNA, 19 nt, Mycobacterium bovis subsp bovis AF2122/97
cgaguuaggccgccagccg

SEQ ID NO: 1053758 - RNA, 18 nt, Mycobacterium bovis subsp bovis AF2122/97
cgaucucgaucgacccgg

SEQ ID NO: 1053759 - RNA, 13 nt, Mycobacterium bovis subsp bovis AF2122/97
cgaucucgaccgu

SEQ ID NO: 1053760 - RNA, 13 nt, Mycobacterium bovis subsp bovis AF2122/97
cgaucucgaccag

SEQ ID NO: 1053761 - RNA, 14 nt, Mycobacterium bovis subsp bovis AF2122/97
cgaucucgaccagc

SEQ ID NO: 1053762 - RNA, 20 nt, Mycobacterium bovis subsp bovis AF2122/97
cgaucuccucuugcaccagg

SEQ ID NO: 1053763 - RNA, 15 nt, Mycobacterium bovis subsp bovis AF2122/97
cgaucuccuccacca

SEQ ID NO: 1053764 - RNA, 22 nt, Mycobacterium bovis subsp bovis AF2122/97
cgaucucccagugagcaugcga

SEQ ID NO: 1053765 - RNA, 16 nt, Mycobacterium bovis subsp bovis AF2122/97
cgaucuccggcggauc

SEQ ID NO: 1053766 - RNA, 21 nt, Mycobacterium bovis subsp bovis AF2122/97
cgaucucauccuccugcgccg

SEQ ID NO: 1053767 - RNA, 20 nt, Mycobacterium bovis subsp bovis AF2122/97
cgaucuccacccgccggccg

SEQ ID NO: 1053768 - RNA, 20 nt, Mycobacterium bovis subsp bovis AF2122/97
cgaucuccagcgguucggug

SEQ ID NO: 1053769 - RNA, 21 nt, Mycobacterium bovis subsp bovis AF2122/97
cgaucuccaggcccggcggug

SEQ ID NO: 1053770 - RNA, 21 nt, Mycobacterium bovis subsp bovis AF2122/97
cgaucgucgcggccaaggcga

SEQ ID NO: 1053771 - RNA, 20 nt, Mycobacterium bovis subsp bovis AF2122/97
cgaucgauaucggcaaucag

SEQ ID NO: 1053772 - RNA, 23 nt, Mycobacterium bovis subsp bovis AF2122/97
cgaucgucgacucggcggcgcgg

SEQ ID NO: 1053773 - RNA, 22 nt, Mycobacterium bovis subsp bovis AF2122/97
cgaucgucgagccgaucgcccg

SEQ ID NO: 1053774 - RNA, 14 nt, Mycobacterium bovis subsp bovis AF2122/97
cgaucgugacguug

SEQ ID NO: 1053775 - RNA, 17 nt, Mycobacterium bovis subsp bovis AF2122/97
cgaucgucuugucgccg

SEQ ID NO: 1053776 - RNA, 14 nt, Mycobacterium bovis subsp bovis AF2122/97
cgaucgucggguug

SEQ ID NO: 1053777 - RNA, 20 nt, Mycobacterium bovis subsp bovis AF2122/97
cgaucgucggguugucgcgg

SEQ ID NO: 1053778 - RNA, 13 nt, Mycobacterium bovis subsp bovis AF2122/97
cgaucgugcaggu

SEQ ID NO: 1053779 - RNA, 17 nt, Mycobacterium bovis subsp bovis AF2122/97
cgaucgugccgggaccg

SEQ ID NO: 1053780 - RNA, 14 nt, Mycobacterium bovis subsp bovis AF2122/97
cgaucgugcgaucg

SEQ ID NO: 1053781 - RNA, 16 nt, Mycobacterium bovis subsp bovis AF2122/97
cgaucgugcugcccgc

SEQ ID NO: 1053782 - RNA, 13 nt, Mycobacterium bovis subsp bovis AF2122/97
cgaucgacgccgc

SEQ ID NO: 1053783 - RNA, 14 nt, Mycobacterium bovis subsp bovis AF2122/97
cgaucgacgccgcc

SEQ ID NO: 1053784 - RNA, 18 nt, Mycobacterium bovis subsp bovis AF2122/97
cgaucgacgccgccaccc

SEQ ID NO: 1053785 - RNA, 20 nt, Mycobacterium bovis subsp bovis AF2122/97
cgaucgacgccgccacccgg

SEQ ID NO: 1053786 - RNA, 15 nt, Mycobacterium bovis subsp bovis AF2122/97
cgauccgcggcguuc

SEQ ID NO: 1053787 - RNA, 15 nt, Mycobacterium bovis subsp bovis AF2122/97
cgauccggcgcacga

SEQ ID NO: 1053788 - RNA, 12 nt, Mycobacterium bovis subsp bovis AF2122/97
cgauccggcgcc

SEQ ID NO: 1053789 - RNA, 23 nt, Mycobacterium bovis subsp bovis AF2122/97
cgaucgacggugucaugaacgac

SEQ ID NO: 1053790 - RNA, 15 nt, Mycobacterium bovis subsp bovis AF2122/97
cgaucgucgacgcgu

SEQ ID NO: 1053791 - RNA, 19 nt, Mycobacterium bovis subsp bovis AF2122/97
cgaucgucagccagcguug

SEQ ID NO: 1053792 - RNA, 21 nt, Mycobacterium bovis subsp bovis AF2122/97
cgaucgcauggucuucgcgga

SEQ ID NO: 1053793 - RNA, 19 nt, Mycobacterium bovis subsp bovis AF2122/97
cgaucgagcugacgauggc

SEQ ID NO: 1053794 - RNA, 21 nt, Mycobacterium bovis subsp bovis AF2122/97
cgaucgcagugggcaauccgg

SEQ ID NO: 1053795 - RNA, 21 nt, Mycobacterium bovis subsp bovis AF2122/97
cgaucgcauccgcgguuggca

SEQ ID NO: 1053796 - RNA, 23 nt, Mycobacterium bovis subsp bovis AF2122/97
cgaucgaggugauguuggccgcc

SEQ ID NO: 1053797 - RNA, 15 nt, Mycobacterium bovis subsp bovis AF2122/97
cgaucgauuccgcuc

SEQ ID NO: 1053798 - RNA, 20 nt, Mycobacterium bovis subsp bovis AF2122/97
cgaucuguggaagcccgucg

SEQ ID NO: 1053799 - RNA, 20 nt, Mycobacterium bovis subsp bovis AF2122/97
cgaucugugguugcagcaca

SEQ ID NO: 1053800 - RNA, 13 nt, Mycobacterium bovis subsp bovis AF2122/97
cgaucuggucgcc

SEQ ID NO: 1053801 - RNA, 17 nt, Mycobacterium bovis subsp bovis AF2122/97
cgaucugggugccggug

SEQ ID NO: 1053802 - RNA, 23 nt, Mycobacterium bovis subsp bovis AF2122/97
cgaucugguaagucagcucgauc

SEQ ID NO: 1053803 - RNA, 21 nt, Mycobacterium bovis subsp bovis AF2122/97
cgaucuggcguagugcucgcc

SEQ ID NO: 1053804 - RNA, 16 nt, Mycobacterium bovis subsp bovis AF2122/97
cgaucuggccgaacga

SEQ ID NO: 1053805 - RNA, 19 nt, Mycobacterium bovis subsp bovis AF2122/97
cgaugaccagggucugcuc

SEQ ID NO: 1053806 - RNA, 19 nt, Mycobacterium bovis subsp bovis AF2122/97
cgaucugucgcgccggugg

SEQ ID NO: 1053807 - RNA, 18 nt, Mycobacterium bovis subsp bovis AF2122/97
cgaucuucuccucgucgg

SEQ ID NO: 1053808 - RNA, 22 nt, Mycobacterium bovis subsp bovis AF2122/97
cgaugacccggaaucccgaguc

SEQ ID NO: 1053809 - RNA, 20 nt, Mycobacterium bovis subsp bovis AF2122/97
cgaugaccgcaccgaccuga

SEQ ID NO: 1053810 - RNA, 21 nt, Mycobacterium bovis subsp bovis AF2122/97
cgaugaccgaagagcgcgcgc

SEQ ID NO: 1053811 - RNA, 15 nt, Mycobacterium bovis subsp bovis AF2122/97
cgaugaccgcaccga

SEQ ID NO: 1053812 - RNA, 15 nt, Mycobacterium bovis subsp bovis AF2122/97
cgaugaccgccugcu

SEQ ID NO: 1053813 - RNA, 12 nt, Mycobacterium bovis subsp bovis AF2122/97
cgaucugcucgc

SEQ ID NO: 1053814 - RNA, 21 nt, Mycobacterium bovis subsp bovis AF2122/97
cgaucugcggcgcccggucga

SEQ ID NO: 1053815 - RNA, 13 nt, Mycobacterium bovis subsp bovis AF2122/97
cgaucugcuacca

SEQ ID NO: 1053816 - RNA, 20 nt, Mycobacterium bovis subsp bovis AF2122/97
cgaucugcgcgucaggccag

SEQ ID NO: 1053817 - RNA, 18 nt, Mycobacterium bovis subsp bovis AF2122/97
cgaucugcggaggcgggu

SEQ ID NO: 1053818 - RNA, 22 nt, Mycobacterium bovis subsp bovis AF2122/97
cgaucugcgacaagaccggcgg

SEQ ID NO: 1053819 - RNA, 12 nt, Mycobacterium bovis subsp bovis AF2122/97
cgaucugcgcca

SEQ ID NO: 1053820 - RNA, 13 nt, Mycobacterium bovis subsp bovis AF2122/97
cgaucugcccccg

SEQ ID NO: 1053821 - RNA, 19 nt, Mycobacterium bovis subsp bovis AF2122/97
cgaucugcccccgccggcc

SEQ ID NO: 1053822 - RNA, 20 nt, Mycobacterium bovis subsp bovis AF2122/97
cgaucugcccccgccggccg

SEQ ID NO: 1053823 - RNA, 20 nt, Mycobacterium bovis subsp bovis AF2122/97
cgaucugcugcucgaucauc

SEQ ID NO: 1053824 - RNA, 15 nt, Mycobacterium bovis subsp bovis AF2122/97
cgaucuggcagccga

SEQ ID NO: 1053825 - RNA, 23 nt, Mycobacterium bovis subsp bovis AF2122/97
cgaucugcugugucguacccggc

SEQ ID NO: 1053826 - RNA, 19 nt, Mycobacterium bovis subsp bovis AF2122/97
cgaucucgccgccagcgcu

SEQ ID NO: 1053827 - RNA, 23 nt, Mycobacterium bovis subsp bovis AF2122/97
cgaucucgccggcgaagaccgcc

SEQ ID NO: 1053828 - RNA, 21 nt, Mycobacterium bovis subsp bovis AF2122/97
cgaucucgcccagcgagcgcc

SEQ ID NO: 1053829 - RNA, 20 nt, Mycobacterium bovis subsp bovis AF2122/97
cgaucugacugacggucauu

SEQ ID NO: 1053830 - RNA, 16 nt, Mycobacterium bovis subsp bovis AF2122/97
cgaugccucggcggcc

SEQ ID NO: 1053831 - RNA, 17 nt, Mycobacterium bovis subsp bovis AF2122/97
cgaugccuugaccgcgg

SEQ ID NO: 1053832 - RNA, 13 nt, Mycobacterium bovis subsp bovis AF2122/97
cgaugcgacgcag

SEQ ID NO: 1053833 - RNA, 13 nt, Mycobacterium bovis subsp bovis AF2122/97
cgaugcgacgaac

SEQ ID NO: 1053834 - RNA, 17 nt, Mycobacterium bovis subsp bovis AF2122/97
cgaugcgcaccagcggc

SEQ ID NO: 1053835 - RNA, 13 nt, Mycobacterium bovis subsp bovis AF2122/97
cgaugcgcaccag

SEQ ID NO: 1053836 - RNA, 22 nt, Mycobacterium bovis subsp bovis AF2122/97
cgaugcgcaccagcaccugcac

SEQ ID NO: 1053837 - RNA, 16 nt, Mycobacterium bovis subsp bovis AF2122/97
cgaugcgaucgacgau

SEQ ID NO: 1053838 - RNA, 21 nt, Mycobacterium bovis subsp bovis AF2122/97
cgaugcgauuccgcgucugcu

SEQ ID NO: 1053839 - RNA, 20 nt, Mycobacterium bovis subsp bovis AF2122/97
cgaugcgauucugcgucugc

SEQ ID NO: 1053840 - RNA, 21 nt, Mycobacterium bovis subsp bovis AF2122/97
cgaugcgauucugcgucugcu

SEQ ID NO: 1053841 - RNA, 15 nt, Mycobacterium bovis subsp bovis AF2122/97
cgaugcgcacaccga

SEQ ID NO: 1053842 - RNA, 22 nt, Mycobacterium bovis subsp bovis AF2122/97
cgaugccguguucgauagcggc

SEQ ID NO: 1053843 - RNA, 14 nt, Mycobacterium bovis subsp bovis AF2122/97
cgaugccgugccgg

SEQ ID NO: 1053844 - RNA, 16 nt, Mycobacterium bovis subsp bovis AF2122/97
cgaugccgugcugggc

SEQ ID NO: 1053845 - RNA, 22 nt, Mycobacterium bovis subsp bovis AF2122/97
cgaugccguaggcggccaguug

SEQ ID NO: 1053846 - RNA, 19 nt, Mycobacterium bovis subsp bovis AF2122/97
cgaugccgugcccggugcg

SEQ ID NO: 1053847 - RNA, 12 nt, Mycobacterium bovis subsp bovis AF2122/97
cgaugccggccc

SEQ ID NO: 1053848 - RNA, 18 nt, Mycobacterium bovis subsp bovis AF2122/97
cgaugccggcgagggcca

SEQ ID NO: 1053849 - RNA, 14 nt, Mycobacterium bovis subsp bovis AF2122/97
cgaugccggcugcc

SEQ ID NO: 1053850 - RNA, 16 nt, Mycobacterium bovis subsp bovis AF2122/97
cgaugccggcugccgc

SEQ ID NO: 1053851 - RNA, 20 nt, Mycobacterium bovis subsp bovis AF2122/97
cgaugccggcuggcggcgug

SEQ ID NO: 1053852 - RNA, 14 nt, Mycobacterium bovis subsp bovis AF2122/97
cgaugcgcagcccg

SEQ ID NO: 1053853 - RNA, 16 nt, Mycobacterium bovis subsp bovis AF2122/97
cgaugcgcagcccguc

SEQ ID NO: 1053854 - RNA, 18 nt, Mycobacterium bovis subsp bovis AF2122/97
cgaugcgcagugcaccgc

SEQ ID NO: 1053855 - RNA, 20 nt, Mycobacterium bovis subsp bovis AF2122/97
cgaugcgcacucccggcucg

SEQ ID NO: 1053856 - RNA, 13 nt, Mycobacterium bovis subsp bovis AF2122/97
cgaugcgcgccga

SEQ ID NO: 1053857 - RNA, 16 nt, Mycobacterium bovis subsp bovis AF2122/97
cgaugcgcgccggcuu

SEQ ID NO: 1053858 - RNA, 16 nt, Mycobacterium bovis subsp bovis AF2122/97
cgaugcgcgcggcgcg

SEQ ID NO: 1053859 - RNA, 17 nt, Mycobacterium bovis subsp bovis AF2122/97
cgaugcgcgcggcgcga

SEQ ID NO: 1053860 - RNA, 22 nt, Mycobacterium bovis subsp bovis AF2122/97
cgaugcgcgcggcgcgaucguc

SEQ ID NO: 1053861 - RNA, 21 nt, Mycobacterium bovis subsp bovis AF2122/97
cgaugcgcugcucacgcagca

SEQ ID NO: 1053862 - RNA, 16 nt, Mycobacterium bovis subsp bovis AF2122/97
cgaugcgcugcucacg

SEQ ID NO: 1053863 - RNA, 19 nt, Mycobacterium bovis subsp bovis AF2122/97
cgaugcgcucacugcagcg

SEQ ID NO: 1053864 - RNA, 15 nt, Mycobacterium bovis subsp bovis AF2122/97
cgaugccgccggccc

SEQ ID NO: 1053865 - RNA, 20 nt, Mycobacterium bovis subsp bovis AF2122/97
cgaugccgccggccccgccg

SEQ ID NO: 1053866 - RNA, 15 nt, Mycobacterium bovis subsp bovis AF2122/97
cgaugccgccggcgg

SEQ ID NO: 1053867 - RNA, 12 nt, Mycobacterium bovis subsp bovis AF2122/97
cgaugccggcca

SEQ ID NO: 1053868 - RNA, 19 nt, Mycobacterium bovis subsp bovis AF2122/97
cgaugccggccaagguggu

SEQ ID NO: 1053869 - RNA, 14 nt, Mycobacterium bovis subsp bovis AF2122/97
cgaugccgaugccc

SEQ ID NO: 1053870 - RNA, 22 nt, Mycobacterium bovis subsp bovis AF2122/97
cgaugccgaggaucgcgccuau

SEQ ID NO: 1053871 - RNA, 23 nt, Mycobacterium bovis subsp bovis AF2122/97
cgaugcaucggugcagcccgccg

SEQ ID NO: 1053872 - RNA, 24 nt, Mycobacterium bovis subsp bovis AF2122/97
cgaugccgauuacggugaucgccg

SEQ ID NO: 1053873 - RNA, 23 nt, Mycobacterium bovis subsp bovis AF2122/97
cgaugccgaagcccccgacguug

SEQ ID NO: 1053874 - RNA, 21 nt, Mycobacterium bovis subsp bovis AF2122/97
cgaugcccacgcacagcaacg

SEQ ID NO: 1053875 - RNA, 20 nt, Mycobacterium bovis subsp bovis AF2122/97
cgaugcccaagcccucgacg

SEQ ID NO: 1053876 - RNA, 13 nt, Mycobacterium bovis subsp bovis AF2122/97
cgaugaccgggga

SEQ ID NO: 1053877 - RNA, 18 nt, Mycobacterium bovis subsp bovis AF2122/97
cgaugaccgucgcacccu

SEQ ID NO: 1053878 - RNA, 17 nt, Mycobacterium bovis subsp bovis AF2122/97
cgaugaccucggcgaug

SEQ ID NO: 1053879 - RNA, 13 nt, Mycobacterium bovis subsp bovis AF2122/97
cgaugaccgcgcg

SEQ ID NO: 1053880 - RNA, 19 nt, Mycobacterium bovis subsp bovis AF2122/97
cgaugaccgcgcggcccgc

SEQ ID NO: 1053881 - RNA, 18 nt, Mycobacterium bovis subsp bovis AF2122/97
cgaugaccuugcccacca

SEQ ID NO: 1053882 - RNA, 17 nt, Mycobacterium bovis subsp bovis AF2122/97
cgaugcaccccaugacc

SEQ ID NO: 1053883 - RNA, 21 nt, Mycobacterium bovis subsp bovis AF2122/97
cgaugcaccccaugaccggga

SEQ ID NO: 1053884 - RNA, 21 nt, Mycobacterium bovis subsp bovis AF2122/97
cgaugcagcgcgcccugcgcg

SEQ ID NO: 1053885 - RNA, 22 nt, Mycobacterium bovis subsp bovis AF2122/97
cgaugcagugcgacccgggcgu

SEQ ID NO: 1053886 - RNA, 13 nt, Mycobacterium bovis subsp bovis AF2122/97
cgaugcaucggug

SEQ ID NO: 1053887 - RNA, 21 nt, Mycobacterium bovis subsp bovis AF2122/97
cgaugcauggcuugcucugcg

SEQ ID NO: 1053888 - RNA, 20 nt, Mycobacterium bovis subsp bovis AF2122/97
cgauggagaaguuagccacc

SEQ ID NO: 1053889 - RNA, 21 nt, Mycobacterium bovis subsp bovis AF2122/97
cgauggagaaguuagccaccu

SEQ ID NO: 1053890 - RNA, 21 nt, Mycobacterium bovis subsp bovis AF2122/97
cgauggaguucucaucgccaa

SEQ ID NO: 1053891 - RNA, 22 nt, Mycobacterium bovis subsp bovis AF2122/97
cgauggaugggcugcgcgucga

SEQ ID NO: 1053892 - RNA, 17 nt, Mycobacterium bovis subsp bovis AF2122/97
cgauggauuggcgucag

SEQ ID NO: 1053893 - RNA, 16 nt, Mycobacterium bovis subsp bovis AF2122/97
cgauggcaucggccau

SEQ ID NO: 1053894 - RNA, 16 nt, Mycobacterium bovis subsp bovis AF2122/97
cgauggcaccggcgug

SEQ ID NO: 1053895 - RNA, 22 nt, Mycobacterium bovis subsp bovis AF2122/97
cgauggcaccggcgugguagac

SEQ ID NO: 1053896 - RNA, 15 nt, Mycobacterium bovis subsp bovis AF2122/97
cgauggcaucucgau

SEQ ID NO: 1053897 - RNA, 13 nt, Mycobacterium bovis subsp bovis AF2122/97
cgauggcaugggc

SEQ ID NO: 1053898 - RNA, 15 nt, Mycobacterium bovis subsp bovis AF2122/97
cgauggcgcaccggc

SEQ ID NO: 1053899 - RNA, 13 nt, Mycobacterium bovis subsp bovis AF2122/97
cgauggcgcaccg

SEQ ID NO: 1053900 - RNA, 21 nt, Mycobacterium bovis subsp bovis AF2122/97
cgauggcgaugagguggccgc

SEQ ID NO: 1053901 - RNA, 22 nt, Mycobacterium bovis subsp bovis AF2122/97
cgaugcggcgucgaacugccgg

SEQ ID NO: 1053902 - RNA, 13 nt, Mycobacterium bovis subsp bovis AF2122/97
cgaugcggcguug

SEQ ID NO: 1053903 - RNA, 15 nt, Mycobacterium bovis subsp bovis AF2122/97
cgaugcgggcgacga

SEQ ID NO: 1053904 - RNA, 14 nt, Mycobacterium bovis subsp bovis AF2122/97
cgaugcgggccgcc

SEQ ID NO: 1053905 - RNA, 15 nt, Mycobacterium bovis subsp bovis AF2122/97
cgaugcggguggcgc

SEQ ID NO: 1053906 - RNA, 21 nt, Mycobacterium bovis subsp bovis AF2122/97
cgaugcggguggcgccggugc

SEQ ID NO: 1053907 - RNA, 21 nt, Mycobacterium bovis subsp bovis AF2122/97
cgaugcgguauugcccgggcg

SEQ ID NO: 1053908 - RNA, 22 nt, Mycobacterium bovis subsp bovis AF2122/97
cgaugcgguaucggucgacugg

SEQ ID NO: 1053909 - RNA, 14 nt, Mycobacterium bovis subsp bovis AF2122/97
cgaugcgguaucgg

SEQ ID NO: 1053910 - RNA, 15 nt, Mycobacterium bovis subsp bovis AF2122/97
cgaugcggucgacgg

SEQ ID NO: 1053911 - RNA, 16 nt, Mycobacterium bovis subsp bovis AF2122/97
cgaugcggucgacggg

SEQ ID NO: 1053912 - RNA, 23 nt, Mycobacterium bovis subsp bovis AF2122/97
cgaugcggugaauccgugcaggg

SEQ ID NO: 1053913 - RNA, 23 nt, Mycobacterium bovis subsp bovis AF2122/97
cgaugcuucccggaugccgaccu

SEQ ID NO: 1053914 - RNA, 12 nt, Mycobacterium bovis subsp bovis AF2122/97
cgaugcggugua

SEQ ID NO: 1053915 - RNA, 14 nt, Mycobacterium bovis subsp bovis AF2122/97
cgaugcggugucgg

SEQ ID NO: 1053916 - RNA, 14 nt, Mycobacterium bovis subsp bovis AF2122/97
cgaugcgguucucg

SEQ ID NO: 1053917 - RNA, 13 nt, Mycobacterium bovis subsp bovis AF2122/97
cgauggaccgcac

SEQ ID NO: 1053918 - RNA, 22 nt, Mycobacterium bovis subsp bovis AF2122/97
cgaugcuuucguauucggccgc

SEQ ID NO: 1053919 - RNA, 16 nt, Mycobacterium bovis subsp bovis AF2122/97
cgauggugugcccgca

SEQ ID NO: 1053920 - RNA, 21 nt, Mycobacterium bovis subsp bovis AF2122/97
cgaugguguuauuccacucgg

SEQ ID NO: 1053921 - RNA, 16 nt, Mycobacterium bovis subsp bovis AF2122/97
cgaugguggccgcgcg

SEQ ID NO: 1053922 - RNA, 21 nt, Mycobacterium bovis subsp bovis AF2122/97
cgaugggagcccggcggcccg

SEQ ID NO: 1053923 - RNA, 22 nt, Mycobacterium bovis subsp bovis AF2122/97
cgaugguagucgcgaccgcggg

SEQ ID NO: 1053924 - RNA, 20 nt, Mycobacterium bovis subsp bovis AF2122/97
cgaugguacccgcgccgcgc

SEQ ID NO: 1053925 - RNA, 20 nt, Mycobacterium bovis subsp bovis AF2122/97
cgauggguguugcuggccgc

SEQ ID NO: 1053926 - RNA, 15 nt, Mycobacterium bovis subsp bovis AF2122/97
cgaugggugacggug

SEQ ID NO: 1053927 - RNA, 21 nt, Mycobacterium bovis subsp bovis AF2122/97
cgaugggugacgguggccggc

SEQ ID NO: 1053928 - RNA, 15 nt, Mycobacterium bovis subsp bovis AF2122/97
cgaugggugcaccga

SEQ ID NO: 1053929 - RNA, 18 nt, Mycobacterium bovis subsp bovis AF2122/97
cgauggcggccaccagcg

SEQ ID NO: 1053930 - RNA, 18 nt, Mycobacterium bovis subsp bovis AF2122/97
cgauggggacggcggcga

SEQ ID NO: 1053931 - RNA, 19 nt, Mycobacterium bovis subsp bovis AF2122/97
cgauggggacggcggcgag

SEQ ID NO: 1053932 - RNA, 13 nt, Mycobacterium bovis subsp bovis AF2122/97
cgauggcggccac

SEQ ID NO: 1053933 - RNA, 17 nt, Mycobacterium bovis subsp bovis AF2122/97
cgauggcggccaccagc

SEQ ID NO: 1053934 - RNA, 19 nt, Mycobacterium bovis subsp bovis AF2122/97
cgauggcggccaccagcgc

SEQ ID NO: 1053935 - RNA, 22 nt, Mycobacterium bovis subsp bovis AF2122/97
cgauggcggccaccgucagcgc

SEQ ID NO: 1053936 - RNA, 18 nt, Mycobacterium bovis subsp bovis AF2122/97
cgauggcucacaugcccg

SEQ ID NO: 1053937 - RNA, 20 nt, Mycobacterium bovis subsp bovis AF2122/97
cgauggcucacaugcccgca

SEQ ID NO: 1053938 - RNA, 21 nt, Mycobacterium bovis subsp bovis AF2122/97
cgaugugcacggugugcacgg

SEQ ID NO: 1053939 - RNA, 17 nt, Mycobacterium bovis subsp bovis AF2122/97
cgauguggccggcgaug

SEQ ID NO: 1053940 - RNA, 20 nt, Mycobacterium bovis subsp bovis AF2122/97
cgauguggguuaccuggacc

SEQ ID NO: 1053941 - RNA, 14 nt, Mycobacterium bovis subsp bovis AF2122/97
cgaugugguccauc

SEQ ID NO: 1053942 - RNA, 17 nt, Mycobacterium bovis subsp bovis AF2122/97
cgauguaccccagcgcc

SEQ ID NO: 1053943 - RNA, 22 nt, Mycobacterium bovis subsp bovis AF2122/97
cgaugguggugccaaccugggc

SEQ ID NO: 1053944 - RNA, 20 nt, Mycobacterium bovis subsp bovis AF2122/97
cgaugguggugccgaccugu

SEQ ID NO: 1053945 - RNA, 23 nt, Mycobacterium bovis subsp bovis AF2122/97
cgaugguugccuuguucgcccac

SEQ ID NO: 1053946 - RNA, 20 nt, Mycobacterium bovis subsp bovis AF2122/97
cgaugugaaccgggcaccac

SEQ ID NO: 1053947 - RNA, 13 nt, Mycobacterium bovis subsp bovis AF2122/97
cgauguccacgcc

SEQ ID NO: 1053948 - RNA, 23 nt, Mycobacterium bovis subsp bovis AF2122/97
cgaugucagcggccgcgacguug

SEQ ID NO: 1053949 - RNA, 17 nt, Mycobacterium bovis subsp bovis AF2122/97
cgauguauccgaugcga

SEQ ID NO: 1053950 - RNA, 20 nt, Mycobacterium bovis subsp bovis AF2122/97
cgaugucagccaccaucugg

SEQ ID NO: 1053951 - RNA, 22 nt, Mycobacterium bovis subsp bovis AF2122/97
cgauuuugcgucugcucggcgc

SEQ ID NO: 1053952 - RNA, 20 nt, Mycobacterium bovis subsp bovis AF2122/97
cgauuuugugucugcucgcc

SEQ ID NO: 1053953 - RNA, 17 nt, Mycobacterium bovis subsp bovis AF2122/97
cgcaaaggccccgguga

SEQ ID NO: 1053954 - RNA, 12 nt, Mycobacterium bovis subsp bovis AF2122/97
cgauuucggcgc

SEQ ID NO: 1053955 - RNA, 13 nt, Mycobacterium bovis subsp bovis AF2122/97
cgauuucggcgcc

SEQ ID NO: 1053956 - RNA, 19 nt, Mycobacterium bovis subsp bovis AF2122/97
cgauuucggcggcgaggcg

SEQ ID NO: 1053957 - RNA, 20 nt, Mycobacterium bovis subsp bovis AF2122/97
cgauuuugcgucugcucgcg

SEQ ID NO: 1053958 - RNA, 19 nt, Mycobacterium bovis subsp bovis AF2122/97
cgauuuugcgucugcucgg

SEQ ID NO: 1053959 - RNA, 20 nt, Mycobacterium bovis subsp bovis AF2122/97
cgauuuugcgucugcucggc

SEQ ID NO: 1053960 - RNA, 17 nt, Mycobacterium bovis subsp bovis AF2122/97
cgcaacacugaguucgg

SEQ ID NO: 1053961 - RNA, 23 nt, Mycobacterium bovis subsp bovis AF2122/97
cgcaacaccggugucggccagca

SEQ ID NO: 1053962 - RNA, 17 nt, Mycobacterium bovis subsp bovis AF2122/97
cgcaacaacgccgcgac

SEQ ID NO: 1053963 - RNA, 16 nt, Mycobacterium bovis subsp bovis AF2122/97
cgcaacaaccgguugg

SEQ ID NO: 1053964 - RNA, 15 nt, Mycobacterium bovis subsp bovis AF2122/97
cgcaacaggccaacu

SEQ ID NO: 1053965 - RNA, 20 nt, Mycobacterium bovis subsp bovis AF2122/97
cgcaacggauaacccguggc

SEQ ID NO: 1053966 - RNA, 13 nt, Mycobacterium bovis subsp bovis AF2122/97
cgcaacgcuucgg

SEQ ID NO: 1053967 - RNA, 18 nt, Mycobacterium bovis subsp bovis AF2122/97
cgcaacgcuucggcagcu

SEQ ID NO: 1053968 - RNA, 13 nt, Mycobacterium bovis subsp bovis AF2122/97
cgcaacgcgucgg

SEQ ID NO: 1053969 - RNA, 20 nt, Mycobacterium bovis subsp bovis AF2122/97
cgauucagcgccccaugcaa

SEQ ID NO: 1053970 - RNA, 17 nt, Mycobacterium bovis subsp bovis AF2122/97
cgauuaccggcacgccg

SEQ ID NO: 1053971 - RNA, 18 nt, Mycobacterium bovis subsp bovis AF2122/97
cgauuacgacuuggugca

SEQ ID NO: 1053972 - RNA, 14 nt, Mycobacterium bovis subsp bovis AF2122/97
cgauuaccagcggc

SEQ ID NO: 1053973 - RNA, 20 nt, Mycobacterium bovis subsp bovis AF2122/97
cgauuaccagcggcaccgcg

SEQ ID NO: 1053974 - RNA, 16 nt, Mycobacterium bovis subsp bovis AF2122/97
cgauguucgccgcgcg

SEQ ID NO: 1053975 - RNA, 19 nt, Mycobacterium bovis subsp bovis AF2122/97
cgauguucgccgcgcggaa

SEQ ID NO: 1053976 - RNA, 15 nt, Mycobacterium bovis subsp bovis AF2122/97
cgauguuggcagggc

SEQ ID NO: 1053977 - RNA, 20 nt, Mycobacterium bovis subsp bovis AF2122/97
cgauguuggcagggccagcg

SEQ ID NO: 1053978 - RNA, 17 nt, Mycobacterium bovis subsp bovis AF2122/97
cgauguuggccagcgcg

SEQ ID NO: 1053979 - RNA, 19 nt, Mycobacterium bovis subsp bovis AF2122/97
cgauugcagcuucggccag

SEQ ID NO: 1053980 - RNA, 20 nt, Mycobacterium bovis subsp bovis AF2122/97
cgauucugugucugcucggc

SEQ ID NO: 1053981 - RNA, 18 nt, Mycobacterium bovis subsp bovis AF2122/97
cgauugaguucggcggcc

SEQ ID NO: 1053982 - RNA, 15 nt, Mycobacterium bovis subsp bovis AF2122/97
cgauuucgacgacca

SEQ ID NO: 1053983 - RNA, 14 nt, Mycobacterium bovis subsp bovis AF2122/97
cgauuucgaucaca

SEQ ID NO: 1053984 - RNA, 18 nt, Mycobacterium bovis subsp bovis AF2122/97
cgauucgucgcggaucag

SEQ ID NO: 1053985 - RNA, 15 nt, Mycobacterium bovis subsp bovis AF2122/97
cgauucggcggccgu

SEQ ID NO: 1053986 - RNA, 16 nt, Mycobacterium bovis subsp bovis AF2122/97
cgauucgggcgucggg

SEQ ID NO: 1053987 - RNA, 22 nt, Mycobacterium bovis subsp bovis AF2122/97
cgauucgucgcggaucagcccg

SEQ ID NO: 1053988 - RNA, 17 nt, Mycobacterium bovis subsp bovis AF2122/97
cgauucgugucggugcg

SEQ ID NO: 1053989 - RNA, 20 nt, Mycobacterium bovis subsp bovis AF2122/97
cgauucugugucugcucgcg

SEQ ID NO: 1053990 - RNA, 13 nt, Mycobacterium bovis subsp bovis AF2122/97
cgauucuggccgg

SEQ ID NO: 1053991 - RNA, 14 nt, Mycobacterium bovis subsp bovis AF2122/97
cgauucuggccgga

SEQ ID NO: 1053992 - RNA, 21 nt, Mycobacterium bovis subsp bovis AF2122/97
cgauucuggccggaugccacg

SEQ ID NO: 1053993 - RNA, 20 nt, Mycobacterium bovis subsp bovis AF2122/97
cgauucugcguccugcucgc

SEQ ID NO: 1053994 - RNA, 19 nt, Mycobacterium bovis subsp bovis AF2122/97
cgauucugcgucugcucgc

SEQ ID NO: 1053995 - RNA, 21 nt, Mycobacterium bovis subsp bovis AF2122/97
cgauucugcgucugcucgccg

SEQ ID NO: 1053996 - RNA, 20 nt, Mycobacterium bovis subsp bovis AF2122/97
cgauucugcgucugcucgcg

SEQ ID NO: 1053997 - RNA, 20 nt, Mycobacterium bovis subsp bovis AF2122/97
cgauucugcgucugcucggc

SEQ ID NO: 1053998 - RNA, 15 nt, Mycobacterium bovis subsp bovis AF2122/97
ccuggcgaaugucgc

SEQ ID NO: 1053999 - RNA, 17 nt, Mycobacterium bovis subsp bovis AF2122/97
ccuggccgucgcuggug

SEQ ID NO: 1054000 - RNA, 23 nt, Mycobacterium bovis subsp bovis AF2122/97
ccuggccgcccagaccgccgacg

SEQ ID NO: 1054001 - RNA, 22 nt, Mycobacterium bovis subsp bovis AF2122/97
ccuggccggugguagcggacag

SEQ ID NO: 1054002 - RNA, 12 nt, Mycobacterium bovis subsp bovis AF2122/97
ccuggcgagcca

SEQ ID NO: 1054003 - RNA, 22 nt, Mycobacterium bovis subsp bovis AF2122/97
ccuggccugcccagcaccaccg

SEQ ID NO: 1054004 - RNA, 16 nt, Mycobacterium bovis subsp bovis AF2122/97
ccuggcgacgcgacac

SEQ ID NO: 1054005 - RNA, 22 nt, Mycobacterium bovis subsp bovis AF2122/97
ccuggcggguaagcgaccgacg

SEQ ID NO: 1054006 - RNA, 20 nt, Mycobacterium bovis subsp bovis AF2122/97
ccuggcgggcgccuuggucg

SEQ ID NO: 1054007 - RNA, 14 nt, Mycobacterium bovis subsp bovis AF2122/97
ccuggcgugucgcc

SEQ ID NO: 1054008 - RNA, 23 nt, Mycobacterium bovis subsp bovis AF2122/97
ccuggcggaacagcuucgcgcag

SEQ ID NO: 1054009 - RNA, 14 nt, Mycobacterium bovis subsp bovis AF2122/97
ccuggcccgccacg

SEQ ID NO: 1054010 - RNA, 19 nt, Mycobacterium bovis subsp bovis AF2122/97
ccuggcccccagguaaccc

SEQ ID NO: 1054011 - RNA, 12 nt, Mycobacterium bovis subsp bovis AF2122/97
ccuggccgccgg

SEQ ID NO: 1054012 - RNA, 13 nt, Mycobacterium bovis subsp bovis AF2122/97
ccuggccgccggc

SEQ ID NO: 1054013 - RNA, 19 nt, Mycobacterium bovis subsp bovis AF2122/97
ccuggccgcccuggccgcc

SEQ ID NO: 1054014 - RNA, 14 nt, Mycobacterium bovis subsp bovis AF2122/97
ccuggccgccggcg

SEQ ID NO: 1054015 - RNA, 13 nt, Mycobacterium bovis subsp bovis AF2122/97
ccugccgccggcc

SEQ ID NO: 1054016 - RNA, 15 nt, Mycobacterium bovis subsp bovis AF2122/97
ccugccggcagcggc

SEQ ID NO: 1054017 - RNA, 21 nt, Mycobacterium bovis subsp bovis AF2122/97
ccugccggcagcggcgaguug

SEQ ID NO: 1054018 - RNA, 13 nt, Mycobacterium bovis subsp bovis AF2122/97
ccugccgaucggg

SEQ ID NO: 1054019 - RNA, 18 nt, Mycobacterium bovis subsp bovis AF2122/97
ccugccgaugacgauggc

SEQ ID NO: 1054020 - RNA, 20 nt, Mycobacterium bovis subsp bovis AF2122/97
ccugcccgucgucggcaacc

SEQ ID NO: 1054021 - RNA, 13 nt, Mycobacterium bovis subsp bovis AF2122/97
ccugccgacggca

SEQ ID NO: 1054022 - RNA, 13 nt, Mycobacterium bovis subsp bovis AF2122/97
ccugcccggcgcc

SEQ ID NO: 1054023 - RNA, 14 nt, Mycobacterium bovis subsp bovis AF2122/97
ccugcccggcgccg

SEQ ID NO: 1054024 - RNA, 22 nt, Mycobacterium bovis subsp bovis AF2122/97
ccugguaaggccggccgguggc

SEQ ID NO: 1054025 - RNA, 21 nt, Mycobacterium bovis subsp bovis AF2122/97
ccuggguuggugauugcggcc

SEQ ID NO: 1054026 - RNA, 22 nt, Mycobacterium bovis subsp bovis AF2122/97
ccuggguuggugauugcggccg

SEQ ID NO: 1054027 - RNA, 16 nt, Mycobacterium bovis subsp bovis AF2122/97
ccuggguugugccgcc

SEQ ID NO: 1054028 - RNA, 15 nt, Mycobacterium bovis subsp bovis AF2122/97
ccugguaaggccggc

SEQ ID NO: 1054029 - RNA, 16 nt, Mycobacterium bovis subsp bovis AF2122/97
ccugguaaggccggcc

SEQ ID NO: 1054030 - RNA, 20 nt, Mycobacterium bovis subsp bovis AF2122/97
ccugguaaggccggccggug

SEQ ID NO: 1054031 - RNA, 14 nt, Mycobacterium bovis subsp bovis AF2122/97
ccuggucaaccgcg

SEQ ID NO: 1054032 - RNA, 18 nt, Mycobacterium bovis subsp bovis AF2122/97
ccugguagcacccacggc

SEQ ID NO: 1054033 - RNA, 18 nt, Mycobacterium bovis subsp bovis AF2122/97
ccuggguauccaccgcga

SEQ ID NO: 1054034 - RNA, 19 nt, Mycobacterium bovis subsp bovis AF2122/97
ccugggguagccaucggcu

SEQ ID NO: 1054035 - RNA, 20 nt, Mycobacterium bovis subsp bovis AF2122/97
ccuggggguggcagcgcggc

SEQ ID NO: 1054036 - RNA, 14 nt, Mycobacterium bovis subsp bovis AF2122/97
ccuggggccguccg

SEQ ID NO: 1054037 - RNA, 16 nt, Mycobacterium bovis subsp bovis AF2122/97
ccuggggccguccggc

SEQ ID NO: 1054038 - RNA, 18 nt, Mycobacterium bovis subsp bovis AF2122/97
ccuggguggcgucgcggu

SEQ ID NO: 1054039 - RNA, 17 nt, Mycobacterium bovis subsp bovis AF2122/97
ccugggugucgcggguu

SEQ ID NO: 1054040 - RNA, 23 nt, Mycobacterium bovis subsp bovis AF2122/97
ccugggugauggccgcgcccgcc

SEQ ID NO: 1054041 - RNA, 22 nt, Mycobacterium bovis subsp bovis AF2122/97
ccugggcaaacugggcaccggc

SEQ ID NO: 1054042 - RNA, 14 nt, Mycobacterium bovis subsp bovis AF2122/97
ccugggaaugacgg

SEQ ID NO: 1054043 - RNA, 15 nt, Mycobacterium bovis subsp bovis AF2122/97
ccugggccgccgccc

SEQ ID NO: 1054044 - RNA, 18 nt, Mycobacterium bovis subsp bovis AF2122/97
ccugggccaucacgguca

SEQ ID NO: 1054045 - RNA, 17 nt, Mycobacterium bovis subsp bovis AF2122/97
ccugggcgggcuuggcg

SEQ ID NO: 1054046 - RNA, 13 nt, Mycobacterium bovis subsp bovis AF2122/97
ccugggcuuggcg

SEQ ID NO: 1054047 - RNA, 19 nt, Mycobacterium bovis subsp bovis AF2122/97
ccugggcgcgcuggcgggc

SEQ ID NO: 1054048 - RNA, 22 nt, Mycobacterium bovis subsp bovis AF2122/97
ccugggcgauauuggacgcgca

SEQ ID NO: 1054049 - RNA, 12 nt, Mycobacterium bovis subsp bovis AF2122/97
ccugguccaccc

SEQ ID NO: 1054050 - RNA, 14 nt, Mycobacterium bovis subsp bovis AF2122/97
ccuggucccaccgc

SEQ ID NO: 1054051 - RNA, 14 nt, Mycobacterium bovis subsp bovis AF2122/97
ccuggucgcgcagc

SEQ ID NO: 1054052 - RNA, 20 nt, Mycobacterium bovis subsp bovis AF2122/97
ccuggugagauugguggccc

SEQ ID NO: 1054053 - RNA, 13 nt, Mycobacterium bovis subsp bovis AF2122/97
ccuggucggccgc

SEQ ID NO: 1054054 - RNA, 20 nt, Mycobacterium bovis subsp bovis AF2122/97
ccuggucgcuggugcacggc

SEQ ID NO: 1054055 - RNA, 13 nt, Mycobacterium bovis subsp bovis AF2122/97
ccuggucggccag

SEQ ID NO: 1054056 - RNA, 15 nt, Mycobacterium bovis subsp bovis AF2122/97
ccugguugcugacga

SEQ ID NO: 1054057 - RNA, 17 nt, Mycobacterium bovis subsp bovis AF2122/97
ccugguugaggucaccc

SEQ ID NO: 1054058 - RNA, 18 nt, Mycobacterium bovis subsp bovis AF2122/97
ccugguugaggucacccg

SEQ ID NO: 1054059 - RNA, 17 nt, Mycobacterium bovis subsp bovis AF2122/97
ccugguguccgagcggc

SEQ ID NO: 1054060 - RNA, 15 nt, Mycobacterium bovis subsp bovis AF2122/97
ccugguuccagaggc

SEQ ID NO: 1054061 - RNA, 19 nt, Mycobacterium bovis subsp bovis AF2122/97
ccugguucgacucaugccg

SEQ ID NO: 1054062 - RNA, 20 nt, Mycobacterium bovis subsp bovis AF2122/97
ccugguucgacucaugccga

SEQ ID NO: 1054063 - RNA, 22 nt, Mycobacterium bovis subsp bovis AF2122/97
ccugguguucgggcagcuggcg

SEQ ID NO: 1054064 - RNA, 18 nt, Mycobacterium bovis subsp bovis AF2122/97
ccugguggacucgggcgc

SEQ ID NO: 1054065 - RNA, 19 nt, Mycobacterium bovis subsp bovis AF2122/97
ccugguguacacacccgcc

SEQ ID NO: 1054066 - RNA, 12 nt, Mycobacterium bovis subsp bovis AF2122/97
ccugguggcggg

SEQ ID NO: 1054067 - RNA, 15 nt, Mycobacterium bovis subsp bovis AF2122/97
ccugguuggugacgu

SEQ ID NO: 1054068 - RNA, 20 nt, Mycobacterium bovis subsp bovis AF2122/97
ccugguuguccguaucgggc

SEQ ID NO: 1054069 - RNA, 24 nt, Mycobacterium bovis subsp bovis AF2122/97
ccuguagaucagcagcggcgaccg

SEQ ID NO: 1054070 - RNA, 21 nt, Mycobacterium bovis subsp bovis AF2122/97
cgaaagcgccgaaacagcacc

SEQ ID NO: 1054071 - RNA, 17 nt, Mycobacterium bovis subsp bovis AF2122/97
cgaaaguccugcagugc

SEQ ID NO: 1054072 - RNA, 13 nt, Mycobacterium bovis subsp bovis AF2122/97
cgaaauacccagc

SEQ ID NO: 1054073 - RNA, 19 nt, Mycobacterium bovis subsp bovis AF2122/97
cgaaauacccagcgcagca

SEQ ID NO: 1054074 - RNA, 21 nt, Mycobacterium bovis subsp bovis AF2122/97
cgaaauacccagcgcagcagc

SEQ ID NO: 1054075 - RNA, 14 nt, Mycobacterium bovis subsp bovis AF2122/97
cgaaaucagcccgc

SEQ ID NO: 1054076 - RNA, 19 nt, Mycobacterium bovis subsp bovis AF2122/97
cgaaaucagcccgcccaau

SEQ ID NO: 1054077 - RNA, 22 nt, Mycobacterium bovis subsp bovis AF2122/97
cgaaauccccugcgcugcagcu

SEQ ID NO: 1054078 - RNA, 17 nt, Mycobacterium bovis subsp bovis AF2122/97
cgaaauccgccgggcgc

SEQ ID NO: 1054079 - RNA, 16 nt, Mycobacterium bovis subsp bovis AF2122/97
cgaaaucgcacagcgc

SEQ ID NO: 1054080 - RNA, 16 nt, Mycobacterium bovis subsp bovis AF2122/97
cgaaaccguggccauc

SEQ ID NO: 1054081 - RNA, 17 nt, Mycobacterium bovis subsp bovis AF2122/97
cgaaacgauggccgggu

SEQ ID NO: 1054082 - RNA, 13 nt, Mycobacterium bovis subsp bovis AF2122/97
cgaaacgccgggu

SEQ ID NO: 1054083 - RNA, 14 nt, Mycobacterium bovis subsp bovis AF2122/97
cgaaacgccggguu

SEQ ID NO: 1054084 - RNA, 19 nt, Mycobacterium bovis subsp bovis AF2122/97
cgaaacggggcgacguccg

SEQ ID NO: 1054085 - RNA, 17 nt, Mycobacterium bovis subsp bovis AF2122/97
cgaaacgguacgccgcc

SEQ ID NO: 1054086 - RNA, 18 nt, Mycobacterium bovis subsp bovis AF2122/97
cgaaacgguacgccgccg

SEQ ID NO: 1054087 - RNA, 11 nt, Mycobacterium bovis subsp bovis AF2122/97
cgaaacccgcc

SEQ ID NO: 1054088 - RNA, 14 nt, Mycobacterium bovis subsp bovis AF2122/97
cgaaaccgcagcgc

SEQ ID NO: 1054089 - RNA, 15 nt, Mycobacterium bovis subsp bovis AF2122/97
cgaaaccgcagcgcg

SEQ ID NO: 1054090 - RNA, 17 nt, Mycobacterium bovis subsp bovis AF2122/97
cgaaaccgccgucccgg

SEQ ID NO: 1054091 - RNA, 23 nt, Mycobacterium bovis subsp bovis AF2122/97
cgaaacaccggccagcggcccgu

SEQ ID NO: 1054092 - RNA, 22 nt, Mycobacterium bovis subsp bovis AF2122/97
cgaaaagccguucgcgucgccg

SEQ ID NO: 1054093 - RNA, 22 nt, Mycobacterium bovis subsp bovis AF2122/97
cgaaacaucucggcgcagccgg

SEQ ID NO: 1054094 - RNA, 18 nt, Mycobacterium bovis subsp bovis AF2122/97
cgaaacaucucggcgcag

SEQ ID NO: 1054095 - RNA, 12 nt, Mycobacterium bovis subsp bovis AF2122/97
ccuugcgguagg

SEQ ID NO: 1054096 - RNA, 16 nt, Mycobacterium bovis subsp bovis AF2122/97
ccuugcucagccggcc

SEQ ID NO: 1054097 - RNA, 17 nt, Mycobacterium bovis subsp bovis AF2122/97
ccuugcucagccggccc

SEQ ID NO: 1054098 - RNA, 15 nt, Mycobacterium bovis subsp bovis AF2122/97
ccuugcgggccuggu

SEQ ID NO: 1054099 - RNA, 19 nt, Mycobacterium bovis subsp bovis AF2122/97
ccuugcgguccaggccggc

SEQ ID NO: 1054100 - RNA, 20 nt, Mycobacterium bovis subsp bovis AF2122/97
ccuuguuguccuucagccag

SEQ ID NO: 1054101 - RNA, 12 nt, Mycobacterium bovis subsp bovis AF2122/97
ccuuggccagca

SEQ ID NO: 1054102 - RNA, 18 nt, Mycobacterium bovis subsp bovis AF2122/97
cgaaaaccgucgcagaaa

SEQ ID NO: 1054103 - RNA, 18 nt, Mycobacterium bovis subsp bovis AF2122/97
cgaaaagccguucgcguc

SEQ ID NO: 1054104 - RNA, 17 nt, Mycobacterium bovis subsp bovis AF2122/97
cgaaaacgacaucacca

SEQ ID NO: 1054105 - RNA, 21 nt, Mycobacterium bovis subsp bovis AF2122/97
cgaaaacgacaucaccaccgc

SEQ ID NO: 1054106 - RNA, 22 nt, Mycobacterium bovis subsp bovis AF2122/97
cgaaaacgacaucaccaccgca

SEQ ID NO: 1054107 - RNA, 22 nt, Mycobacterium bovis subsp bovis AF2122/97
cgaaaacugacccccugacggc

SEQ ID NO: 1054108 - RNA, 15 nt, Mycobacterium bovis subsp bovis AF2122/97
ccuuuacccgggcgg

SEQ ID NO: 1054109 - RNA, 14 nt, Mycobacterium bovis subsp bovis AF2122/97
ccuuuccggccgcc

SEQ ID NO: 1054110 - RNA, 13 nt, Mycobacterium bovis subsp bovis AF2122/97
ccugucccgccgg

SEQ ID NO: 1054111 - RNA, 14 nt, Mycobacterium bovis subsp bovis AF2122/97
ccuucgcggugugc

SEQ ID NO: 1054112 - RNA, 17 nt, Mycobacterium bovis subsp bovis AF2122/97
ccuucgcguuggcccgc

SEQ ID NO: 1054113 - RNA, 13 nt, Mycobacterium bovis subsp bovis AF2122/97
ccuucggccggcg

SEQ ID NO: 1054114 - RNA, 17 nt, Mycobacterium bovis subsp bovis AF2122/97
ccuucagcguccuggug

SEQ ID NO: 1054115 - RNA, 12 nt, Mycobacterium bovis subsp bovis AF2122/97
ccuucggcggug

SEQ ID NO: 1054116 - RNA, 23 nt, Mycobacterium bovis subsp bovis AF2122/97
ccuugacagcuuucuuggcgggc

SEQ ID NO: 1054117 - RNA, 20 nt, Mycobacterium bovis subsp bovis AF2122/97
ccuucgucgcggccgcggcc

SEQ ID NO: 1054118 - RNA, 20 nt, Mycobacterium bovis subsp bovis AF2122/97
ccuucguaaccacgacgacg

SEQ ID NO: 1054119 - RNA, 15 nt, Mycobacterium bovis subsp bovis AF2122/97
ccuucguagaaggac

SEQ ID NO: 1054120 - RNA, 19 nt, Mycobacterium bovis subsp bovis AF2122/97
ccuugagcaaaccgcgcag

SEQ ID NO: 1054121 - RNA, 13 nt, Mycobacterium bovis subsp bovis AF2122/97
ccuugaccgcggu

SEQ ID NO: 1054122 - RNA, 19 nt, Mycobacterium bovis subsp bovis AF2122/97
ccuugacggugagaucggg

SEQ ID NO: 1054123 - RNA, 19 nt, Mycobacterium bovis subsp bovis AF2122/97
ccuugaggauccgcaccac

SEQ ID NO: 1054124 - RNA, 19 nt, Mycobacterium bovis subsp bovis AF2122/97
ccuugaggucaucgggcag

SEQ ID NO: 1054125 - RNA, 14 nt, Mycobacterium bovis subsp bovis AF2122/97
ccuugaucggcgag

SEQ ID NO: 1054126 - RNA, 20 nt, Mycobacterium bovis subsp bovis AF2122/97
ccuugaucaaggugucgacg

SEQ ID NO: 1054127 - RNA, 17 nt, Mycobacterium bovis subsp bovis AF2122/97
ccuugaucaccgugcgg

SEQ ID NO: 1054128 - RNA, 15 nt, Mycobacterium bovis subsp bovis AF2122/97
ccuugauguccgcga

SEQ ID NO: 1054129 - RNA, 21 nt, Mycobacterium bovis subsp bovis AF2122/97
ccuugccgccagccccagcgu

SEQ ID NO: 1054130 - RNA, 18 nt, Mycobacterium bovis subsp bovis AF2122/97
ccuugauguccgcgacgg

SEQ ID NO: 1054131 - RNA, 16 nt, Mycobacterium bovis subsp bovis AF2122/97
cgaacgcguccagcgc

SEQ ID NO: 1054132 - RNA, 17 nt, Mycobacterium bovis subsp bovis AF2122/97
cgaacgcguccagcgcg

SEQ ID NO: 1054133 - RNA, 23 nt, Mycobacterium bovis subsp bovis AF2122/97
cgaacgcguccagcgcggccuug

SEQ ID NO: 1054134 - RNA, 14 nt, Mycobacterium bovis subsp bovis AF2122/97
cgaacgcuccaggc

SEQ ID NO: 1054135 - RNA, 22 nt, Mycobacterium bovis subsp bovis AF2122/97
cgaacgcugaggaagcggcggc

SEQ ID NO: 1054136 - RNA, 16 nt, Mycobacterium bovis subsp bovis AF2122/97
cgaacgaagucgacga

SEQ ID NO: 1054137 - RNA, 18 nt, Mycobacterium bovis subsp bovis AF2122/97
cgaaccuugguugccaac

SEQ ID NO: 1054138 - RNA, 17 nt, Mycobacterium bovis subsp bovis AF2122/97
cgaacgcuggcggcgug

SEQ ID NO: 1054139 - RNA, 20 nt, Mycobacterium bovis subsp bovis AF2122/97
cgaacggcaccagaucuucg

SEQ ID NO: 1054140 - RNA, 12 nt, Mycobacterium bovis subsp bovis AF2122/97
cgaacggcaccg

SEQ ID NO: 1054141 - RNA, 14 nt, Mycobacterium bovis subsp bovis AF2122/97
cgaacggcaccgcg

SEQ ID NO: 1054142 - RNA, 15 nt, Mycobacterium bovis subsp bovis AF2122/97
cgaacggcaccgcgc

SEQ ID NO: 1054143 - RNA, 16 nt, Mycobacterium bovis subsp bovis AF2122/97
cgaacggcaccgcgcc

SEQ ID NO: 1054144 - RNA, 19 nt, Mycobacterium bovis subsp bovis AF2122/97
cgaacgguagcacggucug

SEQ ID NO: 1054145 - RNA, 19 nt, Mycobacterium bovis subsp bovis AF2122/97
cgaacggauucccgcccag

SEQ ID NO: 1054146 - RNA, 15 nt, Mycobacterium bovis subsp bovis AF2122/97
cgaacggcagcccgg

SEQ ID NO: 1054147 - RNA, 21 nt, Mycobacterium bovis subsp bovis AF2122/97
cgaacgucagugccccgcagc

SEQ ID NO: 1054148 - RNA, 15 nt, Mycobacterium bovis subsp bovis AF2122/97
cgaacgucaccaucg

SEQ ID NO: 1054149 - RNA, 18 nt, Mycobacterium bovis subsp bovis AF2122/97
cgaacgucaaccgggcgg

SEQ ID NO: 1054150 - RNA, 12 nt, Mycobacterium bovis subsp bovis AF2122/97
cgaacgucacca

SEQ ID NO: 1054151 - RNA, 21 nt, Mycobacterium bovis subsp bovis AF2122/97
cgaacuccuuaucgucgacgc

SEQ ID NO: 1054152 - RNA, 22 nt, Mycobacterium bovis subsp bovis AF2122/97
cgaacucgcgcaggaagcccac

SEQ ID NO: 1054153 - RNA, 14 nt, Mycobacterium bovis subsp bovis AF2122/97
cgaacucgcgccga

SEQ ID NO: 1054154 - RNA, 17 nt, Mycobacterium bovis subsp bovis AF2122/97
cgaacucgcgccgagcc

SEQ ID NO: 1054155 - RNA, 13 nt, Mycobacterium bovis subsp bovis AF2122/97
cgaacgucgcggc

SEQ ID NO: 1054156 - RNA, 17 nt, Mycobacterium bovis subsp bovis AF2122/97
cgaacgucgcggccagc

SEQ ID NO: 1054157 - RNA, 18 nt, Mycobacterium bovis subsp bovis AF2122/97
cgaacgucgcggccagca

SEQ ID NO: 1054158 - RNA, 15 nt, Mycobacterium bovis subsp bovis AF2122/97
cgaacucacgcagga

SEQ ID NO: 1054159 - RNA, 20 nt, Mycobacterium bovis subsp bovis AF2122/97
cgaacgugaacucacggcgg

SEQ ID NO: 1054160 - RNA, 13 nt, Mycobacterium bovis subsp bovis AF2122/97
cgaacucaccgcc

SEQ ID NO: 1054161 - RNA, 17 nt, Mycobacterium bovis subsp bovis AF2122/97
cgaacucaugcccgacg

SEQ ID NO: 1054162 - RNA, 18 nt, Mycobacterium bovis subsp bovis AF2122/97
cgaacucaugcccgacga

SEQ ID NO: 1054163 - RNA, 19 nt, Mycobacterium bovis subsp bovis AF2122/97
cgaaccgucagcgcgccgu

SEQ ID NO: 1054164 - RNA, 21 nt, Mycobacterium bovis subsp bovis AF2122/97
cgaaccggccgucgacgcaug

SEQ ID NO: 1054165 - RNA, 13 nt, Mycobacterium bovis subsp bovis AF2122/97
cgaaccucggcgg

SEQ ID NO: 1054166 - RNA, 13 nt, Mycobacterium bovis subsp bovis AF2122/97
cgaaccugcucgg

SEQ ID NO: 1054167 - RNA, 20 nt, Mycobacterium bovis subsp bovis AF2122/97
cgaaccugcucggcgcgccg

SEQ ID NO: 1054168 - RNA, 23 nt, Mycobacterium bovis subsp bovis AF2122/97
cgaaccguuugguggcaccgguu

SEQ ID NO: 1054169 - RNA, 22 nt, Mycobacterium bovis subsp bovis AF2122/97
cgaaccggaucaucgccgcggc

SEQ ID NO: 1054170 - RNA, 16 nt, Mycobacterium bovis subsp bovis AF2122/97
cgaacaccccgggcgc

SEQ ID NO: 1054171 - RNA, 17 nt, Mycobacterium bovis subsp bovis AF2122/97
cgaacaccccgggcgcc

SEQ ID NO: 1054172 - RNA, 20 nt, Mycobacterium bovis subsp bovis AF2122/97
cgaacacccgaagccggcgc

SEQ ID NO: 1054173 - RNA, 16 nt, Mycobacterium bovis subsp bovis AF2122/97
cgaacacaccgggcgg

SEQ ID NO: 1054174 - RNA, 13 nt, Mycobacterium bovis subsp bovis AF2122/97
cgaacaccagcgc

SEQ ID NO: 1054175 - RNA, 15 nt, Mycobacterium bovis subsp bovis AF2122/97
cgaacaccagcgcgc

SEQ ID NO: 1054176 - RNA, 17 nt, Mycobacterium bovis subsp bovis AF2122/97
cgaacaccagcgcgccg

SEQ ID NO: 1054177 - RNA, 19 nt, Mycobacterium bovis subsp bovis AF2122/97
cgaacaccagcgcgccgua

SEQ ID NO: 1054178 - RNA, 15 nt, Mycobacterium bovis subsp bovis AF2122/97
cgaaccggcaccagc

SEQ ID NO: 1054179 - RNA, 23 nt, Mycobacterium bovis subsp bovis AF2122/97
cgaaccggccaucgaccguccgg

SEQ ID NO: 1054180 - RNA, 18 nt, Mycobacterium bovis subsp bovis AF2122/97
cgaaccggccgucgacgc

SEQ ID NO: 1054181 - RNA, 20 nt, Mycobacterium bovis subsp bovis AF2122/97
cgaacaaguggccagcgcca

SEQ ID NO: 1054182 - RNA, 23 nt, Mycobacterium bovis subsp bovis AF2122/97
cgaaauguuggccguaccgguga

SEQ ID NO: 1054183 - RNA, 14 nt, Mycobacterium bovis subsp bovis AF2122/97
cgaacaacgcgacg

SEQ ID NO: 1054184 - RNA, 19 nt, Mycobacterium bovis subsp bovis AF2122/97
cgaaauuacuucggccaca

SEQ ID NO: 1054185 - RNA, 22 nt, Mycobacterium bovis subsp bovis AF2122/97
cgaaaucucaucgauuggcucg

SEQ ID NO: 1054186 - RNA, 19 nt, Mycobacterium bovis subsp bovis AF2122/97
cgaaaugcccaucaccaga

SEQ ID NO: 1054187 - RNA, 24 nt, Mycobacterium bovis subsp bovis AF2122/97
cgaaaucggcggcguccagcagcg

SEQ ID NO: 1054188 - RNA, 20 nt, Mycobacterium bovis subsp bovis AF2122/97
cgaaauggucguucccgccg

SEQ ID NO: 1054189 - RNA, 19 nt, Mycobacterium bovis subsp bovis AF2122/97
cgaaaugccgggcccgacg

SEQ ID NO: 1054190 - RNA, 16 nt, Mycobacterium bovis subsp bovis AF2122/97
cgaagcggcugcugcg

SEQ ID NO: 1054191 - RNA, 23 nt, Mycobacterium bovis subsp bovis AF2122/97
cgaagcggcugcugcgcggugcc

SEQ ID NO: 1054192 - RNA, 15 nt, Mycobacterium bovis subsp bovis AF2122/97
cgaagcgggcgugcu

SEQ ID NO: 1054193 - RNA, 21 nt, Mycobacterium bovis subsp bovis AF2122/97
cgaagcgggcccgcaggucgg

SEQ ID NO: 1054194 - RNA, 19 nt, Mycobacterium bovis subsp bovis AF2122/97
cgaagcggugaggucggug

SEQ ID NO: 1054195 - RNA, 13 nt, Mycobacterium bovis subsp bovis AF2122/97
cgaagccggcgcc

SEQ ID NO: 1054196 - RNA, 15 nt, Mycobacterium bovis subsp bovis AF2122/97
cgaagcgauccggcu

SEQ ID NO: 1054197 - RNA, 19 nt, Mycobacterium bovis subsp bovis AF2122/97
cgaagcgaucgccggccgc

SEQ ID NO: 1054198 - RNA, 23 nt, Mycobacterium bovis subsp bovis AF2122/97
cgaagcgaugccgugcugggccg

SEQ ID NO: 1054199 - RNA, 19 nt, Mycobacterium bovis subsp bovis AF2122/97
cgaagcgcccguuggccaa

SEQ ID NO: 1054200 - RNA, 20 nt, Mycobacterium bovis subsp bovis AF2122/97
cgaagcgcucggcagccggc

SEQ ID NO: 1054201 - RNA, 17 nt, Mycobacterium bovis subsp bovis AF2122/97
cgaagcugugcccggcg

SEQ ID NO: 1054202 - RNA, 20 nt, Mycobacterium bovis subsp bovis AF2122/97
cgaagcugcgggucagcgcc

SEQ ID NO: 1054203 - RNA, 23 nt, Mycobacterium bovis subsp bovis AF2122/97
cgaagcugcgggucagcgccgag

SEQ ID NO: 1054204 - RNA, 18 nt, Mycobacterium bovis subsp bovis AF2122/97
cgaagcucaucgccgcua

SEQ ID NO: 1054205 - RNA, 21 nt, Mycobacterium bovis subsp bovis AF2122/97
cgaagcuacgucggcucgucg

SEQ ID NO: 1054206 - RNA, 19 nt, Mycobacterium bovis subsp bovis AF2122/97
cgaagcucaucgccgcuac

SEQ ID NO: 1054207 - RNA, 14 nt, Mycobacterium bovis subsp bovis AF2122/97
cgaaggccgccaac

SEQ ID NO: 1054208 - RNA, 17 nt, Mycobacterium bovis subsp bovis AF2122/97
cgaaggccgccaaccgu

SEQ ID NO: 1054209 - RNA, 22 nt, Mycobacterium bovis subsp bovis AF2122/97
cgaaggccgccacaaacccgau

SEQ ID NO: 1054210 - RNA, 15 nt, Mycobacterium bovis subsp bovis AF2122/97
cgaaggauugcggaa

SEQ ID NO: 1054211 - RNA, 17 nt, Mycobacterium bovis subsp bovis AF2122/97
cgaagccgaccucacgg

SEQ ID NO: 1054212 - RNA, 12 nt, Mycobacterium bovis subsp bovis AF2122/97
cgaagccgccgg

SEQ ID NO: 1054213 - RNA, 18 nt, Mycobacterium bovis subsp bovis AF2122/97
cgaagccggaccgcacuu

SEQ ID NO: 1054214 - RNA, 22 nt, Mycobacterium bovis subsp bovis AF2122/97
cgaagccggcuucggugagcgg

SEQ ID NO: 1054215 - RNA, 12 nt, Mycobacterium bovis subsp bovis AF2122/97
cgaagccggguc

SEQ ID NO: 1054216 - RNA, 13 nt, Mycobacterium bovis subsp bovis AF2122/97
cgaagccggcgcu

SEQ ID NO: 1054217 - RNA, 23 nt, Mycobacterium bovis subsp bovis AF2122/97
cgaagccgucgauguugcccagc

SEQ ID NO: 1054218 - RNA, 21 nt, Mycobacterium bovis subsp bovis AF2122/97
cgaagccuugcagcgcccccg

SEQ ID NO: 1054219 - RNA, 22 nt, Mycobacterium bovis subsp bovis AF2122/97
cgaagccucggcaugcagcccc

SEQ ID NO: 1054220 - RNA, 14 nt, Mycobacterium bovis subsp bovis AF2122/97
cgaagaccucgucg

SEQ ID NO: 1054221 - RNA, 18 nt, Mycobacterium bovis subsp bovis AF2122/97
cgaagaauaugccgauga

SEQ ID NO: 1054222 - RNA, 17 nt, Mycobacterium bovis subsp bovis AF2122/97
cgaagcccccgacguug

SEQ ID NO: 1054223 - RNA, 18 nt, Mycobacterium bovis subsp bovis AF2122/97
cgaagccccucaccucgg

SEQ ID NO: 1054224 - RNA, 23 nt, Mycobacterium bovis subsp bovis AF2122/97
cgaagccccucaccucggcuuug

SEQ ID NO: 1054225 - RNA, 15 nt, Mycobacterium bovis subsp bovis AF2122/97
cgaagcccgacauga

SEQ ID NO: 1054226 - RNA, 14 nt, Mycobacterium bovis subsp bovis AF2122/97
cgaagaccaggccg

SEQ ID NO: 1054227 - RNA, 15 nt, Mycobacterium bovis subsp bovis AF2122/97
cgaagaccaggccgg

SEQ ID NO: 1054228 - RNA, 21 nt, Mycobacterium bovis subsp bovis AF2122/97
cgaagaccaggccggugacgg

SEQ ID NO: 1054229 - RNA, 16 nt, Mycobacterium bovis subsp bovis AF2122/97
cgaagaccagcggcgg

SEQ ID NO: 1054230 - RNA, 22 nt, Mycobacterium bovis subsp bovis AF2122/97
cgaagaccgccuccaccgccgc

SEQ ID NO: 1054231 - RNA, 17 nt, Mycobacterium bovis subsp bovis AF2122/97
cgaagaccgcgucggcg

SEQ ID NO: 1054232 - RNA, 19 nt, Mycobacterium bovis subsp bovis AF2122/97
cgaagaccgcgucggcggc

SEQ ID NO: 1054233 - RNA, 20 nt, Mycobacterium bovis subsp bovis AF2122/97
cgaagaccgcgucggcggcc

SEQ ID NO: 1054234 - RNA, 18 nt, Mycobacterium bovis subsp bovis AF2122/97
cgaacucgcgggcgacca

SEQ ID NO: 1054235 - RNA, 17 nt, Mycobacterium bovis subsp bovis AF2122/97
cgaacucggccgggcgg

SEQ ID NO: 1054236 - RNA, 19 nt, Mycobacterium bovis subsp bovis AF2122/97
cgaagaaccggccgacgaa

SEQ ID NO: 1054237 - RNA, 20 nt, Mycobacterium bovis subsp bovis AF2122/97
cgaagaaccggccgacgaac

SEQ ID NO: 1054238 - RNA, 19 nt, Mycobacterium bovis subsp bovis AF2122/97
cgaagaacgacgccaccgc

SEQ ID NO: 1054239 - RNA, 15 nt, Mycobacterium bovis subsp bovis AF2122/97
cgacaucauggugaa

SEQ ID NO: 1054240 - RNA, 14 nt, Mycobacterium bovis subsp bovis AF2122/97
cgacaucgcugcga

SEQ ID NO: 1054241 - RNA, 13 nt, Mycobacterium bovis subsp bovis AF2122/97
cgacaucgacaag

SEQ ID NO: 1054242 - RNA, 17 nt, Mycobacterium bovis subsp bovis AF2122/97
cgacauaguuggcgccc

SEQ ID NO: 1054243 - RNA, 18 nt, Mycobacterium bovis subsp bovis AF2122/97
cgacauaguuggcgcccg

SEQ ID NO: 1054244 - RNA, 20 nt, Mycobacterium bovis subsp bovis AF2122/97
cgacauaguuggcgcccgaa

SEQ ID NO: 1054245 - RNA, 12 nt, Mycobacterium bovis subsp bovis AF2122/97
cgacaggugcca

SEQ ID NO: 1054246 - RNA, 14 nt, Mycobacterium bovis subsp bovis AF2122/97
cgacaggucacuac

SEQ ID NO: 1054247 - RNA, 13 nt, Mycobacterium bovis subsp bovis AF2122/97
cgacaggucgccc

SEQ ID NO: 1054248 - RNA, 14 nt, Mycobacterium bovis subsp bovis AF2122/97
cgacaucaccaccg

SEQ ID NO: 1054249 - RNA, 15 nt, Mycobacterium bovis subsp bovis AF2122/97
cgacaucaccaccga

SEQ ID NO: 1054250 - RNA, 12 nt, Mycobacterium bovis subsp bovis AF2122/97
cgacaucaccga

SEQ ID NO: 1054251 - RNA, 15 nt, Mycobacterium bovis subsp bovis AF2122/97
cgacaucaccaccgc

SEQ ID NO: 1054252 - RNA, 18 nt, Mycobacterium bovis subsp bovis AF2122/97
cgacaucaccaccgcacg

SEQ ID NO: 1054253 - RNA, 13 nt, Mycobacterium bovis subsp bovis AF2122/97
cgacagcacccgg

SEQ ID NO: 1054254 - RNA, 16 nt, Mycobacterium bovis subsp bovis AF2122/97
cgacagcagccggugc

SEQ ID NO: 1054255 - RNA, 18 nt, Mycobacterium bovis subsp bovis AF2122/97
cgacagcagcgccacccg

SEQ ID NO: 1054256 - RNA, 20 nt, Mycobacterium bovis subsp bovis AF2122/97
cgacagcagaaucucggguc

SEQ ID NO: 1054257 - RNA, 15 nt, Mycobacterium bovis subsp bovis AF2122/97
cgacagccccaucac

SEQ ID NO: 1054258 - RNA, 20 nt, Mycobacterium bovis subsp bovis AF2122/97
cgacagccccaucaccaccg

SEQ ID NO: 1054259 - RNA, 21 nt, Mycobacterium bovis subsp bovis AF2122/97
cgacagccccaucaccaccgg

SEQ ID NO: 1054260 - RNA, 23 nt, Mycobacterium bovis subsp bovis AF2122/97
cgacagccccaucaccaccggca

SEQ ID NO: 1054261 - RNA, 13 nt, Mycobacterium bovis subsp bovis AF2122/97
cgacagccaccgc

SEQ ID NO: 1054262 - RNA, 17 nt, Mycobacterium bovis subsp bovis AF2122/97
cgacagcagguugccga

SEQ ID NO: 1054263 - RNA, 19 nt, Mycobacterium bovis subsp bovis AF2122/97
cgacagcagguugccgaag

SEQ ID NO: 1054264 - RNA, 14 nt, Mycobacterium bovis subsp bovis AF2122/97
cgacagcaucacgc

SEQ ID NO: 1054265 - RNA, 23 nt, Mycobacterium bovis subsp bovis AF2122/97
cgacagggacccgagaucaccgg

SEQ ID NO: 1054266 - RNA, 16 nt, Mycobacterium bovis subsp bovis AF2122/97
cgacagccccgcggcc

SEQ ID NO: 1054267 - RNA, 21 nt, Mycobacterium bovis subsp bovis AF2122/97
cgacagccccgcggccagcag

SEQ ID NO: 1054268 - RNA, 14 nt, Mycobacterium bovis subsp bovis AF2122/97
cgacagccaccgcg

SEQ ID NO: 1054269 - RNA, 17 nt, Mycobacterium bovis subsp bovis AF2122/97
cgacagccaccucgacg

SEQ ID NO: 1054270 - RNA, 12 nt, Mycobacterium bovis subsp bovis AF2122/97
cgacaggcgccc

SEQ ID NO: 1054271 - RNA, 23 nt, Mycobacterium bovis subsp bovis AF2122/97
cgacaagugcccggccaaccacc

SEQ ID NO: 1054272 - RNA, 14 nt, Mycobacterium bovis subsp bovis AF2122/97
cgacaaucgcacgc

SEQ ID NO: 1054273 - RNA, 21 nt, Mycobacterium bovis subsp bovis AF2122/97
cgacaagcugucggcgaccga

SEQ ID NO: 1054274 - RNA, 13 nt, Mycobacterium bovis subsp bovis AF2122/97
cgacacacgccgc

SEQ ID NO: 1054275 - RNA, 16 nt, Mycobacterium bovis subsp bovis AF2122/97
cgacaauggcgccagc

SEQ ID NO: 1054276 - RNA, 18 nt, Mycobacterium bovis subsp bovis AF2122/97
cgacaauggcgccagccg

SEQ ID NO: 1054277 - RNA, 21 nt, Mycobacterium bovis subsp bovis AF2122/97
cgacaauggcgccagccgacc

SEQ ID NO: 1054278 - RNA, 14 nt, Mycobacterium bovis subsp bovis AF2122/97
cgacacagcggcgg

SEQ ID NO: 1054279 - RNA, 19 nt, Mycobacterium bovis subsp bovis AF2122/97
cgacacacgccgccggugu

SEQ ID NO: 1054280 - RNA, 20 nt, Mycobacterium bovis subsp bovis AF2122/97
cgacaccaccagguccaccc

SEQ ID NO: 1054281 - RNA, 13 nt, Mycobacterium bovis subsp bovis AF2122/97
cgacaccaccauu

SEQ ID NO: 1054282 - RNA, 17 nt, Mycobacterium bovis subsp bovis AF2122/97
cgacaccaccauucccg

SEQ ID NO: 1054283 - RNA, 20 nt, Mycobacterium bovis subsp bovis AF2122/97
cgacagcacccggccaccgg

SEQ ID NO: 1054284 - RNA, 16 nt, Mycobacterium bovis subsp bovis AF2122/97
cgacaccaccggcgcc

SEQ ID NO: 1054285 - RNA, 17 nt, Mycobacterium bovis subsp bovis AF2122/97
cgacaccaccggcgccg

SEQ ID NO: 1054286 - RNA, 20 nt, Mycobacterium bovis subsp bovis AF2122/97
cgacaccaccggcgccgccg

SEQ ID NO: 1054287 - RNA, 23 nt, Mycobacterium bovis subsp bovis AF2122/97
cgacaccaccuuggaugcccugc

SEQ ID NO: 1054288 - RNA, 14 nt, Mycobacterium bovis subsp bovis AF2122/97
cgacacggugcugc

SEQ ID NO: 1054289 - RNA, 19 nt, Mycobacterium bovis subsp bovis AF2122/97
cgacacggugcugccguug

SEQ ID NO: 1054290 - RNA, 19 nt, Mycobacterium bovis subsp bovis AF2122/97
cgacacugggaucccgacg

SEQ ID NO: 1054291 - RNA, 20 nt, Mycobacterium bovis subsp bovis AF2122/97
cgacacguuucacguggucg

SEQ ID NO: 1054292 - RNA, 18 nt, Mycobacterium bovis subsp bovis AF2122/97
cgacacuaggggcggggc

SEQ ID NO: 1054293 - RNA, 19 nt, Mycobacterium bovis subsp bovis AF2122/97
cgacacucacgggugcugg

SEQ ID NO: 1054294 - RNA, 15 nt, Mycobacterium bovis subsp bovis AF2122/97
cgacaaagcggcugc

SEQ ID NO: 1054295 - RNA, 15 nt, Mycobacterium bovis subsp bovis AF2122/97
cgacaacacgccguc

SEQ ID NO: 1054296 - RNA, 20 nt, Mycobacterium bovis subsp bovis AF2122/97
cgacaacaacucuucggcgg

SEQ ID NO: 1054297 - RNA, 18 nt, Mycobacterium bovis subsp bovis AF2122/97
cgacaacaccacggugcc

SEQ ID NO: 1054298 - RNA, 19 nt, Mycobacterium bovis subsp bovis AF2122/97
cgacaaaccgggcgugcca

SEQ ID NO: 1054299 - RNA, 17 nt, Mycobacterium bovis subsp bovis AF2122/97
cgacaaacguguugacc

SEQ ID NO: 1054300 - RNA, 21 nt, Mycobacterium bovis subsp bovis AF2122/97
cgacaaacguguugaccgggu

SEQ ID NO: 1054301 - RNA, 18 nt, Mycobacterium bovis subsp bovis AF2122/97
cgacaacgacgucgccga

SEQ ID NO: 1054302 - RNA, 19 nt, Mycobacterium bovis subsp bovis AF2122/97
cgacaacgacgucgccgac

SEQ ID NO: 1054303 - RNA, 17 nt, Mycobacterium bovis subsp bovis AF2122/97
cgacaaccccgccagga

SEQ ID NO: 1054304 - RNA, 14 nt, Mycobacterium bovis subsp bovis AF2122/97
cgacaacagccagc

SEQ ID NO: 1054305 - RNA, 14 nt, Mycobacterium bovis subsp bovis AF2122/97
cgacaacaggccgu

SEQ ID NO: 1054306 - RNA, 16 nt, Mycobacterium bovis subsp bovis AF2122/97
cgacaacacgccgucg

SEQ ID NO: 1054307 - RNA, 14 nt, Mycobacterium bovis subsp bovis AF2122/97
cgacaacagcacgu

SEQ ID NO: 1054308 - RNA, 16 nt, Mycobacterium bovis subsp bovis AF2122/97
cgacaacggcggcaug

SEQ ID NO: 1054309 - RNA, 17 nt, Mycobacterium bovis subsp bovis AF2122/97
cgacaagaauggccgcc

SEQ ID NO: 1054310 - RNA, 17 nt, Mycobacterium bovis subsp bovis AF2122/97
cgacaacugcccgauga

SEQ ID NO: 1054311 - RNA, 14 nt, Mycobacterium bovis subsp bovis AF2122/97
cgacaacgcugggc

SEQ ID NO: 1054312 - RNA, 15 nt, Mycobacterium bovis subsp bovis AF2122/97
cgacaaccgcugccg

SEQ ID NO: 1054313 - RNA, 22 nt, Mycobacterium bovis subsp bovis AF2122/97
cgacaacgacgucgccgacccg

SEQ ID NO: 1054314 - RNA, 23 nt, Mycobacterium bovis subsp bovis AF2122/97
cgacaacgacgucgccgacccgg

SEQ ID NO: 1054315 - RNA, 17 nt, Mycobacterium bovis subsp bovis AF2122/97
cgacaacgaucgcgcga

SEQ ID NO: 1054316 - RNA, 13 nt, Mycobacterium bovis subsp bovis AF2122/97
cgacaacgauguc

SEQ ID NO: 1054317 - RNA, 14 nt, Mycobacterium bovis subsp bovis AF2122/97
cgaauccaggccgu

SEQ ID NO: 1054318 - RNA, 20 nt, Mycobacterium bovis subsp bovis AF2122/97
cgaaucccgcgaugcgcacc

SEQ ID NO: 1054319 - RNA, 21 nt, Mycobacterium bovis subsp bovis AF2122/97
cgaauccgaucaccucggcga

SEQ ID NO: 1054320 - RNA, 18 nt, Mycobacterium bovis subsp bovis AF2122/97
cgaauccgacgucgacga

SEQ ID NO: 1054321 - RNA, 15 nt, Mycobacterium bovis subsp bovis AF2122/97
cgaaugugaucaccc

SEQ ID NO: 1054322 - RNA, 16 nt, Mycobacterium bovis subsp bovis AF2122/97
cgaauguuucggcgau

SEQ ID NO: 1054323 - RNA, 17 nt, Mycobacterium bovis subsp bovis AF2122/97
cgaauguugcgaucugc

SEQ ID NO: 1054324 - RNA, 20 nt, Mycobacterium bovis subsp bovis AF2122/97
cgaauguugcgaucugcggc

SEQ ID NO: 1054325 - RNA, 19 nt, Mycobacterium bovis subsp bovis AF2122/97
cgaauugcguucgccgccc

SEQ ID NO: 1054326 - RNA, 23 nt, Mycobacterium bovis subsp bovis AF2122/97
cgaauugguaaugcaccagggcg

SEQ ID NO: 1054327 - RNA, 14 nt, Mycobacterium bovis subsp bovis AF2122/97
cgaauugcguucgc

SEQ ID NO: 1054328 - RNA, 21 nt, Mycobacterium bovis subsp bovis AF2122/97
cgaaggcggcuccaccgggcc

SEQ ID NO: 1054329 - RNA, 18 nt, Mycobacterium bovis subsp bovis AF2122/97
cgaaggcgggggagccca

SEQ ID NO: 1054330 - RNA, 20 nt, Mycobacterium bovis subsp bovis AF2122/97
cgaaggcguucgccggggcg

SEQ ID NO: 1054331 - RNA, 20 nt, Mycobacterium bovis subsp bovis AF2122/97
cgaaguuggcgaagcccgac

SEQ ID NO: 1054332 - RNA, 20 nt, Mycobacterium bovis subsp bovis AF2122/97
cgaauaacgcggucggcagc

SEQ ID NO: 1054333 - RNA, 17 nt, Mycobacterium bovis subsp bovis AF2122/97
cgaaguuugcgacgacg

SEQ ID NO: 1054334 - RNA, 21 nt, Mycobacterium bovis subsp bovis AF2122/97
cgaauacgaccgucgcgcugc

SEQ ID NO: 1054335 - RNA, 18 nt, Mycobacterium bovis subsp bovis AF2122/97
cgaauaccgccgcgcagc

SEQ ID NO: 1054336 - RNA, 21 nt, Mycobacterium bovis subsp bovis AF2122/97
cgaauaccgguggcagccugc

SEQ ID NO: 1054337 - RNA, 20 nt, Mycobacterium bovis subsp bovis AF2122/97
cgaauaccagaccggccgac

SEQ ID NO: 1054338 - RNA, 22 nt, Mycobacterium bovis subsp bovis AF2122/97
cgaauaccagaccggccgacgu

SEQ ID NO: 1054339 - RNA, 13 nt, Mycobacterium bovis subsp bovis AF2122/97
cgaauacccgcgg

SEQ ID NO: 1054340 - RNA, 15 nt, Mycobacterium bovis subsp bovis AF2122/97
cgaauaccacaccgu

SEQ ID NO: 1054341 - RNA, 19 nt, Mycobacterium bovis subsp bovis AF2122/97
cgaauaccacaccgugacc

SEQ ID NO: 1054342 - RNA, 23 nt, Mycobacterium bovis subsp bovis AF2122/97
cgaaucaccuugcuccacaucgg

SEQ ID NO: 1054343 - RNA, 16 nt, Mycobacterium bovis subsp bovis AF2122/97
cgaauauagcggcguu

SEQ ID NO: 1054344 - RNA, 20 nt, Mycobacterium bovis subsp bovis AF2122/97
cgaauagguguguggcgccg

SEQ ID NO: 1054345 - RNA, 18 nt, Mycobacterium bovis subsp bovis AF2122/97
cgacgaacaccagcgcgc

SEQ ID NO: 1054346 - RNA, 23 nt, Mycobacterium bovis subsp bovis AF2122/97
cgacgaagaucgcugcgaagccg

SEQ ID NO: 1054347 - RNA, 15 nt, Mycobacterium bovis subsp bovis AF2122/97
cgacgaacaccagcg

SEQ ID NO: 1054348 - RNA, 16 nt, Mycobacterium bovis subsp bovis AF2122/97
cgacgaacaccagcgc

SEQ ID NO: 1054349 - RNA, 22 nt, Mycobacterium bovis subsp bovis AF2122/97
cgacgaaguucuccagcucgaa

SEQ ID NO: 1054350 - RNA, 17 nt, Mycobacterium bovis subsp bovis AF2122/97
cgacgaauaacgcgguc

SEQ ID NO: 1054351 - RNA, 16 nt, Mycobacterium bovis subsp bovis AF2122/97
cgacgaauaccgggau

SEQ ID NO: 1054352 - RNA, 20 nt, Mycobacterium bovis subsp bovis AF2122/97
cgacgacguggcugcguucg

SEQ ID NO: 1054353 - RNA, 19 nt, Mycobacterium bovis subsp bovis AF2122/97
cgacgacacgccugggcga

SEQ ID NO: 1054354 - RNA, 16 nt, Mycobacterium bovis subsp bovis AF2122/97
cgacgaaucggcaacg

SEQ ID NO: 1054355 - RNA, 14 nt, Mycobacterium bovis subsp bovis AF2122/97
cgacgaauccccga

SEQ ID NO: 1054356 - RNA, 14 nt, Mycobacterium bovis subsp bovis AF2122/97
cgacgaauguccgc

SEQ ID NO: 1054357 - RNA, 13 nt, Mycobacterium bovis subsp bovis AF2122/97
cgacgacaaccgg

SEQ ID NO: 1054358 - RNA, 14 nt, Mycobacterium bovis subsp bovis AF2122/97
cgacgacaaccggc

SEQ ID NO: 1054359 - RNA, 17 nt, Mycobacterium bovis subsp bovis AF2122/97
cgacgacaaccggccag

SEQ ID NO: 1054360 - RNA, 16 nt, Mycobacterium bovis subsp bovis AF2122/97
cgacgacaacagccag

SEQ ID NO: 1054361 - RNA, 18 nt, Mycobacterium bovis subsp bovis AF2122/97
cgacgacaacagccagcu

SEQ ID NO: 1054362 - RNA, 12 nt, Mycobacterium bovis subsp bovis AF2122/97
cgacgagccgca

SEQ ID NO: 1054363 - RNA, 22 nt, Mycobacterium bovis subsp bovis AF2122/97
cgacgagcaacgccacccgaau

SEQ ID NO: 1054364 - RNA, 16 nt, Mycobacterium bovis subsp bovis AF2122/97
cgacgagcaccgcgcc

SEQ ID NO: 1054365 - RNA, 17 nt, Mycobacterium bovis subsp bovis AF2122/97
cgacgagcaccgcgccg

SEQ ID NO: 1054366 - RNA, 21 nt, Mycobacterium bovis subsp bovis AF2122/97
cgacgagcaccgcgccgcgcc

SEQ ID NO: 1054367 - RNA, 16 nt, Mycobacterium bovis subsp bovis AF2122/97
cgacgagcacgccgac

SEQ ID NO: 1054368 - RNA, 21 nt, Mycobacterium bovis subsp bovis AF2122/97
cgacgagacgaaccgccgacg

SEQ ID NO: 1054369 - RNA, 14 nt, Mycobacterium bovis subsp bovis AF2122/97
cgacgagacggcag

SEQ ID NO: 1054370 - RNA, 18 nt, Mycobacterium bovis subsp bovis AF2122/97
cgacgagauacggccacc

SEQ ID NO: 1054371 - RNA, 19 nt, Mycobacterium bovis subsp bovis AF2122/97
cgacgagauacggccacca

SEQ ID NO: 1054372 - RNA, 19 nt, Mycobacterium bovis subsp bovis AF2122/97
cgacgagauugccgggccg

SEQ ID NO: 1054373 - RNA, 22 nt, Mycobacterium bovis subsp bovis AF2122/97
cgacgagauugccgggccgccg

SEQ ID NO: 1054374 - RNA, 23 nt, Mycobacterium bovis subsp bovis AF2122/97
cgacgagauugccgggccgccga

SEQ ID NO: 1054375 - RNA, 15 nt, Mycobacterium bovis subsp bovis AF2122/97
cgacgauaucgggag

SEQ ID NO: 1054376 - RNA, 17 nt, Mycobacterium bovis subsp bovis AF2122/97
cgacgauaucgggagcg

SEQ ID NO: 1054377 - RNA, 22 nt, Mycobacterium bovis subsp bovis AF2122/97
cgacgauaucgggagcggcugc

SEQ ID NO: 1054378 - RNA, 23 nt, Mycobacterium bovis subsp bovis AF2122/97
cgacgaucaacggaacaucguca

SEQ ID NO: 1054379 - RNA, 22 nt, Mycobacterium bovis subsp bovis AF2122/97
cgacgaucaagccuucgucgau

SEQ ID NO: 1054380 - RNA, 15 nt, Mycobacterium bovis subsp bovis AF2122/97
cgacgauccacggcg

SEQ ID NO: 1054381 - RNA, 16 nt, Mycobacterium bovis subsp bovis AF2122/97
cgacgauccacggcga

SEQ ID NO: 1054382 - RNA, 15 nt, Mycobacterium bovis subsp bovis AF2122/97
cgacgaucgacgccg

SEQ ID NO: 1054383 - RNA, 16 nt, Mycobacterium bovis subsp bovis AF2122/97
cgacgaucgacgccgc

SEQ ID NO: 1054384 - RNA, 18 nt, Mycobacterium bovis subsp bovis AF2122/97
cgacgaucgacgccgcca

SEQ ID NO: 1054385 - RNA, 19 nt, Mycobacterium bovis subsp bovis AF2122/97
cgaccgucccagcgccgca

SEQ ID NO: 1054386 - RNA, 13 nt, Mycobacterium bovis subsp bovis AF2122/97
cgaccguccgggu

SEQ ID NO: 1054387 - RNA, 17 nt, Mycobacterium bovis subsp bovis AF2122/97
cgaccguccgggucacc

SEQ ID NO: 1054388 - RNA, 18 nt, Mycobacterium bovis subsp bovis AF2122/97
cgaccguccgggucacca

SEQ ID NO: 1054389 - RNA, 12 nt, Mycobacterium bovis subsp bovis AF2122/97
cgaccgucgcgc

SEQ ID NO: 1054390 - RNA, 15 nt, Mycobacterium bovis subsp bovis AF2122/97
cgaccgucgcgcugc

SEQ ID NO: 1054391 - RNA, 20 nt, Mycobacterium bovis subsp bovis AF2122/97
cgaccgucgcgcugccggcc

SEQ ID NO: 1054392 - RNA, 23 nt, Mycobacterium bovis subsp bovis AF2122/97
cgaccgucgcgcugccggccgcg

SEQ ID NO: 1054393 - RNA, 16 nt, Mycobacterium bovis subsp bovis AF2122/97
cgaccguauugaccag

SEQ ID NO: 1054394 - RNA, 17 nt, Mycobacterium bovis subsp bovis AF2122/97
cgaccguauugaccagc

SEQ ID NO: 1054395 - RNA, 19 nt, Mycobacterium bovis subsp bovis AF2122/97
cgaccgguucggcguacaa

SEQ ID NO: 1054396 - RNA, 13 nt, Mycobacterium bovis subsp bovis AF2122/97
cgaccgucaaccu

SEQ ID NO: 1054397 - RNA, 21 nt, Mycobacterium bovis subsp bovis AF2122/97
cgaccgucagggucaccugcg

SEQ ID NO: 1054398 - RNA, 15 nt, Mycobacterium bovis subsp bovis AF2122/97
cgaccgugcugggcg

SEQ ID NO: 1054399 - RNA, 16 nt, Mycobacterium bovis subsp bovis AF2122/97
cgaccgugcugggcgc

SEQ ID NO: 1054400 - RNA, 19 nt, Mycobacterium bovis subsp bovis AF2122/97
cgaccgucgucgugcaggc

SEQ ID NO: 1054401 - RNA, 19 nt, Mycobacterium bovis subsp bovis AF2122/97
cgaccgucggcuccagguc

SEQ ID NO: 1054402 - RNA, 17 nt, Mycobacterium bovis subsp bovis AF2122/97
cgaccgucgucaccgcg

SEQ ID NO: 1054403 - RNA, 20 nt, Mycobacterium bovis subsp bovis AF2122/97
cgaccgucgucaccgcgacg

SEQ ID NO: 1054404 - RNA, 14 nt, Mycobacterium bovis subsp bovis AF2122/97
cgaccgugaucagc

SEQ ID NO: 1054405 - RNA, 22 nt, Mycobacterium bovis subsp bovis AF2122/97
cgaccuggccacggggcugccg

SEQ ID NO: 1054406 - RNA, 17 nt, Mycobacterium bovis subsp bovis AF2122/97
cgaccuucaccgcgugu

SEQ ID NO: 1054407 - RNA, 22 nt, Mycobacterium bovis subsp bovis AF2122/97
cgaccugggacaguucgcgccg

SEQ ID NO: 1054408 - RNA, 12 nt, Mycobacterium bovis subsp bovis AF2122/97
cgaccuguccac

SEQ ID NO: 1054409 - RNA, 13 nt, Mycobacterium bovis subsp bovis AF2122/97
cgaccugguggac

SEQ ID NO: 1054410 - RNA, 20 nt, Mycobacterium bovis subsp bovis AF2122/97
cgaccuucucgaugcugacg

SEQ ID NO: 1054411 - RNA, 17 nt, Mycobacterium bovis subsp bovis AF2122/97
cgacgaaaggcgcguug

SEQ ID NO: 1054412 - RNA, 13 nt, Mycobacterium bovis subsp bovis AF2122/97
cgaccuugcccgc

SEQ ID NO: 1054413 - RNA, 12 nt, Mycobacterium bovis subsp bovis AF2122/97
cgaccuugaccc

SEQ ID NO: 1054414 - RNA, 21 nt, Mycobacterium bovis subsp bovis AF2122/97
cgaccuugauuccugcccaac

SEQ ID NO: 1054415 - RNA, 18 nt, Mycobacterium bovis subsp bovis AF2122/97
cgacgaucucgccgccag

SEQ ID NO: 1054416 - RNA, 20 nt, Mycobacterium bovis subsp bovis AF2122/97
cgacgaucucgccgccagcg

SEQ ID NO: 1054417 - RNA, 21 nt, Mycobacterium bovis subsp bovis AF2122/97
cgacgaucucgccgccagcgc

SEQ ID NO: 1054418 - RNA, 15 nt, Mycobacterium bovis subsp bovis AF2122/97
cgacgaucucgccgg

SEQ ID NO: 1054419 - RNA, 15 nt, Mycobacterium bovis subsp bovis AF2122/97
cgacgaucucggcgg

SEQ ID NO: 1054420 - RNA, 18 nt, Mycobacterium bovis subsp bovis AF2122/97
cgacgaucucggcggccg

SEQ ID NO: 1054421 - RNA, 17 nt, Mycobacterium bovis subsp bovis AF2122/97
cgacgaugacgcgcgaa

SEQ ID NO: 1054422 - RNA, 19 nt, Mycobacterium bovis subsp bovis AF2122/97
cgacgauccacggcgaugc

SEQ ID NO: 1054423 - RNA, 19 nt, Mycobacterium bovis subsp bovis AF2122/97
cgacgaugccgggucgcgg

SEQ ID NO: 1054424 - RNA, 15 nt, Mycobacterium bovis subsp bovis AF2122/97
cgacgaugccggccc

SEQ ID NO: 1054425 - RNA, 18 nt, Mycobacterium bovis subsp bovis AF2122/97
cgacgaugccggcccgca

SEQ ID NO: 1054426 - RNA, 18 nt, Mycobacterium bovis subsp bovis AF2122/97
cgacgaugaugccgucgu

SEQ ID NO: 1054427 - RNA, 19 nt, Mycobacterium bovis subsp bovis AF2122/97
cgacgaugcaggugacaug

SEQ ID NO: 1054428 - RNA, 14 nt, Mycobacterium bovis subsp bovis AF2122/97
cgacgaugacggug

SEQ ID NO: 1054429 - RNA, 15 nt, Mycobacterium bovis subsp bovis AF2122/97
cgacgaugccucggc

SEQ ID NO: 1054430 - RNA, 19 nt, Mycobacterium bovis subsp bovis AF2122/97
cgacgaugccucggcggcc

SEQ ID NO: 1054431 - RNA, 14 nt, Mycobacterium bovis subsp bovis AF2122/97
cgacgaugcgcacu

SEQ ID NO: 1054432 - RNA, 15 nt, Mycobacterium bovis subsp bovis AF2122/97
cgacgaugcgcacuc

SEQ ID NO: 1054433 - RNA, 17 nt, Mycobacterium bovis subsp bovis AF2122/97
cgacgaugucgaagauc

SEQ ID NO: 1054434 - RNA, 22 nt, Mycobacterium bovis subsp bovis AF2122/97
cgacgaugucgaagaucgagcc

SEQ ID NO: 1054435 - RNA, 17 nt, Mycobacterium bovis subsp bovis AF2122/97
cgacgccauuggccugu

SEQ ID NO: 1054436 - RNA, 23 nt, Mycobacterium bovis subsp bovis AF2122/97
cgacgccaugucgauguccacgc

SEQ ID NO: 1054437 - RNA, 23 nt, Mycobacterium bovis subsp bovis AF2122/97
cgacgccaucugcuggcugggaa

SEQ ID NO: 1054438 - RNA, 15 nt, Mycobacterium bovis subsp bovis AF2122/97
cgacgccagcugccc

SEQ ID NO: 1054439 - RNA, 18 nt, Mycobacterium bovis subsp bovis AF2122/97
cgacgccagcugcccgac

SEQ ID NO: 1054440 - RNA, 22 nt, Mycobacterium bovis subsp bovis AF2122/97
cgacgccagcugcccgacguug

SEQ ID NO: 1054441 - RNA, 15 nt, Mycobacterium bovis subsp bovis AF2122/97
cgacgccgaccaccc

SEQ ID NO: 1054442 - RNA, 13 nt, Mycobacterium bovis subsp bovis AF2122/97
cgacgccgccggc

SEQ ID NO: 1054443 - RNA, 19 nt, Mycobacterium bovis subsp bovis AF2122/97
cgacgccgccggcaccgua

SEQ ID NO: 1054444 - RNA, 22 nt, Mycobacterium bovis subsp bovis AF2122/97
cgacgccgccggccccgccgau

SEQ ID NO: 1054445 - RNA, 15 nt, Mycobacterium bovis subsp bovis AF2122/97
cgacgccgccggcgc

SEQ ID NO: 1054446 - RNA, 12 nt, Mycobacterium bovis subsp bovis AF2122/97
cgacgccgccac

SEQ ID NO: 1054447 - RNA, 19 nt, Mycobacterium bovis subsp bovis AF2122/97
cgacgccgccacccggcgg

SEQ ID NO: 1054448 - RNA, 22 nt, Mycobacterium bovis subsp bovis AF2122/97
cgacgccgccacccggcgggcg

SEQ ID NO: 1054449 - RNA, 20 nt, Mycobacterium bovis subsp bovis AF2122/97
cgacgccgccagguccgccg

SEQ ID NO: 1054450 - RNA, 19 nt, Mycobacterium bovis subsp bovis AF2122/97
cgacgccaguguugcgcug

SEQ ID NO: 1054451 - RNA, 18 nt, Mycobacterium bovis subsp bovis AF2122/97
cgacgccgaucgcggcgg

SEQ ID NO: 1054452 - RNA, 17 nt, Mycobacterium bovis subsp bovis AF2122/97
cgacgccgcgcagccgg

SEQ ID NO: 1054453 - RNA, 20 nt, Mycobacterium bovis subsp bovis AF2122/97
cgacgccgcgcagccggccc

SEQ ID NO: 1054454 - RNA, 16 nt, Mycobacterium bovis subsp bovis AF2122/97
cgacgcgaacgcggcc

SEQ ID NO: 1054455 - RNA, 13 nt, Mycobacterium bovis subsp bovis AF2122/97
cgacgcgaagcua

SEQ ID NO: 1054456 - RNA, 18 nt, Mycobacterium bovis subsp bovis AF2122/97
cgacgcgacacacgccgc

SEQ ID NO: 1054457 - RNA, 15 nt, Mycobacterium bovis subsp bovis AF2122/97
cgacgcgacacgccg

SEQ ID NO: 1054458 - RNA, 17 nt, Mycobacterium bovis subsp bovis AF2122/97
cgacgcgacacgccgau

SEQ ID NO: 1054459 - RNA, 18 nt, Mycobacterium bovis subsp bovis AF2122/97
cgacgccuugucggcgug

SEQ ID NO: 1054460 - RNA, 19 nt, Mycobacterium bovis subsp bovis AF2122/97
cgacgccugggcacggccg

SEQ ID NO: 1054461 - RNA, 16 nt, Mycobacterium bovis subsp bovis AF2122/97
cgacgcgaccgcgaug

SEQ ID NO: 1054462 - RNA, 16 nt, Mycobacterium bovis subsp bovis AF2122/97
cgacgcgacacgccgg

SEQ ID NO: 1054463 - RNA, 13 nt, Mycobacterium bovis subsp bovis AF2122/97
cgacgcgaucugu

SEQ ID NO: 1054464 - RNA, 19 nt, Mycobacterium bovis subsp bovis AF2122/97
cgacgcgaucuguccgcga

SEQ ID NO: 1054465 - RNA, 21 nt, Mycobacterium bovis subsp bovis AF2122/97
cgacgcgaucuguccgcgaac

SEQ ID NO: 1054466 - RNA, 16 nt, Mycobacterium bovis subsp bovis AF2122/97
cgacgcgcaucgcacg

SEQ ID NO: 1054467 - RNA, 19 nt, Mycobacterium bovis subsp bovis AF2122/97
cgacgcgcaucgcacgggc

SEQ ID NO: 1054468 - RNA, 19 nt, Mycobacterium bovis subsp bovis AF2122/97
cgacgcgcauucgccgggc

SEQ ID NO: 1054469 - RNA, 17 nt, Mycobacterium bovis subsp bovis AF2122/97
cgacgcgucggcgacgc

SEQ ID NO: 1054470 - RNA, 17 nt, Mycobacterium bovis subsp bovis AF2122/97
cgacgcguugcucgaaa

SEQ ID NO: 1054471 - RNA, 17 nt, Mycobacterium bovis subsp bovis AF2122/97
cgacgcuaaguccccgc

SEQ ID NO: 1054472 - RNA, 17 nt, Mycobacterium bovis subsp bovis AF2122/97
cgacgcuaccgccggag

SEQ ID NO: 1054473 - RNA, 14 nt, Mycobacterium bovis subsp bovis AF2122/97
cgacgcucaucucg

SEQ ID NO: 1054474 - RNA, 15 nt, Mycobacterium bovis subsp bovis AF2122/97
cgacgcgggccgcga

SEQ ID NO: 1054475 - RNA, 14 nt, Mycobacterium bovis subsp bovis AF2122/97
cgacgcgucggcga

SEQ ID NO: 1054476 - RNA, 19 nt, Mycobacterium bovis subsp bovis AF2122/97
cgacgcguccggugcacca

SEQ ID NO: 1054477 - RNA, 20 nt, Mycobacterium bovis subsp bovis AF2122/97
cgacgcggucggcggccgcc

SEQ ID NO: 1054478 - RNA, 23 nt, Mycobacterium bovis subsp bovis AF2122/97
cgacgcggucggcggccgccagg

SEQ ID NO: 1054479 - RNA, 23 nt, Mycobacterium bovis subsp bovis AF2122/97
cgacgcgggcguugacgaacacc

SEQ ID NO: 1054480 - RNA, 14 nt, Mycobacterium bovis subsp bovis AF2122/97
cgacgcgggcguug

SEQ ID NO: 1054481 - RNA, 20 nt, Mycobacterium bovis subsp bovis AF2122/97
cgacgcggcgucggucgggu

SEQ ID NO: 1054482 - RNA, 16 nt, Mycobacterium bovis subsp bovis AF2122/97
cgaccgaccuggucgg

SEQ ID NO: 1054483 - RNA, 20 nt, Mycobacterium bovis subsp bovis AF2122/97
cgacccuucgggcuggucgg

SEQ ID NO: 1054484 - RNA, 21 nt, Mycobacterium bovis subsp bovis AF2122/97
cgaccgaaaauucaggcgccg

SEQ ID NO: 1054485 - RNA, 21 nt, Mycobacterium bovis subsp bovis AF2122/97
cgaccgaaacggggcgacguc

SEQ ID NO: 1054486 - RNA, 15 nt, Mycobacterium bovis subsp bovis AF2122/97
cgaccgacaccacca

SEQ ID NO: 1054487 - RNA, 20 nt, Mycobacterium bovis subsp bovis AF2122/97
cgaccgauaacacccgggcc

SEQ ID NO: 1054488 - RNA, 20 nt, Mycobacterium bovis subsp bovis AF2122/97
cgaccgauagcuggccgaug

SEQ ID NO: 1054489 - RNA, 16 nt, Mycobacterium bovis subsp bovis AF2122/97
cgaccgaggcacgucg

SEQ ID NO: 1054490 - RNA, 15 nt, Mycobacterium bovis subsp bovis AF2122/97
cgaccgacgggucgu

SEQ ID NO: 1054491 - RNA, 16 nt, Mycobacterium bovis subsp bovis AF2122/97
cgaccgacgucgccca

SEQ ID NO: 1054492 - RNA, 19 nt, Mycobacterium bovis subsp bovis AF2122/97
cgaccgagacggcgucggg

SEQ ID NO: 1054493 - RNA, 14 nt, Mycobacterium bovis subsp bovis AF2122/97
cgaccgcacgacca

SEQ ID NO: 1054494 - RNA, 20 nt, Mycobacterium bovis subsp bovis AF2122/97
cgaccgaugaucucacccag

SEQ ID NO: 1054495 - RNA, 12 nt, Mycobacterium bovis subsp bovis AF2122/97
cgaccgacggac

SEQ ID NO: 1054496 - RNA, 13 nt, Mycobacterium bovis subsp bovis AF2122/97
cgacccgggccgg

SEQ ID NO: 1054497 - RNA, 12 nt, Mycobacterium bovis subsp bovis AF2122/97
cgacccgggcga

SEQ ID NO: 1054498 - RNA, 16 nt, Mycobacterium bovis subsp bovis AF2122/97
cgacccgggcguccca

SEQ ID NO: 1054499 - RNA, 17 nt, Mycobacterium bovis subsp bovis AF2122/97
cgacccgggggcgcccg

SEQ ID NO: 1054500 - RNA, 16 nt, Mycobacterium bovis subsp bovis AF2122/97
cgacccgggaaggaac

SEQ ID NO: 1054501 - RNA, 19 nt, Mycobacterium bovis subsp bovis AF2122/97
cgacccgggaaggaaccgg

SEQ ID NO: 1054502 - RNA, 19 nt, Mycobacterium bovis subsp bovis AF2122/97
cgacccgaacugggcgauc

SEQ ID NO: 1054503 - RNA, 20 nt, Mycobacterium bovis subsp bovis AF2122/97
cgacccgggaaggaaccggg

SEQ ID NO: 1054504 - RNA, 15 nt, Mycobacterium bovis subsp bovis AF2122/97
cgacccgguccacgc

SEQ ID NO: 1054505 - RNA, 12 nt, Mycobacterium bovis subsp bovis AF2122/97
cgacccggucga

SEQ ID NO: 1054506 - RNA, 14 nt, Mycobacterium bovis subsp bovis AF2122/97
cgacccggucgacg

SEQ ID NO: 1054507 - RNA, 23 nt, Mycobacterium bovis subsp bovis AF2122/97
cgacccggucgacgggucggcgc

SEQ ID NO: 1054508 - RNA, 14 nt, Mycobacterium bovis subsp bovis AF2122/97
cgacccgggcgucc

SEQ ID NO: 1054509 - RNA, 22 nt, Mycobacterium bovis subsp bovis AF2122/97
cgacccgggucggcacgacccg

SEQ ID NO: 1054510 - RNA, 18 nt, Mycobacterium bovis subsp bovis AF2122/97
cgacccgguuguguuggg

SEQ ID NO: 1054511 - RNA, 14 nt, Mycobacterium bovis subsp bovis AF2122/97
cgacccguaccagc

SEQ ID NO: 1054512 - RNA, 22 nt, Mycobacterium bovis subsp bovis AF2122/97
cgacccguugaacucgaagacc

SEQ ID NO: 1054513 - RNA, 14 nt, Mycobacterium bovis subsp bovis AF2122/97
cgacccugcccagc

SEQ ID NO: 1054514 - RNA, 20 nt, Mycobacterium bovis subsp bovis AF2122/97
cgacccugcccagcaccccc

SEQ ID NO: 1054515 - RNA, 21 nt, Mycobacterium bovis subsp bovis AF2122/97
cgacccuagauaugcacccgc

SEQ ID NO: 1054516 - RNA, 13 nt, Mycobacterium bovis subsp bovis AF2122/97
cgacccggccgcu

SEQ ID NO: 1054517 - RNA, 14 nt, Mycobacterium bovis subsp bovis AF2122/97
cgacccggcccagc

SEQ ID NO: 1054518 - RNA, 14 nt, Mycobacterium bovis subsp bovis AF2122/97
cgacccggccagcg

SEQ ID NO: 1054519 - RNA, 23 nt, Mycobacterium bovis subsp bovis AF2122/97
cgacccggccaagggugcuuguc

SEQ ID NO: 1054520 - RNA, 13 nt, Mycobacterium bovis subsp bovis AF2122/97
cgacccgcggcgg

SEQ ID NO: 1054521 - RNA, 18 nt, Mycobacterium bovis subsp bovis AF2122/97
cgacccggaccugggcga

SEQ ID NO: 1054522 - RNA, 18 nt, Mycobacterium bovis subsp bovis AF2122/97
cgacccgccgacgccgcc

SEQ ID NO: 1054523 - RNA, 20 nt, Mycobacterium bovis subsp bovis AF2122/97
cgacccgccgacgccgccgg

SEQ ID NO: 1054524 - RNA, 21 nt, Mycobacterium bovis subsp bovis AF2122/97
cgacccgccgacgccgccggc

SEQ ID NO: 1054525 - RNA, 17 nt, Mycobacterium bovis subsp bovis AF2122/97
cgacccgcccgaagaug

SEQ ID NO: 1054526 - RNA, 20 nt, Mycobacterium bovis subsp bovis AF2122/97
cgacccgcagaccgccaccg

SEQ ID NO: 1054527 - RNA, 20 nt, Mycobacterium bovis subsp bovis AF2122/97
cgacccgaugcgucucgcgc

SEQ ID NO: 1054528 - RNA, 13 nt, Mycobacterium bovis subsp bovis AF2122/97
cgacccgccgccc

SEQ ID NO: 1054529 - RNA, 17 nt, Mycobacterium bovis subsp bovis AF2122/97
cgacccgccgcgcccgg

SEQ ID NO: 1054530 - RNA, 21 nt, Mycobacterium bovis subsp bovis AF2122/97
cgacccgccgcgcccggcgca

SEQ ID NO: 1054531 - RNA, 22 nt, Mycobacterium bovis subsp bovis AF2122/97
cgacccgccgcgcccggcgcaa

SEQ ID NO: 1054532 - RNA, 15 nt, Mycobacterium bovis subsp bovis AF2122/97
cgacccgcgcgccgg

SEQ ID NO: 1054533 - RNA, 18 nt, Mycobacterium bovis subsp bovis AF2122/97
cgacccgcgcgccggcga

SEQ ID NO: 1054534 - RNA, 14 nt, Mycobacterium bovis subsp bovis AF2122/97
cgacccgcaacccg

SEQ ID NO: 1054535 - RNA, 22 nt, Mycobacterium bovis subsp bovis AF2122/97
cgacccgccgcggacaccagga

SEQ ID NO: 1054536 - RNA, 13 nt, Mycobacterium bovis subsp bovis AF2122/97
cgaccccggcugc

SEQ ID NO: 1054537 - RNA, 15 nt, Mycobacterium bovis subsp bovis AF2122/97
cgaccccggcugcgc

SEQ ID NO: 1054538 - RNA, 19 nt, Mycobacterium bovis subsp bovis AF2122/97
cgacaugagcgccacgccg

SEQ ID NO: 1054539 - RNA, 15 nt, Mycobacterium bovis subsp bovis AF2122/97
cgaccccggccccga

SEQ ID NO: 1054540 - RNA, 15 nt, Mycobacterium bovis subsp bovis AF2122/97
cgacaugacgcggcc

SEQ ID NO: 1054541 - RNA, 22 nt, Mycobacterium bovis subsp bovis AF2122/97
cgacaugaggcugccgaaguug

SEQ ID NO: 1054542 - RNA, 17 nt, Mycobacterium bovis subsp bovis AF2122/97
cgacccgaacugggcga

SEQ ID NO: 1054543 - RNA, 17 nt, Mycobacterium bovis subsp bovis AF2122/97
cgacccgacgcuggucg

SEQ ID NO: 1054544 - RNA, 16 nt, Mycobacterium bovis subsp bovis AF2122/97
cgacccgacguagccg

SEQ ID NO: 1054545 - RNA, 21 nt, Mycobacterium bovis subsp bovis AF2122/97
cgacaucugcccagcgguugc

SEQ ID NO: 1054546 - RNA, 13 nt, Mycobacterium bovis subsp bovis AF2122/97
cgacaucggccag

SEQ ID NO: 1054547 - RNA, 19 nt, Mycobacterium bovis subsp bovis AF2122/97
cgacaucggcccgaucacc

SEQ ID NO: 1054548 - RNA, 21 nt, Mycobacterium bovis subsp bovis AF2122/97
cgacaucggcccgaucaccau

SEQ ID NO: 1054549 - RNA, 20 nt, Mycobacterium bovis subsp bovis AF2122/97
cgacaucucggucagaugcg

SEQ ID NO: 1054550 - RNA, 18 nt, Mycobacterium bovis subsp bovis AF2122/97
cgacaucgugauccccgc

SEQ ID NO: 1054551 - RNA, 16 nt, Mycobacterium bovis subsp bovis AF2122/97
cgacaucguuggccgg

SEQ ID NO: 1054552 - RNA, 20 nt, Mycobacterium bovis subsp bovis AF2122/97
cgacaucgguggcggccucc

SEQ ID NO: 1054553 - RNA, 19 nt, Mycobacterium bovis subsp bovis AF2122/97
cgacaucgucgcgacgacg

SEQ ID NO: 1054554 - RNA, 14 nt, Mycobacterium bovis subsp bovis AF2122/97
cgacaucggcggcc

SEQ ID NO: 1054555 - RNA, 12 nt, Mycobacterium bovis subsp bovis AF2122/97
cgacaucgccau

SEQ ID NO: 1054556 - RNA, 15 nt, Mycobacterium bovis subsp bovis AF2122/97
cgacaucgcugcgac

SEQ ID NO: 1054557 - RNA, 19 nt, Mycobacterium bovis subsp bovis AF2122/97
cgacauccagaugcccagc

SEQ ID NO: 1054558 - RNA, 19 nt, Mycobacterium bovis subsp bovis AF2122/97
cgaccgcggggcagcgggc

SEQ ID NO: 1054559 - RNA, 23 nt, Mycobacterium bovis subsp bovis AF2122/97
cgaccgcggggcagcgggccgcc

SEQ ID NO: 1054560 - RNA, 22 nt, Mycobacterium bovis subsp bovis AF2122/97
cgaccgcgggucgugccagcag

SEQ ID NO: 1054561 - RNA, 23 nt, Mycobacterium bovis subsp bovis AF2122/97
cgaccgccaccgccagcgucgac

SEQ ID NO: 1054562 - RNA, 22 nt, Mycobacterium bovis subsp bovis AF2122/97
cgaccgcgggccgacgcaggug

SEQ ID NO: 1054563 - RNA, 19 nt, Mycobacterium bovis subsp bovis AF2122/97
cgaccggaaugcccgggcc

SEQ ID NO: 1054564 - RNA, 19 nt, Mycobacterium bovis subsp bovis AF2122/97
cgaccggacacuccugcac

SEQ ID NO: 1054565 - RNA, 21 nt, Mycobacterium bovis subsp bovis AF2122/97
cgaccggacacuccugcacac

SEQ ID NO: 1054566 - RNA, 17 nt, Mycobacterium bovis subsp bovis AF2122/97
cgaccggaacuguggug

SEQ ID NO: 1054567 - RNA, 18 nt, Mycobacterium bovis subsp bovis AF2122/97
cgaccgcugaugaagaug

SEQ ID NO: 1054568 - RNA, 19 nt, Mycobacterium bovis subsp bovis AF2122/97
cgaccgcugaugaagauga

SEQ ID NO: 1054569 - RNA, 18 nt, Mycobacterium bovis subsp bovis AF2122/97
cgaccgcguuguccgcgg

SEQ ID NO: 1054570 - RNA, 19 nt, Mycobacterium bovis subsp bovis AF2122/97
cgaccgcguuguccgcggc

SEQ ID NO: 1054571 - RNA, 20 nt, Mycobacterium bovis subsp bovis AF2122/97
cgaccgcguuuugcaggccc

SEQ ID NO: 1054572 - RNA, 22 nt, Mycobacterium bovis subsp bovis AF2122/97
cgaccgcuaugaugccgccggu

SEQ ID NO: 1054573 - RNA, 12 nt, Mycobacterium bovis subsp bovis AF2122/97
cgaccggcaccc

SEQ ID NO: 1054574 - RNA, 15 nt, Mycobacterium bovis subsp bovis AF2122/97
cgaccggcaacgcgg

SEQ ID NO: 1054575 - RNA, 17 nt, Mycobacterium bovis subsp bovis AF2122/97
cgaccggcaacgcggcc

SEQ ID NO: 1054576 - RNA, 20 nt, Mycobacterium bovis subsp bovis AF2122/97
cgaccggcaacgcggccuug

SEQ ID NO: 1054577 - RNA, 18 nt, Mycobacterium bovis subsp bovis AF2122/97
cgaccggacgagcgucag

SEQ ID NO: 1054578 - RNA, 19 nt, Mycobacterium bovis subsp bovis AF2122/97
cgaccggacgagcgucaga

SEQ ID NO: 1054579 - RNA, 19 nt, Mycobacterium bovis subsp bovis AF2122/97
cgaccggacgaucagggug

SEQ ID NO: 1054580 - RNA, 13 nt, Mycobacterium bovis subsp bovis AF2122/97
cgaccggaccggg

SEQ ID NO: 1054581 - RNA, 19 nt, Mycobacterium bovis subsp bovis AF2122/97
cgaccggcacccgcggcga

SEQ ID NO: 1054582 - RNA, 22 nt, Mycobacterium bovis subsp bovis AF2122/97
cgaccggcagcgaugcgguguc

SEQ ID NO: 1054583 - RNA, 16 nt, Mycobacterium bovis subsp bovis AF2122/97
cgaccggcuccggaca

SEQ ID NO: 1054584 - RNA, 21 nt, Mycobacterium bovis subsp bovis AF2122/97
cgaccggcccgcauccgcacc

SEQ ID NO: 1054585 - RNA, 19 nt, Mycobacterium bovis subsp bovis AF2122/97
cgaccggcgggaugcgcgc

SEQ ID NO: 1054586 - RNA, 23 nt, Mycobacterium bovis subsp bovis AF2122/97
cgaccggcgggaugcgcgcccga

SEQ ID NO: 1054587 - RNA, 17 nt, Mycobacterium bovis subsp bovis AF2122/97
cgaccggcguaaccggc

SEQ ID NO: 1054588 - RNA, 18 nt, Mycobacterium bovis subsp bovis AF2122/97
cgaccggcguaaccggca

SEQ ID NO: 1054589 - RNA, 19 nt, Mycobacterium bovis subsp bovis AF2122/97
cgaccgggcucuggccagu

SEQ ID NO: 1054590 - RNA, 19 nt, Mycobacterium bovis subsp bovis AF2122/97
cgaccggccacgaccucgg

SEQ ID NO: 1054591 - RNA, 19 nt, Mycobacterium bovis subsp bovis AF2122/97
cgaccgggaucggcuccgc

SEQ ID NO: 1054592 - RNA, 21 nt, Mycobacterium bovis subsp bovis AF2122/97
cgaccgggucgcaaccgccgc

SEQ ID NO: 1054593 - RNA, 22 nt, Mycobacterium bovis subsp bovis AF2122/97
cgaccgggucgcaaccgccgcc

SEQ ID NO: 1054594 - RNA, 22 nt, Mycobacterium bovis subsp bovis AF2122/97
cgaccgguacccguagcaccac

SEQ ID NO: 1054595 - RNA, 20 nt, Mycobacterium bovis subsp bovis AF2122/97
cgaccgguaauccguugccg

SEQ ID NO: 1054596 - RNA, 15 nt, Mycobacterium bovis subsp bovis AF2122/97
cgaccgguccagcca

SEQ ID NO: 1054597 - RNA, 17 nt, Mycobacterium bovis subsp bovis AF2122/97
cgaccggucuggcgaug

SEQ ID NO: 1054598 - RNA, 23 nt, Mycobacterium bovis subsp bovis AF2122/97
cgaccggugauguagagcucacc

SEQ ID NO: 1054599 - RNA, 15 nt, Mycobacterium bovis subsp bovis AF2122/97
cgaccgguggcaccg

SEQ ID NO: 1054600 - RNA, 19 nt, Mycobacterium bovis subsp bovis AF2122/97
cgaccgguggcaccggcgg

SEQ ID NO: 1054601 - RNA, 13 nt, Mycobacterium bovis subsp bovis AF2122/97
cgaccgcgccgca

SEQ ID NO: 1054602 - RNA, 14 nt, Mycobacterium bovis subsp bovis AF2122/97
cgaccgcgccgcau

SEQ ID NO: 1054603 - RNA, 23 nt, Mycobacterium bovis subsp bovis AF2122/97
cgaccgcgacaacaacucuucgg

SEQ ID NO: 1054604 - RNA, 14 nt, Mycobacterium bovis subsp bovis AF2122/97
cgaccgcgacccgg

SEQ ID NO: 1054605 - RNA, 16 nt, Mycobacterium bovis subsp bovis AF2122/97
cgaccgccugcgcggc

SEQ ID NO: 1054606 - RNA, 13 nt, Mycobacterium bovis subsp bovis AF2122/97
cgaccgcggcccc

SEQ ID NO: 1054607 - RNA, 14 nt, Mycobacterium bovis subsp bovis AF2122/97
cgaccgcggccuug

SEQ ID NO: 1054608 - RNA, 14 nt, Mycobacterium bovis subsp bovis AF2122/97
cgaccgcggccggg

SEQ ID NO: 1054609 - RNA, 14 nt, Mycobacterium bovis subsp bovis AF2122/97
cgaccgcgggccga

SEQ ID NO: 1054610 - RNA, 12 nt, Mycobacterium bovis subsp bovis AF2122/97
cgaccgcgccaa

SEQ ID NO: 1054611 - RNA, 13 nt, Mycobacterium bovis subsp bovis AF2122/97
cgaccgcgccaac

SEQ ID NO: 1054612 - RNA, 14 nt, Mycobacterium bovis subsp bovis AF2122/97
cgaccgcgccaaca

SEQ ID NO: 1054613 - RNA, 17 nt, Mycobacterium bovis subsp bovis AF2122/97
cgaccgcgcccgcgggc

SEQ ID NO: 1054614 - RNA, 14 nt, Mycobacterium bovis subsp bovis AF2122/97
cgaccgcgauggug

SEQ ID NO: 1054615 - RNA, 21 nt, Mycobacterium bovis subsp bovis AF2122/97
cgaccgcgagggccagcaagu

SEQ ID NO: 1054616 - RNA, 16 nt, Mycobacterium bovis subsp bovis AF2122/97
cgaccgcccgccagcg

SEQ ID NO: 1054617 - RNA, 19 nt, Mycobacterium bovis subsp bovis AF2122/97
cgaccgccagccgcgagcc

SEQ ID NO: 1054618 - RNA, 20 nt, Mycobacterium bovis subsp bovis AF2122/97
cgaccgccagccgcgagccg

SEQ ID NO: 1054619 - RNA, 13 nt, Mycobacterium bovis subsp bovis AF2122/97
cgaccgccagccc

SEQ ID NO: 1054620 - RNA, 17 nt, Mycobacterium bovis subsp bovis AF2122/97
cgaccgccaucacgacc

SEQ ID NO: 1054621 - RNA, 18 nt, Mycobacterium bovis subsp bovis AF2122/97
cgaccgccaucacgacca

SEQ ID NO: 1054622 - RNA, 12 nt, Mycobacterium bovis subsp bovis AF2122/97
cgaccgccaccg

SEQ ID NO: 1054623 - RNA, 14 nt, Mycobacterium bovis subsp bovis AF2122/97
cgaccgccaccgcc

SEQ ID NO: 1054624 - RNA, 23 nt, Mycobacterium bovis subsp bovis AF2122/97
cgaccgcauugagcuggcgcccg

SEQ ID NO: 1054625 - RNA, 13 nt, Mycobacterium bovis subsp bovis AF2122/97
cgaccgccguggc

SEQ ID NO: 1054626 - RNA, 14 nt, Mycobacterium bovis subsp bovis AF2122/97
cgaccgccguggcc

SEQ ID NO: 1054627 - RNA, 20 nt, Mycobacterium bovis subsp bovis AF2122/97
cgaccgccguggcccgcucg

SEQ ID NO: 1054628 - RNA, 17 nt, Mycobacterium bovis subsp bovis AF2122/97
cgaccgccguggccgca

SEQ ID NO: 1054629 - RNA, 16 nt, Mycobacterium bovis subsp bovis AF2122/97
cgaccgccggaccgcc

SEQ ID NO: 1054630 - RNA, 19 nt, Mycobacterium bovis subsp bovis AF2122/97
cgaccgccggaccgccgca

SEQ ID NO: 1054631 - RNA, 21 nt, Mycobacterium bovis subsp bovis AF2122/97
cgaccgccgcuaccccagccg

SEQ ID NO: 1054632 - RNA, 14 nt, Mycobacterium bovis subsp bovis AF2122/97
cgagacggcgucgg

SEQ ID NO: 1054633 - RNA, 15 nt, Mycobacterium bovis subsp bovis AF2122/97
cgagaccgcgugguc

SEQ ID NO: 1054634 - RNA, 15 nt, Mycobacterium bovis subsp bovis AF2122/97
cgagacgcaaaaucg

SEQ ID NO: 1054635 - RNA, 16 nt, Mycobacterium bovis subsp bovis AF2122/97
cgagacgcaaaaucgc

SEQ ID NO: 1054636 - RNA, 16 nt, Mycobacterium bovis subsp bovis AF2122/97
cgagacgcacggccac

SEQ ID NO: 1054637 - RNA, 23 nt, Mycobacterium bovis subsp bovis AF2122/97
cgagacgcacggccaccgcgcaa

SEQ ID NO: 1054638 - RNA, 20 nt, Mycobacterium bovis subsp bovis AF2122/97
cgagacgcaugucgggccag

SEQ ID NO: 1054639 - RNA, 19 nt, Mycobacterium bovis subsp bovis AF2122/97
cgagaccgggcaacggcgg

SEQ ID NO: 1054640 - RNA, 19 nt, Mycobacterium bovis subsp bovis AF2122/97
cgagaccgccgcugccgcc

SEQ ID NO: 1054641 - RNA, 14 nt, Mycobacterium bovis subsp bovis AF2122/97
cgagaccgccgcug

SEQ ID NO: 1054642 - RNA, 22 nt, Mycobacterium bovis subsp bovis AF2122/97
cgagaccucucugcgccaggcg

SEQ ID NO: 1054643 - RNA, 16 nt, Mycobacterium bovis subsp bovis AF2122/97
cgagacgacgaccggc

SEQ ID NO: 1054644 - RNA, 15 nt, Mycobacterium bovis subsp bovis AF2122/97
cgagaaucacgguca

SEQ ID NO: 1054645 - RNA, 18 nt, Mycobacterium bovis subsp bovis AF2122/97
cgagcacaugcugccgcu

SEQ ID NO: 1054646 - RNA, 15 nt, Mycobacterium bovis subsp bovis AF2122/97
cgagcaccaccccag

SEQ ID NO: 1054647 - RNA, 18 nt, Mycobacterium bovis subsp bovis AF2122/97
cgagcaccaccccagcgg

SEQ ID NO: 1054648 - RNA, 21 nt, Mycobacterium bovis subsp bovis AF2122/97
cgagcaccaccccagcggcca

SEQ ID NO: 1054649 - RNA, 23 nt, Mycobacterium bovis subsp bovis AF2122/97
cgagcaccaccccagcggccacc

SEQ ID NO: 1054650 - RNA, 23 nt, Mycobacterium bovis subsp bovis AF2122/97
cgagcacaccgaggucgccaacc

SEQ ID NO: 1054651 - RNA, 15 nt, Mycobacterium bovis subsp bovis AF2122/97
cgagcacaugcugcc

SEQ ID NO: 1054652 - RNA, 17 nt, Mycobacterium bovis subsp bovis AF2122/97
cgagcacaugcucgacg

SEQ ID NO: 1054653 - RNA, 18 nt, Mycobacterium bovis subsp bovis AF2122/97
cgagaucagucugggcga

SEQ ID NO: 1054654 - RNA, 18 nt, Mycobacterium bovis subsp bovis AF2122/97
cgagaucagccggcagcg

SEQ ID NO: 1054655 - RNA, 22 nt, Mycobacterium bovis subsp bovis AF2122/97
cgagaucagccucgcgggcagg

SEQ ID NO: 1054656 - RNA, 18 nt, Mycobacterium bovis subsp bovis AF2122/97
cgagcacaccgucgucgu

SEQ ID NO: 1054657 - RNA, 16 nt, Mycobacterium bovis subsp bovis AF2122/97
cgagcacacgucggga

SEQ ID NO: 1054658 - RNA, 17 nt, Mycobacterium bovis subsp bovis AF2122/97
cgagaucaccgguacgc

SEQ ID NO: 1054659 - RNA, 13 nt, Mycobacterium bovis subsp bovis AF2122/97
cgagaucaccggu

SEQ ID NO: 1054660 - RNA, 17 nt, Mycobacterium bovis subsp bovis AF2122/97
cgagaucaccgccacca

SEQ ID NO: 1054661 - RNA, 20 nt, Mycobacterium bovis subsp bovis AF2122/97
cgagaucaccgccaccacca

SEQ ID NO: 1054662 - RNA, 22 nt, Mycobacterium bovis subsp bovis AF2122/97
cgagaucaccgccaccaccagg

SEQ ID NO: 1054663 - RNA, 23 nt, Mycobacterium bovis subsp bovis AF2122/97
cgagaguggacgugucaucacgg

SEQ ID NO: 1054664 - RNA, 17 nt, Mycobacterium bovis subsp bovis AF2122/97
cgagaguggccucgucc

SEQ ID NO: 1054665 - RNA, 23 nt, Mycobacterium bovis subsp bovis AF2122/97
cgagacgcuuuccgccgcaccgg

SEQ ID NO: 1054666 - RNA, 21 nt, Mycobacterium bovis subsp bovis AF2122/97
cgagacggcgucgggccguug

SEQ ID NO: 1054667 - RNA, 18 nt, Mycobacterium bovis subsp bovis AF2122/97
cgagagguucgccgucgg

SEQ ID NO: 1054668 - RNA, 18 nt, Mycobacterium bovis subsp bovis AF2122/97
cgagauacggccaccagg

SEQ ID NO: 1054669 - RNA, 21 nt, Mycobacterium bovis subsp bovis AF2122/97
cgagcacccgcaaugcgcgcg

SEQ ID NO: 1054670 - RNA, 15 nt, Mycobacterium bovis subsp bovis AF2122/97
cgagcaccccgacgu

SEQ ID NO: 1054671 - RNA, 18 nt, Mycobacterium bovis subsp bovis AF2122/97
cgagcaccgacaccggcc

SEQ ID NO: 1054672 - RNA, 20 nt, Mycobacterium bovis subsp bovis AF2122/97
cgagcaccgacaccggccgc

SEQ ID NO: 1054673 - RNA, 22 nt, Mycobacterium bovis subsp bovis AF2122/97
cgagcaccgacaccggccgcga

SEQ ID NO: 1054674 - RNA, 14 nt, Mycobacterium bovis subsp bovis AF2122/97
cgagcacccgcugg

SEQ ID NO: 1054675 - RNA, 15 nt, Mycobacterium bovis subsp bovis AF2122/97
cgagcacccgcucca

SEQ ID NO: 1054676 - RNA, 18 nt, Mycobacterium bovis subsp bovis AF2122/97
cgagcaccgcaaccacgc

SEQ ID NO: 1054677 - RNA, 22 nt, Mycobacterium bovis subsp bovis AF2122/97
cgagcaccgcaaccacgccccg

SEQ ID NO: 1054678 - RNA, 15 nt, Mycobacterium bovis subsp bovis AF2122/97
cgagcaccgcgaaca

SEQ ID NO: 1054679 - RNA, 13 nt, Mycobacterium bovis subsp bovis AF2122/97
cgagcaccgcgcc

SEQ ID NO: 1054680 - RNA, 15 nt, Mycobacterium bovis subsp bovis AF2122/97
cgagcaccgcgccgc

SEQ ID NO: 1054681 - RNA, 19 nt, Mycobacterium bovis subsp bovis AF2122/97
cgagcaccgcgccgcgccg

SEQ ID NO: 1054682 - RNA, 13 nt, Mycobacterium bovis subsp bovis AF2122/97
cgagcaccggcug

SEQ ID NO: 1054683 - RNA, 16 nt, Mycobacterium bovis subsp bovis AF2122/97
cgagcaccggcugcgg

SEQ ID NO: 1054684 - RNA, 17 nt, Mycobacterium bovis subsp bovis AF2122/97
cgagcaccucggccucg

SEQ ID NO: 1054685 - RNA, 15 nt, Mycobacterium bovis subsp bovis AF2122/97
cgagcagggcgucga

SEQ ID NO: 1054686 - RNA, 20 nt, Mycobacterium bovis subsp bovis AF2122/97
cgagcagggccggcaccgca

SEQ ID NO: 1054687 - RNA, 14 nt, Mycobacterium bovis subsp bovis AF2122/97
cgagcagcgcgccg

SEQ ID NO: 1054688 - RNA, 22 nt, Mycobacterium bovis subsp bovis AF2122/97
cgagcagcgcgccguucgccug

SEQ ID NO: 1054689 - RNA, 15 nt, Mycobacterium bovis subsp bovis AF2122/97
cgagcaggucggaga

SEQ ID NO: 1054690 - RNA, 15 nt, Mycobacterium bovis subsp bovis AF2122/97
cgagcaggucggcaa

SEQ ID NO: 1054691 - RNA, 14 nt, Mycobacterium bovis subsp bovis AF2122/97
cgagcagggugacc

SEQ ID NO: 1054692 - RNA, 19 nt, Mycobacterium bovis subsp bovis AF2122/97
cgagcagggugaccaggau

SEQ ID NO: 1054693 - RNA, 18 nt, Mycobacterium bovis subsp bovis AF2122/97
cgagcagcaccacccgca

SEQ ID NO: 1054694 - RNA, 21 nt, Mycobacterium bovis subsp bovis AF2122/97
cgagcagauacuccgcgguug

SEQ ID NO: 1054695 - RNA, 22 nt, Mycobacterium bovis subsp bovis AF2122/97
cgagcagauacuccgcgguugu

SEQ ID NO: 1054696 - RNA, 15 nt, Mycobacterium bovis subsp bovis AF2122/97
cgagcagauggugaa

SEQ ID NO: 1054697 - RNA, 17 nt, Mycobacterium bovis subsp bovis AF2122/97
cgagcagccgaugcugc

SEQ ID NO: 1054698 - RNA, 15 nt, Mycobacterium bovis subsp bovis AF2122/97
cgagcagcccggcga

SEQ ID NO: 1054699 - RNA, 13 nt, Mycobacterium bovis subsp bovis AF2122/97
cgagcagcccggc

SEQ ID NO: 1054700 - RNA, 13 nt, Mycobacterium bovis subsp bovis AF2122/97
cgagcagcccgcg

SEQ ID NO: 1054701 - RNA, 19 nt, Mycobacterium bovis subsp bovis AF2122/97
cgagccggugccacugccg

SEQ ID NO: 1054702 - RNA, 19 nt, Mycobacterium bovis subsp bovis AF2122/97
cgagccgguaaccgcgucg

SEQ ID NO: 1054703 - RNA, 18 nt, Mycobacterium bovis subsp bovis AF2122/97
cgagccgguauacccggc

SEQ ID NO: 1054704 - RNA, 17 nt, Mycobacterium bovis subsp bovis AF2122/97
cgagccggugauccggu

SEQ ID NO: 1054705 - RNA, 19 nt, Mycobacterium bovis subsp bovis AF2122/97
cgagccggugccgcgguag

SEQ ID NO: 1054706 - RNA, 13 nt, Mycobacterium bovis subsp bovis AF2122/97
cgagcgccggccg

SEQ ID NO: 1054707 - RNA, 14 nt, Mycobacterium bovis subsp bovis AF2122/97
cgagcgccggccgc

SEQ ID NO: 1054708 - RNA, 20 nt, Mycobacterium bovis subsp bovis AF2122/97
cgagcgccggccgcggcggc

SEQ ID NO: 1054709 - RNA, 18 nt, Mycobacterium bovis subsp bovis AF2122/97
cgagcgccggccgcgggu

SEQ ID NO: 1054710 - RNA, 12 nt, Mycobacterium bovis subsp bovis AF2122/97
cgagcgccggcu

SEQ ID NO: 1054711 - RNA, 14 nt, Mycobacterium bovis subsp bovis AF2122/97
cgagcgccgcggac

SEQ ID NO: 1054712 - RNA, 12 nt, Mycobacterium bovis subsp bovis AF2122/97
cgagccagcgga

SEQ ID NO: 1054713 - RNA, 22 nt, Mycobacterium bovis subsp bovis AF2122/97
cgagcgccucgggaggcagcgc

SEQ ID NO: 1054714 - RNA, 16 nt, Mycobacterium bovis subsp bovis AF2122/97
cgagcgggaucgggcc

SEQ ID NO: 1054715 - RNA, 15 nt, Mycobacterium bovis subsp bovis AF2122/97
cgagcggcggcacug

SEQ ID NO: 1054716 - RNA, 15 nt, Mycobacterium bovis subsp bovis AF2122/97
cgagcggcugagccg

SEQ ID NO: 1054717 - RNA, 16 nt, Mycobacterium bovis subsp bovis AF2122/97
cgagcggcccuucacc

SEQ ID NO: 1054718 - RNA, 20 nt, Mycobacterium bovis subsp bovis AF2122/97
cgagcggcccuucaccagcc

SEQ ID NO: 1054719 - RNA, 19 nt, Mycobacterium bovis subsp bovis AF2122/97
cgagcggcaucggucaccg

SEQ ID NO: 1054720 - RNA, 18 nt, Mycobacterium bovis subsp bovis AF2122/97
cgagcggccuccagcacc

SEQ ID NO: 1054721 - RNA, 19 nt, Mycobacterium bovis subsp bovis AF2122/97
cgagcggccuccagcaccc

SEQ ID NO: 1054722 - RNA, 13 nt, Mycobacterium bovis subsp bovis AF2122/97
cgagcgcuucguc

SEQ ID NO: 1054723 - RNA, 12 nt, Mycobacterium bovis subsp bovis AF2122/97
cgagcggcaucg

SEQ ID NO: 1054724 - RNA, 17 nt, Mycobacterium bovis subsp bovis AF2122/97
cgagcggcaucggucac

SEQ ID NO: 1054725 - RNA, 19 nt, Mycobacterium bovis subsp bovis AF2122/97
cgagcgcuucgucgccgaa

SEQ ID NO: 1054726 - RNA, 19 nt, Mycobacterium bovis subsp bovis AF2122/97
cgagcgcuugaccccgccg

SEQ ID NO: 1054727 - RNA, 21 nt, Mycobacterium bovis subsp bovis AF2122/97
cgagcgcuugaccccgccgaa

SEQ ID NO: 1054728 - RNA, 22 nt, Mycobacterium bovis subsp bovis AF2122/97
cgagcgcuugaccccgccgaac

SEQ ID NO: 1054729 - RNA, 21 nt, Mycobacterium bovis subsp bovis AF2122/97
cgagcggaauggaggccgccg

SEQ ID NO: 1054730 - RNA, 22 nt, Mycobacterium bovis subsp bovis AF2122/97
cgagcggacacauaagcccccg

SEQ ID NO: 1054731 - RNA, 18 nt, Mycobacterium bovis subsp bovis AF2122/97
cgagcggaccaccgcucg

SEQ ID NO: 1054732 - RNA, 22 nt, Mycobacterium bovis subsp bovis AF2122/97
cgagcggagccgccgacucggc

SEQ ID NO: 1054733 - RNA, 20 nt, Mycobacterium bovis subsp bovis AF2122/97
cgagcgcgccgaaggccgcc

SEQ ID NO: 1054734 - RNA, 16 nt, Mycobacterium bovis subsp bovis AF2122/97
cgagcgcgaucgggcc

SEQ ID NO: 1054735 - RNA, 18 nt, Mycobacterium bovis subsp bovis AF2122/97
cgagcgcgaucgggccgg

SEQ ID NO: 1054736 - RNA, 24 nt, Mycobacterium bovis subsp bovis AF2122/97
cgagcgcgaucgggccggcgcggu

SEQ ID NO: 1054737 - RNA, 20 nt, Mycobacterium bovis subsp bovis AF2122/97
cgagcgcgccaaucgcccag

SEQ ID NO: 1054738 - RNA, 19 nt, Mycobacterium bovis subsp bovis AF2122/97
cgagcccacguggggccgg

SEQ ID NO: 1054739 - RNA, 13 nt, Mycobacterium bovis subsp bovis AF2122/97
cgagccaucaccg

SEQ ID NO: 1054740 - RNA, 19 nt, Mycobacterium bovis subsp bovis AF2122/97
cgagccagcuucccgcugg

SEQ ID NO: 1054741 - RNA, 16 nt, Mycobacterium bovis subsp bovis AF2122/97
cgagccacggcuucgc

SEQ ID NO: 1054742 - RNA, 19 nt, Mycobacterium bovis subsp bovis AF2122/97
cgagccacaaaggcgccgg

SEQ ID NO: 1054743 - RNA, 22 nt, Mycobacterium bovis subsp bovis AF2122/97
cgagccacaugaccugauccgg

SEQ ID NO: 1054744 - RNA, 21 nt, Mycobacterium bovis subsp bovis AF2122/97
cgagccagcacccgcagccgc

SEQ ID NO: 1054745 - RNA, 19 nt, Mycobacterium bovis subsp bovis AF2122/97
cgagcagucgcaaaagccc

SEQ ID NO: 1054746 - RNA, 20 nt, Mycobacterium bovis subsp bovis AF2122/97
cgagcagucgcaaaagcccc

SEQ ID NO: 1054747 - RNA, 21 nt, Mycobacterium bovis subsp bovis AF2122/97
cgagcagucgcaaaagccccc

SEQ ID NO: 1054748 - RNA, 17 nt, Mycobacterium bovis subsp bovis AF2122/97
cgagcagguuccgcacg

SEQ ID NO: 1054749 - RNA, 15 nt, Mycobacterium bovis subsp bovis AF2122/97
cgagcaguggccgcc

SEQ ID NO: 1054750 - RNA, 20 nt, Mycobacterium bovis subsp bovis AF2122/97
cgagcaguggccgccgggca

SEQ ID NO: 1054751 - RNA, 20 nt, Mycobacterium bovis subsp bovis AF2122/97
cgagcaguuccagcucgcgg

SEQ ID NO: 1054752 - RNA, 20 nt, Mycobacterium bovis subsp bovis AF2122/97
cgagcagugccucggcgaug

SEQ ID NO: 1054753 - RNA, 22 nt, Mycobacterium bovis subsp bovis AF2122/97
cgagcagguuccgcacgaucgg

SEQ ID NO: 1054754 - RNA, 18 nt, Mycobacterium bovis subsp bovis AF2122/97
cgagcagugaccgcuggu

SEQ ID NO: 1054755 - RNA, 22 nt, Mycobacterium bovis subsp bovis AF2122/97
cgagcaguucucggucccgccg

SEQ ID NO: 1054756 - RNA, 15 nt, Mycobacterium bovis subsp bovis AF2122/97
cgagccacgacccag

SEQ ID NO: 1054757 - RNA, 21 nt, Mycobacterium bovis subsp bovis AF2122/97
cgagccacgccagcgucgacc

SEQ ID NO: 1054758 - RNA, 19 nt, Mycobacterium bovis subsp bovis AF2122/97
cgagccggauucggcugcc

SEQ ID NO: 1054759 - RNA, 20 nt, Mycobacterium bovis subsp bovis AF2122/97
cgagccggauucggcugcca

SEQ ID NO: 1054760 - RNA, 22 nt, Mycobacterium bovis subsp bovis AF2122/97
cgagccggcucagacgacgauc

SEQ ID NO: 1054761 - RNA, 16 nt, Mycobacterium bovis subsp bovis AF2122/97
cgagccggcgccgggu

SEQ ID NO: 1054762 - RNA, 12 nt, Mycobacterium bovis subsp bovis AF2122/97
cgagccggcgcg

SEQ ID NO: 1054763 - RNA, 21 nt, Mycobacterium bovis subsp bovis AF2122/97
cgagccgcgugggccgcugca

SEQ ID NO: 1054764 - RNA, 12 nt, Mycobacterium bovis subsp bovis AF2122/97
cgagccgcucca

SEQ ID NO: 1054765 - RNA, 14 nt, Mycobacterium bovis subsp bovis AF2122/97
cgagccgcggucac

SEQ ID NO: 1054766 - RNA, 19 nt, Mycobacterium bovis subsp bovis AF2122/97
cgagccgcggucaccccgg

SEQ ID NO: 1054767 - RNA, 17 nt, Mycobacterium bovis subsp bovis AF2122/97
cgagccgcggucggcgu

SEQ ID NO: 1054768 - RNA, 16 nt, Mycobacterium bovis subsp bovis AF2122/97
cgagccgcgaugcgcc

SEQ ID NO: 1054769 - RNA, 14 nt, Mycobacterium bovis subsp bovis AF2122/97
cgagccgccgugga

SEQ ID NO: 1054770 - RNA, 13 nt, Mycobacterium bovis subsp bovis AF2122/97
cgagcccagcgcc

SEQ ID NO: 1054771 - RNA, 14 nt, Mycobacterium bovis subsp bovis AF2122/97
cgagcccagcgccu

SEQ ID NO: 1054772 - RNA, 20 nt, Mycobacterium bovis subsp bovis AF2122/97
cgagcccaauccgcaacagc

SEQ ID NO: 1054773 - RNA, 17 nt, Mycobacterium bovis subsp bovis AF2122/97
cgagcccagcugcgccg

SEQ ID NO: 1054774 - RNA, 19 nt, Mycobacterium bovis subsp bovis AF2122/97
cgacguaggacugccagcg

SEQ ID NO: 1054775 - RNA, 17 nt, Mycobacterium bovis subsp bovis AF2122/97
cgacgguuugcaccgcg

SEQ ID NO: 1054776 - RNA, 21 nt, Mycobacterium bovis subsp bovis AF2122/97
cgacguagacgacgucggccg

SEQ ID NO: 1054777 - RNA, 17 nt, Mycobacterium bovis subsp bovis AF2122/97
cgacguaaugcgcugcc

SEQ ID NO: 1054778 - RNA, 17 nt, Mycobacterium bovis subsp bovis AF2122/97
cgacggucagguccugg

SEQ ID NO: 1054779 - RNA, 18 nt, Mycobacterium bovis subsp bovis AF2122/97
cgacguagacgacgucgg

SEQ ID NO: 1054780 - RNA, 17 nt, Mycobacterium bovis subsp bovis AF2122/97
cgacguccucgacgauc

SEQ ID NO: 1054781 - RNA, 13 nt, Mycobacterium bovis subsp bovis AF2122/97
cgacgucgacaau

SEQ ID NO: 1054782 - RNA, 13 nt, Mycobacterium bovis subsp bovis AF2122/97
cgacgucgaccac

SEQ ID NO: 1054783 - RNA, 16 nt, Mycobacterium bovis subsp bovis AF2122/97
cgacgucgaccacugc

SEQ ID NO: 1054784 - RNA, 23 nt, Mycobacterium bovis subsp bovis AF2122/97
cgacgucgagcgccuugucgauc

SEQ ID NO: 1054785 - RNA, 15 nt, Mycobacterium bovis subsp bovis AF2122/97
cgacgucgacggcga

SEQ ID NO: 1054786 - RNA, 14 nt, Mycobacterium bovis subsp bovis AF2122/97
cgacgucgauuucg

SEQ ID NO: 1054787 - RNA, 17 nt, Mycobacterium bovis subsp bovis AF2122/97
cgacgucgauggugcgg

SEQ ID NO: 1054788 - RNA, 19 nt, Mycobacterium bovis subsp bovis AF2122/97
cgacgucgauuucggcgac

SEQ ID NO: 1054789 - RNA, 22 nt, Mycobacterium bovis subsp bovis AF2122/97
cgacgucgauuucggcgaccgg

SEQ ID NO: 1054790 - RNA, 12 nt, Mycobacterium bovis subsp bovis AF2122/97
cgacgucgccaa

SEQ ID NO: 1054791 - RNA, 14 nt, Mycobacterium bovis subsp bovis AF2122/97
cgacgucgccgccg

SEQ ID NO: 1054792 - RNA, 22 nt, Mycobacterium bovis subsp bovis AF2122/97
cgacgucgccgccgcgggcgcc

SEQ ID NO: 1054793 - RNA, 13 nt, Mycobacterium bovis subsp bovis AF2122/97
cgacgucgcccau

SEQ ID NO: 1054794 - RNA, 15 nt, Mycobacterium bovis subsp bovis AF2122/97
cgacgucugccaggc

SEQ ID NO: 1054795 - RNA, 16 nt, Mycobacterium bovis subsp bovis AF2122/97
cgacgucugccaggcg

SEQ ID NO: 1054796 - RNA, 22 nt, Mycobacterium bovis subsp bovis AF2122/97
cgacgucugccaggcgcagcug

SEQ ID NO: 1054797 - RNA, 20 nt, Mycobacterium bovis subsp bovis AF2122/97
cgacgucucgcaugcucacg

SEQ ID NO: 1054798 - RNA, 13 nt, Mycobacterium bovis subsp bovis AF2122/97
cgacgugaagaug

SEQ ID NO: 1054799 - RNA, 23 nt, Mycobacterium bovis subsp bovis AF2122/97
cgacgugaaugguggugucggcg

SEQ ID NO: 1054800 - RNA, 19 nt, Mycobacterium bovis subsp bovis AF2122/97
cgacgugacaacugcgccg

SEQ ID NO: 1054801 - RNA, 16 nt, Mycobacterium bovis subsp bovis AF2122/97
cgacgugaccagcuuc

SEQ ID NO: 1054802 - RNA, 23 nt, Mycobacterium bovis subsp bovis AF2122/97
cgacgugaccagcuucggcuggc

SEQ ID NO: 1054803 - RNA, 15 nt, Mycobacterium bovis subsp bovis AF2122/97
cgacgugaucgcggu

SEQ ID NO: 1054804 - RNA, 23 nt, Mycobacterium bovis subsp bovis AF2122/97
cgacgugaucgcgguccaacagc

SEQ ID NO: 1054805 - RNA, 23 nt, Mycobacterium bovis subsp bovis AF2122/97
cgacgugauggugacuucggugg

SEQ ID NO: 1054806 - RNA, 15 nt, Mycobacterium bovis subsp bovis AF2122/97
cgacgugauggugac

SEQ ID NO: 1054807 - RNA, 22 nt, Mycobacterium bovis subsp bovis AF2122/97
cgacguugaucgccaugguguc

SEQ ID NO: 1054808 - RNA, 18 nt, Mycobacterium bovis subsp bovis AF2122/97
cgacguugccucgcgacg

SEQ ID NO: 1054809 - RNA, 20 nt, Mycobacterium bovis subsp bovis AF2122/97
cgacguugcgaggccgcacg

SEQ ID NO: 1054810 - RNA, 12 nt, Mycobacterium bovis subsp bovis AF2122/97
cgacguucggug

SEQ ID NO: 1054811 - RNA, 13 nt, Mycobacterium bovis subsp bovis AF2122/97
cgacguucggugg

SEQ ID NO: 1054812 - RNA, 17 nt, Mycobacterium bovis subsp bovis AF2122/97
cgacguugaacucgagu

SEQ ID NO: 1054813 - RNA, 14 nt, Mycobacterium bovis subsp bovis AF2122/97
cgacguugaucgcc

SEQ ID NO: 1054814 - RNA, 13 nt, Mycobacterium bovis subsp bovis AF2122/97
cgacgugcgcggc

SEQ ID NO: 1054815 - RNA, 14 nt, Mycobacterium bovis subsp bovis AF2122/97
cgacgugcggcggc

SEQ ID NO: 1054816 - RNA, 13 nt, Mycobacterium bovis subsp bovis AF2122/97
cgacgugcgucgg

SEQ ID NO: 1054817 - RNA, 15 nt, Mycobacterium bovis subsp bovis AF2122/97
cgacgugcgucggcc

SEQ ID NO: 1054818 - RNA, 17 nt, Mycobacterium bovis subsp bovis AF2122/97
cgacguaccaggguguc

SEQ ID NO: 1054819 - RNA, 21 nt, Mycobacterium bovis subsp bovis AF2122/97
cgacgguuucgaccaccaccc

SEQ ID NO: 1054820 - RNA, 16 nt, Mycobacterium bovis subsp bovis AF2122/97
cgacgguuugcaccgc

SEQ ID NO: 1054821 - RNA, 19 nt, Mycobacterium bovis subsp bovis AF2122/97
cgacgguucccagcuuccg

SEQ ID NO: 1054822 - RNA, 17 nt, Mycobacterium bovis subsp bovis AF2122/97
cgacgguuccgccaccg

SEQ ID NO: 1054823 - RNA, 19 nt, Mycobacterium bovis subsp bovis AF2122/97
cgacgguuccgccaccgga

SEQ ID NO: 1054824 - RNA, 21 nt, Mycobacterium bovis subsp bovis AF2122/97
cgacgguuccgccaccggaca

SEQ ID NO: 1054825 - RNA, 19 nt, Mycobacterium bovis subsp bovis AF2122/97
cgacggucaccggcgcacc

SEQ ID NO: 1054826 - RNA, 20 nt, Mycobacterium bovis subsp bovis AF2122/97
cgacggucaccggcgcaccg

SEQ ID NO: 1054827 - RNA, 19 nt, Mycobacterium bovis subsp bovis AF2122/97
cgacggucaaggugcgccg

SEQ ID NO: 1054828 - RNA, 18 nt, Mycobacterium bovis subsp bovis AF2122/97
cgacgggucggcgccgag

SEQ ID NO: 1054829 - RNA, 19 nt, Mycobacterium bovis subsp bovis AF2122/97
cgacgggucggcgccgagc

SEQ ID NO: 1054830 - RNA, 17 nt, Mycobacterium bovis subsp bovis AF2122/97
cgacgggucggcgccga

SEQ ID NO: 1054831 - RNA, 19 nt, Mycobacterium bovis subsp bovis AF2122/97
cgacggggcaaaggagccg

SEQ ID NO: 1054832 - RNA, 15 nt, Mycobacterium bovis subsp bovis AF2122/97
cgacggggcggucgg

SEQ ID NO: 1054833 - RNA, 16 nt, Mycobacterium bovis subsp bovis AF2122/97
cgacggggcggucggc

SEQ ID NO: 1054834 - RNA, 18 nt, Mycobacterium bovis subsp bovis AF2122/97
cgacggggcggucggccg

SEQ ID NO: 1054835 - RNA, 19 nt, Mycobacterium bovis subsp bovis AF2122/97
cgacggggcggucggccgg

SEQ ID NO: 1054836 - RNA, 20 nt, Mycobacterium bovis subsp bovis AF2122/97
cgacggggcggucggccggc

SEQ ID NO: 1054837 - RNA, 22 nt, Mycobacterium bovis subsp bovis AF2122/97
cgacggggcggucggccggcuc

SEQ ID NO: 1054838 - RNA, 21 nt, Mycobacterium bovis subsp bovis AF2122/97
cgacggggaacguccgcgccg

SEQ ID NO: 1054839 - RNA, 22 nt, Mycobacterium bovis subsp bovis AF2122/97
cgacggggaacguccgcgccga

SEQ ID NO: 1054840 - RNA, 16 nt, Mycobacterium bovis subsp bovis AF2122/97
cgacgggaaccagcgg

SEQ ID NO: 1054841 - RNA, 17 nt, Mycobacterium bovis subsp bovis AF2122/97
cgacgggaaccagcggu

SEQ ID NO: 1054842 - RNA, 20 nt, Mycobacterium bovis subsp bovis AF2122/97
cgacgggaaccagcggucgg

SEQ ID NO: 1054843 - RNA, 15 nt, Mycobacterium bovis subsp bovis AF2122/97
cgacggcugcgccga

SEQ ID NO: 1054844 - RNA, 16 nt, Mycobacterium bovis subsp bovis AF2122/97
cgacggcugcgccgaa

SEQ ID NO: 1054845 - RNA, 14 nt, Mycobacterium bovis subsp bovis AF2122/97
cgacgggaaccagc

SEQ ID NO: 1054846 - RNA, 14 nt, Mycobacterium bovis subsp bovis AF2122/97
cgacgggccgucgc

SEQ ID NO: 1054847 - RNA, 15 nt, Mycobacterium bovis subsp bovis AF2122/97
cgacgggccgucgcc

SEQ ID NO: 1054848 - RNA, 21 nt, Mycobacterium bovis subsp bovis AF2122/97
cgacgggcgaaauuccgggcc

SEQ ID NO: 1054849 - RNA, 21 nt, Mycobacterium bovis subsp bovis AF2122/97
cgacgggcacccgagccgcac

SEQ ID NO: 1054850 - RNA, 17 nt, Mycobacterium bovis subsp bovis AF2122/97
cgacgggcacgcggcga

SEQ ID NO: 1054851 - RNA, 16 nt, Mycobacterium bovis subsp bovis AF2122/97
cgacgggaaccucgac

SEQ ID NO: 1054852 - RNA, 16 nt, Mycobacterium bovis subsp bovis AF2122/97
cgacgggacaacccgu

SEQ ID NO: 1054853 - RNA, 17 nt, Mycobacterium bovis subsp bovis AF2122/97
cgacgggacaacccgua

SEQ ID NO: 1054854 - RNA, 17 nt, Mycobacterium bovis subsp bovis AF2122/97
cgacgggagcgacgucg

SEQ ID NO: 1054855 - RNA, 16 nt, Mycobacterium bovis subsp bovis AF2122/97
cgacggcugaccuucu

SEQ ID NO: 1054856 - RNA, 17 nt, Mycobacterium bovis subsp bovis AF2122/97
cgacggcucuaccgguc

SEQ ID NO: 1054857 - RNA, 17 nt, Mycobacterium bovis subsp bovis AF2122/97
cgacgcucgcugcagca

SEQ ID NO: 1054858 - RNA, 14 nt, Mycobacterium bovis subsp bovis AF2122/97
cgagaacgcccgag

SEQ ID NO: 1054859 - RNA, 17 nt, Mycobacterium bovis subsp bovis AF2122/97
cgacuugugacggucgu

SEQ ID NO: 1054860 - RNA, 17 nt, Mycobacterium bovis subsp bovis AF2122/97
cgacuuguugggcgcga

SEQ ID NO: 1054861 - RNA, 13 nt, Mycobacterium bovis subsp bovis AF2122/97
cgagaagaucucg

SEQ ID NO: 1054862 - RNA, 16 nt, Mycobacterium bovis subsp bovis AF2122/97
cgagaagacaccgcgc

SEQ ID NO: 1054863 - RNA, 15 nt, Mycobacterium bovis subsp bovis AF2122/97
cgagaacggcgggcg

SEQ ID NO: 1054864 - RNA, 16 nt, Mycobacterium bovis subsp bovis AF2122/97
cgagaaacacgacagc

SEQ ID NO: 1054865 - RNA, 23 nt, Mycobacterium bovis subsp bovis AF2122/97
cgagaacggauaauucaacagca

SEQ ID NO: 1054866 - RNA, 17 nt, Mycobacterium bovis subsp bovis AF2122/97
cgacuuguacgcaucgc

SEQ ID NO: 1054867 - RNA, 17 nt, Mycobacterium bovis subsp bovis AF2122/97
cgacuuggugacaccga

SEQ ID NO: 1054868 - RNA, 18 nt, Mycobacterium bovis subsp bovis AF2122/97
cgacuuggugacaccgag

SEQ ID NO: 1054869 - RNA, 14 nt, Mycobacterium bovis subsp bovis AF2122/97
cgacuuggcaucgc

SEQ ID NO: 1054870 - RNA, 13 nt, Mycobacterium bovis subsp bovis AF2122/97
cgacuugcuggcg

SEQ ID NO: 1054871 - RNA, 13 nt, Mycobacterium bovis subsp bovis AF2122/97
cgacuugcggugc

SEQ ID NO: 1054872 - RNA, 14 nt, Mycobacterium bovis subsp bovis AF2122/97
cgacuugcggugcu

SEQ ID NO: 1054873 - RNA, 19 nt, Mycobacterium bovis subsp bovis AF2122/97
cgacuugcggugcucacca

SEQ ID NO: 1054874 - RNA, 17 nt, Mycobacterium bovis subsp bovis AF2122/97
cgacuugauuucgaucg

SEQ ID NO: 1054875 - RNA, 16 nt, Mycobacterium bovis subsp bovis AF2122/97
cgacuucuucgcgcaa

SEQ ID NO: 1054876 - RNA, 20 nt, Mycobacterium bovis subsp bovis AF2122/97
cgacuucgggaacgcucguc

SEQ ID NO: 1054877 - RNA, 13 nt, Mycobacterium bovis subsp bovis AF2122/97
cgacuucggcguc

SEQ ID NO: 1054878 - RNA, 22 nt, Mycobacterium bovis subsp bovis AF2122/97
cgacuuccuguacaaccugaug

SEQ ID NO: 1054879 - RNA, 12 nt, Mycobacterium bovis subsp bovis AF2122/97
cgacuucgaugg

SEQ ID NO: 1054880 - RNA, 17 nt, Mycobacterium bovis subsp bovis AF2122/97
cgacugucccgcgcaac

SEQ ID NO: 1054881 - RNA, 18 nt, Mycobacterium bovis subsp bovis AF2122/97
cgacugucccgcgcaacc

SEQ ID NO: 1054882 - RNA, 16 nt, Mycobacterium bovis subsp bovis AF2122/97
cgacuggugccugccg

SEQ ID NO: 1054883 - RNA, 20 nt, Mycobacterium bovis subsp bovis AF2122/97
cgacuggccguuucggcgcc

SEQ ID NO: 1054884 - RNA, 16 nt, Mycobacterium bovis subsp bovis AF2122/97
cgacugucuggucggc

SEQ ID NO: 1054885 - RNA, 20 nt, Mycobacterium bovis subsp bovis AF2122/97
cgacugugaaucucacgacg

SEQ ID NO: 1054886 - RNA, 23 nt, Mycobacterium bovis subsp bovis AF2122/97
cgacugugaaucucacgacgccu

SEQ ID NO: 1054887 - RNA, 14 nt, Mycobacterium bovis subsp bovis AF2122/97
cgacugugcgccgc

SEQ ID NO: 1054888 - RNA, 12 nt, Mycobacterium bovis subsp bovis AF2122/97
cgacugggacga

SEQ ID NO: 1054889 - RNA, 15 nt, Mycobacterium bovis subsp bovis AF2122/97
cgacugugcgccgca

SEQ ID NO: 1054890 - RNA, 16 nt, Mycobacterium bovis subsp bovis AF2122/97
cgacuguggcgccgcc

SEQ ID NO: 1054891 - RNA, 18 nt, Mycobacterium bovis subsp bovis AF2122/97
cgacuguggcgccgccgg

SEQ ID NO: 1054892 - RNA, 19 nt, Mycobacterium bovis subsp bovis AF2122/97
cgacugcgugccgcaccgc

SEQ ID NO: 1054893 - RNA, 17 nt, Mycobacterium bovis subsp bovis AF2122/97
cgacuggaaggcgggca

SEQ ID NO: 1054894 - RNA, 21 nt, Mycobacterium bovis subsp bovis AF2122/97
cgacuggacaggucgcccaac

SEQ ID NO: 1054895 - RNA, 20 nt, Mycobacterium bovis subsp bovis AF2122/97
cgacugcguuccgaucggca

SEQ ID NO: 1054896 - RNA, 16 nt, Mycobacterium bovis subsp bovis AF2122/97
cgacucccccggcucc

SEQ ID NO: 1054897 - RNA, 16 nt, Mycobacterium bovis subsp bovis AF2122/97
cgacugcugucaccgc

SEQ ID NO: 1054898 - RNA, 17 nt, Mycobacterium bovis subsp bovis AF2122/97
cgacugcugucaccgca

SEQ ID NO: 1054899 - RNA, 16 nt, Mycobacterium bovis subsp bovis AF2122/97
cgacuccagcgcccgg

SEQ ID NO: 1054900 - RNA, 17 nt, Mycobacterium bovis subsp bovis AF2122/97
cgacuccagcgcccggu

SEQ ID NO: 1054901 - RNA, 23 nt, Mycobacterium bovis subsp bovis AF2122/97
cgacuccagcaccagcacggcaa

SEQ ID NO: 1054902 - RNA, 13 nt, Mycobacterium bovis subsp bovis AF2122/97
cgacuccacccca

SEQ ID NO: 1054903 - RNA, 18 nt, Mycobacterium bovis subsp bovis AF2122/97
cgacuccaccccacccag

SEQ ID NO: 1054904 - RNA, 19 nt, Mycobacterium bovis subsp bovis AF2122/97
cgacucagcacgcguucaa

SEQ ID NO: 1054905 - RNA, 17 nt, Mycobacterium bovis subsp bovis AF2122/97
cgacucagcccggcacu

SEQ ID NO: 1054906 - RNA, 16 nt, Mycobacterium bovis subsp bovis AF2122/97
cgacuccagcaccagc

SEQ ID NO: 1054907 - RNA, 20 nt, Mycobacterium bovis subsp bovis AF2122/97
cgacucaguucugcacagug

SEQ ID NO: 1054908 - RNA, 12 nt, Mycobacterium bovis subsp bovis AF2122/97
cgacuacgaaga

SEQ ID NO: 1054909 - RNA, 12 nt, Mycobacterium bovis subsp bovis AF2122/97
cgacuacggccu

SEQ ID NO: 1054910 - RNA, 14 nt, Mycobacterium bovis subsp bovis AF2122/97
cgacuagacgccgc

SEQ ID NO: 1054911 - RNA, 16 nt, Mycobacterium bovis subsp bovis AF2122/97
cgacuagacgccgccg

SEQ ID NO: 1054912 - RNA, 17 nt, Mycobacterium bovis subsp bovis AF2122/97
cgacuagacgccgccgc

SEQ ID NO: 1054913 - RNA, 21 nt, Mycobacterium bovis subsp bovis AF2122/97
cgacucacccacccgcaccgc

SEQ ID NO: 1054914 - RNA, 15 nt, Mycobacterium bovis subsp bovis AF2122/97
cgacuaucggccgcc

SEQ ID NO: 1054915 - RNA, 18 nt, Mycobacterium bovis subsp bovis AF2122/97
cgacuaccaucgccgccc

SEQ ID NO: 1054916 - RNA, 11 nt, Mycobacterium bovis subsp bovis AF2122/97
cgacguuggcg

SEQ ID NO: 1054917 - RNA, 20 nt, Mycobacterium bovis subsp bovis AF2122/97
cgacguagcgaagugcgcgc

SEQ ID NO: 1054918 - RNA, 13 nt, Mycobacterium bovis subsp bovis AF2122/97
cgacguugccgaa

SEQ ID NO: 1054919 - RNA, 19 nt, Mycobacterium bovis subsp bovis AF2122/97
cgacuaacggugcgguugc

SEQ ID NO: 1054920 - RNA, 16 nt, Mycobacterium bovis subsp bovis AF2122/97
cacgcgaccaccgccg

SEQ ID NO: 1054921 - RNA, 18 nt, Mycobacterium bovis subsp bovis AF2122/97
cacgcgaccaccgccgag

SEQ ID NO: 1054922 - RNA, 18 nt, Mycobacterium bovis subsp bovis AF2122/97
cacgcgacuugcaccccg

SEQ ID NO: 1054923 - RNA, 16 nt, Mycobacterium bovis subsp bovis AF2122/97
cacgcgcacucgacgc

SEQ ID NO: 1054924 - RNA, 17 nt, Mycobacterium bovis subsp bovis AF2122/97
cacgcgcacucgacgcc

SEQ ID NO: 1054925 - RNA, 15 nt, Mycobacterium bovis subsp bovis AF2122/97
cacgcgcaacucgcc

SEQ ID NO: 1054926 - RNA, 13 nt, Mycobacterium bovis subsp bovis AF2122/97
cacgcgcccgcac

SEQ ID NO: 1054927 - RNA, 15 nt, Mycobacterium bovis subsp bovis AF2122/97
cacgcgcccgcacca

SEQ ID NO: 1054928 - RNA, 15 nt, Mycobacterium bovis subsp bovis AF2122/97
cacgcgcggcgucgu

SEQ ID NO: 1054929 - RNA, 16 nt, Mycobacterium bovis subsp bovis AF2122/97
cacgcgcggaucggcg

SEQ ID NO: 1054930 - RNA, 19 nt, Mycobacterium bovis subsp bovis AF2122/97
cacgcgcggaucggcggcc

SEQ ID NO: 1054931 - RNA, 21 nt, Mycobacterium bovis subsp bovis AF2122/97
cacgcgcggaucggcggccgc

SEQ ID NO: 1054932 - RNA, 22 nt, Mycobacterium bovis subsp bovis AF2122/97
cacgcgcggaucggcggccgcg

SEQ ID NO: 1054933 - RNA, 14 nt, Mycobacterium bovis subsp bovis AF2122/97
cacggaucgcggcg

SEQ ID NO: 1054934 - RNA, 14 nt, Mycobacterium bovis subsp bovis AF2122/97
cacggaugcgaugg

SEQ ID NO: 1054935 - RNA, 20 nt, Mycobacterium bovis subsp bovis AF2122/97
cacggaugugcucaggucgc

SEQ ID NO: 1054936 - RNA, 16 nt, Mycobacterium bovis subsp bovis AF2122/97
cacggauucgggcgaa

SEQ ID NO: 1054937 - RNA, 19 nt, Mycobacterium bovis subsp bovis AF2122/97
cacggagcucuugcgggca

SEQ ID NO: 1054938 - RNA, 13 nt, Mycobacterium bovis subsp bovis AF2122/97
cacggagccgccg

SEQ ID NO: 1054939 - RNA, 20 nt, Mycobacterium bovis subsp bovis AF2122/97
cacggaggguugccgccgac

SEQ ID NO: 1054940 - RNA, 21 nt, Mycobacterium bovis subsp bovis AF2122/97
cacggaggguugccgccgacu

SEQ ID NO: 1054941 - RNA, 23 nt, Mycobacterium bovis subsp bovis AF2122/97
cacgcgcgcgaccucgcuggccg

SEQ ID NO: 1054942 - RNA, 21 nt, Mycobacterium bovis subsp bovis AF2122/97
cacgcgcaacucgccacgguc

SEQ ID NO: 1054943 - RNA, 17 nt, Mycobacterium bovis subsp bovis AF2122/97
cacgcgcggcgucgugg

SEQ ID NO: 1054944 - RNA, 14 nt, Mycobacterium bovis subsp bovis AF2122/97
cacggccccugcca

SEQ ID NO: 1054945 - RNA, 19 nt, Mycobacterium bovis subsp bovis AF2122/97
cacggccccugccacgacg

SEQ ID NO: 1054946 - RNA, 22 nt, Mycobacterium bovis subsp bovis AF2122/97
cacggccccugccacgacgaac

SEQ ID NO: 1054947 - RNA, 12 nt, Mycobacterium bovis subsp bovis AF2122/97
cacggcaccacc

SEQ ID NO: 1054948 - RNA, 18 nt, Mycobacterium bovis subsp bovis AF2122/97
cacggcaccaccaagcuc

SEQ ID NO: 1054949 - RNA, 19 nt, Mycobacterium bovis subsp bovis AF2122/97
cacggcaccaccaagcucg

SEQ ID NO: 1054950 - RNA, 22 nt, Mycobacterium bovis subsp bovis AF2122/97
cacggcaccaccaagcucggcc

SEQ ID NO: 1054951 - RNA, 21 nt, Mycobacterium bovis subsp bovis AF2122/97
cacggcaagcgugacccgccg

SEQ ID NO: 1054952 - RNA, 13 nt, Mycobacterium bovis subsp bovis AF2122/97
cacggcaaccagc

SEQ ID NO: 1054953 - RNA, 16 nt, Mycobacterium bovis subsp bovis AF2122/97
cacggcgcgccagaac

SEQ ID NO: 1054954 - RNA, 22 nt, Mycobacterium bovis subsp bovis AF2122/97
cacggcgccgccacggaucgcg

SEQ ID NO: 1054955 - RNA, 23 nt, Mycobacterium bovis subsp bovis AF2122/97
cacggcgccgccacggaucgcgg

SEQ ID NO: 1054956 - RNA, 19 nt, Mycobacterium bovis subsp bovis AF2122/97
cacggcgccuacaccggcg

SEQ ID NO: 1054957 - RNA, 20 nt, Mycobacterium bovis subsp bovis AF2122/97
cacggcgccuacaccggcgc

SEQ ID NO: 1054958 - RNA, 15 nt, Mycobacterium bovis subsp bovis AF2122/97
cacggcgcgcgcgcc

SEQ ID NO: 1054959 - RNA, 20 nt, Mycobacterium bovis subsp bovis AF2122/97
cacggcgcgcgcgccggcug

SEQ ID NO: 1054960 - RNA, 11 nt, Mycobacterium bovis subsp bovis AF2122/97
cacggcggccc

SEQ ID NO: 1054961 - RNA, 16 nt, Mycobacterium bovis subsp bovis AF2122/97
cacggcggcccgcucg

SEQ ID NO: 1054962 - RNA, 17 nt, Mycobacterium bovis subsp bovis AF2122/97
cacggcggcccgcucgg

SEQ ID NO: 1054963 - RNA, 18 nt, Mycobacterium bovis subsp bovis AF2122/97
cacggcggcccgcucggg

SEQ ID NO: 1054964 - RNA, 11 nt, Mycobacterium bovis subsp bovis AF2122/97
cacggcggcga

SEQ ID NO: 1054965 - RNA, 12 nt, Mycobacterium bovis subsp bovis AF2122/97
cacggcggcgaa

SEQ ID NO: 1054966 - RNA, 15 nt, Mycobacterium bovis subsp bovis AF2122/97
cacggcgggcgaccc

SEQ ID NO: 1054967 - RNA, 17 nt, Mycobacterium bovis subsp bovis AF2122/97
cacggcgggcgacccgu

SEQ ID NO: 1054968 - RNA, 16 nt, Mycobacterium bovis subsp bovis AF2122/97
cacggcgggcgagcca

SEQ ID NO: 1054969 - RNA, 14 nt, Mycobacterium bovis subsp bovis AF2122/97
cacggcggcggcgu

SEQ ID NO: 1054970 - RNA, 20 nt, Mycobacterium bovis subsp bovis AF2122/97
cacggcgggaugcagcugcc

SEQ ID NO: 1054971 - RNA, 20 nt, Mycobacterium bovis subsp bovis AF2122/97
cacggcgguugccccgaccg

SEQ ID NO: 1054972 - RNA, 20 nt, Mycobacterium bovis subsp bovis AF2122/97
cacggccgcauaaaacucgc

SEQ ID NO: 1054973 - RNA, 22 nt, Mycobacterium bovis subsp bovis AF2122/97
cacggccgccgacuccccgccg

SEQ ID NO: 1054974 - RNA, 17 nt, Mycobacterium bovis subsp bovis AF2122/97
cacggccgucgacgauc

SEQ ID NO: 1054975 - RNA, 20 nt, Mycobacterium bovis subsp bovis AF2122/97
cacggccgucgacgaucagc

SEQ ID NO: 1054976 - RNA, 17 nt, Mycobacterium bovis subsp bovis AF2122/97
cacggccuccggaccga

SEQ ID NO: 1054977 - RNA, 20 nt, Mycobacterium bovis subsp bovis AF2122/97
cacggccgggucgaacaggc

SEQ ID NO: 1054978 - RNA, 14 nt, Mycobacterium bovis subsp bovis AF2122/97
cacggccggccgcu

SEQ ID NO: 1054979 - RNA, 14 nt, Mycobacterium bovis subsp bovis AF2122/97
cacggcgauccggu

SEQ ID NO: 1054980 - RNA, 21 nt, Mycobacterium bovis subsp bovis AF2122/97
cacggcgauccggucggccag

SEQ ID NO: 1054981 - RNA, 16 nt, Mycobacterium bovis subsp bovis AF2122/97
cacggccggauacggc

SEQ ID NO: 1054982 - RNA, 14 nt, Mycobacterium bovis subsp bovis AF2122/97
cacggcgccgccac

SEQ ID NO: 1054983 - RNA, 17 nt, Mycobacterium bovis subsp bovis AF2122/97
cacgggcuaccggcagc

SEQ ID NO: 1054984 - RNA, 15 nt, Mycobacterium bovis subsp bovis AF2122/97
cacgggcucgcugca

SEQ ID NO: 1054985 - RNA, 17 nt, Mycobacterium bovis subsp bovis AF2122/97
cacggggaccgggcugu

SEQ ID NO: 1054986 - RNA, 17 nt, Mycobacterium bovis subsp bovis AF2122/97
cacggggauuggcgacg

SEQ ID NO: 1054987 - RNA, 21 nt, Mycobacterium bovis subsp bovis AF2122/97
cacggggauuggcgacgucgc

SEQ ID NO: 1054988 - RNA, 15 nt, Mycobacterium bovis subsp bovis AF2122/97
cacggguagcgucca

SEQ ID NO: 1054989 - RNA, 15 nt, Mycobacterium bovis subsp bovis AF2122/97
cacggcuucgccgcg

SEQ ID NO: 1054990 - RNA, 22 nt, Mycobacterium bovis subsp bovis AF2122/97
cacggcuucgccgcgggacaga

SEQ ID NO: 1054991 - RNA, 12 nt, Mycobacterium bovis subsp bovis AF2122/97
cacggcgucgau

SEQ ID NO: 1054992 - RNA, 15 nt, Mycobacterium bovis subsp bovis AF2122/97
cacggcguugccgcc

SEQ ID NO: 1054993 - RNA, 16 nt, Mycobacterium bovis subsp bovis AF2122/97
cacggcguugccgccg

SEQ ID NO: 1054994 - RNA, 20 nt, Mycobacterium bovis subsp bovis AF2122/97
cacggcguggucggcaaagc

SEQ ID NO: 1054995 - RNA, 15 nt, Mycobacterium bovis subsp bovis AF2122/97
cacggcgugucgggg

SEQ ID NO: 1054996 - RNA, 23 nt, Mycobacterium bovis subsp bovis AF2122/97
cacggcgucuuccucggccaccc

SEQ ID NO: 1054997 - RNA, 22 nt, Mycobacterium bovis subsp bovis AF2122/97
cacggcgugaaaaacgcccgcg

SEQ ID NO: 1054998 - RNA, 11 nt, Mycobacterium bovis subsp bovis AF2122/97
cacggcgucgg

SEQ ID NO: 1054999 - RNA, 15 nt, Mycobacterium bovis subsp bovis AF2122/97
cacggcgucgacugg

SEQ ID NO: 1055000 - RNA, 16 nt, Mycobacterium bovis subsp bovis AF2122/97
cacggcgucggccacc

SEQ ID NO: 1055001 - RNA, 17 nt, Mycobacterium bovis subsp bovis AF2122/97
cacggcgucggccaccg

SEQ ID NO: 1055002 - RNA, 19 nt, Mycobacterium bovis subsp bovis AF2122/97
cacggugaucuucuucagg

SEQ ID NO: 1055003 - RNA, 22 nt, Mycobacterium bovis subsp bovis AF2122/97
cacggugagccgguggcccgcc

SEQ ID NO: 1055004 - RNA, 15 nt, Mycobacterium bovis subsp bovis AF2122/97
cacggugaucagcag

SEQ ID NO: 1055005 - RNA, 12 nt, Mycobacterium bovis subsp bovis AF2122/97
cacggugcggug

SEQ ID NO: 1055006 - RNA, 21 nt, Mycobacterium bovis subsp bovis AF2122/97
cacggugcugaucgguccggc

SEQ ID NO: 1055007 - RNA, 20 nt, Mycobacterium bovis subsp bovis AF2122/97
cacgguggccgagccgcggu

SEQ ID NO: 1055008 - RNA, 22 nt, Mycobacterium bovis subsp bovis AF2122/97
cacgguggccgagccgcgguca

SEQ ID NO: 1055009 - RNA, 12 nt, Mycobacterium bovis subsp bovis AF2122/97
cacgguggccgc

SEQ ID NO: 1055010 - RNA, 13 nt, Mycobacterium bovis subsp bovis AF2122/97
cacgguggccgca

SEQ ID NO: 1055011 - RNA, 16 nt, Mycobacterium bovis subsp bovis AF2122/97
cacggugccgacgaug

SEQ ID NO: 1055012 - RNA, 16 nt, Mycobacterium bovis subsp bovis AF2122/97
cacggugccggcaccc

SEQ ID NO: 1055013 - RNA, 17 nt, Mycobacterium bovis subsp bovis AF2122/97
cacgggucgucaugcca

SEQ ID NO: 1055014 - RNA, 22 nt, Mycobacterium bovis subsp bovis AF2122/97
cacggguguucucgcgcgucgc

SEQ ID NO: 1055015 - RNA, 23 nt, Mycobacterium bovis subsp bovis AF2122/97
cacggguguucucgcgcgucgcg

SEQ ID NO: 1055016 - RNA, 21 nt, Mycobacterium bovis subsp bovis AF2122/97
cacggguagcugccgcggccg

SEQ ID NO: 1055017 - RNA, 23 nt, Mycobacterium bovis subsp bovis AF2122/97
cacggguagcugccgcggccggc

SEQ ID NO: 1055018 - RNA, 19 nt, Mycobacterium bovis subsp bovis AF2122/97
cacgguacauccagagaca

SEQ ID NO: 1055019 - RNA, 19 nt, Mycobacterium bovis subsp bovis AF2122/97
cacgguagacaagucggcg

SEQ ID NO: 1055020 - RNA, 15 nt, Mycobacterium bovis subsp bovis AF2122/97
cacguccgcgcaccg

SEQ ID NO: 1055021 - RNA, 16 nt, Mycobacterium bovis subsp bovis AF2122/97
cacguccgcgcaccgc

SEQ ID NO: 1055022 - RNA, 13 nt, Mycobacterium bovis subsp bovis AF2122/97
cacguccgcgggg

SEQ ID NO: 1055023 - RNA, 21 nt, Mycobacterium bovis subsp bovis AF2122/97
cacguccgcgggggaccgccc

SEQ ID NO: 1055024 - RNA, 19 nt, Mycobacterium bovis subsp bovis AF2122/97
cacguccaucaccggcggc

SEQ ID NO: 1055025 - RNA, 21 nt, Mycobacterium bovis subsp bovis AF2122/97
cacguccaucaccggcggccc

SEQ ID NO: 1055026 - RNA, 12 nt, Mycobacterium bovis subsp bovis AF2122/97
cacgucccagag

SEQ ID NO: 1055027 - RNA, 18 nt, Mycobacterium bovis subsp bovis AF2122/97
cacguccugcccgucguc

SEQ ID NO: 1055028 - RNA, 21 nt, Mycobacterium bovis subsp bovis AF2122/97
cacguccugcccgucgucggc

SEQ ID NO: 1055029 - RNA, 23 nt, Mycobacterium bovis subsp bovis AF2122/97
cacguccugcccgucgucggcaa

SEQ ID NO: 1055030 - RNA, 23 nt, Mycobacterium bovis subsp bovis AF2122/97
cacguccucagccgugcccaggc

SEQ ID NO: 1055031 - RNA, 14 nt, Mycobacterium bovis subsp bovis AF2122/97
cacgucggcgggcg

SEQ ID NO: 1055032 - RNA, 23 nt, Mycobacterium bovis subsp bovis AF2122/97
cacgucggguugcacggcgauug

SEQ ID NO: 1055033 - RNA, 13 nt, Mycobacterium bovis subsp bovis AF2122/97
cacgucgcgggua

SEQ ID NO: 1055034 - RNA, 16 nt, Mycobacterium bovis subsp bovis AF2122/97
cacgucgcgccaggcg

SEQ ID NO: 1055035 - RNA, 17 nt, Mycobacterium bovis subsp bovis AF2122/97
cacgucgcgccaggcgc

SEQ ID NO: 1055036 - RNA, 19 nt, Mycobacterium bovis subsp bovis AF2122/97
cacgucgcgccaggcgcga

SEQ ID NO: 1055037 - RNA, 19 nt, Mycobacterium bovis subsp bovis AF2122/97
cacgguucgcccgucgcca

SEQ ID NO: 1055038 - RNA, 21 nt, Mycobacterium bovis subsp bovis AF2122/97
cacgguggccgcugccagccg

SEQ ID NO: 1055039 - RNA, 17 nt, Mycobacterium bovis subsp bovis AF2122/97
cacgguggcucuguagc

SEQ ID NO: 1055040 - RNA, 14 nt, Mycobacterium bovis subsp bovis AF2122/97
cacgguggccgcac

SEQ ID NO: 1055041 - RNA, 17 nt, Mycobacterium bovis subsp bovis AF2122/97
cacgguggccgcaucga

SEQ ID NO: 1055042 - RNA, 16 nt, Mycobacterium bovis subsp bovis AF2122/97
cacgguguauuggggu

SEQ ID NO: 1055043 - RNA, 19 nt, Mycobacterium bovis subsp bovis AF2122/97
cacgguguauugggguggc

SEQ ID NO: 1055044 - RNA, 17 nt, Mycobacterium bovis subsp bovis AF2122/97
cacgguggugucagcca

SEQ ID NO: 1055045 - RNA, 23 nt, Mycobacterium bovis subsp bovis AF2122/97
cacgguguaccagguggaccggc

SEQ ID NO: 1055046 - RNA, 15 nt, Mycobacterium bovis subsp bovis AF2122/97
cacggugggcgcugg

SEQ ID NO: 1055047 - RNA, 22 nt, Mycobacterium bovis subsp bovis AF2122/97
cacgguggugggcuaggucgcg

SEQ ID NO: 1055048 - RNA, 20 nt, Mycobacterium bovis subsp bovis AF2122/97
cacggugggcgccgacaccg

SEQ ID NO: 1055049 - RNA, 24 nt, Mycobacterium bovis subsp bovis AF2122/97
cacguccgaucggcgcgccgaucg

SEQ ID NO: 1055050 - RNA, 19 nt, Mycobacterium bovis subsp bovis AF2122/97
cacguccgcaaccucgccg

SEQ ID NO: 1055051 - RNA, 22 nt, Mycobacterium bovis subsp bovis AF2122/97
cacguccgcaaccucgccgucg

SEQ ID NO: 1055052 - RNA, 16 nt, Mycobacterium bovis subsp bovis AF2122/97
cacgguuagacgucgu

SEQ ID NO: 1055053 - RNA, 23 nt, Mycobacterium bovis subsp bovis AF2122/97
cacgucguugugcagaucgucgc

SEQ ID NO: 1055054 - RNA, 23 nt, Mycobacterium bovis subsp bovis AF2122/97
cacgucuccuguggggauuccgc

SEQ ID NO: 1055055 - RNA, 23 nt, Mycobacterium bovis subsp bovis AF2122/97
cacgucuccuucggcgacugcgc

SEQ ID NO: 1055056 - RNA, 23 nt, Mycobacterium bovis subsp bovis AF2122/97
cacgucguugggcaugucgccga

SEQ ID NO: 1055057 - RNA, 17 nt, Mycobacterium bovis subsp bovis AF2122/97
cacgucggauccgcccg

SEQ ID NO: 1055058 - RNA, 19 nt, Mycobacterium bovis subsp bovis AF2122/97
cacgucggauccgcccgcc

SEQ ID NO: 1055059 - RNA, 15 nt, Mycobacterium bovis subsp bovis AF2122/97
cacgucgucgcggga

SEQ ID NO: 1055060 - RNA, 12 nt, Mycobacterium bovis subsp bovis AF2122/97
cacgucgucagc

SEQ ID NO: 1055061 - RNA, 21 nt, Mycobacterium bovis subsp bovis AF2122/97
cacgucgucagccaccgcaug

SEQ ID NO: 1055062 - RNA, 15 nt, Mycobacterium bovis subsp bovis AF2122/97
cacgucucgaucagg

SEQ ID NO: 1055063 - RNA, 15 nt, Mycobacterium bovis subsp bovis AF2122/97
cacgucucgcgaggu

SEQ ID NO: 1055064 - RNA, 16 nt, Mycobacterium bovis subsp bovis AF2122/97
cacgugaaggcgaugg

SEQ ID NO: 1055065 - RNA, 15 nt, Mycobacterium bovis subsp bovis AF2122/97
cacgugagugccggc

SEQ ID NO: 1055066 - RNA, 23 nt, Mycobacterium bovis subsp bovis AF2122/97
cacgugagugccggcgugcgcga

SEQ ID NO: 1055067 - RNA, 16 nt, Mycobacterium bovis subsp bovis AF2122/97
cacgugaucgacgacc

SEQ ID NO: 1055068 - RNA, 14 nt, Mycobacterium bovis subsp bovis AF2122/97
cacgugcacggcga

SEQ ID NO: 1055069 - RNA, 16 nt, Mycobacterium bovis subsp bovis AF2122/97
cacuccggcgaucucg

SEQ ID NO: 1055070 - RNA, 22 nt, Mycobacterium bovis subsp bovis AF2122/97
cacuccggcguugacgaucagu

SEQ ID NO: 1055071 - RNA, 16 nt, Mycobacterium bovis subsp bovis AF2122/97
cacuccgggcucggcg

SEQ ID NO: 1055072 - RNA, 17 nt, Mycobacterium bovis subsp bovis AF2122/97
cacuccgggcucggcgu

SEQ ID NO: 1055073 - RNA, 17 nt, Mycobacterium bovis subsp bovis AF2122/97
cacgugaucgacgaccg

SEQ ID NO: 1055074 - RNA, 18 nt, Mycobacterium bovis subsp bovis AF2122/97
cacucgccggcggacgcc

SEQ ID NO: 1055075 - RNA, 21 nt, Mycobacterium bovis subsp bovis AF2122/97
cacucgccggcggacgcccgg

SEQ ID NO: 1055076 - RNA, 23 nt, Mycobacterium bovis subsp bovis AF2122/97
cacucgccggcggacgcccggcg

SEQ ID NO: 1055077 - RNA, 22 nt, Mycobacterium bovis subsp bovis AF2122/97
cacucgccacucagcccgacac

SEQ ID NO: 1055078 - RNA, 22 nt, Mycobacterium bovis subsp bovis AF2122/97
cacucgacgucgucgucgacgg

SEQ ID NO: 1055079 - RNA, 17 nt, Mycobacterium bovis subsp bovis AF2122/97
cacucgaagucgcccag

SEQ ID NO: 1055080 - RNA, 22 nt, Mycobacterium bovis subsp bovis AF2122/97
cacuccugagaugcggccauga

SEQ ID NO: 1055081 - RNA, 20 nt, Mycobacterium bovis subsp bovis AF2122/97
cacuccugaguuccggucga

SEQ ID NO: 1055082 - RNA, 15 nt, Mycobacterium bovis subsp bovis AF2122/97
cacuccugcacacag

SEQ ID NO: 1055083 - RNA, 21 nt, Mycobacterium bovis subsp bovis AF2122/97
cacuccugcaccaucgguauc

SEQ ID NO: 1055084 - RNA, 16 nt, Mycobacterium bovis subsp bovis AF2122/97
cacucgcccgcugccg

SEQ ID NO: 1055085 - RNA, 17 nt, Mycobacterium bovis subsp bovis AF2122/97
cacucgccgaaucgcug

SEQ ID NO: 1055086 - RNA, 22 nt, Mycobacterium bovis subsp bovis AF2122/97
cacucgccgaaucgcugaccgc

SEQ ID NO: 1055087 - RNA, 16 nt, Mycobacterium bovis subsp bovis AF2122/97
cacucgcggauccggg

SEQ ID NO: 1055088 - RNA, 21 nt, Mycobacterium bovis subsp bovis AF2122/97
cacucgcggauccgggcgugg

SEQ ID NO: 1055089 - RNA, 20 nt, Mycobacterium bovis subsp bovis AF2122/97
cacucuggcgagggcuaccg

SEQ ID NO: 1055090 - RNA, 22 nt, Mycobacterium bovis subsp bovis AF2122/97
cacucuucgggcggcgucgcgg

SEQ ID NO: 1055091 - RNA, 19 nt, Mycobacterium bovis subsp bovis AF2122/97
cacugaaccgguugacacc

SEQ ID NO: 1055092 - RNA, 12 nt, Mycobacterium bovis subsp bovis AF2122/97
cacugaaccgua

SEQ ID NO: 1055093 - RNA, 16 nt, Mycobacterium bovis subsp bovis AF2122/97
cacugaagaucgcgcc

SEQ ID NO: 1055094 - RNA, 18 nt, Mycobacterium bovis subsp bovis AF2122/97
cacugccgcgcgcccgcc

SEQ ID NO: 1055095 - RNA, 21 nt, Mycobacterium bovis subsp bovis AF2122/97
cacugccggacagccacgcac

SEQ ID NO: 1055096 - RNA, 12 nt, Mycobacterium bovis subsp bovis AF2122/97
cacugccagccg

SEQ ID NO: 1055097 - RNA, 23 nt, Mycobacterium bovis subsp bovis AF2122/97
cacugcccucaacgaucgcgccg

SEQ ID NO: 1055098 - RNA, 16 nt, Mycobacterium bovis subsp bovis AF2122/97
cacugccggcacgccg

SEQ ID NO: 1055099 - RNA, 19 nt, Mycobacterium bovis subsp bovis AF2122/97
cacugccggcacgccgacc

SEQ ID NO: 1055100 - RNA, 22 nt, Mycobacterium bovis subsp bovis AF2122/97
cacugccgggugggcaagcuga

SEQ ID NO: 1055101 - RNA, 18 nt, Mycobacterium bovis subsp bovis AF2122/97
cacugccguugccgccgg

SEQ ID NO: 1055102 - RNA, 12 nt, Mycobacterium bovis subsp bovis AF2122/97
cacugcgcccgc

SEQ ID NO: 1055103 - RNA, 13 nt, Mycobacterium bovis subsp bovis AF2122/97
cacugcgcccgcc

SEQ ID NO: 1055104 - RNA, 15 nt, Mycobacterium bovis subsp bovis AF2122/97
cacugcgagcgcagc

SEQ ID NO: 1055105 - RNA, 18 nt, Mycobacterium bovis subsp bovis AF2122/97
cacugcgagggcacgcgc

SEQ ID NO: 1055106 - RNA, 19 nt, Mycobacterium bovis subsp bovis AF2122/97
cacugccuuaaccgagccg

SEQ ID NO: 1055107 - RNA, 17 nt, Mycobacterium bovis subsp bovis AF2122/97
cacugcgaacccugcgc

SEQ ID NO: 1055108 - RNA, 22 nt, Mycobacterium bovis subsp bovis AF2122/97
cacugcgaccgucccggccucg

SEQ ID NO: 1055109 - RNA, 23 nt, Mycobacterium bovis subsp bovis AF2122/97
cacuggacccgcccaggcgucca

SEQ ID NO: 1055110 - RNA, 14 nt, Mycobacterium bovis subsp bovis AF2122/97
cacugcucgucgcg

SEQ ID NO: 1055111 - RNA, 20 nt, Mycobacterium bovis subsp bovis AF2122/97
cacugcguuccaucgccgac

SEQ ID NO: 1055112 - RNA, 21 nt, Mycobacterium bovis subsp bovis AF2122/97
cacugcguuccaucgccgacg

SEQ ID NO: 1055113 - RNA, 16 nt, Mycobacterium bovis subsp bovis AF2122/97
cacugcgccgugaccc

SEQ ID NO: 1055114 - RNA, 23 nt, Mycobacterium bovis subsp bovis AF2122/97
cacugcgcgucgagcgaccccca

SEQ ID NO: 1055115 - RNA, 18 nt, Mycobacterium bovis subsp bovis AF2122/97
cacugcgcgugcucgacg

SEQ ID NO: 1055116 - RNA, 22 nt, Mycobacterium bovis subsp bovis AF2122/97
cacugcgcgugcucgacgcgca

SEQ ID NO: 1055117 - RNA, 15 nt, Mycobacterium bovis subsp bovis AF2122/97
cacugcgccggccgg

SEQ ID NO: 1055118 - RNA, 15 nt, Mycobacterium bovis subsp bovis AF2122/97
cacugaucaggccga

SEQ ID NO: 1055119 - RNA, 11 nt, Mycobacterium bovis subsp bovis AF2122/97
cacugagaucc

SEQ ID NO: 1055120 - RNA, 17 nt, Mycobacterium bovis subsp bovis AF2122/97
cacugacgcgcccgacg

SEQ ID NO: 1055121 - RNA, 20 nt, Mycobacterium bovis subsp bovis AF2122/97
cacugacgggccgucaaucg

SEQ ID NO: 1055122 - RNA, 21 nt, Mycobacterium bovis subsp bovis AF2122/97
cacugaccaggucugcggugc

SEQ ID NO: 1055123 - RNA, 19 nt, Mycobacterium bovis subsp bovis AF2122/97
cacugaccccgccgccacg

SEQ ID NO: 1055124 - RNA, 21 nt, Mycobacterium bovis subsp bovis AF2122/97
cacugaccgcgaucgccgacg

SEQ ID NO: 1055125 - RNA, 20 nt, Mycobacterium bovis subsp bovis AF2122/97
cacugcccucaacgaucgcg

SEQ ID NO: 1055126 - RNA, 22 nt, Mycobacterium bovis subsp bovis AF2122/97
cacugcccucaacgaucgcgcc

SEQ ID NO: 1055127 - RNA, 22 nt, Mycobacterium bovis subsp bovis AF2122/97
cacugcagugaucgugaccggc

SEQ ID NO: 1055128 - RNA, 19 nt, Mycobacterium bovis subsp bovis AF2122/97
cagaacaauuucgaccuug

SEQ ID NO: 1055129 - RNA, 14 nt, Mycobacterium bovis subsp bovis AF2122/97
cagaaauggcgcca

SEQ ID NO: 1055130 - RNA, 23 nt, Mycobacterium bovis subsp bovis AF2122/97
cagaacaccggccaggccggcgg

SEQ ID NO: 1055131 - RNA, 18 nt, Mycobacterium bovis subsp bovis AF2122/97
cagaaccuggagccgugc

SEQ ID NO: 1055132 - RNA, 15 nt, Mycobacterium bovis subsp bovis AF2122/97
cagaacgacaccgcu

SEQ ID NO: 1055133 - RNA, 14 nt, Mycobacterium bovis subsp bovis AF2122/97
cagaaccggugcgg

SEQ ID NO: 1055134 - RNA, 16 nt, Mycobacterium bovis subsp bovis AF2122/97
cagaaccuggagccgu

SEQ ID NO: 1055135 - RNA, 22 nt, Mycobacterium bovis subsp bovis AF2122/97
cagaaccgaagccucggcaugc

SEQ ID NO: 1055136 - RNA, 19 nt, Mycobacterium bovis subsp bovis AF2122/97
cagaaggaucagcgcacug

SEQ ID NO: 1055137 - RNA, 13 nt, Mycobacterium bovis subsp bovis AF2122/97
cagaaggccagcg

SEQ ID NO: 1055138 - RNA, 16 nt, Mycobacterium bovis subsp bovis AF2122/97
cagaaggccgcaccgc

SEQ ID NO: 1055139 - RNA, 14 nt, Mycobacterium bovis subsp bovis AF2122/97
cacuuccaagccga

SEQ ID NO: 1055140 - RNA, 16 nt, Mycobacterium bovis subsp bovis AF2122/97
cacuuccagcccggca

SEQ ID NO: 1055141 - RNA, 17 nt, Mycobacterium bovis subsp bovis AF2122/97
cacuuggaugcgacccg

SEQ ID NO: 1055142 - RNA, 13 nt, Mycobacterium bovis subsp bovis AF2122/97
cacuggauccggg

SEQ ID NO: 1055143 - RNA, 20 nt, Mycobacterium bovis subsp bovis AF2122/97
cacuggauggcucgccgaaa

SEQ ID NO: 1055144 - RNA, 18 nt, Mycobacterium bovis subsp bovis AF2122/97
cacuggcacacggucacc

SEQ ID NO: 1055145 - RNA, 22 nt, Mycobacterium bovis subsp bovis AF2122/97
cacuggcgaaccagaguucggc

SEQ ID NO: 1055146 - RNA, 16 nt, Mycobacterium bovis subsp bovis AF2122/97
cacuggugcagcgccg

SEQ ID NO: 1055147 - RNA, 21 nt, Mycobacterium bovis subsp bovis AF2122/97
cacuggugcccgacccgccga

SEQ ID NO: 1055148 - RNA, 14 nt, Mycobacterium bovis subsp bovis AF2122/97
cacuggucaacacg

SEQ ID NO: 1055149 - RNA, 16 nt, Mycobacterium bovis subsp bovis AF2122/97
cacuggggugcugcgc

SEQ ID NO: 1055150 - RNA, 21 nt, Mycobacterium bovis subsp bovis AF2122/97
cacuggggugcugcgcgcggc

SEQ ID NO: 1055151 - RNA, 14 nt, Mycobacterium bovis subsp bovis AF2122/97
cacuggguccacgc

SEQ ID NO: 1055152 - RNA, 22 nt, Mycobacterium bovis subsp bovis AF2122/97
cacuggguccacgcgcucggug

SEQ ID NO: 1055153 - RNA, 22 nt, Mycobacterium bovis subsp bovis AF2122/97
cacugggaugaguucgucgugg

SEQ ID NO: 1055154 - RNA, 12 nt, Mycobacterium bovis subsp bovis AF2122/97
cacugggcgaug

SEQ ID NO: 1055155 - RNA, 14 nt, Mycobacterium bovis subsp bovis AF2122/97
cacuggggccccgg

SEQ ID NO: 1055156 - RNA, 15 nt, Mycobacterium bovis subsp bovis AF2122/97
cacuguuacggccac

SEQ ID NO: 1055157 - RNA, 24 nt, Mycobacterium bovis subsp bovis AF2122/97
cacuguuacggccacaccgucacg

SEQ ID NO: 1055158 - RNA, 22 nt, Mycobacterium bovis subsp bovis AF2122/97
cacugugcccucaacgucccag

SEQ ID NO: 1055159 - RNA, 16 nt, Mycobacterium bovis subsp bovis AF2122/97
cacuucagcacccggc

SEQ ID NO: 1055160 - RNA, 22 nt, Mycobacterium bovis subsp bovis AF2122/97
cacuguuucugagcgcgcuggc

SEQ ID NO: 1055161 - RNA, 13 nt, Mycobacterium bovis subsp bovis AF2122/97
cacuuagcuggcg

SEQ ID NO: 1055162 - RNA, 14 nt, Mycobacterium bovis subsp bovis AF2122/97
cacgccgccggccg

SEQ ID NO: 1055163 - RNA, 15 nt, Mycobacterium bovis subsp bovis AF2122/97
cacgccgccggccgc

SEQ ID NO: 1055164 - RNA, 13 nt, Mycobacterium bovis subsp bovis AF2122/97
cacgccgccggcg

SEQ ID NO: 1055165 - RNA, 15 nt, Mycobacterium bovis subsp bovis AF2122/97
cacgccgccggcgaa

SEQ ID NO: 1055166 - RNA, 21 nt, Mycobacterium bovis subsp bovis AF2122/97
cacgccgccggcgcugaucgc

SEQ ID NO: 1055167 - RNA, 12 nt, Mycobacterium bovis subsp bovis AF2122/97
cacgcgaccacc

SEQ ID NO: 1055168 - RNA, 18 nt, Mycobacterium bovis subsp bovis AF2122/97
cacgcgaaaugccugcgc

SEQ ID NO: 1055169 - RNA, 18 nt, Mycobacterium bovis subsp bovis AF2122/97
cacgccugggcgacgacg

SEQ ID NO: 1055170 - RNA, 18 nt, Mycobacterium bovis subsp bovis AF2122/97
cacgcccuaacccugccc

SEQ ID NO: 1055171 - RNA, 16 nt, Mycobacterium bovis subsp bovis AF2122/97
cacgcccucgacgccg

SEQ ID NO: 1055172 - RNA, 18 nt, Mycobacterium bovis subsp bovis AF2122/97
cacgcccucgacgccgcg

SEQ ID NO: 1055173 - RNA, 13 nt, Mycobacterium bovis subsp bovis AF2122/97
cacgcccgacgag

SEQ ID NO: 1055174 - RNA, 13 nt, Mycobacterium bovis subsp bovis AF2122/97
cacgcccgcacuc

SEQ ID NO: 1055175 - RNA, 17 nt, Mycobacterium bovis subsp bovis AF2122/97
cacgccagcgucgacca

SEQ ID NO: 1055176 - RNA, 20 nt, Mycobacterium bovis subsp bovis AF2122/97
cacgccagcucgccggccgg

SEQ ID NO: 1055177 - RNA, 14 nt, Mycobacterium bovis subsp bovis AF2122/97
cacgcccggccccg

SEQ ID NO: 1055178 - RNA, 21 nt, Mycobacterium bovis subsp bovis AF2122/97
cacgcccgaagaaugggaugg

SEQ ID NO: 1055179 - RNA, 15 nt, Mycobacterium bovis subsp bovis AF2122/97
cacgccagcucgccg

SEQ ID NO: 1055180 - RNA, 16 nt, Mycobacterium bovis subsp bovis AF2122/97
cacgccagcgcgacca

SEQ ID NO: 1055181 - RNA, 20 nt, Mycobacterium bovis subsp bovis AF2122/97
cacgccacguccaacucggc

SEQ ID NO: 1055182 - RNA, 17 nt, Mycobacterium bovis subsp bovis AF2122/97
cacgccacuucuucggg

SEQ ID NO: 1055183 - RNA, 13 nt, Mycobacterium bovis subsp bovis AF2122/97
cacgccaccgcgg

SEQ ID NO: 1055184 - RNA, 19 nt, Mycobacterium bovis subsp bovis AF2122/97
cacgccaccgcaacucgcc

SEQ ID NO: 1055185 - RNA, 18 nt, Mycobacterium bovis subsp bovis AF2122/97
cacgcaguucggucagcg

SEQ ID NO: 1055186 - RNA, 19 nt, Mycobacterium bovis subsp bovis AF2122/97
cacgcauaucgcuugaacg

SEQ ID NO: 1055187 - RNA, 12 nt, Mycobacterium bovis subsp bovis AF2122/97
cacgcaugcgcg

SEQ ID NO: 1055188 - RNA, 22 nt, Mycobacterium bovis subsp bovis AF2122/97
cacgccaacguugcgccagcgg

SEQ ID NO: 1055189 - RNA, 22 nt, Mycobacterium bovis subsp bovis AF2122/97
cacgcaggaaaaccccggccac

SEQ ID NO: 1055190 - RNA, 23 nt, Mycobacterium bovis subsp bovis AF2122/97
cacgcaggaaaaccccggccacc

SEQ ID NO: 1055191 - RNA, 20 nt, Mycobacterium bovis subsp bovis AF2122/97
cacgcacguagacgguguca

SEQ ID NO: 1055192 - RNA, 13 nt, Mycobacterium bovis subsp bovis AF2122/97
cacgcaccgcggu

SEQ ID NO: 1055193 - RNA, 14 nt, Mycobacterium bovis subsp bovis AF2122/97
cacgcaccgcggug

SEQ ID NO: 1055194 - RNA, 21 nt, Mycobacterium bovis subsp bovis AF2122/97
cacgcaccgggugcaggugau

SEQ ID NO: 1055195 - RNA, 13 nt, Mycobacterium bovis subsp bovis AF2122/97
cacgcacucgucg

SEQ ID NO: 1055196 - RNA, 14 nt, Mycobacterium bovis subsp bovis AF2122/97
cacgcacucgucgg

SEQ ID NO: 1055197 - RNA, 19 nt, Mycobacterium bovis subsp bovis AF2122/97
cacgcacucgucgggguug

SEQ ID NO: 1055198 - RNA, 12 nt, Mycobacterium bovis subsp bovis AF2122/97
cacgcacccggc

SEQ ID NO: 1055199 - RNA, 21 nt, Mycobacterium bovis subsp bovis AF2122/97
cacgcacugaugucacccgcc

SEQ ID NO: 1055200 - RNA, 17 nt, Mycobacterium bovis subsp bovis AF2122/97
cacgcagcccgucggcg

SEQ ID NO: 1055201 - RNA, 22 nt, Mycobacterium bovis subsp bovis AF2122/97
cacgcagccgauacaggccacg

SEQ ID NO: 1055202 - RNA, 19 nt, Mycobacterium bovis subsp bovis AF2122/97
cacgcagccgcgcggugau

SEQ ID NO: 1055203 - RNA, 22 nt, Mycobacterium bovis subsp bovis AF2122/97
cacgcagcacccugcgggccga

SEQ ID NO: 1055204 - RNA, 14 nt, Mycobacterium bovis subsp bovis AF2122/97
cacgaucgccaacg

SEQ ID NO: 1055205 - RNA, 21 nt, Mycobacterium bovis subsp bovis AF2122/97
cacgaucgccaacgacucacc

SEQ ID NO: 1055206 - RNA, 15 nt, Mycobacterium bovis subsp bovis AF2122/97
cacgaucgcccguga

SEQ ID NO: 1055207 - RNA, 16 nt, Mycobacterium bovis subsp bovis AF2122/97
cacgauccgcgguagc

SEQ ID NO: 1055208 - RNA, 14 nt, Mycobacterium bovis subsp bovis AF2122/97
cacgaucgcgguga

SEQ ID NO: 1055209 - RNA, 14 nt, Mycobacterium bovis subsp bovis AF2122/97
cacgaucgugccgg

SEQ ID NO: 1055210 - RNA, 19 nt, Mycobacterium bovis subsp bovis AF2122/97
cacgaugaucuugccgcgg

SEQ ID NO: 1055211 - RNA, 16 nt, Mycobacterium bovis subsp bovis AF2122/97
cacgaucucguggauc

SEQ ID NO: 1055212 - RNA, 17 nt, Mycobacterium bovis subsp bovis AF2122/97
cacgaugcccggcaucg

SEQ ID NO: 1055213 - RNA, 16 nt, Mycobacterium bovis subsp bovis AF2122/97
cacgaugcgcacaccg

SEQ ID NO: 1055214 - RNA, 17 nt, Mycobacterium bovis subsp bovis AF2122/97
cacgaugucgucgauga

SEQ ID NO: 1055215 - RNA, 13 nt, Mycobacterium bovis subsp bovis AF2122/97
cacgauggccguc

SEQ ID NO: 1055216 - RNA, 17 nt, Mycobacterium bovis subsp bovis AF2122/97
cacgauggccgucgauc

SEQ ID NO: 1055217 - RNA, 18 nt, Mycobacterium bovis subsp bovis AF2122/97
cacgaugucgaugccgug

SEQ ID NO: 1055218 - RNA, 17 nt, Mycobacterium bovis subsp bovis AF2122/97
cacgcacacgaucgcgg

SEQ ID NO: 1055219 - RNA, 15 nt, Mycobacterium bovis subsp bovis AF2122/97
cacgcaacaccgcca

SEQ ID NO: 1055220 - RNA, 16 nt, Mycobacterium bovis subsp bovis AF2122/97
cacgcaacaccgccaa

SEQ ID NO: 1055221 - RNA, 22 nt, Mycobacterium bovis subsp bovis AF2122/97
cacgcaauucaaaugaaccgca

SEQ ID NO: 1055222 - RNA, 23 nt, Mycobacterium bovis subsp bovis AF2122/97
cacgcaauuggccguuggcggcg

SEQ ID NO: 1055223 - RNA, 18 nt, Mycobacterium bovis subsp bovis AF2122/97
cacgcacaaguucuucga

SEQ ID NO: 1055224 - RNA, 15 nt, Mycobacterium bovis subsp bovis AF2122/97
cacgagguugggccg

SEQ ID NO: 1055225 - RNA, 16 nt, Mycobacterium bovis subsp bovis AF2122/97
cacgagguugggccgg

SEQ ID NO: 1055226 - RNA, 17 nt, Mycobacterium bovis subsp bovis AF2122/97
cacgagguugggccggu

SEQ ID NO: 1055227 - RNA, 19 nt, Mycobacterium bovis subsp bovis AF2122/97
cacgaguccgcggaucacc

SEQ ID NO: 1055228 - RNA, 22 nt, Mycobacterium bovis subsp bovis AF2122/97
cacgauaaaugcuucgaccgcc

SEQ ID NO: 1055229 - RNA, 16 nt, Mycobacterium bovis subsp bovis AF2122/97
cacgagcagccgaugc

SEQ ID NO: 1055230 - RNA, 21 nt, Mycobacterium bovis subsp bovis AF2122/97
cacgaggcacaaucaccgccg

SEQ ID NO: 1055231 - RNA, 13 nt, Mycobacterium bovis subsp bovis AF2122/97
cacgaggcaucgu

SEQ ID NO: 1055232 - RNA, 18 nt, Mycobacterium bovis subsp bovis AF2122/97
cacgaggcaucguccacg

SEQ ID NO: 1055233 - RNA, 19 nt, Mycobacterium bovis subsp bovis AF2122/97
cacgaggcaucguccacgc

SEQ ID NO: 1055234 - RNA, 14 nt, Mycobacterium bovis subsp bovis AF2122/97
cacgaucaaccggg

SEQ ID NO: 1055235 - RNA, 23 nt, Mycobacterium bovis subsp bovis AF2122/97
cacgauaucgggcucagcggcga

SEQ ID NO: 1055236 - RNA, 14 nt, Mycobacterium bovis subsp bovis AF2122/97
cacgauagccaccg

SEQ ID NO: 1055237 - RNA, 17 nt, Mycobacterium bovis subsp bovis AF2122/97
cacgauagccaccgacg

SEQ ID NO: 1055238 - RNA, 16 nt, Mycobacterium bovis subsp bovis AF2122/97
cacgaucacccgcacg

SEQ ID NO: 1055239 - RNA, 17 nt, Mycobacterium bovis subsp bovis AF2122/97
cacgaucacccgcacgu

SEQ ID NO: 1055240 - RNA, 16 nt, Mycobacterium bovis subsp bovis AF2122/97
cacgaucagggcgaug

SEQ ID NO: 1055241 - RNA, 17 nt, Mycobacterium bovis subsp bovis AF2122/97
cacgagcaacgggcgaa

SEQ ID NO: 1055242 - RNA, 20 nt, Mycobacterium bovis subsp bovis AF2122/97
cacgacugucccgcgcaacc

SEQ ID NO: 1055243 - RNA, 14 nt, Mycobacterium bovis subsp bovis AF2122/97
cacgacugugcgcc

SEQ ID NO: 1055244 - RNA, 23 nt, Mycobacterium bovis subsp bovis AF2122/97
cacgacugugcgccgcagccugc

SEQ ID NO: 1055245 - RNA, 22 nt, Mycobacterium bovis subsp bovis AF2122/97
cacgacgucggugaacgcgucg

SEQ ID NO: 1055246 - RNA, 19 nt, Mycobacterium bovis subsp bovis AF2122/97
cacgacugcaucgucgacg

SEQ ID NO: 1055247 - RNA, 23 nt, Mycobacterium bovis subsp bovis AF2122/97
cacgacguucgacgacagcaccg

SEQ ID NO: 1055248 - RNA, 20 nt, Mycobacterium bovis subsp bovis AF2122/97
cacgacguugccucgcgacg

SEQ ID NO: 1055249 - RNA, 22 nt, Mycobacterium bovis subsp bovis AF2122/97
cacgacguugcgaggccgcacg

SEQ ID NO: 1055250 - RNA, 16 nt, Mycobacterium bovis subsp bovis AF2122/97
cacgacgucggugaac

SEQ ID NO: 1055251 - RNA, 20 nt, Mycobacterium bovis subsp bovis AF2122/97
cacgacgucaaucucggucg

SEQ ID NO: 1055252 - RNA, 13 nt, Mycobacterium bovis subsp bovis AF2122/97
cacgacggcacgc

SEQ ID NO: 1055253 - RNA, 12 nt, Mycobacterium bovis subsp bovis AF2122/97
cacgacgggccg

SEQ ID NO: 1055254 - RNA, 19 nt, Mycobacterium bovis subsp bovis AF2122/97
cacgacgccuugucggcgu

SEQ ID NO: 1055255 - RNA, 18 nt, Mycobacterium bovis subsp bovis AF2122/97
cacgacgaagucguuggg

SEQ ID NO: 1055256 - RNA, 19 nt, Mycobacterium bovis subsp bovis AF2122/97
cacgacgacaaccggccag

SEQ ID NO: 1055257 - RNA, 23 nt, Mycobacterium bovis subsp bovis AF2122/97
cacgacgacaaccggccagaugg

SEQ ID NO: 1055258 - RNA, 13 nt, Mycobacterium bovis subsp bovis AF2122/97
cacgacgccgaau

SEQ ID NO: 1055259 - RNA, 14 nt, Mycobacterium bovis subsp bovis AF2122/97
cacgacgccggccu

SEQ ID NO: 1055260 - RNA, 12 nt, Mycobacterium bovis subsp bovis AF2122/97
caccucgaugcc

SEQ ID NO: 1055261 - RNA, 14 nt, Mycobacterium bovis subsp bovis AF2122/97
caccucgagcgcgg

SEQ ID NO: 1055262 - RNA, 17 nt, Mycobacterium bovis subsp bovis AF2122/97
caccucgagcgcggcga

SEQ ID NO: 1055263 - RNA, 21 nt, Mycobacterium bovis subsp bovis AF2122/97
caccucgagcccgcguucagg

SEQ ID NO: 1055264 - RNA, 15 nt, Mycobacterium bovis subsp bovis AF2122/97
caccucgacggugac

SEQ ID NO: 1055265 - RNA, 22 nt, Mycobacterium bovis subsp bovis AF2122/97
caccucgacggugacgaccacg

SEQ ID NO: 1055266 - RNA, 18 nt, Mycobacterium bovis subsp bovis AF2122/97
caccucgaagugcaggug

SEQ ID NO: 1055267 - RNA, 16 nt, Mycobacterium bovis subsp bovis AF2122/97
caccucgaaggcccgc

SEQ ID NO: 1055268 - RNA, 20 nt, Mycobacterium bovis subsp bovis AF2122/97
caccgcggagauaccggacc

SEQ ID NO: 1055269 - RNA, 13 nt, Mycobacterium bovis subsp bovis AF2122/97
caccuccccgauc

SEQ ID NO: 1055270 - RNA, 21 nt, Mycobacterium bovis subsp bovis AF2122/97
caccucccgggcgagccgugc

SEQ ID NO: 1055271 - RNA, 15 nt, Mycobacterium bovis subsp bovis AF2122/97
caccuccgacggccg

SEQ ID NO: 1055272 - RNA, 16 nt, Mycobacterium bovis subsp bovis AF2122/97
caccuccgacggccgc

SEQ ID NO: 1055273 - RNA, 17 nt, Mycobacterium bovis subsp bovis AF2122/97
caccuccgcgacggcgg

SEQ ID NO: 1055274 - RNA, 22 nt, Mycobacterium bovis subsp bovis AF2122/97
caccuccgcguccaaggcgcgc

SEQ ID NO: 1055275 - RNA, 14 nt, Mycobacterium bovis subsp bovis AF2122/97
caccuccgcgucgg

SEQ ID NO: 1055276 - RNA, 14 nt, Mycobacterium bovis subsp bovis AF2122/97
caccucccgcagcc

SEQ ID NO: 1055277 - RNA, 17 nt, Mycobacterium bovis subsp bovis AF2122/97
caccgcggaaggccagc

SEQ ID NO: 1055278 - RNA, 18 nt, Mycobacterium bovis subsp bovis AF2122/97
caccgcggaaggccagcu

SEQ ID NO: 1055279 - RNA, 22 nt, Mycobacterium bovis subsp bovis AF2122/97
caccucccagggcucggcggcc

SEQ ID NO: 1055280 - RNA, 19 nt, Mycobacterium bovis subsp bovis AF2122/97
caccgcggaucgacuucga

SEQ ID NO: 1055281 - RNA, 11 nt, Mycobacterium bovis subsp bovis AF2122/97
caccgcggcaa

SEQ ID NO: 1055282 - RNA, 13 nt, Mycobacterium bovis subsp bovis AF2122/97
caccgcggcaaga

SEQ ID NO: 1055283 - RNA, 13 nt, Mycobacterium bovis subsp bovis AF2122/97
caccucgccggcg

SEQ ID NO: 1055284 - RNA, 14 nt, Mycobacterium bovis subsp bovis AF2122/97
caccucgccggcgg

SEQ ID NO: 1055285 - RNA, 20 nt, Mycobacterium bovis subsp bovis AF2122/97
caccucgccaacaucccaac

SEQ ID NO: 1055286 - RNA, 21 nt, Mycobacterium bovis subsp bovis AF2122/97
caccucgauggcguccaucuc

SEQ ID NO: 1055287 - RNA, 13 nt, Mycobacterium bovis subsp bovis AF2122/97
caccucgaugccg

SEQ ID NO: 1055288 - RNA, 22 nt, Mycobacterium bovis subsp bovis AF2122/97
caccucgcccucccgggcccgc

SEQ ID NO: 1055289 - RNA, 13 nt, Mycobacterium bovis subsp bovis AF2122/97
caccucgcgggug

SEQ ID NO: 1055290 - RNA, 21 nt, Mycobacterium bovis subsp bovis AF2122/97
caccucggucccguugccgcc

SEQ ID NO: 1055291 - RNA, 19 nt, Mycobacterium bovis subsp bovis AF2122/97
caccucggugaccaggccg

SEQ ID NO: 1055292 - RNA, 20 nt, Mycobacterium bovis subsp bovis AF2122/97
caccucggugaccaggccgg

SEQ ID NO: 1055293 - RNA, 17 nt, Mycobacterium bovis subsp bovis AF2122/97
caccucggugccggccg

SEQ ID NO: 1055294 - RNA, 19 nt, Mycobacterium bovis subsp bovis AF2122/97
caccucggugccggccgca

SEQ ID NO: 1055295 - RNA, 20 nt, Mycobacterium bovis subsp bovis AF2122/97
caccucggugcggaacaccg

SEQ ID NO: 1055296 - RNA, 21 nt, Mycobacterium bovis subsp bovis AF2122/97
caccucguauacccgggcggu

SEQ ID NO: 1055297 - RNA, 13 nt, Mycobacterium bovis subsp bovis AF2122/97
caccuggcgcagc

SEQ ID NO: 1055298 - RNA, 15 nt, Mycobacterium bovis subsp bovis AF2122/97
caccugggcugccgg

SEQ ID NO: 1055299 - RNA, 20 nt, Mycobacterium bovis subsp bovis AF2122/97
caccugggcugccggccaga

SEQ ID NO: 1055300 - RNA, 15 nt, Mycobacterium bovis subsp bovis AF2122/97
caccugggucgacga

SEQ ID NO: 1055301 - RNA, 15 nt, Mycobacterium bovis subsp bovis AF2122/97
caccugggccagcag

SEQ ID NO: 1055302 - RNA, 17 nt, Mycobacterium bovis subsp bovis AF2122/97
caccugggccagcagcc

SEQ ID NO: 1055303 - RNA, 13 nt, Mycobacterium bovis subsp bovis AF2122/97
caccugggcggca

SEQ ID NO: 1055304 - RNA, 14 nt, Mycobacterium bovis subsp bovis AF2122/97
caccugggcggcau

SEQ ID NO: 1055305 - RNA, 23 nt, Mycobacterium bovis subsp bovis AF2122/97
caccugggcgggcuuggcgucga

SEQ ID NO: 1055306 - RNA, 14 nt, Mycobacterium bovis subsp bovis AF2122/97
caccugcucgucgg

SEQ ID NO: 1055307 - RNA, 21 nt, Mycobacterium bovis subsp bovis AF2122/97
caccugcucgucggucaccga

SEQ ID NO: 1055308 - RNA, 14 nt, Mycobacterium bovis subsp bovis AF2122/97
caccugcuggccgu

SEQ ID NO: 1055309 - RNA, 21 nt, Mycobacterium bovis subsp bovis AF2122/97
caccugcuggccguaacgcgg

SEQ ID NO: 1055310 - RNA, 16 nt, Mycobacterium bovis subsp bovis AF2122/97
caccuggauccaccag

SEQ ID NO: 1055311 - RNA, 13 nt, Mycobacterium bovis subsp bovis AF2122/97
caccugcgccacc

SEQ ID NO: 1055312 - RNA, 20 nt, Mycobacterium bovis subsp bovis AF2122/97
caccugcgggugcgucgaug

SEQ ID NO: 1055313 - RNA, 17 nt, Mycobacterium bovis subsp bovis AF2122/97
caccugcgucggcccgc

SEQ ID NO: 1055314 - RNA, 14 nt, Mycobacterium bovis subsp bovis AF2122/97
caccugcgcgcggc

SEQ ID NO: 1055315 - RNA, 16 nt, Mycobacterium bovis subsp bovis AF2122/97
caccugcgcgcggccg

SEQ ID NO: 1055316 - RNA, 22 nt, Mycobacterium bovis subsp bovis AF2122/97
caccugcgcgcggccgcgcugc

SEQ ID NO: 1055317 - RNA, 16 nt, Mycobacterium bovis subsp bovis AF2122/97
caccugccguuccggc

SEQ ID NO: 1055318 - RNA, 20 nt, Mycobacterium bovis subsp bovis AF2122/97
caccugccagugggccgacg

SEQ ID NO: 1055319 - RNA, 19 nt, Mycobacterium bovis subsp bovis AF2122/97
caccugccgacucaucggc

SEQ ID NO: 1055320 - RNA, 22 nt, Mycobacterium bovis subsp bovis AF2122/97
caccugccgacucaucggccgc

SEQ ID NO: 1055321 - RNA, 16 nt, Mycobacterium bovis subsp bovis AF2122/97
caccugccgaucgggc

SEQ ID NO: 1055322 - RNA, 14 nt, Mycobacterium bovis subsp bovis AF2122/97
caccugaaaccacu

SEQ ID NO: 1055323 - RNA, 15 nt, Mycobacterium bovis subsp bovis AF2122/97
caccuucgacguugc

SEQ ID NO: 1055324 - RNA, 22 nt, Mycobacterium bovis subsp bovis AF2122/97
caccuucgacguugcggacggc

SEQ ID NO: 1055325 - RNA, 19 nt, Mycobacterium bovis subsp bovis AF2122/97
caccuguuggcaugccgcc

SEQ ID NO: 1055326 - RNA, 16 nt, Mycobacterium bovis subsp bovis AF2122/97
caccugguuuacccgc

SEQ ID NO: 1055327 - RNA, 14 nt, Mycobacterium bovis subsp bovis AF2122/97
caccuguucaccaa

SEQ ID NO: 1055328 - RNA, 16 nt, Mycobacterium bovis subsp bovis AF2122/97
caccuggucgcgucca

SEQ ID NO: 1055329 - RNA, 19 nt, Mycobacterium bovis subsp bovis AF2122/97
caccuggucgcguccaccc

SEQ ID NO: 1055330 - RNA, 22 nt, Mycobacterium bovis subsp bovis AF2122/97
caccuggucgcguccacccacg

SEQ ID NO: 1055331 - RNA, 13 nt, Mycobacterium bovis subsp bovis AF2122/97
caccuggucggcc

SEQ ID NO: 1055332 - RNA, 14 nt, Mycobacterium bovis subsp bovis AF2122/97
caccuggucggccg

SEQ ID NO: 1055333 - RNA, 23 nt, Mycobacterium bovis subsp bovis AF2122/97
caccuuggcggucggcagaccga

SEQ ID NO: 1055334 - RNA, 14 nt, Mycobacterium bovis subsp bovis AF2122/97
cacgaaacccaguc

SEQ ID NO: 1055335 - RNA, 18 nt, Mycobacterium bovis subsp bovis AF2122/97
caccuuuggccgcgaccg

SEQ ID NO: 1055336 - RNA, 15 nt, Mycobacterium bovis subsp bovis AF2122/97
caccuugccuagccg

SEQ ID NO: 1055337 - RNA, 15 nt, Mycobacterium bovis subsp bovis AF2122/97
caccuuggccggccc

SEQ ID NO: 1055338 - RNA, 19 nt, Mycobacterium bovis subsp bovis AF2122/97
caccuuggccggccccgcc

SEQ ID NO: 1055339 - RNA, 21 nt, Mycobacterium bovis subsp bovis AF2122/97
caccuugcccaagaucucgcg

SEQ ID NO: 1055340 - RNA, 13 nt, Mycobacterium bovis subsp bovis AF2122/97
caccuugcguccg

SEQ ID NO: 1055341 - RNA, 17 nt, Mycobacterium bovis subsp bovis AF2122/97
caccuucgucgcggccg

SEQ ID NO: 1055342 - RNA, 18 nt, Mycobacterium bovis subsp bovis AF2122/97
caccuucugacgcggccg

SEQ ID NO: 1055343 - RNA, 20 nt, Mycobacterium bovis subsp bovis AF2122/97
caccuugaccgggucgauga

SEQ ID NO: 1055344 - RNA, 16 nt, Mycobacterium bovis subsp bovis AF2122/97
cacgaagccggcuucg

SEQ ID NO: 1055345 - RNA, 14 nt, Mycobacterium bovis subsp bovis AF2122/97
cacgaagcuggcgu

SEQ ID NO: 1055346 - RNA, 15 nt, Mycobacterium bovis subsp bovis AF2122/97
cacgaagcuggcgug

SEQ ID NO: 1055347 - RNA, 22 nt, Mycobacterium bovis subsp bovis AF2122/97
cacgaagcuggcgugcagcagg

SEQ ID NO: 1055348 - RNA, 20 nt, Mycobacterium bovis subsp bovis AF2122/97
cacgaagaccaggccgguga

SEQ ID NO: 1055349 - RNA, 17 nt, Mycobacterium bovis subsp bovis AF2122/97
cacgaagaccgcgucgg

SEQ ID NO: 1055350 - RNA, 19 nt, Mycobacterium bovis subsp bovis AF2122/97
cacgaagaccgcgucggcg

SEQ ID NO: 1055351 - RNA, 15 nt, Mycobacterium bovis subsp bovis AF2122/97
cacgaacucggccgg

SEQ ID NO: 1055352 - RNA, 18 nt, Mycobacterium bovis subsp bovis AF2122/97
cacgaacucggccgggcg

SEQ ID NO: 1055353 - RNA, 20 nt, Mycobacterium bovis subsp bovis AF2122/97
cacgaacugaucgaccgccu

SEQ ID NO: 1055354 - RNA, 16 nt, Mycobacterium bovis subsp bovis AF2122/97
cacgaaaucagcccgc

SEQ ID NO: 1055355 - RNA, 23 nt, Mycobacterium bovis subsp bovis AF2122/97
cacgaaaucgcccugacccggag

SEQ ID NO: 1055356 - RNA, 21 nt, Mycobacterium bovis subsp bovis AF2122/97
cacgaaauugggcgauucugc

SEQ ID NO: 1055357 - RNA, 17 nt, Mycobacterium bovis subsp bovis AF2122/97
cacgacccgggaaggaa

SEQ ID NO: 1055358 - RNA, 22 nt, Mycobacterium bovis subsp bovis AF2122/97
cacgaccccggcgguaccgccg

SEQ ID NO: 1055359 - RNA, 22 nt, Mycobacterium bovis subsp bovis AF2122/97
cacgaccagcugagcuggcagc

SEQ ID NO: 1055360 - RNA, 19 nt, Mycobacterium bovis subsp bovis AF2122/97
cacgacccaagucgccgag

SEQ ID NO: 1055361 - RNA, 15 nt, Mycobacterium bovis subsp bovis AF2122/97
cacgacccagcaugg

SEQ ID NO: 1055362 - RNA, 15 nt, Mycobacterium bovis subsp bovis AF2122/97
cacgaccgccgauac

SEQ ID NO: 1055363 - RNA, 18 nt, Mycobacterium bovis subsp bovis AF2122/97
cacgaccucgggaucggc

SEQ ID NO: 1055364 - RNA, 22 nt, Mycobacterium bovis subsp bovis AF2122/97
cacgacgaacaccagcgcgccg

SEQ ID NO: 1055365 - RNA, 20 nt, Mycobacterium bovis subsp bovis AF2122/97
cacgacaucguaggccggca

SEQ ID NO: 1055366 - RNA, 18 nt, Mycobacterium bovis subsp bovis AF2122/97
cacgacaucgucgcgacg

SEQ ID NO: 1055367 - RNA, 16 nt, Mycobacterium bovis subsp bovis AF2122/97
cagcgaaucacccgcg

SEQ ID NO: 1055368 - RNA, 17 nt, Mycobacterium bovis subsp bovis AF2122/97
cagcgaaugcugacaug

SEQ ID NO: 1055369 - RNA, 17 nt, Mycobacterium bovis subsp bovis AF2122/97
cagcgaagaccagcggc

SEQ ID NO: 1055370 - RNA, 15 nt, Mycobacterium bovis subsp bovis AF2122/97
cagccugccagguac

SEQ ID NO: 1055371 - RNA, 13 nt, Mycobacterium bovis subsp bovis AF2122/97
cagccugcgccgc

SEQ ID NO: 1055372 - RNA, 14 nt, Mycobacterium bovis subsp bovis AF2122/97
cagccugcgccgcg

SEQ ID NO: 1055373 - RNA, 16 nt, Mycobacterium bovis subsp bovis AF2122/97
cagccugcgccgcgcg

SEQ ID NO: 1055374 - RNA, 13 nt, Mycobacterium bovis subsp bovis AF2122/97
cagcgaaccgacc

SEQ ID NO: 1055375 - RNA, 19 nt, Mycobacterium bovis subsp bovis AF2122/97
cagccuggccucgccauug

SEQ ID NO: 1055376 - RNA, 14 nt, Mycobacterium bovis subsp bovis AF2122/97
cagccuggcaacca

SEQ ID NO: 1055377 - RNA, 16 nt, Mycobacterium bovis subsp bovis AF2122/97
cagccuggcaaccacg

SEQ ID NO: 1055378 - RNA, 22 nt, Mycobacterium bovis subsp bovis AF2122/97
cagcgaaccgccggcaccgccg

SEQ ID NO: 1055379 - RNA, 18 nt, Mycobacterium bovis subsp bovis AF2122/97
cagcgaacggccaggaca

SEQ ID NO: 1055380 - RNA, 12 nt, Mycobacterium bovis subsp bovis AF2122/97
cagcgacgucgc

SEQ ID NO: 1055381 - RNA, 19 nt, Mycobacterium bovis subsp bovis AF2122/97
cagcgacgcugccgccagg

SEQ ID NO: 1055382 - RNA, 19 nt, Mycobacterium bovis subsp bovis AF2122/97
cagcgacggucccggcacg

SEQ ID NO: 1055383 - RNA, 16 nt, Mycobacterium bovis subsp bovis AF2122/97
cagcgacgccaugguc

SEQ ID NO: 1055384 - RNA, 13 nt, Mycobacterium bovis subsp bovis AF2122/97
cagcgacgcacgc

SEQ ID NO: 1055385 - RNA, 16 nt, Mycobacterium bovis subsp bovis AF2122/97
cagcgacgcauaaccg

SEQ ID NO: 1055386 - RNA, 23 nt, Mycobacterium bovis subsp bovis AF2122/97
cagcgacgcauaaccggcgcgcc

SEQ ID NO: 1055387 - RNA, 14 nt, Mycobacterium bovis subsp bovis AF2122/97
cagcgacgcggcca

SEQ ID NO: 1055388 - RNA, 21 nt, Mycobacterium bovis subsp bovis AF2122/97
cagcgacgcggccagcggcaa

SEQ ID NO: 1055389 - RNA, 15 nt, Mycobacterium bovis subsp bovis AF2122/97
cagcgacgccauguc

SEQ ID NO: 1055390 - RNA, 20 nt, Mycobacterium bovis subsp bovis AF2122/97
cagcgacgccaugucgaugu

SEQ ID NO: 1055391 - RNA, 19 nt, Mycobacterium bovis subsp bovis AF2122/97
cagcgacgccggcccgacg

SEQ ID NO: 1055392 - RNA, 14 nt, Mycobacterium bovis subsp bovis AF2122/97
cagcgacaacacca

SEQ ID NO: 1055393 - RNA, 15 nt, Mycobacterium bovis subsp bovis AF2122/97
cagcgacaacaccac

SEQ ID NO: 1055394 - RNA, 21 nt, Mycobacterium bovis subsp bovis AF2122/97
cagcgacaacaccacggugcc

SEQ ID NO: 1055395 - RNA, 21 nt, Mycobacterium bovis subsp bovis AF2122/97
cagcgaccucacugcggcgcc

SEQ ID NO: 1055396 - RNA, 15 nt, Mycobacterium bovis subsp bovis AF2122/97
cagcgacgaagucgc

SEQ ID NO: 1055397 - RNA, 15 nt, Mycobacterium bovis subsp bovis AF2122/97
cagccggcagcagcg

SEQ ID NO: 1055398 - RNA, 16 nt, Mycobacterium bovis subsp bovis AF2122/97
cagccggaccguguac

SEQ ID NO: 1055399 - RNA, 19 nt, Mycobacterium bovis subsp bovis AF2122/97
cagccggcagcagcgggcg

SEQ ID NO: 1055400 - RNA, 18 nt, Mycobacterium bovis subsp bovis AF2122/97
cagccggccgcgaccgcg

SEQ ID NO: 1055401 - RNA, 23 nt, Mycobacterium bovis subsp bovis AF2122/97
cagccggccugucccgcacccgg

SEQ ID NO: 1055402 - RNA, 23 nt, Mycobacterium bovis subsp bovis AF2122/97
cagccguauugccuaucgacaac

SEQ ID NO: 1055403 - RNA, 18 nt, Mycobacterium bovis subsp bovis AF2122/97
cagccgucaccgcgaccc

SEQ ID NO: 1055404 - RNA, 16 nt, Mycobacterium bovis subsp bovis AF2122/97
cagccguccgggcggc

SEQ ID NO: 1055405 - RNA, 20 nt, Mycobacterium bovis subsp bovis AF2122/97
cagccguccgggcggccucc

SEQ ID NO: 1055406 - RNA, 17 nt, Mycobacterium bovis subsp bovis AF2122/97
cagccgucggcgcugcg

SEQ ID NO: 1055407 - RNA, 22 nt, Mycobacterium bovis subsp bovis AF2122/97
cagccgucggcgcugcgcgcga

SEQ ID NO: 1055408 - RNA, 15 nt, Mycobacterium bovis subsp bovis AF2122/97
cagccgugcggcggc

SEQ ID NO: 1055409 - RNA, 21 nt, Mycobacterium bovis subsp bovis AF2122/97
cagccgugccgguuuggccga

SEQ ID NO: 1055410 - RNA, 21 nt, Mycobacterium bovis subsp bovis AF2122/97
cagccgugcccaggccaccgg

SEQ ID NO: 1055411 - RNA, 17 nt, Mycobacterium bovis subsp bovis AF2122/97
cagccgugcccaggcca

SEQ ID NO: 1055412 - RNA, 14 nt, Mycobacterium bovis subsp bovis AF2122/97
cagccgucgcacca

SEQ ID NO: 1055413 - RNA, 21 nt, Mycobacterium bovis subsp bovis AF2122/97
cagccgucguccgcugacccg

SEQ ID NO: 1055414 - RNA, 24 nt, Mycobacterium bovis subsp bovis AF2122/97
cagccgucguccgcugacccgcca

SEQ ID NO: 1055415 - RNA, 21 nt, Mycobacterium bovis subsp bovis AF2122/97
cagccucguagaacgcuagcg

SEQ ID NO: 1055416 - RNA, 21 nt, Mycobacterium bovis subsp bovis AF2122/97
cagccucucgcuuagcgucgc

SEQ ID NO: 1055417 - RNA, 13 nt, Mycobacterium bovis subsp bovis AF2122/97
cagccgugcgggc

SEQ ID NO: 1055418 - RNA, 20 nt, Mycobacterium bovis subsp bovis AF2122/97
cagccgugcgggccggucgu

SEQ ID NO: 1055419 - RNA, 17 nt, Mycobacterium bovis subsp bovis AF2122/97
cagcccguucgugccgu

SEQ ID NO: 1055420 - RNA, 15 nt, Mycobacterium bovis subsp bovis AF2122/97
cagcccgucggcgcc

SEQ ID NO: 1055421 - RNA, 16 nt, Mycobacterium bovis subsp bovis AF2122/97
cagcccguccaggcgc

SEQ ID NO: 1055422 - RNA, 14 nt, Mycobacterium bovis subsp bovis AF2122/97
cagcccgucggugg

SEQ ID NO: 1055423 - RNA, 19 nt, Mycobacterium bovis subsp bovis AF2122/97
cagcccugcgcagccgccu

SEQ ID NO: 1055424 - RNA, 14 nt, Mycobacterium bovis subsp bovis AF2122/97
cagccgcacgguuc

SEQ ID NO: 1055425 - RNA, 15 nt, Mycobacterium bovis subsp bovis AF2122/97
cagccgcaccagugg

SEQ ID NO: 1055426 - RNA, 22 nt, Mycobacterium bovis subsp bovis AF2122/97
cagccgcacgguugccgucagg

SEQ ID NO: 1055427 - RNA, 13 nt, Mycobacterium bovis subsp bovis AF2122/97
cagccgccgccgg

SEQ ID NO: 1055428 - RNA, 14 nt, Mycobacterium bovis subsp bovis AF2122/97
cagccgccgccugu

SEQ ID NO: 1055429 - RNA, 13 nt, Mycobacterium bovis subsp bovis AF2122/97
cagccgcccgccc

SEQ ID NO: 1055430 - RNA, 22 nt, Mycobacterium bovis subsp bovis AF2122/97
cagccgccgacuuccgcgucgc

SEQ ID NO: 1055431 - RNA, 23 nt, Mycobacterium bovis subsp bovis AF2122/97
cagccgccucaaugaccaccggg

SEQ ID NO: 1055432 - RNA, 18 nt, Mycobacterium bovis subsp bovis AF2122/97
cagccgcgacauccgcgg

SEQ ID NO: 1055433 - RNA, 11 nt, Mycobacterium bovis subsp bovis AF2122/97
cagccgcgacc

SEQ ID NO: 1055434 - RNA, 12 nt, Mycobacterium bovis subsp bovis AF2122/97
cagccgccccgg

SEQ ID NO: 1055435 - RNA, 16 nt, Mycobacterium bovis subsp bovis AF2122/97
cagccgcaggccaugg

SEQ ID NO: 1055436 - RNA, 20 nt, Mycobacterium bovis subsp bovis AF2122/97
cagccgccaaccgcaggccg

SEQ ID NO: 1055437 - RNA, 21 nt, Mycobacterium bovis subsp bovis AF2122/97
cagccgccaaccgcaggccga

SEQ ID NO: 1055438 - RNA, 22 nt, Mycobacterium bovis subsp bovis AF2122/97
cagccgcauaggccccgccagc

SEQ ID NO: 1055439 - RNA, 18 nt, Mycobacterium bovis subsp bovis AF2122/97
cagccgcuuggcgcggcc

SEQ ID NO: 1055440 - RNA, 16 nt, Mycobacterium bovis subsp bovis AF2122/97
cagccgcucggggugg

SEQ ID NO: 1055441 - RNA, 20 nt, Mycobacterium bovis subsp bovis AF2122/97
cagccggaccgcgacggcgc

SEQ ID NO: 1055442 - RNA, 15 nt, Mycobacterium bovis subsp bovis AF2122/97
cagccgcucacccgg

SEQ ID NO: 1055443 - RNA, 13 nt, Mycobacterium bovis subsp bovis AF2122/97
cagccgcgacgcg

SEQ ID NO: 1055444 - RNA, 22 nt, Mycobacterium bovis subsp bovis AF2122/97
cagccgcgacgcggcgucgguc

SEQ ID NO: 1055445 - RNA, 15 nt, Mycobacterium bovis subsp bovis AF2122/97
cagccgcgagccggu

SEQ ID NO: 1055446 - RNA, 19 nt, Mycobacterium bovis subsp bovis AF2122/97
cagccgcgccagcuccgug

SEQ ID NO: 1055447 - RNA, 13 nt, Mycobacterium bovis subsp bovis AF2122/97
cagccgcgccgcg

SEQ ID NO: 1055448 - RNA, 17 nt, Mycobacterium bovis subsp bovis AF2122/97
cagccgcgccgcggccc

SEQ ID NO: 1055449 - RNA, 14 nt, Mycobacterium bovis subsp bovis AF2122/97
cagccgcgccgacc

SEQ ID NO: 1055450 - RNA, 13 nt, Mycobacterium bovis subsp bovis AF2122/97
cagccgcgcgcca

SEQ ID NO: 1055451 - RNA, 14 nt, Mycobacterium bovis subsp bovis AF2122/97
cagccgcgccgggu

SEQ ID NO: 1055452 - RNA, 18 nt, Mycobacterium bovis subsp bovis AF2122/97
cagccgcgcgggucacga

SEQ ID NO: 1055453 - RNA, 13 nt, Mycobacterium bovis subsp bovis AF2122/97
cagccgcgcggug

SEQ ID NO: 1055454 - RNA, 17 nt, Mycobacterium bovis subsp bovis AF2122/97
cagccgcgcguccgggc

SEQ ID NO: 1055455 - RNA, 13 nt, Mycobacterium bovis subsp bovis AF2122/97
cagccgcggcggc

SEQ ID NO: 1055456 - RNA, 16 nt, Mycobacterium bovis subsp bovis AF2122/97
cagccgcgggccgcgu

SEQ ID NO: 1055457 - RNA, 23 nt, Mycobacterium bovis subsp bovis AF2122/97
cagccgcggcgccuccgcucggu

SEQ ID NO: 1055458 - RNA, 22 nt, Mycobacterium bovis subsp bovis AF2122/97
cagccagcccaggguguccguc

SEQ ID NO: 1055459 - RNA, 13 nt, Mycobacterium bovis subsp bovis AF2122/97
cagccagccgcga

SEQ ID NO: 1055460 - RNA, 15 nt, Mycobacterium bovis subsp bovis AF2122/97
cagccagccugcugg

SEQ ID NO: 1055461 - RNA, 21 nt, Mycobacterium bovis subsp bovis AF2122/97
cagccagccugcuggccgcgg

SEQ ID NO: 1055462 - RNA, 15 nt, Mycobacterium bovis subsp bovis AF2122/97
cagccaggaagcggu

SEQ ID NO: 1055463 - RNA, 14 nt, Mycobacterium bovis subsp bovis AF2122/97
cagccaggagccga

SEQ ID NO: 1055464 - RNA, 23 nt, Mycobacterium bovis subsp bovis AF2122/97
cagccaggagccgaucacgcugc

SEQ ID NO: 1055465 - RNA, 22 nt, Mycobacterium bovis subsp bovis AF2122/97
cagccauguccgcaguucgguc

SEQ ID NO: 1055466 - RNA, 15 nt, Mycobacterium bovis subsp bovis AF2122/97
cagcccacaggcggc

SEQ ID NO: 1055467 - RNA, 16 nt, Mycobacterium bovis subsp bovis AF2122/97
cagcccaaagcgccag

SEQ ID NO: 1055468 - RNA, 18 nt, Mycobacterium bovis subsp bovis AF2122/97
cagccagcguccaugguc

SEQ ID NO: 1055469 - RNA, 21 nt, Mycobacterium bovis subsp bovis AF2122/97
cagcccaacucggccagcuug

SEQ ID NO: 1055470 - RNA, 16 nt, Mycobacterium bovis subsp bovis AF2122/97
cagcccagccgccagc

SEQ ID NO: 1055471 - RNA, 17 nt, Mycobacterium bovis subsp bovis AF2122/97
cagcccagcagguucca

SEQ ID NO: 1055472 - RNA, 17 nt, Mycobacterium bovis subsp bovis AF2122/97
cagcccagcacgcuggc

SEQ ID NO: 1055473 - RNA, 23 nt, Mycobacterium bovis subsp bovis AF2122/97
cagcccagcacgcuggcguuguu

SEQ ID NO: 1055474 - RNA, 14 nt, Mycobacterium bovis subsp bovis AF2122/97
cagcccacucgucg

SEQ ID NO: 1055475 - RNA, 18 nt, Mycobacterium bovis subsp bovis AF2122/97
cagcccaucuaccagcuc

SEQ ID NO: 1055476 - RNA, 15 nt, Mycobacterium bovis subsp bovis AF2122/97
cagcccaugcccggc

SEQ ID NO: 1055477 - RNA, 15 nt, Mycobacterium bovis subsp bovis AF2122/97
cagcccaugucgagc

SEQ ID NO: 1055478 - RNA, 12 nt, Mycobacterium bovis subsp bovis AF2122/97
cagcccggccgg

SEQ ID NO: 1055479 - RNA, 16 nt, Mycobacterium bovis subsp bovis AF2122/97
cagcccggccuugccg

SEQ ID NO: 1055480 - RNA, 20 nt, Mycobacterium bovis subsp bovis AF2122/97
cagcccggccuugccgccgg

SEQ ID NO: 1055481 - RNA, 23 nt, Mycobacterium bovis subsp bovis AF2122/97
cagcccggccuugccgccggcgc

SEQ ID NO: 1055482 - RNA, 17 nt, Mycobacterium bovis subsp bovis AF2122/97
cagcccggcgacgaccc

SEQ ID NO: 1055483 - RNA, 15 nt, Mycobacterium bovis subsp bovis AF2122/97
cagcccggcggccgc

SEQ ID NO: 1055484 - RNA, 16 nt, Mycobacterium bovis subsp bovis AF2122/97
cagcccggcggccgcu

SEQ ID NO: 1055485 - RNA, 14 nt, Mycobacterium bovis subsp bovis AF2122/97
cagcccggcggcgg

SEQ ID NO: 1055486 - RNA, 15 nt, Mycobacterium bovis subsp bovis AF2122/97
cagcccggcggcggu

SEQ ID NO: 1055487 - RNA, 20 nt, Mycobacterium bovis subsp bovis AF2122/97
cagcccggcggcggucacca

SEQ ID NO: 1055488 - RNA, 12 nt, Mycobacterium bovis subsp bovis AF2122/97
cagcccggcgcu

SEQ ID NO: 1055489 - RNA, 17 nt, Mycobacterium bovis subsp bovis AF2122/97
cagcccggcgcgccgag

SEQ ID NO: 1055490 - RNA, 12 nt, Mycobacterium bovis subsp bovis AF2122/97
cagcccggcgcg

SEQ ID NO: 1055491 - RNA, 21 nt, Mycobacterium bovis subsp bovis AF2122/97
cagcccggcgacgacccgggu

SEQ ID NO: 1055492 - RNA, 12 nt, Mycobacterium bovis subsp bovis AF2122/97
cagcccggugau

SEQ ID NO: 1055493 - RNA, 18 nt, Mycobacterium bovis subsp bovis AF2122/97
cagcccggugugcugcac

SEQ ID NO: 1055494 - RNA, 15 nt, Mycobacterium bovis subsp bovis AF2122/97
cagcccggcguuguu

SEQ ID NO: 1055495 - RNA, 23 nt, Mycobacterium bovis subsp bovis AF2122/97
cagcccggugugcugcacggcca

SEQ ID NO: 1055496 - RNA, 13 nt, Mycobacterium bovis subsp bovis AF2122/97
cagcccgccgggc

SEQ ID NO: 1055497 - RNA, 13 nt, Mycobacterium bovis subsp bovis AF2122/97
cagcccgcccaau

SEQ ID NO: 1055498 - RNA, 13 nt, Mycobacterium bovis subsp bovis AF2122/97
cagcccgccggcg

SEQ ID NO: 1055499 - RNA, 15 nt, Mycobacterium bovis subsp bovis AF2122/97
cagcccgccggaccc

SEQ ID NO: 1055500 - RNA, 19 nt, Mycobacterium bovis subsp bovis AF2122/97
cagccccacuucgggcgga

SEQ ID NO: 1055501 - RNA, 20 nt, Mycobacterium bovis subsp bovis AF2122/97
cagcccgaugccgugcccgg

SEQ ID NO: 1055502 - RNA, 18 nt, Mycobacterium bovis subsp bovis AF2122/97
cagcaucuuuggcggccg

SEQ ID NO: 1055503 - RNA, 15 nt, Mycobacterium bovis subsp bovis AF2122/97
cagcaugacaccggc

SEQ ID NO: 1055504 - RNA, 19 nt, Mycobacterium bovis subsp bovis AF2122/97
cagcaugacaccggccacc

SEQ ID NO: 1055505 - RNA, 20 nt, Mycobacterium bovis subsp bovis AF2122/97
cagcaugacaccggccacca

SEQ ID NO: 1055506 - RNA, 22 nt, Mycobacterium bovis subsp bovis AF2122/97
cagcaugauccgcucguggucg

SEQ ID NO: 1055507 - RNA, 16 nt, Mycobacterium bovis subsp bovis AF2122/97
cagcaucacgcccacg

SEQ ID NO: 1055508 - RNA, 14 nt, Mycobacterium bovis subsp bovis AF2122/97
cagcaucaacaccg

SEQ ID NO: 1055509 - RNA, 16 nt, Mycobacterium bovis subsp bovis AF2122/97
cagcaucaacaccggc

SEQ ID NO: 1055510 - RNA, 22 nt, Mycobacterium bovis subsp bovis AF2122/97
cagcaggcauucccgcggcaac

SEQ ID NO: 1055511 - RNA, 14 nt, Mycobacterium bovis subsp bovis AF2122/97
cagcaggacgauga

SEQ ID NO: 1055512 - RNA, 13 nt, Mycobacterium bovis subsp bovis AF2122/97
cagcaggaucggc

SEQ ID NO: 1055513 - RNA, 19 nt, Mycobacterium bovis subsp bovis AF2122/97
cagcaggaucggcagcaga

SEQ ID NO: 1055514 - RNA, 14 nt, Mycobacterium bovis subsp bovis AF2122/97
cagcaggcccaccc

SEQ ID NO: 1055515 - RNA, 15 nt, Mycobacterium bovis subsp bovis AF2122/97
cagcaggcccacccg

SEQ ID NO: 1055516 - RNA, 16 nt, Mycobacterium bovis subsp bovis AF2122/97
cagcaggcccagcgga

SEQ ID NO: 1055517 - RNA, 14 nt, Mycobacterium bovis subsp bovis AF2122/97
cagcaugccugcga

SEQ ID NO: 1055518 - RNA, 19 nt, Mycobacterium bovis subsp bovis AF2122/97
cagcaugcccgccauccga

SEQ ID NO: 1055519 - RNA, 17 nt, Mycobacterium bovis subsp bovis AF2122/97
cagcauugacccgacga

SEQ ID NO: 1055520 - RNA, 20 nt, Mycobacterium bovis subsp bovis AF2122/97
cagccaaaaacgcugccgcc

SEQ ID NO: 1055521 - RNA, 22 nt, Mycobacterium bovis subsp bovis AF2122/97
cagccaaaaacgcugccgccgu

SEQ ID NO: 1055522 - RNA, 21 nt, Mycobacterium bovis subsp bovis AF2122/97
cagccagauucauuggccugg

SEQ ID NO: 1055523 - RNA, 21 nt, Mycobacterium bovis subsp bovis AF2122/97
cagccagaugccgguaacgaa

SEQ ID NO: 1055524 - RNA, 18 nt, Mycobacterium bovis subsp bovis AF2122/97
cagccagcccagccgcca

SEQ ID NO: 1055525 - RNA, 19 nt, Mycobacterium bovis subsp bovis AF2122/97
cagccagcccagccgccag

SEQ ID NO: 1055526 - RNA, 15 nt, Mycobacterium bovis subsp bovis AF2122/97
cagccagaucuccag

SEQ ID NO: 1055527 - RNA, 19 nt, Mycobacterium bovis subsp bovis AF2122/97
cagccagaucuccagguuc

SEQ ID NO: 1055528 - RNA, 20 nt, Mycobacterium bovis subsp bovis AF2122/97
cagccagaucuccccgaccg

SEQ ID NO: 1055529 - RNA, 14 nt, Mycobacterium bovis subsp bovis AF2122/97
cagccagaccaaca

SEQ ID NO: 1055530 - RNA, 14 nt, Mycobacterium bovis subsp bovis AF2122/97
cagccaaccggcgc

SEQ ID NO: 1055531 - RNA, 14 nt, Mycobacterium bovis subsp bovis AF2122/97
cagccaacccgucu

SEQ ID NO: 1055532 - RNA, 20 nt, Mycobacterium bovis subsp bovis AF2122/97
cagcagaccaaguccggucg

SEQ ID NO: 1055533 - RNA, 23 nt, Mycobacterium bovis subsp bovis AF2122/97
cagcagaccaaguccggucgcgg

SEQ ID NO: 1055534 - RNA, 19 nt, Mycobacterium bovis subsp bovis AF2122/97
cagcacuuggccagcuugg

SEQ ID NO: 1055535 - RNA, 22 nt, Mycobacterium bovis subsp bovis AF2122/97
cagcagacgacgaucagcccca

SEQ ID NO: 1055536 - RNA, 18 nt, Mycobacterium bovis subsp bovis AF2122/97
cagcagaaucucgggucg

SEQ ID NO: 1055537 - RNA, 20 nt, Mycobacterium bovis subsp bovis AF2122/97
cagcagaguggugaucuugg

SEQ ID NO: 1055538 - RNA, 14 nt, Mycobacterium bovis subsp bovis AF2122/97
cagcagagccccgg

SEQ ID NO: 1055539 - RNA, 19 nt, Mycobacterium bovis subsp bovis AF2122/97
cagcagagcggcacgcacg

SEQ ID NO: 1055540 - RNA, 19 nt, Mycobacterium bovis subsp bovis AF2122/97
cagcagcacuccggcgacg

SEQ ID NO: 1055541 - RNA, 19 nt, Mycobacterium bovis subsp bovis AF2122/97
cagcagauuaccgagcugg

SEQ ID NO: 1055542 - RNA, 13 nt, Mycobacterium bovis subsp bovis AF2122/97
cagcacgcuggcg

SEQ ID NO: 1055543 - RNA, 16 nt, Mycobacterium bovis subsp bovis AF2122/97
cagcacggcgaucggu

SEQ ID NO: 1055544 - RNA, 18 nt, Mycobacterium bovis subsp bovis AF2122/97
cagcacggcgaucgguga

SEQ ID NO: 1055545 - RNA, 15 nt, Mycobacterium bovis subsp bovis AF2122/97
cagcacggcgccgcc

SEQ ID NO: 1055546 - RNA, 17 nt, Mycobacterium bovis subsp bovis AF2122/97
cagcacggcgccgccac

SEQ ID NO: 1055547 - RNA, 20 nt, Mycobacterium bovis subsp bovis AF2122/97
cagcacuuggacccggccgg

SEQ ID NO: 1055548 - RNA, 16 nt, Mycobacterium bovis subsp bovis AF2122/97
cagcacuuggccagcu

SEQ ID NO: 1055549 - RNA, 17 nt, Mycobacterium bovis subsp bovis AF2122/97
cagcacggcaaccagcg

SEQ ID NO: 1055550 - RNA, 16 nt, Mycobacterium bovis subsp bovis AF2122/97
cagcacgccagcccca

SEQ ID NO: 1055551 - RNA, 17 nt, Mycobacterium bovis subsp bovis AF2122/97
cagcacgccgccggccg

SEQ ID NO: 1055552 - RNA, 19 nt, Mycobacterium bovis subsp bovis AF2122/97
cagcacgcccgcgcugaca

SEQ ID NO: 1055553 - RNA, 22 nt, Mycobacterium bovis subsp bovis AF2122/97
cagcacgccgggugccgccacg

SEQ ID NO: 1055554 - RNA, 12 nt, Mycobacterium bovis subsp bovis AF2122/97
cagcacgccggg

SEQ ID NO: 1055555 - RNA, 16 nt, Mycobacterium bovis subsp bovis AF2122/97
cagcacgccguccagg

SEQ ID NO: 1055556 - RNA, 17 nt, Mycobacterium bovis subsp bovis AF2122/97
cagcacgccguccaggu

SEQ ID NO: 1055557 - RNA, 17 nt, Mycobacterium bovis subsp bovis AF2122/97
cagcagcagauccuggc

SEQ ID NO: 1055558 - RNA, 14 nt, Mycobacterium bovis subsp bovis AF2122/97
cagcagcgccgcgu

SEQ ID NO: 1055559 - RNA, 14 nt, Mycobacterium bovis subsp bovis AF2122/97
cagcagcgugacca

SEQ ID NO: 1055560 - RNA, 13 nt, Mycobacterium bovis subsp bovis AF2122/97
cagcagcgcgaca

SEQ ID NO: 1055561 - RNA, 14 nt, Mycobacterium bovis subsp bovis AF2122/97
cagcagcgcgacaa

SEQ ID NO: 1055562 - RNA, 16 nt, Mycobacterium bovis subsp bovis AF2122/97
cagcagcgugaccacc

SEQ ID NO: 1055563 - RNA, 19 nt, Mycobacterium bovis subsp bovis AF2122/97
cagcagcgugaccaccgcc

SEQ ID NO: 1055564 - RNA, 24 nt, Mycobacterium bovis subsp bovis AF2122/97
cagcagcgugaccaccgccgacag

SEQ ID NO: 1055565 - RNA, 17 nt, Mycobacterium bovis subsp bovis AF2122/97
cagcagcucguugaugc

SEQ ID NO: 1055566 - RNA, 18 nt, Mycobacterium bovis subsp bovis AF2122/97
cagcagcuguuggcgugg

SEQ ID NO: 1055567 - RNA, 19 nt, Mycobacterium bovis subsp bovis AF2122/97
cagcagcucggggcgauga

SEQ ID NO: 1055568 - RNA, 18 nt, Mycobacterium bovis subsp bovis AF2122/97
cagcagcucgccggcacg

SEQ ID NO: 1055569 - RNA, 14 nt, Mycobacterium bovis subsp bovis AF2122/97
cagcagcguucggu

SEQ ID NO: 1055570 - RNA, 16 nt, Mycobacterium bovis subsp bovis AF2122/97
cagcagcuccacuggc

SEQ ID NO: 1055571 - RNA, 19 nt, Mycobacterium bovis subsp bovis AF2122/97
cagcagcgacuccagcgcc

SEQ ID NO: 1055572 - RNA, 14 nt, Mycobacterium bovis subsp bovis AF2122/97
cagcagcagguugu

SEQ ID NO: 1055573 - RNA, 21 nt, Mycobacterium bovis subsp bovis AF2122/97
cagcagcauccggccgucauc

SEQ ID NO: 1055574 - RNA, 23 nt, Mycobacterium bovis subsp bovis AF2122/97
cagcagcaucggcacgucguugg

SEQ ID NO: 1055575 - RNA, 13 nt, Mycobacterium bovis subsp bovis AF2122/97
cagcagcagcgug

SEQ ID NO: 1055576 - RNA, 14 nt, Mycobacterium bovis subsp bovis AF2122/97
cagcagcagcguga

SEQ ID NO: 1055577 - RNA, 14 nt, Mycobacterium bovis subsp bovis AF2122/97
cagcaccucgaccg

SEQ ID NO: 1055578 - RNA, 16 nt, Mycobacterium bovis subsp bovis AF2122/97
cagcaccucgucgauc

SEQ ID NO: 1055579 - RNA, 15 nt, Mycobacterium bovis subsp bovis AF2122/97
cagcaccucggccag

SEQ ID NO: 1055580 - RNA, 14 nt, Mycobacterium bovis subsp bovis AF2122/97
cagcaccucgucga

SEQ ID NO: 1055581 - RNA, 20 nt, Mycobacterium bovis subsp bovis AF2122/97
cagcacgauccagcuguaca

SEQ ID NO: 1055582 - RNA, 13 nt, Mycobacterium bovis subsp bovis AF2122/97
cagcacgacgugc

SEQ ID NO: 1055583 - RNA, 14 nt, Mycobacterium bovis subsp bovis AF2122/97
cagcacgaccuggu

SEQ ID NO: 1055584 - RNA, 23 nt, Mycobacterium bovis subsp bovis AF2122/97
cagcaccuccguaacgccaagcu

SEQ ID NO: 1055585 - RNA, 13 nt, Mycobacterium bovis subsp bovis AF2122/97
cagcaccgucggg

SEQ ID NO: 1055586 - RNA, 14 nt, Mycobacterium bovis subsp bovis AF2122/97
cagcaccguucgca

SEQ ID NO: 1055587 - RNA, 16 nt, Mycobacterium bovis subsp bovis AF2122/97
cagcaccuagucgcgg

SEQ ID NO: 1055588 - RNA, 19 nt, Mycobacterium bovis subsp bovis AF2122/97
cagcaccuagucgcggccg

SEQ ID NO: 1055589 - RNA, 22 nt, Mycobacterium bovis subsp bovis AF2122/97
cagcaccgucgggcccagccgg

SEQ ID NO: 1055590 - RNA, 22 nt, Mycobacterium bovis subsp bovis AF2122/97
cagcaccucggucccguugccg

SEQ ID NO: 1055591 - RNA, 20 nt, Mycobacterium bovis subsp bovis AF2122/97
cagcaccgggaugugcggcu

SEQ ID NO: 1055592 - RNA, 22 nt, Mycobacterium bovis subsp bovis AF2122/97
cagcaccgggaugugcggcugc

SEQ ID NO: 1055593 - RNA, 14 nt, Mycobacterium bovis subsp bovis AF2122/97
cagcaccgucggca

SEQ ID NO: 1055594 - RNA, 13 nt, Mycobacterium bovis subsp bovis AF2122/97
cagcaccggcucg

SEQ ID NO: 1055595 - RNA, 16 nt, Mycobacterium bovis subsp bovis AF2122/97
cagcaccgccgcgccg

SEQ ID NO: 1055596 - RNA, 18 nt, Mycobacterium bovis subsp bovis AF2122/97
cagcaccggaucgaccaa

SEQ ID NO: 1055597 - RNA, 13 nt, Mycobacterium bovis subsp bovis AF2122/97
cagcaccgcgacg

SEQ ID NO: 1055598 - RNA, 21 nt, Mycobacterium bovis subsp bovis AF2122/97
cagcaccgcgacgacgagguc

SEQ ID NO: 1055599 - RNA, 15 nt, Mycobacterium bovis subsp bovis AF2122/97
cagcaccgccggcga

SEQ ID NO: 1055600 - RNA, 17 nt, Mycobacterium bovis subsp bovis AF2122/97
cagcaccgccggugcgg

SEQ ID NO: 1055601 - RNA, 14 nt, Mycobacterium bovis subsp bovis AF2122/97
cagcaccgccgcug

SEQ ID NO: 1055602 - RNA, 13 nt, Mycobacterium bovis subsp bovis AF2122/97
cagcaccgccgcg

SEQ ID NO: 1055603 - RNA, 20 nt, Mycobacterium bovis subsp bovis AF2122/97
cagcaccgaacccgccaccg

SEQ ID NO: 1055604 - RNA, 15 nt, Mycobacterium bovis subsp bovis AF2122/97
cagcaccgacggcgc

SEQ ID NO: 1055605 - RNA, 15 nt, Mycobacterium bovis subsp bovis AF2122/97
cagcaccgacgugau

SEQ ID NO: 1055606 - RNA, 15 nt, Mycobacterium bovis subsp bovis AF2122/97
cagcacccgcagccg

SEQ ID NO: 1055607 - RNA, 15 nt, Mycobacterium bovis subsp bovis AF2122/97
cagcacccgcgccag

SEQ ID NO: 1055608 - RNA, 13 nt, Mycobacterium bovis subsp bovis AF2122/97
cagcacccgcgcg

SEQ ID NO: 1055609 - RNA, 16 nt, Mycobacterium bovis subsp bovis AF2122/97
cagcacccgcgcgacg

SEQ ID NO: 1055610 - RNA, 13 nt, Mycobacterium bovis subsp bovis AF2122/97
cagcacccgagcg

SEQ ID NO: 1055611 - RNA, 14 nt, Mycobacterium bovis subsp bovis AF2122/97
cagcacccgcacgg

SEQ ID NO: 1055612 - RNA, 16 nt, Mycobacterium bovis subsp bovis AF2122/97
cagcacccgcacggug

SEQ ID NO: 1055613 - RNA, 20 nt, Mycobacterium bovis subsp bovis AF2122/97
cagcacccgcacgguguauc

SEQ ID NO: 1055614 - RNA, 19 nt, Mycobacterium bovis subsp bovis AF2122/97
cagcacccggcuucgccgc

SEQ ID NO: 1055615 - RNA, 18 nt, Mycobacterium bovis subsp bovis AF2122/97
cagcacccgcucggccgc

SEQ ID NO: 1055616 - RNA, 21 nt, Mycobacterium bovis subsp bovis AF2122/97
cagcacccugaugugagucca

SEQ ID NO: 1055617 - RNA, 14 nt, Mycobacterium bovis subsp bovis AF2122/97
cagcaccccgccgg

SEQ ID NO: 1055618 - RNA, 18 nt, Mycobacterium bovis subsp bovis AF2122/97
cagcaccccgccgggggc

SEQ ID NO: 1055619 - RNA, 19 nt, Mycobacterium bovis subsp bovis AF2122/97
cagcacccccugcaccguc

SEQ ID NO: 1055620 - RNA, 15 nt, Mycobacterium bovis subsp bovis AF2122/97
cagcaccccauggcc

SEQ ID NO: 1055621 - RNA, 20 nt, Mycobacterium bovis subsp bovis AF2122/97
cagcaccccauggccaccga

SEQ ID NO: 1055622 - RNA, 14 nt, Mycobacterium bovis subsp bovis AF2122/97
cagcacccacgccg

SEQ ID NO: 1055623 - RNA, 17 nt, Mycobacterium bovis subsp bovis AF2122/97
cagcacccagacgaugg

SEQ ID NO: 1055624 - RNA, 23 nt, Mycobacterium bovis subsp bovis AF2122/97
cagcacccaccgaagcgaacggc

SEQ ID NO: 1055625 - RNA, 17 nt, Mycobacterium bovis subsp bovis AF2122/97
cagcacccaacccggcg

SEQ ID NO: 1055626 - RNA, 18 nt, Mycobacterium bovis subsp bovis AF2122/97
cagcacccaacccggcgg

SEQ ID NO: 1055627 - RNA, 14 nt, Mycobacterium bovis subsp bovis AF2122/97
cagcaccagggcgc

SEQ ID NO: 1055628 - RNA, 22 nt, Mycobacterium bovis subsp bovis AF2122/97
cagcaccaguguggcgaugacc

SEQ ID NO: 1055629 - RNA, 19 nt, Mycobacterium bovis subsp bovis AF2122/97
cagcaccaccgcggugugc

SEQ ID NO: 1055630 - RNA, 14 nt, Mycobacterium bovis subsp bovis AF2122/97
cagcaccaccggcu

SEQ ID NO: 1055631 - RNA, 13 nt, Mycobacterium bovis subsp bovis AF2122/97
cagcaccacaucg

SEQ ID NO: 1055632 - RNA, 22 nt, Mycobacterium bovis subsp bovis AF2122/97
cagcaccaaggucuucaggccg

SEQ ID NO: 1055633 - RNA, 13 nt, Mycobacterium bovis subsp bovis AF2122/97
cagcaccaccagc

SEQ ID NO: 1055634 - RNA, 11 nt, Mycobacterium bovis subsp bovis AF2122/97
cagcaccagca

SEQ ID NO: 1055635 - RNA, 14 nt, Mycobacterium bovis subsp bovis AF2122/97
cagcaccagccacg

SEQ ID NO: 1055636 - RNA, 20 nt, Mycobacterium bovis subsp bovis AF2122/97
cagcaccagcgccuugacca

SEQ ID NO: 1055637 - RNA, 16 nt, Mycobacterium bovis subsp bovis AF2122/97
cagcaccacgucgacg

SEQ ID NO: 1055638 - RNA, 14 nt, Mycobacterium bovis subsp bovis AF2122/97
cagcaccacggcca

SEQ ID NO: 1055639 - RNA, 16 nt, Mycobacterium bovis subsp bovis AF2122/97
cagcaccacggccagc

SEQ ID NO: 1055640 - RNA, 22 nt, Mycobacterium bovis subsp bovis AF2122/97
cagcaccacggcgcgcgcgccg

SEQ ID NO: 1055641 - RNA, 12 nt, Mycobacterium bovis subsp bovis AF2122/97
cagauucgccgc

SEQ ID NO: 1055642 - RNA, 14 nt, Mycobacterium bovis subsp bovis AF2122/97
cagauucgccgccc

SEQ ID NO: 1055643 - RNA, 24 nt, Mycobacterium bovis subsp bovis AF2122/97
cagcaacgacccgaagccgaccgg

SEQ ID NO: 1055644 - RNA, 18 nt, Mycobacterium bovis subsp bovis AF2122/97
cagcaacgcggugccggg

SEQ ID NO: 1055645 - RNA, 14 nt, Mycobacterium bovis subsp bovis AF2122/97
cagcaacucggcca

SEQ ID NO: 1055646 - RNA, 20 nt, Mycobacterium bovis subsp bovis AF2122/97
cagcaacucgacgucaugca

SEQ ID NO: 1055647 - RNA, 13 nt, Mycobacterium bovis subsp bovis AF2122/97
cagcaacggcggc

SEQ ID NO: 1055648 - RNA, 14 nt, Mycobacterium bovis subsp bovis AF2122/97
cagcaacgucacgu

SEQ ID NO: 1055649 - RNA, 20 nt, Mycobacterium bovis subsp bovis AF2122/97
cagcaacgucacgucgacgg

SEQ ID NO: 1055650 - RNA, 16 nt, Mycobacterium bovis subsp bovis AF2122/97
cagcaacgucgguaaa

SEQ ID NO: 1055651 - RNA, 19 nt, Mycobacterium bovis subsp bovis AF2122/97
cagcaacugggcggccugg

SEQ ID NO: 1055652 - RNA, 16 nt, Mycobacterium bovis subsp bovis AF2122/97
cagcaacucggccacg

SEQ ID NO: 1055653 - RNA, 18 nt, Mycobacterium bovis subsp bovis AF2122/97
cagcaaucagccgccuuc

SEQ ID NO: 1055654 - RNA, 15 nt, Mycobacterium bovis subsp bovis AF2122/97
cagcaauacggcggc

SEQ ID NO: 1055655 - RNA, 17 nt, Mycobacterium bovis subsp bovis AF2122/97
cagcaauacggcggcgc

SEQ ID NO: 1055656 - RNA, 12 nt, Mycobacterium bovis subsp bovis AF2122/97
cagcacaucggc

SEQ ID NO: 1055657 - RNA, 14 nt, Mycobacterium bovis subsp bovis AF2122/97
cagcacaucggcga

SEQ ID NO: 1055658 - RNA, 18 nt, Mycobacterium bovis subsp bovis AF2122/97
cagcacaggcuggcgaug

SEQ ID NO: 1055659 - RNA, 16 nt, Mycobacterium bovis subsp bovis AF2122/97
cagcacauccugcagc

SEQ ID NO: 1055660 - RNA, 18 nt, Mycobacterium bovis subsp bovis AF2122/97
cagcacauccugcagcuc

SEQ ID NO: 1055661 - RNA, 14 nt, Mycobacterium bovis subsp bovis AF2122/97
cagcacagcgcagc

SEQ ID NO: 1055662 - RNA, 17 nt, Mycobacterium bovis subsp bovis AF2122/97
cagcacacccgucaugc

SEQ ID NO: 1055663 - RNA, 17 nt, Mycobacterium bovis subsp bovis AF2122/97
cagcacaccgucgacga

SEQ ID NO: 1055664 - RNA, 13 nt, Mycobacterium bovis subsp bovis AF2122/97
cagcacacgacga

SEQ ID NO: 1055665 - RNA, 23 nt, Mycobacterium bovis subsp bovis AF2122/97
cagcaauugcaccuucuccaccg

SEQ ID NO: 1055666 - RNA, 14 nt, Mycobacterium bovis subsp bovis AF2122/97
cagcaaugccgacu

SEQ ID NO: 1055667 - RNA, 21 nt, Mycobacterium bovis subsp bovis AF2122/97
cagauaguagucgugaucgcg

SEQ ID NO: 1055668 - RNA, 14 nt, Mycobacterium bovis subsp bovis AF2122/97
cagauaguccggcu

SEQ ID NO: 1055669 - RNA, 15 nt, Mycobacterium bovis subsp bovis AF2122/97
cagauacuccgcggu

SEQ ID NO: 1055670 - RNA, 19 nt, Mycobacterium bovis subsp bovis AF2122/97
cagauagacuagccgaucc

SEQ ID NO: 1055671 - RNA, 21 nt, Mycobacterium bovis subsp bovis AF2122/97
cagauagacuagccgauccag

SEQ ID NO: 1055672 - RNA, 21 nt, Mycobacterium bovis subsp bovis AF2122/97
cagauacuuguugaagccgau

SEQ ID NO: 1055673 - RNA, 15 nt, Mycobacterium bovis subsp bovis AF2122/97
cagauaccaccgccg

SEQ ID NO: 1055674 - RNA, 17 nt, Mycobacterium bovis subsp bovis AF2122/97
cagaauucggcgcgaca

SEQ ID NO: 1055675 - RNA, 15 nt, Mycobacterium bovis subsp bovis AF2122/97
cagaauugccggcga

SEQ ID NO: 1055676 - RNA, 19 nt, Mycobacterium bovis subsp bovis AF2122/97
cagaauugugugcagcagc

SEQ ID NO: 1055677 - RNA, 21 nt, Mycobacterium bovis subsp bovis AF2122/97
cagaaucaggcucgccgaugc

SEQ ID NO: 1055678 - RNA, 16 nt, Mycobacterium bovis subsp bovis AF2122/97
cagaaucaggcucgcc

SEQ ID NO: 1055679 - RNA, 16 nt, Mycobacterium bovis subsp bovis AF2122/97
cagaaucggugggcgg

SEQ ID NO: 1055680 - RNA, 12 nt, Mycobacterium bovis subsp bovis AF2122/97
cagaaugccgaa

SEQ ID NO: 1055681 - RNA, 20 nt, Mycobacterium bovis subsp bovis AF2122/97
cagaaucgcccauuucggca

SEQ ID NO: 1055682 - RNA, 13 nt, Mycobacterium bovis subsp bovis AF2122/97
cagaaucgcacgc

SEQ ID NO: 1055683 - RNA, 17 nt, Mycobacterium bovis subsp bovis AF2122/97
cagaauccggucgauga

SEQ ID NO: 1055684 - RNA, 18 nt, Mycobacterium bovis subsp bovis AF2122/97
cagaauccggucggccca

SEQ ID NO: 1055685 - RNA, 16 nt, Mycobacterium bovis subsp bovis AF2122/97
cagaaucgaccgccgc

SEQ ID NO: 1055686 - RNA, 18 nt, Mycobacterium bovis subsp bovis AF2122/97
cagaugcgaaggcaucgc

SEQ ID NO: 1055687 - RNA, 14 nt, Mycobacterium bovis subsp bovis AF2122/97
cagaucagccgccg

SEQ ID NO: 1055688 - RNA, 15 nt, Mycobacterium bovis subsp bovis AF2122/97
cagaucagccgccgc

SEQ ID NO: 1055689 - RNA, 20 nt, Mycobacterium bovis subsp bovis AF2122/97
cagaucagcgucccggucgc

SEQ ID NO: 1055690 - RNA, 17 nt, Mycobacterium bovis subsp bovis AF2122/97
cagaucaggacgcgauc

SEQ ID NO: 1055691 - RNA, 20 nt, Mycobacterium bovis subsp bovis AF2122/97
cagaucaacaucaucacugu

SEQ ID NO: 1055692 - RNA, 18 nt, Mycobacterium bovis subsp bovis AF2122/97
cagaucaacgcgaaccgu

SEQ ID NO: 1055693 - RNA, 14 nt, Mycobacterium bovis subsp bovis AF2122/97
cagaucaacgcguc

SEQ ID NO: 1055694 - RNA, 22 nt, Mycobacterium bovis subsp bovis AF2122/97
cagaucagcaccgacagcccga

SEQ ID NO: 1055695 - RNA, 16 nt, Mycobacterium bovis subsp bovis AF2122/97
cagaucaacgcgucgc

SEQ ID NO: 1055696 - RNA, 13 nt, Mycobacterium bovis subsp bovis AF2122/97
cagaucaccgcca

SEQ ID NO: 1055697 - RNA, 18 nt, Mycobacterium bovis subsp bovis AF2122/97
cagaucaccgccagcugg

SEQ ID NO: 1055698 - RNA, 16 nt, Mycobacterium bovis subsp bovis AF2122/97
cagauagugcuccacg

SEQ ID NO: 1055699 - RNA, 17 nt, Mycobacterium bovis subsp bovis AF2122/97
cagauauuugucggcgc

SEQ ID NO: 1055700 - RNA, 15 nt, Mycobacterium bovis subsp bovis AF2122/97
cagaugguggcaugc

SEQ ID NO: 1055701 - RNA, 19 nt, Mycobacterium bovis subsp bovis AF2122/97
cagaugguuggaucgccac

SEQ ID NO: 1055702 - RNA, 19 nt, Mycobacterium bovis subsp bovis AF2122/97
cagauguaccucaucgcag

SEQ ID NO: 1055703 - RNA, 20 nt, Mycobacterium bovis subsp bovis AF2122/97
cagauguaccucaucgcaga

SEQ ID NO: 1055704 - RNA, 21 nt, Mycobacterium bovis subsp bovis AF2122/97
cagaugguuggaucgccaccg

SEQ ID NO: 1055705 - RNA, 20 nt, Mycobacterium bovis subsp bovis AF2122/97
cagauguguccggcaucggu

SEQ ID NO: 1055706 - RNA, 22 nt, Mycobacterium bovis subsp bovis AF2122/97
cagauggucucgaacuccaugc

SEQ ID NO: 1055707 - RNA, 22 nt, Mycobacterium bovis subsp bovis AF2122/97
cagauggugaaguugccgguca

SEQ ID NO: 1055708 - RNA, 20 nt, Mycobacterium bovis subsp bovis AF2122/97
cagauggguacccgaucacu

SEQ ID NO: 1055709 - RNA, 20 nt, Mycobacterium bovis subsp bovis AF2122/97
cagaugggccuccaccgcgu

SEQ ID NO: 1055710 - RNA, 13 nt, Mycobacterium bovis subsp bovis AF2122/97
cagaugcuggugu

SEQ ID NO: 1055711 - RNA, 19 nt, Mycobacterium bovis subsp bovis AF2122/97
cagauggcauugcgcccac

SEQ ID NO: 1055712 - RNA, 15 nt, Mycobacterium bovis subsp bovis AF2122/97
cagcggcagcggcgu

SEQ ID NO: 1055713 - RNA, 18 nt, Mycobacterium bovis subsp bovis AF2122/97
cagcggcagcaccgcacg

SEQ ID NO: 1055714 - RNA, 23 nt, Mycobacterium bovis subsp bovis AF2122/97
cagcggaucgucguugucagcga

SEQ ID NO: 1055715 - RNA, 14 nt, Mycobacterium bovis subsp bovis AF2122/97
cagcggagcgcccu

SEQ ID NO: 1055716 - RNA, 18 nt, Mycobacterium bovis subsp bovis AF2122/97
cagcggcaauggccagca

SEQ ID NO: 1055717 - RNA, 20 nt, Mycobacterium bovis subsp bovis AF2122/97
cagcggcacacccaucaccg

SEQ ID NO: 1055718 - RNA, 22 nt, Mycobacterium bovis subsp bovis AF2122/97
cagcggcacacccaucaccgcc

SEQ ID NO: 1055719 - RNA, 19 nt, Mycobacterium bovis subsp bovis AF2122/97
cagcggcacaucaugggcg

SEQ ID NO: 1055720 - RNA, 17 nt, Mycobacterium bovis subsp bovis AF2122/97
cagcggcaccgcggcca

SEQ ID NO: 1055721 - RNA, 12 nt, Mycobacterium bovis subsp bovis AF2122/97
cagcggcaccgg

SEQ ID NO: 1055722 - RNA, 16 nt, Mycobacterium bovis subsp bovis AF2122/97
cagcggcacgaucggc

SEQ ID NO: 1055723 - RNA, 13 nt, Mycobacterium bovis subsp bovis AF2122/97
cagcggauccagg

SEQ ID NO: 1055724 - RNA, 14 nt, Mycobacterium bovis subsp bovis AF2122/97
cagcggaucccgcc

SEQ ID NO: 1055725 - RNA, 17 nt, Mycobacterium bovis subsp bovis AF2122/97
cagcggagccacucggc

SEQ ID NO: 1055726 - RNA, 23 nt, Mycobacterium bovis subsp bovis AF2122/97
cagcggagacgaucgccaggccg

SEQ ID NO: 1055727 - RNA, 12 nt, Mycobacterium bovis subsp bovis AF2122/97
cagcggagacga

SEQ ID NO: 1055728 - RNA, 16 nt, Mycobacterium bovis subsp bovis AF2122/97
cagcggagacgaucgc

SEQ ID NO: 1055729 - RNA, 20 nt, Mycobacterium bovis subsp bovis AF2122/97
cagcggaccgcugccugccg

SEQ ID NO: 1055730 - RNA, 23 nt, Mycobacterium bovis subsp bovis AF2122/97
cagcggaccgauugucggcaacg

SEQ ID NO: 1055731 - RNA, 13 nt, Mycobacterium bovis subsp bovis AF2122/97
cagcggaccgcug

SEQ ID NO: 1055732 - RNA, 13 nt, Mycobacterium bovis subsp bovis AF2122/97
cagcggaccccac

SEQ ID NO: 1055733 - RNA, 16 nt, Mycobacterium bovis subsp bovis AF2122/97
cagcgcuuugaugccg

SEQ ID NO: 1055734 - RNA, 19 nt, Mycobacterium bovis subsp bovis AF2122/97
cagcgcuuugaugccgaug

SEQ ID NO: 1055735 - RNA, 22 nt, Mycobacterium bovis subsp bovis AF2122/97
cagcgcuuugaugccgaugucg

SEQ ID NO: 1055736 - RNA, 13 nt, Mycobacterium bovis subsp bovis AF2122/97
cagcgcugcgaug

SEQ ID NO: 1055737 - RNA, 13 nt, Mycobacterium bovis subsp bovis AF2122/97
cagcgcugagccg

SEQ ID NO: 1055738 - RNA, 18 nt, Mycobacterium bovis subsp bovis AF2122/97
cagcgcugagccgcucau

SEQ ID NO: 1055739 - RNA, 21 nt, Mycobacterium bovis subsp bovis AF2122/97
cagcgcugagccgcucaucga

SEQ ID NO: 1055740 - RNA, 19 nt, Mycobacterium bovis subsp bovis AF2122/97
cagcgcuccagccgcgcgu

SEQ ID NO: 1055741 - RNA, 19 nt, Mycobacterium bovis subsp bovis AF2122/97
cagcgcucguuccggcggu

SEQ ID NO: 1055742 - RNA, 14 nt, Mycobacterium bovis subsp bovis AF2122/97
cagcgcugaccggc

SEQ ID NO: 1055743 - RNA, 17 nt, Mycobacterium bovis subsp bovis AF2122/97
cagcgcugucguaccgc

SEQ ID NO: 1055744 - RNA, 18 nt, Mycobacterium bovis subsp bovis AF2122/97
cagcgcuggcaggccggg

SEQ ID NO: 1055745 - RNA, 17 nt, Mycobacterium bovis subsp bovis AF2122/97
cagcgcuggcuacgccu

SEQ ID NO: 1055746 - RNA, 19 nt, Mycobacterium bovis subsp bovis AF2122/97
cagcgcuucacgggccguc

SEQ ID NO: 1055747 - RNA, 15 nt, Mycobacterium bovis subsp bovis AF2122/97
cagcgcuucgucggc

SEQ ID NO: 1055748 - RNA, 19 nt, Mycobacterium bovis subsp bovis AF2122/97
cagcgcuucggcggucgcc

SEQ ID NO: 1055749 - RNA, 22 nt, Mycobacterium bovis subsp bovis AF2122/97
cagcgcuucggcggucgccgcg

SEQ ID NO: 1055750 - RNA, 21 nt, Mycobacterium bovis subsp bovis AF2122/97
cagcgcuucgucggccggcac

SEQ ID NO: 1055751 - RNA, 22 nt, Mycobacterium bovis subsp bovis AF2122/97
cagcgcgucggagccgggcagu

SEQ ID NO: 1055752 - RNA, 22 nt, Mycobacterium bovis subsp bovis AF2122/97
cagcgcgucucguugauacggc

SEQ ID NO: 1055753 - RNA, 20 nt, Mycobacterium bovis subsp bovis AF2122/97
cagcgcgucguccagggcga

SEQ ID NO: 1055754 - RNA, 22 nt, Mycobacterium bovis subsp bovis AF2122/97
cagcgcuagccgggcgcgccgg

SEQ ID NO: 1055755 - RNA, 15 nt, Mycobacterium bovis subsp bovis AF2122/97
cagcgcuccagcacc

SEQ ID NO: 1055756 - RNA, 22 nt, Mycobacterium bovis subsp bovis AF2122/97
cagcgcuccagcacccgcgcga

SEQ ID NO: 1055757 - RNA, 23 nt, Mycobacterium bovis subsp bovis AF2122/97
cagcgcguggaacuugcgcaggu

SEQ ID NO: 1055758 - RNA, 14 nt, Mycobacterium bovis subsp bovis AF2122/97
cagcgcggccaccc

SEQ ID NO: 1055759 - RNA, 13 nt, Mycobacterium bovis subsp bovis AF2122/97
cagcgcggccacg

SEQ ID NO: 1055760 - RNA, 16 nt, Mycobacterium bovis subsp bovis AF2122/97
cagcgcggccacgccg

SEQ ID NO: 1055761 - RNA, 13 nt, Mycobacterium bovis subsp bovis AF2122/97
cagcgcggccggg

SEQ ID NO: 1055762 - RNA, 12 nt, Mycobacterium bovis subsp bovis AF2122/97
cagcgcggcgac

SEQ ID NO: 1055763 - RNA, 15 nt, Mycobacterium bovis subsp bovis AF2122/97
cagcgcggcgcccug

SEQ ID NO: 1055764 - RNA, 20 nt, Mycobacterium bovis subsp bovis AF2122/97
cagcgcggcgcccuggccgc

SEQ ID NO: 1055765 - RNA, 22 nt, Mycobacterium bovis subsp bovis AF2122/97
cagcgcggcgcccuggccgccc

SEQ ID NO: 1055766 - RNA, 15 nt, Mycobacterium bovis subsp bovis AF2122/97
cagcgcggcgcacaa

SEQ ID NO: 1055767 - RNA, 15 nt, Mycobacterium bovis subsp bovis AF2122/97
cagcgcggcgcgaca

SEQ ID NO: 1055768 - RNA, 16 nt, Mycobacterium bovis subsp bovis AF2122/97
cagcgcggcgcgacag

SEQ ID NO: 1055769 - RNA, 13 nt, Mycobacterium bovis subsp bovis AF2122/97
cagcgcggcgcga

SEQ ID NO: 1055770 - RNA, 21 nt, Mycobacterium bovis subsp bovis AF2122/97
cagcgcguagcgggcgcccuu

SEQ ID NO: 1055771 - RNA, 17 nt, Mycobacterium bovis subsp bovis AF2122/97
cagcgcguaguccgcau

SEQ ID NO: 1055772 - RNA, 21 nt, Mycobacterium bovis subsp bovis AF2122/97
cagcgcguauggcucaccccg

SEQ ID NO: 1055773 - RNA, 21 nt, Mycobacterium bovis subsp bovis AF2122/97
cagcgcgggacacgucgcgcc

SEQ ID NO: 1055774 - RNA, 18 nt, Mycobacterium bovis subsp bovis AF2122/97
cagcgcgggacacgucgc

SEQ ID NO: 1055775 - RNA, 13 nt, Mycobacterium bovis subsp bovis AF2122/97
cagcgcggcggca

SEQ ID NO: 1055776 - RNA, 16 nt, Mycobacterium bovis subsp bovis AF2122/97
cagcgacucggccagg

SEQ ID NO: 1055777 - RNA, 23 nt, Mycobacterium bovis subsp bovis AF2122/97
cagcgacuuggcaucgcgagcca

SEQ ID NO: 1055778 - RNA, 14 nt, Mycobacterium bovis subsp bovis AF2122/97
cagcgacuuggcau

SEQ ID NO: 1055779 - RNA, 19 nt, Mycobacterium bovis subsp bovis AF2122/97
cagcgacuuggcaucgcga

SEQ ID NO: 1055780 - RNA, 13 nt, Mycobacterium bovis subsp bovis AF2122/97
cagcgcgccgcgu

SEQ ID NO: 1055781 - RNA, 14 nt, Mycobacterium bovis subsp bovis AF2122/97
cagcgcgccgcguu

SEQ ID NO: 1055782 - RNA, 14 nt, Mycobacterium bovis subsp bovis AF2122/97
cagcgcgccggcgu

SEQ ID NO: 1055783 - RNA, 17 nt, Mycobacterium bovis subsp bovis AF2122/97
cagcgcgccggcgucgg

SEQ ID NO: 1055784 - RNA, 12 nt, Mycobacterium bovis subsp bovis AF2122/97
cagcgcgccggc

SEQ ID NO: 1055785 - RNA, 17 nt, Mycobacterium bovis subsp bovis AF2122/97
cagcgcgcugcgcgacu

SEQ ID NO: 1055786 - RNA, 14 nt, Mycobacterium bovis subsp bovis AF2122/97
cagcgcggcaccca

SEQ ID NO: 1055787 - RNA, 12 nt, Mycobacterium bovis subsp bovis AF2122/97
cagcgcggcacg

SEQ ID NO: 1055788 - RNA, 22 nt, Mycobacterium bovis subsp bovis AF2122/97
cagcgcggccaauugcgccgcc

SEQ ID NO: 1055789 - RNA, 14 nt, Mycobacterium bovis subsp bovis AF2122/97
cagcgcgcgcgggu

SEQ ID NO: 1055790 - RNA, 14 nt, Mycobacterium bovis subsp bovis AF2122/97
cagcgcgcgccgag

SEQ ID NO: 1055791 - RNA, 16 nt, Mycobacterium bovis subsp bovis AF2122/97
cagcgcgcgccgagcc

SEQ ID NO: 1055792 - RNA, 13 nt, Mycobacterium bovis subsp bovis AF2122/97
cagcgcgcgccgc

SEQ ID NO: 1055793 - RNA, 14 nt, Mycobacterium bovis subsp bovis AF2122/97
cagcgcgccguaga

SEQ ID NO: 1055794 - RNA, 14 nt, Mycobacterium bovis subsp bovis AF2122/97
cagcgcgccgucgg

SEQ ID NO: 1055795 - RNA, 18 nt, Mycobacterium bovis subsp bovis AF2122/97
cagcggcucggcggcgcg

SEQ ID NO: 1055796 - RNA, 12 nt, Mycobacterium bovis subsp bovis AF2122/97
cagcggcgucgu

SEQ ID NO: 1055797 - RNA, 19 nt, Mycobacterium bovis subsp bovis AF2122/97
cagcggcucuauccggcgc

SEQ ID NO: 1055798 - RNA, 16 nt, Mycobacterium bovis subsp bovis AF2122/97
cagcggcugaccgggc

SEQ ID NO: 1055799 - RNA, 13 nt, Mycobacterium bovis subsp bovis AF2122/97
cagcggcugccca

SEQ ID NO: 1055800 - RNA, 18 nt, Mycobacterium bovis subsp bovis AF2122/97
cagcgggaacacaccgca

SEQ ID NO: 1055801 - RNA, 15 nt, Mycobacterium bovis subsp bovis AF2122/97
cagcggcuugcccag

SEQ ID NO: 1055802 - RNA, 17 nt, Mycobacterium bovis subsp bovis AF2122/97
cagcggcuugcccaggc

SEQ ID NO: 1055803 - RNA, 18 nt, Mycobacterium bovis subsp bovis AF2122/97
cagcggcuugcccaggcg

SEQ ID NO: 1055804 - RNA, 20 nt, Mycobacterium bovis subsp bovis AF2122/97
cagcggcuugcccaggcgca

SEQ ID NO: 1055805 - RNA, 22 nt, Mycobacterium bovis subsp bovis AF2122/97
cagcggcuugcccaggcgcaac

SEQ ID NO: 1055806 - RNA, 18 nt, Mycobacterium bovis subsp bovis AF2122/97
cagcggguaagacgucgg

SEQ ID NO: 1055807 - RNA, 15 nt, Mycobacterium bovis subsp bovis AF2122/97
cagcgggacaaaauc

SEQ ID NO: 1055808 - RNA, 17 nt, Mycobacterium bovis subsp bovis AF2122/97
cagcgggggcagcgcga

SEQ ID NO: 1055809 - RNA, 13 nt, Mycobacterium bovis subsp bovis AF2122/97
cagcggcgccgcc

SEQ ID NO: 1055810 - RNA, 19 nt, Mycobacterium bovis subsp bovis AF2122/97
cagcggcgcucggcgccac

SEQ ID NO: 1055811 - RNA, 20 nt, Mycobacterium bovis subsp bovis AF2122/97
cagcggcgcucggcgccacg

SEQ ID NO: 1055812 - RNA, 14 nt, Mycobacterium bovis subsp bovis AF2122/97
cagcggcggccacg

SEQ ID NO: 1055813 - RNA, 13 nt, Mycobacterium bovis subsp bovis AF2122/97
cagcggcggcccu

SEQ ID NO: 1055814 - RNA, 20 nt, Mycobacterium bovis subsp bovis AF2122/97
cagcggcggcgacgagcgca

SEQ ID NO: 1055815 - RNA, 14 nt, Mycobacterium bovis subsp bovis AF2122/97
cagcggcggcaacg

SEQ ID NO: 1055816 - RNA, 22 nt, Mycobacterium bovis subsp bovis AF2122/97
cagcggcggaaggacggcagcc

SEQ ID NO: 1055817 - RNA, 14 nt, Mycobacterium bovis subsp bovis AF2122/97
cagcggcgggggcg

SEQ ID NO: 1055818 - RNA, 20 nt, Mycobacterium bovis subsp bovis AF2122/97
cagcggcgggucccgccacc

SEQ ID NO: 1055819 - RNA, 16 nt, Mycobacterium bovis subsp bovis AF2122/97
cagcggcggcggcggc

SEQ ID NO: 1055820 - RNA, 19 nt, Mycobacterium bovis subsp bovis AF2122/97
cagcggcggcgucgacggc

SEQ ID NO: 1055821 - RNA, 14 nt, Mycobacterium bovis subsp bovis AF2122/97
cagcggcgggcgau

SEQ ID NO: 1055822 - RNA, 16 nt, Mycobacterium bovis subsp bovis AF2122/97
cagcggcgggcgauga

SEQ ID NO: 1055823 - RNA, 14 nt, Mycobacterium bovis subsp bovis AF2122/97
cagcggcaucgcgg

SEQ ID NO: 1055824 - RNA, 17 nt, Mycobacterium bovis subsp bovis AF2122/97
cagcggcauccagcuuc

SEQ ID NO: 1055825 - RNA, 18 nt, Mycobacterium bovis subsp bovis AF2122/97
cagcggcaucgcgggcgg

SEQ ID NO: 1055826 - RNA, 16 nt, Mycobacterium bovis subsp bovis AF2122/97
cagcggcaucggccag

SEQ ID NO: 1055827 - RNA, 19 nt, Mycobacterium bovis subsp bovis AF2122/97
cagcggcaucggccagccg

SEQ ID NO: 1055828 - RNA, 13 nt, Mycobacterium bovis subsp bovis AF2122/97
cagcggccaaccc

SEQ ID NO: 1055829 - RNA, 15 nt, Mycobacterium bovis subsp bovis AF2122/97
cagcggccaacccau

SEQ ID NO: 1055830 - RNA, 17 nt, Mycobacterium bovis subsp bovis AF2122/97
cagcggcccgucaccgc

SEQ ID NO: 1055831 - RNA, 22 nt, Mycobacterium bovis subsp bovis AF2122/97
cagcggcccgucaccgcgggca

SEQ ID NO: 1055832 - RNA, 16 nt, Mycobacterium bovis subsp bovis AF2122/97
cagcggccgaccgcga

SEQ ID NO: 1055833 - RNA, 14 nt, Mycobacterium bovis subsp bovis AF2122/97
cagcggccaccgag

SEQ ID NO: 1055834 - RNA, 19 nt, Mycobacterium bovis subsp bovis AF2122/97
cagcggccagcagugcggu

SEQ ID NO: 1055835 - RNA, 21 nt, Mycobacterium bovis subsp bovis AF2122/97
cagcggccauaucgcccacca

SEQ ID NO: 1055836 - RNA, 15 nt, Mycobacterium bovis subsp bovis AF2122/97
cagcggccauccggc

SEQ ID NO: 1055837 - RNA, 18 nt, Mycobacterium bovis subsp bovis AF2122/97
cagcggccagggcaccca

SEQ ID NO: 1055838 - RNA, 13 nt, Mycobacterium bovis subsp bovis AF2122/97
cagcggccgcgac

SEQ ID NO: 1055839 - RNA, 14 nt, Mycobacterium bovis subsp bovis AF2122/97
cagcggccgcgacg

SEQ ID NO: 1055840 - RNA, 17 nt, Mycobacterium bovis subsp bovis AF2122/97
cagcggccgaccgcgac

SEQ ID NO: 1055841 - RNA, 17 nt, Mycobacterium bovis subsp bovis AF2122/97
cagcggccgcgauggug

SEQ ID NO: 1055842 - RNA, 13 nt, Mycobacterium bovis subsp bovis AF2122/97
cagcggccgguac

SEQ ID NO: 1055843 - RNA, 16 nt, Mycobacterium bovis subsp bovis AF2122/97
cagcggccugaccggc

SEQ ID NO: 1055844 - RNA, 18 nt, Mycobacterium bovis subsp bovis AF2122/97
cagcggccugaccggcuc

SEQ ID NO: 1055845 - RNA, 20 nt, Mycobacterium bovis subsp bovis AF2122/97
cagcggccugaccggcucgc

SEQ ID NO: 1055846 - RNA, 21 nt, Mycobacterium bovis subsp bovis AF2122/97
cagcggcgccaguauggccgc

SEQ ID NO: 1055847 - RNA, 23 nt, Mycobacterium bovis subsp bovis AF2122/97
cagcggcgccaguauggccgcca

SEQ ID NO: 1055848 - RNA, 13 nt, Mycobacterium bovis subsp bovis AF2122/97
cagcggcgccacg

SEQ ID NO: 1055849 - RNA, 22 nt, Mycobacterium bovis subsp bovis AF2122/97
cagcggcgcgaggaacgccggg

SEQ ID NO: 1055850 - RNA, 16 nt, Mycobacterium bovis subsp bovis AF2122/97
cagcggcgaucaggcg

SEQ ID NO: 1055851 - RNA, 23 nt, Mycobacterium bovis subsp bovis AF2122/97
cagcggcgaaggucuggccugcc

SEQ ID NO: 1055852 - RNA, 20 nt, Mycobacterium bovis subsp bovis AF2122/97
cagcgucuucagguccaccg

SEQ ID NO: 1055853 - RNA, 21 nt, Mycobacterium bovis subsp bovis AF2122/97
cagcgucuucagguccaccgc

SEQ ID NO: 1055854 - RNA, 23 nt, Mycobacterium bovis subsp bovis AF2122/97
cagcgucuucagguccaccgcug

SEQ ID NO: 1055855 - RNA, 20 nt, Mycobacterium bovis subsp bovis AF2122/97
cagcguggacaucgggcggc

SEQ ID NO: 1055856 - RNA, 23 nt, Mycobacterium bovis subsp bovis AF2122/97
cagcguggacguacugucgucgc

SEQ ID NO: 1055857 - RNA, 17 nt, Mycobacterium bovis subsp bovis AF2122/97
cagcgucguaaccgucg

SEQ ID NO: 1055858 - RNA, 22 nt, Mycobacterium bovis subsp bovis AF2122/97
cagcgucuggccgucgcuggug

SEQ ID NO: 1055859 - RNA, 22 nt, Mycobacterium bovis subsp bovis AF2122/97
cagcgucucggaggcgaccacg

SEQ ID NO: 1055860 - RNA, 17 nt, Mycobacterium bovis subsp bovis AF2122/97
cagcgucggugccacca

SEQ ID NO: 1055861 - RNA, 13 nt, Mycobacterium bovis subsp bovis AF2122/97
cagcgucggcgca

SEQ ID NO: 1055862 - RNA, 15 nt, Mycobacterium bovis subsp bovis AF2122/97
cagcguccagccgcc

SEQ ID NO: 1055863 - RNA, 16 nt, Mycobacterium bovis subsp bovis AF2122/97
cagcguccagccgccc

SEQ ID NO: 1055864 - RNA, 17 nt, Mycobacterium bovis subsp bovis AF2122/97
cagcgucaccucaccga

SEQ ID NO: 1055865 - RNA, 20 nt, Mycobacterium bovis subsp bovis AF2122/97
cagcgucaggugcgcgacca

SEQ ID NO: 1055866 - RNA, 13 nt, Mycobacterium bovis subsp bovis AF2122/97
cagcgucagcugu

SEQ ID NO: 1055867 - RNA, 22 nt, Mycobacterium bovis subsp bovis AF2122/97
cagcgucagcuguuugccggcu

SEQ ID NO: 1055868 - RNA, 13 nt, Mycobacterium bovis subsp bovis AF2122/97
cagcgggucgcgg

SEQ ID NO: 1055869 - RNA, 23 nt, Mycobacterium bovis subsp bovis AF2122/97
cagcgggugaaucgacaccgccc

SEQ ID NO: 1055870 - RNA, 19 nt, Mycobacterium bovis subsp bovis AF2122/97
cagcggguuugccgggcgc

SEQ ID NO: 1055871 - RNA, 20 nt, Mycobacterium bovis subsp bovis AF2122/97
cagcggguuugccgggcgcu

SEQ ID NO: 1055872 - RNA, 20 nt, Mycobacterium bovis subsp bovis AF2122/97
cagcggguucaacgcgcgca

SEQ ID NO: 1055873 - RNA, 20 nt, Mycobacterium bovis subsp bovis AF2122/97
cagcguggugaagucggugc

SEQ ID NO: 1055874 - RNA, 14 nt, Mycobacterium bovis subsp bovis AF2122/97
cagcgugggcagcg

SEQ ID NO: 1055875 - RNA, 20 nt, Mycobacterium bovis subsp bovis AF2122/97
cagcgugggcagcgcgauca

SEQ ID NO: 1055876 - RNA, 16 nt, Mycobacterium bovis subsp bovis AF2122/97
cagcguggggccgcca

SEQ ID NO: 1055877 - RNA, 17 nt, Mycobacterium bovis subsp bovis AF2122/97
cagcguggggccgccac

SEQ ID NO: 1055878 - RNA, 16 nt, Mycobacterium bovis subsp bovis AF2122/97
cagcguggagaucacg

SEQ ID NO: 1055879 - RNA, 21 nt, Mycobacterium bovis subsp bovis AF2122/97
cagcguggagaucacgugccg

SEQ ID NO: 1055880 - RNA, 13 nt, Mycobacterium bovis subsp bovis AF2122/97
cagcguggcuggc

SEQ ID NO: 1055881 - RNA, 21 nt, Mycobacterium bovis subsp bovis AF2122/97
cagcgugucuugucgcgcagc

SEQ ID NO: 1055882 - RNA, 22 nt, Mycobacterium bovis subsp bovis AF2122/97
cagcguguaguggcccgcgggc

SEQ ID NO: 1055883 - RNA, 19 nt, Mycobacterium bovis subsp bovis AF2122/97
cagcguggggccgccacca

SEQ ID NO: 1055884 - RNA, 22 nt, Mycobacterium bovis subsp bovis AF2122/97
cagcguggggccgccaccagcg

SEQ ID NO: 1055885 - RNA, 23 nt, Mycobacterium bovis subsp bovis AF2122/97
cagcguggggccgccaccagcgc

SEQ ID NO: 1055886 - RNA, 22 nt, Mycobacterium bovis subsp bovis AF2122/97
cagcgugugcucgugggcgacg

SEQ ID NO: 1055887 - RNA, 19 nt, Mycobacterium bovis subsp bovis AF2122/97
cagcguguggagcucgcgg

SEQ ID NO: 1055888 - RNA, 20 nt, Mycobacterium bovis subsp bovis AF2122/97
cagcguguggagcucgcggc

SEQ ID NO: 1055889 - RNA, 14 nt, Mycobacterium bovis subsp bovis AF2122/97
cagcgugucgccga

SEQ ID NO: 1055890 - RNA, 18 nt, Mycobacterium bovis subsp bovis AF2122/97
cagcguguugagggcugu

SEQ ID NO: 1055891 - RNA, 22 nt, Mycobacterium bovis subsp bovis AF2122/97
cagcuagguauugccgcagacg

SEQ ID NO: 1055892 - RNA, 13 nt, Mycobacterium bovis subsp bovis AF2122/97
cagcguucccgcc

SEQ ID NO: 1055893 - RNA, 17 nt, Mycobacterium bovis subsp bovis AF2122/97
cagcguucccgccggcu

SEQ ID NO: 1055894 - RNA, 14 nt, Mycobacterium bovis subsp bovis AF2122/97
cagcucaaugucga

SEQ ID NO: 1055895 - RNA, 14 nt, Mycobacterium bovis subsp bovis AF2122/97
cagcucaccaccca

SEQ ID NO: 1055896 - RNA, 16 nt, Mycobacterium bovis subsp bovis AF2122/97
cagcucaccacccgca

SEQ ID NO: 1055897 - RNA, 22 nt, Mycobacterium bovis subsp bovis AF2122/97
cagcucaccacccgcacuccaa

SEQ ID NO: 1055898 - RNA, 20 nt, Mycobacterium bovis subsp bovis AF2122/97
cagcucacggacgcugggcg

SEQ ID NO: 1055899 - RNA, 15 nt, Mycobacterium bovis subsp bovis AF2122/97
cagcucccgggcggc

SEQ ID NO: 1055900 - RNA, 19 nt, Mycobacterium bovis subsp bovis AF2122/97
cagcucccgggcggcggcc

SEQ ID NO: 1055901 - RNA, 20 nt, Mycobacterium bovis subsp bovis AF2122/97
cagcucccgggcggcggccu

SEQ ID NO: 1055902 - RNA, 21 nt, Mycobacterium bovis subsp bovis AF2122/97
cagcucccgggcggcggccug

SEQ ID NO: 1055903 - RNA, 17 nt, Mycobacterium bovis subsp bovis AF2122/97
cagcucaucgcgcacgc

SEQ ID NO: 1055904 - RNA, 14 nt, Mycobacterium bovis subsp bovis AF2122/97
cagcucagugaugc

SEQ ID NO: 1055905 - RNA, 21 nt, Mycobacterium bovis subsp bovis AF2122/97
cagcucacccggagcacccgg

SEQ ID NO: 1055906 - RNA, 21 nt, Mycobacterium bovis subsp bovis AF2122/97
cagcuauugcuauuccgcggc

SEQ ID NO: 1055907 - RNA, 20 nt, Mycobacterium bovis subsp bovis AF2122/97
caggccaacggcgcugccgg

SEQ ID NO: 1055908 - RNA, 17 nt, Mycobacterium bovis subsp bovis AF2122/97
caggccaacuuggcggc

SEQ ID NO: 1055909 - RNA, 20 nt, Mycobacterium bovis subsp bovis AF2122/97
caggccaacuuggcggccag

SEQ ID NO: 1055910 - RNA, 22 nt, Mycobacterium bovis subsp bovis AF2122/97
caggccaacuuggcggccagcc

SEQ ID NO: 1055911 - RNA, 18 nt, Mycobacterium bovis subsp bovis AF2122/97
caggccaccccgaccucc

SEQ ID NO: 1055912 - RNA, 13 nt, Mycobacterium bovis subsp bovis AF2122/97
caggccaccgcag

SEQ ID NO: 1055913 - RNA, 23 nt, Mycobacterium bovis subsp bovis AF2122/97
caggccaccgcagacgccgucug

SEQ ID NO: 1055914 - RNA, 17 nt, Mycobacterium bovis subsp bovis AF2122/97
caggccagcgcucaccg

SEQ ID NO: 1055915 - RNA, 23 nt, Mycobacterium bovis subsp bovis AF2122/97
caggccagcaugucgggccgcuc

SEQ ID NO: 1055916 - RNA, 15 nt, Mycobacterium bovis subsp bovis AF2122/97
caggccagagucgcc

SEQ ID NO: 1055917 - RNA, 13 nt, Mycobacterium bovis subsp bovis AF2122/97
caggccacugccg

SEQ ID NO: 1055918 - RNA, 15 nt, Mycobacterium bovis subsp bovis AF2122/97
caggccacugccgac

SEQ ID NO: 1055919 - RNA, 23 nt, Mycobacterium bovis subsp bovis AF2122/97
caggccacugcguuccaucgccg

SEQ ID NO: 1055920 - RNA, 14 nt, Mycobacterium bovis subsp bovis AF2122/97
caggccagagucgc

SEQ ID NO: 1055921 - RNA, 14 nt, Mycobacterium bovis subsp bovis AF2122/97
caggccacgggcgu

SEQ ID NO: 1055922 - RNA, 17 nt, Mycobacterium bovis subsp bovis AF2122/97
caggccacgggcgugcu

SEQ ID NO: 1055923 - RNA, 18 nt, Mycobacterium bovis subsp bovis AF2122/97
caggccacgcaccgggug

SEQ ID NO: 1055924 - RNA, 13 nt, Mycobacterium bovis subsp bovis AF2122/97
caggcauggccug

SEQ ID NO: 1055925 - RNA, 21 nt, Mycobacterium bovis subsp bovis AF2122/97
caggcauuuucacugugccgc

SEQ ID NO: 1055926 - RNA, 12 nt, Mycobacterium bovis subsp bovis AF2122/97
caggcagguugg

SEQ ID NO: 1055927 - RNA, 21 nt, Mycobacterium bovis subsp bovis AF2122/97
caggcagguuggccaccgccc

SEQ ID NO: 1055928 - RNA, 22 nt, Mycobacterium bovis subsp bovis AF2122/97
caggcagguuggccaccgccca

SEQ ID NO: 1055929 - RNA, 14 nt, Mycobacterium bovis subsp bovis AF2122/97
caggcaguccaccg

SEQ ID NO: 1055930 - RNA, 16 nt, Mycobacterium bovis subsp bovis AF2122/97
caggcaguccaccgcg

SEQ ID NO: 1055931 - RNA, 17 nt, Mycobacterium bovis subsp bovis AF2122/97
caggcaguccaccgcgc

SEQ ID NO: 1055932 - RNA, 21 nt, Mycobacterium bovis subsp bovis AF2122/97
caggcagcuugccaaucaccg

SEQ ID NO: 1055933 - RNA, 16 nt, Mycobacterium bovis subsp bovis AF2122/97
caggccgaagacgugc

SEQ ID NO: 1055934 - RNA, 20 nt, Mycobacterium bovis subsp bovis AF2122/97
caggccgaagacgugccggc

SEQ ID NO: 1055935 - RNA, 22 nt, Mycobacterium bovis subsp bovis AF2122/97
caggccgaagacgugccggcuc

SEQ ID NO: 1055936 - RNA, 16 nt, Mycobacterium bovis subsp bovis AF2122/97
caggcccuggccaccc

SEQ ID NO: 1055937 - RNA, 23 nt, Mycobacterium bovis subsp bovis AF2122/97
caggcccugguagugaacggauc

SEQ ID NO: 1055938 - RNA, 21 nt, Mycobacterium bovis subsp bovis AF2122/97
caggccgaucagcgcggcgcc

SEQ ID NO: 1055939 - RNA, 16 nt, Mycobacterium bovis subsp bovis AF2122/97
caggccgaugccgacc

SEQ ID NO: 1055940 - RNA, 17 nt, Mycobacterium bovis subsp bovis AF2122/97
caggccgaugacgaugc

SEQ ID NO: 1055941 - RNA, 19 nt, Mycobacterium bovis subsp bovis AF2122/97
caggccgaugacgaugccg

SEQ ID NO: 1055942 - RNA, 21 nt, Mycobacterium bovis subsp bovis AF2122/97
caggccgaugacgaugccgcc

SEQ ID NO: 1055943 - RNA, 22 nt, Mycobacterium bovis subsp bovis AF2122/97
caggccgaugacgaugccgccg

SEQ ID NO: 1055944 - RNA, 13 nt, Mycobacterium bovis subsp bovis AF2122/97
caggcccacccgg

SEQ ID NO: 1055945 - RNA, 15 nt, Mycobacterium bovis subsp bovis AF2122/97
caggcccacccgggc

SEQ ID NO: 1055946 - RNA, 17 nt, Mycobacterium bovis subsp bovis AF2122/97
caggcccacccgggcgu

SEQ ID NO: 1055947 - RNA, 23 nt, Mycobacterium bovis subsp bovis AF2122/97
caggccauccgggcugccaaggc

SEQ ID NO: 1055948 - RNA, 15 nt, Mycobacterium bovis subsp bovis AF2122/97
caggcccugccgacg

SEQ ID NO: 1055949 - RNA, 16 nt, Mycobacterium bovis subsp bovis AF2122/97
caggcccugccgacgc

SEQ ID NO: 1055950 - RNA, 17 nt, Mycobacterium bovis subsp bovis AF2122/97
caggccaugggaaccga

SEQ ID NO: 1055951 - RNA, 17 nt, Mycobacterium bovis subsp bovis AF2122/97
caggccagugccaccug

SEQ ID NO: 1055952 - RNA, 18 nt, Mycobacterium bovis subsp bovis AF2122/97
caggccagggcgguggcc

SEQ ID NO: 1055953 - RNA, 22 nt, Mycobacterium bovis subsp bovis AF2122/97
caggccagugccaccugggcgg

SEQ ID NO: 1055954 - RNA, 15 nt, Mycobacterium bovis subsp bovis AF2122/97
caggccgcccagcug

SEQ ID NO: 1055955 - RNA, 14 nt, Mycobacterium bovis subsp bovis AF2122/97
caggccgcgcgaca

SEQ ID NO: 1055956 - RNA, 15 nt, Mycobacterium bovis subsp bovis AF2122/97
caggccgcgcgacaa

SEQ ID NO: 1055957 - RNA, 12 nt, Mycobacterium bovis subsp bovis AF2122/97
caggccgcgaca

SEQ ID NO: 1055958 - RNA, 19 nt, Mycobacterium bovis subsp bovis AF2122/97
caggccgcgcauggucagg

SEQ ID NO: 1055959 - RNA, 15 nt, Mycobacterium bovis subsp bovis AF2122/97
caggccgcgcgcacc

SEQ ID NO: 1055960 - RNA, 12 nt, Mycobacterium bovis subsp bovis AF2122/97
caggccgcgcgg

SEQ ID NO: 1055961 - RNA, 17 nt, Mycobacterium bovis subsp bovis AF2122/97
caggccgcggagaaggc

SEQ ID NO: 1055962 - RNA, 16 nt, Mycobacterium bovis subsp bovis AF2122/97
caggccgcgcucgucg

SEQ ID NO: 1055963 - RNA, 17 nt, Mycobacterium bovis subsp bovis AF2122/97
caggccgcgcgacaacc

SEQ ID NO: 1055964 - RNA, 21 nt, Mycobacterium bovis subsp bovis AF2122/97
caggccgcgcgacaacccggc

SEQ ID NO: 1055965 - RNA, 22 nt, Mycobacterium bovis subsp bovis AF2122/97
caggccgcgcgacaacccggcg

SEQ ID NO: 1055966 - RNA, 22 nt, Mycobacterium bovis subsp bovis AF2122/97
caggccuccucuuggguccaca

SEQ ID NO: 1055967 - RNA, 16 nt, Mycobacterium bovis subsp bovis AF2122/97
caggccucgaccgcgg

SEQ ID NO: 1055968 - RNA, 18 nt, Mycobacterium bovis subsp bovis AF2122/97
caggccucggcgccgccc

SEQ ID NO: 1055969 - RNA, 20 nt, Mycobacterium bovis subsp bovis AF2122/97
caggccuccaaaaucgcggc

SEQ ID NO: 1055970 - RNA, 18 nt, Mycobacterium bovis subsp bovis AF2122/97
caggccuccaagcccgcc

SEQ ID NO: 1055971 - RNA, 16 nt, Mycobacterium bovis subsp bovis AF2122/97
caggccuggcgagcca

SEQ ID NO: 1055972 - RNA, 16 nt, Mycobacterium bovis subsp bovis AF2122/97
caggccgcgcggaccc

SEQ ID NO: 1055973 - RNA, 19 nt, Mycobacterium bovis subsp bovis AF2122/97
caggccgcugggccgaccg

SEQ ID NO: 1055974 - RNA, 20 nt, Mycobacterium bovis subsp bovis AF2122/97
caggccuagcgcggcgacga

SEQ ID NO: 1055975 - RNA, 16 nt, Mycobacterium bovis subsp bovis AF2122/97
caggccuaggccgagg

SEQ ID NO: 1055976 - RNA, 13 nt, Mycobacterium bovis subsp bovis AF2122/97
caggccuaggucg

SEQ ID NO: 1055977 - RNA, 19 nt, Mycobacterium bovis subsp bovis AF2122/97
caggccuaggucgacgccg

SEQ ID NO: 1055978 - RNA, 22 nt, Mycobacterium bovis subsp bovis AF2122/97
caggccuaggucgacgccgacc

SEQ ID NO: 1055979 - RNA, 20 nt, Mycobacterium bovis subsp bovis AF2122/97
caggccuaguccggcacugc

SEQ ID NO: 1055980 - RNA, 16 nt, Mycobacterium bovis subsp bovis AF2122/97
caggcgcgccgcaccc

SEQ ID NO: 1055981 - RNA, 13 nt, Mycobacterium bovis subsp bovis AF2122/97
caggcgcggccca

SEQ ID NO: 1055982 - RNA, 22 nt, Mycobacterium bovis subsp bovis AF2122/97
caggcgcgcuaccagcucacgg

SEQ ID NO: 1055983 - RNA, 14 nt, Mycobacterium bovis subsp bovis AF2122/97
caggcgcgccgcac

SEQ ID NO: 1055984 - RNA, 14 nt, Mycobacterium bovis subsp bovis AF2122/97
caggcgcgaucgcg

SEQ ID NO: 1055985 - RNA, 20 nt, Mycobacterium bovis subsp bovis AF2122/97
caggcgcauagggccaccgc

SEQ ID NO: 1055986 - RNA, 22 nt, Mycobacterium bovis subsp bovis AF2122/97
caggcgcauagggccaccgccg

SEQ ID NO: 1055987 - RNA, 16 nt, Mycobacterium bovis subsp bovis AF2122/97
caggcgauugcccgcg

SEQ ID NO: 1055988 - RNA, 21 nt, Mycobacterium bovis subsp bovis AF2122/97
caggcgauugcccgcgcucgc

SEQ ID NO: 1055989 - RNA, 20 nt, Mycobacterium bovis subsp bovis AF2122/97
caggcgcaccaggcggccgu

SEQ ID NO: 1055990 - RNA, 23 nt, Mycobacterium bovis subsp bovis AF2122/97
caggcgaagucgacucgccacau

SEQ ID NO: 1055991 - RNA, 15 nt, Mycobacterium bovis subsp bovis AF2122/97
caggcgaaggcggcu

SEQ ID NO: 1055992 - RNA, 18 nt, Mycobacterium bovis subsp bovis AF2122/97
caggccuuggugcggccg

SEQ ID NO: 1055993 - RNA, 19 nt, Mycobacterium bovis subsp bovis AF2122/97
caggccuuggugcggccgg

SEQ ID NO: 1055994 - RNA, 20 nt, Mycobacterium bovis subsp bovis AF2122/97
caggccuuggugcggccggg

SEQ ID NO: 1055995 - RNA, 10 nt, Mycobacterium bovis subsp bovis AF2122/97
caggcgaacc

SEQ ID NO: 1055996 - RNA, 18 nt, Mycobacterium bovis subsp bovis AF2122/97
caggcgaagucgacucgc

SEQ ID NO: 1055997 - RNA, 15 nt, Mycobacterium bovis subsp bovis AF2122/97
caggcgaacaccaga

SEQ ID NO: 1055998 - RNA, 21 nt, Mycobacterium bovis subsp bovis AF2122/97
cagcuuccgcugaacaccgug

SEQ ID NO: 1055999 - RNA, 14 nt, Mycobacterium bovis subsp bovis AF2122/97
cagcuuggcgucga

SEQ ID NO: 1056000 - RNA, 19 nt, Mycobacterium bovis subsp bovis AF2122/97
cagcuucaaugucggugac

SEQ ID NO: 1056001 - RNA, 20 nt, Mycobacterium bovis subsp bovis AF2122/97
cagcuugggcagcagcgcgc

SEQ ID NO: 1056002 - RNA, 13 nt, Mycobacterium bovis subsp bovis AF2122/97
cagcugucgggca

SEQ ID NO: 1056003 - RNA, 17 nt, Mycobacterium bovis subsp bovis AF2122/97
cagcuguugucgcggaa

SEQ ID NO: 1056004 - RNA, 16 nt, Mycobacterium bovis subsp bovis AF2122/97
cagcugugcgacccgc

SEQ ID NO: 1056005 - RNA, 14 nt, Mycobacterium bovis subsp bovis AF2122/97
caggaaaccggcgc

SEQ ID NO: 1056006 - RNA, 20 nt, Mycobacterium bovis subsp bovis AF2122/97
cagcuuuugcaccggaccgu

SEQ ID NO: 1056007 - RNA, 20 nt, Mycobacterium bovis subsp bovis AF2122/97
cagcuugugggcgacggcga

SEQ ID NO: 1056008 - RNA, 21 nt, Mycobacterium bovis subsp bovis AF2122/97
cagcuuguuuuccaccagcga

SEQ ID NO: 1056009 - RNA, 19 nt, Mycobacterium bovis subsp bovis AF2122/97
caggaaccacccaccggcc

SEQ ID NO: 1056010 - RNA, 16 nt, Mycobacterium bovis subsp bovis AF2122/97
caggaaaccggcgcgg

SEQ ID NO: 1056011 - RNA, 16 nt, Mycobacterium bovis subsp bovis AF2122/97
caggaacaaugagauc

SEQ ID NO: 1056012 - RNA, 16 nt, Mycobacterium bovis subsp bovis AF2122/97
cagcuggucggcuucg

SEQ ID NO: 1056013 - RNA, 14 nt, Mycobacterium bovis subsp bovis AF2122/97
cagcuggucggugg

SEQ ID NO: 1056014 - RNA, 20 nt, Mycobacterium bovis subsp bovis AF2122/97
cagcugguagcgcaccacac

SEQ ID NO: 1056015 - RNA, 16 nt, Mycobacterium bovis subsp bovis AF2122/97
cagcugguggcggcgg

SEQ ID NO: 1056016 - RNA, 19 nt, Mycobacterium bovis subsp bovis AF2122/97
cagcugcgcacgucgggcc

SEQ ID NO: 1056017 - RNA, 17 nt, Mycobacterium bovis subsp bovis AF2122/97
cagcugucccucgggau

SEQ ID NO: 1056018 - RNA, 23 nt, Mycobacterium bovis subsp bovis AF2122/97
cagcugucccucgggaucaccga

SEQ ID NO: 1056019 - RNA, 15 nt, Mycobacterium bovis subsp bovis AF2122/97
cagcuggcucaccga

SEQ ID NO: 1056020 - RNA, 15 nt, Mycobacterium bovis subsp bovis AF2122/97
cagcugggcaucacc

SEQ ID NO: 1056021 - RNA, 17 nt, Mycobacterium bovis subsp bovis AF2122/97
cagcugggcaucaccgc

SEQ ID NO: 1056022 - RNA, 22 nt, Mycobacterium bovis subsp bovis AF2122/97
cagcugggcaucaccgccgcgg

SEQ ID NO: 1056023 - RNA, 22 nt, Mycobacterium bovis subsp bovis AF2122/97
cagcuggcgcagccugccgaug

SEQ ID NO: 1056024 - RNA, 21 nt, Mycobacterium bovis subsp bovis AF2122/97
cagcugcggauuaagucggcg

SEQ ID NO: 1056025 - RNA, 18 nt, Mycobacterium bovis subsp bovis AF2122/97
cagcugcggcuccggcgg

SEQ ID NO: 1056026 - RNA, 19 nt, Mycobacterium bovis subsp bovis AF2122/97
cagcugcggcuccggcggc

SEQ ID NO: 1056027 - RNA, 23 nt, Mycobacterium bovis subsp bovis AF2122/97
cagcugcggcuccggcggcagcg

SEQ ID NO: 1056028 - RNA, 22 nt, Mycobacterium bovis subsp bovis AF2122/97
cagcugcggguucacuuccggg

SEQ ID NO: 1056029 - RNA, 21 nt, Mycobacterium bovis subsp bovis AF2122/97
cagcugcguggcgaaccaggg

SEQ ID NO: 1056030 - RNA, 13 nt, Mycobacterium bovis subsp bovis AF2122/97
cagcugccggcga

SEQ ID NO: 1056031 - RNA, 15 nt, Mycobacterium bovis subsp bovis AF2122/97
cagcuccuugagguc

SEQ ID NO: 1056032 - RNA, 21 nt, Mycobacterium bovis subsp bovis AF2122/97
cagcuccuuggcuaacaccgc

SEQ ID NO: 1056033 - RNA, 23 nt, Mycobacterium bovis subsp bovis AF2122/97
cagcuccuuggcuaacaccgcag

SEQ ID NO: 1056034 - RNA, 23 nt, Mycobacterium bovis subsp bovis AF2122/97
cagcugcggacuggcauccgccc

SEQ ID NO: 1056035 - RNA, 23 nt, Mycobacterium bovis subsp bovis AF2122/97
cagcugcggauccaccacgcugg

SEQ ID NO: 1056036 - RNA, 15 nt, Mycobacterium bovis subsp bovis AF2122/97
cagcugcgcgggcga

SEQ ID NO: 1056037 - RNA, 21 nt, Mycobacterium bovis subsp bovis AF2122/97
cagcugcgcagcgcaacaucg

SEQ ID NO: 1056038 - RNA, 13 nt, Mycobacterium bovis subsp bovis AF2122/97
cagcugcgcaucg

SEQ ID NO: 1056039 - RNA, 17 nt, Mycobacterium bovis subsp bovis AF2122/97
cagcuccgggugcagau

SEQ ID NO: 1056040 - RNA, 17 nt, Mycobacterium bovis subsp bovis AF2122/97
cagcuccgugacaccgg

SEQ ID NO: 1056041 - RNA, 18 nt, Mycobacterium bovis subsp bovis AF2122/97
cagcuccgugacaccggg

SEQ ID NO: 1056042 - RNA, 23 nt, Mycobacterium bovis subsp bovis AF2122/97
cagcuccgggucgacgacgucgc

SEQ ID NO: 1056043 - RNA, 19 nt, Mycobacterium bovis subsp bovis AF2122/97
cagcuccgccugccgcugg

SEQ ID NO: 1056044 - RNA, 16 nt, Mycobacterium bovis subsp bovis AF2122/97
caggacgucggcgaau

SEQ ID NO: 1056045 - RNA, 20 nt, Mycobacterium bovis subsp bovis AF2122/97
caggacggcuaccaccgcac

SEQ ID NO: 1056046 - RNA, 13 nt, Mycobacterium bovis subsp bovis AF2122/97
caggacggaucgu

SEQ ID NO: 1056047 - RNA, 13 nt, Mycobacterium bovis subsp bovis AF2122/97
caggacggcaccc

SEQ ID NO: 1056048 - RNA, 22 nt, Mycobacterium bovis subsp bovis AF2122/97
caggacgcgaucggcgucacga

SEQ ID NO: 1056049 - RNA, 20 nt, Mycobacterium bovis subsp bovis AF2122/97
caggaacuugugccgggcga

SEQ ID NO: 1056050 - RNA, 16 nt, Mycobacterium bovis subsp bovis AF2122/97
caggacgacgccgacg

SEQ ID NO: 1056051 - RNA, 17 nt, Mycobacterium bovis subsp bovis AF2122/97
caggacgacgccgacga

SEQ ID NO: 1056052 - RNA, 15 nt, Mycobacterium bovis subsp bovis AF2122/97
caggaagccgagacc

SEQ ID NO: 1056053 - RNA, 22 nt, Mycobacterium bovis subsp bovis AF2122/97
caggaucagcccggacguaggc

SEQ ID NO: 1056054 - RNA, 23 nt, Mycobacterium bovis subsp bovis AF2122/97
caggaucacccacucgacgucgu

SEQ ID NO: 1056055 - RNA, 22 nt, Mycobacterium bovis subsp bovis AF2122/97
caggaucccgguggcagcacag

SEQ ID NO: 1056056 - RNA, 14 nt, Mycobacterium bovis subsp bovis AF2122/97
caggauccgacccc

SEQ ID NO: 1056057 - RNA, 17 nt, Mycobacterium bovis subsp bovis AF2122/97
caggagcgccgucaucg

SEQ ID NO: 1056058 - RNA, 19 nt, Mycobacterium bovis subsp bovis AF2122/97
caggagccccagguagucg

SEQ ID NO: 1056059 - RNA, 14 nt, Mycobacterium bovis subsp bovis AF2122/97
caggagccggcaac

SEQ ID NO: 1056060 - RNA, 17 nt, Mycobacterium bovis subsp bovis AF2122/97
caggacuggcaccgcca

SEQ ID NO: 1056061 - RNA, 18 nt, Mycobacterium bovis subsp bovis AF2122/97
caggacuggcaccgccag

SEQ ID NO: 1056062 - RNA, 19 nt, Mycobacterium bovis subsp bovis AF2122/97
caggagaacacauccgcuu

SEQ ID NO: 1056063 - RNA, 22 nt, Mycobacterium bovis subsp bovis AF2122/97
caggagaacacauccgcuugcg

SEQ ID NO: 1056064 - RNA, 21 nt, Mycobacterium bovis subsp bovis AF2122/97
caggacugaacaguugcacac

SEQ ID NO: 1056065 - RNA, 19 nt, Mycobacterium bovis subsp bovis AF2122/97
caggacuccggccgcacgc

SEQ ID NO: 1056066 - RNA, 22 nt, Mycobacterium bovis subsp bovis AF2122/97
caggagaucaacauccugggca

SEQ ID NO: 1056067 - RNA, 19 nt, Mycobacterium bovis subsp bovis AF2122/97
caggagcagcacgucgaac

SEQ ID NO: 1056068 - RNA, 15 nt, Mycobacterium bovis subsp bovis AF2122/97
caggcagcuccgccg

SEQ ID NO: 1056069 - RNA, 17 nt, Mycobacterium bovis subsp bovis AF2122/97
caggcagcuccgccgcc

SEQ ID NO: 1056070 - RNA, 18 nt, Mycobacterium bovis subsp bovis AF2122/97
caggcagcuccgccgccg

SEQ ID NO: 1056071 - RNA, 21 nt, Mycobacterium bovis subsp bovis AF2122/97
caggcagcuccgccgccgacg

SEQ ID NO: 1056072 - RNA, 13 nt, Mycobacterium bovis subsp bovis AF2122/97
caggcagcucggc

SEQ ID NO: 1056073 - RNA, 14 nt, Mycobacterium bovis subsp bovis AF2122/97
caggcagcucggca

SEQ ID NO: 1056074 - RNA, 17 nt, Mycobacterium bovis subsp bovis AF2122/97
caggcagcucggcaacg

SEQ ID NO: 1056075 - RNA, 18 nt, Mycobacterium bovis subsp bovis AF2122/97
caggcagcucggcaacgu

SEQ ID NO: 1056076 - RNA, 20 nt, Mycobacterium bovis subsp bovis AF2122/97
caggaugccugccacccguu

SEQ ID NO: 1056077 - RNA, 20 nt, Mycobacterium bovis subsp bovis AF2122/97
caggaucgcguggcgcacca

SEQ ID NO: 1056078 - RNA, 22 nt, Mycobacterium bovis subsp bovis AF2122/97
caggaucgcaaugccgugcgcc

SEQ ID NO: 1056079 - RNA, 14 nt, Mycobacterium bovis subsp bovis AF2122/97
caggaucuccgggu

SEQ ID NO: 1056080 - RNA, 20 nt, Mycobacterium bovis subsp bovis AF2122/97
caggaucgcggcgccgucgu

SEQ ID NO: 1056081 - RNA, 15 nt, Mycobacterium bovis subsp bovis AF2122/97
caggaucggcggaua

SEQ ID NO: 1056082 - RNA, 23 nt, Mycobacterium bovis subsp bovis AF2122/97
caggaucggcuugggaaacccgg

SEQ ID NO: 1056083 - RNA, 15 nt, Mycobacterium bovis subsp bovis AF2122/97
cagggucagcgccgc

SEQ ID NO: 1056084 - RNA, 14 nt, Mycobacterium bovis subsp bovis AF2122/97
cagggucagcucgg

SEQ ID NO: 1056085 - RNA, 13 nt, Mycobacterium bovis subsp bovis AF2122/97
cagggucagcugg

SEQ ID NO: 1056086 - RNA, 17 nt, Mycobacterium bovis subsp bovis AF2122/97
cagggucaccucgucgc

SEQ ID NO: 1056087 - RNA, 17 nt, Mycobacterium bovis subsp bovis AF2122/97
caggguauccacgccgg

SEQ ID NO: 1056088 - RNA, 18 nt, Mycobacterium bovis subsp bovis AF2122/97
caggguauccacgccggg

SEQ ID NO: 1056089 - RNA, 21 nt, Mycobacterium bovis subsp bovis AF2122/97
caggguauccacgccgggcaa

SEQ ID NO: 1056090 - RNA, 13 nt, Mycobacterium bovis subsp bovis AF2122/97
cagggucccgccg

SEQ ID NO: 1056091 - RNA, 23 nt, Mycobacterium bovis subsp bovis AF2122/97
cagggucguagacgguuaccgcg

SEQ ID NO: 1056092 - RNA, 17 nt, Mycobacterium bovis subsp bovis AF2122/97
cagggucugcgccgccg

SEQ ID NO: 1056093 - RNA, 18 nt, Mycobacterium bovis subsp bovis AF2122/97
cagggucugcgccgccgg

SEQ ID NO: 1056094 - RNA, 22 nt, Mycobacterium bovis subsp bovis AF2122/97
cagggucugcgccgccggcggc

SEQ ID NO: 1056095 - RNA, 14 nt, Mycobacterium bovis subsp bovis AF2122/97
cagggugacuucgc

SEQ ID NO: 1056096 - RNA, 18 nt, Mycobacterium bovis subsp bovis AF2122/97
cagggugcccucggccgc

SEQ ID NO: 1056097 - RNA, 19 nt, Mycobacterium bovis subsp bovis AF2122/97
cagggugcccucggccgcc

SEQ ID NO: 1056098 - RNA, 21 nt, Mycobacterium bovis subsp bovis AF2122/97
cagggugcccucggccgccug

SEQ ID NO: 1056099 - RNA, 17 nt, Mycobacterium bovis subsp bovis AF2122/97
cagggugcccucggccg

SEQ ID NO: 1056100 - RNA, 17 nt, Mycobacterium bovis subsp bovis AF2122/97
cagggugccggcgccgc

SEQ ID NO: 1056101 - RNA, 14 nt, Mycobacterium bovis subsp bovis AF2122/97
cagggugccggcgg

SEQ ID NO: 1056102 - RNA, 18 nt, Mycobacterium bovis subsp bovis AF2122/97
cagggugccggcggugac

SEQ ID NO: 1056103 - RNA, 17 nt, Mycobacterium bovis subsp bovis AF2122/97
caggguggcccggggac

SEQ ID NO: 1056104 - RNA, 16 nt, Mycobacterium bovis subsp bovis AF2122/97
caggguggccagcagg

SEQ ID NO: 1056105 - RNA, 18 nt, Mycobacterium bovis subsp bovis AF2122/97
caggguguauggccacca

SEQ ID NO: 1056106 - RNA, 20 nt, Mycobacterium bovis subsp bovis AF2122/97
caggguguauggccaccacg

SEQ ID NO: 1056107 - RNA, 15 nt, Mycobacterium bovis subsp bovis AF2122/97
caggguguccgucga

SEQ ID NO: 1056108 - RNA, 14 nt, Mycobacterium bovis subsp bovis AF2122/97
caggguggcgacgu

SEQ ID NO: 1056109 - RNA, 14 nt, Mycobacterium bovis subsp bovis AF2122/97
caggguggggcggu

SEQ ID NO: 1056110 - RNA, 17 nt, Mycobacterium bovis subsp bovis AF2122/97
caggguggggcgguggc

SEQ ID NO: 1056111 - RNA, 18 nt, Mycobacterium bovis subsp bovis AF2122/97
caggguguccgucgaacc

SEQ ID NO: 1056112 - RNA, 21 nt, Mycobacterium bovis subsp bovis AF2122/97
cagggugucgucuugcgucca

SEQ ID NO: 1056113 - RNA, 19 nt, Mycobacterium bovis subsp bovis AF2122/97
caggguguugaucucgccg

SEQ ID NO: 1056114 - RNA, 17 nt, Mycobacterium bovis subsp bovis AF2122/97
cagggugucgaagagca

SEQ ID NO: 1056115 - RNA, 21 nt, Mycobacterium bovis subsp bovis AF2122/97
caggguuccggauccgaugac

SEQ ID NO: 1056116 - RNA, 17 nt, Mycobacterium bovis subsp bovis AF2122/97
cagguacggcgggcggc

SEQ ID NO: 1056117 - RNA, 21 nt, Mycobacterium bovis subsp bovis AF2122/97
cagguacgccucgacagcggc

SEQ ID NO: 1056118 - RNA, 18 nt, Mycobacterium bovis subsp bovis AF2122/97
cagguacgcgaucagcgc

SEQ ID NO: 1056119 - RNA, 17 nt, Mycobacterium bovis subsp bovis AF2122/97
cagguacaucccggugu

SEQ ID NO: 1056120 - RNA, 22 nt, Mycobacterium bovis subsp bovis AF2122/97
cagguacaucccggugucgaug

SEQ ID NO: 1056121 - RNA, 20 nt, Mycobacterium bovis subsp bovis AF2122/97
cagguaagcagccagcaaca

SEQ ID NO: 1056122 - RNA, 16 nt, Mycobacterium bovis subsp bovis AF2122/97
cagguaauugccgacc

SEQ ID NO: 1056123 - RNA, 17 nt, Mycobacterium bovis subsp bovis AF2122/97
cagguaauugccgaccg

SEQ ID NO: 1056124 - RNA, 14 nt, Mycobacterium bovis subsp bovis AF2122/97
cagguagcgcucga

SEQ ID NO: 1056125 - RNA, 19 nt, Mycobacterium bovis subsp bovis AF2122/97
cagguagaccggaaaccac

SEQ ID NO: 1056126 - RNA, 23 nt, Mycobacterium bovis subsp bovis AF2122/97
cagguagaacuccucgcugucga

SEQ ID NO: 1056127 - RNA, 14 nt, Mycobacterium bovis subsp bovis AF2122/97
cagggccgccgcga

SEQ ID NO: 1056128 - RNA, 12 nt, Mycobacterium bovis subsp bovis AF2122/97
cagggccgccga

SEQ ID NO: 1056129 - RNA, 12 nt, Mycobacterium bovis subsp bovis AF2122/97
cagggccgccgc

SEQ ID NO: 1056130 - RNA, 13 nt, Mycobacterium bovis subsp bovis AF2122/97
cagggccgcucgc

SEQ ID NO: 1056131 - RNA, 14 nt, Mycobacterium bovis subsp bovis AF2122/97
cagggccgcucgcc

SEQ ID NO: 1056132 - RNA, 17 nt, Mycobacterium bovis subsp bovis AF2122/97
cagggccggcaccgcag

SEQ ID NO: 1056133 - RNA, 19 nt, Mycobacterium bovis subsp bovis AF2122/97
cagggccggcaccgcagcg

SEQ ID NO: 1056134 - RNA, 13 nt, Mycobacterium bovis subsp bovis AF2122/97
cagggcgccgaau

SEQ ID NO: 1056135 - RNA, 22 nt, Mycobacterium bovis subsp bovis AF2122/97
cagggcgccgaauuggcccggg

SEQ ID NO: 1056136 - RNA, 19 nt, Mycobacterium bovis subsp bovis AF2122/97
cagggcgccacugaccgcg

SEQ ID NO: 1056137 - RNA, 16 nt, Mycobacterium bovis subsp bovis AF2122/97
cagggcgaucugcgcg

SEQ ID NO: 1056138 - RNA, 12 nt, Mycobacterium bovis subsp bovis AF2122/97
cagggccacugg

SEQ ID NO: 1056139 - RNA, 14 nt, Mycobacterium bovis subsp bovis AF2122/97
cagggccccaccga

SEQ ID NO: 1056140 - RNA, 19 nt, Mycobacterium bovis subsp bovis AF2122/97
cagggccccaccgagcggu

SEQ ID NO: 1056141 - RNA, 17 nt, Mycobacterium bovis subsp bovis AF2122/97
cagggcccgcaacaucg

SEQ ID NO: 1056142 - RNA, 17 nt, Mycobacterium bovis subsp bovis AF2122/97
cagggcccuagccggcg

SEQ ID NO: 1056143 - RNA, 13 nt, Mycobacterium bovis subsp bovis AF2122/97
caggcgcgucggu

SEQ ID NO: 1056144 - RNA, 17 nt, Mycobacterium bovis subsp bovis AF2122/97
cagggcauugcggcccg

SEQ ID NO: 1056145 - RNA, 23 nt, Mycobacterium bovis subsp bovis AF2122/97
cagggcaucagcagagccccggc

SEQ ID NO: 1056146 - RNA, 13 nt, Mycobacterium bovis subsp bovis AF2122/97
cagggccaccgcg

SEQ ID NO: 1056147 - RNA, 16 nt, Mycobacterium bovis subsp bovis AF2122/97
cagggccaccgcgccg

SEQ ID NO: 1056148 - RNA, 16 nt, Mycobacterium bovis subsp bovis AF2122/97
cagggccaccaccacg

SEQ ID NO: 1056149 - RNA, 18 nt, Mycobacterium bovis subsp bovis AF2122/97
cagggccaccaccacggc

SEQ ID NO: 1056150 - RNA, 17 nt, Mycobacterium bovis subsp bovis AF2122/97
cagggcgggcgucgagg

SEQ ID NO: 1056151 - RNA, 13 nt, Mycobacterium bovis subsp bovis AF2122/97
cagggcggcaucc

SEQ ID NO: 1056152 - RNA, 20 nt, Mycobacterium bovis subsp bovis AF2122/97
cagggcggugccaucgggcg

SEQ ID NO: 1056153 - RNA, 16 nt, Mycobacterium bovis subsp bovis AF2122/97
cagggcugcgaugcgg

SEQ ID NO: 1056154 - RNA, 15 nt, Mycobacterium bovis subsp bovis AF2122/97
cagggcgccgacgac

SEQ ID NO: 1056155 - RNA, 20 nt, Mycobacterium bovis subsp bovis AF2122/97
cagggcgaucugcgcgaugc

SEQ ID NO: 1056156 - RNA, 21 nt, Mycobacterium bovis subsp bovis AF2122/97
cagggcgccgacgacuccggc

SEQ ID NO: 1056157 - RNA, 15 nt, Mycobacterium bovis subsp bovis AF2122/97
cagggcggcaacggc

SEQ ID NO: 1056158 - RNA, 19 nt, Mycobacterium bovis subsp bovis AF2122/97
cagggcggcaacggcggca

SEQ ID NO: 1056159 - RNA, 14 nt, Mycobacterium bovis subsp bovis AF2122/97
cagggguggcgcgg

SEQ ID NO: 1056160 - RNA, 19 nt, Mycobacterium bovis subsp bovis AF2122/97
cagggguggcgcgggccgg

SEQ ID NO: 1056161 - RNA, 22 nt, Mycobacterium bovis subsp bovis AF2122/97
caggggaggcgaaaaacaccua

SEQ ID NO: 1056162 - RNA, 16 nt, Mycobacterium bovis subsp bovis AF2122/97
caggggaucccccgcg

SEQ ID NO: 1056163 - RNA, 19 nt, Mycobacterium bovis subsp bovis AF2122/97
caggggaucccccgcgcga

SEQ ID NO: 1056164 - RNA, 16 nt, Mycobacterium bovis subsp bovis AF2122/97
caggggaucguccggc

SEQ ID NO: 1056165 - RNA, 14 nt, Mycobacterium bovis subsp bovis AF2122/97
caggggaccgcggc

SEQ ID NO: 1056166 - RNA, 16 nt, Mycobacterium bovis subsp bovis AF2122/97
caggggcgcagcgcgg

SEQ ID NO: 1056167 - RNA, 16 nt, Mycobacterium bovis subsp bovis AF2122/97
caggucaccggccgcc

SEQ ID NO: 1056168 - RNA, 16 nt, Mycobacterium bovis subsp bovis AF2122/97
caggucagccgcgcgg

SEQ ID NO: 1056169 - RNA, 22 nt, Mycobacterium bovis subsp bovis AF2122/97
caggucagcgcugccaccgcgg

SEQ ID NO: 1056170 - RNA, 18 nt, Mycobacterium bovis subsp bovis AF2122/97
caggucauauugcggugc

SEQ ID NO: 1056171 - RNA, 19 nt, Mycobacterium bovis subsp bovis AF2122/97
caggucauauugcggugca

SEQ ID NO: 1056172 - RNA, 14 nt, Mycobacterium bovis subsp bovis AF2122/97
cagguccaccgcug

SEQ ID NO: 1056173 - RNA, 18 nt, Mycobacterium bovis subsp bovis AF2122/97
cagguccaccgcugccgg

SEQ ID NO: 1056174 - RNA, 21 nt, Mycobacterium bovis subsp bovis AF2122/97
cagguccaccgcugccggcag

SEQ ID NO: 1056175 - RNA, 22 nt, Mycobacterium bovis subsp bovis AF2122/97
cagguccaccgcugccggcagc

SEQ ID NO: 1056176 - RNA, 14 nt, Mycobacterium bovis subsp bovis AF2122/97
cagguccaccggcc

SEQ ID NO: 1056177 - RNA, 23 nt, Mycobacterium bovis subsp bovis AF2122/97
cagguaucggggggucuugccga

SEQ ID NO: 1056178 - RNA, 17 nt, Mycobacterium bovis subsp bovis AF2122/97
caggucgagcaccggcu

SEQ ID NO: 1056179 - RNA, 17 nt, Mycobacterium bovis subsp bovis AF2122/97
caggucgacaccgcggu

SEQ ID NO: 1056180 - RNA, 16 nt, Mycobacterium bovis subsp bovis AF2122/97
cagguccugcgccgca

SEQ ID NO: 1056181 - RNA, 19 nt, Mycobacterium bovis subsp bovis AF2122/97
cagguccccgacaacggcg

SEQ ID NO: 1056182 - RNA, 16 nt, Mycobacterium bovis subsp bovis AF2122/97
caggucauugccggcg

SEQ ID NO: 1056183 - RNA, 14 nt, Mycobacterium bovis subsp bovis AF2122/97
cagguccgccccgu

SEQ ID NO: 1056184 - RNA, 19 nt, Mycobacterium bovis subsp bovis AF2122/97
cagguccgccggugccgcc

SEQ ID NO: 1056185 - RNA, 21 nt, Mycobacterium bovis subsp bovis AF2122/97
cagguccgccggugccgccgu

SEQ ID NO: 1056186 - RNA, 15 nt, Mycobacterium bovis subsp bovis AF2122/97
cagguccgcggccgc

SEQ ID NO: 1056187 - RNA, 17 nt, Mycobacterium bovis subsp bovis AF2122/97
cagguccgcggccgcgg

SEQ ID NO: 1056188 - RNA, 17 nt, Mycobacterium bovis subsp bovis AF2122/97
cagguccggguuggcca

SEQ ID NO: 1056189 - RNA, 16 nt, Mycobacterium bovis subsp bovis AF2122/97
cagguggccgcaucgc

SEQ ID NO: 1056190 - RNA, 13 nt, Mycobacterium bovis subsp bovis AF2122/97
caggugccgugau

SEQ ID NO: 1056191 - RNA, 23 nt, Mycobacterium bovis subsp bovis AF2122/97
caggugccgugaucgcuggcgac

SEQ ID NO: 1056192 - RNA, 20 nt, Mycobacterium bovis subsp bovis AF2122/97
caggugccguggcuaccgca

SEQ ID NO: 1056193 - RNA, 18 nt, Mycobacterium bovis subsp bovis AF2122/97
caggugccuuucggcaga

SEQ ID NO: 1056194 - RNA, 19 nt, Mycobacterium bovis subsp bovis AF2122/97
caggugccaaacgccgccc

SEQ ID NO: 1056195 - RNA, 17 nt, Mycobacterium bovis subsp bovis AF2122/97
caggugccaaccgcggc

SEQ ID NO: 1056196 - RNA, 12 nt, Mycobacterium bovis subsp bovis AF2122/97
caggugcccggc

SEQ ID NO: 1056197 - RNA, 16 nt, Mycobacterium bovis subsp bovis AF2122/97
caggugcccgccccga

SEQ ID NO: 1056198 - RNA, 17 nt, Mycobacterium bovis subsp bovis AF2122/97
caggugccagaccaggg

SEQ ID NO: 1056199 - RNA, 15 nt, Mycobacterium bovis subsp bovis AF2122/97
caggugcagcaccag

SEQ ID NO: 1056200 - RNA, 21 nt, Mycobacterium bovis subsp bovis AF2122/97
caggucgguggucucgacggc

SEQ ID NO: 1056201 - RNA, 20 nt, Mycobacterium bovis subsp bovis AF2122/97
caggucggugugcaucgccg

SEQ ID NO: 1056202 - RNA, 13 nt, Mycobacterium bovis subsp bovis AF2122/97
caggucgucacgc

SEQ ID NO: 1056203 - RNA, 15 nt, Mycobacterium bovis subsp bovis AF2122/97
caggucgucacgccc

SEQ ID NO: 1056204 - RNA, 20 nt, Mycobacterium bovis subsp bovis AF2122/97
caggucguccaucgcgucgu

SEQ ID NO: 1056205 - RNA, 17 nt, Mycobacterium bovis subsp bovis AF2122/97
caggucgucggcgucgc

SEQ ID NO: 1056206 - RNA, 19 nt, Mycobacterium bovis subsp bovis AF2122/97
caggucgucggcgucgcgg

SEQ ID NO: 1056207 - RNA, 17 nt, Mycobacterium bovis subsp bovis AF2122/97
caggucgucguaccggc

SEQ ID NO: 1056208 - RNA, 14 nt, Mycobacterium bovis subsp bovis AF2122/97
caggucgugcccgg

SEQ ID NO: 1056209 - RNA, 19 nt, Mycobacterium bovis subsp bovis AF2122/97
caggucgugcccgggacca

SEQ ID NO: 1056210 - RNA, 16 nt, Mycobacterium bovis subsp bovis AF2122/97
caggucgggcccccgg

SEQ ID NO: 1056211 - RNA, 23 nt, Mycobacterium bovis subsp bovis AF2122/97
caggucgaggcaggccucggcgc

SEQ ID NO: 1056212 - RNA, 23 nt, Mycobacterium bovis subsp bovis AF2122/97
caggucgagcgcccacuggugau

SEQ ID NO: 1056213 - RNA, 16 nt, Mycobacterium bovis subsp bovis AF2122/97
caggucgauaccggcg

SEQ ID NO: 1056214 - RNA, 19 nt, Mycobacterium bovis subsp bovis AF2122/97
cagguuggauacggugcga

SEQ ID NO: 1056215 - RNA, 20 nt, Mycobacterium bovis subsp bovis AF2122/97
cagguggugacacgacgugc

SEQ ID NO: 1056216 - RNA, 17 nt, Mycobacterium bovis subsp bovis AF2122/97
caggugggccgagagca

SEQ ID NO: 1056217 - RNA, 20 nt, Mycobacterium bovis subsp bovis AF2122/97
caggugggcguuggcgacga

SEQ ID NO: 1056218 - RNA, 23 nt, Mycobacterium bovis subsp bovis AF2122/97
cagguggcgagcgccuuucgguc

SEQ ID NO: 1056219 - RNA, 22 nt, Mycobacterium bovis subsp bovis AF2122/97
cagguggccgcucuccaccccg

SEQ ID NO: 1056220 - RNA, 15 nt, Mycobacterium bovis subsp bovis AF2122/97
caggugggcagcagg

SEQ ID NO: 1056221 - RNA, 17 nt, Mycobacterium bovis subsp bovis AF2122/97
caggugggcagcaggcc

SEQ ID NO: 1056222 - RNA, 17 nt, Mycobacterium bovis subsp bovis AF2122/97
cagguuggucaccaccu

SEQ ID NO: 1056223 - RNA, 14 nt, Mycobacterium bovis subsp bovis AF2122/97
cagguuggccccgg

SEQ ID NO: 1056224 - RNA, 13 nt, Mycobacterium bovis subsp bovis AF2122/97
cagguugucggcg

SEQ ID NO: 1056225 - RNA, 18 nt, Mycobacterium bovis subsp bovis AF2122/97
cagguugucggcgaucaa

SEQ ID NO: 1056226 - RNA, 20 nt, Mycobacterium bovis subsp bovis AF2122/97
cagguugugauccugggugu

SEQ ID NO: 1056227 - RNA, 15 nt, Mycobacterium bovis subsp bovis AF2122/97
caguaccaccggcac

SEQ ID NO: 1056228 - RNA, 21 nt, Mycobacterium bovis subsp bovis AF2122/97
caguacgcgcugagcgacugc

SEQ ID NO: 1056229 - RNA, 16 nt, Mycobacterium bovis subsp bovis AF2122/97
caguacaccgcccggc

SEQ ID NO: 1056230 - RNA, 16 nt, Mycobacterium bovis subsp bovis AF2122/97
caguacaccggcgugc

SEQ ID NO: 1056231 - RNA, 13 nt, Mycobacterium bovis subsp bovis AF2122/97
caguacagcgcgu

SEQ ID NO: 1056232 - RNA, 20 nt, Mycobacterium bovis subsp bovis AF2122/97
cagguuugcgccgcgcagcg

SEQ ID NO: 1056233 - RNA, 15 nt, Mycobacterium bovis subsp bovis AF2122/97
caguaauucggccau

SEQ ID NO: 1056234 - RNA, 14 nt, Mycobacterium bovis subsp bovis AF2122/97
cagguuuucgaucu

SEQ ID NO: 1056235 - RNA, 13 nt, Mycobacterium bovis subsp bovis AF2122/97
caguccggacggc

SEQ ID NO: 1056236 - RNA, 16 nt, Mycobacterium bovis subsp bovis AF2122/97
caguccgcgccggcgg

SEQ ID NO: 1056237 - RNA, 21 nt, Mycobacterium bovis subsp bovis AF2122/97
caguccgagcuuggccgccgc

SEQ ID NO: 1056238 - RNA, 16 nt, Mycobacterium bovis subsp bovis AF2122/97
caguccgaucgccgag

SEQ ID NO: 1056239 - RNA, 18 nt, Mycobacterium bovis subsp bovis AF2122/97
caguccgaucacccgcac

SEQ ID NO: 1056240 - RNA, 19 nt, Mycobacterium bovis subsp bovis AF2122/97
caguccgaaagccgccgag

SEQ ID NO: 1056241 - RNA, 20 nt, Mycobacterium bovis subsp bovis AF2122/97
caguccgacaccacggacca

SEQ ID NO: 1056242 - RNA, 15 nt, Mycobacterium bovis subsp bovis AF2122/97
caguccgacaccggc

SEQ ID NO: 1056243 - RNA, 19 nt, Mycobacterium bovis subsp bovis AF2122/97
cagucccucgccaaccagu

SEQ ID NO: 1056244 - RNA, 22 nt, Mycobacterium bovis subsp bovis AF2122/97
cagucccggugggcggcucguc

SEQ ID NO: 1056245 - RNA, 18 nt, Mycobacterium bovis subsp bovis AF2122/97
cagucccccgcucgacca

SEQ ID NO: 1056246 - RNA, 21 nt, Mycobacterium bovis subsp bovis AF2122/97
cagucccagcacacccccguc

SEQ ID NO: 1056247 - RNA, 15 nt, Mycobacterium bovis subsp bovis AF2122/97
cagucccaacacggc

SEQ ID NO: 1056248 - RNA, 19 nt, Mycobacterium bovis subsp bovis AF2122/97
caguagccggugccggcgc

SEQ ID NO: 1056249 - RNA, 15 nt, Mycobacterium bovis subsp bovis AF2122/97
caguagccacgccca

SEQ ID NO: 1056250 - RNA, 21 nt, Mycobacterium bovis subsp bovis AF2122/97
caguccaggcacuccagcggc

SEQ ID NO: 1056251 - RNA, 23 nt, Mycobacterium bovis subsp bovis AF2122/97
caguccaggcacuccagcggcgg

SEQ ID NO: 1056252 - RNA, 22 nt, Mycobacterium bovis subsp bovis AF2122/97
caguccacgcguagcggucccg

SEQ ID NO: 1056253 - RNA, 19 nt, Mycobacterium bovis subsp bovis AF2122/97
caguccacugaucaggccg

SEQ ID NO: 1056254 - RNA, 20 nt, Mycobacterium bovis subsp bovis AF2122/97
caguccacugaucaggccga

SEQ ID NO: 1056255 - RNA, 14 nt, Mycobacterium bovis subsp bovis AF2122/97
caguagaucgcgaa

SEQ ID NO: 1056256 - RNA, 15 nt, Mycobacterium bovis subsp bovis AF2122/97
caguacuaacaacac

SEQ ID NO: 1056257 - RNA, 21 nt, Mycobacterium bovis subsp bovis AF2122/97
caguacuaacaacaccaccag

SEQ ID NO: 1056258 - RNA, 22 nt, Mycobacterium bovis subsp bovis AF2122/97
caucaccgccagccccgcgccc

SEQ ID NO: 1056259 - RNA, 11 nt, Mycobacterium bovis subsp bovis AF2122/97
caucaccgccg

SEQ ID NO: 1056260 - RNA, 14 nt, Mycobacterium bovis subsp bovis AF2122/97
caucaccgccgcgg

SEQ ID NO: 1056261 - RNA, 18 nt, Mycobacterium bovis subsp bovis AF2122/97
caucaccgccgcggccgc

SEQ ID NO: 1056262 - RNA, 22 nt, Mycobacterium bovis subsp bovis AF2122/97
caucaccgccgcggccgccguc

SEQ ID NO: 1056263 - RNA, 13 nt, Mycobacterium bovis subsp bovis AF2122/97
caucaccgccguu

SEQ ID NO: 1056264 - RNA, 21 nt, Mycobacterium bovis subsp bovis AF2122/97
caucaccgccuuugccgccgg

SEQ ID NO: 1056265 - RNA, 14 nt, Mycobacterium bovis subsp bovis AF2122/97
caucacguccgcgg

SEQ ID NO: 1056266 - RNA, 21 nt, Mycobacterium bovis subsp bovis AF2122/97
caucaccggcaugcgugccgg

SEQ ID NO: 1056267 - RNA, 13 nt, Mycobacterium bovis subsp bovis AF2122/97
caucacccagcgc

SEQ ID NO: 1056268 - RNA, 14 nt, Mycobacterium bovis subsp bovis AF2122/97
caucacccagcgcc

SEQ ID NO: 1056269 - RNA, 15 nt, Mycobacterium bovis subsp bovis AF2122/97
caucacccagcgccg

SEQ ID NO: 1056270 - RNA, 16 nt, Mycobacterium bovis subsp bovis AF2122/97
caucaccccggccuug

SEQ ID NO: 1056271 - RNA, 21 nt, Mycobacterium bovis subsp bovis AF2122/97
caucaccccggccuuggcggc

SEQ ID NO: 1056272 - RNA, 20 nt, Mycobacterium bovis subsp bovis AF2122/97
caucaccgaacggcgaggug

SEQ ID NO: 1056273 - RNA, 16 nt, Mycobacterium bovis subsp bovis AF2122/97
caucaccgacgcgucg

SEQ ID NO: 1056274 - RNA, 18 nt, Mycobacterium bovis subsp bovis AF2122/97
caucaccgacgcgucggc

SEQ ID NO: 1056275 - RNA, 20 nt, Mycobacterium bovis subsp bovis AF2122/97
caucaccagaaauggcgcca

SEQ ID NO: 1056276 - RNA, 13 nt, Mycobacterium bovis subsp bovis AF2122/97
caucaccaccgcc

SEQ ID NO: 1056277 - RNA, 14 nt, Mycobacterium bovis subsp bovis AF2122/97
caucaccacggccg

SEQ ID NO: 1056278 - RNA, 18 nt, Mycobacterium bovis subsp bovis AF2122/97
caucaccacggccgccga

SEQ ID NO: 1056279 - RNA, 15 nt, Mycobacterium bovis subsp bovis AF2122/97
caucaccacuggacc

SEQ ID NO: 1056280 - RNA, 18 nt, Mycobacterium bovis subsp bovis AF2122/97
caucaccaccggcaccgc

SEQ ID NO: 1056281 - RNA, 15 nt, Mycobacterium bovis subsp bovis AF2122/97
caucaccacccgacc

SEQ ID NO: 1056282 - RNA, 20 nt, Mycobacterium bovis subsp bovis AF2122/97
caucaccaaaaacccgguga

SEQ ID NO: 1056283 - RNA, 15 nt, Mycobacterium bovis subsp bovis AF2122/97
caucaacgcgggcgc

SEQ ID NO: 1056284 - RNA, 13 nt, Mycobacterium bovis subsp bovis AF2122/97
caucacacccauc

SEQ ID NO: 1056285 - RNA, 13 nt, Mycobacterium bovis subsp bovis AF2122/97
caucacacccggu

SEQ ID NO: 1056286 - RNA, 23 nt, Mycobacterium bovis subsp bovis AF2122/97
caucacacccgguaugcgcgucc

SEQ ID NO: 1056287 - RNA, 14 nt, Mycobacterium bovis subsp bovis AF2122/97
caucaacaucggcc

SEQ ID NO: 1056288 - RNA, 22 nt, Mycobacterium bovis subsp bovis AF2122/97
caucaacgacaccagaucguuc

SEQ ID NO: 1056289 - RNA, 12 nt, Mycobacterium bovis subsp bovis AF2122/97
cauaucggugcc

SEQ ID NO: 1056290 - RNA, 20 nt, Mycobacterium bovis subsp bovis AF2122/97
cauaucgauaaccgcgacca

SEQ ID NO: 1056291 - RNA, 17 nt, Mycobacterium bovis subsp bovis AF2122/97
cauauccgccggcgaca

SEQ ID NO: 1056292 - RNA, 21 nt, Mycobacterium bovis subsp bovis AF2122/97
cauauagaucacugcucgucg

SEQ ID NO: 1056293 - RNA, 16 nt, Mycobacterium bovis subsp bovis AF2122/97
cauauaggagcgggug

SEQ ID NO: 1056294 - RNA, 15 nt, Mycobacterium bovis subsp bovis AF2122/97
cauauugggaguccg

SEQ ID NO: 1056295 - RNA, 17 nt, Mycobacterium bovis subsp bovis AF2122/97
caucaaacccccggggc

SEQ ID NO: 1056296 - RNA, 19 nt, Mycobacterium bovis subsp bovis AF2122/97
caucaaacccccggggcgc

SEQ ID NO: 1056297 - RNA, 20 nt, Mycobacterium bovis subsp bovis AF2122/97
caucaggucgguggucucga

SEQ ID NO: 1056298 - RNA, 18 nt, Mycobacterium bovis subsp bovis AF2122/97
caucaggucgucguccug

SEQ ID NO: 1056299 - RNA, 14 nt, Mycobacterium bovis subsp bovis AF2122/97
caucaggucggcga

SEQ ID NO: 1056300 - RNA, 20 nt, Mycobacterium bovis subsp bovis AF2122/97
caucaccggcauacagccgg

SEQ ID NO: 1056301 - RNA, 17 nt, Mycobacterium bovis subsp bovis AF2122/97
caucacucgcgccagug

SEQ ID NO: 1056302 - RNA, 18 nt, Mycobacterium bovis subsp bovis AF2122/97
caucagaaccuccucggg

SEQ ID NO: 1056303 - RNA, 23 nt, Mycobacterium bovis subsp bovis AF2122/97
caucagaccaaugaccgccagca

SEQ ID NO: 1056304 - RNA, 16 nt, Mycobacterium bovis subsp bovis AF2122/97
caucagagcgcugguu

SEQ ID NO: 1056305 - RNA, 18 nt, Mycobacterium bovis subsp bovis AF2122/97
caucaucggguccacguc

SEQ ID NO: 1056306 - RNA, 16 nt, Mycobacterium bovis subsp bovis AF2122/97
caucaucgcugugcgc

SEQ ID NO: 1056307 - RNA, 16 nt, Mycobacterium bovis subsp bovis AF2122/97
caucaucccgacccug

SEQ ID NO: 1056308 - RNA, 17 nt, Mycobacterium bovis subsp bovis AF2122/97
caucaucgccaccaccc

SEQ ID NO: 1056309 - RNA, 17 nt, Mycobacterium bovis subsp bovis AF2122/97
caucagugcucccgaua

SEQ ID NO: 1056310 - RNA, 17 nt, Mycobacterium bovis subsp bovis AF2122/97
caucagugcgccggcga

SEQ ID NO: 1056311 - RNA, 12 nt, Mycobacterium bovis subsp bovis AF2122/97
caucccggaacg

SEQ ID NO: 1056312 - RNA, 18 nt, Mycobacterium bovis subsp bovis AF2122/97
caucccggaccgaugguu

SEQ ID NO: 1056313 - RNA, 15 nt, Mycobacterium bovis subsp bovis AF2122/97
caucccggagccgcu

SEQ ID NO: 1056314 - RNA, 18 nt, Mycobacterium bovis subsp bovis AF2122/97
caucccgacccuucgggc

SEQ ID NO: 1056315 - RNA, 12 nt, Mycobacterium bovis subsp bovis AF2122/97
caucccgguguc

SEQ ID NO: 1056316 - RNA, 17 nt, Mycobacterium bovis subsp bovis AF2122/97
caucccggugucgaugc

SEQ ID NO: 1056317 - RNA, 12 nt, Mycobacterium bovis subsp bovis AF2122/97
caucccggcgcc

SEQ ID NO: 1056318 - RNA, 15 nt, Mycobacterium bovis subsp bovis AF2122/97
caucccggccgagua

SEQ ID NO: 1056319 - RNA, 22 nt, Mycobacterium bovis subsp bovis AF2122/97
caucccucaguguacaccgcgc

SEQ ID NO: 1056320 - RNA, 19 nt, Mycobacterium bovis subsp bovis AF2122/97
cauccgagcgggaacgagc

SEQ ID NO: 1056321 - RNA, 19 nt, Mycobacterium bovis subsp bovis AF2122/97
cauccgaucacgacguugc

SEQ ID NO: 1056322 - RNA, 14 nt, Mycobacterium bovis subsp bovis AF2122/97
cauccgaucgccgc

SEQ ID NO: 1056323 - RNA, 16 nt, Mycobacterium bovis subsp bovis AF2122/97
cauccgaucgccgcga

SEQ ID NO: 1056324 - RNA, 17 nt, Mycobacterium bovis subsp bovis AF2122/97
cauccgaucgccgcgaa

SEQ ID NO: 1056325 - RNA, 18 nt, Mycobacterium bovis subsp bovis AF2122/97
caucccguucagcgacca

SEQ ID NO: 1056326 - RNA, 18 nt, Mycobacterium bovis subsp bovis AF2122/97
caucccgggcaguccagg

SEQ ID NO: 1056327 - RNA, 16 nt, Mycobacterium bovis subsp bovis AF2122/97
caucaugguccgggcc

SEQ ID NO: 1056328 - RNA, 16 nt, Mycobacterium bovis subsp bovis AF2122/97
caucaugccgcccauc

SEQ ID NO: 1056329 - RNA, 20 nt, Mycobacterium bovis subsp bovis AF2122/97
caucaugccgcccaucaccc

SEQ ID NO: 1056330 - RNA, 16 nt, Mycobacterium bovis subsp bovis AF2122/97
cauccccuggccagca

SEQ ID NO: 1056331 - RNA, 15 nt, Mycobacterium bovis subsp bovis AF2122/97
cauccccggccagcc

SEQ ID NO: 1056332 - RNA, 14 nt, Mycobacterium bovis subsp bovis AF2122/97
cauccaccucgaug

SEQ ID NO: 1056333 - RNA, 14 nt, Mycobacterium bovis subsp bovis AF2122/97
cauccaacgaccuc

SEQ ID NO: 1056334 - RNA, 14 nt, Mycobacterium bovis subsp bovis AF2122/97
cauccacaaucaca

SEQ ID NO: 1056335 - RNA, 12 nt, Mycobacterium bovis subsp bovis AF2122/97
cauaggccggcg

SEQ ID NO: 1056336 - RNA, 15 nt, Mycobacterium bovis subsp bovis AF2122/97
cauagggccaccgcc

SEQ ID NO: 1056337 - RNA, 20 nt, Mycobacterium bovis subsp bovis AF2122/97
cauagggccaccgccgccug

SEQ ID NO: 1056338 - RNA, 17 nt, Mycobacterium bovis subsp bovis AF2122/97
cauaggcuuccggcgcg

SEQ ID NO: 1056339 - RNA, 20 nt, Mycobacterium bovis subsp bovis AF2122/97
cauagugaggccgaccagca

SEQ ID NO: 1056340 - RNA, 16 nt, Mycobacterium bovis subsp bovis AF2122/97
cauagucagacgacga

SEQ ID NO: 1056341 - RNA, 15 nt, Mycobacterium bovis subsp bovis AF2122/97
cauagugcggcagcg

SEQ ID NO: 1056342 - RNA, 15 nt, Mycobacterium bovis subsp bovis AF2122/97
cauaguuggcgcccg

SEQ ID NO: 1056343 - RNA, 13 nt, Mycobacterium bovis subsp bovis AF2122/97
cauacccgcgcgc

SEQ ID NO: 1056344 - RNA, 17 nt, Mycobacterium bovis subsp bovis AF2122/97
cauacccagcucgucgc

SEQ ID NO: 1056345 - RNA, 19 nt, Mycobacterium bovis subsp bovis AF2122/97
cauaccgaugguggugcca

SEQ ID NO: 1056346 - RNA, 14 nt, Mycobacterium bovis subsp bovis AF2122/97
cauaccgccgggcc

SEQ ID NO: 1056347 - RNA, 22 nt, Mycobacterium bovis subsp bovis AF2122/97
cauaccgcaauggcggccuugc

SEQ ID NO: 1056348 - RNA, 15 nt, Mycobacterium bovis subsp bovis AF2122/97
cauacgucgccucga

SEQ ID NO: 1056349 - RNA, 23 nt, Mycobacterium bovis subsp bovis AF2122/97
cauacgugccgccgaugucgacg

SEQ ID NO: 1056350 - RNA, 19 nt, Mycobacterium bovis subsp bovis AF2122/97
caguugguagagcaccagg

SEQ ID NO: 1056351 - RNA, 15 nt, Mycobacterium bovis subsp bovis AF2122/97
caguugguagccgcc

SEQ ID NO: 1056352 - RNA, 16 nt, Mycobacterium bovis subsp bovis AF2122/97
caguugguagccgccc

SEQ ID NO: 1056353 - RNA, 19 nt, Mycobacterium bovis subsp bovis AF2122/97
caguuuaccgugccgcccg

SEQ ID NO: 1056354 - RNA, 15 nt, Mycobacterium bovis subsp bovis AF2122/97
caguugugcggccag

SEQ ID NO: 1056355 - RNA, 14 nt, Mycobacterium bovis subsp bovis AF2122/97
caguuugacgccga

SEQ ID NO: 1056356 - RNA, 15 nt, Mycobacterium bovis subsp bovis AF2122/97
caguuuggcggcgcg

SEQ ID NO: 1056357 - RNA, 17 nt, Mycobacterium bovis subsp bovis AF2122/97
cauaaaugcgcguucga

SEQ ID NO: 1056358 - RNA, 15 nt, Mycobacterium bovis subsp bovis AF2122/97
caguuuucaccgcga

SEQ ID NO: 1056359 - RNA, 20 nt, Mycobacterium bovis subsp bovis AF2122/97
cauaacccuggccggugcgc

SEQ ID NO: 1056360 - RNA, 15 nt, Mycobacterium bovis subsp bovis AF2122/97
cauaaccggcgcgcc

SEQ ID NO: 1056361 - RNA, 18 nt, Mycobacterium bovis subsp bovis AF2122/97
cauaccaagcgcgguggu

SEQ ID NO: 1056362 - RNA, 23 nt, Mycobacterium bovis subsp bovis AF2122/97
cauaagcccccgcacgcacggcg

SEQ ID NO: 1056363 - RNA, 17 nt, Mycobacterium bovis subsp bovis AF2122/97
cagugccgguucgaugg

SEQ ID NO: 1056364 - RNA, 12 nt, Mycobacterium bovis subsp bovis AF2122/97
cagugccucgcg

SEQ ID NO: 1056365 - RNA, 14 nt, Mycobacterium bovis subsp bovis AF2122/97
cagugccucggcga

SEQ ID NO: 1056366 - RNA, 15 nt, Mycobacterium bovis subsp bovis AF2122/97
cagugccucggcggc

SEQ ID NO: 1056367 - RNA, 13 nt, Mycobacterium bovis subsp bovis AF2122/97
cagugcgaugcgg

SEQ ID NO: 1056368 - RNA, 16 nt, Mycobacterium bovis subsp bovis AF2122/97
cagugcgaugcggugu

SEQ ID NO: 1056369 - RNA, 12 nt, Mycobacterium bovis subsp bovis AF2122/97
cagugcgcacgg

SEQ ID NO: 1056370 - RNA, 20 nt, Mycobacterium bovis subsp bovis AF2122/97
cagugcgcagaacaccaccg

SEQ ID NO: 1056371 - RNA, 23 nt, Mycobacterium bovis subsp bovis AF2122/97
cagugcgcagaacaccaccgcca

SEQ ID NO: 1056372 - RNA, 21 nt, Mycobacterium bovis subsp bovis AF2122/97
cagugcgacucugcgucugcu

SEQ ID NO: 1056373 - RNA, 17 nt, Mycobacterium bovis subsp bovis AF2122/97
caguggcguuacgcucg

SEQ ID NO: 1056374 - RNA, 22 nt, Mycobacterium bovis subsp bovis AF2122/97
caguggcuacgcgaucagcugg

SEQ ID NO: 1056375 - RNA, 14 nt, Mycobacterium bovis subsp bovis AF2122/97
caguggccagaccc

SEQ ID NO: 1056376 - RNA, 13 nt, Mycobacterium bovis subsp bovis AF2122/97
caguggccgccgg

SEQ ID NO: 1056377 - RNA, 19 nt, Mycobacterium bovis subsp bovis AF2122/97
caguggcgcccauggccac

SEQ ID NO: 1056378 - RNA, 21 nt, Mycobacterium bovis subsp bovis AF2122/97
caguggcgcccauggccacca

SEQ ID NO: 1056379 - RNA, 19 nt, Mycobacterium bovis subsp bovis AF2122/97
cagucgcuggguggcgggc

SEQ ID NO: 1056380 - RNA, 21 nt, Mycobacterium bovis subsp bovis AF2122/97
cagucgcgguaccaucaccgc

SEQ ID NO: 1056381 - RNA, 21 nt, Mycobacterium bovis subsp bovis AF2122/97
caguccggcguucccgccauu

SEQ ID NO: 1056382 - RNA, 21 nt, Mycobacterium bovis subsp bovis AF2122/97
caguccgacaccggcggcauc

SEQ ID NO: 1056383 - RNA, 20 nt, Mycobacterium bovis subsp bovis AF2122/97
caguccgaugguaugcccgc

SEQ ID NO: 1056384 - RNA, 22 nt, Mycobacterium bovis subsp bovis AF2122/97
caguccgaugguaugcccgccg

SEQ ID NO: 1056385 - RNA, 15 nt, Mycobacterium bovis subsp bovis AF2122/97
caguccggcccccga

SEQ ID NO: 1056386 - RNA, 18 nt, Mycobacterium bovis subsp bovis AF2122/97
cagucgcaggaucggcgg

SEQ ID NO: 1056387 - RNA, 15 nt, Mycobacterium bovis subsp bovis AF2122/97
cagucgccggccggc

SEQ ID NO: 1056388 - RNA, 17 nt, Mycobacterium bovis subsp bovis AF2122/97
cagucgccggccggccc

SEQ ID NO: 1056389 - RNA, 23 nt, Mycobacterium bovis subsp bovis AF2122/97
caguugcguuguccaccaucaac

SEQ ID NO: 1056390 - RNA, 23 nt, Mycobacterium bovis subsp bovis AF2122/97
caguugaugcggaugucgucgac

SEQ ID NO: 1056391 - RNA, 17 nt, Mycobacterium bovis subsp bovis AF2122/97
caguuggcagcgcuggc

SEQ ID NO: 1056392 - RNA, 19 nt, Mycobacterium bovis subsp bovis AF2122/97
caguugcacaccgaucggc

SEQ ID NO: 1056393 - RNA, 15 nt, Mycobacterium bovis subsp bovis AF2122/97
caguugcacaucggu

SEQ ID NO: 1056394 - RNA, 13 nt, Mycobacterium bovis subsp bovis AF2122/97
caguuccggugac

SEQ ID NO: 1056395 - RNA, 13 nt, Mycobacterium bovis subsp bovis AF2122/97
caguuccgcugcg

SEQ ID NO: 1056396 - RNA, 15 nt, Mycobacterium bovis subsp bovis AF2122/97
cagugguaccggcgc

SEQ ID NO: 1056397 - RNA, 16 nt, Mycobacterium bovis subsp bovis AF2122/97
cagugguaggccgccg

SEQ ID NO: 1056398 - RNA, 21 nt, Mycobacterium bovis subsp bovis AF2122/97
cagugguaggccgccggaccc

SEQ ID NO: 1056399 - RNA, 20 nt, Mycobacterium bovis subsp bovis AF2122/97
cagugggggugguaccggcg

SEQ ID NO: 1056400 - RNA, 21 nt, Mycobacterium bovis subsp bovis AF2122/97
cagugggggugguaccggcgg

SEQ ID NO: 1056401 - RNA, 22 nt, Mycobacterium bovis subsp bovis AF2122/97
cagugggggugguaccggcggc

SEQ ID NO: 1056402 - RNA, 17 nt, Mycobacterium bovis subsp bovis AF2122/97
cagugggacaggucggc

SEQ ID NO: 1056403 - RNA, 22 nt, Mycobacterium bovis subsp bovis AF2122/97
cagugggcaauccggucagcgc

SEQ ID NO: 1056404 - RNA, 21 nt, Mycobacterium bovis subsp bovis AF2122/97
cagugggcgguugaucgccgg

SEQ ID NO: 1056405 - RNA, 22 nt, Mycobacterium bovis subsp bovis AF2122/97
cagugggcgguugaucgccggc

SEQ ID NO: 1056406 - RNA, 17 nt, Mycobacterium bovis subsp bovis AF2122/97
caguggucggcuccgcg

SEQ ID NO: 1056407 - RNA, 18 nt, Mycobacterium bovis subsp bovis AF2122/97
caguggggguccggcggc

SEQ ID NO: 1056408 - RNA, 20 nt, Mycobacterium bovis subsp bovis AF2122/97
caguggggguccggcggccg

SEQ ID NO: 1056409 - RNA, 18 nt, Mycobacterium bovis subsp bovis AF2122/97
caguguacaccgcgcccg

SEQ ID NO: 1056410 - RNA, 14 nt, Mycobacterium bovis subsp bovis AF2122/97
caguucaccgcgcu

SEQ ID NO: 1056411 - RNA, 15 nt, Mycobacterium bovis subsp bovis AF2122/97
caguuccaccgcgca

SEQ ID NO: 1056412 - RNA, 13 nt, Mycobacterium bovis subsp bovis AF2122/97
ccagcgccgccgc

SEQ ID NO: 1056413 - RNA, 15 nt, Mycobacterium bovis subsp bovis AF2122/97
ccagcgccgccaggu

SEQ ID NO: 1056414 - RNA, 20 nt, Mycobacterium bovis subsp bovis AF2122/97
ccagcgccgcaguggaugca

SEQ ID NO: 1056415 - RNA, 16 nt, Mycobacterium bovis subsp bovis AF2122/97
ccagcgcaucggccag

SEQ ID NO: 1056416 - RNA, 22 nt, Mycobacterium bovis subsp bovis AF2122/97
ccagcgcagugccuccgacacc

SEQ ID NO: 1056417 - RNA, 15 nt, Mycobacterium bovis subsp bovis AF2122/97
ccagcgcagcagcgg

SEQ ID NO: 1056418 - RNA, 18 nt, Mycobacterium bovis subsp bovis AF2122/97
ccagcgcacgcucggcac

SEQ ID NO: 1056419 - RNA, 15 nt, Mycobacterium bovis subsp bovis AF2122/97
ccagcgcacggacca

SEQ ID NO: 1056420 - RNA, 17 nt, Mycobacterium bovis subsp bovis AF2122/97
ccagcgcagccaggcug

SEQ ID NO: 1056421 - RNA, 22 nt, Mycobacterium bovis subsp bovis AF2122/97
ccagcgcacuacucgaacaacc

SEQ ID NO: 1056422 - RNA, 13 nt, Mycobacterium bovis subsp bovis AF2122/97
ccagcgcagccga

SEQ ID NO: 1056423 - RNA, 19 nt, Mycobacterium bovis subsp bovis AF2122/97
ccagcgcccgucgcuggga

SEQ ID NO: 1056424 - RNA, 23 nt, Mycobacterium bovis subsp bovis AF2122/97
ccagcgcaucuuugaacgccauc

SEQ ID NO: 1056425 - RNA, 17 nt, Mycobacterium bovis subsp bovis AF2122/97
ccagcgcaucggccagc

SEQ ID NO: 1056426 - RNA, 20 nt, Mycobacterium bovis subsp bovis AF2122/97
ccagcgcaucggccagcagc

SEQ ID NO: 1056427 - RNA, 23 nt, Mycobacterium bovis subsp bovis AF2122/97
ccagcgcaucggccagcagcgac

SEQ ID NO: 1056428 - RNA, 16 nt, Mycobacterium bovis subsp bovis AF2122/97
ccagcgcccggcccgc

SEQ ID NO: 1056429 - RNA, 14 nt, Mycobacterium bovis subsp bovis AF2122/97
ccagccgcggcgcc

SEQ ID NO: 1056430 - RNA, 15 nt, Mycobacterium bovis subsp bovis AF2122/97
ccagccgcgggccgc

SEQ ID NO: 1056431 - RNA, 14 nt, Mycobacterium bovis subsp bovis AF2122/97
ccagcgacgcgguc

SEQ ID NO: 1056432 - RNA, 15 nt, Mycobacterium bovis subsp bovis AF2122/97
ccagcgacgcgguca

SEQ ID NO: 1056433 - RNA, 16 nt, Mycobacterium bovis subsp bovis AF2122/97
ccagcgacucggccag

SEQ ID NO: 1056434 - RNA, 16 nt, Mycobacterium bovis subsp bovis AF2122/97
ccagcgagaucagcau

SEQ ID NO: 1056435 - RNA, 15 nt, Mycobacterium bovis subsp bovis AF2122/97
ccagcgacucggcca

SEQ ID NO: 1056436 - RNA, 22 nt, Mycobacterium bovis subsp bovis AF2122/97
ccagcgcacgauagccaccgac

SEQ ID NO: 1056437 - RNA, 14 nt, Mycobacterium bovis subsp bovis AF2122/97
ccagcgcaccgccg

SEQ ID NO: 1056438 - RNA, 14 nt, Mycobacterium bovis subsp bovis AF2122/97
ccagcgagcccagc

SEQ ID NO: 1056439 - RNA, 22 nt, Mycobacterium bovis subsp bovis AF2122/97
ccagcgaggagcagggcucguc

SEQ ID NO: 1056440 - RNA, 17 nt, Mycobacterium bovis subsp bovis AF2122/97
ccagcgagcgccagguc

SEQ ID NO: 1056441 - RNA, 12 nt, Mycobacterium bovis subsp bovis AF2122/97
ccagccgcgcgu

SEQ ID NO: 1056442 - RNA, 21 nt, Mycobacterium bovis subsp bovis AF2122/97
ccagccgcgcguccgggcagc

SEQ ID NO: 1056443 - RNA, 16 nt, Mycobacterium bovis subsp bovis AF2122/97
ccagccgcggaucauc

SEQ ID NO: 1056444 - RNA, 22 nt, Mycobacterium bovis subsp bovis AF2122/97
ccagccgcggcccucgaugccg

SEQ ID NO: 1056445 - RNA, 14 nt, Mycobacterium bovis subsp bovis AF2122/97
ccagccgcgccagc

SEQ ID NO: 1056446 - RNA, 16 nt, Mycobacterium bovis subsp bovis AF2122/97
ccagccgcgagccggu

SEQ ID NO: 1056447 - RNA, 17 nt, Mycobacterium bovis subsp bovis AF2122/97
ccagccgcgagccggug

SEQ ID NO: 1056448 - RNA, 20 nt, Mycobacterium bovis subsp bovis AF2122/97
ccagccgcgagccggugauc

SEQ ID NO: 1056449 - RNA, 16 nt, Mycobacterium bovis subsp bovis AF2122/97
ccagccgcaucgggca

SEQ ID NO: 1056450 - RNA, 15 nt, Mycobacterium bovis subsp bovis AF2122/97
ccagccgccagcccg

SEQ ID NO: 1056451 - RNA, 13 nt, Mycobacterium bovis subsp bovis AF2122/97
ccagccgaucacg

SEQ ID NO: 1056452 - RNA, 20 nt, Mycobacterium bovis subsp bovis AF2122/97
ccagccgaucaucaccggca

SEQ ID NO: 1056453 - RNA, 13 nt, Mycobacterium bovis subsp bovis AF2122/97
ccagccgcacggu

SEQ ID NO: 1056454 - RNA, 17 nt, Mycobacterium bovis subsp bovis AF2122/97
ccagccgcaacaccccc

SEQ ID NO: 1056455 - RNA, 15 nt, Mycobacterium bovis subsp bovis AF2122/97
ccagcgggcggcccu

SEQ ID NO: 1056456 - RNA, 23 nt, Mycobacterium bovis subsp bovis AF2122/97
ccagcgggcauaacccgcaccgg

SEQ ID NO: 1056457 - RNA, 19 nt, Mycobacterium bovis subsp bovis AF2122/97
ccagcgggcgaugagcgcg

SEQ ID NO: 1056458 - RNA, 22 nt, Mycobacterium bovis subsp bovis AF2122/97
ccagcgguaaugccagcggcac

SEQ ID NO: 1056459 - RNA, 16 nt, Mycobacterium bovis subsp bovis AF2122/97
ccagcgguagccgagc

SEQ ID NO: 1056460 - RNA, 19 nt, Mycobacterium bovis subsp bovis AF2122/97
ccagcggucagccggccau

SEQ ID NO: 1056461 - RNA, 16 nt, Mycobacterium bovis subsp bovis AF2122/97
ccagcgggugagguca

SEQ ID NO: 1056462 - RNA, 17 nt, Mycobacterium bovis subsp bovis AF2122/97
ccagcgguucggugauc

SEQ ID NO: 1056463 - RNA, 17 nt, Mycobacterium bovis subsp bovis AF2122/97
ccagcguaucggccggc

SEQ ID NO: 1056464 - RNA, 18 nt, Mycobacterium bovis subsp bovis AF2122/97
ccagcguaucggccggca

SEQ ID NO: 1056465 - RNA, 23 nt, Mycobacterium bovis subsp bovis AF2122/97
ccagcguaucggccggcagauug

SEQ ID NO: 1056466 - RNA, 21 nt, Mycobacterium bovis subsp bovis AF2122/97
ccagcguccuggcguagugca

SEQ ID NO: 1056467 - RNA, 15 nt, Mycobacterium bovis subsp bovis AF2122/97
ccagcgucgcaaggc

SEQ ID NO: 1056468 - RNA, 16 nt, Mycobacterium bovis subsp bovis AF2122/97
ccagcgucgcacgcgc

SEQ ID NO: 1056469 - RNA, 16 nt, Mycobacterium bovis subsp bovis AF2122/97
ccagcgucaccucacc

SEQ ID NO: 1056470 - RNA, 22 nt, Mycobacterium bovis subsp bovis AF2122/97
ccagcguccauggucgcgccac

SEQ ID NO: 1056471 - RNA, 18 nt, Mycobacterium bovis subsp bovis AF2122/97
ccagcguccagccgcccu

SEQ ID NO: 1056472 - RNA, 16 nt, Mycobacterium bovis subsp bovis AF2122/97
ccagcgucgcggccac

SEQ ID NO: 1056473 - RNA, 17 nt, Mycobacterium bovis subsp bovis AF2122/97
ccagcgucgcggccacg

SEQ ID NO: 1056474 - RNA, 23 nt, Mycobacterium bovis subsp bovis AF2122/97
ccagcgucgcggccacggucagc

SEQ ID NO: 1056475 - RNA, 15 nt, Mycobacterium bovis subsp bovis AF2122/97
ccagcgucucaaggc

SEQ ID NO: 1056476 - RNA, 17 nt, Mycobacterium bovis subsp bovis AF2122/97
ccagcgucucgaucacc

SEQ ID NO: 1056477 - RNA, 17 nt, Mycobacterium bovis subsp bovis AF2122/97
ccagcggccaccgaggc

SEQ ID NO: 1056478 - RNA, 19 nt, Mycobacterium bovis subsp bovis AF2122/97
ccagcggcauauggauguu

SEQ ID NO: 1056479 - RNA, 17 nt, Mycobacterium bovis subsp bovis AF2122/97
ccagcggcugaccgggc

SEQ ID NO: 1056480 - RNA, 21 nt, Mycobacterium bovis subsp bovis AF2122/97
ccagcggcugcccaucgguga

SEQ ID NO: 1056481 - RNA, 14 nt, Mycobacterium bovis subsp bovis AF2122/97
ccagcggcccguca

SEQ ID NO: 1056482 - RNA, 19 nt, Mycobacterium bovis subsp bovis AF2122/97
ccagcggcccgucaccgcg

SEQ ID NO: 1056483 - RNA, 20 nt, Mycobacterium bovis subsp bovis AF2122/97
ccagcgccgcggcuacaucg

SEQ ID NO: 1056484 - RNA, 16 nt, Mycobacterium bovis subsp bovis AF2122/97
ccagcgccucggcauc

SEQ ID NO: 1056485 - RNA, 19 nt, Mycobacterium bovis subsp bovis AF2122/97
ccagcgcgcgcugagccgu

SEQ ID NO: 1056486 - RNA, 13 nt, Mycobacterium bovis subsp bovis AF2122/97
ccagcgcgcgccg

SEQ ID NO: 1056487 - RNA, 14 nt, Mycobacterium bovis subsp bovis AF2122/97
ccagcgcgcgccga

SEQ ID NO: 1056488 - RNA, 15 nt, Mycobacterium bovis subsp bovis AF2122/97
ccagcgcgcgccgca

SEQ ID NO: 1056489 - RNA, 17 nt, Mycobacterium bovis subsp bovis AF2122/97
ccagcggcaccgcgccg

SEQ ID NO: 1056490 - RNA, 19 nt, Mycobacterium bovis subsp bovis AF2122/97
ccagcggcaccgcgccggc

SEQ ID NO: 1056491 - RNA, 15 nt, Mycobacterium bovis subsp bovis AF2122/97
ccagcggcaccgcgg

SEQ ID NO: 1056492 - RNA, 21 nt, Mycobacterium bovis subsp bovis AF2122/97
ccagauguaccucaucgcaga

SEQ ID NO: 1056493 - RNA, 22 nt, Mycobacterium bovis subsp bovis AF2122/97
ccagauguccgacgcaccaacg

SEQ ID NO: 1056494 - RNA, 10 nt, Mycobacterium bovis subsp bovis AF2122/97
ccagcagcgc

SEQ ID NO: 1056495 - RNA, 10 nt, Mycobacterium bovis subsp bovis AF2122/97
ccagcagcac

SEQ ID NO: 1056496 - RNA, 14 nt, Mycobacterium bovis subsp bovis AF2122/97
ccagcagagcggca

SEQ ID NO: 1056497 - RNA, 20 nt, Mycobacterium bovis subsp bovis AF2122/97
ccagcagauuaccgagcugg

SEQ ID NO: 1056498 - RNA, 17 nt, Mycobacterium bovis subsp bovis AF2122/97
ccagcacuccaccgcug

SEQ ID NO: 1056499 - RNA, 18 nt, Mycobacterium bovis subsp bovis AF2122/97
ccagcacugccaucgcgg

SEQ ID NO: 1056500 - RNA, 22 nt, Mycobacterium bovis subsp bovis AF2122/97
ccagcacugccaucgcggcguu

SEQ ID NO: 1056501 - RNA, 19 nt, Mycobacterium bovis subsp bovis AF2122/97
ccagcacgccgccggccgc

SEQ ID NO: 1056502 - RNA, 14 nt, Mycobacterium bovis subsp bovis AF2122/97
ccagcagaucaggu

SEQ ID NO: 1056503 - RNA, 12 nt, Mycobacterium bovis subsp bovis AF2122/97
ccagcagcgcgg

SEQ ID NO: 1056504 - RNA, 22 nt, Mycobacterium bovis subsp bovis AF2122/97
ccagcaggcccuggccacccag

SEQ ID NO: 1056505 - RNA, 19 nt, Mycobacterium bovis subsp bovis AF2122/97
ccagcaggcccuuggcgau

SEQ ID NO: 1056506 - RNA, 13 nt, Mycobacterium bovis subsp bovis AF2122/97
ccagcaggccgaa

SEQ ID NO: 1056507 - RNA, 17 nt, Mycobacterium bovis subsp bovis AF2122/97
ccagcaggccgggacag

SEQ ID NO: 1056508 - RNA, 16 nt, Mycobacterium bovis subsp bovis AF2122/97
ccagcagggccaccac

SEQ ID NO: 1056509 - RNA, 14 nt, Mycobacterium bovis subsp bovis AF2122/97
ccagcaggcggcug

SEQ ID NO: 1056510 - RNA, 18 nt, Mycobacterium bovis subsp bovis AF2122/97
ccagcaguucgccgcgca

SEQ ID NO: 1056511 - RNA, 20 nt, Mycobacterium bovis subsp bovis AF2122/97
ccagcaguucgccgcgcagc

SEQ ID NO: 1056512 - RNA, 19 nt, Mycobacterium bovis subsp bovis AF2122/97
ccagcauuagccaggcccg

SEQ ID NO: 1056513 - RNA, 19 nt, Mycobacterium bovis subsp bovis AF2122/97
ccagcauucucgccgacgg

SEQ ID NO: 1056514 - RNA, 18 nt, Mycobacterium bovis subsp bovis AF2122/97
ccagccaaaacgagcaga

SEQ ID NO: 1056515 - RNA, 19 nt, Mycobacterium bovis subsp bovis AF2122/97
ccagccaaaucagccaggc

SEQ ID NO: 1056516 - RNA, 18 nt, Mycobacterium bovis subsp bovis AF2122/97
ccagccacgaacugaucg

SEQ ID NO: 1056517 - RNA, 20 nt, Mycobacterium bovis subsp bovis AF2122/97
ccagccacgccagccaggcg

SEQ ID NO: 1056518 - RNA, 20 nt, Mycobacterium bovis subsp bovis AF2122/97
ccagccacgcugucccgcgg

SEQ ID NO: 1056519 - RNA, 14 nt, Mycobacterium bovis subsp bovis AF2122/97
ccagccacagcccg

SEQ ID NO: 1056520 - RNA, 18 nt, Mycobacterium bovis subsp bovis AF2122/97
ccagccacagcccggcgg

SEQ ID NO: 1056521 - RNA, 21 nt, Mycobacterium bovis subsp bovis AF2122/97
ccagccaccccugcgguccgc

SEQ ID NO: 1056522 - RNA, 13 nt, Mycobacterium bovis subsp bovis AF2122/97
ccagccaccgacc

SEQ ID NO: 1056523 - RNA, 15 nt, Mycobacterium bovis subsp bovis AF2122/97
ccagccagcgggcga

SEQ ID NO: 1056524 - RNA, 14 nt, Mycobacterium bovis subsp bovis AF2122/97
ccagcccaccggcg

SEQ ID NO: 1056525 - RNA, 13 nt, Mycobacterium bovis subsp bovis AF2122/97
ccagccagcgggu

SEQ ID NO: 1056526 - RNA, 17 nt, Mycobacterium bovis subsp bovis AF2122/97
ccagccaggcgauugcc

SEQ ID NO: 1056527 - RNA, 19 nt, Mycobacterium bovis subsp bovis AF2122/97
ccagcccuucagcguccug

SEQ ID NO: 1056528 - RNA, 23 nt, Mycobacterium bovis subsp bovis AF2122/97
ccagcccguccaggcgcugcagc

SEQ ID NO: 1056529 - RNA, 15 nt, Mycobacterium bovis subsp bovis AF2122/97
ccagcccguccggcc

SEQ ID NO: 1056530 - RNA, 21 nt, Mycobacterium bovis subsp bovis AF2122/97
ccagcccggugauggugccau

SEQ ID NO: 1056531 - RNA, 23 nt, Mycobacterium bovis subsp bovis AF2122/97
ccagcccggucauggucagcaga

SEQ ID NO: 1056532 - RNA, 14 nt, Mycobacterium bovis subsp bovis AF2122/97
ccagcccggcgugc

SEQ ID NO: 1056533 - RNA, 15 nt, Mycobacterium bovis subsp bovis AF2122/97
ccagcccggcgugca

SEQ ID NO: 1056534 - RNA, 23 nt, Mycobacterium bovis subsp bovis AF2122/97
ccagcccggccggucgagacgcu

SEQ ID NO: 1056535 - RNA, 14 nt, Mycobacterium bovis subsp bovis AF2122/97
ccagcccggccgcc

SEQ ID NO: 1056536 - RNA, 13 nt, Mycobacterium bovis subsp bovis AF2122/97
ccagcccggccgc

SEQ ID NO: 1056537 - RNA, 19 nt, Mycobacterium bovis subsp bovis AF2122/97
ccagcccgccgaucgggcu

SEQ ID NO: 1056538 - RNA, 13 nt, Mycobacterium bovis subsp bovis AF2122/97
ccagcccgcccag

SEQ ID NO: 1056539 - RNA, 14 nt, Mycobacterium bovis subsp bovis AF2122/97
ccagccccacccgc

SEQ ID NO: 1056540 - RNA, 15 nt, Mycobacterium bovis subsp bovis AF2122/97
ccagccccacccgca

SEQ ID NO: 1056541 - RNA, 16 nt, Mycobacterium bovis subsp bovis AF2122/97
ccagccccacccgccg

SEQ ID NO: 1056542 - RNA, 22 nt, Mycobacterium bovis subsp bovis AF2122/97
ccagccccacccgccgccgccc

SEQ ID NO: 1056543 - RNA, 21 nt, Mycobacterium bovis subsp bovis AF2122/97
ccagcccaugcgccacgccac

SEQ ID NO: 1056544 - RNA, 19 nt, Mycobacterium bovis subsp bovis AF2122/97
ccagccccgcuggucgacc

SEQ ID NO: 1056545 - RNA, 16 nt, Mycobacterium bovis subsp bovis AF2122/97
ccagccccgcgcccac

SEQ ID NO: 1056546 - RNA, 14 nt, Mycobacterium bovis subsp bovis AF2122/97
ccagccccgacuga

SEQ ID NO: 1056547 - RNA, 16 nt, Mycobacterium bovis subsp bovis AF2122/97
ccagccccccggcgac

SEQ ID NO: 1056548 - RNA, 19 nt, Mycobacterium bovis subsp bovis AF2122/97
ccagccccccggcgacggc

SEQ ID NO: 1056549 - RNA, 18 nt, Mycobacterium bovis subsp bovis AF2122/97
ccacgacccagcauggug

SEQ ID NO: 1056550 - RNA, 16 nt, Mycobacterium bovis subsp bovis AF2122/97
ccacgaccccggcggu

SEQ ID NO: 1056551 - RNA, 20 nt, Mycobacterium bovis subsp bovis AF2122/97
ccacgaccucgggaucggcg

SEQ ID NO: 1056552 - RNA, 17 nt, Mycobacterium bovis subsp bovis AF2122/97
ccacgaaucgcccaucg

SEQ ID NO: 1056553 - RNA, 23 nt, Mycobacterium bovis subsp bovis AF2122/97
ccacgaaugaucgucccgcggcg

SEQ ID NO: 1056554 - RNA, 16 nt, Mycobacterium bovis subsp bovis AF2122/97
ccacgaaugcaagacc

SEQ ID NO: 1056555 - RNA, 21 nt, Mycobacterium bovis subsp bovis AF2122/97
ccaccuuggcguugaccagca

SEQ ID NO: 1056556 - RNA, 20 nt, Mycobacterium bovis subsp bovis AF2122/97
ccaccuuggccagacccacc

SEQ ID NO: 1056557 - RNA, 23 nt, Mycobacterium bovis subsp bovis AF2122/97
ccacgaacgcgcgcagccgggca

SEQ ID NO: 1056558 - RNA, 21 nt, Mycobacterium bovis subsp bovis AF2122/97
ccacgaacccucagccgcgcc

SEQ ID NO: 1056559 - RNA, 23 nt, Mycobacterium bovis subsp bovis AF2122/97
ccacgaacccucagccgcgccgg

SEQ ID NO: 1056560 - RNA, 21 nt, Mycobacterium bovis subsp bovis AF2122/97
ccaccuguuggcaugccgccc

SEQ ID NO: 1056561 - RNA, 22 nt, Mycobacterium bovis subsp bovis AF2122/97
ccaccuguuggcaugccgcccg

SEQ ID NO: 1056562 - RNA, 23 nt, Mycobacterium bovis subsp bovis AF2122/97
ccaccuuagcgcuugccgcugag

SEQ ID NO: 1056563 - RNA, 23 nt, Mycobacterium bovis subsp bovis AF2122/97
ccaccuguucacccacuccgccg

SEQ ID NO: 1056564 - RNA, 22 nt, Mycobacterium bovis subsp bovis AF2122/97
ccaccuucugguccagcaccgg

SEQ ID NO: 1056565 - RNA, 21 nt, Mycobacterium bovis subsp bovis AF2122/97
ccaccuggucgcguccaccca

SEQ ID NO: 1056566 - RNA, 21 nt, Mycobacterium bovis subsp bovis AF2122/97
ccaccuggugcaaccgugccg

SEQ ID NO: 1056567 - RNA, 22 nt, Mycobacterium bovis subsp bovis AF2122/97
ccaccuggugcaaccgugccgc

SEQ ID NO: 1056568 - RNA, 15 nt, Mycobacterium bovis subsp bovis AF2122/97
ccaccugcuggccgu

SEQ ID NO: 1056569 - RNA, 18 nt, Mycobacterium bovis subsp bovis AF2122/97
ccaccugcuggccguaac

SEQ ID NO: 1056570 - RNA, 13 nt, Mycobacterium bovis subsp bovis AF2122/97
ccaccucgacgca

SEQ ID NO: 1056571 - RNA, 21 nt, Mycobacterium bovis subsp bovis AF2122/97
ccaccucggugaccaggccgg

SEQ ID NO: 1056572 - RNA, 14 nt, Mycobacterium bovis subsp bovis AF2122/97
ccaccucggugcgg

SEQ ID NO: 1056573 - RNA, 15 nt, Mycobacterium bovis subsp bovis AF2122/97
ccaccuccgaggccg

SEQ ID NO: 1056574 - RNA, 12 nt, Mycobacterium bovis subsp bovis AF2122/97
ccaccgugccgg

SEQ ID NO: 1056575 - RNA, 22 nt, Mycobacterium bovis subsp bovis AF2122/97
ccaccgugcgguauuugaacgc

SEQ ID NO: 1056576 - RNA, 14 nt, Mycobacterium bovis subsp bovis AF2122/97
ccaccguggcgccc

SEQ ID NO: 1056577 - RNA, 16 nt, Mycobacterium bovis subsp bovis AF2122/97
ccaccguggcgcccgc

SEQ ID NO: 1056578 - RNA, 18 nt, Mycobacterium bovis subsp bovis AF2122/97
ccaccguuugagcggcca

SEQ ID NO: 1056579 - RNA, 19 nt, Mycobacterium bovis subsp bovis AF2122/97
ccaccguuugagcggccac

SEQ ID NO: 1056580 - RNA, 20 nt, Mycobacterium bovis subsp bovis AF2122/97
ccaccguuugagcggccacc

SEQ ID NO: 1056581 - RNA, 20 nt, Mycobacterium bovis subsp bovis AF2122/97
ccaccguuugcgcaccgguc

SEQ ID NO: 1056582 - RNA, 19 nt, Mycobacterium bovis subsp bovis AF2122/97
ccaccgugugcacgcgaug

SEQ ID NO: 1056583 - RNA, 15 nt, Mycobacterium bovis subsp bovis AF2122/97
ccaccguuaccgccg

SEQ ID NO: 1056584 - RNA, 17 nt, Mycobacterium bovis subsp bovis AF2122/97
ccaccguuagccagguc

SEQ ID NO: 1056585 - RNA, 14 nt, Mycobacterium bovis subsp bovis AF2122/97
ccaccgugaccgag

SEQ ID NO: 1056586 - RNA, 22 nt, Mycobacterium bovis subsp bovis AF2122/97
ccaccgugaagcccuggccagc

SEQ ID NO: 1056587 - RNA, 15 nt, Mycobacterium bovis subsp bovis AF2122/97
ccaccgucucgccgc

SEQ ID NO: 1056588 - RNA, 18 nt, Mycobacterium bovis subsp bovis AF2122/97
ccaccgucucgccgcgca

SEQ ID NO: 1056589 - RNA, 15 nt, Mycobacterium bovis subsp bovis AF2122/97
ccaccgucugcuggc

SEQ ID NO: 1056590 - RNA, 18 nt, Mycobacterium bovis subsp bovis AF2122/97
ccaccgucugcuggccgg

SEQ ID NO: 1056591 - RNA, 16 nt, Mycobacterium bovis subsp bovis AF2122/97
ccaccgucuccggcgc

SEQ ID NO: 1056592 - RNA, 19 nt, Mycobacterium bovis subsp bovis AF2122/97
ccaccgucuccggcgccac

SEQ ID NO: 1056593 - RNA, 18 nt, Mycobacterium bovis subsp bovis AF2122/97
ccaccgucacggucgcgg

SEQ ID NO: 1056594 - RNA, 14 nt, Mycobacterium bovis subsp bovis AF2122/97
ccaccgucagcgcg

SEQ ID NO: 1056595 - RNA, 15 nt, Mycobacterium bovis subsp bovis AF2122/97
ccaccgucagcgcga

SEQ ID NO: 1056596 - RNA, 21 nt, Mycobacterium bovis subsp bovis AF2122/97
ccaccaucaccucgcacgaca

SEQ ID NO: 1056597 - RNA, 15 nt, Mycobacterium bovis subsp bovis AF2122/97
ccaccaucaccgccu

SEQ ID NO: 1056598 - RNA, 15 nt, Mycobacterium bovis subsp bovis AF2122/97
ccaccaucgccgccg

SEQ ID NO: 1056599 - RNA, 23 nt, Mycobacterium bovis subsp bovis AF2122/97
ccaccaucgccucggcgcugcgc

SEQ ID NO: 1056600 - RNA, 15 nt, Mycobacterium bovis subsp bovis AF2122/97
ccaccaucguugccg

SEQ ID NO: 1056601 - RNA, 22 nt, Mycobacterium bovis subsp bovis AF2122/97
ccaccaucguugccggugccgc

SEQ ID NO: 1056602 - RNA, 22 nt, Mycobacterium bovis subsp bovis AF2122/97
ccaccaugaucacaccgagcgc

SEQ ID NO: 1056603 - RNA, 19 nt, Mycobacterium bovis subsp bovis AF2122/97
ccaccaucuguuccgugcc

SEQ ID NO: 1056604 - RNA, 22 nt, Mycobacterium bovis subsp bovis AF2122/97
ccaccaucuguuccgugccagc

SEQ ID NO: 1056605 - RNA, 14 nt, Mycobacterium bovis subsp bovis AF2122/97
ccacccaagcucgg

SEQ ID NO: 1056606 - RNA, 22 nt, Mycobacterium bovis subsp bovis AF2122/97
ccaccauucgcgggccgaggcc

SEQ ID NO: 1056607 - RNA, 12 nt, Mycobacterium bovis subsp bovis AF2122/97
ccacgaccgcga

SEQ ID NO: 1056608 - RNA, 16 nt, Mycobacterium bovis subsp bovis AF2122/97
ccacgacgcccaccgu

SEQ ID NO: 1056609 - RNA, 19 nt, Mycobacterium bovis subsp bovis AF2122/97
ccacgacgaacaccagcgc

SEQ ID NO: 1056610 - RNA, 20 nt, Mycobacterium bovis subsp bovis AF2122/97
ccacgacgaacaccagcgcg

SEQ ID NO: 1056611 - RNA, 15 nt, Mycobacterium bovis subsp bovis AF2122/97
ccacgacgucgguga

SEQ ID NO: 1056612 - RNA, 15 nt, Mycobacterium bovis subsp bovis AF2122/97
ccacgagcaucaacg

SEQ ID NO: 1056613 - RNA, 16 nt, Mycobacterium bovis subsp bovis AF2122/97
ccacgauccuuggcgu

SEQ ID NO: 1056614 - RNA, 13 nt, Mycobacterium bovis subsp bovis AF2122/97
ccacgaucgcagu

SEQ ID NO: 1056615 - RNA, 16 nt, Mycobacterium bovis subsp bovis AF2122/97
ccacgaucacccggau

SEQ ID NO: 1056616 - RNA, 22 nt, Mycobacterium bovis subsp bovis AF2122/97
ccacgaucaacucgugcgggca

SEQ ID NO: 1056617 - RNA, 15 nt, Mycobacterium bovis subsp bovis AF2122/97
ccacgagucgcacgu

SEQ ID NO: 1056618 - RNA, 18 nt, Mycobacterium bovis subsp bovis AF2122/97
ccacgaggcaucguccac

SEQ ID NO: 1056619 - RNA, 22 nt, Mycobacterium bovis subsp bovis AF2122/97
ccacgaggcaucguccacgcag

SEQ ID NO: 1056620 - RNA, 17 nt, Mycobacterium bovis subsp bovis AF2122/97
ccacgaggcuugcggca

SEQ ID NO: 1056621 - RNA, 20 nt, Mycobacterium bovis subsp bovis AF2122/97
ccacgagucgcacgugggca

SEQ ID NO: 1056622 - RNA, 14 nt, Mycobacterium bovis subsp bovis AF2122/97
ccacgaguuggcca

SEQ ID NO: 1056623 - RNA, 15 nt, Mycobacterium bovis subsp bovis AF2122/97
ccacgaguuggccaa

SEQ ID NO: 1056624 - RNA, 24 nt, Mycobacterium bovis subsp bovis AF2122/97
ccacgauaaaugcuucgaccgccg

SEQ ID NO: 1056625 - RNA, 16 nt, Mycobacterium bovis subsp bovis AF2122/97
ccacgauaaggucaca

SEQ ID NO: 1056626 - RNA, 17 nt, Mycobacterium bovis subsp bovis AF2122/97
ccacgcacucacuaccg

SEQ ID NO: 1056627 - RNA, 15 nt, Mycobacterium bovis subsp bovis AF2122/97
ccacgcacucacuac

SEQ ID NO: 1056628 - RNA, 13 nt, Mycobacterium bovis subsp bovis AF2122/97
ccacgcaccgccc

SEQ ID NO: 1056629 - RNA, 15 nt, Mycobacterium bovis subsp bovis AF2122/97
ccacgcaccgccccg

SEQ ID NO: 1056630 - RNA, 13 nt, Mycobacterium bovis subsp bovis AF2122/97
ccacgcaccgggu

SEQ ID NO: 1056631 - RNA, 20 nt, Mycobacterium bovis subsp bovis AF2122/97
ccacgcaccgggugcaggug

SEQ ID NO: 1056632 - RNA, 13 nt, Mycobacterium bovis subsp bovis AF2122/97
ccacgcagcacgg

SEQ ID NO: 1056633 - RNA, 14 nt, Mycobacterium bovis subsp bovis AF2122/97
ccacgcagcacggc

SEQ ID NO: 1056634 - RNA, 19 nt, Mycobacterium bovis subsp bovis AF2122/97
ccacgcagaggcggcuggc

SEQ ID NO: 1056635 - RNA, 19 nt, Mycobacterium bovis subsp bovis AF2122/97
ccacgcacaauacggucag

SEQ ID NO: 1056636 - RNA, 19 nt, Mycobacterium bovis subsp bovis AF2122/97
ccacgaugaucuugccgcg

SEQ ID NO: 1056637 - RNA, 13 nt, Mycobacterium bovis subsp bovis AF2122/97
ccacgauggcggc

SEQ ID NO: 1056638 - RNA, 15 nt, Mycobacterium bovis subsp bovis AF2122/97
ccacgauggcggcca

SEQ ID NO: 1056639 - RNA, 14 nt, Mycobacterium bovis subsp bovis AF2122/97
ccacgaucgcgucg

SEQ ID NO: 1056640 - RNA, 16 nt, Mycobacterium bovis subsp bovis AF2122/97
ccacgaucgcgucgga

SEQ ID NO: 1056641 - RNA, 13 nt, Mycobacterium bovis subsp bovis AF2122/97
ccacgaucggccc

SEQ ID NO: 1056642 - RNA, 15 nt, Mycobacterium bovis subsp bovis AF2122/97
ccacgaucggcucac

SEQ ID NO: 1056643 - RNA, 18 nt, Mycobacterium bovis subsp bovis AF2122/97
ccacgccgaggcguucga

SEQ ID NO: 1056644 - RNA, 15 nt, Mycobacterium bovis subsp bovis AF2122/97
ccacgccgaccaucu

SEQ ID NO: 1056645 - RNA, 14 nt, Mycobacterium bovis subsp bovis AF2122/97
ccacgccgaucaac

SEQ ID NO: 1056646 - RNA, 14 nt, Mycobacterium bovis subsp bovis AF2122/97
ccacgccgauggga

SEQ ID NO: 1056647 - RNA, 13 nt, Mycobacterium bovis subsp bovis AF2122/97
ccacgccgacgaa

SEQ ID NO: 1056648 - RNA, 12 nt, Mycobacterium bovis subsp bovis AF2122/97
ccacgccgccgg

SEQ ID NO: 1056649 - RNA, 18 nt, Mycobacterium bovis subsp bovis AF2122/97
ccacgccgccguugccga

SEQ ID NO: 1056650 - RNA, 15 nt, Mycobacterium bovis subsp bovis AF2122/97
ccacgccgccggcgc

SEQ ID NO: 1056651 - RNA, 13 nt, Mycobacterium bovis subsp bovis AF2122/97
ccacgccgccggu

SEQ ID NO: 1056652 - RNA, 12 nt, Mycobacterium bovis subsp bovis AF2122/97
ccacgccggcau

SEQ ID NO: 1056653 - RNA, 18 nt, Mycobacterium bovis subsp bovis AF2122/97
ccacgccggcaucgucga

SEQ ID NO: 1056654 - RNA, 23 nt, Mycobacterium bovis subsp bovis AF2122/97
ccacgccggcaucgucgacgccc

SEQ ID NO: 1056655 - RNA, 12 nt, Mycobacterium bovis subsp bovis AF2122/97
ccacgccgugcu

SEQ ID NO: 1056656 - RNA, 17 nt, Mycobacterium bovis subsp bovis AF2122/97
ccacgccguggcccgcu

SEQ ID NO: 1056657 - RNA, 12 nt, Mycobacterium bovis subsp bovis AF2122/97
ccacgccgggca

SEQ ID NO: 1056658 - RNA, 12 nt, Mycobacterium bovis subsp bovis AF2122/97
ccacgcccggcc

SEQ ID NO: 1056659 - RNA, 21 nt, Mycobacterium bovis subsp bovis AF2122/97
ccacgcccggccccgcggcca

SEQ ID NO: 1056660 - RNA, 23 nt, Mycobacterium bovis subsp bovis AF2122/97
ccacgcccggccccgcggccagc

SEQ ID NO: 1056661 - RNA, 13 nt, Mycobacterium bovis subsp bovis AF2122/97
ccacgcccgacga

SEQ ID NO: 1056662 - RNA, 15 nt, Mycobacterium bovis subsp bovis AF2122/97
ccacgcccgacgcca

SEQ ID NO: 1056663 - RNA, 15 nt, Mycobacterium bovis subsp bovis AF2122/97
ccacgcccagcgccc

SEQ ID NO: 1056664 - RNA, 17 nt, Mycobacterium bovis subsp bovis AF2122/97
ccacgcccaauguccag

SEQ ID NO: 1056665 - RNA, 14 nt, Mycobacterium bovis subsp bovis AF2122/97
ccacgccagcccgu

SEQ ID NO: 1056666 - RNA, 18 nt, Mycobacterium bovis subsp bovis AF2122/97
ccacgccagcccguccgg

SEQ ID NO: 1056667 - RNA, 14 nt, Mycobacterium bovis subsp bovis AF2122/97
ccacgccagagcgg

SEQ ID NO: 1056668 - RNA, 13 nt, Mycobacterium bovis subsp bovis AF2122/97
ccacgccagcucg

SEQ ID NO: 1056669 - RNA, 21 nt, Mycobacterium bovis subsp bovis AF2122/97
ccacgccagcucgccggccgg

SEQ ID NO: 1056670 - RNA, 12 nt, Mycobacterium bovis subsp bovis AF2122/97
ccacgccaccgc

SEQ ID NO: 1056671 - RNA, 16 nt, Mycobacterium bovis subsp bovis AF2122/97
ccagacgccacugcca

SEQ ID NO: 1056672 - RNA, 19 nt, Mycobacterium bovis subsp bovis AF2122/97
ccagacgccacugccagcc

SEQ ID NO: 1056673 - RNA, 17 nt, Mycobacterium bovis subsp bovis AF2122/97
ccagaccgcgcgcauac

SEQ ID NO: 1056674 - RNA, 17 nt, Mycobacterium bovis subsp bovis AF2122/97
ccagaccgccgacgccg

SEQ ID NO: 1056675 - RNA, 12 nt, Mycobacterium bovis subsp bovis AF2122/97
ccagaccgcgcg

SEQ ID NO: 1056676 - RNA, 14 nt, Mycobacterium bovis subsp bovis AF2122/97
ccagaccgcggcgg

SEQ ID NO: 1056677 - RNA, 18 nt, Mycobacterium bovis subsp bovis AF2122/97
ccagaccgcggcggccga

SEQ ID NO: 1056678 - RNA, 13 nt, Mycobacterium bovis subsp bovis AF2122/97
ccagaccggccga

SEQ ID NO: 1056679 - RNA, 14 nt, Mycobacterium bovis subsp bovis AF2122/97
ccagaccggcucgu

SEQ ID NO: 1056680 - RNA, 13 nt, Mycobacterium bovis subsp bovis AF2122/97
ccagaccggcggc

SEQ ID NO: 1056681 - RNA, 15 nt, Mycobacterium bovis subsp bovis AF2122/97
ccagacccaccaccg

SEQ ID NO: 1056682 - RNA, 18 nt, Mycobacterium bovis subsp bovis AF2122/97
ccagaccaccgugaccga

SEQ ID NO: 1056683 - RNA, 20 nt, Mycobacterium bovis subsp bovis AF2122/97
ccagacaucagugcgccggc

SEQ ID NO: 1056684 - RNA, 19 nt, Mycobacterium bovis subsp bovis AF2122/97
ccagacaucagugcgccgg

SEQ ID NO: 1056685 - RNA, 15 nt, Mycobacterium bovis subsp bovis AF2122/97
ccagacacuggccgu

SEQ ID NO: 1056686 - RNA, 19 nt, Mycobacterium bovis subsp bovis AF2122/97
ccagacacuggccgucggc

SEQ ID NO: 1056687 - RNA, 21 nt, Mycobacterium bovis subsp bovis AF2122/97
ccacuggcgccggugccgccg

SEQ ID NO: 1056688 - RNA, 19 nt, Mycobacterium bovis subsp bovis AF2122/97
ccacuggauggcucgccga

SEQ ID NO: 1056689 - RNA, 16 nt, Mycobacterium bovis subsp bovis AF2122/97
ccacugcgccgugacc

SEQ ID NO: 1056690 - RNA, 14 nt, Mycobacterium bovis subsp bovis AF2122/97
ccacugcucgaugu

SEQ ID NO: 1056691 - RNA, 19 nt, Mycobacterium bovis subsp bovis AF2122/97
ccacugcggcauggcaggc

SEQ ID NO: 1056692 - RNA, 21 nt, Mycobacterium bovis subsp bovis AF2122/97
ccacugcggcauggcaggcga

SEQ ID NO: 1056693 - RNA, 12 nt, Mycobacterium bovis subsp bovis AF2122/97
ccacugcgccac

SEQ ID NO: 1056694 - RNA, 13 nt, Mycobacterium bovis subsp bovis AF2122/97
ccagaugcagcgg

SEQ ID NO: 1056695 - RNA, 16 nt, Mycobacterium bovis subsp bovis AF2122/97
ccagaucgucgggcac

SEQ ID NO: 1056696 - RNA, 18 nt, Mycobacterium bovis subsp bovis AF2122/97
ccagaucuugcagugcgc

SEQ ID NO: 1056697 - RNA, 19 nt, Mycobacterium bovis subsp bovis AF2122/97
ccagaucuugcagugcgcc

SEQ ID NO: 1056698 - RNA, 13 nt, Mycobacterium bovis subsp bovis AF2122/97
ccagaucggcgac

SEQ ID NO: 1056699 - RNA, 15 nt, Mycobacterium bovis subsp bovis AF2122/97
ccagaucggucggcc

SEQ ID NO: 1056700 - RNA, 17 nt, Mycobacterium bovis subsp bovis AF2122/97
ccagaucggucggccaa

SEQ ID NO: 1056701 - RNA, 22 nt, Mycobacterium bovis subsp bovis AF2122/97
ccagaucgguugaucggccacg

SEQ ID NO: 1056702 - RNA, 14 nt, Mycobacterium bovis subsp bovis AF2122/97
ccagauccgucagc

SEQ ID NO: 1056703 - RNA, 15 nt, Mycobacterium bovis subsp bovis AF2122/97
ccagauccgcagcgu

SEQ ID NO: 1056704 - RNA, 17 nt, Mycobacterium bovis subsp bovis AF2122/97
ccagaucagcaccgaca

SEQ ID NO: 1056705 - RNA, 22 nt, Mycobacterium bovis subsp bovis AF2122/97
ccagaucaacgcgucgcccgca

SEQ ID NO: 1056706 - RNA, 15 nt, Mycobacterium bovis subsp bovis AF2122/97
ccagauagaucguga

SEQ ID NO: 1056707 - RNA, 15 nt, Mycobacterium bovis subsp bovis AF2122/97
ccagauaccaccgcc

SEQ ID NO: 1056708 - RNA, 16 nt, Mycobacterium bovis subsp bovis AF2122/97
ccagauaccaccgccg

SEQ ID NO: 1056709 - RNA, 18 nt, Mycobacterium bovis subsp bovis AF2122/97
ccagagucgcccgcacac

SEQ ID NO: 1056710 - RNA, 14 nt, Mycobacterium bovis subsp bovis AF2122/97
ccacgcgcccgcac

SEQ ID NO: 1056711 - RNA, 16 nt, Mycobacterium bovis subsp bovis AF2122/97
ccacgcgcccgcacca

SEQ ID NO: 1056712 - RNA, 17 nt, Mycobacterium bovis subsp bovis AF2122/97
ccacgcgcccgcaccac

SEQ ID NO: 1056713 - RNA, 22 nt, Mycobacterium bovis subsp bovis AF2122/97
ccacgcgcccgcaccaccggcc

SEQ ID NO: 1056714 - RNA, 19 nt, Mycobacterium bovis subsp bovis AF2122/97
ccacgcgcacucgacgcca

SEQ ID NO: 1056715 - RNA, 19 nt, Mycobacterium bovis subsp bovis AF2122/97
ccacgccugagccaccaac

SEQ ID NO: 1056716 - RNA, 15 nt, Mycobacterium bovis subsp bovis AF2122/97
ccacgcggaccucga

SEQ ID NO: 1056717 - RNA, 21 nt, Mycobacterium bovis subsp bovis AF2122/97
ccacgcggcggucguugccga

SEQ ID NO: 1056718 - RNA, 20 nt, Mycobacterium bovis subsp bovis AF2122/97
ccacgcgucuucggucgcgg

SEQ ID NO: 1056719 - RNA, 22 nt, Mycobacterium bovis subsp bovis AF2122/97
ccacgguccggcccaccagcgc

SEQ ID NO: 1056720 - RNA, 13 nt, Mycobacterium bovis subsp bovis AF2122/97
ccacggucagcca

SEQ ID NO: 1056721 - RNA, 17 nt, Mycobacterium bovis subsp bovis AF2122/97
ccacggucauugggugu

SEQ ID NO: 1056722 - RNA, 16 nt, Mycobacterium bovis subsp bovis AF2122/97
ccacggcguggucggc

SEQ ID NO: 1056723 - RNA, 19 nt, Mycobacterium bovis subsp bovis AF2122/97
ccacggcgucggccacccg

SEQ ID NO: 1056724 - RNA, 20 nt, Mycobacterium bovis subsp bovis AF2122/97
ccacggcgucggccacccgg

SEQ ID NO: 1056725 - RNA, 22 nt, Mycobacterium bovis subsp bovis AF2122/97
ccacggcgugaaaaacgcccgc

SEQ ID NO: 1056726 - RNA, 19 nt, Mycobacterium bovis subsp bovis AF2122/97
ccacggcguugccgccggc

SEQ ID NO: 1056727 - RNA, 20 nt, Mycobacterium bovis subsp bovis AF2122/97
ccacggcguugccgccggcu

SEQ ID NO: 1056728 - RNA, 15 nt, Mycobacterium bovis subsp bovis AF2122/97
ccacggcgucggcca

SEQ ID NO: 1056729 - RNA, 19 nt, Mycobacterium bovis subsp bovis AF2122/97
ccacggcggugccgugcuc

SEQ ID NO: 1056730 - RNA, 12 nt, Mycobacterium bovis subsp bovis AF2122/97
ccacggcggcca

SEQ ID NO: 1056731 - RNA, 13 nt, Mycobacterium bovis subsp bovis AF2122/97
ccacggcggccac

SEQ ID NO: 1056732 - RNA, 14 nt, Mycobacterium bovis subsp bovis AF2122/97
ccacggcggccacc

SEQ ID NO: 1056733 - RNA, 13 nt, Mycobacterium bovis subsp bovis AF2122/97
ccacggcgggcga

SEQ ID NO: 1056734 - RNA, 21 nt, Mycobacterium bovis subsp bovis AF2122/97
ccacgcguuucgaaccgcacg

SEQ ID NO: 1056735 - RNA, 13 nt, Mycobacterium bovis subsp bovis AF2122/97
ccacggcggcggc

SEQ ID NO: 1056736 - RNA, 17 nt, Mycobacterium bovis subsp bovis AF2122/97
ccacggcgggcgacccg

SEQ ID NO: 1056737 - RNA, 19 nt, Mycobacterium bovis subsp bovis AF2122/97
ccacggcgccuacaccggc

SEQ ID NO: 1056738 - RNA, 21 nt, Mycobacterium bovis subsp bovis AF2122/97
ccacggcgccuacaccggcgc

SEQ ID NO: 1056739 - RNA, 15 nt, Mycobacterium bovis subsp bovis AF2122/97
ccacggcgcguagug

SEQ ID NO: 1056740 - RNA, 19 nt, Mycobacterium bovis subsp bovis AF2122/97
ccacggcgcgcgcgccggc

SEQ ID NO: 1056741 - RNA, 20 nt, Mycobacterium bovis subsp bovis AF2122/97
ccacggugcggugauauccg

SEQ ID NO: 1056742 - RNA, 15 nt, Mycobacterium bovis subsp bovis AF2122/97
ccacgguggagcgcg

SEQ ID NO: 1056743 - RNA, 12 nt, Mycobacterium bovis subsp bovis AF2122/97
ccacgguggcgc

SEQ ID NO: 1056744 - RNA, 13 nt, Mycobacterium bovis subsp bovis AF2122/97
ccacgguggcgca

SEQ ID NO: 1056745 - RNA, 23 nt, Mycobacterium bovis subsp bovis AF2122/97
ccacgguggcgcaagugauuucg

SEQ ID NO: 1056746 - RNA, 13 nt, Mycobacterium bovis subsp bovis AF2122/97
ccacgucgcccag

SEQ ID NO: 1056747 - RNA, 20 nt, Mycobacterium bovis subsp bovis AF2122/97
ccacggugucccgcgaggca

SEQ ID NO: 1056748 - RNA, 15 nt, Mycobacterium bovis subsp bovis AF2122/97
ccacgucgucgccca

SEQ ID NO: 1056749 - RNA, 16 nt, Mycobacterium bovis subsp bovis AF2122/97
ccacgucgucgcccag

SEQ ID NO: 1056750 - RNA, 14 nt, Mycobacterium bovis subsp bovis AF2122/97
ccacgucggcgaac

SEQ ID NO: 1056751 - RNA, 23 nt, Mycobacterium bovis subsp bovis AF2122/97
ccacgucggacagcuuuccgcga

SEQ ID NO: 1056752 - RNA, 15 nt, Mycobacterium bovis subsp bovis AF2122/97
ccacgucgcggcguu

SEQ ID NO: 1056753 - RNA, 18 nt, Mycobacterium bovis subsp bovis AF2122/97
ccacgucuccuucggcga

SEQ ID NO: 1056754 - RNA, 13 nt, Mycobacterium bovis subsp bovis AF2122/97
ccacuccagcgaa

SEQ ID NO: 1056755 - RNA, 21 nt, Mycobacterium bovis subsp bovis AF2122/97
ccacuccagcgaaccgacccg

SEQ ID NO: 1056756 - RNA, 13 nt, Mycobacterium bovis subsp bovis AF2122/97
ccacucagcccga

SEQ ID NO: 1056757 - RNA, 20 nt, Mycobacterium bovis subsp bovis AF2122/97
ccacugccgcgcgcccgccu

SEQ ID NO: 1056758 - RNA, 14 nt, Mycobacterium bovis subsp bovis AF2122/97
ccacugccggcagc

SEQ ID NO: 1056759 - RNA, 17 nt, Mycobacterium bovis subsp bovis AF2122/97
ccacugccggcagcgcc

SEQ ID NO: 1056760 - RNA, 18 nt, Mycobacterium bovis subsp bovis AF2122/97
ccacugccggcagcgccc

SEQ ID NO: 1056761 - RNA, 20 nt, Mycobacterium bovis subsp bovis AF2122/97
ccacugccgugccggugugu

SEQ ID NO: 1056762 - RNA, 16 nt, Mycobacterium bovis subsp bovis AF2122/97
ccacugccguugccgc

SEQ ID NO: 1056763 - RNA, 13 nt, Mycobacterium bovis subsp bovis AF2122/97
ccacuccccagcc

SEQ ID NO: 1056764 - RNA, 13 nt, Mycobacterium bovis subsp bovis AF2122/97
ccacugcccgccg

SEQ ID NO: 1056765 - RNA, 20 nt, Mycobacterium bovis subsp bovis AF2122/97
ccacugccguugccgccggu

SEQ ID NO: 1056766 - RNA, 17 nt, Mycobacterium bovis subsp bovis AF2122/97
ccacguucgcggccaac

SEQ ID NO: 1056767 - RNA, 15 nt, Mycobacterium bovis subsp bovis AF2122/97
ccacguucgcgggcg

SEQ ID NO: 1056768 - RNA, 17 nt, Mycobacterium bovis subsp bovis AF2122/97
ccacguucgcgggcguc

SEQ ID NO: 1056769 - RNA, 24 nt, Mycobacterium bovis subsp bovis AF2122/97
ccacguugcgcauaggcgaucguc

SEQ ID NO: 1056770 - RNA, 18 nt, Mycobacterium bovis subsp bovis AF2122/97
ccacgugaucgacgaccg

SEQ ID NO: 1056771 - RNA, 19 nt, Mycobacterium bovis subsp bovis AF2122/97
ccacguugaugaugccggc

SEQ ID NO: 1056772 - RNA, 15 nt, Mycobacterium bovis subsp bovis AF2122/97
ccacguuggccaggc

SEQ ID NO: 1056773 - RNA, 18 nt, Mycobacterium bovis subsp bovis AF2122/97
ccacguuguccgcgacgu

SEQ ID NO: 1056774 - RNA, 12 nt, Mycobacterium bovis subsp bovis AF2122/97
caucgggaccgg

SEQ ID NO: 1056775 - RNA, 17 nt, Mycobacterium bovis subsp bovis AF2122/97
caucggcuggccgcgcc

SEQ ID NO: 1056776 - RNA, 15 nt, Mycobacterium bovis subsp bovis AF2122/97
caucgggcaccaacc

SEQ ID NO: 1056777 - RNA, 17 nt, Mycobacterium bovis subsp bovis AF2122/97
caucgggccacagcaac

SEQ ID NO: 1056778 - RNA, 18 nt, Mycobacterium bovis subsp bovis AF2122/97
caucgggauggacaccac

SEQ ID NO: 1056779 - RNA, 17 nt, Mycobacterium bovis subsp bovis AF2122/97
caucgggaccggggacg

SEQ ID NO: 1056780 - RNA, 22 nt, Mycobacterium bovis subsp bovis AF2122/97
caucgggaccggggacgcgccc

SEQ ID NO: 1056781 - RNA, 22 nt, Mycobacterium bovis subsp bovis AF2122/97
caucgggacgccuugaucggcg

SEQ ID NO: 1056782 - RNA, 17 nt, Mycobacterium bovis subsp bovis AF2122/97
caucgggagccgcaccc

SEQ ID NO: 1056783 - RNA, 16 nt, Mycobacterium bovis subsp bovis AF2122/97
caucggucaccgcggc

SEQ ID NO: 1056784 - RNA, 15 nt, Mycobacterium bovis subsp bovis AF2122/97
caucggucaaugcca

SEQ ID NO: 1056785 - RNA, 20 nt, Mycobacterium bovis subsp bovis AF2122/97
caucgggucgcugccggcug

SEQ ID NO: 1056786 - RNA, 23 nt, Mycobacterium bovis subsp bovis AF2122/97
caucgguaauagcggaacgggca

SEQ ID NO: 1056787 - RNA, 19 nt, Mycobacterium bovis subsp bovis AF2122/97
caucggucagcgccgacuc

SEQ ID NO: 1056788 - RNA, 15 nt, Mycobacterium bovis subsp bovis AF2122/97
caucggucagcgcgg

SEQ ID NO: 1056789 - RNA, 21 nt, Mycobacterium bovis subsp bovis AF2122/97
caucggugagcccguugaccu

SEQ ID NO: 1056790 - RNA, 17 nt, Mycobacterium bovis subsp bovis AF2122/97
caucggugaucaaaccg

SEQ ID NO: 1056791 - RNA, 19 nt, Mycobacterium bovis subsp bovis AF2122/97
caucggugaucaaaccggc

SEQ ID NO: 1056792 - RNA, 22 nt, Mycobacterium bovis subsp bovis AF2122/97
caucggugaucaaaccggcggc

SEQ ID NO: 1056793 - RNA, 15 nt, Mycobacterium bovis subsp bovis AF2122/97
caucggugaugaguc

SEQ ID NO: 1056794 - RNA, 14 nt, Mycobacterium bovis subsp bovis AF2122/97
caucgggccgccga

SEQ ID NO: 1056795 - RNA, 15 nt, Mycobacterium bovis subsp bovis AF2122/97
caucgggcggcaccg

SEQ ID NO: 1056796 - RNA, 21 nt, Mycobacterium bovis subsp bovis AF2122/97
caucgggcuugcgcagcagcg

SEQ ID NO: 1056797 - RNA, 22 nt, Mycobacterium bovis subsp bovis AF2122/97
caucgggguggccaccagcggc

SEQ ID NO: 1056798 - RNA, 23 nt, Mycobacterium bovis subsp bovis AF2122/97
caucggggcuucaucuggcgccg

SEQ ID NO: 1056799 - RNA, 13 nt, Mycobacterium bovis subsp bovis AF2122/97
caucggguggcga

SEQ ID NO: 1056800 - RNA, 22 nt, Mycobacterium bovis subsp bovis AF2122/97
caucggguucuucaacuccggg

SEQ ID NO: 1056801 - RNA, 15 nt, Mycobacterium bovis subsp bovis AF2122/97
cauccgcgacggcgc

SEQ ID NO: 1056802 - RNA, 16 nt, Mycobacterium bovis subsp bovis AF2122/97
cauccgccgcccccgc

SEQ ID NO: 1056803 - RNA, 16 nt, Mycobacterium bovis subsp bovis AF2122/97
cauccgccccgcccgc

SEQ ID NO: 1056804 - RNA, 18 nt, Mycobacterium bovis subsp bovis AF2122/97
cauccgcgacggcgcccu

SEQ ID NO: 1056805 - RNA, 16 nt, Mycobacterium bovis subsp bovis AF2122/97
cauccggcggcggcca

SEQ ID NO: 1056806 - RNA, 18 nt, Mycobacterium bovis subsp bovis AF2122/97
cauccggcggcggccagg

SEQ ID NO: 1056807 - RNA, 19 nt, Mycobacterium bovis subsp bovis AF2122/97
cauccggcggcggccagga

SEQ ID NO: 1056808 - RNA, 22 nt, Mycobacterium bovis subsp bovis AF2122/97
cauccggucgaugucagccacc

SEQ ID NO: 1056809 - RNA, 19 nt, Mycobacterium bovis subsp bovis AF2122/97
cauccggucggucucggcg

SEQ ID NO: 1056810 - RNA, 20 nt, Mycobacterium bovis subsp bovis AF2122/97
cauccggucggucucggcga

SEQ ID NO: 1056811 - RNA, 17 nt, Mycobacterium bovis subsp bovis AF2122/97
cauccgggccgcggcca

SEQ ID NO: 1056812 - RNA, 19 nt, Mycobacterium bovis subsp bovis AF2122/97
cauccgggccgcggccaca

SEQ ID NO: 1056813 - RNA, 15 nt, Mycobacterium bovis subsp bovis AF2122/97
cauccgguucgccgc

SEQ ID NO: 1056814 - RNA, 17 nt, Mycobacterium bovis subsp bovis AF2122/97
cauccggucucggccga

SEQ ID NO: 1056815 - RNA, 22 nt, Mycobacterium bovis subsp bovis AF2122/97
caucguggcgucgugcgcggcc

SEQ ID NO: 1056816 - RNA, 23 nt, Mycobacterium bovis subsp bovis AF2122/97
caucguggcgucgugcgcggccg

SEQ ID NO: 1056817 - RNA, 23 nt, Mycobacterium bovis subsp bovis AF2122/97
caucguggggaucgaccaugguc

SEQ ID NO: 1056818 - RNA, 12 nt, Mycobacterium bovis subsp bovis AF2122/97
caucgugguaac

SEQ ID NO: 1056819 - RNA, 14 nt, Mycobacterium bovis subsp bovis AF2122/97
caucguggcgucgu

SEQ ID NO: 1056820 - RNA, 19 nt, Mycobacterium bovis subsp bovis AF2122/97
caucguugccggugccgcc

SEQ ID NO: 1056821 - RNA, 20 nt, Mycobacterium bovis subsp bovis AF2122/97
caucguugccggugccgccg

SEQ ID NO: 1056822 - RNA, 23 nt, Mycobacterium bovis subsp bovis AF2122/97
caucguugccggugccgccgcgg

SEQ ID NO: 1056823 - RNA, 19 nt, Mycobacterium bovis subsp bovis AF2122/97
caucguuggccgggcacgc

SEQ ID NO: 1056824 - RNA, 18 nt, Mycobacterium bovis subsp bovis AF2122/97
caucguuuucgccgaucc

SEQ ID NO: 1056825 - RNA, 18 nt, Mycobacterium bovis subsp bovis AF2122/97
caucguugacccggcgau

SEQ ID NO: 1056826 - RNA, 14 nt, Mycobacterium bovis subsp bovis AF2122/97
caucgucggcgggc

SEQ ID NO: 1056827 - RNA, 15 nt, Mycobacterium bovis subsp bovis AF2122/97
caucgucggcgggcg

SEQ ID NO: 1056828 - RNA, 21 nt, Mycobacterium bovis subsp bovis AF2122/97
caucgucggaaugcuggggcc

SEQ ID NO: 1056829 - RNA, 19 nt, Mycobacterium bovis subsp bovis AF2122/97
caucgucgggucaaugcug

SEQ ID NO: 1056830 - RNA, 17 nt, Mycobacterium bovis subsp bovis AF2122/97
caucgugcccgcgucua

SEQ ID NO: 1056831 - RNA, 23 nt, Mycobacterium bovis subsp bovis AF2122/97
caucgucugguggcagcgcaccc

SEQ ID NO: 1056832 - RNA, 14 nt, Mycobacterium bovis subsp bovis AF2122/97
caucgucguggagg

SEQ ID NO: 1056833 - RNA, 22 nt, Mycobacterium bovis subsp bovis AF2122/97
caucgucgccaagcccaggcga

SEQ ID NO: 1056834 - RNA, 14 nt, Mycobacterium bovis subsp bovis AF2122/97
caucgucgccgagc

SEQ ID NO: 1056835 - RNA, 14 nt, Mycobacterium bovis subsp bovis AF2122/97
caucgucgcgacga

SEQ ID NO: 1056836 - RNA, 13 nt, Mycobacterium bovis subsp bovis AF2122/97
caucgucgacgcc

SEQ ID NO: 1056837 - RNA, 22 nt, Mycobacterium bovis subsp bovis AF2122/97
caucgucgagccacagcgucga

SEQ ID NO: 1056838 - RNA, 22 nt, Mycobacterium bovis subsp bovis AF2122/97
caucgucgagcgcggugccgcc

SEQ ID NO: 1056839 - RNA, 22 nt, Mycobacterium bovis subsp bovis AF2122/97
caucgucauccaggggcgcaac

SEQ ID NO: 1056840 - RNA, 12 nt, Mycobacterium bovis subsp bovis AF2122/97
caucgucaucga

SEQ ID NO: 1056841 - RNA, 14 nt, Mycobacterium bovis subsp bovis AF2122/97
caucgucacugcca

SEQ ID NO: 1056842 - RNA, 17 nt, Mycobacterium bovis subsp bovis AF2122/97
caucgucaggaaccacc

SEQ ID NO: 1056843 - RNA, 15 nt, Mycobacterium bovis subsp bovis AF2122/97
caucguaggccggca

SEQ ID NO: 1056844 - RNA, 21 nt, Mycobacterium bovis subsp bovis AF2122/97
caucgguguggcccaacaccg

SEQ ID NO: 1056845 - RNA, 15 nt, Mycobacterium bovis subsp bovis AF2122/97
caucggucagcgccg

SEQ ID NO: 1056846 - RNA, 16 nt, Mycobacterium bovis subsp bovis AF2122/97
caucggucagcgccga

SEQ ID NO: 1056847 - RNA, 23 nt, Mycobacterium bovis subsp bovis AF2122/97
caucggugaugagucaggcgccg

SEQ ID NO: 1056848 - RNA, 19 nt, Mycobacterium bovis subsp bovis AF2122/97
caucggugccacggcaccg

SEQ ID NO: 1056849 - RNA, 20 nt, Mycobacterium bovis subsp bovis AF2122/97
caucggugccacguucgcgg

SEQ ID NO: 1056850 - RNA, 16 nt, Mycobacterium bovis subsp bovis AF2122/97
caucggugcgggcgcc

SEQ ID NO: 1056851 - RNA, 12 nt, Mycobacterium bovis subsp bovis AF2122/97
caucgguggcgc

SEQ ID NO: 1056852 - RNA, 17 nt, Mycobacterium bovis subsp bovis AF2122/97
caucgguggcggccucc

SEQ ID NO: 1056853 - RNA, 20 nt, Mycobacterium bovis subsp bovis AF2122/97
caucggugguaacaccggcg

SEQ ID NO: 1056854 - RNA, 22 nt, Mycobacterium bovis subsp bovis AF2122/97
caucggugguaacaccggcgag

SEQ ID NO: 1056855 - RNA, 21 nt, Mycobacterium bovis subsp bovis AF2122/97
caucggugguggcgucgaugg

SEQ ID NO: 1056856 - RNA, 20 nt, Mycobacterium bovis subsp bovis AF2122/97
caucggugguuagguggcug

SEQ ID NO: 1056857 - RNA, 14 nt, Mycobacterium bovis subsp bovis AF2122/97
caucgguguggccc

SEQ ID NO: 1056858 - RNA, 19 nt, Mycobacterium bovis subsp bovis AF2122/97
caucuggggguagccgccg

SEQ ID NO: 1056859 - RNA, 13 nt, Mycobacterium bovis subsp bovis AF2122/97
caucuggcgcgcc

SEQ ID NO: 1056860 - RNA, 17 nt, Mycobacterium bovis subsp bovis AF2122/97
caucuuuggcggccgca

SEQ ID NO: 1056861 - RNA, 12 nt, Mycobacterium bovis subsp bovis AF2122/97
caucuugccacc

SEQ ID NO: 1056862 - RNA, 13 nt, Mycobacterium bovis subsp bovis AF2122/97
caucuugccaccg

SEQ ID NO: 1056863 - RNA, 14 nt, Mycobacterium bovis subsp bovis AF2122/97
caugaacgaucgga

SEQ ID NO: 1056864 - RNA, 20 nt, Mycobacterium bovis subsp bovis AF2122/97
caugaacgaucggaccacca

SEQ ID NO: 1056865 - RNA, 22 nt, Mycobacterium bovis subsp bovis AF2122/97
caugaagauccagaacgcaucg

SEQ ID NO: 1056866 - RNA, 14 nt, Mycobacterium bovis subsp bovis AF2122/97
caugaagccgggcg

SEQ ID NO: 1056867 - RNA, 15 nt, Mycobacterium bovis subsp bovis AF2122/97
caugaagccgggcgc

SEQ ID NO: 1056868 - RNA, 21 nt, Mycobacterium bovis subsp bovis AF2122/97
caugaagccguugccgccacg

SEQ ID NO: 1056869 - RNA, 16 nt, Mycobacterium bovis subsp bovis AF2122/97
caugaacugcucgccg

SEQ ID NO: 1056870 - RNA, 22 nt, Mycobacterium bovis subsp bovis AF2122/97
caugaaucgcgcuucaggcauc

SEQ ID NO: 1056871 - RNA, 19 nt, Mycobacterium bovis subsp bovis AF2122/97
caugacagccccgccgccc

SEQ ID NO: 1056872 - RNA, 14 nt, Mycobacterium bovis subsp bovis AF2122/97
caucucgucgaucu

SEQ ID NO: 1056873 - RNA, 14 nt, Mycobacterium bovis subsp bovis AF2122/97
caucucgucgaugu

SEQ ID NO: 1056874 - RNA, 16 nt, Mycobacterium bovis subsp bovis AF2122/97
caucucgucgucgcgg

SEQ ID NO: 1056875 - RNA, 19 nt, Mycobacterium bovis subsp bovis AF2122/97
caucucgucgucgcggccg

SEQ ID NO: 1056876 - RNA, 16 nt, Mycobacterium bovis subsp bovis AF2122/97
caucucgggcaggccg

SEQ ID NO: 1056877 - RNA, 16 nt, Mycobacterium bovis subsp bovis AF2122/97
caucucggcgcagccg

SEQ ID NO: 1056878 - RNA, 13 nt, Mycobacterium bovis subsp bovis AF2122/97
caucucgcaccgc

SEQ ID NO: 1056879 - RNA, 14 nt, Mycobacterium bovis subsp bovis AF2122/97
caucucggaccaca

SEQ ID NO: 1056880 - RNA, 13 nt, Mycobacterium bovis subsp bovis AF2122/97
caucucgaaggug

SEQ ID NO: 1056881 - RNA, 14 nt, Mycobacterium bovis subsp bovis AF2122/97
caucuccucggcga

SEQ ID NO: 1056882 - RNA, 16 nt, Mycobacterium bovis subsp bovis AF2122/97
caucuccucggcgaug

SEQ ID NO: 1056883 - RNA, 18 nt, Mycobacterium bovis subsp bovis AF2122/97
caucucccgaccgccgag

SEQ ID NO: 1056884 - RNA, 15 nt, Mycobacterium bovis subsp bovis AF2122/97
caucucgacgucggu

SEQ ID NO: 1056885 - RNA, 15 nt, Mycobacterium bovis subsp bovis AF2122/97
caucucgacggugac

SEQ ID NO: 1056886 - RNA, 16 nt, Mycobacterium bovis subsp bovis AF2122/97
caucucccgaccgccg

SEQ ID NO: 1056887 - RNA, 14 nt, Mycobacterium bovis subsp bovis AF2122/97
caucuccaccgucg

SEQ ID NO: 1056888 - RNA, 18 nt, Mycobacterium bovis subsp bovis AF2122/97
caucuacaucgucgagcg

SEQ ID NO: 1056889 - RNA, 16 nt, Mycobacterium bovis subsp bovis AF2122/97
caucugccggucgaug

SEQ ID NO: 1056890 - RNA, 17 nt, Mycobacterium bovis subsp bovis AF2122/97
caucugccggucgaugu

SEQ ID NO: 1056891 - RNA, 14 nt, Mycobacterium bovis subsp bovis AF2122/97
caucuggccggcgg

SEQ ID NO: 1056892 - RNA, 16 nt, Mycobacterium bovis subsp bovis AF2122/97
caucugcuguggaucg

SEQ ID NO: 1056893 - RNA, 13 nt, Mycobacterium bovis subsp bovis AF2122/97
caucugcgggacg

SEQ ID NO: 1056894 - RNA, 19 nt, Mycobacterium bovis subsp bovis AF2122/97
caucugcgggacgucgucg

SEQ ID NO: 1056895 - RNA, 19 nt, Mycobacterium bovis subsp bovis AF2122/97
caucugaugacggugugga

SEQ ID NO: 1056896 - RNA, 18 nt, Mycobacterium bovis subsp bovis AF2122/97
caucugauccggugccgc

SEQ ID NO: 1056897 - RNA, 19 nt, Mycobacterium bovis subsp bovis AF2122/97
caucugauccggugccgcg

SEQ ID NO: 1056898 - RNA, 12 nt, Mycobacterium bovis subsp bovis AF2122/97
caugauggccgc

SEQ ID NO: 1056899 - RNA, 18 nt, Mycobacterium bovis subsp bovis AF2122/97
caugaugccuaccgggcc

SEQ ID NO: 1056900 - RNA, 17 nt, Mycobacterium bovis subsp bovis AF2122/97
caugaucgcaccgaggu

SEQ ID NO: 1056901 - RNA, 20 nt, Mycobacterium bovis subsp bovis AF2122/97
caugaucgcaccgagguugc

SEQ ID NO: 1056902 - RNA, 13 nt, Mycobacterium bovis subsp bovis AF2122/97
caugaucucggcg

SEQ ID NO: 1056903 - RNA, 20 nt, Mycobacterium bovis subsp bovis AF2122/97
caugauccgcugggccgggg

SEQ ID NO: 1056904 - RNA, 16 nt, Mycobacterium bovis subsp bovis AF2122/97
caugagcuggaaucga

SEQ ID NO: 1056905 - RNA, 14 nt, Mycobacterium bovis subsp bovis AF2122/97
caugaccgcucgga

SEQ ID NO: 1056906 - RNA, 15 nt, Mycobacterium bovis subsp bovis AF2122/97
caugaccgcucggag

SEQ ID NO: 1056907 - RNA, 13 nt, Mycobacterium bovis subsp bovis AF2122/97
caugaccggccgc

SEQ ID NO: 1056908 - RNA, 17 nt, Mycobacterium bovis subsp bovis AF2122/97
caugaccgggcuggcca

SEQ ID NO: 1056909 - RNA, 19 nt, Mycobacterium bovis subsp bovis AF2122/97
caugaguggcaaucccgcc

SEQ ID NO: 1056910 - RNA, 15 nt, Mycobacterium bovis subsp bovis AF2122/97
caugagccgcugcgc

SEQ ID NO: 1056911 - RNA, 22 nt, Mycobacterium bovis subsp bovis AF2122/97
caugccgucggguaggccgccg

SEQ ID NO: 1056912 - RNA, 18 nt, Mycobacterium bovis subsp bovis AF2122/97
caugccgucgucggcgua

SEQ ID NO: 1056913 - RNA, 22 nt, Mycobacterium bovis subsp bovis AF2122/97
caugccgugugugcgauccagg

SEQ ID NO: 1056914 - RNA, 23 nt, Mycobacterium bovis subsp bovis AF2122/97
caugccggucauccgggcgacca

SEQ ID NO: 1056915 - RNA, 12 nt, Mycobacterium bovis subsp bovis AF2122/97
caugccgguguu

SEQ ID NO: 1056916 - RNA, 16 nt, Mycobacterium bovis subsp bovis AF2122/97
caugccgguguugccg

SEQ ID NO: 1056917 - RNA, 14 nt, Mycobacterium bovis subsp bovis AF2122/97
caugccgaccggca

SEQ ID NO: 1056918 - RNA, 15 nt, Mycobacterium bovis subsp bovis AF2122/97
caugccgaccggcac

SEQ ID NO: 1056919 - RNA, 13 nt, Mycobacterium bovis subsp bovis AF2122/97
caugccgacgacg

SEQ ID NO: 1056920 - RNA, 14 nt, Mycobacterium bovis subsp bovis AF2122/97
caugccgagcgacc

SEQ ID NO: 1056921 - RNA, 19 nt, Mycobacterium bovis subsp bovis AF2122/97
caugccauggcccgugcgg

SEQ ID NO: 1056922 - RNA, 18 nt, Mycobacterium bovis subsp bovis AF2122/97
caugcccugcgcucgggc

SEQ ID NO: 1056923 - RNA, 15 nt, Mycobacterium bovis subsp bovis AF2122/97
caugcccuggaccag

SEQ ID NO: 1056924 - RNA, 19 nt, Mycobacterium bovis subsp bovis AF2122/97
caugccauagaugcccgcg

SEQ ID NO: 1056925 - RNA, 23 nt, Mycobacterium bovis subsp bovis AF2122/97
caugccauagaugcccgcgauca

SEQ ID NO: 1056926 - RNA, 18 nt, Mycobacterium bovis subsp bovis AF2122/97
caugccacaacgccucga

SEQ ID NO: 1056927 - RNA, 24 nt, Mycobacterium bovis subsp bovis AF2122/97
caugccacaacgccucgauggcgg

SEQ ID NO: 1056928 - RNA, 21 nt, Mycobacterium bovis subsp bovis AF2122/97
caugcaggaaugggugaucga

SEQ ID NO: 1056929 - RNA, 12 nt, Mycobacterium bovis subsp bovis AF2122/97
cauggcggcccg

SEQ ID NO: 1056930 - RNA, 23 nt, Mycobacterium bovis subsp bovis AF2122/97
cauggcggcagcaacgacgucgu

SEQ ID NO: 1056931 - RNA, 19 nt, Mycobacterium bovis subsp bovis AF2122/97
cauggcggcuccgcccggc

SEQ ID NO: 1056932 - RNA, 18 nt, Mycobacterium bovis subsp bovis AF2122/97
cauggccggccaucgccc

SEQ ID NO: 1056933 - RNA, 20 nt, Mycobacterium bovis subsp bovis AF2122/97
cauggcccgaucgaccgcug

SEQ ID NO: 1056934 - RNA, 13 nt, Mycobacterium bovis subsp bovis AF2122/97
cauggccagcgcu

SEQ ID NO: 1056935 - RNA, 23 nt, Mycobacterium bovis subsp bovis AF2122/97
cauggccagcgcuucgucggccg

SEQ ID NO: 1056936 - RNA, 15 nt, Mycobacterium bovis subsp bovis AF2122/97
cauggcccgcucgua

SEQ ID NO: 1056937 - RNA, 20 nt, Mycobacterium bovis subsp bovis AF2122/97
cauggcccguuggcagcaca

SEQ ID NO: 1056938 - RNA, 14 nt, Mycobacterium bovis subsp bovis AF2122/97
cauggcccuggcga

SEQ ID NO: 1056939 - RNA, 15 nt, Mycobacterium bovis subsp bovis AF2122/97
cauggcccuggcgac

SEQ ID NO: 1056940 - RNA, 17 nt, Mycobacterium bovis subsp bovis AF2122/97
cauggcccuggcgacca

SEQ ID NO: 1056941 - RNA, 12 nt, Mycobacterium bovis subsp bovis AF2122/97
cauggucgcgcc

SEQ ID NO: 1056942 - RNA, 20 nt, Mycobacterium bovis subsp bovis AF2122/97
cauggugaaggcaaacacca

SEQ ID NO: 1056943 - RNA, 15 nt, Mycobacterium bovis subsp bovis AF2122/97
cauggucgagauugg

SEQ ID NO: 1056944 - RNA, 14 nt, Mycobacterium bovis subsp bovis AF2122/97
cauggucaggcggc

SEQ ID NO: 1056945 - RNA, 20 nt, Mycobacterium bovis subsp bovis AF2122/97
cauggucauguucggggcgc

SEQ ID NO: 1056946 - RNA, 21 nt, Mycobacterium bovis subsp bovis AF2122/97
caugguccaagugggccggcg

SEQ ID NO: 1056947 - RNA, 18 nt, Mycobacterium bovis subsp bovis AF2122/97
caugguccacagccggcg

SEQ ID NO: 1056948 - RNA, 14 nt, Mycobacterium bovis subsp bovis AF2122/97
caugguccggccgc

SEQ ID NO: 1056949 - RNA, 15 nt, Mycobacterium bovis subsp bovis AF2122/97
caugguccggccgcg

SEQ ID NO: 1056950 - RNA, 22 nt, Mycobacterium bovis subsp bovis AF2122/97
cauggcguucugcgcccguccg

SEQ ID NO: 1056951 - RNA, 19 nt, Mycobacterium bovis subsp bovis AF2122/97
caugggucgugcaggcgac

SEQ ID NO: 1056952 - RNA, 22 nt, Mycobacterium bovis subsp bovis AF2122/97
caugcgccauaauauugccgcc

SEQ ID NO: 1056953 - RNA, 13 nt, Mycobacterium bovis subsp bovis AF2122/97
caugcgcgcgccg

SEQ ID NO: 1056954 - RNA, 19 nt, Mycobacterium bovis subsp bovis AF2122/97
caugcuggcgaucgcgacg

SEQ ID NO: 1056955 - RNA, 16 nt, Mycobacterium bovis subsp bovis AF2122/97
caugcgauacacggcg

SEQ ID NO: 1056956 - RNA, 17 nt, Mycobacterium bovis subsp bovis AF2122/97
caugcgccaacccggcc

SEQ ID NO: 1056957 - RNA, 17 nt, Mycobacterium bovis subsp bovis AF2122/97
caugcgauucugcgucc

SEQ ID NO: 1056958 - RNA, 19 nt, Mycobacterium bovis subsp bovis AF2122/97
caugcgauucugcguccug

SEQ ID NO: 1056959 - RNA, 15 nt, Mycobacterium bovis subsp bovis AF2122/97
caugcgaccggcaac

SEQ ID NO: 1056960 - RNA, 21 nt, Mycobacterium bovis subsp bovis AF2122/97
caugcgaccggcaacgcggcc

SEQ ID NO: 1056961 - RNA, 16 nt, Mycobacterium bovis subsp bovis AF2122/97
caugcuggucagcggc

SEQ ID NO: 1056962 - RNA, 21 nt, Mycobacterium bovis subsp bovis AF2122/97
cauggcauggcgaacacgucg

SEQ ID NO: 1056963 - RNA, 12 nt, Mycobacterium bovis subsp bovis AF2122/97
cauggcauuccg

SEQ ID NO: 1056964 - RNA, 13 nt, Mycobacterium bovis subsp bovis AF2122/97
cauggcagcggcg

SEQ ID NO: 1056965 - RNA, 15 nt, Mycobacterium bovis subsp bovis AF2122/97
cauggcacugccggc

SEQ ID NO: 1056966 - RNA, 17 nt, Mycobacterium bovis subsp bovis AF2122/97
cauggcacugccggcac

SEQ ID NO: 1056967 - RNA, 21 nt, Mycobacterium bovis subsp bovis AF2122/97
cauggcacugccggcacgccg

SEQ ID NO: 1056968 - RNA, 11 nt, Mycobacterium bovis subsp bovis AF2122/97
ccaccagcacg

SEQ ID NO: 1056969 - RNA, 15 nt, Mycobacterium bovis subsp bovis AF2122/97
ccaccagcaccgccg

SEQ ID NO: 1056970 - RNA, 16 nt, Mycobacterium bovis subsp bovis AF2122/97
ccaccagcaccgccgc

SEQ ID NO: 1056971 - RNA, 12 nt, Mycobacterium bovis subsp bovis AF2122/97
ccaccagaaucc

SEQ ID NO: 1056972 - RNA, 23 nt, Mycobacterium bovis subsp bovis AF2122/97
ccaccacuagcuucgcuugccga

SEQ ID NO: 1056973 - RNA, 22 nt, Mycobacterium bovis subsp bovis AF2122/97
ccaccacuucggcgccgcgccg

SEQ ID NO: 1056974 - RNA, 17 nt, Mycobacterium bovis subsp bovis AF2122/97
ccaccagaaacaccgac

SEQ ID NO: 1056975 - RNA, 19 nt, Mycobacterium bovis subsp bovis AF2122/97
ccaccaagguguggccuug

SEQ ID NO: 1056976 - RNA, 21 nt, Mycobacterium bovis subsp bovis AF2122/97
ccacauuucaccaccguggcc

SEQ ID NO: 1056977 - RNA, 16 nt, Mycobacterium bovis subsp bovis AF2122/97
ccaccaaacgcugcug

SEQ ID NO: 1056978 - RNA, 20 nt, Mycobacterium bovis subsp bovis AF2122/97
ccaccagcgacgaccacacc

SEQ ID NO: 1056979 - RNA, 19 nt, Mycobacterium bovis subsp bovis AF2122/97
ccaccagggcaacggccgc

SEQ ID NO: 1056980 - RNA, 21 nt, Mycobacterium bovis subsp bovis AF2122/97
ccaccagggcacguucggcgc

SEQ ID NO: 1056981 - RNA, 18 nt, Mycobacterium bovis subsp bovis AF2122/97
ccaccaggggaccgcggc

SEQ ID NO: 1056982 - RNA, 20 nt, Mycobacterium bovis subsp bovis AF2122/97
ccaccaggggaccgcggcgc

SEQ ID NO: 1056983 - RNA, 21 nt, Mycobacterium bovis subsp bovis AF2122/97
ccaccagugccccgccgagcg

SEQ ID NO: 1056984 - RNA, 18 nt, Mycobacterium bovis subsp bovis AF2122/97
ccaccaguaccaccggca

SEQ ID NO: 1056985 - RNA, 19 nt, Mycobacterium bovis subsp bovis AF2122/97
ccaccagguacgcgaucag

SEQ ID NO: 1056986 - RNA, 15 nt, Mycobacterium bovis subsp bovis AF2122/97
ccacauccuggcggc

SEQ ID NO: 1056987 - RNA, 20 nt, Mycobacterium bovis subsp bovis AF2122/97
ccacauccuggcggcugcag

SEQ ID NO: 1056988 - RNA, 20 nt, Mycobacterium bovis subsp bovis AF2122/97
ccacaucgaaggugcuggug

SEQ ID NO: 1056989 - RNA, 13 nt, Mycobacterium bovis subsp bovis AF2122/97
ccacaucgccagc

SEQ ID NO: 1056990 - RNA, 22 nt, Mycobacterium bovis subsp bovis AF2122/97
ccacauccagggugccggucac

SEQ ID NO: 1056991 - RNA, 16 nt, Mycobacterium bovis subsp bovis AF2122/97
ccacaucccacggugg

SEQ ID NO: 1056992 - RNA, 18 nt, Mycobacterium bovis subsp bovis AF2122/97
ccacaucaggucggcgaa

SEQ ID NO: 1056993 - RNA, 22 nt, Mycobacterium bovis subsp bovis AF2122/97
ccacaucaccaaaaacccggug

SEQ ID NO: 1056994 - RNA, 17 nt, Mycobacterium bovis subsp bovis AF2122/97
ccacaucaaaacggcgg

SEQ ID NO: 1056995 - RNA, 21 nt, Mycobacterium bovis subsp bovis AF2122/97
ccacaucgguguggcccaaca

SEQ ID NO: 1056996 - RNA, 15 nt, Mycobacterium bovis subsp bovis AF2122/97
ccacauggugaccau

SEQ ID NO: 1056997 - RNA, 14 nt, Mycobacterium bovis subsp bovis AF2122/97
ccacauuccgcagu

SEQ ID NO: 1056998 - RNA, 12 nt, Mycobacterium bovis subsp bovis AF2122/97
ccacaucggugu

SEQ ID NO: 1056999 - RNA, 12 nt, Mycobacterium bovis subsp bovis AF2122/97
ccacaucgggcc

SEQ ID NO: 1057000 - RNA, 14 nt, Mycobacterium bovis subsp bovis AF2122/97
ccacaucgggccgg

SEQ ID NO: 1057001 - RNA, 18 nt, Mycobacterium bovis subsp bovis AF2122/97
ccacaucgucggcgggcg

SEQ ID NO: 1057002 - RNA, 15 nt, Mycobacterium bovis subsp bovis AF2122/97
ccacaucguggcguc

SEQ ID NO: 1057003 - RNA, 14 nt, Mycobacterium bovis subsp bovis AF2122/97
ccacauggcggccc

SEQ ID NO: 1057004 - RNA, 17 nt, Mycobacterium bovis subsp bovis AF2122/97
ccacaugaucgagcagu

SEQ ID NO: 1057005 - RNA, 11 nt, Mycobacterium bovis subsp bovis AF2122/97
ccacacccgcg

SEQ ID NO: 1057006 - RNA, 15 nt, Mycobacterium bovis subsp bovis AF2122/97
ccacacccgcgaacg

SEQ ID NO: 1057007 - RNA, 14 nt, Mycobacterium bovis subsp bovis AF2122/97
ccaauagcacgggc

SEQ ID NO: 1057008 - RNA, 16 nt, Mycobacterium bovis subsp bovis AF2122/97
ccaauaccgcacccgc

SEQ ID NO: 1057009 - RNA, 21 nt, Mycobacterium bovis subsp bovis AF2122/97
ccacaccgccgccaagcucgg

SEQ ID NO: 1057010 - RNA, 15 nt, Mycobacterium bovis subsp bovis AF2122/97
ccacacccagcgugc

SEQ ID NO: 1057011 - RNA, 19 nt, Mycobacterium bovis subsp bovis AF2122/97
ccacacccggcacacccuc

SEQ ID NO: 1057012 - RNA, 14 nt, Mycobacterium bovis subsp bovis AF2122/97
ccacacccgggacg

SEQ ID NO: 1057013 - RNA, 12 nt, Mycobacterium bovis subsp bovis AF2122/97
ccacaccgcggc

SEQ ID NO: 1057014 - RNA, 13 nt, Mycobacterium bovis subsp bovis AF2122/97
ccacaccgcggcg

SEQ ID NO: 1057015 - RNA, 13 nt, Mycobacterium bovis subsp bovis AF2122/97
ccacaccggcagc

SEQ ID NO: 1057016 - RNA, 14 nt, Mycobacterium bovis subsp bovis AF2122/97
ccacaccgugacca

SEQ ID NO: 1057017 - RNA, 19 nt, Mycobacterium bovis subsp bovis AF2122/97
ccacaccgucacgccaccg

SEQ ID NO: 1057018 - RNA, 20 nt, Mycobacterium bovis subsp bovis AF2122/97
ccacaccgugggcgacggcg

SEQ ID NO: 1057019 - RNA, 21 nt, Mycobacterium bovis subsp bovis AF2122/97
ccacaccgugggcgacggcgg

SEQ ID NO: 1057020 - RNA, 22 nt, Mycobacterium bovis subsp bovis AF2122/97
ccacaccgugggcgacggcggc

SEQ ID NO: 1057021 - RNA, 17 nt, Mycobacterium bovis subsp bovis AF2122/97
ccacaccuuggccgccg

SEQ ID NO: 1057022 - RNA, 17 nt, Mycobacterium bovis subsp bovis AF2122/97
ccacaccuuggcggucg

SEQ ID NO: 1057023 - RNA, 18 nt, Mycobacterium bovis subsp bovis AF2122/97
ccacaccuuggcggucgg

SEQ ID NO: 1057024 - RNA, 16 nt, Mycobacterium bovis subsp bovis AF2122/97
ccacacgcccucgacg

SEQ ID NO: 1057025 - RNA, 17 nt, Mycobacterium bovis subsp bovis AF2122/97
ccaagacuucuccgcgu

SEQ ID NO: 1057026 - RNA, 22 nt, Mycobacterium bovis subsp bovis AF2122/97
ccaagacaccggccugcgcgac

SEQ ID NO: 1057027 - RNA, 19 nt, Mycobacterium bovis subsp bovis AF2122/97
ccaagacagccugcgccac

SEQ ID NO: 1057028 - RNA, 17 nt, Mycobacterium bovis subsp bovis AF2122/97
ccaagaaugugggcgac

SEQ ID NO: 1057029 - RNA, 15 nt, Mycobacterium bovis subsp bovis AF2122/97
ccaagagcgcgcagc

SEQ ID NO: 1057030 - RNA, 13 nt, Mycobacterium bovis subsp bovis AF2122/97
ccaagauggcgcg

SEQ ID NO: 1057031 - RNA, 15 nt, Mycobacterium bovis subsp bovis AF2122/97
ccaagauggcgcgcu

SEQ ID NO: 1057032 - RNA, 12 nt, Mycobacterium bovis subsp bovis AF2122/97
ccaagccggcga

SEQ ID NO: 1057033 - RNA, 21 nt, Mycobacterium bovis subsp bovis AF2122/97
ccaagccguaguaguggccgc

SEQ ID NO: 1057034 - RNA, 22 nt, Mycobacterium bovis subsp bovis AF2122/97
ccaagcccaggcgaucgcccgg

SEQ ID NO: 1057035 - RNA, 20 nt, Mycobacterium bovis subsp bovis AF2122/97
ccaagcccgauucagcgccc

SEQ ID NO: 1057036 - RNA, 22 nt, Mycobacterium bovis subsp bovis AF2122/97
ccaagcccgucgucgugcacga

SEQ ID NO: 1057037 - RNA, 18 nt, Mycobacterium bovis subsp bovis AF2122/97
ccaagccauguggcgucg

SEQ ID NO: 1057038 - RNA, 12 nt, Mycobacterium bovis subsp bovis AF2122/97
ccaagcaggcgg

SEQ ID NO: 1057039 - RNA, 16 nt, Mycobacterium bovis subsp bovis AF2122/97
ccaagcagcgaccagc

SEQ ID NO: 1057040 - RNA, 17 nt, Mycobacterium bovis subsp bovis AF2122/97
ccaagcagcgaccagca

SEQ ID NO: 1057041 - RNA, 19 nt, Mycobacterium bovis subsp bovis AF2122/97
ccaacugcgccguucgcuc

SEQ ID NO: 1057042 - RNA, 14 nt, Mycobacterium bovis subsp bovis AF2122/97
ccaacuggccgcgu

SEQ ID NO: 1057043 - RNA, 17 nt, Mycobacterium bovis subsp bovis AF2122/97
ccaacuggccgcgucgc

SEQ ID NO: 1057044 - RNA, 14 nt, Mycobacterium bovis subsp bovis AF2122/97
ccaagaaccacgac

SEQ ID NO: 1057045 - RNA, 20 nt, Mycobacterium bovis subsp bovis AF2122/97
ccaagaacggaugccggucg

SEQ ID NO: 1057046 - RNA, 14 nt, Mycobacterium bovis subsp bovis AF2122/97
ccaacuuggcggcc

SEQ ID NO: 1057047 - RNA, 17 nt, Mycobacterium bovis subsp bovis AF2122/97
ccaacuuggcggccagc

SEQ ID NO: 1057048 - RNA, 15 nt, Mycobacterium bovis subsp bovis AF2122/97
ccaagaaggacauca

SEQ ID NO: 1057049 - RNA, 16 nt, Mycobacterium bovis subsp bovis AF2122/97
ccaagaaggacaucac

SEQ ID NO: 1057050 - RNA, 13 nt, Mycobacterium bovis subsp bovis AF2122/97
ccaacugggccga

SEQ ID NO: 1057051 - RNA, 20 nt, Mycobacterium bovis subsp bovis AF2122/97
ccaacugggccgagcgcgcc

SEQ ID NO: 1057052 - RNA, 14 nt, Mycobacterium bovis subsp bovis AF2122/97
ccaacuggucgcca

SEQ ID NO: 1057053 - RNA, 23 nt, Mycobacterium bovis subsp bovis AF2122/97
ccaacuucugcacgaacgccugc

SEQ ID NO: 1057054 - RNA, 22 nt, Mycobacterium bovis subsp bovis AF2122/97
ccaagcggguuguggcacccgg

SEQ ID NO: 1057055 - RNA, 15 nt, Mycobacterium bovis subsp bovis AF2122/97
ccaagcgugccugca

SEQ ID NO: 1057056 - RNA, 18 nt, Mycobacterium bovis subsp bovis AF2122/97
ccaagcgugcugccgccu

SEQ ID NO: 1057057 - RNA, 12 nt, Mycobacterium bovis subsp bovis AF2122/97
ccaagguggcgg

SEQ ID NO: 1057058 - RNA, 13 nt, Mycobacterium bovis subsp bovis AF2122/97
ccaagguggcggc

SEQ ID NO: 1057059 - RNA, 22 nt, Mycobacterium bovis subsp bovis AF2122/97
ccaagcgcagccuggucgcgca

SEQ ID NO: 1057060 - RNA, 15 nt, Mycobacterium bovis subsp bovis AF2122/97
ccaagccgccggcgc

SEQ ID NO: 1057061 - RNA, 16 nt, Mycobacterium bovis subsp bovis AF2122/97
ccaagccguggccgga

SEQ ID NO: 1057062 - RNA, 19 nt, Mycobacterium bovis subsp bovis AF2122/97
ccaagcgacucgccggcga

SEQ ID NO: 1057063 - RNA, 19 nt, Mycobacterium bovis subsp bovis AF2122/97
ccaagcgagcggucgacgu

SEQ ID NO: 1057064 - RNA, 22 nt, Mycobacterium bovis subsp bovis AF2122/97
ccaagguguccagcaccugccg

SEQ ID NO: 1057065 - RNA, 21 nt, Mycobacterium bovis subsp bovis AF2122/97
ccaaguagucggguuuggccg

SEQ ID NO: 1057066 - RNA, 14 nt, Mycobacterium bovis subsp bovis AF2122/97
ccaagucgccgagg

SEQ ID NO: 1057067 - RNA, 19 nt, Mycobacterium bovis subsp bovis AF2122/97
ccaagugagcgaucgggug

SEQ ID NO: 1057068 - RNA, 17 nt, Mycobacterium bovis subsp bovis AF2122/97
ccaaguugcagcgggcc

SEQ ID NO: 1057069 - RNA, 15 nt, Mycobacterium bovis subsp bovis AF2122/97
ccaacgcggugacga

SEQ ID NO: 1057070 - RNA, 19 nt, Mycobacterium bovis subsp bovis AF2122/97
ccaacgcgggugccgggca

SEQ ID NO: 1057071 - RNA, 19 nt, Mycobacterium bovis subsp bovis AF2122/97
ccaacgcgauguccaggug

SEQ ID NO: 1057072 - RNA, 23 nt, Mycobacterium bovis subsp bovis AF2122/97
ccaacgcgcaccuggcgcgcgca

SEQ ID NO: 1057073 - RNA, 21 nt, Mycobacterium bovis subsp bovis AF2122/97
ccaacgaacgugccccggcgg

SEQ ID NO: 1057074 - RNA, 23 nt, Mycobacterium bovis subsp bovis AF2122/97
ccaacgcuucugccugcgcacga

SEQ ID NO: 1057075 - RNA, 24 nt, Mycobacterium bovis subsp bovis AF2122/97
ccaacgcuucugccugcgcacgac

SEQ ID NO: 1057076 - RNA, 22 nt, Mycobacterium bovis subsp bovis AF2122/97
ccaacgcgucccgccgcaccgc

SEQ ID NO: 1057077 - RNA, 21 nt, Mycobacterium bovis subsp bovis AF2122/97
ccaacgcgucccgccgcaccg

SEQ ID NO: 1057078 - RNA, 16 nt, Mycobacterium bovis subsp bovis AF2122/97
ccaacgcggugacgau

SEQ ID NO: 1057079 - RNA, 22 nt, Mycobacterium bovis subsp bovis AF2122/97
ccaacgccuugacugaacucaa

SEQ ID NO: 1057080 - RNA, 13 nt, Mycobacterium bovis subsp bovis AF2122/97
ccaacgccaccgu

SEQ ID NO: 1057081 - RNA, 15 nt, Mycobacterium bovis subsp bovis AF2122/97
ccaacgccaccgucg

SEQ ID NO: 1057082 - RNA, 14 nt, Mycobacterium bovis subsp bovis AF2122/97
ccaacgccacggca

SEQ ID NO: 1057083 - RNA, 14 nt, Mycobacterium bovis subsp bovis AF2122/97
ccaacgccagcggg

SEQ ID NO: 1057084 - RNA, 18 nt, Mycobacterium bovis subsp bovis AF2122/97
ccaacgcccgggcgaauc

SEQ ID NO: 1057085 - RNA, 19 nt, Mycobacterium bovis subsp bovis AF2122/97
ccaacgagaugugagcaca

SEQ ID NO: 1057086 - RNA, 16 nt, Mycobacterium bovis subsp bovis AF2122/97
ccaacgcacacaccgu

SEQ ID NO: 1057087 - RNA, 13 nt, Mycobacterium bovis subsp bovis AF2122/97
ccaacucggcgac

SEQ ID NO: 1057088 - RNA, 12 nt, Mycobacterium bovis subsp bovis AF2122/97
ccaacucggccc

SEQ ID NO: 1057089 - RNA, 16 nt, Mycobacterium bovis subsp bovis AF2122/97
ccaacucggcccgggu

SEQ ID NO: 1057090 - RNA, 23 nt, Mycobacterium bovis subsp bovis AF2122/97
ccaacucgacgugcacggucaac

SEQ ID NO: 1057091 - RNA, 13 nt, Mycobacterium bovis subsp bovis AF2122/97
ccaacucccgcgg

SEQ ID NO: 1057092 - RNA, 16 nt, Mycobacterium bovis subsp bovis AF2122/97
ccaacguugcgccagc

SEQ ID NO: 1057093 - RNA, 17 nt, Mycobacterium bovis subsp bovis AF2122/97
ccaacuccagcacccgc

SEQ ID NO: 1057094 - RNA, 17 nt, Mycobacterium bovis subsp bovis AF2122/97
ccaacggcuccgggcgc

SEQ ID NO: 1057095 - RNA, 15 nt, Mycobacterium bovis subsp bovis AF2122/97
ccaacggcgcugccg

SEQ ID NO: 1057096 - RNA, 17 nt, Mycobacterium bovis subsp bovis AF2122/97
ccaacgggaacaacggc

SEQ ID NO: 1057097 - RNA, 21 nt, Mycobacterium bovis subsp bovis AF2122/97
ccaacggugggugggcgccgc

SEQ ID NO: 1057098 - RNA, 20 nt, Mycobacterium bovis subsp bovis AF2122/97
ccaacgucgacuucagcggc

SEQ ID NO: 1057099 - RNA, 22 nt, Mycobacterium bovis subsp bovis AF2122/97
ccaacgucgauguccccggcgg

SEQ ID NO: 1057100 - RNA, 17 nt, Mycobacterium bovis subsp bovis AF2122/97
ccaacgggcugccccuc

SEQ ID NO: 1057101 - RNA, 21 nt, Mycobacterium bovis subsp bovis AF2122/97
caugucacacccacacccagc

SEQ ID NO: 1057102 - RNA, 17 nt, Mycobacterium bovis subsp bovis AF2122/97
cauguccguccgcgaca

SEQ ID NO: 1057103 - RNA, 16 nt, Mycobacterium bovis subsp bovis AF2122/97
cauguccguccgcgac

SEQ ID NO: 1057104 - RNA, 16 nt, Mycobacterium bovis subsp bovis AF2122/97
cauguccauagccggc

SEQ ID NO: 1057105 - RNA, 17 nt, Mycobacterium bovis subsp bovis AF2122/97
caugucgaucagcgcga

SEQ ID NO: 1057106 - RNA, 17 nt, Mycobacterium bovis subsp bovis AF2122/97
cauguccugggccgccg

SEQ ID NO: 1057107 - RNA, 21 nt, Mycobacterium bovis subsp bovis AF2122/97
caugucgaagaaccggccgac

SEQ ID NO: 1057108 - RNA, 22 nt, Mycobacterium bovis subsp bovis AF2122/97
caugucgaagaaccggccgacg

SEQ ID NO: 1057109 - RNA, 20 nt, Mycobacterium bovis subsp bovis AF2122/97
caugucgccgaacgccacca

SEQ ID NO: 1057110 - RNA, 20 nt, Mycobacterium bovis subsp bovis AF2122/97
cauucccggacccaccaauc

SEQ ID NO: 1057111 - RNA, 13 nt, Mycobacterium bovis subsp bovis AF2122/97
cauucccagaggc

SEQ ID NO: 1057112 - RNA, 16 nt, Mycobacterium bovis subsp bovis AF2122/97
cauucguccgcggucu

SEQ ID NO: 1057113 - RNA, 22 nt, Mycobacterium bovis subsp bovis AF2122/97
cauucgucgguaccguccucga

SEQ ID NO: 1057114 - RNA, 14 nt, Mycobacterium bovis subsp bovis AF2122/97
cauuggcgccgccg

SEQ ID NO: 1057115 - RNA, 20 nt, Mycobacterium bovis subsp bovis AF2122/97
cauuggccuaggacaccggc

SEQ ID NO: 1057116 - RNA, 21 nt, Mycobacterium bovis subsp bovis AF2122/97
cauuggccuaggacaccggca

SEQ ID NO: 1057117 - RNA, 22 nt, Mycobacterium bovis subsp bovis AF2122/97
cauuggccuaggacaccggcac

SEQ ID NO: 1057118 - RNA, 16 nt, Mycobacterium bovis subsp bovis AF2122/97
cauuggccaggucggc

SEQ ID NO: 1057119 - RNA, 18 nt, Mycobacterium bovis subsp bovis AF2122/97
cauuggccagguggcgag

SEQ ID NO: 1057120 - RNA, 19 nt, Mycobacterium bovis subsp bovis AF2122/97
cauugguaccggcuucguc

SEQ ID NO: 1057121 - RNA, 22 nt, Mycobacterium bovis subsp bovis AF2122/97
cauugguaccggcuucgucggc

SEQ ID NO: 1057122 - RNA, 18 nt, Mycobacterium bovis subsp bovis AF2122/97
cauuggguaaccagcgcc

SEQ ID NO: 1057123 - RNA, 21 nt, Mycobacterium bovis subsp bovis AF2122/97
cauuggcggugcgcaccaccg

SEQ ID NO: 1057124 - RNA, 22 nt, Mycobacterium bovis subsp bovis AF2122/97
cauugccugggcgaccggcucg

SEQ ID NO: 1057125 - RNA, 14 nt, Mycobacterium bovis subsp bovis AF2122/97
cauugcggcccgcg

SEQ ID NO: 1057126 - RNA, 19 nt, Mycobacterium bovis subsp bovis AF2122/97
cauugcuagguucgcgacg

SEQ ID NO: 1057127 - RNA, 20 nt, Mycobacterium bovis subsp bovis AF2122/97
cauugccucccgcgccggcg

SEQ ID NO: 1057128 - RNA, 20 nt, Mycobacterium bovis subsp bovis AF2122/97
cauuggcaggcauggcgccg

SEQ ID NO: 1057129 - RNA, 14 nt, Mycobacterium bovis subsp bovis AF2122/97
cauugcccgagccc

SEQ ID NO: 1057130 - RNA, 11 nt, Mycobacterium bovis subsp bovis AF2122/97
cauugcccuug

SEQ ID NO: 1057131 - RNA, 15 nt, Mycobacterium bovis subsp bovis AF2122/97
cauugccgaugguca

SEQ ID NO: 1057132 - RNA, 14 nt, Mycobacterium bovis subsp bovis AF2122/97
cauugccgccggcg

SEQ ID NO: 1057133 - RNA, 20 nt, Mycobacterium bovis subsp bovis AF2122/97
cauugccgccggcgccgccg

SEQ ID NO: 1057134 - RNA, 14 nt, Mycobacterium bovis subsp bovis AF2122/97
cauugccgccgucg

SEQ ID NO: 1057135 - RNA, 13 nt, Mycobacterium bovis subsp bovis AF2122/97
cauugccgccguu

SEQ ID NO: 1057136 - RNA, 19 nt, Mycobacterium bovis subsp bovis AF2122/97
cauugccgccguugccgcc

SEQ ID NO: 1057137 - RNA, 15 nt, Mycobacterium bovis subsp bovis AF2122/97
cauugccggccacca

SEQ ID NO: 1057138 - RNA, 14 nt, Mycobacterium bovis subsp bovis AF2122/97
cauugccggcgacg

SEQ ID NO: 1057139 - RNA, 14 nt, Mycobacterium bovis subsp bovis AF2122/97
cauugccgacccgu

SEQ ID NO: 1057140 - RNA, 20 nt, Mycobacterium bovis subsp bovis AF2122/97
cauugccgacgcgcggccag

SEQ ID NO: 1057141 - RNA, 23 nt, Mycobacterium bovis subsp bovis AF2122/97
cauugccguccgguggaccgccg

SEQ ID NO: 1057142 - RNA, 16 nt, Mycobacterium bovis subsp bovis AF2122/97
cauugccguucucguc

SEQ ID NO: 1057143 - RNA, 18 nt, Mycobacterium bovis subsp bovis AF2122/97
cauugccguucucgucga

SEQ ID NO: 1057144 - RNA, 21 nt, Mycobacterium bovis subsp bovis AF2122/97
cauugccguucucgucgagga

SEQ ID NO: 1057145 - RNA, 23 nt, Mycobacterium bovis subsp bovis AF2122/97
cauugccauacagcaccccgccg

SEQ ID NO: 1057146 - RNA, 20 nt, Mycobacterium bovis subsp bovis AF2122/97
cauugguguccaccaccggc

SEQ ID NO: 1057147 - RNA, 22 nt, Mycobacterium bovis subsp bovis AF2122/97
cauugguguccaccaccggcac

SEQ ID NO: 1057148 - RNA, 11 nt, Mycobacterium bovis subsp bovis AF2122/97
cauuggugagg

SEQ ID NO: 1057149 - RNA, 13 nt, Mycobacterium bovis subsp bovis AF2122/97
cauugugcucgcc

SEQ ID NO: 1057150 - RNA, 14 nt, Mycobacterium bovis subsp bovis AF2122/97
cauugugcucgccg

SEQ ID NO: 1057151 - RNA, 17 nt, Mycobacterium bovis subsp bovis AF2122/97
ccaaacccaugucggcg

SEQ ID NO: 1057152 - RNA, 17 nt, Mycobacterium bovis subsp bovis AF2122/97
ccaaacccggcgggccc

SEQ ID NO: 1057153 - RNA, 16 nt, Mycobacterium bovis subsp bovis AF2122/97
ccaaaccgacgcgggc

SEQ ID NO: 1057154 - RNA, 18 nt, Mycobacterium bovis subsp bovis AF2122/97
ccaaacgcugcgcccgga

SEQ ID NO: 1057155 - RNA, 19 nt, Mycobacterium bovis subsp bovis AF2122/97
ccaaaauuuugucggccgc

SEQ ID NO: 1057156 - RNA, 19 nt, Mycobacterium bovis subsp bovis AF2122/97
ccaacgacagcgacggucc

SEQ ID NO: 1057157 - RNA, 16 nt, Mycobacterium bovis subsp bovis AF2122/97
ccaacgaccaccacca

SEQ ID NO: 1057158 - RNA, 15 nt, Mycobacterium bovis subsp bovis AF2122/97
ccaacgacuguggcg

SEQ ID NO: 1057159 - RNA, 19 nt, Mycobacterium bovis subsp bovis AF2122/97
ccaacgacuguggcgccgc

SEQ ID NO: 1057160 - RNA, 21 nt, Mycobacterium bovis subsp bovis AF2122/97
ccaacgacuguggcgccgccg

SEQ ID NO: 1057161 - RNA, 22 nt, Mycobacterium bovis subsp bovis AF2122/97
ccaacgacuguggcgccgccgg

SEQ ID NO: 1057162 - RNA, 23 nt, Mycobacterium bovis subsp bovis AF2122/97
ccaacgacuguggcgccgccggc

SEQ ID NO: 1057163 - RNA, 16 nt, Mycobacterium bovis subsp bovis AF2122/97
ccaacgacagcgacgg

SEQ ID NO: 1057164 - RNA, 16 nt, Mycobacterium bovis subsp bovis AF2122/97
ccaaccgggccggcua

SEQ ID NO: 1057165 - RNA, 16 nt, Mycobacterium bovis subsp bovis AF2122/97
ccaaccggucacgucg

SEQ ID NO: 1057166 - RNA, 20 nt, Mycobacterium bovis subsp bovis AF2122/97
ccaaccggucacgucgauga

SEQ ID NO: 1057167 - RNA, 14 nt, Mycobacterium bovis subsp bovis AF2122/97
ccaaccgguggccg

SEQ ID NO: 1057168 - RNA, 17 nt, Mycobacterium bovis subsp bovis AF2122/97
ccaaccgguucgucgaa

SEQ ID NO: 1057169 - RNA, 15 nt, Mycobacterium bovis subsp bovis AF2122/97
ccaaccucaucgcgg

SEQ ID NO: 1057170 - RNA, 18 nt, Mycobacterium bovis subsp bovis AF2122/97
ccaaccugaagccagcgc

SEQ ID NO: 1057171 - RNA, 14 nt, Mycobacterium bovis subsp bovis AF2122/97
ccaaccgccggcca

SEQ ID NO: 1057172 - RNA, 13 nt, Mycobacterium bovis subsp bovis AF2122/97
ccaaccgcgccac

SEQ ID NO: 1057173 - RNA, 12 nt, Mycobacterium bovis subsp bovis AF2122/97
ccaaccgcgcga

SEQ ID NO: 1057174 - RNA, 16 nt, Mycobacterium bovis subsp bovis AF2122/97
ccaaccgcgcgagccu

SEQ ID NO: 1057175 - RNA, 19 nt, Mycobacterium bovis subsp bovis AF2122/97
ccaaccgcgugcgucagcg

SEQ ID NO: 1057176 - RNA, 12 nt, Mycobacterium bovis subsp bovis AF2122/97
ccaacccggcgg

SEQ ID NO: 1057177 - RNA, 15 nt, Mycobacterium bovis subsp bovis AF2122/97
ccaacccugcggcgu

SEQ ID NO: 1057178 - RNA, 16 nt, Mycobacterium bovis subsp bovis AF2122/97
ccaacccugcggcguc

SEQ ID NO: 1057179 - RNA, 12 nt, Mycobacterium bovis subsp bovis AF2122/97
ccaacccucgcc

SEQ ID NO: 1057180 - RNA, 19 nt, Mycobacterium bovis subsp bovis AF2122/97
ccaacccucgccggucagc

SEQ ID NO: 1057181 - RNA, 15 nt, Mycobacterium bovis subsp bovis AF2122/97
ccaaagcgacgagca

SEQ ID NO: 1057182 - RNA, 13 nt, Mycobacterium bovis subsp bovis AF2122/97
ccaaagacccggc

SEQ ID NO: 1057183 - RNA, 19 nt, Mycobacterium bovis subsp bovis AF2122/97
ccaaagccgggauugccgc

SEQ ID NO: 1057184 - RNA, 16 nt, Mycobacterium bovis subsp bovis AF2122/97
ccaaagccgugccagc

SEQ ID NO: 1057185 - RNA, 18 nt, Mycobacterium bovis subsp bovis AF2122/97
ccaaagcgacgagcagca

SEQ ID NO: 1057186 - RNA, 18 nt, Mycobacterium bovis subsp bovis AF2122/97
ccaaaggacgacaccgcg

SEQ ID NO: 1057187 - RNA, 21 nt, Mycobacterium bovis subsp bovis AF2122/97
ccaaaggacgacaccgcgaau

SEQ ID NO: 1057188 - RNA, 13 nt, Mycobacterium bovis subsp bovis AF2122/97
ccaaccccgccgg

SEQ ID NO: 1057189 - RNA, 16 nt, Mycobacterium bovis subsp bovis AF2122/97
ccaaaucggcaucggc

SEQ ID NO: 1057190 - RNA, 15 nt, Mycobacterium bovis subsp bovis AF2122/97
ccaaaucccagagca

SEQ ID NO: 1057191 - RNA, 14 nt, Mycobacterium bovis subsp bovis AF2122/97
ccaaauccggugcc

SEQ ID NO: 1057192 - RNA, 17 nt, Mycobacterium bovis subsp bovis AF2122/97
ccaaauccuucggcgug

SEQ ID NO: 1057193 - RNA, 14 nt, Mycobacterium bovis subsp bovis AF2122/97
cccgucgaccucca

SEQ ID NO: 1057194 - RNA, 19 nt, Mycobacterium bovis subsp bovis AF2122/97
cccgucgaccuccaccaau

SEQ ID NO: 1057195 - RNA, 16 nt, Mycobacterium bovis subsp bovis AF2122/97
cccgucgacgagcgcc

SEQ ID NO: 1057196 - RNA, 23 nt, Mycobacterium bovis subsp bovis AF2122/97
cccgucgaacgcgcgcguggucg

SEQ ID NO: 1057197 - RNA, 18 nt, Mycobacterium bovis subsp bovis AF2122/97
cccgucgagccgugccuc

SEQ ID NO: 1057198 - RNA, 12 nt, Mycobacterium bovis subsp bovis AF2122/97
cccgucgagccg

SEQ ID NO: 1057199 - RNA, 21 nt, Mycobacterium bovis subsp bovis AF2122/97
cccgucgaucagaacgugacg

SEQ ID NO: 1057200 - RNA, 13 nt, Mycobacterium bovis subsp bovis AF2122/97
cccgucgccaccg

SEQ ID NO: 1057201 - RNA, 14 nt, Mycobacterium bovis subsp bovis AF2122/97
cccgucgccagggc

SEQ ID NO: 1057202 - RNA, 16 nt, Mycobacterium bovis subsp bovis AF2122/97
cccgucgccgaucaac

SEQ ID NO: 1057203 - RNA, 23 nt, Mycobacterium bovis subsp bovis AF2122/97
cccgucgccgaucaacagcaccg

SEQ ID NO: 1057204 - RNA, 11 nt, Mycobacterium bovis subsp bovis AF2122/97
cccgucgccgc

SEQ ID NO: 1057205 - RNA, 12 nt, Mycobacterium bovis subsp bovis AF2122/97
cccgucgccgcc

SEQ ID NO: 1057206 - RNA, 13 nt, Mycobacterium bovis subsp bovis AF2122/97
cccgucgccgccc

SEQ ID NO: 1057207 - RNA, 13 nt, Mycobacterium bovis subsp bovis AF2122/97
cccgucgugaccg

SEQ ID NO: 1057208 - RNA, 19 nt, Mycobacterium bovis subsp bovis AF2122/97
cccgucgggcacaccgacg

SEQ ID NO: 1057209 - RNA, 20 nt, Mycobacterium bovis subsp bovis AF2122/97
cccgucgggcacaccgacgc

SEQ ID NO: 1057210 - RNA, 22 nt, Mycobacterium bovis subsp bovis AF2122/97
cccgucgggcacaccgacgccg

SEQ ID NO: 1057211 - RNA, 20 nt, Mycobacterium bovis subsp bovis AF2122/97
cccgucgugaccgaccgcca

SEQ ID NO: 1057212 - RNA, 16 nt, Mycobacterium bovis subsp bovis AF2122/97
cccgucggcguggcug

SEQ ID NO: 1057213 - RNA, 15 nt, Mycobacterium bovis subsp bovis AF2122/97
cccgucggcgccgaa

SEQ ID NO: 1057214 - RNA, 13 nt, Mycobacterium bovis subsp bovis AF2122/97
cccgucggcggcg

SEQ ID NO: 1057215 - RNA, 15 nt, Mycobacterium bovis subsp bovis AF2122/97
cccgucgcggccggc

SEQ ID NO: 1057216 - RNA, 19 nt, Mycobacterium bovis subsp bovis AF2122/97
cccgucgcggccggcggcc

SEQ ID NO: 1057217 - RNA, 14 nt, Mycobacterium bovis subsp bovis AF2122/97
cccgucgcuggccg

SEQ ID NO: 1057218 - RNA, 12 nt, Mycobacterium bovis subsp bovis AF2122/97
cccgucggcgcc

SEQ ID NO: 1057219 - RNA, 23 nt, Mycobacterium bovis subsp bovis AF2122/97
cccgucgucggcaaccaaccgcg

SEQ ID NO: 1057220 - RNA, 14 nt, Mycobacterium bovis subsp bovis AF2122/97
cccguccaggcccg

SEQ ID NO: 1057221 - RNA, 15 nt, Mycobacterium bovis subsp bovis AF2122/97
cccguccaggcgcug

SEQ ID NO: 1057222 - RNA, 18 nt, Mycobacterium bovis subsp bovis AF2122/97
cccguccaacuacgccag

SEQ ID NO: 1057223 - RNA, 19 nt, Mycobacterium bovis subsp bovis AF2122/97
cccgucauacucgacaccg

SEQ ID NO: 1057224 - RNA, 12 nt, Mycobacterium bovis subsp bovis AF2122/97
cccguccgccgc

SEQ ID NO: 1057225 - RNA, 13 nt, Mycobacterium bovis subsp bovis AF2122/97
cccguccgcgcgc

SEQ ID NO: 1057226 - RNA, 15 nt, Mycobacterium bovis subsp bovis AF2122/97
cccguccgcgcgccg

SEQ ID NO: 1057227 - RNA, 13 nt, Mycobacterium bovis subsp bovis AF2122/97
cccguccggcccc

SEQ ID NO: 1057228 - RNA, 22 nt, Mycobacterium bovis subsp bovis AF2122/97
cccgucccagcugaccagcguc

SEQ ID NO: 1057229 - RNA, 23 nt, Mycobacterium bovis subsp bovis AF2122/97
cccguccugcggguaggugacga

SEQ ID NO: 1057230 - RNA, 16 nt, Mycobacterium bovis subsp bovis AF2122/97
cccgucgaacgcgcgc

SEQ ID NO: 1057231 - RNA, 19 nt, Mycobacterium bovis subsp bovis AF2122/97
cccgucacucaccccaaca

SEQ ID NO: 1057232 - RNA, 13 nt, Mycobacterium bovis subsp bovis AF2122/97
cccgucaccgccg

SEQ ID NO: 1057233 - RNA, 12 nt, Mycobacterium bovis subsp bovis AF2122/97
cccgucaccgcg

SEQ ID NO: 1057234 - RNA, 15 nt, Mycobacterium bovis subsp bovis AF2122/97
cccgucaccgcgggc

SEQ ID NO: 1057235 - RNA, 14 nt, Mycobacterium bovis subsp bovis AF2122/97
cccgucacgcccgc

SEQ ID NO: 1057236 - RNA, 22 nt, Mycobacterium bovis subsp bovis AF2122/97
cccgucacgcccgcgaaccgcg

SEQ ID NO: 1057237 - RNA, 16 nt, Mycobacterium bovis subsp bovis AF2122/97
cccguauuucaccgaa

SEQ ID NO: 1057238 - RNA, 15 nt, Mycobacterium bovis subsp bovis AF2122/97
cccguauggcggcuc

SEQ ID NO: 1057239 - RNA, 14 nt, Mycobacterium bovis subsp bovis AF2122/97
cccggugccgaccg

SEQ ID NO: 1057240 - RNA, 14 nt, Mycobacterium bovis subsp bovis AF2122/97
cccggugccgcagc

SEQ ID NO: 1057241 - RNA, 23 nt, Mycobacterium bovis subsp bovis AF2122/97
cccggugccgcagcaggggacga

SEQ ID NO: 1057242 - RNA, 18 nt, Mycobacterium bovis subsp bovis AF2122/97
cccgguucgaggaucccg

SEQ ID NO: 1057243 - RNA, 22 nt, Mycobacterium bovis subsp bovis AF2122/97
cccgguucugcgcccacccgcg

SEQ ID NO: 1057244 - RNA, 14 nt, Mycobacterium bovis subsp bovis AF2122/97
cccgguugacgccg

SEQ ID NO: 1057245 - RNA, 20 nt, Mycobacterium bovis subsp bovis AF2122/97
cccggugcccgcggugacga

SEQ ID NO: 1057246 - RNA, 21 nt, Mycobacterium bovis subsp bovis AF2122/97
cccgguugacgccgguccccg

SEQ ID NO: 1057247 - RNA, 17 nt, Mycobacterium bovis subsp bovis AF2122/97
cccggugaccagcaacc

SEQ ID NO: 1057248 - RNA, 20 nt, Mycobacterium bovis subsp bovis AF2122/97
cccgguugacucgcuccgac

SEQ ID NO: 1057249 - RNA, 20 nt, Mycobacterium bovis subsp bovis AF2122/97
cccgguuguggaaccacggc

SEQ ID NO: 1057250 - RNA, 21 nt, Mycobacterium bovis subsp bovis AF2122/97
cccgguuguggaaccacggcg

SEQ ID NO: 1057251 - RNA, 23 nt, Mycobacterium bovis subsp bovis AF2122/97
cccgguuguggaaccacggcgca

SEQ ID NO: 1057252 - RNA, 15 nt, Mycobacterium bovis subsp bovis AF2122/97
cccguaggguggccg

SEQ ID NO: 1057253 - RNA, 14 nt, Mycobacterium bovis subsp bovis AF2122/97
cccguagccgugcc

SEQ ID NO: 1057254 - RNA, 18 nt, Mycobacterium bovis subsp bovis AF2122/97
cccggucuacgacgucgc

SEQ ID NO: 1057255 - RNA, 22 nt, Mycobacterium bovis subsp bovis AF2122/97
cccggucggagcggugccgacg

SEQ ID NO: 1057256 - RNA, 12 nt, Mycobacterium bovis subsp bovis AF2122/97
cccggucggcga

SEQ ID NO: 1057257 - RNA, 20 nt, Mycobacterium bovis subsp bovis AF2122/97
cccggucucgacggcggccg

SEQ ID NO: 1057258 - RNA, 16 nt, Mycobacterium bovis subsp bovis AF2122/97
cccggugaccagcaac

SEQ ID NO: 1057259 - RNA, 21 nt, Mycobacterium bovis subsp bovis AF2122/97
cccggucuauuugccugccgc

SEQ ID NO: 1057260 - RNA, 20 nt, Mycobacterium bovis subsp bovis AF2122/97
cccggucuugggcgcgggug

SEQ ID NO: 1057261 - RNA, 21 nt, Mycobacterium bovis subsp bovis AF2122/97
cccggucgccggucaucgccg

SEQ ID NO: 1057262 - RNA, 17 nt, Mycobacterium bovis subsp bovis AF2122/97
cccggguagacaccgcg

SEQ ID NO: 1057263 - RNA, 15 nt, Mycobacterium bovis subsp bovis AF2122/97
cccggguaucgccag

SEQ ID NO: 1057264 - RNA, 15 nt, Mycobacterium bovis subsp bovis AF2122/97
cccgggucagcgacc

SEQ ID NO: 1057265 - RNA, 22 nt, Mycobacterium bovis subsp bovis AF2122/97
cccggguccaagaaccacgacg

SEQ ID NO: 1057266 - RNA, 12 nt, Mycobacterium bovis subsp bovis AF2122/97
cccgggucccau

SEQ ID NO: 1057267 - RNA, 15 nt, Mycobacterium bovis subsp bovis AF2122/97
cccggggcgcucgcg

SEQ ID NO: 1057268 - RNA, 16 nt, Mycobacterium bovis subsp bovis AF2122/97
cccggggcgcucgcgc

SEQ ID NO: 1057269 - RNA, 19 nt, Mycobacterium bovis subsp bovis AF2122/97
cccggggcgcucgcgcgcu

SEQ ID NO: 1057270 - RNA, 14 nt, Mycobacterium bovis subsp bovis AF2122/97
cccggcgcgguggc

SEQ ID NO: 1057271 - RNA, 23 nt, Mycobacterium bovis subsp bovis AF2122/97
cccggcgcuagcgccgcgcuugc

SEQ ID NO: 1057272 - RNA, 20 nt, Mycobacterium bovis subsp bovis AF2122/97
cccggcgcuggugcgccacg

SEQ ID NO: 1057273 - RNA, 23 nt, Mycobacterium bovis subsp bovis AF2122/97
cccggcggccaucccgcguucga

SEQ ID NO: 1057274 - RNA, 20 nt, Mycobacterium bovis subsp bovis AF2122/97
cccggcuguucucgccgaag

SEQ ID NO: 1057275 - RNA, 21 nt, Mycobacterium bovis subsp bovis AF2122/97
cccggcuggucacccguaucg

SEQ ID NO: 1057276 - RNA, 17 nt, Mycobacterium bovis subsp bovis AF2122/97
cccggcugccagcgccg

SEQ ID NO: 1057277 - RNA, 20 nt, Mycobacterium bovis subsp bovis AF2122/97
cccggcugccagcgccgccg

SEQ ID NO: 1057278 - RNA, 17 nt, Mycobacterium bovis subsp bovis AF2122/97
cccggcuucgccgcgcu

SEQ ID NO: 1057279 - RNA, 18 nt, Mycobacterium bovis subsp bovis AF2122/97
cccggcuuucccaccgcu

SEQ ID NO: 1057280 - RNA, 14 nt, Mycobacterium bovis subsp bovis AF2122/97
cccgggcagccgca

SEQ ID NO: 1057281 - RNA, 14 nt, Mycobacterium bovis subsp bovis AF2122/97
cccgggcaccggcc

SEQ ID NO: 1057282 - RNA, 13 nt, Mycobacterium bovis subsp bovis AF2122/97
cccgggcaccguc

SEQ ID NO: 1057283 - RNA, 14 nt, Mycobacterium bovis subsp bovis AF2122/97
cccgggcaccgucg

SEQ ID NO: 1057284 - RNA, 13 nt, Mycobacterium bovis subsp bovis AF2122/97
cccgggaugcucc

SEQ ID NO: 1057285 - RNA, 18 nt, Mycobacterium bovis subsp bovis AF2122/97
cccgggacgaaccggccg

SEQ ID NO: 1057286 - RNA, 20 nt, Mycobacterium bovis subsp bovis AF2122/97
cccgggacguuguccaccgc

SEQ ID NO: 1057287 - RNA, 21 nt, Mycobacterium bovis subsp bovis AF2122/97
cccgggacguuguccaccgcc

SEQ ID NO: 1057288 - RNA, 22 nt, Mycobacterium bovis subsp bovis AF2122/97
cccgggacguuguccaccgcca

SEQ ID NO: 1057289 - RNA, 20 nt, Mycobacterium bovis subsp bovis AF2122/97
cccgggauaguuuucggccg

SEQ ID NO: 1057290 - RNA, 22 nt, Mycobacterium bovis subsp bovis AF2122/97
cccgggauaguuuucggccgcc

SEQ ID NO: 1057291 - RNA, 23 nt, Mycobacterium bovis subsp bovis AF2122/97
cccgggaaauagauucccggcuc

SEQ ID NO: 1057292 - RNA, 15 nt, Mycobacterium bovis subsp bovis AF2122/97
cccggcuuuuccggc

SEQ ID NO: 1057293 - RNA, 19 nt, Mycobacterium bovis subsp bovis AF2122/97
cccggcuuuugcgcccagc

SEQ ID NO: 1057294 - RNA, 16 nt, Mycobacterium bovis subsp bovis AF2122/97
cccgggccgccagggc

SEQ ID NO: 1057295 - RNA, 17 nt, Mycobacterium bovis subsp bovis AF2122/97
cccgggcccgcgggauc

SEQ ID NO: 1057296 - RNA, 12 nt, Mycobacterium bovis subsp bovis AF2122/97
cccgggccaccg

SEQ ID NO: 1057297 - RNA, 13 nt, Mycobacterium bovis subsp bovis AF2122/97
cccgggccaccgg

SEQ ID NO: 1057298 - RNA, 14 nt, Mycobacterium bovis subsp bovis AF2122/97
cccgggccacgucg

SEQ ID NO: 1057299 - RNA, 19 nt, Mycobacterium bovis subsp bovis AF2122/97
cccgggcucugcugccagc

SEQ ID NO: 1057300 - RNA, 21 nt, Mycobacterium bovis subsp bovis AF2122/97
cccgggcugccgcccaugccg

SEQ ID NO: 1057301 - RNA, 13 nt, Mycobacterium bovis subsp bovis AF2122/97
cccgggccgcggc

SEQ ID NO: 1057302 - RNA, 13 nt, Mycobacterium bovis subsp bovis AF2122/97
cccggggagacga

SEQ ID NO: 1057303 - RNA, 14 nt, Mycobacterium bovis subsp bovis AF2122/97
cccggggcgcucgc

SEQ ID NO: 1057304 - RNA, 22 nt, Mycobacterium bovis subsp bovis AF2122/97
cccggcgcacaaacauacgcca

SEQ ID NO: 1057305 - RNA, 21 nt, Mycobacterium bovis subsp bovis AF2122/97
cccggcgcaccaucgcggccg

SEQ ID NO: 1057306 - RNA, 22 nt, Mycobacterium bovis subsp bovis AF2122/97
cccggcgccguagugcgcaucg

SEQ ID NO: 1057307 - RNA, 23 nt, Mycobacterium bovis subsp bovis AF2122/97
cccggcgccgcgggugcggcaug

SEQ ID NO: 1057308 - RNA, 15 nt, Mycobacterium bovis subsp bovis AF2122/97
cccggcgcaacaacc

SEQ ID NO: 1057309 - RNA, 23 nt, Mycobacterium bovis subsp bovis AF2122/97
cccggaucuggugggugcggcca

SEQ ID NO: 1057310 - RNA, 15 nt, Mycobacterium bovis subsp bovis AF2122/97
cccggauagacggcg

SEQ ID NO: 1057311 - RNA, 17 nt, Mycobacterium bovis subsp bovis AF2122/97
cccggauagacggcgac

SEQ ID NO: 1057312 - RNA, 15 nt, Mycobacterium bovis subsp bovis AF2122/97
cccggaggcaauccg

SEQ ID NO: 1057313 - RNA, 13 nt, Mycobacterium bovis subsp bovis AF2122/97
cccggagccgcca

SEQ ID NO: 1057314 - RNA, 18 nt, Mycobacterium bovis subsp bovis AF2122/97
cccggagcgauccggcaa

SEQ ID NO: 1057315 - RNA, 16 nt, Mycobacterium bovis subsp bovis AF2122/97
cccggagcggucagcg

SEQ ID NO: 1057316 - RNA, 12 nt, Mycobacterium bovis subsp bovis AF2122/97
cccggacgucgg

SEQ ID NO: 1057317 - RNA, 15 nt, Mycobacterium bovis subsp bovis AF2122/97
cccggaacaccgacg

SEQ ID NO: 1057318 - RNA, 21 nt, Mycobacterium bovis subsp bovis AF2122/97
cccggacgauggcgucggcca

SEQ ID NO: 1057319 - RNA, 20 nt, Mycobacterium bovis subsp bovis AF2122/97
cccggaaagaucucggucac

SEQ ID NO: 1057320 - RNA, 21 nt, Mycobacterium bovis subsp bovis AF2122/97
cccgcuuuuucccggcggcgc

SEQ ID NO: 1057321 - RNA, 17 nt, Mycobacterium bovis subsp bovis AF2122/97
cccgcuuggcgugaccu

SEQ ID NO: 1057322 - RNA, 20 nt, Mycobacterium bovis subsp bovis AF2122/97
cccucaguucacgcucgacg

SEQ ID NO: 1057323 - RNA, 22 nt, Mycobacterium bovis subsp bovis AF2122/97
cccucaguucacguucggcgac

SEQ ID NO: 1057324 - RNA, 17 nt, Mycobacterium bovis subsp bovis AF2122/97
cccgugcuggcgccgaa

SEQ ID NO: 1057325 - RNA, 20 nt, Mycobacterium bovis subsp bovis AF2122/97
cccguucaugcggcggcgcu

SEQ ID NO: 1057326 - RNA, 14 nt, Mycobacterium bovis subsp bovis AF2122/97
cccguuccacgccg

SEQ ID NO: 1057327 - RNA, 16 nt, Mycobacterium bovis subsp bovis AF2122/97
cccguuccacgccggc

SEQ ID NO: 1057328 - RNA, 16 nt, Mycobacterium bovis subsp bovis AF2122/97
cccucccgggcccgcu

SEQ ID NO: 1057329 - RNA, 15 nt, Mycobacterium bovis subsp bovis AF2122/97
cccucccuggggccg

SEQ ID NO: 1057330 - RNA, 15 nt, Mycobacterium bovis subsp bovis AF2122/97
cccuccgcgaugccg

SEQ ID NO: 1057331 - RNA, 16 nt, Mycobacterium bovis subsp bovis AF2122/97
cccuccgcgccgauca

SEQ ID NO: 1057332 - RNA, 19 nt, Mycobacterium bovis subsp bovis AF2122/97
cccuccagauaccaccgcc

SEQ ID NO: 1057333 - RNA, 19 nt, Mycobacterium bovis subsp bovis AF2122/97
cccuccgcgccgaucagcg

SEQ ID NO: 1057334 - RNA, 19 nt, Mycobacterium bovis subsp bovis AF2122/97
cccuccggacccacccgca

SEQ ID NO: 1057335 - RNA, 12 nt, Mycobacterium bovis subsp bovis AF2122/97
cccuccggccac

SEQ ID NO: 1057336 - RNA, 12 nt, Mycobacterium bovis subsp bovis AF2122/97
cccuccucgaug

SEQ ID NO: 1057337 - RNA, 16 nt, Mycobacterium bovis subsp bovis AF2122/97
cccgugcgcgcgcagc

SEQ ID NO: 1057338 - RNA, 19 nt, Mycobacterium bovis subsp bovis AF2122/97
cccgugcggcucgccggcg

SEQ ID NO: 1057339 - RNA, 20 nt, Mycobacterium bovis subsp bovis AF2122/97
cccguggcgaauucgaccac

SEQ ID NO: 1057340 - RNA, 21 nt, Mycobacterium bovis subsp bovis AF2122/97
cccgugggccucgaucagcgc

SEQ ID NO: 1057341 - RNA, 20 nt, Mycobacterium bovis subsp bovis AF2122/97
cccgugggguguggcggcgg

SEQ ID NO: 1057342 - RNA, 18 nt, Mycobacterium bovis subsp bovis AF2122/97
cccgugagcucgucgagg

SEQ ID NO: 1057343 - RNA, 12 nt, Mycobacterium bovis subsp bovis AF2122/97
cccgugccgucg

SEQ ID NO: 1057344 - RNA, 14 nt, Mycobacterium bovis subsp bovis AF2122/97
cccgugccgcccgc

SEQ ID NO: 1057345 - RNA, 18 nt, Mycobacterium bovis subsp bovis AF2122/97
cccgugccgcccgcgccg

SEQ ID NO: 1057346 - RNA, 20 nt, Mycobacterium bovis subsp bovis AF2122/97
cccgugccgcccgcgccgcc

SEQ ID NO: 1057347 - RNA, 15 nt, Mycobacterium bovis subsp bovis AF2122/97
cccgugcacgaucgc

SEQ ID NO: 1057348 - RNA, 22 nt, Mycobacterium bovis subsp bovis AF2122/97
cccgucucguugaccaacgucg

SEQ ID NO: 1057349 - RNA, 21 nt, Mycobacterium bovis subsp bovis AF2122/97
cccgucugcgugggccugcgc

SEQ ID NO: 1057350 - RNA, 16 nt, Mycobacterium bovis subsp bovis AF2122/97
cccgucucguugacca

SEQ ID NO: 1057351 - RNA, 18 nt, Mycobacterium bovis subsp bovis AF2122/97
cccucgaauucggccggc

SEQ ID NO: 1057352 - RNA, 19 nt, Mycobacterium bovis subsp bovis AF2122/97
cccucgaauucggccggcg

SEQ ID NO: 1057353 - RNA, 22 nt, Mycobacterium bovis subsp bovis AF2122/97
cccucggugagaaucgacuccg

SEQ ID NO: 1057354 - RNA, 19 nt, Mycobacterium bovis subsp bovis AF2122/97
cccucguuaucgaccgccg

SEQ ID NO: 1057355 - RNA, 17 nt, Mycobacterium bovis subsp bovis AF2122/97
cccugacagcgagcgac

SEQ ID NO: 1057356 - RNA, 15 nt, Mycobacterium bovis subsp bovis AF2122/97
cccugacgccccgcc

SEQ ID NO: 1057357 - RNA, 23 nt, Mycobacterium bovis subsp bovis AF2122/97
cccugacgguggugaccgcgggc

SEQ ID NO: 1057358 - RNA, 22 nt, Mycobacterium bovis subsp bovis AF2122/97
cccugacgucacguucggcgca

SEQ ID NO: 1057359 - RNA, 15 nt, Mycobacterium bovis subsp bovis AF2122/97
cccugcccggcccgc

SEQ ID NO: 1057360 - RNA, 14 nt, Mycobacterium bovis subsp bovis AF2122/97
cccuggccagcaga

SEQ ID NO: 1057361 - RNA, 13 nt, Mycobacterium bovis subsp bovis AF2122/97
cccuggccagccc

SEQ ID NO: 1057362 - RNA, 22 nt, Mycobacterium bovis subsp bovis AF2122/97
cccuggccagcccgagcucggg

SEQ ID NO: 1057363 - RNA, 21 nt, Mycobacterium bovis subsp bovis AF2122/97
cccugcggccacgguggcgca

SEQ ID NO: 1057364 - RNA, 13 nt, Mycobacterium bovis subsp bovis AF2122/97
cccugcgccgcca

SEQ ID NO: 1057365 - RNA, 15 nt, Mycobacterium bovis subsp bovis AF2122/97
cccugcgccgccaca

SEQ ID NO: 1057366 - RNA, 19 nt, Mycobacterium bovis subsp bovis AF2122/97
cccugccgaucccguggug

SEQ ID NO: 1057367 - RNA, 21 nt, Mycobacterium bovis subsp bovis AF2122/97
cccugccgcgaugagcggcgc

SEQ ID NO: 1057368 - RNA, 18 nt, Mycobacterium bovis subsp bovis AF2122/97
cccugucgggucgagucc

SEQ ID NO: 1057369 - RNA, 17 nt, Mycobacterium bovis subsp bovis AF2122/97
ccgaaaaacaccagcga

SEQ ID NO: 1057370 - RNA, 16 nt, Mycobacterium bovis subsp bovis AF2122/97
ccgaaaagccguucgc

SEQ ID NO: 1057371 - RNA, 15 nt, Mycobacterium bovis subsp bovis AF2122/97
ccgaaaagcgccucg

SEQ ID NO: 1057372 - RNA, 14 nt, Mycobacterium bovis subsp bovis AF2122/97
cccugucgcgcacc

SEQ ID NO: 1057373 - RNA, 18 nt, Mycobacterium bovis subsp bovis AF2122/97
cccuggguauccaccgcg

SEQ ID NO: 1057374 - RNA, 17 nt, Mycobacterium bovis subsp bovis AF2122/97
ccgaaacgauggccggg

SEQ ID NO: 1057375 - RNA, 20 nt, Mycobacterium bovis subsp bovis AF2122/97
ccgaaacgccgaccgcgccg

SEQ ID NO: 1057376 - RNA, 23 nt, Mycobacterium bovis subsp bovis AF2122/97
ccgaaaccaugccgccgaagccg

SEQ ID NO: 1057377 - RNA, 16 nt, Mycobacterium bovis subsp bovis AF2122/97
ccgaaacuucgcccgg

SEQ ID NO: 1057378 - RNA, 21 nt, Mycobacterium bovis subsp bovis AF2122/97
ccgaaacuucgcccgggccgc

SEQ ID NO: 1057379 - RNA, 21 nt, Mycobacterium bovis subsp bovis AF2122/97
ccgaaaugccgggcccgacgu

SEQ ID NO: 1057380 - RNA, 13 nt, Mycobacterium bovis subsp bovis AF2122/97
cccuggccgcgcc

SEQ ID NO: 1057381 - RNA, 11 nt, Mycobacterium bovis subsp bovis AF2122/97
cccuggccggu

SEQ ID NO: 1057382 - RNA, 13 nt, Mycobacterium bovis subsp bovis AF2122/97
cccuggccgccgc

SEQ ID NO: 1057383 - RNA, 16 nt, Mycobacterium bovis subsp bovis AF2122/97
cccuggcgaccagccg

SEQ ID NO: 1057384 - RNA, 17 nt, Mycobacterium bovis subsp bovis AF2122/97
cccuggcgaccagccga

SEQ ID NO: 1057385 - RNA, 14 nt, Mycobacterium bovis subsp bovis AF2122/97
cccuggugucgauc

SEQ ID NO: 1057386 - RNA, 20 nt, Mycobacterium bovis subsp bovis AF2122/97
cccugggugauggccgcgcc

SEQ ID NO: 1057387 - RNA, 21 nt, Mycobacterium bovis subsp bovis AF2122/97
cccugggguugcaucaugccg

SEQ ID NO: 1057388 - RNA, 15 nt, Mycobacterium bovis subsp bovis AF2122/97
cccugggcgucgacc

SEQ ID NO: 1057389 - RNA, 22 nt, Mycobacterium bovis subsp bovis AF2122/97
cccugggcgucgaccacgcaag

SEQ ID NO: 1057390 - RNA, 18 nt, Mycobacterium bovis subsp bovis AF2122/97
ccgaaccggcaccagcgg

SEQ ID NO: 1057391 - RNA, 15 nt, Mycobacterium bovis subsp bovis AF2122/97
ccgaacccggcggac

SEQ ID NO: 1057392 - RNA, 15 nt, Mycobacterium bovis subsp bovis AF2122/97
ccgaaccgccgcugc

SEQ ID NO: 1057393 - RNA, 18 nt, Mycobacterium bovis subsp bovis AF2122/97
ccgaaccgccgcugccgc

SEQ ID NO: 1057394 - RNA, 15 nt, Mycobacterium bovis subsp bovis AF2122/97
ccgaaccccgaccgc

SEQ ID NO: 1057395 - RNA, 18 nt, Mycobacterium bovis subsp bovis AF2122/97
ccgaacccgccaccgcga

SEQ ID NO: 1057396 - RNA, 14 nt, Mycobacterium bovis subsp bovis AF2122/97
ccgaacccacccau

SEQ ID NO: 1057397 - RNA, 14 nt, Mycobacterium bovis subsp bovis AF2122/97
ccgaaccaccgcgu

SEQ ID NO: 1057398 - RNA, 15 nt, Mycobacterium bovis subsp bovis AF2122/97
ccgaaccaccgcguu

SEQ ID NO: 1057399 - RNA, 19 nt, Mycobacterium bovis subsp bovis AF2122/97
ccgaaccaccgcguuggcc

SEQ ID NO: 1057400 - RNA, 15 nt, Mycobacterium bovis subsp bovis AF2122/97
ccgaaccacgcgccc

SEQ ID NO: 1057401 - RNA, 17 nt, Mycobacterium bovis subsp bovis AF2122/97
ccgaacaguucggcgag

SEQ ID NO: 1057402 - RNA, 19 nt, Mycobacterium bovis subsp bovis AF2122/97
ccgaagauuuugggcgccg

SEQ ID NO: 1057403 - RNA, 19 nt, Mycobacterium bovis subsp bovis AF2122/97
ccgaagauggccagcgcgg

SEQ ID NO: 1057404 - RNA, 14 nt, Mycobacterium bovis subsp bovis AF2122/97
ccgaacgacucgac

SEQ ID NO: 1057405 - RNA, 23 nt, Mycobacterium bovis subsp bovis AF2122/97
ccgaaccgguguagcagcgccag

SEQ ID NO: 1057406 - RNA, 16 nt, Mycobacterium bovis subsp bovis AF2122/97
ccgaaccgucagcggc

SEQ ID NO: 1057407 - RNA, 20 nt, Mycobacterium bovis subsp bovis AF2122/97
ccgaacgaggcgcccagcga

SEQ ID NO: 1057408 - RNA, 14 nt, Mycobacterium bovis subsp bovis AF2122/97
ccgaacgcaacgcc

SEQ ID NO: 1057409 - RNA, 16 nt, Mycobacterium bovis subsp bovis AF2122/97
ccgaacgcaacgccga

SEQ ID NO: 1057410 - RNA, 15 nt, Mycobacterium bovis subsp bovis AF2122/97
ccgaagccgccgggu

SEQ ID NO: 1057411 - RNA, 16 nt, Mycobacterium bovis subsp bovis AF2122/97
ccgaagccccgauuga

SEQ ID NO: 1057412 - RNA, 16 nt, Mycobacterium bovis subsp bovis AF2122/97
ccgaagcggccaccgc

SEQ ID NO: 1057413 - RNA, 17 nt, Mycobacterium bovis subsp bovis AF2122/97
ccgaagcggccaccgcc

SEQ ID NO: 1057414 - RNA, 18 nt, Mycobacterium bovis subsp bovis AF2122/97
ccgaagcggccaccgccg

SEQ ID NO: 1057415 - RNA, 18 nt, Mycobacterium bovis subsp bovis AF2122/97
ccgaaguuuuggaagccc

SEQ ID NO: 1057416 - RNA, 18 nt, Mycobacterium bovis subsp bovis AF2122/97
ccgaaguugaugucgcgu

SEQ ID NO: 1057417 - RNA, 17 nt, Mycobacterium bovis subsp bovis AF2122/97
ccgaagccucggcaugc

SEQ ID NO: 1057418 - RNA, 13 nt, Mycobacterium bovis subsp bovis AF2122/97
ccgaagccgggcc

SEQ ID NO: 1057419 - RNA, 23 nt, Mycobacterium bovis subsp bovis AF2122/97
ccgaagccggugccggcguugcc

SEQ ID NO: 1057420 - RNA, 14 nt, Mycobacterium bovis subsp bovis AF2122/97
ccgaagcgcccgga

SEQ ID NO: 1057421 - RNA, 16 nt, Mycobacterium bovis subsp bovis AF2122/97
ccgaagcgcccguugg

SEQ ID NO: 1057422 - RNA, 20 nt, Mycobacterium bovis subsp bovis AF2122/97
ccgaagcgcccguuggccaa

SEQ ID NO: 1057423 - RNA, 17 nt, Mycobacterium bovis subsp bovis AF2122/97
ccgaagccuugcagcgc

SEQ ID NO: 1057424 - RNA, 16 nt, Mycobacterium bovis subsp bovis AF2122/97
ccgaaucgcgggcuga

SEQ ID NO: 1057425 - RNA, 16 nt, Mycobacterium bovis subsp bovis AF2122/97
ccgaaucgggucggcc

SEQ ID NO: 1057426 - RNA, 17 nt, Mycobacterium bovis subsp bovis AF2122/97
ccgaaugcacgacggug

SEQ ID NO: 1057427 - RNA, 17 nt, Mycobacterium bovis subsp bovis AF2122/97
ccgaaucugccggccgg

SEQ ID NO: 1057428 - RNA, 13 nt, Mycobacterium bovis subsp bovis AF2122/97
ccgaauagucggc

SEQ ID NO: 1057429 - RNA, 16 nt, Mycobacterium bovis subsp bovis AF2122/97
ccgaauaccgccgcgc

SEQ ID NO: 1057430 - RNA, 14 nt, Mycobacterium bovis subsp bovis AF2122/97
cccgcccagcccgg

SEQ ID NO: 1057431 - RNA, 11 nt, Mycobacterium bovis subsp bovis AF2122/97
cccgcccagcg

SEQ ID NO: 1057432 - RNA, 14 nt, Mycobacterium bovis subsp bovis AF2122/97
cccgcccgcgcggu

SEQ ID NO: 1057433 - RNA, 19 nt, Mycobacterium bovis subsp bovis AF2122/97
cccgcccgagccgcugcga

SEQ ID NO: 1057434 - RNA, 13 nt, Mycobacterium bovis subsp bovis AF2122/97
cccgccggcgccg

SEQ ID NO: 1057435 - RNA, 12 nt, Mycobacterium bovis subsp bovis AF2122/97
cccgccggcccc

SEQ ID NO: 1057436 - RNA, 15 nt, Mycobacterium bovis subsp bovis AF2122/97
cccgccggccgcgcc

SEQ ID NO: 1057437 - RNA, 13 nt, Mycobacterium bovis subsp bovis AF2122/97
cccgccggccucc

SEQ ID NO: 1057438 - RNA, 22 nt, Mycobacterium bovis subsp bovis AF2122/97
cccgccggaacugcgcaacacc

SEQ ID NO: 1057439 - RNA, 15 nt, Mycobacterium bovis subsp bovis AF2122/97
cccgccggacccgcc

SEQ ID NO: 1057440 - RNA, 15 nt, Mycobacterium bovis subsp bovis AF2122/97
cccgccgcugccgcc

SEQ ID NO: 1057441 - RNA, 22 nt, Mycobacterium bovis subsp bovis AF2122/97
cccgccgcugccgccggugccg

SEQ ID NO: 1057442 - RNA, 12 nt, Mycobacterium bovis subsp bovis AF2122/97
cccgccgucacc

SEQ ID NO: 1057443 - RNA, 13 nt, Mycobacterium bovis subsp bovis AF2122/97
cccgccggucacg

SEQ ID NO: 1057444 - RNA, 20 nt, Mycobacterium bovis subsp bovis AF2122/97
cccgccggucacgacguccg

SEQ ID NO: 1057445 - RNA, 17 nt, Mycobacterium bovis subsp bovis AF2122/97
cccgccggugaucggcg

SEQ ID NO: 1057446 - RNA, 14 nt, Mycobacterium bovis subsp bovis AF2122/97
cccgccgguggccg

SEQ ID NO: 1057447 - RNA, 18 nt, Mycobacterium bovis subsp bovis AF2122/97
cccgcgaacgcgacagcc

SEQ ID NO: 1057448 - RNA, 21 nt, Mycobacterium bovis subsp bovis AF2122/97
cccgcgaacgcgacagccacc

SEQ ID NO: 1057449 - RNA, 23 nt, Mycobacterium bovis subsp bovis AF2122/97
cccgcgaacgcgacagccaccuc

SEQ ID NO: 1057450 - RNA, 13 nt, Mycobacterium bovis subsp bovis AF2122/97
cccgccggcgggu

SEQ ID NO: 1057451 - RNA, 17 nt, Mycobacterium bovis subsp bovis AF2122/97
cccgccgggcuccacgu

SEQ ID NO: 1057452 - RNA, 18 nt, Mycobacterium bovis subsp bovis AF2122/97
cccgcgcgagagccucca

SEQ ID NO: 1057453 - RNA, 14 nt, Mycobacterium bovis subsp bovis AF2122/97
cccgcgcgccagcu

SEQ ID NO: 1057454 - RNA, 16 nt, Mycobacterium bovis subsp bovis AF2122/97
cccgcgcgccggcgac

SEQ ID NO: 1057455 - RNA, 14 nt, Mycobacterium bovis subsp bovis AF2122/97
cccgcgcggcgcau

SEQ ID NO: 1057456 - RNA, 13 nt, Mycobacterium bovis subsp bovis AF2122/97
cccgcgaucgggc

SEQ ID NO: 1057457 - RNA, 15 nt, Mycobacterium bovis subsp bovis AF2122/97
cccgcgaucgggccg

SEQ ID NO: 1057458 - RNA, 19 nt, Mycobacterium bovis subsp bovis AF2122/97
cccgcgagguugaccacca

SEQ ID NO: 1057459 - RNA, 23 nt, Mycobacterium bovis subsp bovis AF2122/97
cccgcgaucgcgacacggccauc

SEQ ID NO: 1057460 - RNA, 21 nt, Mycobacterium bovis subsp bovis AF2122/97
cccgcgaugcgcaccagcggc

SEQ ID NO: 1057461 - RNA, 22 nt, Mycobacterium bovis subsp bovis AF2122/97
cccgcgagaucgggccggccgc

SEQ ID NO: 1057462 - RNA, 15 nt, Mycobacterium bovis subsp bovis AF2122/97
cccgccggcagugag

SEQ ID NO: 1057463 - RNA, 15 nt, Mycobacterium bovis subsp bovis AF2122/97
cccgcgaagccgcca

SEQ ID NO: 1057464 - RNA, 18 nt, Mycobacterium bovis subsp bovis AF2122/97
cccgcgguggaccgggca

SEQ ID NO: 1057465 - RNA, 19 nt, Mycobacterium bovis subsp bovis AF2122/97
cccgcggugaccaccccgg

SEQ ID NO: 1057466 - RNA, 13 nt, Mycobacterium bovis subsp bovis AF2122/97
cccgcggugacga

SEQ ID NO: 1057467 - RNA, 13 nt, Mycobacterium bovis subsp bovis AF2122/97
cccgcgguccggc

SEQ ID NO: 1057468 - RNA, 16 nt, Mycobacterium bovis subsp bovis AF2122/97
cccgcgcgucgcccag

SEQ ID NO: 1057469 - RNA, 16 nt, Mycobacterium bovis subsp bovis AF2122/97
cccgcgguagccgacc

SEQ ID NO: 1057470 - RNA, 19 nt, Mycobacterium bovis subsp bovis AF2122/97
cccgcgguagccgaccgac

SEQ ID NO: 1057471 - RNA, 15 nt, Mycobacterium bovis subsp bovis AF2122/97
cccgcgcguucggcg

SEQ ID NO: 1057472 - RNA, 19 nt, Mycobacterium bovis subsp bovis AF2122/97
cccgcgcugagcacgcgga

SEQ ID NO: 1057473 - RNA, 13 nt, Mycobacterium bovis subsp bovis AF2122/97
cccgcgcgucgcc

SEQ ID NO: 1057474 - RNA, 17 nt, Mycobacterium bovis subsp bovis AF2122/97
cccgcgcgggcggaucg

SEQ ID NO: 1057475 - RNA, 14 nt, Mycobacterium bovis subsp bovis AF2122/97
cccgcgcggugccc

SEQ ID NO: 1057476 - RNA, 23 nt, Mycobacterium bovis subsp bovis AF2122/97
cccgcgcggugcccugccggcag

SEQ ID NO: 1057477 - RNA, 14 nt, Mycobacterium bovis subsp bovis AF2122/97
cccgcgcgguggcg

SEQ ID NO: 1057478 - RNA, 20 nt, Mycobacterium bovis subsp bovis AF2122/97
cccgcgcgguggcggucgcc

SEQ ID NO: 1057479 - RNA, 13 nt, Mycobacterium bovis subsp bovis AF2122/97
cccgcuccgggac

SEQ ID NO: 1057480 - RNA, 21 nt, Mycobacterium bovis subsp bovis AF2122/97
cccgcgguuugcacgucacgc

SEQ ID NO: 1057481 - RNA, 21 nt, Mycobacterium bovis subsp bovis AF2122/97
cccgcgucuacgucguccagc

SEQ ID NO: 1057482 - RNA, 19 nt, Mycobacterium bovis subsp bovis AF2122/97
cccgcucgagcagcgcgcc

SEQ ID NO: 1057483 - RNA, 14 nt, Mycobacterium bovis subsp bovis AF2122/97
cccgcucgaucggc

SEQ ID NO: 1057484 - RNA, 18 nt, Mycobacterium bovis subsp bovis AF2122/97
cccgcucgaucggcagcc

SEQ ID NO: 1057485 - RNA, 21 nt, Mycobacterium bovis subsp bovis AF2122/97
cccgcucgaucggcagccagg

SEQ ID NO: 1057486 - RNA, 20 nt, Mycobacterium bovis subsp bovis AF2122/97
cccgcggugacgcaacaucg

SEQ ID NO: 1057487 - RNA, 15 nt, Mycobacterium bovis subsp bovis AF2122/97
cccgcggugacgcca

SEQ ID NO: 1057488 - RNA, 17 nt, Mycobacterium bovis subsp bovis AF2122/97
cccgcggugacgccagc

SEQ ID NO: 1057489 - RNA, 23 nt, Mycobacterium bovis subsp bovis AF2122/97
cccgcuccuccggcaccaacgcc

SEQ ID NO: 1057490 - RNA, 16 nt, Mycobacterium bovis subsp bovis AF2122/97
cccgcuccgcgccgcc

SEQ ID NO: 1057491 - RNA, 17 nt, Mycobacterium bovis subsp bovis AF2122/97
cccgcuccgcgccgccc

SEQ ID NO: 1057492 - RNA, 14 nt, Mycobacterium bovis subsp bovis AF2122/97
cccgcuccgcggcu

SEQ ID NO: 1057493 - RNA, 14 nt, Mycobacterium bovis subsp bovis AF2122/97
cccgcucgaugucg

SEQ ID NO: 1057494 - RNA, 15 nt, Mycobacterium bovis subsp bovis AF2122/97
cccgcucgcaggccg

SEQ ID NO: 1057495 - RNA, 14 nt, Mycobacterium bovis subsp bovis AF2122/97
cccgcucgcccgcc

SEQ ID NO: 1057496 - RNA, 16 nt, Mycobacterium bovis subsp bovis AF2122/97
cccgcucgcccgccgc

SEQ ID NO: 1057497 - RNA, 14 nt, Mycobacterium bovis subsp bovis AF2122/97
cccgcucggccgca

SEQ ID NO: 1057498 - RNA, 19 nt, Mycobacterium bovis subsp bovis AF2122/97
cccgcucggccgccggguc

SEQ ID NO: 1057499 - RNA, 14 nt, Mycobacterium bovis subsp bovis AF2122/97
cccgcucggcgcgc

SEQ ID NO: 1057500 - RNA, 15 nt, Mycobacterium bovis subsp bovis AF2122/97
cccgcuggcgguaag

SEQ ID NO: 1057501 - RNA, 14 nt, Mycobacterium bovis subsp bovis AF2122/97
cccgcugggucgac

SEQ ID NO: 1057502 - RNA, 22 nt, Mycobacterium bovis subsp bovis AF2122/97
cccgccaucagcccggcgcgcc

SEQ ID NO: 1057503 - RNA, 14 nt, Mycobacterium bovis subsp bovis AF2122/97
cccgccauugccgc

SEQ ID NO: 1057504 - RNA, 15 nt, Mycobacterium bovis subsp bovis AF2122/97
cccgccaugcggcgc

SEQ ID NO: 1057505 - RNA, 22 nt, Mycobacterium bovis subsp bovis AF2122/97
cccgcccaccucgaucgcgccg

SEQ ID NO: 1057506 - RNA, 16 nt, Mycobacterium bovis subsp bovis AF2122/97
cccgccauugccgccg

SEQ ID NO: 1057507 - RNA, 19 nt, Mycobacterium bovis subsp bovis AF2122/97
cccgccauugccgccgucg

SEQ ID NO: 1057508 - RNA, 12 nt, Mycobacterium bovis subsp bovis AF2122/97
cccgccagcgcc

SEQ ID NO: 1057509 - RNA, 19 nt, Mycobacterium bovis subsp bovis AF2122/97
cccgccagcgccgccgagg

SEQ ID NO: 1057510 - RNA, 19 nt, Mycobacterium bovis subsp bovis AF2122/97
cccgccagcgccgccggag

SEQ ID NO: 1057511 - RNA, 19 nt, Mycobacterium bovis subsp bovis AF2122/97
cccgccagaacggcgucga

SEQ ID NO: 1057512 - RNA, 19 nt, Mycobacterium bovis subsp bovis AF2122/97
cccgccacgaugucgucga

SEQ ID NO: 1057513 - RNA, 15 nt, Mycobacterium bovis subsp bovis AF2122/97
cccgccacgccgaag

SEQ ID NO: 1057514 - RNA, 12 nt, Mycobacterium bovis subsp bovis AF2122/97
cccgccaccccg

SEQ ID NO: 1057515 - RNA, 11 nt, Mycobacterium bovis subsp bovis AF2122/97
cccgccaccga

SEQ ID NO: 1057516 - RNA, 12 nt, Mycobacterium bovis subsp bovis AF2122/97
cccgccaccgaa

SEQ ID NO: 1057517 - RNA, 13 nt, Mycobacterium bovis subsp bovis AF2122/97
cccgccaccggcg

SEQ ID NO: 1057518 - RNA, 15 nt, Mycobacterium bovis subsp bovis AF2122/97
cccgccacaacggcg

SEQ ID NO: 1057519 - RNA, 16 nt, Mycobacterium bovis subsp bovis AF2122/97
cccgccacaacggcgg

SEQ ID NO: 1057520 - RNA, 15 nt, Mycobacterium bovis subsp bovis AF2122/97
cccgcaucgcaccag

SEQ ID NO: 1057521 - RNA, 14 nt, Mycobacterium bovis subsp bovis AF2122/97
cccgcaucgcccaa

SEQ ID NO: 1057522 - RNA, 18 nt, Mycobacterium bovis subsp bovis AF2122/97
cccgcaucgcggcaucga

SEQ ID NO: 1057523 - RNA, 22 nt, Mycobacterium bovis subsp bovis AF2122/97
cccgcaucgcggcaucgacgcg

SEQ ID NO: 1057524 - RNA, 14 nt, Mycobacterium bovis subsp bovis AF2122/97
cccgcaucggcacg

SEQ ID NO: 1057525 - RNA, 18 nt, Mycobacterium bovis subsp bovis AF2122/97
cccgcaauucgcgguccg

SEQ ID NO: 1057526 - RNA, 17 nt, Mycobacterium bovis subsp bovis AF2122/97
cccgcaugacgccggcg

SEQ ID NO: 1057527 - RNA, 18 nt, Mycobacterium bovis subsp bovis AF2122/97
cccgcaugcacgucaucg

SEQ ID NO: 1057528 - RNA, 15 nt, Mycobacterium bovis subsp bovis AF2122/97
cccgcaugccggcgc

SEQ ID NO: 1057529 - RNA, 17 nt, Mycobacterium bovis subsp bovis AF2122/97
cccgcauggacgcgaug

SEQ ID NO: 1057530 - RNA, 17 nt, Mycobacterium bovis subsp bovis AF2122/97
cccgcauggcagcggcg

SEQ ID NO: 1057531 - RNA, 17 nt, Mycobacterium bovis subsp bovis AF2122/97
cccgcauugacgaaacc

SEQ ID NO: 1057532 - RNA, 17 nt, Mycobacterium bovis subsp bovis AF2122/97
cccgcauggcgcggguc

SEQ ID NO: 1057533 - RNA, 17 nt, Mycobacterium bovis subsp bovis AF2122/97
cccgcauugccaacgcc

SEQ ID NO: 1057534 - RNA, 21 nt, Mycobacterium bovis subsp bovis AF2122/97
cccgcauugaucucgaccggc

SEQ ID NO: 1057535 - RNA, 16 nt, Mycobacterium bovis subsp bovis AF2122/97
cccgcaaugcgagcgc

SEQ ID NO: 1057536 - RNA, 19 nt, Mycobacterium bovis subsp bovis AF2122/97
cccgcagguagucgucgac

SEQ ID NO: 1057537 - RNA, 17 nt, Mycobacterium bovis subsp bovis AF2122/97
cccgcaggucggccacc

SEQ ID NO: 1057538 - RNA, 22 nt, Mycobacterium bovis subsp bovis AF2122/97
cccgcagguggcuguucaccuc

SEQ ID NO: 1057539 - RNA, 14 nt, Mycobacterium bovis subsp bovis AF2122/97
cccgcaagucgaga

SEQ ID NO: 1057540 - RNA, 15 nt, Mycobacterium bovis subsp bovis AF2122/97
cccgcaaugcgagcg

SEQ ID NO: 1057541 - RNA, 17 nt, Mycobacterium bovis subsp bovis AF2122/97
cccgcauaccguucacc

SEQ ID NO: 1057542 - RNA, 22 nt, Mycobacterium bovis subsp bovis AF2122/97
cccgcaacgccaacacgcguug

SEQ ID NO: 1057543 - RNA, 13 nt, Mycobacterium bovis subsp bovis AF2122/97
cccgcaacgccaa

SEQ ID NO: 1057544 - RNA, 23 nt, Mycobacterium bovis subsp bovis AF2122/97
cccgcaacaucgggucgcugccg

SEQ ID NO: 1057545 - RNA, 21 nt, Mycobacterium bovis subsp bovis AF2122/97
cccgauugaguucggcggcca

SEQ ID NO: 1057546 - RNA, 18 nt, Mycobacterium bovis subsp bovis AF2122/97
cccgcaaaaucgucagcg

SEQ ID NO: 1057547 - RNA, 19 nt, Mycobacterium bovis subsp bovis AF2122/97
cccgcaaaaucgucagcgc

SEQ ID NO: 1057548 - RNA, 20 nt, Mycobacterium bovis subsp bovis AF2122/97
cccgcaaaaucgucagcgcc

SEQ ID NO: 1057549 - RNA, 20 nt, Mycobacterium bovis subsp bovis AF2122/97
cccgcaaaccgguccggguc

SEQ ID NO: 1057550 - RNA, 18 nt, Mycobacterium bovis subsp bovis AF2122/97
cccgauggcgucgccggc

SEQ ID NO: 1057551 - RNA, 13 nt, Mycobacterium bovis subsp bovis AF2122/97
cccgaugcuggca

SEQ ID NO: 1057552 - RNA, 17 nt, Mycobacterium bovis subsp bovis AF2122/97
cccgauguuacggcccc

SEQ ID NO: 1057553 - RNA, 20 nt, Mycobacterium bovis subsp bovis AF2122/97
cccgaugguggugccgaccu

SEQ ID NO: 1057554 - RNA, 23 nt, Mycobacterium bovis subsp bovis AF2122/97
cccgauguaccccagcgccacca

SEQ ID NO: 1057555 - RNA, 16 nt, Mycobacterium bovis subsp bovis AF2122/97
cccgaugucgucgacg

SEQ ID NO: 1057556 - RNA, 14 nt, Mycobacterium bovis subsp bovis AF2122/97
cccgauggugccga

SEQ ID NO: 1057557 - RNA, 16 nt, Mycobacterium bovis subsp bovis AF2122/97
cccgauggugccgacc

SEQ ID NO: 1057558 - RNA, 16 nt, Mycobacterium bovis subsp bovis AF2122/97
cccgaugguggugccg

SEQ ID NO: 1057559 - RNA, 17 nt, Mycobacterium bovis subsp bovis AF2122/97
cccgaugguggugccga

SEQ ID NO: 1057560 - RNA, 14 nt, Mycobacterium bovis subsp bovis AF2122/97
cccgauagcgaccg

SEQ ID NO: 1057561 - RNA, 19 nt, Mycobacterium bovis subsp bovis AF2122/97
cccgauagcgaccgcggcc

SEQ ID NO: 1057562 - RNA, 21 nt, Mycobacterium bovis subsp bovis AF2122/97
cccgauagcgaccgcggcccc

SEQ ID NO: 1057563 - RNA, 22 nt, Mycobacterium bovis subsp bovis AF2122/97
cccgauagcgaccgcggccccg

SEQ ID NO: 1057564 - RNA, 16 nt, Mycobacterium bovis subsp bovis AF2122/97
cccgaucucugcggcg

SEQ ID NO: 1057565 - RNA, 17 nt, Mycobacterium bovis subsp bovis AF2122/97
cccgauacgccaccggc

SEQ ID NO: 1057566 - RNA, 13 nt, Mycobacterium bovis subsp bovis AF2122/97
cccgauacgggug

SEQ ID NO: 1057567 - RNA, 18 nt, Mycobacterium bovis subsp bovis AF2122/97
cccgauacuugcgcuguu

SEQ ID NO: 1057568 - RNA, 14 nt, Mycobacterium bovis subsp bovis AF2122/97
cccgaugaccgccu

SEQ ID NO: 1057569 - RNA, 22 nt, Mycobacterium bovis subsp bovis AF2122/97
cccgaugaggacauccggcgcc

SEQ ID NO: 1057570 - RNA, 15 nt, Mycobacterium bovis subsp bovis AF2122/97
cccgaugaucccgcc

SEQ ID NO: 1057571 - RNA, 20 nt, Mycobacterium bovis subsp bovis AF2122/97
cccgaugaucccgccaccga

SEQ ID NO: 1057572 - RNA, 21 nt, Mycobacterium bovis subsp bovis AF2122/97
cccgaguuaaacgcagcggug

SEQ ID NO: 1057573 - RNA, 19 nt, Mycobacterium bovis subsp bovis AF2122/97
cccgagucgugcguugccg

SEQ ID NO: 1057574 - RNA, 17 nt, Mycobacterium bovis subsp bovis AF2122/97
cccgagucugcgagcag

SEQ ID NO: 1057575 - RNA, 22 nt, Mycobacterium bovis subsp bovis AF2122/97
cccgagugaccaggguggcauc

SEQ ID NO: 1057576 - RNA, 21 nt, Mycobacterium bovis subsp bovis AF2122/97
cccgagcggcugagccgcauc

SEQ ID NO: 1057577 - RNA, 21 nt, Mycobacterium bovis subsp bovis AF2122/97
cccgaguuauagaagccgacg

SEQ ID NO: 1057578 - RNA, 18 nt, Mycobacterium bovis subsp bovis AF2122/97
cccgauaacaaggccgcc

SEQ ID NO: 1057579 - RNA, 17 nt, Mycobacterium bovis subsp bovis AF2122/97
cccgaaacaccgucugg

SEQ ID NO: 1057580 - RNA, 21 nt, Mycobacterium bovis subsp bovis AF2122/97
cccgaaaacccaacacccaga

SEQ ID NO: 1057581 - RNA, 23 nt, Mycobacterium bovis subsp bovis AF2122/97
ccccuguggacacggcgcugccc

SEQ ID NO: 1057582 - RNA, 14 nt, Mycobacterium bovis subsp bovis AF2122/97
ccccuucaaagcgg

SEQ ID NO: 1057583 - RNA, 16 nt, Mycobacterium bovis subsp bovis AF2122/97
ccccuucgccagcgcc

SEQ ID NO: 1057584 - RNA, 18 nt, Mycobacterium bovis subsp bovis AF2122/97
ccccuucaaagcggccuc

SEQ ID NO: 1057585 - RNA, 23 nt, Mycobacterium bovis subsp bovis AF2122/97
ccccuucaaagcggccucgaccu

SEQ ID NO: 1057586 - RNA, 21 nt, Mycobacterium bovis subsp bovis AF2122/97
ccccugcgcggccaccucauc

SEQ ID NO: 1057587 - RNA, 14 nt, Mycobacterium bovis subsp bovis AF2122/97
ccccuggcaccucg

SEQ ID NO: 1057588 - RNA, 15 nt, Mycobacterium bovis subsp bovis AF2122/97
ccccuggcgauuucg

SEQ ID NO: 1057589 - RNA, 11 nt, Mycobacterium bovis subsp bovis AF2122/97
ccccuggcgau

SEQ ID NO: 1057590 - RNA, 22 nt, Mycobacterium bovis subsp bovis AF2122/97
ccccugucauguccugggccgc

SEQ ID NO: 1057591 - RNA, 17 nt, Mycobacterium bovis subsp bovis AF2122/97
ccccgucgaucagcggc

SEQ ID NO: 1057592 - RNA, 15 nt, Mycobacterium bovis subsp bovis AF2122/97
ccccgucgccaccga

SEQ ID NO: 1057593 - RNA, 13 nt, Mycobacterium bovis subsp bovis AF2122/97
ccccgucgccagg

SEQ ID NO: 1057594 - RNA, 12 nt, Mycobacterium bovis subsp bovis AF2122/97
ccccgucgccga

SEQ ID NO: 1057595 - RNA, 13 nt, Mycobacterium bovis subsp bovis AF2122/97
ccccggucccgcc

SEQ ID NO: 1057596 - RNA, 12 nt, Mycobacterium bovis subsp bovis AF2122/97
ccccguugccgc

SEQ ID NO: 1057597 - RNA, 15 nt, Mycobacterium bovis subsp bovis AF2122/97
ccccguugagcagca

SEQ ID NO: 1057598 - RNA, 16 nt, Mycobacterium bovis subsp bovis AF2122/97
ccccguugagcagcac

SEQ ID NO: 1057599 - RNA, 18 nt, Mycobacterium bovis subsp bovis AF2122/97
ccccguugagcagcaccc

SEQ ID NO: 1057600 - RNA, 16 nt, Mycobacterium bovis subsp bovis AF2122/97
ccccguuccacgauca

SEQ ID NO: 1057601 - RNA, 13 nt, Mycobacterium bovis subsp bovis AF2122/97
ccccucggugcca

SEQ ID NO: 1057602 - RNA, 17 nt, Mycobacterium bovis subsp bovis AF2122/97
ccccucggugccacugc

SEQ ID NO: 1057603 - RNA, 22 nt, Mycobacterium bovis subsp bovis AF2122/97
ccccucggugccacugccggug

SEQ ID NO: 1057604 - RNA, 14 nt, Mycobacterium bovis subsp bovis AF2122/97
ccccuccgcgccga

SEQ ID NO: 1057605 - RNA, 13 nt, Mycobacterium bovis subsp bovis AF2122/97
ccccuccggccac

SEQ ID NO: 1057606 - RNA, 15 nt, Mycobacterium bovis subsp bovis AF2122/97
ccccucuagcgccuc

SEQ ID NO: 1057607 - RNA, 22 nt, Mycobacterium bovis subsp bovis AF2122/97
ccccguugccgccugucccgcc

SEQ ID NO: 1057608 - RNA, 20 nt, Mycobacterium bovis subsp bovis AF2122/97
ccccguuucggucgacaacg

SEQ ID NO: 1057609 - RNA, 16 nt, Mycobacterium bovis subsp bovis AF2122/97
ccccggggccgcaacc

SEQ ID NO: 1057610 - RNA, 16 nt, Mycobacterium bovis subsp bovis AF2122/97
ccccggggcgcucgcg

SEQ ID NO: 1057611 - RNA, 13 nt, Mycobacterium bovis subsp bovis AF2122/97
ccccggguccgcc

SEQ ID NO: 1057612 - RNA, 20 nt, Mycobacterium bovis subsp bovis AF2122/97
ccccgguagccccgucgacc

SEQ ID NO: 1057613 - RNA, 18 nt, Mycobacterium bovis subsp bovis AF2122/97
ccccgguagcguucggcg

SEQ ID NO: 1057614 - RNA, 19 nt, Mycobacterium bovis subsp bovis AF2122/97
cccauucucggccggcggc

SEQ ID NO: 1057615 - RNA, 20 nt, Mycobacterium bovis subsp bovis AF2122/97
cccauucucggccggcggcg

SEQ ID NO: 1057616 - RNA, 22 nt, Mycobacterium bovis subsp bovis AF2122/97
cccauucucggccggcggcgcc

SEQ ID NO: 1057617 - RNA, 12 nt, Mycobacterium bovis subsp bovis AF2122/97
ccccgggcgccg

SEQ ID NO: 1057618 - RNA, 14 nt, Mycobacterium bovis subsp bovis AF2122/97
ccccgguucaccuc

SEQ ID NO: 1057619 - RNA, 16 nt, Mycobacterium bovis subsp bovis AF2122/97
ccccgguuccgcgaug

SEQ ID NO: 1057620 - RNA, 14 nt, Mycobacterium bovis subsp bovis AF2122/97
ccccggugccgccc

SEQ ID NO: 1057621 - RNA, 17 nt, Mycobacterium bovis subsp bovis AF2122/97
ccccggugcccgcggug

SEQ ID NO: 1057622 - RNA, 12 nt, Mycobacterium bovis subsp bovis AF2122/97
ccccggugccgc

SEQ ID NO: 1057623 - RNA, 13 nt, Mycobacterium bovis subsp bovis AF2122/97
ccccggucgccgc

SEQ ID NO: 1057624 - RNA, 15 nt, Mycobacterium bovis subsp bovis AF2122/97
ccccgguucugcgcc

SEQ ID NO: 1057625 - RNA, 18 nt, Mycobacterium bovis subsp bovis AF2122/97
ccccguaggugcacaacc

SEQ ID NO: 1057626 - RNA, 14 nt, Mycobacterium bovis subsp bovis AF2122/97
cccauggccagcgc

SEQ ID NO: 1057627 - RNA, 12 nt, Mycobacterium bovis subsp bovis AF2122/97
cccauucggcgg

SEQ ID NO: 1057628 - RNA, 13 nt, Mycobacterium bovis subsp bovis AF2122/97
cccauucucggcc

SEQ ID NO: 1057629 - RNA, 17 nt, Mycobacterium bovis subsp bovis AF2122/97
cccaugcacggccgagc

SEQ ID NO: 1057630 - RNA, 13 nt, Mycobacterium bovis subsp bovis AF2122/97
cccaugccgaugc

SEQ ID NO: 1057631 - RNA, 13 nt, Mycobacterium bovis subsp bovis AF2122/97
cccaugccgaccg

SEQ ID NO: 1057632 - RNA, 13 nt, Mycobacterium bovis subsp bovis AF2122/97
cccaugcgccagc

SEQ ID NO: 1057633 - RNA, 18 nt, Mycobacterium bovis subsp bovis AF2122/97
cccaugcgccagcgagcg

SEQ ID NO: 1057634 - RNA, 22 nt, Mycobacterium bovis subsp bovis AF2122/97
cccaugccgaccggcacccgcg

SEQ ID NO: 1057635 - RNA, 23 nt, Mycobacterium bovis subsp bovis AF2122/97
cccaugcuucggagaccgccucg

SEQ ID NO: 1057636 - RNA, 20 nt, Mycobacterium bovis subsp bovis AF2122/97
cccgagccacaaaggcgccg

SEQ ID NO: 1057637 - RNA, 23 nt, Mycobacterium bovis subsp bovis AF2122/97
cccgagcccagcgccuccagcac

SEQ ID NO: 1057638 - RNA, 17 nt, Mycobacterium bovis subsp bovis AF2122/97
cccgagcccgucagcuc

SEQ ID NO: 1057639 - RNA, 18 nt, Mycobacterium bovis subsp bovis AF2122/97
cccgagcaacggcggcag

SEQ ID NO: 1057640 - RNA, 15 nt, Mycobacterium bovis subsp bovis AF2122/97
cccgagccggggaac

SEQ ID NO: 1057641 - RNA, 16 nt, Mycobacterium bovis subsp bovis AF2122/97
cccgagcggagccgcc

SEQ ID NO: 1057642 - RNA, 23 nt, Mycobacterium bovis subsp bovis AF2122/97
cccgagccuugagcgcggcuacg

SEQ ID NO: 1057643 - RNA, 17 nt, Mycobacterium bovis subsp bovis AF2122/97
cccgagcugccaacgcc

SEQ ID NO: 1057644 - RNA, 14 nt, Mycobacterium bovis subsp bovis AF2122/97
cccgagcucgccgc

SEQ ID NO: 1057645 - RNA, 20 nt, Mycobacterium bovis subsp bovis AF2122/97
cccgaggugccggggcccca

SEQ ID NO: 1057646 - RNA, 16 nt, Mycobacterium bovis subsp bovis AF2122/97
cccgaggcucgggccg

SEQ ID NO: 1057647 - RNA, 15 nt, Mycobacterium bovis subsp bovis AF2122/97
cccgaggcuggcauc

SEQ ID NO: 1057648 - RNA, 13 nt, Mycobacterium bovis subsp bovis AF2122/97
cccgaggcgccca

SEQ ID NO: 1057649 - RNA, 16 nt, Mycobacterium bovis subsp bovis AF2122/97
cccgaggcgcccaaca

SEQ ID NO: 1057650 - RNA, 20 nt, Mycobacterium bovis subsp bovis AF2122/97
cccgacggaguucgacgucg

SEQ ID NO: 1057651 - RNA, 24 nt, Mycobacterium bovis subsp bovis AF2122/97
cccgacucggccgugaccgagccg

SEQ ID NO: 1057652 - RNA, 22 nt, Mycobacterium bovis subsp bovis AF2122/97
cccgacuguagaaaacccguau

SEQ ID NO: 1057653 - RNA, 12 nt, Mycobacterium bovis subsp bovis AF2122/97
cccgacguucgu

SEQ ID NO: 1057654 - RNA, 18 nt, Mycobacterium bovis subsp bovis AF2122/97
cccgacggugaaccacca

SEQ ID NO: 1057655 - RNA, 20 nt, Mycobacterium bovis subsp bovis AF2122/97
cccgacgcgaagcugagcac

SEQ ID NO: 1057656 - RNA, 12 nt, Mycobacterium bovis subsp bovis AF2122/97
cccgacgcagcu

SEQ ID NO: 1057657 - RNA, 21 nt, Mycobacterium bovis subsp bovis AF2122/97
cccgacgcagcuugcccgacg

SEQ ID NO: 1057658 - RNA, 12 nt, Mycobacterium bovis subsp bovis AF2122/97
cccgacgccacg

SEQ ID NO: 1057659 - RNA, 13 nt, Mycobacterium bovis subsp bovis AF2122/97
cccgacgccacgc

SEQ ID NO: 1057660 - RNA, 15 nt, Mycobacterium bovis subsp bovis AF2122/97
cccgacgccagcugc

SEQ ID NO: 1057661 - RNA, 22 nt, Mycobacterium bovis subsp bovis AF2122/97
cccgacgaugcgggcgaucucg

SEQ ID NO: 1057662 - RNA, 14 nt, Mycobacterium bovis subsp bovis AF2122/97
cccgaccccgacgg

SEQ ID NO: 1057663 - RNA, 17 nt, Mycobacterium bovis subsp bovis AF2122/97
cccgacgaggaugucga

SEQ ID NO: 1057664 - RNA, 16 nt, Mycobacterium bovis subsp bovis AF2122/97
cccgacgaggaugucg

SEQ ID NO: 1057665 - RNA, 15 nt, Mycobacterium bovis subsp bovis AF2122/97
cccgaccgggaacca

SEQ ID NO: 1057666 - RNA, 13 nt, Mycobacterium bovis subsp bovis AF2122/97
cccgaccgccgag

SEQ ID NO: 1057667 - RNA, 14 nt, Mycobacterium bovis subsp bovis AF2122/97
cccgaccgcugguu

SEQ ID NO: 1057668 - RNA, 12 nt, Mycobacterium bovis subsp bovis AF2122/97
cccgaccgccau

SEQ ID NO: 1057669 - RNA, 11 nt, Mycobacterium bovis subsp bovis AF2122/97
cccgaccgccg

SEQ ID NO: 1057670 - RNA, 23 nt, Mycobacterium bovis subsp bovis AF2122/97
cccgacacucgauccggauucag

SEQ ID NO: 1057671 - RNA, 14 nt, Mycobacterium bovis subsp bovis AF2122/97
cccgacaacggcgg

SEQ ID NO: 1057672 - RNA, 13 nt, Mycobacterium bovis subsp bovis AF2122/97
cccgacacccgca

SEQ ID NO: 1057673 - RNA, 19 nt, Mycobacterium bovis subsp bovis AF2122/97
cccgacacccguaagcgga

SEQ ID NO: 1057674 - RNA, 14 nt, Mycobacterium bovis subsp bovis AF2122/97
cccgacaccgaucg

SEQ ID NO: 1057675 - RNA, 16 nt, Mycobacterium bovis subsp bovis AF2122/97
cccgacaccgaucgga

SEQ ID NO: 1057676 - RNA, 12 nt, Mycobacterium bovis subsp bovis AF2122/97
cccgaccagcac
